United States Patent 9,782,462 (MODIFIED POLYNUCLEOTIDES FOR THE PRODUCTION OF PROTEINS ASSOCIATED WITH HUMAN DISEASE) - sequence listing, part 118

SEQ ID NO: 229470 - DNA, 1440 bp, Artificial Sequence
  Description of Artificial Sequence: Synthetic coding sequence
atgctgtccagacttcgggtggtctccaccacatgcactctggcctgccggcacctccacatcaaggagaaggggaagcctctgatgctgaatccccgaaccaacaaaggcatggccttcactctgcaggaaagacaaatgctcgggttacagggactcctgccacccaaaatcgagacccaggatatccaggccctgagattccaccggaatctcaagaagatgactagtcctctcgagaagtatatttacattatgggcattcaggaaagaaacgagaagttgttctacaggattcttcaggacgatatcgagagtttgatgccgatcgtgtacactccaaccgttggcctggcatgttcccaatacggccacatcttccgacggcctaaaggcctgtttatttcaatctcagaccgaggacacgtgagaagcatagtcgataattggcctgagaaccacgtgaaggcagtggttgtaaccgatggggaacgcattcttggactaggcgatctgggcgtgtatggcatgggaatccctgtcggcaaactttgcctctatacagcctgcgcaggtattcgacccgatcgttgtctgcccgtgtgcattgatgtcgggactgacaatattgcgttgctcaaggacccgttctacatgggtctgtatcagaaacgagaccgaacacagcagtacgacgacctgattgacgaatttatgaaagccatcaccgatcgatatggtcgaaatacactgatccagttcgaggatttcggaaatcacaatgcattcaggtttctgcgtaagtaccgcgaaaaatactgtacttttaacgatgacatccagggcaccgccgcagtggcattagcagggctgctagcggcacagaaagtgatctctaagcccatcagcgagcacaagatcttgttcctgggagctggcgaagccgctttaggcatcgccaatctgattgttatgagcatggttgaaaatggcctgtccgaacaggaggcccagaagaaaatttggatgtttgacaagtacggactcctagtgaaaggcagaaaggcaaagatagactcctatcaggaacctttcactcacagcgcaccagaaagtatacccgatacttttgaagacgccgttaacatcctgaaacctagcacaatcatcggggtcgctggggcaggccgtctgttcacgccagatgtgatccgagctatggcatcaattaatgaaagacccgttatcttcgcactgtccaacccgaccgctcaggccgagtgcacagcagaggaagcttataccctaactgagggtagatgcctttttgctagcggctctccattcgggccagttaaactgacggacggtcgtgtgttcacaccaggacaagggaataatgtctacatttttcccggatacaggattccgatctgctag

SEQ ID NO: 229471 - DNA, 780 bp, Artificial Sequence
  Description of Artificial Sequence: Synthetic coding sequence
atggctttcacactcgaggagcggctacagcttggaattcacggcctgattcccccttgcttcctttcccaagatgtacagcttctgcgtattatgaggtattacgagaggcagcaatctgatctggataaatatataattctgatgaccctccaggatcgaaacgaaaaactcttctatcgggttctcacgtcagacgtggaaaaattcatgccgatcgtctataccccaaccgtgggccttgcttgtcaacactatggccttaccttccgtcggccaaggggtttgtttataactatccatgacaagggacacctggccacaatgctgaattcctggcccgaagacaatatcaaagccgtagtagtgaccgacggagagagaattttaggcctgggggatcttggttgctatggcatgggcattcctgtgggcaagttggctctgtataccgcatgcggcggagttaaccctcaacagtgtctgccagtgttgctagatgttggcaccaacaatgaggaactgctccgtgaccccctctatataggtttgaagcatcaacgcgtgcacggaaaggcctacgatgatcttttggacgagttcatgcaagccgtcactgacaagttcggaatcaactgtcttatccagttcgaggatttcgctaatgccaacgcttttaggctccttaacaagtatcggaacaaatactgcatgttcaatgatgacatccaggacgacttttcccggggtcccaagaggtcccagttgttctttaaatag

SEQ ID NO: 229472 - DNA, 1815 bp, Artificial Sequence
  Description of Artificial Sequence: Synthetic coding sequence
atgggcgcagcccttggcactggcacaaggctagcaccctggcctggaagggcctgtggcgctttgcccaggtggaccccaacggctccagctcaaggctgccacagtaagcctggtccagcaagacctgtgccattaaagaagcgaggctatgacgtcacccgaaatccacatctgaacaaggggatggcattcacactggaagagcggctgcaacttggaattcacggactcatccccccatgtttcctgtcccaagacgtgcaactgctgcgcatcatgagatattacgaaaggcagcagagtgatcttgacaagtacataatcctgatgacactgcaggatcgcaacgaaaagttgttctaccgggtgctcacttctgacgttgaaaaatttatgcccattgtttacacaccgaccgttggtctggcctgtcagcattacggactcacgttcagacggccacgcggactgttcattactattcacgacaaagggcacctggcgactatgttgaatagctggcccgaagacaacattaaggctgtagtggtaaccgatggcgagagaatcctaggattgggcgatctggggtgctatgggatgggcatacctgtcggcaagctcgccctatacaccgcgtgcgggggtgtgaacccccagcaatgcttaccagtgctcctcgatgtcgggactaataacgaagaattgcttagagacccattatatataggactgaagcaccaaagggtgcacggtaaggcctacgatgatttattagacgaatttatgcaggccgtcacagataaatttggtattaactgcctcatccagttcgaggattttgccaacgccaacgccttcaggctgctcaataagtatcgcaacaaatactgcatgttcaatgatgacatccagggcaccgctagcgtggcagttgccggaattctcgctgctctcagaatcacgaaaaacaagctatccaaccatgtctttgtttttcaaggcgctggggaggccgcaatggggattgctcatcttttggttatggccctggagaaagagggggtgcccaaggccgaagccactcgaaaaatttggatggtcgattcaaagggtcttatagttaaggggaggagccatcttaatcatgagaaggagatgttcgcacaagatcaccccgaggtaaactcattggaagaggtcgtcaggttggtcaaacctacagctatcattggtgtggccgctattgccggagcattcacagagcagatcctgagggacatggcgtcatttcatgagagacctattatttttgctctttctaaccccacctccaaagctgagtgtacagccgagaagtgctatagagtgaccgaggggaggggcatatttgcgtccgggtccccgttcaagtctgttacgttggaggatggcaaaacctttatccccggacaaggtaacaatgcctatgtcttccccggtgtcgccctcggagtgatcgccggtggaatcagacatattcctgatgaaatatttttgctgacggcggagcaaatcgctcaggaggtgtcagagcagcacctgagccagggacgattgtacccccctctttctactatccgggacgttagcctaaggatcgctattaaggttcttgattacgcttataaacataatctcgcttcttactatcccgaacctaaggataaggaagccttcgtgagatccctagtgtacacccccgactacgattcttttactctggactcttacacatggccaaaagaggcaatgaatgtgcagaccgtgtag

SEQ ID NO: 229473 - DNA, 1815 bp, Artificial Sequence
  Description of Artificial Sequence: Synthetic coding sequence
atgggggcagccctgggtactggtacccgcttagcaccatggccaggtcgtgcctgtggtgcacttccaaggtggactccaacagctccagcccaggggtgtcacagcaaacccggaccagccaggcctgtgcccttaaaaaaaagaggttacgatgtaacaagaaatcctcacctgaataagggaatggccttcacgctggaggagcgccttcagctgggaatccatggcctgattccaccttgcttcctgtctcaggatgtccagctgttacgcattatgagatactacgaacgccagcagtccgacctcgacaagtatataatattgatgaccctccaggacaggaacgaaaaactgttctacagggtgctgacttcagacgtcgagaaattcatgcccattgtgtataccccaacagtgggattggcttgtcagcactatggcctgacctttcgacggcctaggggactgttcattacaattcatgacaaaggtcatctcgctaccatgttgaattcatggcctgaagataatatcaaagccgtggtcgtaacagatggtgagagaattctgggacttggtgatctgggatgttacgggatgggaattcctgtgggaaagctcgcactgtacaccgcctgcggcggagtgaacccacaacagtgcttgccggttctccttgatgttggaacaaacaatgaagagctactgagagacccgctctacatcggcttgaagcatcagagggtgcacggaaaagcttacgacgacctgctggatgagtttatgcaggcagtcaccgacaagtttggcatcaattgccttatacagtttgaggatttcgccaacgctaatgcttttaggctactcaacaagtaccggaacaagtactgtatgtttaatgatgatatacaggggacagccagtgtggcagtggctggaatcctcgccgcacttagaattaccaaaaataagctctccaatcacgtgtttgtctttcagggcgcaggagaggctgccatgggcatcgcgcacctcctggtgatggccttagagaaagagggagtaccaaaagccgaggctactcgaaagatctggatggtggatagtaagggtctcattgtgaaggggaggagccacttgaatcatgagaaggaaatgttcgcccaggatcatcctgaggtgaattctttggaggaggtggtccgtcttgtcaagcccaccgccatcatcggggtggcggcaattgccggagctttcaccgaacagattctccgcgacatggccagttttcatgagcggccaattatcttcgcactgtcaaacccaacgagcaaggctgaatgtactgccgaaaagtgttaccgtgtcacggagggaaggggtatctttgctagcgggagcccttttaagagtgtgaccctggaagacggcaagactttcattcccggacaaggcaacaacgcttacgtctttcccggagtggccctgggcgtcatcgcaggaggtatccgtcatatccccgatgagatctttctgctgactgctgaacagatcgcccaagaggtgtccgaacaacacctttcccaagggagactgtaccctcccttgtcgactattagggacgtctccctgcgcatcgccataaaagtcctagactacgcatataagcacaacttggcctcttactatcctgagcctaaggacaaagaggccttcgtcaggagtcttgtgtacaccccggactacgactccttcaccttagactcatacacttggccgaaggaagccatgaacgtgcagacagtgtag

SEQ ID NO: 229474 - DNA, 1746 bp, Artificial Sequence
  Description of Artificial Sequence: Synthetic coding sequence
atgggagccgcactcggcacaggtactaggctcgcaccatggcccggaagggcctgcggagccctgccacggtggacgcccacagcgccagcccaggggtgccacagcaaaccaggcccagcaaggcctgtgcctctcaagaagaggggttatgatgtgacccgaaacccccacctgaataaaggaatggcattcaccttagaggagcgcttacaattggggattcacggtctaattcctccctgtttcctgagccaggacgtgcaattgctccggatcatgagatactatgagcggcagcagtcagatttagacaaatatattattctcatgactctccaggatcgcaacgaaaaactgttttaccgcgttctcacatctgatgttgaaaagtttatgcccatcgtgtatacccctacggtaggcctcgcatgccagcactacggcctcacattcaggcggcctcgaggcctttttattaccatccacgacaaaggccatctggcaacaatgctgaactcatggcccgaggataacattaaggcggttgtggtcactgatggcgaacgcatcctagggctcggcgacctgggttgctacggaatgggtatccctgttgggaaactggctctgtatacagcttgtggcggagtgaacccgcagcagtgcctgcccgtgcttctggacgttggaacaaataatgaggagcttctgagggatcctctctatatcggtctaaaacaccaacgggtgcatggcaaagcctatgacgacctcctggacgaatttatgcaggcagtcaccgataaattcggaatcaattgcctcatccagttcgaagattttgctaacgcgaatgcttttcgactccttaacaaatatcgtaataagtactgcatgtttaatgacgacatccaggggactgcaagcgtggctgttgccggaattctggctgccctcagaatcacgaagaataaactgtctaaccatgtcttcgtcttccaaggcgctggcgaggcagccatgggcatcgcacacctactcgtcatggcactggagaaggagggggtccctaaggccgaagcaactcggaaaatttggatggtagacagtaaaggcctcattgtaaaaggacggtcacatctcaaccatgaaaaggagatgtttgcccaggaccatcccgaagtgaactctctggaggaagttgtgcgattagtcaagccgaccgctatcatcggggtggcagctatcgccggtgcgtttactgagcagatcctgagggacatggcttcttttcacgaacgccctattatcttcgcactttcaaacccgacctctaaggccgagtgtaccgctgaaaaatgctaccgcgttaccgagggccgtggtatttttgcgtccggcagtccctttaaatctgttaccctagaggatgggaagacatttatacccggacagggaaacaatgcgtacgttttcccaggagtggccctgggagttatagccggaggaatcaggcatattcccgatgaaatctttctacttaccgcggaacagattgctcaagaagtgtctgagcaacatcttagccagggacgactttaccccccactatctactattcgcgacgtctctcttagaatcgcaatcaaagtgctggattacgcgtacaaacacaacctagccagctattatccggagcctaaagacaaagaggctttcgtgcgctcactggtttacacctag

SEQ ID NO: 229475 - DNA, 1029 bp, Artificial Sequence
  Description of Artificial Sequence: Synthetic coding sequence
atgggagccgctctggggaccgggacgcgcctggcaccgtggcccggacgggcatgcggggcactgcctcgctggaccccaaccgcacctgctcagggatgtcactccaaacccggtcccgctcgtcccgtgcctctgaaaaagcgtgggtacgatgtgactcgcaacccacatcttaataaaggcatggctttcacgttagaggagcgtctgcagctggggatccatggcctcattccgccatgcttcctttcccaagatgtgcaactgttgagaatcatgaggtattacgagagacagcagtcagacctggacaaatacataattctgatgactctccaagaccgcaacgagaaattgttctacagagtgctcactagcgacgtagagaaattcatgccaatcgtgtacactccaacggtcggcctggcttgccaacactacggactaacttttagacgacctcgcggactgttcattactattcatgacaagggccatttggcaactatgttaaatagctggcccgaagacaacatcaaggccgtcgtcgtaactgatggggaaagaattctgggactcggtgacttggggtgttacggaatgggtattccggtaggtaagctcgccctctataccgcgtgtgggggtgtgaacccacagcagtgtctaccagttctgctggacgtcggaaccaataatgaggaattgctgcgggaccccctgtatataggcctcaagcaccagcgagtccacggcaaggcctacgacgacctgctggatgaattcatgcaggctgtcaccgataagtttggaataaattgccttatccaattcgaagattttgccaacgcaaatgcatttcgactgctgaacaagtatcgcaacaagtattgcatgttcaacgacgacattcagggaacaacttgtcacactttttcatgcccctggcacctctgggcacaggtaatgttccagcatattcccggaccgatgggattcagcgaatggcttccccgtaacagttag

SEQ ID NO: 229476 - DNA, 189 bp, Artificial Sequence
  Description of Artificial Sequence: Synthetic coding sequence
atgggtgccgcacttgggactggaactcgactggctccctggcccggtcgcgcttgtggggctcttcctcgctggactcctaccgctcccgctcagggatgtcatagcaagcctggtcccgcacgcccagtgcctctgaagaagcggggttatgatgtgactaggaacccacatttgaataaggtgtag

SEQ ID NO: 229477 - DNA, 186 bp, Artificial Sequence
  Description of Artificial Sequence: Synthetic coding sequence
atgggagctgcactgggcaccggaaccagattagcgccatggccgggtagagcctgtggcgcattaccaagatggacccctaccgctccagcccagggttgccactccaagcctggtcctgccagaccagtgcctttgaagaagcgcggatatgacgttaccaggaacccccatcttaataagtag

SEQ ID NO: 229478 - DNA, 456 bp, Artificial Sequence
  Description of Artificial Sequence: Synthetic coding sequence
atgggcgcagcactgggtactgggactcggctggcgccttggcccggtagagcatgcggagcgttaccgcgttggacaccaacggcccctgcacagggttgccacagcaaaccaggaccagcccgtcccgttccccttaagaaaagaggctacgacgtgactaggaacccacaccttaataaaggcatggccttcaccctagaggaacgcctccagctcggaattcacggtctgatcccaccttgcttcttgtcacaggacgtgcaattgctgcgcatcatgcgctactatgagcgccaacagagcgacttggacaaatatattattttgatgaccttgcaggacagaaacgaaaagctgttctacagggtcctgacctcagacgtagaaaagtttatgcctatcgtgtataccccaacagtaggccttgcttgtcaacattacgggctcacctag

SEQ ID NO: 229479 - DNA, 240 bp, Artificial Sequence
  Description of Artificial Sequence: Synthetic coding sequence
atgggcgctgcactggggaccggaactcggctggctccctggccagggagagcatgtggcgctttgcctcgctggactcccacagcgccagcccaaggctgccattccaagccaggcccagcaagaccagtccccctaaagaagagaggctatgacgtcactcgtaaccctcatctgaacaaagtgatgggccaaagggccggacggccagcactcaggagcagagggtgtcggaagtag

SEQ ID NO: 229480 - DNA, 1815 bp, Artificial Sequence
  Description of Artificial Sequence: Synthetic coding sequence
atgggagccgcactcgggaccgggactcgactcgctccttggccgggacgagcgtgcggagctctccctcgctggacaccgaccgctccagctcagggctgtcatagcaagcccggaccggctcgcccagtgcctctaaaaaagcggggatatgacgtcactcggaatcctcatttgaacaaaggcatggcattcacacttgaagaacggttgcagctgggtattcacggccttattccaccctgcttcctgtcccaagacgtgcagttgctgaggataatgcgctactatgagcgtcagcaatccgatctcgacaagtatattattctgatgacactacaggacaggaacgaaaaactgttctaccgagtgctaactagcgatgtggagaagttcatgcccatcgtgtacacgcctactgttggcctggcctgtcaacactatggcctcaccttccgtcggccacgagggttatttatcactatacatgataaagggcatctcgccaccatgctcaattcctggcctgaggacaatatcaaagccgtggtcgtcacagatggtgagagaatcttgggattaggggatctagggtgttatggaatgggcattcccgttgggaagctggccctgtataccgcatgcggtggagtcaatccccagcaatgcctgcccgtactgctggacgtgggcactaataatgaagaactgttaagggatcccctgtatattggtttgaagcaccagagagtacatggtaaagcttacgatgacctgctcgacgaatttatgcaagctgtcacagataaatttggcattaattgccttatacagtttgaggatttcgcaaacgctaacgcctttcggctcttgaataaatatcgaaataagtattgcatgttcaatgacgacatccaaggcacggcatctgtcgcggtcgctggtatcttggccgcactgagaattactaagaacaagctgagtaaccacgtattcgtctttcagggagcaggagaagccgcaatgggcattgcccatttgctagtcatggccttagagaaagagggcgtgcccaaggccgaggcaaccaggaaaatatggatggtggattctaagggcctcatcgtaaagggtaggtcacacttaaatcacgaaaaggagatgtttgctcaggaccatccagaagtgaatagcctggaagaggttgtccgccttgtgaagcccactgctattatcggcgtggccgcaatcgctggagccttcacagaacaaattcttcgagatatggcaagctttcatgagcggccaataatctttgcgttgagtaacccgacgtccaaggcagagtgcactgccgaaaagtgctatcgagtgacagaagggagaggaatatttgcatctggctcgcccttcaaaagtgtcacactggaggatggaaaaacatttattccagggcagggcaataacgcctatgtgtttccgggagtcgctctgggcgtgatcgccggaggaatcagacatatacctgacgagattttcctcttaaccgcagaacagatagcccaggaggtgtcagaacagcacctctcccaaggtcggctgtatccacccctttccaccattagagatgtcagtcttagaatagcaataaaggtgctggactacgcctataagcacaatttagcttcctattatccagagcccaaagataaggaggcctttgtacgaagcctggtttacacgccagactacgattccttcacccttgacagttacacatggccgaaggaggccatgaacgtccaaactgtgtag

SEQ ID NO: 229481 - DNA, 759 bp, Artificial Sequence
  Description of Artificial Sequence: Synthetic coding sequence
atggcattcaccttggaggagagacttcaacttggcatccacggcttgattcctccatgttttcttagtcaggacgtgcaactgctgaggatcatgagatattatgaaaggcagcaatctgatctcgacaaatacattatactaatgaccctccaagatcgcaatgagaagcttttttatcgtgtgctaacaagcgacgtggaaaagttcatgcctatcgtttatacgcctactgtgggcctggcctgccagcactacggtttgacgttccgaaggccgagggggctttttattactatccacgataaaggacatctggccactatgctgaacagttggcccgaggacaatatcaaggcagttgttgtgacagacggcgaacgaatattgggtctcggggaccttgggtgttatggaatgggcattcccgtcggaaagctagcactgtacacagcttgtggtggtgtgaatccccagcaatgtctgcctgtgctcctcgatgtggggaccaataatgaggaactgctccgcgatccactctacatcggtcttaaacatcagagagttcacgggaaagcttatgatgacctcctagatgaatttatgcaggcagtcactgataagtttgggatcaactgtctgatccagtttgaagactttgcaaacgcgaatgctttccgtcttctcaataaatacaggaacaagtactgcatgtttaacgatgacattcaggcccctagtactgcccctgcaacctag

SEQ ID NO: 229482 - DNA, 1482 bp, Artificial Sequence
  Description of Artificial Sequence: Synthetic coding sequence
atgcggggatttggtcccggactgacagcaagacggttattacccctcagactgccccctcgtccgcctggcccacgtctcgctagcggtcaagcagctggcgctctggaacgggcaatggacgaactcctgcgcagagccgttcccccaacgccagcatacgagttgagggagaaaacacctgctcccgcagaaggccagtgtgctgacttcgtcagcttctacggaggccttgctgagaccgcacagcgggcagagctgctgggcaggttagccaggggcttcggggtcgatcatggccaggttgccgaacagagtgccggtgttttgcacttacgtcagcagcagagggaggccgcagtcttgctgcaggccgaagatcgcctcaggtacgcacttgtcccacgctatcgtggcctgtttcatcacatttcaaaactcgacggtggggtcagatttctcgtccagttgcgggctgacctcctggaggcacaggccctgaagctcgtggagggccctgatgtgcgggagatgaatggtgtcctgaagggcatgctctccgaatggttctccagtggttttctcaatctggaacgcgtcacctggcacagtccctgtgaggttctccagaagattagcgaggccgaagccgtacaccccgtcaaaaactggatggatatgaaaagacgagtaggtccctataggcgatgctacttcttttcccactgtagcacacccggagagccattggttgtgctacatgtggcccttacaggggatatctctagcaatatccaagcaattgtgaaagaacaccctcccagcgaaactgaagagaagaacaagatcacagcggcaattttttactcaatctctctcacccagcagggcttgcagggcgtagaactggggacctttctaattaagagagtggtgaaggaactccaaagggaattcccccacctcggcgtattcagtagcctcagcccaataccaggttttaccaaatggctgctaggcctcctgaatagccaaactaaagagcatggccgtaatgaactgttcaccgattctgaatgcaaagagatatccgagattaccggcggacctatcaacgagaccctaaagttgctcctctcgtcaagtgagtgggtacagtccgaaaagctggtccgggcacttcagacacctctcatgagactctgcgcctggtatctgtacggggaaaaacatcgcggatatgcgctaaaccctgtcgcaaattttcaccttcaaaatggcgctgttctgtggaggattaactggatggctgacgtgagtctgagaggcatcacaggatcttgtggcctgatggccaactaccgatatttccttgaggaaactggcccaaactccacctcttacctcggatcgaagatcattaaagcttctgagcaggtgctgagcctcgtggcccaatttcagaagaattctaagctgtag

SEQ ID NO: 229483 - DNA, 558 bp, Artificial Sequence
  Description of Artificial Sequence: Synthetic coding sequence
atggctagaaagaaactgaagaagtttaccactctggagatcgttctatctgtactattgctggttttgtttatcatcagcatcgtgcttatagtccttttagctaaagaaagtctcaaaagtacagccccagatccagggacgactgggaccccagatccgggaacgaccggtacgcccgaccctggcacgacggggaccactcacgcccgaacaacaggtccaccagatccaggaacaaccggaacaacccccgttagcgccgagtgtcctgtcgtgaacgagttggagcggataaactgtattcccgatcaaccacccactaaggccacgtgcgaccaacgcggatgttgttggaacccccagggagcggttagcgttccctggtgttactattccaaaaaccattcataccatgtcgagggtaatcttgtgaacaccaacgctggattcactgctcggctcaaaaacctaccttcgagtcctgtcttcggttctaatgtggataatgtgcttcttactgcagaatatcagacttccaatcgcttccacttttag

SEQ ID NO: 229484 - DNA, 4989 bp, Artificial Sequence
  Description of Artificial Sequence: Synthetic coding sequence
gctgtgtctgtcccctggtgctactactcaaagaatcattcataccatgttgaagggaacctggtgaatactaatgccggatttactgcacggctcaagaaccttccctcaagcccagtattcggcagtaatgtagacaacgtgctgctgaccgcagagtatcagacctcaaatcgatttcactttaagctgacagatcagactaataacaggtttgaggtgcctcatgaacatgtgcagtcattttcaggaaatgccgcagcgtctctgacctatcaggtggagatatctaggcagccatttagcattaaagtcacgcgaaggagcaataacagggttcttttcgacagcagcatcgggccactcctgttcgccgaccaatttctgcaactaagcactcggctgccctccacaaacgtctacgggttgggggaacatgtacaccaacagtatcgccacgacatgaactggaagacctggccaatttttaatcgggacactactcccaacgggaacgggaccaatttgtatggtgctcagacatttttcttatgcttggaggacgcgtccggactgtcctttggggtttttctgatgaactcaaatgcaatggaagtcgtgctccaaccggcaccagcgatcacatatcgcacgattggtgggatcttagatttctacgtatttcttggcaatacaccagagcaggtggtccaggagtacttggagctgataggacggccagccctgccgagctactgggctctgggtttccatctgtctcggtacgagtatggaacactcgataatatgagggaggttgtggagcgcaaccgcgctgcacagctgccgtacgacgttcagcatgccgatattgattatatggatgagaggagagatttcacttacgattctgtggacttcaaagggttcccagagttcgtgaacgagctccataataatggccagaaactggtcatcatcgtcgatcctgcaatctctaacaattccagttcgtctaagccatatggcccttacgaccggggatccgatatgaagatctgggttaacagctccgacggagtgactcctcttattggcgaagtgtggcctggacagaccgttttccctgattacaccaacccaaactgcgctgtgtggtggactaaggaattcgaactctttcacaaccaggttgaattcgacggcatttggattgacatgaacgaagtcagcaacttcgtggacggaagcgtgtctggctgttcaaccaataacttgaataaccccccatttacacccagaattctggatggctatttattttgtaaaaccctgtgtatggatgccgtccagcactgggggaaacaatacgacatccacaacctgtatggctatagcatggcagtcgctacagcagaagctgctaaaaccgtgtttcctaacaaaaggagcttcattctcacccggagcacatttgcaggcagtggaaaattcgcagcccattggctaggtgacaataccgcaacatgggatgacctgaggtggtctatcccaggggtgttggagtttaatctctttggcatcccaatggtgggacccgatatctgtggatttgcattggacacccccgaagaactctgcaggaggtggatgcagctcggagctttttaccctttctctcggaaccataacggtcaggggtacaaagatcaggatccagcctcttttggagccgacagtctcctgctgaattccagccggcactatctgaacattaggtacactcttctgccttacctctacaccctatttttccgtgcccacagtcggggagacaccgtagctcgaccactgcttcatgaattctacgaggacaactctacatgggacgttcaccagcagttcttgtggggccctggtctgctgatcacgccggtgcttgacgagggggctgagaaggttatggcctatgtgcctgatgccgtatggtatgactacgaaaccggttcacaagtgcgctggcggaaacaaaaagtggaaatggagctgccaggtgacaaaataggcctccatctccgcggtggctacatcttccctacccagcagccgaacactaccactctggcctcacgcaagaatccactgggactgataattgctctcgatgagaacaaggaggcaaaaggcgaactgttttgggacaatggcgagactaaggataccgtggccaataaagtgtatctgctgtgtgaattctccgtaacgcagaatcgtctggaggttaacatatcgcagtccacctacaaagatccaaacaatttagcattcaacgagatcaagatacttggtaccgaggaaccaagtaacgtcacagtcaagcacaacggggtcccttctcagacaagtcctacggtaacctacgattcgaacctgaaggtcgcaatcataaccgacattgaccttttactgggagaagcctataccgttgagtggtcaatcaaaatccgcgacgaggagaaaattgattgctacccagatgagaacggcgcaagtgctgaaaactgtaccgcgagaggatgcatttgggaggctagcaacagcagtggtgtgcctttctgctatttcgtgaatgacttgtactccgtgtcagatgtgcaatacaactctcatggagctactgctgatatcagcctgaagtcaagcgtgtacgctaacgcgttccctagcacgccagttaacccactgcggctggatgtgacctatcacaagaacgagatgttacagttcaagatttatgaccctaacaaaaatcggtacgaagtgcccgtcccacttaacattccgtccatgccttcgtcaacacccgaggggcagctttacgatgtgttaatcaagaaaaatccgtttggaattgagatccggagaaagtccactggcacaatcatctgggattcacaactgttagggttcacgtttagcgatatgtttatacgcatcagcacaagattaccctccaagtacttgtacgggttcggtgagactgagcatcgctcgtacaggcgcgaccttgaatggcatacctggggcatgtttagccgggatcagccacctggctataaaaagaatagctatggcgtgcatccttactacatgggtctggaggaggatggttcagctcacggcgtcctgctcctaaattcaaacgctatggatgtaacattccagcctcttccagcccttacttaccgtactaccggcggagtgctcgatttttacgtctttctcggacctacacccgaacttgtcacccagcagtataccgagctgattggtcgtcctgtcatggtcccttattggtccctgggattccaattgtgtagatatggataccagaatgacagcgagatcgcctccttgtacgacgagatggtcgccgctcagatcccttacgatgtgcagtattcggatattgattacatggaacggcagctggattttacactctcccccaaatttgcaggattccctgcactgataaaccgcatgaaggccgacgggatgcgtgtgattttgatactcgatcctgcaatctcgggaaatgagactcagccttacccagcatttacacggggtgtagaagacgatgtcttcatcaagtaccccaacgatggggatattgtgtggggcaaagtgtggccggatttcccagacgtggttgtaaatggatccctagactgggactcccaggtggaactgtatcgggcttatgtcgcttttcctgatttctttcgaaacagcaccgcgaagtggtggaaaagagaaatcgaggagttgtacaataacccgcagaatcctgagaggtctctgaaatttgacggcatgtggattgacatgaatgagccctcttcatttgttaatggggcagtgagccccggttgccgcgacgcaagcctgaatcaccccccatacatgccacatttggaatctcgagaccggggactctcctcaaagacattatgcatggagtcccagcagattcttcctgacggatccttggtgcagcattataacgtgcacaacctttacggttggagccagacacgacctacatatgaggctgtccaggaggtcacagggcagaggggggtcgtgatcacacggagtacgttcccctcttctgggcgatgggccggacactggctcggcgataatactgcggcatgggatcaactgaagaagtctataataggtatgatggagttcagtctgtttgggatttcatatacgggggctgacatctgcggtttcttccaggacgctgagtatgaaatgtgtgtgaggtggatgcagctgggcgcattctaccccttctccaggaatcataacacgatcgggactcggagacaggatcctgtttcctgggacgccgcttttgtcaacatttctcggaacgtcttgcaaacacggtacacgctactaccctatttatacaccttgatgcaaaaggcacatacagaaggcgtgactgtcgtcaggcctcttctgcatgagttcgtttccgatcaggtcacctgggacatcgacagtcagttcctcctcggtcctgctttcttggtctctcccgtgcttgagaggaacgcacgtaacgtgaccgcctattttccacgcgcaagatggtacgattattacacaggtgtggatataaacgcacgcggagaatggaagacactgcccgctcctcttgaccacatcaacttgcacgtacggggtgggtatatcctgccatggcaggagcccgctctgaacacccacctctcaagaaagaaccccctaggtctcattattgctctggacgagaacaaagaggctaagggggagctgttctgggacgatggacagacaaaagatacagtggcaaaaaaggtttatctgctgtgtgaattcagtgtgacacagcaggtggtcttcctcaatatcgtgttcaattag

SEQ ID NO: 229485 - DNA, 5573 bp, Artificial Sequence
  Description of Artificial Sequence: Synthetic coding sequence
atggctcggaaaaagttgaaaaagtttacgaccctagagattgtcttgtcggtgctgcttcttgtgctgtttatcatatcaatcgtgctcatagtgctattggcaaaggagtcactcaagtctaccgccccagatccgggtactacagggacaccagaccctggaactaccggaactcctgacccaggcacaaccggaacaacccatgctcgcacaaccggcccaccggaccctgggacaaccggcacaacaccggtatccgctgaatgccccgtggtcaatgagctggaacgcatcaattgtatccccgaccaaccaccaacaaaggccacctgcgaccaaagaggctgttgttggaacccacaaggcgcagtatctgtgccctggtgctactactcaaagaaccactcatatcacgtcgagggaaatctcgtcaatacaaacgcagggtttacagctcgccttaagaatctcccatcatctccagtgttcggctctaacgtggacaatgtgctgcttacagcggaatatcagacctccaacagatttcattttaaactgactgatcaaactaataaccgctttgaagtacctcacgagcatgtgcagagcttttccggaaatgctgccgcatccttgacctatcaggttgagatttccagacagccattctccattaaggtgaccagaaggtctaacaatagggttctgttcgacagcagcatcgggccactcctttttgcagatcagtttctgcagctttccaccaggctgccttcaacaaatgtgtacggactgggggagcacgttcatcaacaatatcgacacgacatgaattggaaaacgtggcctattttcaatcgagacactactcccaacggtaatggcaccaatctttatggcgctcagacgttcttcttgtgtttagaggacgccagcggattgagcttcggcgtgttcctgatgaactctaatgcaatggaggtcgtgcttcaacctgctccagccattacttatcgcacaattgggggtatcctggatttttatgtatttctgggcaataccccggagcaggtagtgcaggaatacctggaactgatagggagaccggctctgccttcctattgggcacttggctttcatcttagtcggtatgaatacggcacactcgacaatatgcgcgaggtggtggaacgaaatcgtgcagcccagctcccatacgatgtgcaacatgcagacatcgactatatggacgaacgaagggacttcacatacgactcagtcgatttcaaggggttccccgagttcgtgaatgaactgcacaacaacggccagaaacttgtgataatcgtggatccggcaatctctaataatagcagcagttccaaaccatacggcccatacgaccggggttctgatatgaagatttgggtaaatagctccgacggagtgacccctttaattggagaagtatggcctggtcaaacagtgttccccgattacactaatccaaattgcgcggtatggtggactaaagagtttgagctctttcacaaccaggttgagttcgacgggatttggatagatatgaatgaggtttccaacttcgtcgacggatccgttagcggatgttcaaccaacaatctgaataacccgcctttcacccccaggatcttggatggctatctgttttgtaaaacgctgtgtatggacgccgttcaacactggggcaagcaatatgatatccataacctctacgggtactctatggcagtcgccactgctgaggcagccaaaactgtcttccctaataaacggtcatttatcttgacccgatcaacattcgccggttctgggaaatttgctgcccactggctcggagacaacaccgcgacgtgggacgacttacgttggtccatcccaggagtattggagtttaatctcttcggaattcctatggtgggcccagatatttgtggatttgctctggatactccagaggagctctgcaggaggtggatgcagttgggggcattttatccgttctccaggaatcacaatggccagggttacaaggatcaagatcctgcatcatttggggcagattctttgctcctcaattcctccaggcactatctcaacatcaggtacaccttgctcccgtacctttatactctcttcttccgggcacacagtcggggagacactgtggctagaccactgctacacgaattctatgaggataatagcacctgggacgttcaccagcagtttttatggggcccaggactcctcattacacctgttctggacgaaggcgcagaaaaggtcatggcttacgtgccagatgccgtgtggtatgactatgagactggatcccaggttaggtggcgcaagcaaaaggttgagatggagctcccaggggataagattggactgcacctccggggtgggtacatcttcccaactcagcagcctaacaccaccacgctggccagcagaaagaacccactggggctcattatcgccctggatgagaataaagaggcaaaaggcgaactcttctgggacaatggtgagactaaagacacagtagccaacaaggtataccttctctgcgagtttagtgtgacccaaaacaggcttgaagtgaatatctctcagtccacatataaagatcccaacaacctggccttcaacgaaatcaagattctcgggacagaggagccctccaacgttaccgtcaagcataacggggtcccgtcccaaacatctcccaccgtgacatacgattccaatctaaaagtggccattataaccgacatcgatcttcttctcggtgaagcatatacagttgagtggagcatcaagatccgagatgaggagaaaatcgactgctaccccgacgaaaatggcgcatccgcggagaattgtacggccagggggtgtatctgggaagcctcaaattcctccggcgtgcccttctgttactttgttaatgacttgtactctgtatctgatgtgcagtacaattcccacggggctaccgccgacatcagtctcaagtcttcagtgtacgccaacgctttcccgtctaccccagttaaccccctcagactagatgtgacctaccacaaaaacgagatgctacagttcaagatctacgatcccaataagaaccggtatgaggtccccgtcccactaaacatacctagcatgccctcttccactccggaaggacagctgtacgatgtgctcattaaaaagaaccctttcggcattgagatacgacgcaagtccaccggtacaataatctgggatagccagctgctcgggttcacattttccgatatgttcatccggataagtacaaggctgcctagcaagtatttgtacggatttggagaaacggagcatcgatcatatcggcgagatctggagtggcacacttgggggatgttctcaagggatcagcctcccggatataagaaaaattcttatggcgtgcacccgtattatatggggctcgaagaagatggcagcgcccatggagtgctgctgctcaacagcaatgctatggacgtgaccttccaacctctccctgcattgacataccgcactactggaggggttctggatttttacgtcttcctaggtccgacccctgagctggtgacacagcagtacacagagctgatcgggcgacccgtcatggtgccctactggagtcttgggttccagctttgtcgctatgggtaccagaacgactccgagattgcctccctgtacgacgagatggttgctgcgcaaatcccttacgacgtgcaatattctgatatagattacatggagaggcaactagattttactctaagtcccaaattcgccggtttccccgctttaatcaatcgcatgaaggctgacggaatgagggtgatcctgattctggacccggctatctctggcaatgagacacaaccctaccctgcctttacccggggagtcgaagacgacgtgttcatcaaatatcccaatgacggggacatcgtgtgggggaaagtctggccggactttcctgacgtcgtggtgaacggctcgctggactgggactctcaagtggagctctaccgggcatacgtggcctttccggatttcttcaggaacagcaccgccaagtggtggaagcgggagatcgaggagctctacaataatcctcagaatccagagcggtccttgaagtttgatgggatgtggatcgacatgaacgagccatcctccttcgtgaatggggctgtaagcccaggatgccgcgatgcgagcctgaaccatcccccatatatgccacacttggaaagccgggaccgcggattgagcagtaagaccctctgtatggagtcgcaacagatcctccctgatggaagtcttgtgcagcactataatgtacacaatctgtacggctggtctcagaccaggcccacttacgaggccgtgcaggaggtcacaggacaacgcggtgtcgtcatcacccgctcaaccttcccaagttctggcaggtgggcgggtcactggctgggtgataacaccgctgcttgggaccaactaaaaaagtccatcatcgggatgatggagttcagtctctttggtatcagctataccggagccgacatatgcggattttttcaggacgccgaatacgaaatgtgcgtgcgctggatgcagctgggcgcattttaccccttctctagaaaccacaacaccattgggacacgacgacaagacccggtatcctgggatgttgcgtttgtcaacatatcaaggaccgtgctgcagacaaggtacaccctgttgccttatctgtataccttgatgcacaaggcccacaccgaaggtgtgacggtggtgaggcctcttcttcatgagtttgtttccgatcaggtgacttgggacatagattctcagttcctgctcggccctgctttcctggtgagtcctgtgttagaacgaaatgctcggaatgtgaccgcgtactttcctagagccagatggtatgattattacacgggtgtggatattaatgctcgaggggagtggaaaacactccctgctccgctcgaccacataaacctgcatgtgaggggtggatatatacttccatggcaggaacccgctctgaatacccatttgagtcggcagaaatttatggggttcaaaattgcactggatgatgagggcaccgcaggcggttggcttttttgggacgacggtcagtccatagatacctatggcaaggggttatactatttggcttcattctctgcgtcacagaatacgatgcagtcccatataatcttcaataactacatcacggggacaaacccgttaaaacttggttacatcgagatctggggcgtgggcagcgtgcccgttacgagcgtgtctatttccgtgtctggcatggtgatcacgccttcctttaataatgatcctaccacccaggtcctgtccatcgacgtcacagatagaaacatctccctccataattttacgtcgttaacttggatctccactcttta

SEQ ID NO: 229486 - DNA, 2061 bp, Artificial Sequence
  Description of Artificial Sequence: Synthetic coding sequence
atgttactcagaggggtcctcctggctctgcaggccctccagctggccggagcactggacctacccgctggctcctgtgccttcgaggaatccacctgcggctttgactcagtgctggcatcccttccatggatccttaatgaggaaggtcactatatctatgtggacacgtctttcggtaagcagggggagaaagcggtacttctttctcctgacctccaggcagaagaatggtcctgtctgaggctagtatatcagattactacctcatcagaatcgctctccgacccatcccagttaaacctttacatgcgctttgaagacgaatctttcgatagattattatggagcgcgaaagaaccctcagattcatggctgatcgcctccctggatctgcagaactcaagtaaaaagttcaagatcttgatagaaggcgtacttggacagggtaacactgcgtctatcgccttgtttgaaatcaagatgaccacgggatactgtatcgagtgtgacttcgaggagaatcacctttgtgggttcgtgaaccgatggaaccccaacgtcaactggtttgttggtggcggatcgattagaaatgtacactccatcctgccacaggatcacacttttaagagtgaattgggacattacatgtatgtagactcggtgtatgtcaagcactttcaggaagtagcccagttgatttcgcccctgacgactgctcctatggctgggtgcctgagcttttattaccagattcagcaggggaatgacaatgtattttcattgtacactagagacgttgctggcctgtatgaagagatttggaaggctgaccggccaggtaatgcagcctggaacttggctgaggtggagttctccgcgccatatcctatggaagtcatctttgaagtggctttcaatgggcctaaaggcggatacgtagctctcgacgacatttcctttagcccagtgcattgtcagaatcagaccgaactgcttttttccgcagtggaagcttcttgtaacttcgagcaggacctgtgcaatttctatcaagacaaggagggtcccggttggacacgggtgaaggtgaaaccaaacatgtatcgagcaggcgatcatacaacagggctgggctactacctgctggcaaacacgaagtttacttcccaacccggatacatcggtaggttgtatgggccaagcctgcctggaaacctgcagtattgtttgcggttccattatgccatctacggatttctgaaaatgagtgatactcttgcggtgtatatattcgaagagaaccacgtagtccaagaaaagatctggtcagtgctcgaatcccctagaggagtctggatgcaagctgagatcacatttaagaagcccatgccaacaaaagtagtctttatgagcctgtgtaagagcttttgggattgcgggcttgttgctctggatgatattacaatccagctaggtagttgctcatccagcgagaagctcccacctcccccaggcgagtgcactttcgaacaggatgaatgcacttttactcaggagaagcgtaatcgtagctcatggcatcggagaaggggtgagacacctacctcttacaccggcccaaagggcgaccacactacaggagtagggtactatatgtatatcgaggcatcacatatggtgtatggccagaaggctaggctgctatcccgcccacttaggggggtatcaggcaagcactgtcttaccttcttttatcacatgtacggtggaggtacaggcttactgtctgtgtacctcaaaaaagaggaggacagtgaggagagcctgctgtggaggaggcgcggagaacagtctattagttggctgagggctctcatcgaatatagctgtgagcgacagcatcaaataatcttcgaagcgatcaggggggtgtcaattagatcagacattgctatcgatgatgtaaagtttcaagccggaccatgcggcgaaatggaggacactacgcagcagagctcaggttacagtgaagatctcaacgagattgagtactag

SEQ ID NO: 229487 - DNA, 2880 bp, Artificial Sequence
  Description of Artificial Sequence: Synthetic coding sequence
atggaggttacgtgcttgctgttactcgccctgatcccctttcattgtagaggtcagggagtttacgccccagcccaggcccagatcgttcacgcaggccaggcatgcgtagtcaaggaagacaacatcagcgaaagggtgtacacaatcagggaaggggacaccctcatgctacagtgcttagtgaccggccacccccgaccccaggttagatggacgaagacagccggttcggcgtccgataagtttcaggagacctctgtgtttaacgagaccctgaggatagagcgaatcgcaagaacacagggcggtagatattactgcaaggccgaaaatggggtgggagttccagccatcaaaagcattcgggtcgatgtgcaatacctcgatgagcccatgttaacggtgcaccagacagtgtcagacgtgaggggcaatttctaccaagagaaaacggtatttttgagatgtaccgtcaatagtaatcccccagccaggttcatctggaagaggggatctgacacgctctcgcacagccaggacaatggggttgacatttacgagccgctgtacacccagggagagactaaggtcctgaaactgaaaaacctgaggccgcaggactacgcatcatacacctgccaggtctcagtgcgaaatgtgtgtgggatcccggataaggccatcacatttagacttacaaatacaaccgctccccctgccctgaaactgtcagtaaatgagacactcgtggttaatccgggagagaatgtaactgtgcagtgcctgctgaccggtggagatcctctgccccagctgcagtggtcgcacggaccgggaccgctccccttaggagcactggcgcagggaggaaccctctctatacctagtgttcaggcacgcgacagtggctactataactgtaccgcaacaaataacgttggtaatcctgctaagaagaccgtgaaccttttggtaagatctatgaagaatgcaaccttccagattacacccgatgtcattaaagagtccgaaaatatacagctcgggcaggatttgaaactgtcttgtcacgtcgacgctgttccgcaggaaaaggttacataccagtggttcaagaacggcaagcccgcaagaatgtctaagaggttgctagtgacccgcaatgatcctgagctgcccgcagttacttcctcgctggaactcatcgatctacacttttccgattatggcacatatctgtgtatggcatctttccctggggcacctgttcctgatctgtctgtggaagtcaatatctcttccgagactgttcctcccaccatcagcgtgccaaagggtagagctgtcgtaactgttcgggaaggcagcccggcagagctgcagtgtgaggttagaggcaagcccagaccccctgtcctgtggagtagggtggacaaggaggctgctctactcccatccggcttgccgcttgaggagacacccgatgggaaactcagattggagcgtgtgtcccgggacatgtctggcacatatcggtgtcaaactgcacggtacaatggctttaacgtgagacctcgggaggcccaggtgcaactgaatgtacagtccccttgcttcccacccgaagtcgagccaagcagccaggatgtgcggcaggcactcggcaggcctgtgctgcttcgctgttccctgttgaggggatccccacagaggattgcctcagccgtctggaggttcaagggccagctcctgccccctccccctgtggtcccagcagccgctgaagcccctgatcatgccgaactgagacttgacgctgtcaccagagatagtagtggatcttatgaatgcagtgtttcaaacgatgtggggtccgccgcatgcctcttccaagttagtgccaaggcctactcccccgagttttactttgatacacctaaccccacccggtcccacaagttatccaagaattacagctatgtactgcagtggacccaaagggagcctgacgcggtcgaccccgtactaaattatcgcctctccatacgacagctcaatcagcacaatgcggtggtgaaggccatccccgtgagaagggtggagaaaggccagcttttggagtacatcctcactgatctgcgggtcccccactcgtatgaggtgcgacttacaccatatacaaccttcggggctggcgatatggccagtcgcatcatccattacaccgagctgttagccctcaggactttgagctccgataatacatgccattttgaagacgaaaaaatttgcggctatactcaggacctaactgacaacttcgattggacccggcagaatgccctgactcagaatccaaagcgatcccctaatacggggccacccaccgacatctcagggacgccagaaggatactacatgtttatagagacctctcgccctcgtgaattgggcgatcgggcaagactcgtctccccactctacaatgcatccgcgaaattctactgtgtctcattcttttaccacatgtacggaaagcacattggcagcttgaatcttctggtgagatcccgcaacaagggggcacttgatactcacgcatggtccctgtcaggcaataaaggtaatgtatggcagcaggcacacgtccccattagccctagtgggccatttcagatcatttttgagggcgtgaggggacccggttatctaggggacatcgcgatcgatgacgtaaccctgaagaagggcgagtgtcctaggaagcagaccgaccctaataaggtggtggtgatgccgggaagcggcgctccgtgccagtcttctccccagctgtggggcccaatggcaatctttcttttggccttgcagagatag

SEQ ID NO: 229488 - DNA, 2868 bp, Artificial Sequence
  Description of Artificial Sequence: Synthetic coding sequence
atggaggttacgtgcttgcttttgcttgccttgataccctttcattgccggggtcagggagtctatgcccctgcacaagcccaaatcgtgcacgctgggcaggcttgtgtagtaaaagaggacaatattagtgagcgcgtctatacaattagggagggggacactctcatgctgcagtgcttagtgactggccacccaagacctcaggtgcgctggactaagaccgcgggatcagcaagtgataagttccaggagacctccgtttttaatgagacccttcggattgaaagaatcgcaagaacacaaggaggcaggtactattgcaaagctgagaatggagtgggagtgcctgccatcaagtctatcagagtagacgtgcagtacttggatgaaccaatgctgacagtgcatcagaccgtgtcggatgttcggggtaatttctatcaggagaaaacagttttcctgaggtgtactgtcaattccaacccaccagcgagattcatatggaaaaggggctccgatactttgtcccatagccaggacaatggcgtggacatttatgagcctctttacacccaaggggagaccaaagtgctaaaactgaaaaatcttagaccacaggactatgcatcatacacttgtcaggtttccgtgaggaatgtgtgtgggatccctgacaaggccattacttttcgcctaacaaatacaaccgctccaccagccctgaaactgtccgtcaatgagacactggtcgttaaccctggcgaaaacgtgactgtgcagtgtctccttaccggaggggacccgttgccacagttacagtggtcccatggcccaggccctcttcctctgggagctctcgcccagggtggaactctctccattccatcggtgcaagccagagattcaggatactacaactgcacggcaacgaacaacgtcggcaacccagcaaaaaagaccgtcaacctcttggtacgctcaatgaagaacgcaacattccagatcacaccagacgtgattaaggaaagcgaaaatatacaattaggccaggacctgaaattgtcttgtcacgtcgacgctgtgccccaggaaaaagtgacctaccagtggttcaagaatggcaagcctgcgagaatgtctaagaggctactcgtgacccgaaacgacccagaacttcccgctgtgacctccagtctcgagctcatcgacctccacttttctgactatggaacctatctgtgtatggcatccttcccaggggcaccagtacccgatttgtcagtggaggtgaacattagctctgaaacagtaccacccaccatttcagtgccaaaggggcgtgcggttgtgaccgtgcgcgaaggcagtccggcagagctgcagtgtgaagttcgcggaaagcccagaccgcctgtgctgtggagtcgcgtggataaggaagccgctttgctcccaagcggcctgcccctcgaggaaacccctgatggtaaattacggttggaacgggtcagcagagacatgagcggcacgtatcggtgtcagactgccaggtataacggctttaacgtgcgcccacgagaagcccaggttcagctaaatgtgcaatttccgccagaagtggaacctagtagccaggatgtcaggcaggcgctggggaggccggttttgctgagatgttctctgctgagagggtctccacaacggattgccagtgcggtgtggagattcaagggccagctgctgccccctccccctgtggtgccagctgccgctgaagcacccgaccacgctgagctgcgtctggatgctgtaacccgcgatagcagcgggagctacgaatgttcggtgtctaatgatgtcggctccgctgcctgcctctttcaggtctcagctaaggcctacagcccagaattttactttgacactcccaatcctacccgcagccacaagctgtctaagaactactcatacgtgctacagtggacacaacgagagcctgatgctgtggacccagttctgaactacaggctatccattcgccagctcaatcaacacaatgctgtggtgaaggccatcccagtgcggcgagtggagaaagggcaactcctggagtatatactgaccgatctgcgcgttcctcactcttatgaggttagactaacaccttacactacctttggggctggagacatggcatcccggattatacactataccgagccaattaacagtcctaacctgtctgataacacctgtcactttgaggacgagaagatttgtggatacacccaggacttaactgacaacttcgattggacacgccaaaacgcacttacccaaaatcccaaacgctcgcctaatactggtccgcctactgacatttccgggacccccgaagggtactacatgttcattgaaactagccgtccacgtgagctgggagaccgcgctcgcttggtttctcctctgtataacgcttccgccaagttctattgcgtgtctttcttctatcacatgtatggcaagcatatcggctcacttaacctcctggttaggagtagaaataagggcgctctagacacccatgcttggtcactgagcgggaacaagggaaacgtgtggcaacaggcacatgtgcccatcagtccgagtggcccattccaaattattttcgaaggagtgaggggccctgggtatcttggagacatcgccatagatgatgtcacgctgaagaaaggtgaatgccccagaaaacagaccgatccgaataaggttgtggtgatgcctggctccggagctccatgccaaagctctccacaactgtggggacccatggccatttttctgctggcactgcagcgctag

SEQ ID NO: 229489 - DNA, 2922 bp, Artificial Sequence
  Description of Artificial Sequence: Synthetic coding sequence
atggaggtgacttgtctgctcttgcttgcacttattccttttcattgccgaggccaaggtgtctatgccccagcccaggctcagatcgtacacgcaggccaagcctgtgtggtgaaggaagataacattagtgaacgtgtctacaccatcagggaaggggataccctgatgctacagtgtttggtgaccgggcacccgaggccacaggttcgctggacaaagacggctggctctgccagcgacaaatttcaagagacatccgtgtttaacgagacccttcgtatagagcgaattgccagaacacagggaggtaggtactactgtaaagccgagaatggtgttggcgtcccggcaatcaagtccattagggtcgatgtgcagtatctggacgagcccatgctgacagtccatcagactgtcagcgatgtccgagggaacttctaccaggaaaagaccgtgttcttacggtgtaccgtgaatagcaatcctcccgcacgattcatttggaagcggggttcagacacgctttcgcattctcaggacaacggggtagacatctacgagcctctctatacacaaggggaaaccaaggtcctaaaactgaaaaatttacggccacaagattatgcgagctacacttgtcaggtctcagtccggaatgtctgcggtatccccgataaggctatcacatttaggctcacaaacacaaccgctccccctgcactaaagctctcagttaatgagaccctggtggtgaaccccggtgagaacgtcaccgtccagtgtcttcttactggtggtgatccactgccacaactgcagtggtctcacgggcctggcccactgccccttggggctcttgcacaggggggaaccctatcaattccctcagtgcaagcgagagactctggctattataattgtacagcgacaaacaatgtcggaaaccctgccaagaagacagtgaacttgctggttaggagtatgaaaaatgctacgttccagatcaccccagacgtgattaaagagtctgagaacatacagcttgggcaagatctgaagttatcctgccacgtcgacgccgtacctcaggagaaggtaacataccagtggttcaagaacggcaaacccgctcggatgtctaagaggcttctggtgactagaaacgaccctgagctgccagctgttaccagttccctggagttaattgacttgcattttagtgactacggtacttacctgtgcatggctagttttcctggcgctcctgtccccgacctgtcagtagaggtgaatatatcctctgaaactgttccacctactatttcagtgcccaaagggcgagccgtggttacggtgcgggagggttctccagcagaacttcaatgtgaagtgagggggaaaccaaggcctcccgtcctttggtcaagagtggacaaggaggctgcattgctccctagtggcctgccactggaggaaacaccagatggtaaactgagactggaacgagtgtcccgcgatatgtccggaacataccgatgccagactgcaagatacaatgggtttaacgttaggcctcgcgaagcccaggtacaactcaacgtacaatttccacctgaggtcgagcccagttcccaagatgtgagacaagcgctggggagaccagttctgttgcgatgctcgctcctgagaggaagccctcagagaatcgcctccgcggtctggagatttaaggggcagctgctgcctccacctccagtggtcccagccgcagcggaggcccctgaccatgctgagcttcggctcgatgcggtcacccgggactcaagtgggagctatgaatgttcagtgtctaacgatgttgggtctgcagcctgcctctttcaggtgagtgccaaagcgtactcccctgaattctatttcgacacgccaaatcctaccaggtcccacaagctgagcaaaaattactcatacgttcttcagtggacgcaacgggaacctgatgcagtggatccagtgctaaactataggctgtctatcagacaactcaaccagcacaacgcagtcgtgaaagcgattccagtacggcgagtggagaaaggtcagttactggaatacattctaacagacctgagggtaccgcactcttacgaggtgagactgacaccctatacaaccttcggagccggagatatggcctctagaataatacattacacagaaccgattaatagccccaatcttagcgacaacacctgccatttcgaagacgagaagatttgcggatacacccaggacctgactgacaacttcgactggacccgccagaacgctctgacgcaaaacccgaaacggtcccccaacaccggccctcctaccgacatatccggtacccccgagggttattatatgttcatcgagacaagtcggccaagggagctcggagacagggcacgcctcgtgagtccactctataacgcatctgcaaaattctactgcgtttcgttcttttaccatatgtatgggaagcacataggcagcctgaatctgttggtcagatctcgtaataagggtgctttagatactcacgcctggtctctttccggcaataaaggcaatgtgtggcagcaggcacacgtccctatctcgccttccggcccattccagatcatcttcgaaggagtgagagggccaggctacctcggcgatatcgcaatcgatgacgtaactctaaagaagggcgagtgccccaggaaacagacagaccctaataagggagcaagaagggagggaggagggggagcagagtcagggggatcatgcgcctggagaggcttcctctccgtagaggggggttgccttggcttgaatcgaggaagtgaatgtctgagcgacggaaaccacgtggcacttaccgtttag

SEQ ID NO: 229490 - DNA, 2184 bp, Artificial Sequence
  Description of Artificial Sequence: Synthetic coding sequence
atggtatcctttcgtctgtccaataaaaccgcttcccccagtattaagctgttggtggacgaccctatcgtggtgaatccaggcgaggcaattacccttgtatgcgtgacaactggcggagaacccgcaccctcactcacctgggtacggagcttcggtaccttgccagaaaaaacggtgctcaatggaggtaccttaacaatccctgccatcaccagtgacgatgctggaacatattcatgcatcgccaacaataatgtgggcaatcctgcaaagaaaagcacaaatatcatagtgagggcactgaaaaagggcagattctggatcacacccgacccataccacaaggacgacaacatacaaatcgggagagaggtgaaaatcagttgccaggtagaagccgtgcctagcgaggagcttaccttttcatggttcaagaacggaaggccattgcgctcttctgagcggatggtgatcacgcagactgaccccgacgtgagcccgggaactacgaatctggacattatcgaccttaagtttacagatttcggtacatacacatgcgtggctagtcttaagggcggaggcatcagtgatatctcgatcgacgtgaatatctcatcgtctacggtaccacctaatctgaccgtgcctcaggagaaatctcccctggtgaccagggaaggagatacgatagagttgcagtgccaggtaactgggaagcccaaaccaattattctctggtctagggccgacaaagaggtggccatgcccgatggcagtatgcagatggaatcttacgatggaacactccgcattgtgaacgtgagcagggaaatgagcgggatgtatcgctgtcagactagccagtataatggcttcaatgttaaacccagggaagccctggtgcagctgattgtccaatatccacctgccgtagagccagccttcctggaaattaggcaaggccaagaccgatccgtgacaatgagttgcagagtattacgcgcttaccctattagggttttgacatacgaatggcgccttgggaacaagttactgagaactggacagtttgactctcaggagtacaccgaatacgcagttaaaagtttgagcaacgaaaattatggcgtctacaattgtagtattatcaatgaggcaggtgccggacgatgttccttcctggtaacaggaaaggcctacgcccctgagttctattacgacacttataatcccgtctggcagaatcgccatagagtgtacagttattctctccagtggacccaaatgaaccccgatgctgtggacaggatcgtggcttatcggctcggcataagacaagctggccagcagcggtggtgggagcaggaaataaaaatcaacggcaatatccagaagggcgaattaataacttataatcttactgaactgatcaagcctgaggcatatgaggtacgcctcacacccctcactaaattcggagagggagacagcacaatccgggtgattaagtacagtgcccctgtgaaccctcacctgagagaatttcactgcggatttgaagacggcaacatctgcttgtttacgcaggacgacactgataattttgattggaccaaacagagtaccgctaccagaaacactaagtacacccccaatacagggccaaacgccgatagatcgggcagtaaggagggattttacatgtacattgagaccagcaggccccgattagagggggagaaggcccgattgctgtcccccgttttcagcattgctccgaaaaacccatacggcccaaccaatacagcatattgcttcagcttcttctatcatatgtacgggcagcacattggtgttctgaatgtctatttgcggttgaaaggacagaccacaattgagaaccccctctggtcctcttccggtaataagggccagcgctggaacgaagcacacgtgaacatttatcccataacaagtttccagctgattttcgaagggatcagaggaccaggtatcgagggcgatattgcaattgacgacgtgagcattgctgagggagagtgtgctaagcaggatctggcaacaaaaaatagtgtggatggcgcagtggggatcctggttcatatctggctgtttcctatcatagtgttaatctctatactttcgccccgacgctag

SEQ ID NO: 229491 - DNA, 477 bp, Artificial Sequence
  Description of Artificial Sequence: Synthetic coding sequence
atgtacatcgagacatcccggcctcgactcgagggggaaaaagctcgccttctgtctccagtatttagcatcgcccctaagaatccttacggaccaactaacacagcctattgcttttcgtttttttaccatatgtatggccagcatatcggggtcttaaacgtgtacctgcggctcaaaggccaaactactatagaaaatcccctctggtctagctcgggcaataagggtcagaggtggaatgaagcacatgttaatatctatcctattaccagcttccagctgattttcgagggcatccgcggaccagggatcgagggcgacatagctatcgacgacgtctccatcgctgagggagaatgtgccaagcaggatcttgctactaaaaactccgtcgacggggctgtggggatcttggtgcatatatggctttttcctatcatcgttctcatatctattcttagcccacggagatag

SEQ ID NO: 229492 - DNA, 3078 bp, Artificial Sequence
  Description of Artificial Sequence: Synthetic coding sequence
atgtctgtttggagcgctgggctccttcggagtgctcgaagaagaaggcgtggccgaactgatggcaggcgatttcttctgcgacgcgctgtgccaggacacctgggtctagcgagggccagagttgagagagcatggttggctgcaggactgctgaaagttcctctgaggacaccctgggcaggctacgtgcatgtccacgttaagatggacttgttatatgggttggtgtggcttctcactgtcctcctggaggggatcagcgggcagggggtgtacgcaccacctaccgtcaggatcgttcatagtggccttgcttgtaacatcgaggaggaacggtatagcgagcgagtctataccatccgcgagggggaaaccttggagctgacatgccttgtgactgggcaccctagacctcagatacgttggacaaagactgccggatccgccagcgaccgatttcaggactcgtcagtcttcaacgagacactcagaatcaccaatatccagcggcaccagggaggcaggtattactgcaaggcggaaaacggactcgggtcccctgcgattaaaagcattagggttgacgtatattacctcgatgacccagtggtaacagtgcaccagtcgatcggcgaggcaaaggagcagttttattatgagcggacagtcttcctgagatgtgtggcaaactctaatccgcctgtgagatatagttggaggagaggccaggaggttctcttgcaggggagtgacaaaggagtggaaatttacgagccgttctttacccagggcgaaacaaaaattctgaagctgaaaaacttgagacctcaagattatgctaattattcttgtatcgcatctgtgaggaacgtgtgcaatatcccagataagatggtgtcatttcggctttcaaacaaaacagcaagcccctcaatcaagttgctggtagacgatccaattgtcgtgaaccctggtgaggctattacattagtttgcgtgaccaccgggggtgaacctgccccttcactgacgtgggtgcgaagctttggcacacttcccgaaaaaactgtcctaaatggcggtaccctcacaatccctgccataacttcagacgacgccggaacctactcttgcattgccaacaacaacgttgggaaccctgccaagaaatcaaccaacataattgtaagagccctcaagaaaggcaggttctggatcacccctgacccttatcacaaggacgacaacatacaaatcggtagagaggtgaagatatcatgccaggtagaagccgtgccttccgaggagctgacctttagctggttcaagaacggaagacccctccgatctagcgaacgtatggtaatcacccagacagatcctgacgtgtcgcctggcacaaccaaccttgacattatcgacctgaaatttacagactttgggacgtatacatgtgttgcctctctgaaaggcggaggaatctctgatatcagtatagatgtgaatattagctcctcaactgtgccacccaacctgaccgtcccacaggagaagagcccacttgtgacacgggagggcgacacaattgagctgcagtgccaagtgactgggaagccaaagcccatcattttatggtctcgtgccgacaaagaggtcgccatgccagatggctctatgcaaatggaaagttacgatggtacactgcggatagtcaatgtttcacgggagatgtccggaatgtacaggtgccagacaagtcaatacaacgggtttaatgtcaaaccaagagaggccctggtacagctgatagtacagtatcccccagctgtcgagcccgcttttctggaaattagacagggtcaggacagaagcgtgactatgtcatgccgggtgctgagagcatatcccatccgggtgttgacttatgagtggagactgggtaacaagctgctccgcacaggtcaattcgacagtcaggaatacacggaatacgccgtgaagtcgctttctaacgagaattacggcgtctataactgcagtataatcaatgaagcaggagctggcaggtgttctttcctcgtgactggaaaagcctacgctcccgagttctactacgacacttacaatcctgtctggcagaacagacaccgagtatactcatatagtctccaatggacccaaatgaatcccgatgcagttgatcgcatcgttgcataccgcctggggatccgacaggcaggtcaacagcgctggtgggaacaggaaatcaaaattaacggaaatattcagaaaggagagttgatcacctataacttgacagagctgattaagccagaagcatatgaggttaggctgacaccattaaccaagtttggggagggagacagcacgataagggtgatcaagtatagcgccccagtgaacccgcatctgcgtgaatttcattgcgggttcgaggacggaaacatctgcctgttcactcaggacgacacagataattttgattggacaaaacagtccacagccacccgtaacaccaaatatactccaaatacagggccaaacgcggatcggtcaggttcaaaggaaggattttacatgtacattgagacttcgaggccccgactggaaggggaaaaagcccgtttactgtcaccagtgttcagtatcgctccgaagaacccctatggaccgaccaacaccgcgtactgcttctccttcttttaccatatgtatggccagcacatcggtgtgctcaacgtgtatctgcggctgaagggacagaccaccatagagaacccactgtggagctcctctggtaataagggccagcgctggaacgaggctcatgttaatatctaccctatcacctccttccaactgatattcgagggtataaggggcccagggattgaaggcgacatcgctatcgacgacgtgtcaatcgccgagggtgaatgcgccaagcaggaccttgctacaaagaactctgtcgatggcgctgtcgggatcctggtccacatttggcttttcccaatcatcgtactgatttcaattctgtcccctagacggtag

SEQ ID NO: 229493 - DNA, 2184 bp, Artificial Sequence
  Description of Artificial Sequence: Synthetic coding sequence
atggtgagctttcgcctgagcaacaagactgcctctccttctatcaagcttttggttgatgaccccatcgtcgtgaacccaggagaagccattactctggtttgcgtaacaaccggaggggaacctgcgccatccctgacttgggtgcggtcatttggaacgttgccagaaaaaactgtgctgaatggaggaaccctgactatccccgctattaccagtgatgacgccggaacctatagttgtattgccaacaacaatgtcggcaatcccgcaaaaaaaagtaccaatatcattgtgcgagccctcaagaagggacgtttttggatcaccccagacccatatcacaaagacgacaatatacagatcggccgtgaagtcaagatctcatgccaagtggaagcagtcccatcagaggagctgacattcagctggtttaagaacggtcggcctctgcgtagtagcgaacgtatggtcattactcagaccgatcctgatgtcagtccaggcactaccaatctcgatataatcgacctcaagtttacagacttcggcacctatacatgtgttgcatcactaaaagggggtggcatttctgatataagtattgatgttaacatctcctcaagcaccgtgcccccaaacttgaccgtaccacaggaaaagagcccattggtgacaagggagggcgataccatagagctgcagtgccaggtgacagggaagcctaagcctatcatcctctggtcacgggcagacaaagaggttgcaatgccggatggaagcatgcagatggagtcatacgacggaactttgcgcattgtcaacgtttcacgagagatgtctggaatgtatcgatgccagacctcgcagtacaacggatttaacgtcaagcctcgcgaagctctcgtgcaactgattgtgcagtatcctcctgccgtggagcccgcatttctggagattcgccagggccaagatcgatctgtcactatgtcctgtcgggtacttagggcctacccgattagggttttgacttacgaatggaggctcgggaataagttacttcgaactgggcagtttgactcccaagagtacactgagtacgctgttaaatcattatccaacgagaactatggggtgtacaactgctcaataatcaatgaggcaggcgctggaagatgtagcttcctggtgactgggaaagcatatgcccctgagttttattacgacacttacaatccagtgtggcagaacaggcaccgagtgtactcctactcccttcagtggactcagatgaaccctgacgctgtggaccggatcgtggcctaccgccttggaatcaggcaagccggacagcagcggtggtgggagcaggaaatcaagatcaatggcaacatccagaagggggaactgattacctataatcttaccgagttgatcaaacccgaggcgtatgaggttaggctaacacctctcacaaaatttggcgaaggagattctacaatcagagtgatcaaatattccgctccagtgaacccccacttgcgagagttccactgcggcttcgaggatggaaatatttgtctgtttactcaagatgacacagacaattttgattggaccaaacaatcaaccgccacaaggaacactaagtataccccaaatactgggcctaacgctgacagatcaggaagcaaagaagggttttacatgtatatagagacttcaaggccccgtttagaaggggagaaagctcgcctcctgagtccagtgttttccatcgcaccaaagaacccatacggaccaaccaatactgcttactgtttttcatttttctatcacatgtacggccagcacatcggagtcctcaatgtctatctgagactgaaaggtcagacaaccatagaaaatccactgtggtctagctccggaaataagggtcaacggtggaatgaggctcatgtaaacatatacccaattacaagctttcagctgatttttgagggtatccggggtcccggaatcgaaggtgacatcgccatcgacgacgtgtccatcgcagagggcgaatgtgcaaagcaggatctggcaactaaaaatagtgtggatggtgcggtcggcatcttggtgcacatttggctctttcctatcatcgtgctgatctccatcctgtccccacgtaggtag

SEQ ID NO: 229494 - DNA, 2871 bp, Artificial Sequence
  Description of Artificial Sequence: Synthetic coding sequence
atggacctgctttacggcctcgtctggttattgactgtcctgctcgagggaattagcggacaaggcgtctatgccccacctacagtcagaatcgttcacagtggactagcatgtaacattgaagaagagcggtattccgaaagagtgtacaccatccgcgagggggagaccctggaactcacttgtctcgtcaccggccacccacggccacagatacgatggaccaaaacagctggaagcgcaagcgacagattccaagattcctctgtctttaatgagacactccgcataactaacattcagcggcaccagggaggcagatattattgtaaagccgagaatggattgggctcgccagccatcaagagcattcgagtagatgtctactacctcgatgacccagtcgtgaccgtgcatcagtcaatcggtgaggccaaagagcagttctattatgaacggaccgtattccttcgctgtgttgctaactcgaatcctccagtgaggtattcctggcgacgtggacaagaagtgctgctgcagggctccgataaaggcgtcgagatctacgaacctttctttacccaaggcgaaacaaaaatcctgaagctgaaaaaccttcgccctcaggattacgccaattactcctgtatcgccagcgtgcggaacgtttgtaacatccccgataaaatggtgtccttccgcctgagcaataaaaccgcttctcccagcataaagctgcttgtggatgaccctattgtggttaacccaggagaagctattactctcgtgtgtgtaacaacaggcggtgagcccgcaccaagcctgacgtgggttaggagcttcgggacgttacctgagaagaccgtgctgaatggcggaactcttacaattccagctataacgagtgatgacgctggcacatattcttgcatcgctaacaataatgtgggaaaccccgctaagaagtctacgaacataattgtccgggcactgaaaaagggccgtttctggatcactccagatccatatcacaaagatgataatatacaaattgggcgagaggtgaaaataagctgtcaggtcgaagccgttccatcggaagagttgacattctcctggttcaaaaatggtcgccctctgcgttcctcagagagaatggtgattacacagaccgatcctgacgtgtcgcctggaaccacaaacttagacatcatagatttgaagttcactgattttggtacatacacttgtgttgccagtctgaaaggtggcggaatatctgacatctcaatagatgttaatatctcatcatctacagtaccccctaacctaactgtgcctcaggagaagagccccctggttacaagggaaggggacacaattgaacttcagtgtcaagtaacaggcaagcccaaacccattattttgtggtctcgagctgacaaggaggtcgcaatgccagacggatcaatgcagatggaatcctatgatggcacgttacggatcgtgaatgtgagtagagaaatgtcaggaatgtaccgctgccagaccagccagtacaacggtttcaacgtcaaacctcgagaggcattggttcaactgatcgtacagtatcctccggctgtagaaccagcatttctagaaattcggcagggacaggatcgttccgtgacaatgagctgtcgggtgctgcgtgcatacccaatccgagtgctaacttacgaatggcgactgggcaacaaactactccgcaccggacagtttgatagtcaggaatacaccgagtatgccgttaagagcctgtcaaatgaaaattatggggtctacaactgttcgatcattaacgaagctggagctggcaggtgctcattccttgtcaccggaaaggcttacgcacccgaattttactacgatacctacaacccggtctggcagaacaggcaccgtgtgtattcatactccctacagtggactcagatgaatccagatgccgtggaccggatcgtcgcgtaccggttaggcattcgccaagctggtcagcagagatggtgggaacaagaaattaagataaatggtaacatccaaaaaggagagctgatcacctacaacctcaccgagcttataaaaccagaggcgtatgaagtcaggctgacacccctcactaaatttggcgagggcgacagcacaattcgggtcattaaatacagcgcaccagtgaacccacatctgagggaatttcactgcggtttcgaagacgggaacatctgcctgttcacgcaggacgatactgataactttgactggactaaacagtccacagcaactaggaataccaaatacactcctaacactggcccaaatgcagaccgctccgggagtaaggaaggtttctatatgtatatcgaaacctctagaccaaggcttgagggagaaaaggctcggctgctctcacctgtattctcgatagctcccaaaaatccctatggccctacaaacacagcttactgcttcagcttcttttatcatatgtacggtcagcacatcggcgttctcaacgtgtacctgagactcaaggggcagacaacaattgagaaccctctctggagttcttcaggaaataagggacagagatggaacgaggcccatgtcaatatctaccccatcaccagtttccagctcatctttgaggggattcgcggacctggcatcgaaggggacatcgctattgacgacgtctctatcgccgaaggcgaatgcgccaaacaagacttggcaaccaagaatagcgtggatggagccgtcgggatcctggtgcatatctggctgtttcctatcatcgtgttaatttctatcttgagtcctagacgctag

SEQ ID NO: 229495 - DNA, 1143 bp, Artificial Sequence
  Description of Artificial Sequence: Synthetic coding sequence
atgagatggctattgctgtactatgccttatgtttcagcctgtctaaggcgtcagcccacacagtagagttgaacaacatgttcggccagattcaatctcctggctatcctgatagttacccgtcggatagcgaggtgacttggaatatcaccgtgcccgacggatttaggatcaaactctacttcatgcattttaacctggagtcatcttacctctgcgagtacgattatgtgaaagtggaaactgaggaccaggttctggctactttctgcgggagagagaccaccgacaccgaacagacaccaggccaggaggtggtgctcagcccaggttcctttatgagcatcacttttcgatcagactttagcaatgaagaacgctttacagggtttgacgcccactacatggccgtggatgtggacgagtgtaaggagcgcgaggacgaggagctgtcttgcgaccattattgtcacaattatataggaggctactactgttcctgccgatttggatatattctgcacaccgacaacagaacttgtcgcgtagagtgttctgacaacctgttcacccaaagaacaggcgtgattactagtccagattttcctaatccctatccaaagagctcagagtgcctctacacaatcgaattagaggaaggcttcatggtgaatctgcagtttgaagacattttcgatattgaagaccaccctgaagtgccgtgtccatacgactacattaagatcaaggtaggcccaaaggtattggggcctttttgcggtgaaaaggccccagaaccaatcagcacacagagtcactcggtgcttattttgtttcatagtgataattcaggtgagaaccgcggttggcgcctgtcctaccgggcagccggtaatgagtgtcccgagttgcagcctcccgtacacggaaagattgagcccagccaagctaagtatttcttcaaagaccaggtgctggtttcctgtgataccggctacaaagtgctcaaggacaacgtggagatggacacattccagattgagtgtctcaaggacggaacatggagcaacaagatccccacctgcaagaaaaatgaaatcgacctggaatcagagctgaagtcggagcaggtgacagaatag

SEQ ID NO: 229496 - DNA, 2187 bp, Artificial Sequence
  Description of Artificial Sequence: Synthetic coding sequence
atgagatggctgcttctgtactacgccttatgttttagtctgagtaaggccagcgcacacacagtggaactaaacaacatgtttgggcagatccagtcacccggttatccagactcataccctagtgatagtgaggtaacctggaatatcaccgtcccagacggatttagaatcaagttatattttatgcacttcaatctggagagttcatacctgtgcgagtacgactatgtgaaagtggagacagaagaccaggtgcttgctacattctgtgggcgtgagacaactgatacagagcagacacctggacaggaagtggtgctgtcacctggcagctttatgtcaatcaccttcaggtctgatttttccaatgaagagagatttaccggcttcgatgcgcactatatggcagtggatgtcgatgaatgcaaagagcgtgaggatgaggaactgagctgtgatcattactgccacaactatatcggtggctattattgctcatgcaggtttggatacattctccacaccgacaacaggacttgcagggtggagtgttctgataatctgtttacccagcggactggagttatcacgtctcccgactttccaaacccctatcccaagagttctgaatgtctctatacaattgagcttgaggagggttttatggtgaacctgcagttcgaagatatttttgatatcgaggatcatcccgaggtgccatgtccttatgattacatcaaaattaaggttggccctaaggtattaggacctttctgcggagagaaagcgcctgagcccataagtactcagtcacacagcgtccttattctgtttcactccgacaattcaggcgagaacagggggtggcggctttcctatcgggctgccggaaatgagtgtcccgagctgcaacctcctgtgcacggtaagatagaaccttcccaggccaaatattttttcaaggaccaagtgctggtctcttgtgatacaggttataaggttctcaaggacaacgtagaaatggataccttccagatcgaatgcctcaaggatggcacctggtcgaataaaatacccacatgcaagatcgtcgattgtagggcaccgggtgagctggagcacggtctgataactttcagcacacggaataatctcaccacttacaaaagcgagattaaatattcgtgccaggaaccttactataaaatgcttaacaataatacaggtatctatacctgcagcgcccagggagtgtggatgaacaaagtgctgggacgcagcctgccaacttgcttaccagaatgcggccagccttctcgatctctaccctccctggtgaagcgtatcattggtggcaggaatgcggaacccggtcttttcccctggcaggctctgatcgtggttgaggatacaagtcgcgtgccgaacgacaaatggtttggtagtggcgcacttctctcagccagctggatcctcactgctgctcacgtcctgcgcagtcagaggcgcgacacaactgttatcccggttagcaaggaacatgtgactgtctacctgggactgcacgacgtgagagacaaatctggagctgtcaattcctccgctgcgagggtcgtcctgcatcccgacttcaatatccagaactacaatcatgacatagccttagtgcaacttcaggagcccgtgcctctgggtccgcatgtgatgccagtgtgcctgcccagactcgaacccgaagggccagcccctcacatgctgggactggtcgcaggttggggtatctctaacccaaatgtcactgtagatgaaattatttcaagcgggaccagaactcttagtgatgtccttcagtacgtgaaactcccagttgtgccacacgcggagtgtaaaacttcatatgaatcgcggtccggcaactatagcgtaactgaaaacatgttctgcgctgggtactacgaggggggtaaggacacctgtctgggagattcaggaggcgcttttgtgattttcgatgacctctcgcagcggtgggtggtccaagggcttgtatcctggggtggcccagaggaatgtgggtccaaacaagtgtatggcgtatacaccaaggtcagtaattacgtcgattgggtttgggagcagatgggactaccccagtctgtcgtggaacctcaagtggagagatag

SEQ ID NO: 229497 - DNA, 2100 bp, Artificial Sequence
  Description of Artificial Sequence: Synthetic coding sequence
atgagatggctcctgctatattatgccctgtgctttagcttgtcaaaagcatccgcccatacggtcgagttgaataacatgttcggtcagatccagagccctggataccccgacagctatccaagtgatagtgaagttacatggaacatcaccgtgcccgatggctttcggatcaaactctacttcatgcacttcaaccttgagagttcatatctgtgcgaatacgactatgtaaaagttgaaactgaggatcaggtgttggccactttttgtggcagagaaacaactgacaccgagcagacaccgggtcaggaagtagtgttgtctccaggatcgtttatgagcattacattccgctctgatttctcaaacgaagaacgctttacaggttttgacgctcattacatggctgtggatgttgacgaatgtaaagaaagggaagatgaggagcttagctgtgatcattactgtcacaactacattgggggatactactgtagctgcagattcggttacatcttgcatacagacaatagaacatgtcgggtagaatgtagtgacaacctattcacacagcgaacgggagtaatcactagcccagattttccaaacccgtacccaaagagtagtgagtgcctgtacactatcgagctggaggagggtttcatggttaacctgcaatttgaggatatatttgacatagaagaccaccctgaggtcccttgcccgtatgattacatcaaaattaaggtcggacctaaagtcctggggcctttttgcggagagaaagctcctgaacccatctccactcaatcccacagcgttctgatcctgtttcacagcgataactccggggagaacagagggtggaggctctcttatagggctgcgggaaacgaatgtccagaacttcagccgcctgtgcatgggaaaatagagccttcacaggccaagtacttctttaaagatcaagtgttggtcagctgcgacactggatataaagtgttgaaggacaatgtggagatggatacattccagattgaatgcttaaaagacggtacatggagcaataagatacccacatgcaaaatcgtcgactgcagagcccctggcgaattagaacatgggctgatcaccttttctacccgtaataacctgacaacatataagagtgagatcaagtactcctgtcaggagccctattataagatgctgaataacaacaccggcatttacacttgctccgcccagggggtctggatgaacaaagtattagggagaagtctgcccacatgtctacctgtgtgtggactccctaaattctccaggaagctcatggcccgtattttcaacggaaggcctgcccagaagggcacaacaccctggatcgctatgctatcccatctgaatggccagcctttttgtggcggaagcttgctcgggtcctcatggattgtcacagccgctcactgtctacaccagtctctcgacccagaagatccaactctccgcgatagcgacctgctaagtccatccgacttcaagattatcctgggcaagcactggcgtctgaggagtgacgaaaatgaacagcacttgggagtcaagcacaccacactgcacccccagtacgacccgaacactttcgagaatgatgtcgcgctggtggaactgctcgagtcccccgtccttaacgccttcgtgatgcctatttgcctgcctgaggggccacagcaggagggcgctatggttatcgtgagcggatggggtaagcagtttctgcagaggttccccgaaactctcatggagatcgagatccccattgtagaccacagcacctgtcagaaggcgtatgcccctcttaagaagaaggttacacgcgatatgatctgcgccggtgagaaagagggcggtaaagatgcctgtgcgggtgactccggaggaccaatggtgacactgaaccgcgagaggggccaatggtacttggtcggcacagtcagctggggagacgactgcggtaaaaaagatcgatatggggtctactcgtacatacatcataataaggactggatccagagggttaccggtgtacgtaattag

SEQ ID NO: 229498 - DNA, 1848 bp, Artificial Sequence
  Description of Artificial Sequence: Synthetic coding sequence
atgtcaattacgttccgatctgacttcagcaacgaggaaagattcaccgggttcgacgcccattatatggctgtggatgttgatgagtgcaaagagagagaggatgaagaattgtcttgcgatcactattgtcataactacatcgggggatactactgcagttgtcgttttggatatatccttcacacagataaccggacgtgccgggtggagtgtagcgataacctgtttacccagagaaccggcgtgataacatcccctgacttcccgaacccataccctaaaagttcagaatgtctttataccattgaactggaggagggattcatggtgaacttgcagttcgaggatatattcgacatcgaggaccatccagaggtcccgtgtccttatgactacattaaaattaaggttggcccaaaagtgctagggcctttttgcggggaaaaggcaccagaacccattagcactcagtcgcatagcgtcctgatcctctttcactcagacaatagcggcgaaaaccggggatggagattgagctacagggcagctggtaatgaatgccctgagttgcagcccccagtgcacggaaagattgagccttcccaggcgaagtacttcttcaaggaccaggtgctcgtgtcctgcgacaccgggtacaaggtgctcaaagacaacgtagaaatggatactttccagatcgagtgtctgaaagacgggacctggtcgaataagatccctacctgcaagatagttgactgtcgtgcccctggtgaattagaacacggcctgattaccttctcaactcgcaacaacctgaccacctataagtcggagatcaaatatagctgccaagagccctattataaaatgttaaataacaacactggtatatacacctgttccgcgcaaggcgtttggatgaataaggttttgggcaggtcccttcccacctgcctgccagaatgcggccagccctcccggtccttgcccagcctggttaagcgaatcatcggcggaagaaacgccgagcctggattgttcccatggcaagctttgattgtggtggaagacaccagtcgggtgcctaatgacaaatggttcgggtccggagccctgctgtcagcgagctggatcctgacagccgcacacgtccttagatctcaacgtagagacacgacagttatcccagtatccaaggagcacgttaccgtttacctaggtctccatgacgtgcgggacaaaagcggcgctgtcaatagctcagccgcaagggtcgtcctgcatccagactttaacattcagaattacaatcatgatatcgcactagtccagctgcaggaacccgtcccactggggccacacgtgatgcccgtgtgtctccctcgactggagccagaaggacctgcaccacacatgttgggccttgtggctggatggggaattagcaaccccaatgtgaccgtggacgagattatttcatccggcacgcggactttgagtgatgtattacagtatgtaaagctgccagtcgtcccacacgccgaatgcaaaacctcctacgaatcccgatctggtaactatagtgtcactgaaaatatgttttgcgctggctactacgaggggggaaaagacacatgcttgggagacagcgggggagcattcgtcatctttgacgacctgagccagcgatgggtcgttcaaggcctggtctcatggggcggtcccgaagagtgtggctcaaaacaggtgtatggggtgtatacaaaggtttcaaactacgtagattgggtttgggagcaaatgggactgccgcagagcgtggtcgaaccacaggtagaaaggtag

SEQ ID NO: 229499 - DNA, 249 bp, Artificial Sequence
  Description of Artificial Sequence: Synthetic coding sequence
atgttctgcgccggatactacgaaggcggaaaggacacttgtctaggggatagtggaggcgcatttgtgatctttgacgatctctcccagcgatgggtggttcaggggctggtctcatgggggggtcccgaagaatgtgggagcaagcaggtgtatggagtctacaccaaagtgtctaactacgtggattgggtctgggaacagatggggctccctcagtccgtcgtagaacctcaggtagagaggtag

SEQ ID NO: 229500 - DNA, 1443 bp, Artificial Sequence
  Description of Artificial Sequence: Synthetic coding sequence
atgtctatcacattccgaagtgacttcagtaacgaggagcgattcactggcttcgatgctcattacatggccgtcgacgtggacgagtgtaaggaaagggaggatgaggaattaagctgcgaccactactgccataactacatcggcggttattactgctcatgccggttcggttatatcttacacaccgacaatagaacctgccgagttgagtgttctgacaacctatttacacagcgcacaggcgtaattacaagccccgacttccccaatccatatcccaagtctagcgagtgtctatacaccatcgaacttgaagagggtttcatggttaacctgcaattcgaggacatctttgatatcgaggatcatccagaagtcccgtgtccctatgactatattaaaattaaggtgggaccaaaggtccttggaccattttgtggagagaaggcccctgagccaatcagcacacagtcccacagcgtgcttatcttatttcacagcgataacagtggcgaaaacagaggatggcggcttagttaccgggctgccggtaacgagtgcccggaactgcaacctcctgtgcacgggaaaatcgagccctctcaggcaaagtacttcttcaaagatcaagttcttgtgagctgcgataccggatacaaagtcctgaaggacaacgtggagatggacaccttccagattgagtgcctcaaggacggcacctggtccaataaaatcccaacgtgcaaaattgtcgactgtcgtgcgccaggtgaattggagcacggtctgatcactttctccaccaggaacaatctcactacatataagtccgaaatcaagtactcctgtcaggagccctattacaagatgctgaacaataacactggtatatatacatgttcagcccagggcgtgtggatgaacaaggttctgggaaggtccctgcctacatgcttgcccgagtgcggtcagccttctcgctctcttccttcccttgtgaagcgcataataggaggccgtaatgccgagccgggactgttcccttggcaggccctgatcgtcgtggaggacactagcagggtccccaatgacaagtggtttggcagtggcgctctgcttagcgcatcatggattctcacagcagctcacgtgctccgatcccagcgccgagacactacagtcattccagtttctaaagaacatgtgaccgtctatctgggtttacacgatgtcagagacaaatcaggagccgttaattccagtgctgcacgagtggtgttgcacccggactttaacatacaaaattacaatcatgacattgcactcgtgcagttgcaggagccggttccgctgggtcctcacgtgatgcccgtgtgcctccctaggctggaaccacctgggggtcggctcggccacctgcagtcccagtgcgacagttag

SEQ ID NO: 229501 - DNA, 2061 bp, Artificial Sequence
  Description of Artificial Sequence: Synthetic coding sequence
atgcgcctgctgactctcctgggtcttctctgtggctccgtggccactccattaggtcccaagtggcctgagcctgtgtttggcagacttgcctcaccgggattccccggagaatacgccaacgaccaagaacgcaggtggacgcttacggctccccctgggtatcgtcttaggttatactttactcattttgatctggagctttcacatctgtgtgagtatgatttcgtcaagctgtcgtcaggtgctaaagtcttggctactctgtgtgggcaagagtccaccgataccgaaagggctcccggaaaggataccttttactctctgggttcatccctggacatcacattcaggagcgactatagtaacgagaaacctttcactggcttcgaggccttctatgcggcagaggacattgacgaatgtcaggttgctccaggcgaggcacccacatgcgaccatcactgtcataaccacctgggaggattctactgttcatgcagagccggatatgtgctgcatcggaacaaacgcacttgttctgccctatgcagcgggcaggtttttacacagcggagcggcgaactttccagccctgagtatcccagaccatacccaaaactgtcaagttgcacctatagcatctcactggaggagggcttctcggtcatcctggattttgttgagtcttttgacgttgagacacaccctgaaaccctgtgcccttatgattttctcaaaattcagaccgacagggaagagcacggcccattctgcggcaagactctgccccacagaatagagaccaagagcaacactgttaccattactttcgtgacagacgagtctggagaccacactgggtggaaaattcactatacgtccaccgcacagccttgcccataccctatggccccaccaaacggccatgtcagccccgtgcaagcaaagtatattttgaaggattcattttcaattttttgcgaaacgggatacgaactgttgcagggtcaccttcctctgaagtccttcaccgccgtttgtcagaaagacggatcctgggacaggcctatgccagcatgttcaattgtggattgtggccctccggacgatctgccgagtggcagggttgagtatatcaccgggcctggggtgactacatataaagcggttattcagtactcgtgcgaggagaccttctacacaatgaaggtcaacgatggtaaatatgtttgcgaggcggatggattctggacaagcagcaagggcgagaagtctttaccggtctgcgagccggtctgcggcttaagtgcccgaaccaccggcggacgcatttacgggggacaaaaagcgaagccaggtgattttccctggcaggtgctaatcttgggaggaactactgccgcaggcgctctgctgtacgacaactgggtgctgaccgccgcacacgctgtgtatgagcagaagcacgacgcttccgcccttgacatccggatgggtacattaaaaaggctgtcccctcactacacccaggcttggtcagaggccgtgtttatacatgagggttacacacatgacgctggattcgacaacgacattgcgctaataaagcttaacaataaagtcgtcattaatagtaatataactcccatctgtctgcctcgcaaggaagccgagtcttttatgcgcactgacgacattggcaccgcctctgggtggggtctgacccaacgtggctttctcgcacggaacttgatgtacgtcgatatccccatcgtggatcatcagaaatgcacagcagcctacgaaaaacccccttaccccaggggctcagtgaccgccaacatgttgtgtgccggactcgagagcggtggaaaagacagctgcagaggagattctgggggtgcacttgtgttcctggattcagagacagagcgttggtttgtgggaggcattgtgagctgggggtccatgaattgtggagaagccggacagtatggcgtatacactaaagtcatcaactacatcccctggatcgaaaatataatttcagatttttag

SEQ ID NO: 229502 - DNA, 558 bp, Artificial Sequence
  Description of Artificial Sequence: Synthetic coding sequence
atgcggcttctcacactgctgggtcttctgtgtggtagtgtcgcgacgccactggggcctaaatggccagagcccgtattcggtcgcctggcgtctcctggttttcccggagagtatgccaatgaccaggaacggagatggactctgaccgctccacccggttatcgactcaggctgtacttcacccacttcgacctagagctcagccacctgtgtgaatacgactttgttaaacttagctctggcgcaaaagtactggctaccttgtgtgggcaggaatccacagacaccgagagggcacctggcaaggatacattttactcactgggcagcagtcttgacatcactttcaggtcagattactcgaacgagaaaccattcaccggtttcgaggctttctatgcagctgaggacatcgacgagtgccaggttgcacccggagaagcacctacttgcgatcatcattgccataatcatctcggcggtttctactgttcttgtagagcaggatacgtactgcatcgcaacaaacggacttgcagtgagcagtctttatag

SEQ ID NO: 229503 - DNA, 1089 bp, Artificial Sequence
  Description of Artificial Sequence: Synthetic coding sequence
atggccgcaccaagggtgtttcccctgtcatgcgctgttcaacaatatgcctggggaaagatgggtagcaacagtgaggtggctcgtcttttagccagctccgatccactcgcccaaatcgccgaggataagccttatgctgagttgtggatggggacccacccacgcggagatgcgaagatcctggacaacaggattagtcaaaagactctgtcacaatggatcgcggaaaaccaagactcgctgggctctaaagtaaaggacacctttaacgggaacttgccgtttctctttaaagtacttagcgtggagacaccgttaagcattcaggcacacccaaataaagagctagctgaaaagctccatctacaagcccctcagcactacccggatgctaaccacaagcctgagatggcaattgccctgaccccctttcaaggactatgcggcttccggccagttgaggagatcgtaacttttttgaaaactgccgcaggcaacaacatggaggacatatttggggagctcttgctgcagttacatcagcagtaccctggtgacattggctgcttcgctatctatttcttgaacctcctaacactgaagcccggagaggccatgttcctggaggccaatgtgcctcatgcttatctgaaaggagactgcgtcgagtgcatggcatgcagcgacaacacagtgcgagccggattaaccccaaagttcatcgatgtgccgactttgtgtgaaatgctcagctacactccgagcagcagtaaggaccgtctctttctgcctactcgttcccaagaagacccatacctctctatttacgaccccccagtcccagacttcaccataatgaaaactgaggtgccagggtctgtgactgagtataaggtgttagccctcgactctgcctcaattctgctgatggtacaggggactgtcatagcatccaccccaacgactcaaactcccattcccctgcagcggggtggggttttgtttatcggagctaatgagtccgtgagtctgaaactgactgagcctaaggatctattaatcttccgggcatgttgcctgctgtag

SEQ ID NO: 229504 - DNA, 1272 bp, Artificial Sequence
  Description of Artificial Sequence: Synthetic coding sequence
atggccgcaccaagggtatttcctttgtcatgcgccgttcaacaatacgcttggggaaagatgggttcaaactcagaagtggcaagactgttggcctcttcagatccactggcccagatcgccgaggataaaccctatgcagaattgtggatgggcacacacccacgcggtgatgccaagatcctcgacaataggatctctcagaagactctcagtcagtggattgccgaaaatcaggattcgctggggagcaaagtgaaggatactttcaatgggaatctgccttttctgttcaaggtgttgtcggtggaaacccccctctccatccaggcccaccccaacaaggagctcgcagaaaagctgcacctgcaagcccctcagcactacccagacgccaaccataaacctgagatggcaattgcgctcacaccctttcagggtttgtgcgggtttaggccagtcgaggaaatcgtcacattcctgaagaaggtacctgaatttcaattcctgattggggacgaagctgcgacacacctgaaacagactatgagtcacgactcccaggctgtcgctagcagcttgcaaagctgcttctcccacctaatgaagagtgagaaaaaggtggttgtggagcagctcaatttgctagtaaaacgcatatcccagcaagctgcggcaggaaacaatatggaagacatatttggagaactgttattgcagctacaccagcagtaccctggggatataggctgcttcgccatctacttccttaacctcctgacactcaagcctggggaggcaatgtttctggaggcgaacgtcccccatgcctatctcaagggcgactgcgtggagtgtatggcctgcagcgacaataccgtacgcgcagggctgacaccaaaattcatcgatgtccctacactctgtgagatgttaagttacactccttctagcagtaaggacagactcttcctccccaccagatcccaggaagatccatacctcagtatttatgatcctccagtccccgacttcactatcatgaaaaccgaagtccctgggagcgtcaccgagtacaaggttctggcactcgacagcgcttctattctcctgatggtccaaggtacagttatagctagtaccccaaccacccagacccccatcccattacagcgcggtggtgtgctttttattggcgctaatgaaagtgtctctctcaagctaactgagccaaaagaccttctaattttcagggcatgttgcctcctgtag

SEQ ID NO: 229505 - DNA, 804 bp, Artificial Sequence
  Description of Artificial Sequence: Synthetic coding sequence
atggggtctaactcagaagttgctcgccttctcgccagttccgaccctctggcccagatcgctgaggacaaaccatacgctgaactctggatgggtacccaccccagaggtgacgctaaaatcctggataatcgaatcagccaaaaaacactgtctcagtggattgcggagaatcaggattccctaggttcgaaggtgaaagacaccttcaatggcaaccttccgttcctgtttaaggtgctgtcggtggaaacgcctctaagcatacaagctcaccccaataaggagttggccgaaaagctgcatctccaggctcctcagcactaccctgacgccaaccacaagccagagatggctatcgccttgactccgttccaagggctctgcgggtttaggcccgtggaagagatcgtgacttttctcaagaaggtgccggagtttcagtttctgattggcgacgaggctgcaacacaccttaaacagacaatgagccacgactctcaggccgtggccagttcgcttcagtcttgcttctctcacctaatgaagagcgagaagaaagttgtggttgagcaactcaatctgctggtgaagcggattagtcaacaggccgcagccggaaataacatggaggacatttttggtgaactcttgttgcagcttcatcaacaatacccaggagatataggatgctttgcaatttattttttaaatctgctcactctgaagccgggagaggcaatgttcctcgaagcaaatgtgccacatgcctacctcaagggcggtccctggctttgccactag

SEQ ID NO: 229506 - DNA, 1122 bp, Artificial Sequence
  Description of Artificial Sequence: Synthetic coding sequence
atgggcacacatccacgcggtgatgccaagatcctggataaccgtattagccagaagactctgtcacagtggattgcagaaaaccaagattccttgggcagcaaggtcaaagacacatttaatggtaaccttccctttttattcaaggtcctgagtgtggagacccccttgagcatacaggcccacccgaacaaggagttggctgagaagcttcacctgcaagctccccaacattatcctgatgccaaccacaagcctgaaatggccatcgccctgactccttttcaagggttgtgtggatttcggccagttgaggagatcgtaacattcctcaagaaagtgccggaatttcagtttcttatcggcgatgaggcagccacgcaccttaaacaaaccatgtctcatgacagccaggccgttgcctcatccctgcagtcttgcttcagccacttaatgaagtcagagaaaaaggtggtcgtcgaacagcttaaccttctggttaaaaggatctctcagcaagccgctgcaggcaacaatatggaagatattttcggcgagctgctgcttcaacttcatcaacaataccctggagacatcggttgttttgccatctatttcctcaacctcctcactttgaaacccggagaggccatgttcctcgaagcaaatgttcctcacgcctatcttaaaggagactgtgtggaatgcatggcctgttctgacaatactgttagggccggtttgacccctaaatttatagacgtccccacactctgtgagatgttgtcttacactccaagcagctcgaaggatcgcttgtttctcccaacaaggtctcaggaagatccgtatctgtcgatttacgacccacctgtgcccgattttaccattatgaagacagaggtcccaggttctgtcaccgagtataaggttctggccctcgatagcgcgagcatcttgctcatggttcaggggacagtgatcgcctctacccccacaacgcagaccccaattccattgcagcggggtggtgttctgttcatcggggctaatgagtccgtgagcctcaaactgaccgagcccaaggatctcttaatcttcagggcatgttgtctgctatag

SEQ ID NO: 229507 - DNA, 4371 bp, Artificial Sequence
  Description of Artificial Sequence: Synthetic coding sequence
atgcgtctgcctctgctgctggtttttgctagcgttatcccaggcgctgttcttctgttagacacccggcagtttctaatttacaacgaagaccataaaagatgtgtggacgccgtgagtccctccgccgtacaaacagccgcatgtaaccaggacgccgaatcacaaaaattcaggtgggtttcggagtcacagattatgtccgtggccttcaagctgtgccttggcgtgccatcaaaaactgactgggtggcaattacactgtatgcctgcgattccaagtcagagttccaaaaatgggaatgtaaaaatgacactctgctgggcattaaaggagaggatctctttttcaactatggcaacagacaagagaaaaacatcatgttgtataagggctcaggcctgtggtcccgttggaagatctacgggactaccgataacttatgcagtcggggatacgaagcaatgtacactctgctgggtaacgcaaacggagccacctgcgcatttccttttaagttcgaaaacaagtggtatgcggactgtacatcggcaggaaggtctgacggctggctgtggtgcggtaccactacagattacgatactgataagctgttcggatattgccctctcaaatttgaaggctcggagtcactgtggaataaagaccccttaactagcgtgtcttatcagatcaatagcaagtctgctctgacctggcaccaggcccgaaaatcttgtcaacaacagaacgctgagttactctccataaccgagattcatgaacagacctacttaacgggcctgactagtagtctgaccagcggcctctggattggcctgaactctctgagttttaactctggctggcaatggtctgatcggtcccccttccgttatctcaactggttgccaggcagcccgtctgccgagccagggaagtcttgtgtgtctttgaaccctggcaaaaacgccaaatgggagaaccttgagtgcgtccagaagctgggctacatttgtaagaaaggcaatacgaccctcaattccttcgtgattccctctgaatctgatgtcccaactcattgccctagccagtggtggccgtacgccggacactgctataaaattcacagggatgagaaaaaaatccaacgtgacgcactgacaacatgtagaaaagaaggaggcgatctgacatcaatacatactatcgaggaactggattttattatctcacagcttggctacgagcctaatgatgaactgtggatcggacttaatgacattaagatccagatgtatttcgaatggagcgatggcacaccagtaacctttacaaaatggctgcgcggtgaacccagccatgagaataatcgccaagaggactgcgtggtgatgaaaggaaaggatggatactgggccgatcggggttgcgagtggccattgggctacatttgcaagatgaagagccgaagtcaaggacctgagattgtggaggtagaaaaggggtgcagaaaaggatggaagaaacaccatttttattgttacatgattggccacaccctaagtacattcgctgaggctaaccaaacctgcaacaatgagaacgcctacctgacgactatcgaggacagatacgaacaggccttcttgacttcgtttgtgggactgaggccagagaagtatttttggacgggactgagcgatattcagactaaaggcaccttccagtggaccatcgaagaggaggtcaggtttacccactggaacagcgacatgcccggacgaaagcctggctgcgtcgccatgcgtaccggcatcgctggagggctctgggacgttcttaagtgtgatgaaaaggccaaatttgtgtgtaagcattgggctgaaggagttacccacccgccaaaacccacgaccacacccgagccaaagtgccccgaggattggggcgcatcatcccgtacgagcctgtgtttcaagctgtatgccaaaggcaagcacgaaaagaaaacctggtttgagtccagagacttttgtcgggctctgggcggagatctggcctctatcaataacaaagaagagcagcagactatctggaggctgattacggcgtcaggatcataccacaagctgttctggctgggattgacatacggttccccctctgagggattcacgtggtccgacggctcccccgtttcctatgaaaactgggcatacggagaacccaataattatcagaatgtcgagtattgtggggagctcaaaggagacccaaccatgagctggaatgacattaattgtgaacatctgaacaattggatatgtcagatccagaaaggccagacaccgaaacccgagcctacccctgccccacaagataatccccctgtgacagaggacggctgggtgatctataaggattaccaatactacttctccaaagaaaaggaaacaatggacaacgccagagccttctgcaagcggaactttggggacctggtgagcatccagagcgagagcgaaaagaagtttctttggaaatacgtcaataggaacgacgcacagagcgcttacttcatcggcctcctcatcagtttggacaagaagttcgcctggatggacggttccaaggtcgactatgttagctgggcgacgggggaaccaaattttgccaacgaggacgagaattgtgttactatgtacagtaactcagggttctggaacgatatcaattgtggttatccaaacgcattcatatgccagcgtcataatagttcaattaatgcaaccacggttatgcctacaatgccatctgtgccgagcggatgtaaagaagggtggaatttttattccaacaaatgttttaagatttttggattcatggaggaggagcgcaagaactggcaggaggcccgtaaagcttgcatcggatttgggggaaatcttgtgagcatccagaatgagaaagagcaggcgttcctgacgtaccacatgaaggattctacattcagcgcatggacaggattaaatgacgtcaacagtgaacacactttcctgtggacagatggaagaggtgtgcactataccaactggggtaaaggttaccctggtggaaggagatcaagtctgtcttacgaggacgcggattgcgtggtcattattgggggtgcaagcaatgaagccggtaaatggatggatgatacttgtgacagtaaacgtgggtacatatgccaaactcggtcagacccatcgctgaccaaccctccagctaccattcagaccgacggtttcgtcaagtacggcaaatccagttattccctgatgcgccaaaaattccagtggcatgaggccgagacatactgcaagttgcataattctctgattgcctctattttggatccttacagtaacgcctttgcctggctccaaatggaaaccagcaatgaacgggtttggattgctctgaattcaaaccttaccgataatcagtacacctggacagacaaatggcgtgttaggtacaccaactgggcggctgatgagcccaagttgaaatctgcctgtgtttatctggacctagatggatactggaagactgcgcattgtaacgagtcattttacttcttatgcaaacgctcagatgaaatccccgcaactgaaccgccacagctcccgggaaggtgcccggagagcgaccacaccgcctggattccctttcacggacactgttactatatcgagagctcttatactcgaaactggggccaagcctctttagagtgcttgcggatgggctcttcactcgtgtccatagagagtgctgccgagtcttccttcctatcttatcgcgtggaacccctgaagtccaagacgaatttttggatcgggctgttccgcaacgtggaggggacctggctgtggatcaacaattctcctgtgagcttcgtgaactggaatacaggggatccatcgggggagcgaaatgattgcgtggcgctgcatgcatccagtgggttctggagcaacatccactgctctagctacaagggttatatctgcaaaagacctaagatcatagacgctaagcccacccacgaacttctgacaacaaaagccgacaccaggaagatggatccatccaagcccagctcaaatgtagctggggtggttatcatcgtaatcttgttgatcttaacgggcgctgggttagcagcctacttcttctacaagaaaagacgggtccacctgccacaggaaggcgcattcgaaaacacactgtattttaactctcagtcttcccctggaacctccgatatgaaagacttggttggtaacatcgagcagaatgaacacagtgtgatctag

SEQ ID NO: 229508 - DNA, 4440 bp, Artificial Sequence
  Description of Artificial Sequence: Synthetic coding sequence
atgggtccaggtcggcctgctcctgcgccatggccacgccacctgctcagatgcgtcttgctcctgggctgcctgcatctgggtagaccaggcgcacccggagacgcagcattgcctgaacctaacgtttttctaattttttctcacggattgcaggggtgcctcgaagctcaaggcggacaagtgagggtaaccccagcctgcaacactagtttgcctgctcagcggtggaaatgggtctcaaggaatagattatttaacctgggcaccatgcagtgtctaggtaccggctggcccggaaccaatactaccgcgtccctcggcatgtacgaatgtgacagagaagcgctgaacttgaggtggcactgccggactcttggggaccagctgtcattactgctgggggctaggacttctaatatctccaagcctggtacattagagcgaggcgatcagacaaggagcggacagtggagaatttatgggagcgaagaagatctctgcgcactcccttaccatgaggtgtacaccattcagggcaactctcacggaaagccgtgcacaatcccctttaagtatgataatcaatggttccacggctgcacgagtaccgggagggaagatgggcacctctggtgcgcaaccacccaggactatggcaaggacgagaggtggggattctgtcctataaagagtaacgactgtgagaccttttgggacaaagaccaacttaccgatagctgctaccagttcaactttcagtctaccctcagttggagggaagcatgggccagttgtgaacagcagggagctgaccttctgagtatcaccgaaatacacgaacagacctacataaatggcttgttaactggctactccagtacgctgtggataggattaaacgacctggatacatccggtggctggcagtggtcggacaattctcctttgaaatacctgaattgggaatcggatcagcccgataatccatcagaggaaaactgtggcgtgattcgcactgagtcttctgggggatggcagaatagggattgttccattgctttgccctacgtttgcaagaagaagccaaacgcgacagccgagcctacgccacccgaccgatgggcaaatgtcaaggtggagtgcgaaccatcttggcagccttttcagggccactgctaccggctccaggcagagaagaggagctggcaagagagcaagaaagcctgtttgaggggtggcggagacctcgtttcgatccacagcatggcagagctggagttcattacaaaacaaattaagcaggaggtggaggagctttggatcggcctgaacgacctcaagctccaaatgaacttcgagtggtcagatggttctctcgtatcctttacacactggcatcctttcgaacctaataacttcagagattcgcttgaggactgtgtaacaatctggggacccgaagggcgatggaacgattccccctgtaaccagtcgctccccagcatctgcaagaaagcgggacaactgtctcagggagcagctgaagaagaccatgggtgccggaagggctggacgtggcacagccccagttgctattggctgggggaagatcaggtgacatattccgaagctcgcagactctgtaccgaccacggatcgcagctggtgaccattaccaatcgatttgagcaagcattcgtaagctcactgatctataattgggagggcgagtatttctggactgccctgcaggacttaaatagcaccggctcattcttctggctttctggtgatgaggttatgtacactcactggaacagggatcagccagggtattcacggggaggctgcgtagccctcgctacaggatccgcgatggggctttgggaggtaaaaaactgtacttcattccgcgctcggtacatctgtaggcagtctctcgggacccctgtgacccccgagcttcctggacctgaccctactccatcgcttaccggaagctgccctcagggctgggccagtgatacgaagctacgttactgttacaaggttttctctagtgaacgtctccaggacaaaaagtcttgggtgcaggcacaaggtgcttgtcaagaattgggagcgcaactgctgtctctcgcttcgtacgaggaggagcactttgtggctaatatgctgaataaaatcttcggagaatccgagcctgaaatccatgaacaacattggttctggattggcttgaatagacgagaccctcgcggaggccaaagttggcgctggtcggacggcgtgggcttctcctatcataacttcgatagatcacgacatgacgacgatgatatccgcggatgcgccgtgttggacttagccagcctccagtgggtggccatgcagtgcgatacgcagctggactggatctgcaagatcccaaggggaactgatgtacgagagcctgatgattcacctcagggtaggagggaatggttacgttttcaggaggccgagtacaagttctttgaacaccacagtacctgggctcaggcccagcgcatctgcacttggtttcaggcggaattgactagcgtgcattcccaagctgagttggattttctctctcacaacctacagaaattctcccgggctcaggaacagcattggtggattggtcttcacaccagcgagagcgacgggcgttttagatggaccgacggctcaataataaattttattagctgggctcccggaaagccacgtccggttgggaaagataaaaaatgtgtgtacatgacagcatccagagaagactggggagatcagaggtgcctgaccgccctgccatacatctgcaagcgttctaatgttacaaaagagacgcaaccaccggatcttcctaccacagccttgggcggatgcccatctgactggatccagttcctcaataagtgttttcaagtgcaaggccaagaaccccagtctcgagtgaagtggtccgaggcacagtttagttgcgagcagcaggaggcgcagcttgtcacgattactaatccacttgagcaagccttcattacggcctcactgcccaatgttacatttgacctgtggattggtctccatgcaagccaacgggatttccagtgggtcgaacaagagcctctgatgtacgcaaattgggcaccgggagagccctcagggcctagtcctgcaccgagcggcaacaaaccaacgagctgcgccgtcgttttgcactccccttccgcacattttacgggccgttgggacgacaggtcctgcactgaagaaacccacggcttcatttgccagaaagggacagatccctctcttagcccatcaccagccgcactgccaccagcccctggaactgagttatcatacctgaatggtacattccgcttactccaaaaacccctaaggtggcacgatgctctgttgctttgcgagagtaggaacgcgtcgcttgcatacgttcctgacccatacacacaagcttttctcacccaagctgcacggggacttcgaacccctctgtggatcgggctggccggtgaagagggatcacggaggtacagctgggtgagcgaagaacctcttaattatgtcggctggcaagatggagagcctcagcagccagggggatgtacctacgtggacgtagatggagcctggcgaactacctcctgcgataccaagctgcagggggctgtgtgtggagtatccagtggtcctccacctccaagacgtatttcctatcatggaagttgtccgcaggggcttgctgactcagcctggatcccttttagggagcactgttactcattccatatggagctgttgcttgggcacaaggaagcacgccagcggtgtcaacgggcaggaggtgccgttctgtccatacttgacgaaatggaaaacgtgtttgtgtgggagcatttacagtcctacgagggccaaagcagaggagcgtggcttggaatgaactttaatccaaaaggtggtactctggtgtggcaggacaatacagcagtaaattactctaactggggcccacccggtctcgggccaagcatgctgagtcacaactcatgttactggattcaaagcaactctggtctgtggagacctggagcctgcactaacattacaatgggtgtggtgtgtaagctcccacgagctgagcaaagttccttctcccctagcgcactgcctgagaatccagccgctttggtagtggtactcatggccgtgctattgttgcttgctttgcttacagctgccctgatactctaccgacggcgtcagtccattgaacgcggtgctttcgagggggctagatacagtcgtagcagttcctctcctaccgaggcaacggaaaagaacatactggtgagcgacatggagatgaatgagcagcaggagtag

SEQ ID NO: 229509 - DNA, 1038 bp, Artificial Sequence
  Description of Artificial Sequence: Synthetic coding sequence
atgcccacaggccacctggggtctcccctggctctggcccttctccctgtggctacaaaccggccagcggtccagtggagctgcacagccccacagcctaccagcttagccgcagggacaatcggcgcagcaagaagacggcctatggccagcagtgccaggcgggctcgcggtagccgtagatactcatgggtttctgaagagccgctaaactacgtcggatggcaagacggagagcctcaacaacccggaggttgcacctacgttgacgtcgacggtgcatggcggaccacatcgtgtgataccaagctgcaaggggcagtgtgcggggtgagctccggccctcctccccctagaaggatcagctatcatggcagctgtccccaaggtcttgcagactcggcttggattcctttcagagagcactgctatagctttcacatggagctacttttgggccataaggaggccaggcagagatgtcagagagctggaggtgccgtcctgagtattttggacgagatggagaatgtattcgtttgggagcatctgcagagctacgaggggcaaagccgtggggcttggctgggaatgaatttcaatcctaagggcggtaccttagtgtggcaagataatacggcagtgaattattctaattgggggccacccggtttgggtccctctatgctgagccacaattcttgttattggatccagagcaattctggtctgtggaggccaggggcatgtaccaacatcaccatgggcgtggtgtgcaaattaccaagggcagaacagtcctccttcagccctagcgcattgccagagaaccctgccgctcttgtggttgtgctgatggctgttcttctgttgctcgcacttctgacagccgctctaatcttatacagacgcaggcagagtattgagaggggggctttcgaaggagcgcgatattctagatctagctcttcgcctacagaggccaccgagaagaacattttagtctccgatatggagatgaacgagcagcaggagtag

SEQ ID NO: 229510 - DNA, 834 bp, Artificial Sequence
  Description of Artificial Sequence: Synthetic coding sequence
atgttcccattctatagttgttggcgaacaggcttgttgctcctgctgctagctgtggccgttcgcgagtcttggcagaccgaagaaaaaacttgtgacctggttggggagaagggaaaagagtcagagaaggaactcgccctggttaagcgcttaaagcccttattcaataagtcattcgaaagtacagttgggcaaggctcagacacgtacatctacatttttagggtgtgtcgtgaggcaggcaaccatacttccggagccggtctggtacaaatcaataagagtaacggcaaagagactgtcgttgggaggttgaacgaaacccacatcttcaacggcagcaactggatcatgttgatctataaaggtggagacgagtacgataaccattgcggcaaagagcagcggagggctgtggttatgattagctgcaaccggcatacgttggcagacaatttcaatcctgtctcagaggagcggggtaaagtacaggactgtttttatttgttcgagatggatagcagcctggcatgctccccggagatatctcatctgagtgtcggtagcatcttgctggtgacatttgcatctttggtggcggtgtacgttgtgggtggcttcctgtaccagaggctagttgtgggagcaaaggggatggagcagtttccacatcttgcgttttggcaggatctgggcaatctggtggctgacggctgcgactttgtttgtcgctctaagccgcgaaatgtgccagccgcttacaggggagtgggcgatgaccaactgggagaggaatccgaggagagagatgaccatttgttgccgatgtag

SEQ ID NO: 229511 - DNA, 279 bp, Artificial Sequence
  Description of Artificial Sequence: Synthetic coding sequence
atgttcccattctattcatgttggcggaccggactgctcttgctgcttctggccgttgcggtaagagagtcctggcagacagaggaaaaaacgtgtgacctcgtcggcgagaaaggcaaggaatccgagaaggagctggcactggtgaaacgcctgaagcccctattcaacaagtccttcgaatcgacagtgggtcaggggagcgacacctacatctacatttttagagtatgtcgagaagcgggaaaccatacaagcggagcgggtctcgttcagtag

SEQ ID NO: 229512 - DNA, 330 bp, Artificial Sequence
  Description of Artificial Sequence: Synthetic coding sequence
atgttcccgttctattcctgttggcgtaccggcctgttacttctgctcttagcagtggctgtgagggagagctggcagacggaggagaagacctgcgatttagtcggtgagaaggggaaggagagcgagaaagagctggcattagtgaagcgtctgaaacctctttttaacaagtcgttcgaatctaccgtgggccagggcagcgacacctatatctacatctttcgtgtgtgccgggaggcaggaaaccacacctccggagcaggactggtgcaaatcaacaaatctaatggaaaggagactgttgtgggccgactcaatgaaacgtag

SEQ ID NO: 229513 - DNA, 747 bp, Artificial Sequence
  Description of Artificial Sequence: Synthetic coding sequence
atgtcactatttccttcccttccgttactgctactgagcatggttgctgcttcatattctgagaccgtgacgtgtgaggatgcccagaaaacatgtcctgcggttatcgcgtgtagtagtcctggcatcaacgggttccctgggaaagatggcagagacgggaccaagggggagaaaggcgagccgggtcaaggactccggggtttacaaggaccaccagggaagttgggccctccgggaaatccaggtccctccggaagtcccggaccaaaaggtcaaaagggtgatcccggaaagtcacctgacggagatagttccctcgccgcaagcgagcggaaagctctgcagactgaaatggcccgtatcaaaaagtggttaaccttctcgctcggcaaacaggtgggcaataagttcttcctgacaaatggagaaatcatgacatttgagaaagtaaaggctctctgtgttaaattccaagctagtgttgccacaccacggaacgcggcagaaaacggggctatacagaatctaatcaaagaagaggcctttctgggaattaccgacgagaaaactgagggacagttcgtggacctgacgggcaacaggctaacctacaccaactggaatgaaggagaacctaataatgctggatccgacgaagattgtgtgctgctccttaagaacggacagtggaacgacgtgccatgctctacgtcacatctggctgtgtgtgaattccccatttag

SEQ ID NO: 229514 - DNA, 744 bp, Artificial Sequence
  Description of Artificial Sequence: Synthetic coding sequence
atggctgcagaggctgacggcccacttaaaaggctgctcgtgcccatactgctgcccgagaaatgctatgaccagttattcgtgcagtgggatttgcttcatgtgccctgccttaaaattctgttgtccaaagggttggggttgggcatcgttgccggatctctgctggtcaagctgccacaggtcttcaagatactcggagccaagagtgctgaaggtcttagcctgcagtccgtgatgttggagttggtggctttgactggtacaatggtgtactcaattacaaacaactttccattttcttcttggggcgaagccctcttcttgatgctacagaccatcaccatttgtttcctggtcatgcattatagaggacagactgtgaagggcgtggcatttcttgcctgttacggacttgtgcttctggtgctactgtcgcctctcactccactcactgtggtgacactccttcaggcatcgaacgtgccagcagtggtcgtgggaaggctgcttcaggcagcaaccaattaccacaatggccacaccggccagctctccgccatcaccgtgttccttctctttgggggaagcctggccagaattttcacatctattcaagagaccggagatcccctcatggctggcacttttgttgtgtcttctctctgtaacgggttgatcgccgcacagctcctgttctattggaacgccaaacctcctcacaaacagaaaaaggcacagtag

SEQ ID NO: 229515 - DNA, 381 bp, Artificial Sequence
  Description of Artificial Sequence: Synthetic coding sequence
atggcagctgaggccgatggtcctcttaagcgcttgctggtgcctatcctgctgcctgaaaaatgctacgaccagctgttcgtacagtgggatttattgcacgtaccgtgcttgaagatcttgctttccaagggcttaggtttagggattgtggcaggctctctccttgtcaaactgccccaggtgttcaagattcttggcgctaaaagcgcagctggtctaaagaaggaagacgaagcgcgaccagtccgttctgcttcaatgagggtcagggggggacttggagcctggggacatcaacaaggggaaggctgtatggagtgggagtcacagggtgctggaagcgggtatcggtgggctgcagtaccaccaggtgcgtag

SEQ ID NO: 229516 - DNA, 900 bp, Artificial Sequence
  Description of Artificial Sequence: Synthetic coding sequence
atggccgcagaagctgacggccctctgaagcgactactcgtgcctatcctgctccccgaaaagtgttatgatcaactgtttgtgcaatgggaccttctgcacgtgccgtgcctgaaaattctcctcagcaaagggctggggctgggaatcgtagcgggatctttgctggtaaagctcccccaggtttttaaaattcttggcgcaaagagcgccgaaggcttatcacttcagagcgtgatgttggagttagtggccctgacaggcaccatggtgtattcaattacaaataactttcccttttcttcctggggtgaagctcttttcctaatgcttcagaccatcaccatatgctttctcgtgatgcactaccgcggacaaacagtgaaaggagttgcatttctggcatgctatggtctggtactcctcgtgctgctctctcccctcacacctttgacggtggtcccatgttccggtctgcaatgtgcctgctgcggaggcggtgaggcttctcctgggtcccatcagctcccacagagagcccataggcccgctctttctcatcactccctgccagctgtgtggggtttaccgggacccaacctgcacttccacagcggaaatcgacggagccctgacggctgggatctttgtggactcctgagcctacaaagacctcataggaggccggcagcgctgctgctggaatgcaaagcctcacctcaagcagagaagggtgctgtggagcccgctactggtgtgattcccttcccgctgattcaccctacatccggtttctctccgagtgagcccgcatgctggtgtgatcttctcatactgcacagttccgccctcgcggactttctgagtcaggggtttctccttgtggagaccaatggctag

SEQ ID NO: 229517 - DNA, 636 bp, Artificial Sequence
  Description of Artificial Sequence: Synthetic coding sequence
atggccgctgaagctgacggacccctcaaacgcttgctggtcccaattttactgccggagaagtgttatgaccaactttttgtgcagtgggacctgttgcacgtgccttgtctaaagattctcctgtctaagggactggggctagggattgtggctggttcccttctcgtcaagttgccccaagtatttaagattctgggggcaaagtcagccgagggactgagtctccaatcagtaatgctggaactggtggcgctgacaggaacaatggtgtatagcatcacaaacaatttccccttctcttcttggggcgaagccctctttttaatgttgcagaccattactatatgttttctggtcatgcactatagagggcagactgtgaagggggtagctttcctggcatgttacgggctggtgcttctggttttattgtctcctctgactccactgaccgtagtgacgcttctgcaggcatctaacgtcccagccgttgtggtggggcgtctcctgcaggccgcaactaacaccactaccggtacgcaagcctcaagccagcctagtcaaagttcttgttgcctgggagcaccctggccggagagctccctgccattcaggaaacccgagatcccctag

SEQ ID NO: 229518 - DNA, 561 bp, Artificial Sequence
  Description of Artificial Sequence: Synthetic coding sequence
atggccgcagaggctgacggtccactgaagcgattactagtgcccatcttgctgccggagaagtgttacgaccagctgtttgtgcaatgggacctgctccacgtgccatgcctgaaaattttgctgtcaaagggtcttggcctagggatcgtcgcagggtccttgttagtgaagcttcctcaggtatttaaaatcctcggagccaaaagtgccgaggggctctcccttcagagcgtgatgctcgaacttgtcgcacttacaggtacaatggtgtatagcatcacaaataactttcccttcagatgtagatttccacggcttctgcgccctgggcctgccggagccagtctgacaagcgatgcgctagattgctcccatccggctcccggactgcagtgcgcttgctgtggcggaggagaagcctcccctggctcccatcagctgcctcagcgggctcacagaccggctctgtcccaccatagtttaccggctgtttggggcctgcctggtcctaacctgcactttcacagcggagtgtccatccctttttctcaactgtag

SEQ ID NO: 229519 - DNA, 2826 bp, Artificial Sequence
  Description of Artificial Sequence: Synthetic coding sequence
atggcggctgccccagcattgaagcattggcggaccaccctggagcgggtcgagaaattcgtctcgcccctctattttacggattgtaacttacggggaaggctgtttggagccagttgcccggtggctgttctctcgagttttctaactcctgaaagactgccctaccaggaagccgtgcagcgggactttcgcccagcccaggtgggagactcatttggacctacatggtggacgtgttggtttagagtcgagcttactattcctgaggcgtgggttggccaggaggtgcacctctgttgggaatcggatggggaaggacttgtctggcgggatggggaacccgtccagggccttaccaaggaaggggagaagaccagctacgtccttaccgacaggctaggagaaagggatcctcgatctctgactctttacgtggaagtggcctgcaacggcctgctgggggcaggtaaagggtcgatgattgctgcccctgatcctgaaaagatgttccaactgtctagagccgagttggccgtcttccatcgcgacgtgcacatgctgcttgttgacctagagctcttgctcgggatcgccaaagcccagcagctggagtgggtgaagtctcgctatccgggtctttattctaggatccaggaatttgcctgccgaggtcagtttgttcctgtcggcggaacatgggtcgagatggacgggaaccttccttccggcgaagcaatggttaggcagttcctgcagggtcagaacttcttcttgcaggagttcggcaagatgtgtagcgagttctggctgcccgacacttttgggtattctgctcagttacctcagatcatgcatggatgcgggatcaggcgattcttaacccagaagttaagctggaatctagtgaacagctttccacatcatacctttttctgggagggcctggatgggtctcgggtcttagtgcacttcccaccgggagattcttacggcatgcaggggagcgtagaagaagtgctgaagacagtagctaacaaccgggataaggggagagccaaccatagcgcctttttattcggatttggcgatggcggtggtggacccacgcagacaatgttagacagattaaagaggttatccaacacagatggccttccacgggtgcagctgtcttcccctcgacagctcttttccgccttagagtccgacagtgagcagctgtgtacgtgggttggcgagttatttctagagctccacaacggcacatatacaacacacgcacagattaaaaaggggaaccgggagtgcgagcggatcctgcatgacgtggagttactttctagcctcgctctggctaggagcgctcagtttttatacccggcagctcagctgcagcacctgtggcgcctgctgcttttaaatcaattccacgacgtggtaaccggcagctgcatccagatggtggccgaagaagccatgtgccattacgaggatatccgaagtcatggcaacacgctgctgtcagccgcagccgctgctctatgtgccggtgaacccggaccagaggggctcttaatcgttaacacactgccatggaaaaggatcgaggtcatggcactacccaaacccggaggtgctcactcattagcgctggttacggttccctccatgggctatgctccagtgcctcccccaacttcactacagccattgctgccgcagcaacctgtgtttgtggttcaggagacggatggaagcgtcacgttggataacggaataatcagggtaaagttagatcctactgggaggctgacctctctggtgctcgtcgcaagcggaagagaagccatcgctgaaggagcagtcggcaatcagttcgtgctatttgatgacgtgccactgtactgggacgcctgggacgtcatggattaccacctcgaaacaagaaaacctgtcctgggacaggcaggaacactagccgtggggacagaggggggtctgagaggctctgcctggttcctcctgcaaatcagccctaatagcaggttgtcacaggaggtcgtgcttgacgtgggatgtccgtacgtgcgcttccataccgaggtccactggcacgaggcacataagtttctgaaggttgaattccctgcaagggtccgctccagtcaggctacctatgagatccagtttgggcatctgcaaaggccaacccactataatacttcatgggactgggcccgtttcgaagtatgggcccacaggtggatggatcttagcgagcatgggttcggtctggccctgctgaatgattgcaaatacggagcatccgttcgcggttccatcctctctcttagcctccttcgagcacctaaggcaccagacgccaccgctgacaccggtcgccacgaatttacctatgccctgatgccacataagggctcctttcaggatgccggtgtcatccaggctgcgtacagcctcaactttcctctgcttgccctgcccgcacccagtccagccccagctactagttggtccgccttttcagtctcttctcccgcagtggtgctggagactgtgaagcaagctgagtcctcccctcagcgacgtagtttggtgctgcggctgtacgaggcacacggaagccacgtggactgttggttacacctgtcccttcctgtgcaagaagctattctgtgtgatttattggaacgtcccgatcctgctggacacctgactcttcgcgataacagactgaagttgactttttcgccatttcaagtgctttctttgctgctggtgctacagcccccaccccattag

SEQ ID NO: 229520 - DNA, 3174 bp, Artificial Sequence
  Description of Artificial Sequence: Synthetic coding sequence
atggctgccgcacccgcacttaaacactggagaacgacgctggagcgggtcgagaagtttgtaagtcccctgtacttcacagactgtaacctcaggggaaggctttttggggcatcctgccccgtggcagttctcagtagtttcctgacacccgagcggctaccataccaggaggccgtgcaacgggatttccgcccagcacaggtgggcgatagcttcggtcctacctggtggacatgttggttccgggttgagctgacaattcctgaggcttgggtcggtcaggaagtccatctgtgctgggagagtgatggtgagggtctggtgtggcgagatggagagccggtgcagggactcaccaaggaaggagaaaaaaccagctatgtgctgactgatcggctgggagagcgggatcccagaagcctcaccctttacgtcgaagtggcctgcaacggcctcctgggagccggaaaggggtctatgatagccgcacccgatccagagaagatgtttcagctgtcacgtgccgagttggccgtctttcacagagatgtacacatgttgctggtggaccttgaacttttgcttgggatcgccaagggcctgggcaaggacaaccaacgctccttccaggcgctctacaccgctaaccagatggtgaatgtgtgtgaccctgcacaaccggagactttccctgtagcgcaggctctagcgtccaggttctttggtcagcacgggggagagtctcagcacacgatccatgctaccggccactgccacattgatactgcatggctgtggccttttaaagaaaccgtgcgcaagtgtgcgagatcatgggtgacggccttacagctgatggagaggaaccccgaatttatcttcgcttgcagtcaggcccagcagctggaatgggtgaaatcacggtatcccggactctacagtcgaatccaagaattcgcctgccgcggacaatttgtgccggtgggaggcacatgggtggaaatggatggcaatttgcccagcggggaggctatggtgcgtcaatttttgcagggtcaaaattttttccttcaggagtttggcaagatgtgttctgagttctggctgcccgacacatttggatacagtgcccagctaccacagattatgcatggatgtgggatcaggcgcttcctgacacagaagttatcgtggaacctggttaacagtttcccgcatcacacattcttctgggaaggcttggacggatcgcgagttctggtacatttccccccaggtgatagttatggcatgcagggctctgttgaggaggtgctaaagaccgtggcgaataacagggacaaaggccgagctaaccattccgcatttttgtttggcttcggagatgggggaggcggacccacccagaccatgttagacagacttaagagattaagcaacacagatggcctgccccgtgtgcagttaagtagcccaagacagctgtttagcgcgcttgaatccgattccgagcaactgtgtacctgggtgggtgaattgtttctggagttgcataacggcacgtacacgacccacgctcagatcaagaaaggaaaccgagagtgtgaacgcatcctacatgatgttgaactgctctcttccctggcgctagcccgtagcgcccagtttctgtaccccgcagcacaactacagcacctgtggcgcctgctcctgttaaaccagttccacgacgtggtaaccggctcttgcatccagatggttgctgaggaggcaatgtgccactatgaggacatcagatctcacggtaacaccctgctgtcggctgccgctgcagcgctctgcgccggtgagccgggacccgaagggttgctgattgtgaacacattgccatggaagagaattgaggttatggctctgcccaagcccggaggggctcactccctgggactgactcccagcccgggagatagcgcccagcacgggttgtgctcttgttcatcaccacacctgacagccgcacctgccgcacccgcagcttgcgtccgcagcgctagggctcctaccgacagcgcctcccgacccccacctaccaagacagatggctccgtcaccctcgacaacgggataattcgcgtcaagctggaccctacaggtagactaacttcgctcgtgctagtggcaagcgggagggaggcgatcgccgaaggggcagtcggcaaccaattcgtgctctttgacgacgtgcccctgtattgggacgcctgggacgtcatggactaccatctcgagactcgaaagccggttttggggcaggcagggacactggccgtagggactgagggaggactgcgtggaagtgcctggttcctgctgcagatttcacccaacagtaggcttagtcaggaggttgtgctggacgtcgggtgtccctatgttcgcttccacacagaggtccactggcacgaggcccataagtttctgaaggtggaattcccagcaagagtacggtcatctcaggccacctatgagattcagtttgggcatctgcagcggcctacacattataatacctcctgggattgggcaagattcgaggtgtgggcacatcgttggatggatctctcagaacatggttttggcctggcgctgttaaatgactgcaagtatggggcttccgttagaggaagcattctcagtctcagcctgctccgagcaccaaaggctccagatgctaccgccgacactggtagacacgagttcacatatgcactcatgccacacaagggaagtttccaggacgcgggtgtcatccaggctgcatattcgttgaacttccccctgctggcgttacccgcaccatcacccgcacctgctactagttggtccgcctttagcgtgagtagcccagctgtagtgctagagacggtcaagcaggccgagtctagcccccagcgtaggagtctcgttttacgcctttacgaggcgcatggcagccatgtggactgttggctgcacctcagtctgccagtgcaagaggctattctttgtgacctgctggaacgccctgaccccgctggccatctgactctgagggacaatagactgaagctgacattctcacctttccaggtcttgtccctcctgctggtgttacagccaccccctcactag

SEQ ID NO: 229521 - DNA, 3054 bp, Artificial Sequence
  Description of Artificial Sequence: Synthetic coding sequence
atggcggctgcacccgctctcaaacactggcgtaccacactggagcgggttgaaaaatttgtctcccccctgtacttcactgattgcaatctgaggggcagactgttcggagcctcctgtccggtggccgtgcttagctccttcttaacacctgagagactgccctaccaggaggcagtccaaagggacttccggcctgcccaggttggagattccttcggtcctacttggtggacatgctggttccgggtcgagctgactatacctgaggcctgggtcggccaggaagtacatctttgttgggagtcagacggtgagggtctggtgtggcgtgatggtgagcctgttcagggtctaactaaggaaggcgaaaagaccagctacgttctgacagatcggctgggcgagagggatccccgttcccttacactgtacgtcgaggtcgcatgcaacgggctcctcggggcagggaagggctccatgattgccgctcctgaccccgagaaaatgttccagctgagcagagccgaactggcagtgttccacagagatgtccacatgctcctggtggatctggagctccttctgggaatagccaagggactagggaaagataaccagagaagttttcaagcactctacacagccaatcagatggtgaacgtgtgcgaccccgcacagccagaaacctttcccgtggcccaggccctagcttcccgcttcttcggacagcatgggggagagtctcagcacactatccacgccaccggccactgccacatcgacacagcttggctctggcctttcaaagagaccgttcggaagtgtgctaggagctgggtgaccgcactgcaactgatggagagaaatcctgaattcattttcgcatgttctcaggctcagcagctggaatgggtgaaatcccggtatccagggctgtacagtaggatccaggagtttgcctgtcgcggacagttcgtgccagtcggaggcacgtgggtggagatggatggtaatttacctagcggcgaagctatggtcagacagtttctccaaggtcagaattttttcttacaagagtttggaaagatgtgttccgaattttggttaccggatacgtttggctactccgcacaactgccacagattatgcatggatgcggaattaggagattcctgacccagaaactgtcctggaacttggtaaactcatttccgcaccacacgttcttttgggagggccttgatggcagcagagtgttggttcatttcccgccaggcgattcctatggaatgcaaggcagtgtggaagaggtattaaaaaccgtggctaacaatagggataaaggacgggcaaaccatagtgcctttctgttcggttttggggatgggggaggcggtcctacccagacgatgctagaccgactgaaaaggctatccaacactgacggtttgcctcgagtccagttgtcctctcccagacaactgttctccgcgctggagagcgattccgagcaactctgcacctgggtaggagagcttttccttgagctccataatggaacatatacaacccacgctcaaatcaagaaggggaacagagagtgtgaacggatcctgcacgacgttgagctgctgtcgtcccttgccctggctaggtcagctcagtttttgtatcctgctgcccaactgcagcacctctggcgcctccttcttttaaaccagttccatgatgttgtgacgggaagctgtatccagatggtagcagaagaggcaatgtgccattatgaggatataagaagccacggtaacaccctcctgagtgccgcagcggcagcactgtgtgctggggagccgggacctgagggtctactcatcgtcaacacattgccatggaaaagaattgaggtcatggcgctgcctaagccagggggagcccattccctcgccctggttacggtccctagcatgggctatgcccctgtcccccctcctacttccctgcagccacttctgcctcagcagcccgtgtttgtcgtccaggagaccgatgggtctgtgacccttgacaacgggattatccgcgttaaattggaccccaccggacgactgacctccttggtgctggttgctagcggcagggaagcaattgccgagggtgcggtgggaaaccaattcgtcctatttgacgacgtgccgctttactgggacgcttgggatgtgatggattaccatttggaaacgagaaagccagtcctgggccaggcgggaactttggcagtgggtaccgagggcggtctgcggggttcagcgtggttcctcctgcagatatccccgaactctcgcttatcgcaggaagtagtgcttgacgtgggctgtccatacgtccgattccataccgaggttcattggcacgaagcgcacaagttccttaaagtagaattcccggcaagggtacggtcatcccaggccacatacgagatccaattcggtcaccttcagaggcccacccactataacacctcgtgggactgggccagattcgaggtttgggctcaccgatggatggacctctcagagcatggctttggcctggcccttctgaatgactgcaagtacggcgctagcgtcagagggtccatcttgtccctgtccctcctgagagcccctaaggctcctgatgctacagccgacacgggaagacatgagttcacgtacgcccttatgccccacaaggctccaagccctgcacctgccacctcatggagcgcattctccgtatcttcacctgccgtagtgctcgaaaccgttaaacaggctgagtcttccccacagcgccgatcactggtgcttcggttgtatgaagcccacggctctcacgtggactgctggctgcatctgtctttacctgtgcaggaggccatcctgtgtgatctgcttgagcggccagatcctgcaggccatttgaccctgcgagataaccgattgaaattgacattctcacccttccaggtcctctctttgctcttggttctgcagccaccacctcactag

SEQ ID NO: 229522 - DNA, 1104 bp, Artificial Sequence
  Description of Artificial Sequence: Synthetic coding sequence
atgcccgtcggaggcctactgccccttttcagcagccctgccggaggcgtgcttgggggagggctgggtgggggtggcggtagaaagggctcagggcctgcagctctgaggctgacagagaaatttgtgctcttgctcgtctttagcgctttcattactttgtgcttcggggctatcttcttcctgcctgatagttctaaactcctgagcggggtacttttccactcatctcccgcactgcagccggctgccgatcacaaacccggtcccggagctagggccgaagacgcagcagaaggtcgtgcccgtcggagagaggagggggcacccggagatccggaagccgctttggaggataatcttgctcgcatccgagagaaccatgagagggctttaagggaggctaaagagacgctgcaaaagttgcccgaggaaattcaacgtgatattctcctggaaaagaagaaggttgcccaggaccagctgagagataaggctccgttcagaggcttgcctccagtcgactttgtgccccctatcggtgttgaaagcagagagccagctgacgctgccatccgggaaaaacgcgcaaaaattaaggaggagatcgaagccagaaaaggacaggcaaattgccccggtagttctagttcctgtgaggtcgagatacagatgatgaagcatgcttggaataattacaaggggtatgcgtggggcctgaatgaactcaaaccaatttctaagggcggacactcttcaagtcttttcggaaatataaaaggggctaccatcgtggacgcactcgataccctctttatcatggagatgaagcacgaatttgaggaagcaaaatcctgggtcgaggagaatctcgattttaacgtcaatgccgaaatcagcgtttttgaggtgaacataagattcgttgggggactgctttcagcttactacttgtctggagaggagattttcaggaagaaggccgtggagctcggtgtcaagctactgcctgcctttcataccccttctgggatcccctgggctttgctcaacatgaaacggtggatgtgcaacatccctcgagctatggaggccacaatttag

SEQ ID NO: 229523 - DNA, 1962 bp, Artificial Sequence
  Description of Artificial Sequence: Synthetic coding sequence
atgccagtaggcggactgctgcccttattcagttctcctgcaggcggagtactgggcggagggctggggggtgggggagggcgaaagggctccggacctgctgcactgcgtctgacagaaaagtttgtgctgttgctggttttctcagcttttatcactctgtgcttcggcgcaatattttttctgcctgactccagtaaactgctttccggcgttttattccattcctccccagcgctgcagccagccgcagaccacaagccaggccctggagcacgcgcagaagatgctgcggaaggacgagcacgacgcagggaggaaggcgcaccgggagacccagaggctgccctcgaggataatctcgctaggattagggaaaatcatgagcgcgcactccgggaagccaaagagactctgcagaagttgcctgaggaaatccagcgtgacatcttactggagaagaagaaagtggctcaagaccagcttcgggacaaggctccattccgcggactgccgccagtcgactttgtgcccccaatcggagtcgaaagcagagagcccgctgatgcagcaattagggaaaagagggctaaaataaaagagatgatgaagcacgcttggaacaactataagggttatgcctggggcttaaacgagctcaagccaatttccaaaggaggtcatagttctagcctttttggaaacattaaaggggcaacaatcgtggatgcactggatacgctgtttattatggagatgaagcacgagttcgaggaagccaaaagctgggtggaagagaacctggatttcaacgtcaatgccgagatatcggttttcgaggtaaatataaggttcgtgggaggtctcttgagcgcctactatctgtctggtgaagagatctttcgcaagaaagctgtcgaactgggcgtaaaactgctccctgcctttcataccccaagtggtatcccctgggccttgctgaatatgaaatccggaattggcagaaactggccatgggcctctggtgggtcctcaatcttagccgagttcggcacattacacctggagttcatgcacctgagccacctgagtggcaacccaattttcgctgagaaagtgatgaatattcggaccgtgctcaataagctggaaaagccacagggcctttatcctaattacctgaaccctagttctggtcagtggggtcaacatcacgtctcagttggaggactgggagactccttttacgaatacctcttgaaagcctggcttatgtccgacaaaacagacctcgaagctaaaaaaatgtatttcgacgccgtacaggctatcgaaactcacctgattagaaaatcctcgtctggcctgacatacattgcggagtggaaaggcggactcctcgagcacaaaatgggacacctgacttgctttgcaggcggtatgttcgctttaggcgctgatgcagcccctgaaggaatggctcagcactacctagaacttggtgccgaaatcgccaggacctgtcacgaatcgtacaatagaacctttatgaagctagggcctgaagcattccgtttcgacggcggtgtggaagcaattgctactcggcagaacgaaaaatattatattctccgcccagaggtgatggagacatacatgtacatgtggagacttacccatgacccaaagtaccggaagtgggcatgggaagctgttgaagcgcttgaaaatcattgccgcgttaacgggggatatagcgggctaagggatgtctacctgttgcacgagtcttatgatgacgtgcagcagtcctttttcctcgccgaaacactgaaatacctttacctgatcttttccgatgacgatctcctgcccctggagcactggatcttcaactccgaggcccatctgttgccgatcctgcctaaagacaaaaaagaagtcgaaatccgcgaggagtag

SEQ ID NO: 229524 - DNA, 579 bp, Artificial Sequence
  Description of Artificial Sequence: Synthetic coding sequence
atgttcgccctgggagctgacgggtcacgggcagataaggcaggacattacctcgagctgggtgcagaaatcgccagaacatgccacgaatcttatgacagaactgccctcaagttaggtcctgaatcgttcaaattcgatggcgcagtggaagcagtggccgtgcggcaggccgaaaagtactacattctacgccctgaggtgattgaaacctactggtatctgtggagatttacacatgacccccgttatcgccagtggggatgggaggctgccctcgcaatagagaaatactgcagagtgaacggcggtttttccggtgtaaaagacgtgtacagctcgacccctacgcatgacgacgtgcagcaatcctttttcttggcggaaacactgaagtatctgtatttgcttttcagcggagatgatctgctgccattagatcactgggtattcaatactgaagcacatcctctacccgtgcttcacctggctaacacgaccctgagcgggacctcgcagggtatgcggaggcaaaacccgtactttcaggtgctgtacttatattacccagacgattag

SEQ ID NO: 229525 - DNA, 1926 bp, Artificial Sequence
  Description of Artificial Sequence: Synthetic coding sequence
atgactacgcctgccctccttccgcttagcggaagacggattccacccctgaatctgggtcctccttctttccctcaccaccgggcaactcttaggttgagcgaaaaattcatcctgctgctgattctgagtgctttcattactctgtgctttggggctttttttttcctgcccgacagttccaagcataaaaggttcgatctaggacttgaggatgtacttataccacacgttgacgctggcaagggagccaaaaatccgggagtgtttctaatccacggaccggacgaacatcggcatagagaagaagaagagaggctgcggaataagattagggcggaccatgagaaggccctcgaagaggccaaggagaaactgagaaaatcccgggaagagatccgagctgagatccaaactgagaagaataaagtagttcaggaaatgaagatcaaagaaaacaagcccttaccccctgtgcccattcctaaccttgtggggatacggggaggtgaccccgaagataacgatattagagagaagagggaaaagatcaaggagatgatgaagcacgcttgggataattacagaacttacggctggggtcacaatgaactgagacccatagccaggaagggtcactcacccaatattttcggttcgtcccagatgggggcaactatcgtggacgctctggacacattatacatcatgggacttcatgacgagtttctggatgggcagcggtggatcgaggataatcttgatttctccgtcaattctgaagtctcagttttcgaagttaatatccggtttattgggggactcctggccgcttattacctgtctggcgaggaaatcttcaagattaaggctgtgcagcttgccgagaagctgctgccggctttcaacacccctacaggaataccatgggcaatggtaaacttaaagagcggcgtgggccgtaactggggttgggccagcgctggcagcagtatcctcgctgagtttggcacattacacatggagttcatccatctctcctatctgacaggtgatttaacctactacaaaaaggttatgcacatacgcaagttgctgcagaagatggatcggccaaacggcctatatcctaattacctgaatcctaggacagggagatggggtcagtaccacaccagtgtgggaggtctcggcgattcattttacgaatatcttctcaaagcttggctgatgtccgacaagacagaccacgaggcaagaaagatgtatgacgacgcaattgaggccattgaaaaacaccttatcaaaaaatctcgaggcggacttacttttattggcgagtggaaaaatggccatctcgaaaaaaaaatggggcatctagcctgtttcgccggtgggatgttcgccttgggagcagatggatctcgtgccgataaggccggtcactacttggagctaggcgctgagattgccaggacctgccatgaatcctatgacaggacagctcttaaactcggccctgagtcttttaaattcgacggcgctgtggaagccgtcgccgttcggcaagccgagaaatactatatcttacggccagaagtgatagaaacctattggtacctctggaggtttacccacgacccccgataccgccagtggggatgggaggctgccctggcgattgagaagtactgtcgagttaatggtggattttctggggtaaaagacgtttactcctcaacccccactcatgatgacgtccagcagagcttcttcttggctgagactcttaaatatctgtacctgctctttagcggcgacgacctcctcccattggatcactgggtctttaatacggaggcccatcccctccccgttttgcacctggctaatactacattaagtggaaatcccgcagtgcggtag

SEQ ID NO: 229526 - DNA, 1128 bp, Artificial Sequence
  Description of Artificial Sequence: Synthetic coding sequence
atgggcctgcatgatgaattcctcgatgggcagaggtggatcgaggataacctggacttttcagtgaactcagaggtgtctgtgttcgaagtgaatatccgcttcatcgggggactactggccgcttactatcttagcggagaagagattttcaagattaaggctgtacaactggccgagaaactgctgccagccttcaatactcccacaggcatcccttgggcgatggtgaacctgaagtccggggtgggcaggaactggggatgggcttcagccggatcatctatactcgccgagttcggtaccctacatatggagttcatacacctcagttatttaacaggtgatctgacctactataaaaaagtgatgcacatcaggaaactgctgcagaaaatggaccggcctaacgggctgtatcccaactacttgaacccacgaacgggccgatggggacagtatcacacatccgtgggaggtctcggcgacagtttctacgagtacctcctcaaagcgtggcttatgagcgacaaaacggatcacgaggctcgtaaaatgtatgacgacgcaatcgaggccatagagaagcatctgattaagaaaagtcggggagggctgactttcatcggtgagtggaagaacggccatctcgagaaaaaaatgggccacctggcttgtttcgcagggggtatgtttgcactgggagcagatggctcgcgagctgacaaggcgggtcactatctcgaactcggcgcagaaattgcccgtacatgccacgaatcttatgaccgcacagctcttaaactggggcctgaatcttttaaattcgacggagcagtagaagcagtagccgtgcggcaggctgagaagtactacatcctgcggcctgaggtaatagagacttattggtacctgtggcgctttacgcatgatccaagatacaggcagtggggatgggaggcagctctggctattgagaagtactgccgagtgaacggtggctttagtggggtcaaggatgtttactcctctacaccaacacatgacgatgtgcaacagtcttttttcctggccgagaccctcaagctcgcatcctaccacgagaggacagtgtttcctgcaggttag

SEQ ID NO: 229527 - DNA, 615 bp, Artificial Sequence
  Description of Artificial Sequence: Synthetic coding sequence
taaatcaaaaaatcacgcggtggccttacctttatcggcgaatggaagaatggtcatctcgaaaagaaaatggggcacctggcctgcttcgccggaggaatgttcgccttaggcgctgatgggtcccgagctgacaaagccggtcactaccttgagcttggcgctgagatcgcacggacatgtcatgagtcctacgaccgcacagcactgaagctggggcctgagtctttcaagttcgacggagcagtcgaagccgtcgccgtgaggcaggctgaaaagtactatatcctgaggccagaggtgattgaaacgtattggtatctctggcgctttacgcacgaccctcgttaccgtcagtggggctgggaggctgcgttagccatcgagaagtactgtagagtcaatggcggattcagcggtgttaaggacgtctattccagtaccccaacccatgatgatgtacagcaatcttttttcctggctgaaactcttaaatacttataccttctgttctcaggagatgatttgctccctctggaccactgggtcttcaatacggaggcccatccactgccagtattacaccttgcaaataccaccctctctgaaagctag

SEQ ID NO: 229528 - DNA, 294 bp, Artificial Sequence
  Description of Artificial Sequence: Synthetic coding sequence
gagaaatattgtcgcgttaatggcggattcagcggggtcaaggatgtgtacagctctacacccacacacgatgacgtccagcaaagcttctttctcgctgagacactgaagtacctgtatttgctgttctccggtgacgatctgctgcctctcgatcattgggtattcaatacagaggcccaccctctccctgtgttgcatcttgctaatacgacactgtcaggtacttctcagggaatgcgcaggcagaatccctactttcaggtgctgtacctgtattatcctgatgactag

SEQ ID NO: 229529 - DNA, 1035 bp, Artificial Sequence
  Description of Artificial Sequence: Synthetic coding sequence
taaatccgatttattggcggactgctggctgcatattatctgtcaggagaggagatcttcaagatcaaggcagttcagctagccgaaaagttgctgcctgcttttaatactcccacgggaattccctgggcaatggtgaatctgaagagcggtgtggggaggaactgggggtgggcaagtgccggttcaagtatactggccgagtttgggactctacatatggagttcattcacctgtcatacctgaccggcgacctaacatactataagaaagtgatgcacatacgcaaactcctgcaaaaaatggaccgcccaaacggcttgtatcccaactacctcaaccctcgaacgggcagatggggccaataccacacgtccgtagggggacttggggattctttttacgagtacctgttaaaggcttggctgatgagtgacaagacggaccacgaagcccgtaagatgtacgacgacgctatcgaggctatcgagaagcacttaattaaaaagtctaggggtggcctgaccttcataggcgagtggaaaaacggacacctggagaagaaaatggggcatctggcctgcttcgcgggtgggatgtttgccctcggagctgatggttccagagcagataaggctggacactacctagaactcggagcagaaatcgccaggacttgtcacgagagctacgatcgcacagcattaaagctaggccctgagtcattcaagtttgacggcgctgtggaggctgtggccgtccggcaggccgaaaaatattatatcttaaggcctgaagttattgaaacgtactggtacctgtggcggttcacgcacgatcccaggtatcggcaatggggttgggaggcagcacttgcgatagagaaatattgtcgagttaatggaggattttctggagtgaaagatgtttactccagtacaccaactcacgacgatgtacagcagtccttttttctggctgagacgttaaaactagcttcctatcacgaaaggaccgttttcccagcgggttag

SEQ ID NO: 229530 - DNA, 2100 bp, Artificial Sequence
  Description of Artificial Sequence: Synthetic coding sequence
atggcagcatgcgagggtcgccgatccggtgctttaggttcttctcaaagtgacttcctcactcctccggtgggtggtgcaccatgggcggtggctacaacggtggtaatgtatccaccaccacctcctcccccacatagggacttcatttccgtaaccctgtcctttggcgagaattacgacaactctaagtcatggcgacgcagaagctgctggcgaaagtggaaacaactctctagattgcagagaaacatgatcttatttttgcttgcctttctcctgttctgcggactgcttttctacatcaatttggccgatcactggaaagccctggccttccggctggaagaggagcagaaaatgaggccagaaatagctgggctgaaacctgctaaccctccagtgcttcctgccccacagaaggcagacacagatcccgaaaatctgccagagatcagtagtcagaaaacgcagcggcacattcagaggggccctccacatttgcagatccgccctccatcccaggatttaaaggacggtacacaggaggaagcaaccaagcgccaggaggcgccagttgatcccagacccgagggggatcctcagcgaacagtgatttcctggcgcggtgcagtgatcgaacctgaacagggtaccgagctcccgtcacgtagggccgaggtacccactaagccccctctgccacccgcacggacccaaggtacgccagtacatctgaattacagacaaaagggcgtgatcgatgtgtttctgcatgcctggaagggctatcgaaaattcgcctggggacacgatgagctgaaacctgtatccaggagcttctctgagtggtttggcttaggcctgacactgatcgacgctcttgatacgatgtggatcctggggttgcgcaaggagttcgaggaggcccgaaaatgggtgagtaagaagcttcacttcgagaaggacgttgatgtaaatctctttgagtcaacgattcgcattcttggcggtttactgtctgcgtatcatttgtcaggtgattccttgttccttagaaaagccgaggattttggaaatagactgatgcccgctttcagaacgccgtctaagatcccctattcagacgttaacatcggaacaggggtggcacacccaccacggtggacatctgatagcacagtagcagaggttacctcaatccagctggagttcagagaactcagccggctaaccggggacaagaagtttcaggaagccgtcgaaaaggttacccagcacatacacggactctccggcaaaaaggacgggctggtgcccatgtttattaatacacatagtggccttttcacccacctgggcgtgttcacgctgggagcgcgagccgacagttactatgaatacttactgaagcagtggattcagggtgggaaacaggaaacccaactgctggaagactacgtagaggcaatcgagggagtgcggacccatcttctcagacacagcgagcccagtaagctgacgttcgtgggggagctcgctcacggccgattctctgcaaaaatggaccatctggtctgcttcctgcctggcacattggcactcggagtgtaccatggcctcccggcttcccacatggagctagcacaggaactgatggaaacttgctatcagatgaatcgccaaatggagaccggtctatcccccgaaatcgtccactttaatctctatcctcagcctggtaggcgggatgtcgaggtcaagcctgcggaccgccataacctactacgcccagagaccgtcgaatccttgttctacctgtaccgagttacaggcgatcgaaaatatcaggactggggctgggaaatcctgcagtccttctctcggtttactcgggtgcctagtggcggttacagcagtattaataacgtccaagacccacagaaacctgaaccaagggataagatggagtcattcttcttaggggagacactcaaatacctcttcctgttgttctctgatgacccaaatctcctgagcctggacgcttacgtgtttaacactgaggctcacccacttccaatttggacgcctgcatag

SEQ ID NO: 229531 - DNA, 1209 bp, Artificial Sequence
  Description of Artificial Sequence: Synthetic coding sequence
atgtggatcctgggactgagaaaggaatttgaggaagcacgcaaatgggtgagcaaaaagctgcattttgaaaaggacgtggacgtgaatttgttcgagtctacaatccgcattctcggtggcctgttgagcgcctatcatctcagcggtgattccctctttctgcggaaggcagaagacttcggaaacaggcttatgccggcttttcgcacacccagcaagatcccgtacagtgacgtcaacatcggaacaggggttgcacacccgcctcgttggacatctgattccaccgttgccgaagtcacttccatccagctggagttccgggaattgagccgcctcaccggagataaaaagttccaggaggccgtggagaaagtgacacagcatatacatggtctcagtggaaagaaggatggtctggtacctatgtttatcaatacacattccggtctatttacacacctgggcgtatttacattaggcgctcgcgctgactcctactacgaatatctgctgaagcagtggatccagggcggaaagcaggaaacacagctgctggaggattacgtcgaagcaattgagggtgtcaggacccacttgctgaggcacagtgaacccagcaagttgaccttcgtcggcgaactggctcacggcagattctccgctaagatggaccacctggtatgcttcctgcccggaacactggcgctgggcgtgtatcacgggttacctgcctcccacatggagcttgcccaggagctcatggaaacttgctaccagatgaaccggcagatggagacgggactgagtcccgagatcgtacattttaacctgtacccccaacccggtaggagagatgtggaagtgaaaccagcggatcgacataatttacttcgcccagaaacggttgagtccctcttttatttgtaccgagtgaccggcgatcgtaagtaccaagactggggttgggaaatcctgcagtccttctcccggttcactagggtaccaagtgggggatacagctccatcaacaacgtccaggacccacagaagcccgagcctcgagacaagatggagagcttcttcctcggagagaccctgaagtatctctttctgctgtttagcgatgacccgaacctcctgagcctggacgcttatgtgttcaacaccgaggctcacccactgcctatctggacacccgcatag

SEQ ID NO: 229532 - DNA, 2118 bp, Artificial Sequence
  Description of Artificial Sequence: Synthetic coding sequence
taaccttgggcagtcgcaaccacagtagtgatgtaccccccaccaccacctccaccgcacagagacttcatttccgttacactgagttttggagagaattatgataattcaaagagctggcgcagacgaagctgttggcggaagtggaaacagctttcacggctgcaaaggaacatgatcctgttccttctcgcctttctcctgttctgtggattgttgttctacatcaacctagccgatcattggaaggccctggccttcaggttggaggaggagcagaagatgcggccagaaatcgccggactcaagccagctaaccctccagtactccccgcaccacagaaggccgacacagatcccgagaacctgcctgagatttcaagtcagaagacgcagcgtcacattcaaagaggtccacctcatcttcaaattcgcccaccttcccaggacctcaaggacggtacccaagaggaggcaaccaagcgccaagaggccccagtggaccctagaccagaaggagatcctcagcgcactgtcatctcctggagaggcgctgtgatagaacccgagcaaggtaccgaactgccctctaggcgtgcagaagtccccaccaagcctcccctgccacctgctcgaactcagggaacccctgttcacctgaattatcgccagaaaggggtaattgatgtgtttctgcatgcatggaagggataccgcaagtttgcttggggccacgatgagttaaaacccgtctctaggtcttttagcgagtggttcggcctgggattgaccctaattgatgctctggacactatgtggattctcggcctcaggaaggaattcgaggaagccagaaagtgggtatcaaagaaattgcatttcgagaaggacgttgacgtgaatttgtttgagagcaccatcaggattcttgggggtctgctctcagcataccacctgtctggggattctctctttctgcggaaagctgaagacttcgggaataggctgatgcctgcttttcggacgcccagcaaaatcccctacagcgacgtcaacattggaaccggggtggcacatcctcctcgctggacctccgactctactgtcgctgaggtgacatctattcaactagagtttagagagttatcccgcttgactggagataagaagttccaagaagccgttgaaaaagtcacacaacatatccacgggttatcagggaaaaaggacggtctggtgcccatgttcataaacacacactcaggcctgttcacacacctaggcgttttcacactcggagcccgagctgacagctattatgaatatcttctcaagcagtggatccagggcggaaaacaggaaacgcagttgctcgaagattatgtagaggcgatcgaaggcgtccgaacccatctcttgcgtcacagtgagccgagtaaactcacctttgtgggagagctggctcacggcagattctctgctaagatggatcacctggtatgcttccttcccggtacgctcgccttaggcgtgtatcatggcctccctgccagccatatggagctggcacaggaactaatggagacatgctaccagatgaataggcagatggagaccgggctgagccctgaaattgttcactttaatctgtacccgcagcctgggaggagagatgtcgaagttaagcccgctgatcgtcataacctgttacgacccgaaacagtcgagtccctgttttacttatatcgtgtcacaggggataggaagtatcaggattgggggtgggaaatccttcagtctttcagcagattcacaagagtcagcacctgtccccgtcccgcatggtctagacccccaggccacaggcatggttgggctgtgggattacgcctggcacccttgttggtagtggccgttacatggataagagaaggcagggcatgccgcagtcttggcgtcgccacgctgcagctgggcggaccgggaatccccatacctactgagttgcatggatgtggtacacaatccacttggaggggttgggcgcctctcatattcatctcacaaggcttgagccgggagggattatgctgcggtccttccatccctcccgtgtag

SEQ ID NO: 229533 - DNA, 3435 bp, Artificial Sequence
  Description of Artificial Sequence: Synthetic coding sequence
atgaagctgtcacgccaatttaccgtttttggcagcgcaatcttctgcgtcgtgatcttcagcttgtatctcatgctagaccgtggacatcttgactatccaagaaatcctaggagagaaggtagtttccctcaggggcagctcagcatgctacaggaaaaaatagatcatctggagcgtctgctcgccgaaaacaatgagataatatcaaatattagagattccgtcatcaacttatcggaatccgtcgaagatggtccgaagtctagtcagagtaatttctcccagggggcaggctcacacctgctaccttctcaattgtctctgtccgtggataccgccgactgtctcttcgcatcgcagtctggatcacacaattctgacgtgcagatgctggatgtgtactctcttatatcctttgataatcctgatggcggagtgtggaaacagggtttcgatatcacctatgaaagcaacgaatgggacaccgaaccacttcaagtattcgtggtgccgcactctcacaatgatcctggctggttgaagaccttcaacgactactttcgggataagactcagtatatattcaacaacatggtgctgaaactgaaggaagacagccgcaggaaatttatttggtcagagatcagctacttgagtaagtggtgggacatcattgatatccagaaaaaagatgctgtgaagagcctgatagagaacggtcagctggagatcgttactgggggttgggtgatgccagatgaagccacacctcactattttgccctgattgatcagctgattgaaggtcaccaatggctggagaataacatcggggtaaaacctcggtctggatgggccattgaccctttcggtcatagtccgacgatggcctacctcctcaatagggctggcctgtcccacatgctgattcagagggtccattatgcagtgaaaaagcatttcgccctccacaagaccttggagttcttctggcgccaaaattgggacttggggtcagttacagacattctgtgccatatgatgcccttttattcttacgacattccccatacatgtggacctgaccctaagatttgctgtcagtttgacttcaagcgattacccggaggcagatttgggtgcccttggggcgtcccgccagagactattcatccagggaacgtgcagtcaagggcccgaatgcttcttgaccagtacaggaagaagtccaagctgttccgaaccaaggtcctcctggcccctcttggcgatgactttagatattgtgaatacaccgagtgggatctgcagttcaagaactaccagcaactctttgactatatgaattcccaatctaaattcaaggtcaaaattcagtttggtacactcagcgactttttcgacgccctggacaaagcggacgaaacccagcgggataaaggccagtccatgttccccgtgctgtcgggggatttttttacctatgccgatcgggatgaccattactggtccggatatttcacatcccgccctttctacaaaagaatggacaggataatggaaagtcacctcagagcagcggagattctctattactttgcactgaggcaggcccacaagtacaagatcaacaagtttctcagctccagcttgtacacagcacttacagaagctcggagaaatctcgggctcttccagcaccatgacgccatcacaggcactgcgaaagattgggtggtggtcgattacgggactcgtctcttccactcccttatggtattagaaaagatcattggtaacagcgcattcctgttgatcctgaaagacaaattaacttatgactcatactctccagacacatttctggagatggatctgaaacagaagagccaggacagcctccctcagaaaaatataattagactctccgctgagccccgataccttgttgtctacaatcccctcgagcaagacaggatcagcttggtgtctgtgtatgtttccagcccaaccgtgcaggtcttctctgcctccgggaagccagttgaggtccaagtttccgcagtgtgggacaccgccaacaccattagcgagactgcctacgaaatttcctttcgcgctcacattccccctctggggctgaaagtgtataagatccttgagtcagcctctagtaatagccacctcgcggactatgttttatataagaataaggtggaagattccgggatatttactatcaaaaacatgattaataccgaggaggggatcacgctcgaaaacagtttcgttctgctgaggttcgatcagacaggcctgatgaagcagatgatgaccaaagaggatggaaaacatcacgaggttaatgtgcagttcagctggtatggcacaacaataaaacgcgataagtctggagcctatctgtttttgccggacggcaacgcaaagccatacgtctacacaactccaccatttgtgcgggtgactcatggcaggatatactccgaggtgacctgcttcttcgaccacgtgacacaccgggtccgcctgtatcacatccagggcatcgaggggcagtcggttgaagtaagcaacatagtcgatatccgcaaagtttacaaccgggaaattgctatgaaaatctcttccgatattaaatcacagaaccgcttttacactgaccttaacgggtaccagatacaacctcgcatgactctcagtaagctgccgttgcaggccaatgtgtacccaatgacaaccatggcgtatatccaagacgcaaagcacaggctgacacttctctcagctcagtctctgggcgtttcaagcctaaactccggccagatcgaagtcattatggatagacgcctcatgcaggacgacaataggggtctagagcaggggatccaggacaacaagattactgccaacctctttcggatcctattagaaaagcggagcgccgtgaacacagaagaggagaagaaaagtgtgtcgtaccccagcctcttatcacacattacctcgagcttgatgaaccatccagtgattcccatggcgaacaaatttagtagtccaaccctggagctgcaaggtgaattcagcccattacagtcatcacttccatgtgatattcatctggtgaatctcaggactatccagagcaaggttggcaatggacattcaaacgaggctgcactgatcctccacagaaaaggtttcgactgtcgtttcagctccaaggggaccgggttgttttgtagcaccacccagggaaaaatcctggtgcagaaactgttgaataaatttatcgtggagtccttaacaccttcttcactgtccctcatgcacagccccccagggactcagaacattagtgagatcaacttgtcaccgatggaaatttccacatttaggatccagctgcgctag

SEQ ID NO: 229534 - DNA, 3453 bp, Artificial Sequence
  Description of Artificial Sequence: Synthetic coding sequence
atgaaactcaaaaaacaggtcaccgtgtgcggcgctgccatattttgtgtggcagtattcagtctatatcttatgctggatagggtccagcatgacccaaccagacatcagaacggcggaaacttccctaggtcccagattagcgttctccagaatagaattgaacagttagaacagctccttgaggagaatcatgagatcataagccacattaaggattccgttctggaactgacagccaatgcagagggccctcccgcaatgctcccatactatactgtgaacggaagctgggtcgtccccccagaacctagacccagtttcttcagcatttcaccacaggactgtcagtttgcactgggagggagaggccagaaaccggagctgcaaatgctcaccgtgtcagaagagctgccattcgataacgtagatggaggggtgtggcgtcagggattcgacatcagttacgatccccatgattgggacgccgaggacctgcaggtattcgttgtcccacactcccataacgaccccggatggattaaaaccttcgacaagtactacaccgagcaaactcagcacattctcaactcgatggtatcaaaactgcaagaagatccaaggcgtcgtttcctgtgggcagaggttagcttcttcgcaaaatggtgggataacattaatgtgcagaaacgagccgctgtacgacgcctcgttggcaacgggcagcttgagatcgctactggcggatgggtgatgcccgatgaggcgaattcccactacttcgcactgattgaccagttgatcgaaggccaccagtggctggaacgcaatcttggcgctactcctcggtctggatgggcggtggatccttttgggtacagcagcaccatgccatatctgctgagacgagcgaacctgacctccatgttgattcagagagtgcactacgcaatcaagaaacatttcgctgcgacacacagcttggaattcatgtggcgccagacctgggactcggactctagcacagatatcttttgtcatatgatgccgttttactcttacgatgtcccacatacttgcggtcccgatccaaaaatttgttgccagttcgacttcaaaagactgccagggggaaggatcaactgtccttggaaagtcccaccaagagccattaccgaggctaacgttgccgagagggcagctctgctactggaccagtaccgtaaaaaaagccaactctttcgctcaaatgtgttgctggtgccacttggcgacgactttagatatgataaaccacaggaatgggacgcacaatttttcaattaccaaaggctctttgatttcttcaactctagacccaatcttcatgtgcaggcacagttcggcactctgtctgattattttgacgcactatataaaaggactggggtggagcccggagcgcgtcctcccggattccctgtgctctccggagattttttctcgtatgccgaccgcgaggaccactactggactggatattacacctcacggccattttataagtccctggaccgcgtgttagaggcccacttgcgcggtgccgaggtgctctatagtctggctgccgcacacgcacggaggagcggtctggccggacggtaccccctgtctgacttcacactactcactgaggcccgacggactctcggacttttccagcatcacgatgcaattacgggtactgccaaggaggcagtggtggtggactacggcgtccgcctgctacgaagcctggttaacctcaaacaggtgatcatccatgctgctcattatctggtgcttggagacaaggagacctaccattttgatcccgaggcccctttcctgcaggtggacgataccaggttgtcacatgacgcccttcccgagcgcacagtgattcagctcgactcttcccctcggttcgtagttctatttaacccacttgagcaggaaaggttctccatggtttccctcctggtcaacagccccagagtacgcgttctgtctgaagagggccagccactggcggttcagatctctgcccattggagctccgcaaccgaggcggtgcccgacgtgtaccaggtgtccgtgcccgtcagactgcctgccctcggcttgggcgtgctccagctgcaactggggcttgacggccaccggacactgccgtcaagcgtcagaatttacctgcatgggagacagctgtccgtgtcacgccatgaggccttccccttgcgtgtgattgatagcggcactagcgacttcgcactgagtaacagatatatgcaggtgtggttcagtggtctcactgggctgctgaagtccattagaagggtggatgaagagcacgaacagcaggtcgacatgcaggtgctagtgtatgggacaaggaccagcaaggataagtcaggagcttacctgttccttccagatggcgaagccaagccttatgtaccgaaggaacctcccgtgctgagggtaacggagggtccgttttttagtgaggtagtggcttactatgaacacattcatcaagctgttcggctgtataacctccctggggtcgagggcctctcactggacatcagcagcttagtggacatccgggattatgtgaataaagagctggccctccacatccataccgatatagacagccagggtattttttttactgacttgaacggctttcaggtgcaacctcgcaggtatcttaagaagctgccactgcaagccaacttctaccccatgcccgtaatggcatatatccaagatgctcaaaagcggctgacattgcacaccgcacaggctttgggggtgtccagcctgaaggatggtcagttggaagtgatactggacaggcgccttatgcaggacgacaacagaggattgggccaagggctgaaggacaacaaacgtacatgcaatcgcttccgacttctgttggaaagaagaacagtgggctccgaagtccaagactctcactccacttcctatccttcgttgctcagtcacctcactagtatgtaccttaacgctccagccctcgctttgcctgtggcacgaatgcagctcccgggacctggactgaggtcgttccacccactcgcctcatccctgccttgcgatttccacctgctcaacttgaggactctgcaggcggaagaagacactctgccttccgccgagaccgcgctaattttgcataggaaaggcttcgactgtgggctggaagccaagaatctcggattcaactgcactactagtcagggcaaagtcgccctgggtagcttatttcacggattggatgtggtcttcctgcagccgacaagcctgacacttctttatcctctggccagccccagcaatagtacagatgtatatctagagcctatggagattgccacgtttcgtcttaggctcggatag

SEQ ID NO: 229535 - DNA, 1023 bp, Artificial Sequence
  Description of Artificial Sequence: Synthetic coding sequence
atgcaggtctggtttagtggcctgacaggattgctgaaaccttatgtgcctaaagaaccacccgtcctcagagttactgagggtcccttcttttctgaggtcgtagcctattatgaacacattcatcaggcagttcgcttatacaacctccccggagtggagggcctaagcctcgacatctcttcgctcgtggacatccgcgactacgtgaataaggaactcgctctccacatccacactgacattgacagtcagggcattttttttaccgatctgaacggctttcaggtccagccgcgaagatacttgaagaaactgccactccaggccaacttctatcctatgcctgtaatggcttacattcaggacgcacagaaacgcctcacattgcacacagcccaggcgcttggggtgagtagtcttaaggacggacaactagaggttatcctggatagacgcttgatgcaggatgacaaccggggactgggccagggcttgaaggataacaagcggacttgcaacagatttagactgctcttggagcgcagaacagttgggagcgaagtccaagatagccactctacgtcttatccctccctcctgtcacacctcacatccatgtatctgaatgcacccgctcttgcgctgcccgtggccagaatgcaattgcctgggccaggcctcagaagcttccaccccttggcctcttctctgccttgtgacttccacttgctaaatctgaggacacttcaggctgaggaagataccctcccgtccgcggagactgcacttattcttcacagaaaaggcttcgactgtggcctcgaagccaagaatctggggttcaattgcactacaagccaaggcaaagtcgcattgggctccctgttccacggactggacgtcgtgtttctgcagcctacttcactcacactgctgtatcctctcgcatcccccagcaactcgactgacgtctatttggagcccatggaaattgccaccttccggttaaggctgggctag

SEQ ID NO: 229536 - DNA, 1977 bp, Artificial Sequence
  Description of Artificial Sequence: Synthetic coding sequence
atgacgagcgacatgacatcccctagatccgggatgccttccagctccacgacgaatggatccctgacatctagtactgcaggacttacatcaatgtgcaggggtgccgaggtgctctatagcctagcagccgcacacgcaagaagatctggcctagctgggcgttacccactttccgactttacgttgctaaccgaagcccgacggaccttaggcctgttccagcaccacgatgctatcaccggaacagccaaggaggcggtcgtggtggactacggagtcaggttgctgaggtctcttgtgaacttgaagcaagtgattatccacgctgcccactacctagttctgggggataaggagacttaccacttcgatcccgaagcgccttttctacaggttgatgataccagattaagccatgatgcactgccagagcgcaccgtcatacagcttgactctagtcccagattcgttgtgttgttcaatcccctggaacaggagcgcttctccatggtgagtctcttggtgaattcccctagggtgcgcgtgttgtccgaagagggacagcccctggccgtccagatctctgctcactggtccagtgccacagaggccgtacccgacgtctaccaggtttccgtgcccgtgagactgccggctctgggactgggagtgctgcagctacaactgggcctcgacgggcaccgaactctccctagcagcgtgcggatctatctacacgggcgtcagctgtccgtaagccgccacgaggctttcccacttagggtaatcgactccggtacctccgacttcgcactgagcaatcgttatatgcaagtttggtttagcggcctgactggtctattaaagtctatcagacgagtcgatgaggaacatgaacagcaggtggatatgcaagtcctagtgtacgggacacgtacaagtaaagataaaagtggtgcttatctctttttacccgatggagaagctaagccttacgtcccaaaagagccccctgttttgagggttacagaggggccttttttttctgaggtcgtggcatactatgaacacatccaccaggctgtgagactctacaaccttcccggtgtggaaggcctctcactggacattagcagcctggttgatattcgagattatgtcaataaggaactagccttgcatatccacacggatatcgactcacagggaatttttttcacagatctgaacggcttccaagtgcagcctcgaaggtatctaaagaaactgcctctccaggcgaacttttaccccatgcctgtgatggcgtacattcaagatgcccagaaaaggcttacactccatactgcgcaggccctgggtgtgagttccctgaaggacggccaactggaggtgattcttgacagacgcttgatgcaggacgacaacagaggactggggcagggcctgaaagacaacaaacggacttgcaacagattcaggctgctgctggaacgacgaactgtcggctctgaagtgcaagactctcatagtacttcctatccttcactgttaagtcatttaacctccatgtacttaaatgcaccagccctggccttgccagttgcgagaatgcagctccctggacctggcctgagaagtttccatccactggctagctctctcccctgcgatttccaccttctgaatctcagaacactacaggccgaggaggatacgttgcccagcgccgagaccgctctgatcctgcataggaagggatttgactgcgggctggaggctaaaaacctgggatttaactgcacgacctcccaagggaaggtggcattaggtagtctgttccacgggcttgacgtggtgtttttgcaaccaaccagtttaacactgctgtatcccttggcaagcccaagcaattctaccgatgtctatctggaacccatggaaatagcaacatttcggttgcgtctgggttag

SEQ ID NO: 229537 - DNA, 219 bp, Artificial Sequence
  Description of Artificial Sequence: Synthetic coding sequence
atgaaattaaagaaacaggtaaccgtctgcggcgctgcaatcttctgcgtcgctgtgttcagtctctatctgatgcttgatagagtgcagcatgatccgaccagacatcagaacggcggaaattttcccagaagtcagatctctgtgcttcagaatcggatcgagcagctggagcagttgctggaagaaaaccatgaaataatatcccacataaagtag

SEQ ID NO: 229538 - DNA, 153 bp, Artificial Sequence
  Description of Artificial Sequence: Synthetic coding sequence
atgaagctcaaaaaacaggtcacggtatgtggagccgctatattctgtgtggccgttttttcactgtaccttatgttggaccgggttcagcatgatccaacccgccaccaaaacggaggaaacttcccgcgaagtcaaatttctgtgttatag

SEQ ID NO: 229539 - DNA, 3192 bp, Artificial Sequence
  Description of Artificial Sequence: Synthetic coding sequence
atgctcccctactatacggtgaacgggagctgggtggtgccgccagagcccagaccatcattcttcagcatatccccacaagactgccagtttgctctagggggaagggggcagaaacctgagcttcagatgctgactgtgtccgaggagttgccgttcgacaatgtggacgggggtgtgtggaggcagggtttcgacatatcttacgacccgcatgattgggatgcggaggatttgcaggtgtttgtcgtcccacactcgcataacgatccaggatggatcaaaacatttgacaaatactacaccgagcagactcagcacatcttgaattcaatggtgagcaaactacaagaggacccacgcagacgatttctttgggccgaggtttcctttttcgcaaaatggtgggacaacataaatgtgcagaaaagggccgcagtccgacggttggttggaaacggccaactcgagattgcgactggcggttgggttatgcctgacgaggccaacagccactattttgcccttatcgatcaattgatcgaaggtcatcagtggctagagcgcaatctgggcgcaacccctcgttcaggatgggccgttgatcccttcggctacagcagcacgatgccttatctgttaagaagggctaatctgacaagtatgctgattcagcgggtacactacgccattaagaaacattttgccgctacacactccctggagttcatgtggaggcagacttgggattctgattcgtctaccgacatcttttgccacatgatgcccttttactcgtatgacgttcctcatacctgcggccctgacccaaagatttgttgtcagtttgattttaagcgacttcctgggggaagaatcaactgcccatggaaggttcccccacgcgctataacggaggccaatgttgccgagagggcagctctgttacttgatcagtatcgaaaaaaaagccagctgttccggtcaaacgttctgttagtgcctctgggggacgatttcagatatgacaagcctcaggaatgggacgcgcaatttttcaattaccagaggctcttcgatttttttaatagcagacctaacctccatgtgcaggcgcagtttggaacactatccgactatttcgatgctctctataaaaggacgggcgtggagcccggagcgaggcctccgggattccccgtcctgtcaggcgattttttctcctacgccgaccgggaagatcattattggacaggctactacaccagcagacccttttacaagagcctggacagggtactggaagcgcaccttcgaggagcagaagtgttgtactcgcttgccgctgcccacgcaaggcgttcaggcttggcaggaaggtatccactcagcgatttcactctgctgaccgaggccagacgtacccttgggctttttcagcaccatgacgccatcaccggaacagcaaaggaagccgtcgttgtggattatggggtcaggctgctgcgatctctcgtcaatctgaaacaggtcatcatccacgccgctcattacctggtattaggggataaggagacataccacttcgatcccgaggccccatttttacaggtagatgatactagacttagccatgacgccctgccagagcgaaccgtgatccaactcgacagcagcccaaggtttgtggttctgtttaatcctctggaacaggagcgtttttctatggtgtcgctgctcgtgaattctcccagagtcagagtgctcagcgaggaaggtcagcccttagcagtgcagattagcgcccattggagctcggcaacagaggcagtgcccgacgtgtaccaggtgtcagtcccagtccggcttcccgcactagggttaggagtgctgcagcttcagcttggtctcgacggtcaccggactttgccctcatctgttagaatttacctacacggaagacagttgagtgtgtcaaggcacgaggccttccccctccgagtcatcgatagcggaactagcgattttgcgttgtctaatcgctacatgcaagtctggtttagcggactaaccggtcttcttaagtccattagaagggtcgatgaggagcatgagcagcaggtggacatgcaagtgcttgtctacggcactcggactagcaaggataagagcggcgcttacctcttcctgcccgacggagaggcaaagccgtacgtgcctaaggaacccccagttcttcgcgtcaccgagggacctttcttttccgaggtagtggcttattacgaacacatccatcaggccgtacgactgtacaacctgccaggcgtcgagggactcagcctcgacattagtagccttgtggatattcgtgattatgtaaacaaagaactcgcccttcatatacacaccgatatagatagccaaggaatatttttcactgacctgaacgggtttcaggtgcagccacggaggtatctaaagaaattgcctctgcaggctaacttttatccgatgccagttatggcttatattcaggacgcgcagaaaaggcttaccttacacaccgcccaggcgctgggagtgagcagcctgaaggacggccagctggaagtgatcctagaccggcgactgatgcaagacgacaatcgtggcctgggccaggggcttaaggataacaagcgtacatgcaatcgtttcagacttttgctggagagacgaaccgtgggaagcgaggtacaggattcacatagtacatcttacccttcgctcttgtcacacctgacctcaatgtatctgaatgccccagcactggctctccctgtcgccagaatgcagctcccgggacccggtctgaggagctttcacccactggccagttcattaccttgtgacttccacttgctcaacttacgaaccctccaggccgaagaggacacacttccatctgccgaaaccgcgttgatcctgcacagaaaaggcttcgactgtggcctcgaggcaaagaatttgggcttcaattgcaccaccagtcaagggaaggtcgctcttggttctctatttcatggcttagacgttgttttcctgcagccaaccagcctcactttgttgtacccacttgcttctccatccaatagcacagatgtgtacttggagccaatggagatcgctacgttcaggctgcggctgggatag

SEQ ID NO: 229540 - DNA, 231 bp, Artificial Sequence
  Description of Artificial Sequence: Synthetic coding sequence
atgaaactgaagaaacaggtgactgtctgcggggctgccatcttctgtgtggccgtgttcagcttatacctcatgctggatcgggtccaacacgaccctacgcgtcaccagaatgggggtaactttccgagatcccaaatttctgtcctgcagaatcggattgagcagttggagcagcttctcgaggagaaccatgagattatctcacacatcaaggactccgtactatag

SEQ ID NO: 229541 - DNA, 363 bp, Artificial Sequence
  Description of Artificial Sequence: Synthetic coding sequence
atgaagctgaagaagcaggtgaccgtttgcggcgcagccattttctgcgtcgcagtgttttccttgtatctgatgctggaccgcgtccagcacgaccccactaggcatcagaacggcggtaacttccctaggtcccagatctccgtcctgcagaataggatcgagcaactggaacaacttctcgaagagaatcacgagataattagccatatcaaagattccgtgctggaactgactgcgaacgcagaaggaccgcctgccatgctgccttactatacagtgaacggctcttgggtcgtcccaccggaacctcgaccctctttttttagcatctcgccacaggattgccagtttgctctgtag

SEQ ID NO: 229542 - DNA, 3123 bp, Artificial Sequence
  Description of Artificial Sequence: Synthetic coding sequence
atggcagcagccccagccctcaaacattggcgcactaccctggagagggtagaaaaattcgttagcccgctctactttactgactgcaatctccggggaagactcttcggcgcatcctgcccggtggccgtgctcagttcctttctgactccagaaagattaccctaccaagaagccgtccagagggactttagacccgctcaagtgggggactcttttgggcctacctggtggacctgctggtttcgcgtggagctcactatccccgaggcctgggtggggcaagaggtgcacctctgttgggagtcggacggggaagggctagtgtggagggacggggagcccgtgcagggcctcaccaaggaaggggagaaaacgagctacgttcttactgacagattaggcgaacgcgaccctcgctctctcacattgtacgtagaagtcgcatgcaacggactcctaggcgcagggaaaggctccatgatcgctgccccagatccggagaaaatgttccagctttcccgagctgagctggccgtgttccacagggacgttcacatgttacttgtggacctggagttactcctcggcattgccaagggcttaggaaaggacaatcagaggtccttccaagccttatatacagcaaatcagatggtaaatgtgtgtgacccggctcagcccgagactttccctgttgcccaggcgcttgcctcacgattcttcggacagcacggtggggagtctcagcacaccatacatgccaccggccattgccatattgatacagcgtggctgtggccattcaaggaaaccgtccggaaatgcgcacgcagctgggtgactgccctacaactaatggagcgcaatccggaattcatctttgcttgttcacaggcccagcagcttgagtgggtaaagagcagatatcccggtttatacagccgtattcaggagttcgcttgtcgagggcaatttgttccagtcggaggtacatgggtagagatggacggcaatctgccctctggggaggcgatggttcggcagtttctgcaggggcaaaacttcttcttgcaggagtttggcaagatgtgcagcgagttctggctgcccgatacattcggctatagcgctcagttgccacagattatgcacggttgtggcatcaggcgcttcctgacccaaaaactctcttggaacttagttaacagcttcccacaccacactttcttttgggaaggcctagacggctcacgggtgttagtgcacttcccaccaggggattcctatggaatgcagggctccgtggaggaagttctgaaaaccgtggctaacaaccgtgataagggacgtgccaaccatagtgcgtttttgttcggattcggagatgggggaggcggtcccactcaaaccatgctggatcggctgaaaaggctttccaataccgacggactgccaagagtccaattgtccagccctcgccagcttttttccgccctggagtctgatagcgaacagctttgcacttgggtcggtgagctgtttctcgagctgcataatgggacatataccacacacgctcaaatcaagaagggcaaccgtgagtgtgaaaggatcctgcatgacgtggagcttctgtcctcgctcgctttggccagatccgctcagtttctctatcctgccgcacagttgcagcacttgtggcggttgctgctacttaaccagtttcatgacgtggtgactgggagctgcattcagatggtggccgaggaagccatgtgccactacgaagacattcgctctcacgggaacacactcctttcggcagccgcagctgcactttgcgcaggcgaaccaggaccagaagggctgctgatcgtgaatacccttccttggaagagaatcgaggtcatggcactgccaaagcccggaggcgctcactctctagccctggtgacggtgccttccatgggttatgcccctgtacccccacccacctctctacagcctctcctgcctcagcaacccgtcttcgtggttcaggaaaccgacggtagcgtgacgcttgataatggaatcatacgcgtgaagctggatcccacaggacgccttacatccctggttctcgtagcctctggacgggaagccattgctgaaggcgcagttggcaaccagtttgtgctgttcgatgacgtcccactgtattgggacgcgtgggacgtgatggattaccacctggaaacaagaaagcctgttctcggtcaggcaggcacactggctgtgggaaccgaaggtggactgaggggctcggcatggttcctgctacagatttctcccaatagtcgcttgagccaagaggtcgtacttgatgttggttgcccttatgttagattccacacagaagtgcactggcatgaggcccataaattcttaaaagtcgaatttcccgctcgtgtcaggtcctcgcaagccacatatgaaatccaattcggacatcttcaacggcctacacattataataccagctgggattgggcgagatttgaagtgtgggcccatagatggatggacctgtccgagcacggctttggcttggctctgctgaacgattgcaaatacggagcatcagttcggggatccatactgtcactctcactactacgggctccaaaggcgcctgatgcaactgctgataccggcagacatgagttcacttatgcactgatgcctcataagggcagtttccaggatgccggagtgattcaggccgcttattccctcaattttccgttattagcgttgcctgcccctagccccgcacccgctacttcatggtccgcattctccgtcagttctccagctgtggtacttgaaaccgtaaagcaggcagaatcttcacctcagcgccgaagtctcgtgttaagattgtatgaggctcatggatcacacgtggactgctggctgcatctttctctccccgtccaagaagccatcttatgcgacctgctggaaaggccagatcccgctggacatctcactctgagagataatcggctcaaactcaccttctcccctttccaggtgctgtcccttctgctcgtgctccaacctccacctcactag

SEQ ID NO: 229543 - DNA, 630 bp, Artificial Sequence
  Description of Artificial Sequence: Synthetic coding sequence
atggctgccgcaccagctttgaaacactggcggacaactctcgagagagtggaaaagttcgtttctcccctctattttacagactgcaacctgcggggtcggcttttcggagcaagttgccccgtagctgtgctgtccagcttccttactcccgaacggctcccctatcaggaagccgtgcagagagacttccgacccgctcaggtgggagatagttttggacccacctggtggacatgttggttccgggtcgagttaaccatacccgaggcctgggtggggcaggaggtccatctctgctgggaatcagatggcgaaggtttggtgtggagagacggggaacctgtccaggggctgacaaaagagggggagaaaactagttatgtgctgaccgatcggctcggcgagcgggacccaaggtctcttaccctttacgttgaggtggcgtgcaacggcctgctgggagcaggcaaaggttctatgatagctgctcccgaccctgagaaaatgttccagctctcgagggccgagcttgcagtgttccaccgcgacgtgcacatgctgctcgtggacttggagctcttgctggggatcgcaaaacccggatttggccctagtaaacggttatag

SEQ ID NO: 229544 - DNA, 2910 bp, Artificial Sequence
  Description of Artificial Sequence: Synthetic coding sequence
atggccgaggacgacccctatctcggccgaccggaacaaatgtttcacctcgacccatcactgacgcataccatctttaatcccgaagtgtttcagcctcagatggctttacccaccgcggacggaccgtatttacagatcttagaacaacccaaacagcgcggtttcagattcagatacgtgtgtgagggacccagtcatggcggtttgcccggtgcctcttcagaaaagaataagaagtcctatccacaagtgaagatttgcaactatgtgggcccagcaaaggttattgttcagctggtgactaacggcaagaatattcacctgcacgctcattcactggttggtaagcattgcgaggacggaatttgcactgtgaccgccggacctaaggatatggttgtgggcttcgcaaatctgggaatcttacacgttacaaaaaagaaggtcttcgagaccctggaggcaaggatgacggaggcttgtatcagaggttacaatcccggtctcctggtccatcctgacctagcctatcttcaggccgagggcggaggagatcgacagctaggggatcgcgagaaggagctcatccgccaggccgcactccagcaaaccaaggagatggacttgtctgtggtgcgcctaatgtttactgctttcctcccagattctactggatcttttactcgccgtctggaaccagtcgtgtctgacgccatctacgactcaaaagccccaaatgcatccaatctgaagattgtgaggatggatcgtactgctgggtgcgtcacagggggagaggaaatttatctcctctgcgacaaagtacagaaagacgatatccagatccgcttctacgaggaggaggagaacgggggagtttgggaagggttcggcgacttttcgccaaccgacgttcaccgccaatttgccatagtctttaaaacccccaaatataaggacattaacataacaaagcccgcatccgtcttcgtgcagctccgtcggaaaagtgatttagagacttcggaaccgaaaccctttctctattaccctgaaatcaaagataaagaagaggtccagcgaaagcgccaaaaattgatgcccaatttctctgattcattcgggggtggaagtggggctggtgccggaggaggcggaatgttcggtagcggtggaggcggagggggtactggaagtactggacccggatactcctttccccactatggctttcccacctacggaggtattactttccatcctggcactactaagtctaacgctggaatgaaacatgggacgatggacaccgagtctaagaaagaccctgaaggttgcgataaaagtgacgacaaaaataccgtcaatctcttcgggaaggtaatcgagacaactgagcaggatcaagaaccctccgaagctacagtgggcaacggcgaggtgacactcacatatgcaacagggactaaagaagagtcagccggtgtgcaggataacctttttttggaaaaggcgatgcaattggctaagcgccacgcaaatgcgttattcgattatgccgtgaccggcgatgtcaagatgcttctggctgtgcagcgtcatctgaccgctgtacaggacgagaacggtgactctgtgctgcatctggccattattcacctgcattcacagcttgtgcgtgatctgttagaggtcacttctggcctgatcagtgacgatattattaatatgagaaacgacttgtaccaaaccccacttcatctggccgtaataaccaagcaggaagatgttgtagaggacctgctccgggctggcgctgatttgtctcttttagatcgcctgggcaatagtgttctccatttagcagcaaaggaggggcatgacaaggtcttatcgattttgctgaagcacaagaaggctgccctgcttctggaccaccctaacggggatggtttaaatgcaatccacctggcaatgatgtccaacagtcttccatgccttctcttactagtagccgctggcgctgatgtgaacgcccaggaacagaagtctggccgaactgccttacacctggcagtagagcacgacaacatatcactagccggatgtctcttactggaaggagatgcacacgtcgattccaccacctatgacgggactacccccctacatattgccgctggccgtggaagcacaagactggcggctctgctgaaagcagctggcgcagatccactggtggaaaatttcgaacctttatacgatctggacgattcttgggagaacgccggagaagacgagggggtcgtgccgggaaccactcccctggatatggctactagctggcaggtatttgacatcttgaatggtaagccctacgagccagaattcacaagcgatgacctactggctcaaggcgacatgaaacagctagcggaagatgttaagctgcagctttacaagctgttggaaattcccgaccccgataaaaactgggccaccttagctcagaagctggggctggggatcctcaataatgcgttcaggttgtctccagccccaagcaagaccttgatggataactacgaagtaagtggcggaacagtccgcgaacttgtcgaggcactgcgccaaatggggtatacggaagccattgaagtaatccaggccgctagctcccccgttaagacgacttcccaggctcatagtttgcctctgagccctgcctcaacgcgtcagcagatagacgagttgagagattcagattctgtatgtgatagtggagttgaaacttcgttccgcaagctcagcttcacagagtcattgacatccggagcatctctgttgacgcttaacaagatgccccacgactacggccaggagggtccactggaaggcaagatatag

SEQ ID NO: 229545 - DNA, 1389 bp, Artificial Sequence
  Description of Artificial Sequence: Synthetic coding sequence
atggcgaaattcagacggaggacctgtattatcctcgctttgtttatcttattcatattctcccttatgatggggctcaagatgttgcggcctaataccgctaccttcggcgcaccatttggcctggatctgttgccggaactgcaccagaggaccatacaccttggtaagaactttgatttccagaagtccgaccgaattaattctgagacgaacacgaaaaatctcaaatctgtggaaattaccatgaagccctccaaagcctctgagcttaatctggatgaacttcctcctctcaacaattatctgcatgtgttctattattcctggtatggcaatccccaatttgatggtaagtatatccactggaatcatcccgtacttgagcactgggaccctaggatcgccaagaattaccctcagggcaggcataacccacctgatgacattggatcatccttttatccagagttaggcagctattccagcagggatccctcagtgatcgaaacgcacatgcgccagatgcgcagcgcgtcaataggggttctcgcactcagctggtaccccccagatgtcaatgatgaaaacggcgaacccaccgataaccttgtgcctaccatcttagataaggctcacaagtataacctgaaggtaacattccatatagaaccatactctaacagggatgaccagaacatgtacaaaaatgtcaaatacattattgacaagtacggaaaccatcccgctttctacagatacaagactaagactggcaatgccctgcctatgttttatgtgtacgattcttatatcacgaaacccgaaaagtgggccaacctcttgaccacctccggatcacgatctattagaaacagcccctatgatggcctgttcatcgctctgctggttgaggaaaagcacaaatatgacattctccagagtggtttcgacggtatatatacctactttgctacgaacggctttacatatggcagctcccaccaaaactgggctagtctcaagcttttctgcgacaagtataatctgatcttcataccctcagtgggtcctggatatattgacactagtatcaggccgtggaacacgcaaaacactagaaacagaataaacgggaagtattacgaaatagggctgtccgctgcactccagacccgaccctctctgatttctatcactagctttaatgaatggcacgagggtactcagatcgagaaggccgtcccaaagcggacaagtaacactgtgtacctcgattaccggccacacaaacctggcctctacctggaactgacacggaagtggagcgagaagtactctaaggagagggctacttatgctctggatcgccagctgcccgtgagttag

SEQ ID NO: 229546 - DNA, 597 bp, Artificial Sequence
  Description of Artificial Sequence: Synthetic coding sequence
atggctaaattccggagacggacctgcatcatattggccctttttatcttgttcattttttctctgatgatggggctgaagatgctgcgacctaataccgcaacttttggggcacctttcggcttggacctgctgcctgagttgcaccaaaggacaatccacctaggtaaaaactttgacttccagaagtccgaccgcatcaacagtgagactaataccaaaaatctcaaatccgtggagattaccatgaaacccagcaaagcctccgagttaaacctggacgagctgccacctctgaataattatctgcacgtcttctactactcctggtacgggaaccctcagttcgatggcaagtatattcactggaatcatccggtgttggagcactgggacccccgaattgccaaaaattatccacaaggacgccataacccccctgatgacattggctcttccttctaccctgaacttggaagttatagctcacgggatccatcggtgattgagacccatatgcgccagatgcgctctgcatctatcggcaactattgcatctatatttacgtgtgtctctgtctatacatctgcatctag

SEQ ID NO: 229547 - DNA, 624 bp, Artificial Sequence
  Description of Artificial Sequence: Synthetic coding sequence
atggcgaagtttcgacgaagaacatgtataatcctggcactgtttattctgttcatctttagtctcatgatgggcctcaagatgttgagacctaacactgccacatttggcgcacccttcggtttggacctactccctgagttacatcagcgcactatacacctaggaaagaacttcgactttcagaagtccgacaggattaacagcgagactaataccaaaaacctcaaaagtgtggagatcacgatgaagccatctaaggcttctgaacttaacctggacgagctccctcccctgaataattatcttcatgtcttctactacagctggtatgggaacccgcagttcgatggaaagtatatccactggaaccatccggtgctggaacactgggatccacgcatcgcaaagaactatcctcaggggcgacataacccccctgacgacattggctcaagcttttacccagagttgggaagttactccagtagggacccctcagtgatcgagactcacatgaggcagatgcgaagcgcttctatcgggaattactgtatatacatttgtgtgtttgtgtcggtttatatgcatatcaacgacttcttgtgtaatttcacatcctag

SEQ ID NO: 229548 - DNA, 2379 bp, Artificial Sequence
  Description of Artificial Sequence: Synthetic coding sequence
atgatcacagtcaacccggacgggaaaataatggtccgaaggtgcctggtcacactcaggcccttcaggctatttgtgttgggaataggcttctttactctgtgctttctgatgactagtctgggaggacaatttagcgcgcgacggctgggcgattcaccatttaccatcagaactgaggtgatggggggtccagaatctcgcggagtactccgaaagatgagcgatctgctggagctcatggtcaagcgcatggatgcactggccagattagaaaacagttctgaactgcacagggccggtggagatctgcattttcccgctgacaggatgcccccaggtgcgggactcatggagcgtattcaggccatagctcagaacgtctctgatatcgccgttaaggtcgaccagattctgagacattcgctgctcctccacagcaaagttagcgagggacggagggaccaatgtgaggcaccaagcgatccgaaattcccagattgcagcggaaaggtggaatggatgcgagcacgctggacttctgatccttgctacgccttttttggcgtggatggaaccgagtgctcattcttaatttacctatctgaggtagagtggttctgcccaccgctgccttggagaaaccagactgccgctcaacgcgcaccgaaacctctgcctaaggtacaagccgtcttcaggagcaatttgtcacatctgttagatcttatgggatctggaaaagaaagcctcatattcatgaagaagagaactaaaagactgaccgcacagtgggccctggccgctcaacgccttgcacagaagctgggcgcaactcagagggatcagaagcagatcctggtgcacattggctttctaactgaagagtccggcgacgttttcagcccaagggtgctgaaaggaggcccactgggcgagatggtgcagtgggccgacattctaaccgctttgtacgtgttgggccacgggctgcgggtcactgtgtccctgaaggaactccagtccaatctcggagttccgcctggcagaggcagctgcccgctgacaatgccactgccttttgatcttatctataccgactatcacggcttacagcagatgaaacggcacatgggcttgtccttcaagaaatacaggtgcaggattcgcgtaattgatacatttggcactgagcctgcctataatcacgaagagtacgccactttgcatggttatagaaccaactggggatactggaaccttaatccaaagcagttcatgacaatgtttccacacactcccgataacagctttatgggcttcgtgtccgaagagctgaatgaaactgaaaaacggctgatcaaggggggtaaagcctccaacatggcagtagtgtacggcaaggaggcctcgatctggaaactgcagggcaaggaaaagttcttgggcatcttgaacaagtatatggaaatccacggcaccgtgtattatgagtctcagcgccctcctgaagtgccagcctttgtcaagaatcacggactactgcctcaaccagagttccagcaactgctgaggaaggccaaactctttatcggcttcgggtttccgtacgaaggtcccgctcccctcgaggccatagccaacggctgtatctttcttcaaagtcggttcagccccccacacagttcacttaaccatgaatttttccgcggaaagcctaccagccgggaagtgttttcgcaacacccctacgcagagaactttatagggaagcctcacgtatggacggtggattacaataattctgaggaattcgaagcagccataaaggccattatgagaacccaggtcgacccatacctgccctacgagtatacctgcgagggaatgcttgagaggattcacgcctacatacagcaccaagacttttgtagggccccagaccccgctttgccagaggcccacgccccacagtcacctttcgtgttggcgcctaacgcaacccacctggaatgggcccgtaacactagtctcgctccaggcgcttggcccccagcccacgcccttcgagcctggctggcagtgcctggacgggcttgtaccgatacatgcctcgaccacggcctgatttgtgaaccaagcttctttcctttcctcaacagtcaggatgccttccttaaactccaagttccatgcgactccaccgagtcagagatgaaccacctctatcccgcatttgcccaaccagggcaggaatgctatctccagaaggagcccctgctcttctcatgtgccggatcaaacacaaagtacaggcgactctgtccttgtagagacttcagaaagggacaggtggccctctgtcaaggatgtctgtag

SEQ ID NO: 229549 - DNA, 1338 bp, Artificial Sequence
  Description of Artificial Sequence: Synthetic coding sequence
atgctcaagaaacagagcgccggtctcgtcctgtggggagccatcctatttgtggcatggaatgctttgcttcttttgttcttctggacaagacctgcccctgggaggcctccatccgtttccgcgctcgacggggatcccgcttccttgacccgggaggtgatcaggctagcccaggacgcagaggtggaactcgagcgtcagaggggtctgctgcaacagataggagacgccctttcttctcaacggggaagagtgcctacagctgcccctcccgctcagcctcgggtgccggtaaccccagcccctgctgtaatccccattctggtgattgcctgcgacagatctacagtacgtagatgcctcgataaactcctgcattatcgcccatcagcggaactcttccccatcatagtgtcccaggattgtggccatgaggaaacggctcaagccattgcctcgtatggatccgcagtgacccacattcgacagcctgatttatcaagcattgccgtaccaccggaccataggaaattccaggggtactacaaaatcgctcggcactatagatgggcactgggtcaagtgttccggcagtttcgctttcccgcagcagtggtggtggaggacgatctcgaagtcgctccagatttcttcgagtacttccgagcaacctacccacttctgaaagccgatccctccctttggtgcgtgtcagcatggaacgataatgggaaagagcagatggtggatgcttccaggcccgaacttctctaccgcaccgatttctttcctggacttggctggctcctgttagcagagctttgggctgagctggaacccaagtggccaaaagccttttgggatgactggatgagacggccagaacagcggcagggcagagcctgcatccggcctgagattagtcgaactatgacattcggacggaagggagtttctcacggacagttttttgaccagcacctgaaattcatcaagctgaaccaacaattcgttcacttcactcagctggatttgtcatatcttcaacgtgaagcctacgatagagatttccttgctcgggtgtatggcgctccacaacttcaggttgaaaaggtccgaacaaacgaccggaaggagctgggcgaggtgagagtgcagtacacgggtcgggacagcttcaaggcatttgcaaaggctctgggcgtcatggatgatcttaagtccggtgtccccagggccggttataggggaattgtgacttttcagttccgtggtcgtcgcgtgcatctggcgcctcccctgacctgggaggggtacgaccccagctggaactag

SEQ ID NO: 229550 - DNA, 1338 bp, Artificial Sequence
  Description of Artificial Sequence: Synthetic coding sequence
atgctgaagaagcagagtgctggcctcgtgttatggggagctatactctttgtggcttggaacgcattactcctgctgtttttttggacccgtccagcacccggaagacccccaagtgtgtctgccttggatggcgatcctgcctccctcaccagagaagtaattagattagcacaagacgcggaggtagaattagaaaggcaacggggactgcttcaacagattggggacgccttgagcagccagaggggtagagtcccaaccgctgccccacccgctcagcctcgggttccagtgacccccgctcccgctgtcatccccattttggtcatagcgtgcgacaggagcaccgtgcgcagatgtctggataagttacttcactatcgtcctagcgcagagctgttcccgataattgtgtctcaggactgtggtcacgaagaaactgcccaggcaatcgcgtcttatggaagcgccgtgacacacattcgacagccagatcttagttcaattgccgtgccgcctgatcaccggaagtttcaggggtattataaaattgccagacactatcgctgggctctcgggcaagtcttcagacaatttaggttccctgccgctgtggtagtggaggatgatctggaagtggctcccgatttttttgagtatttccgggctacataccctctcctgaaagcagaccccagcctctggtgcgttagcgcgtggaacgataacggcaaagagcagatggtcgacgcttcacggccagaattgctgtacaggaccgacttcttccctggactggggtggttactcttggcagagttgtgggccgaactggaacccaagtggcccaaggctttttgggacgactggatgcggcgacctgagcagcgccaaggcagggcgtgtatccggccagagattagccgtacaatgacattcggcagaaaaggggtcagccacggccagttctttgatcagcacctgaagttcatcaagctgaatcagcagtttgtgcattttacacagctggacctgagttacttacagcgcgaggcatacgatagggatttcctagcacgagtatatggagcaccgcagctgcaggtcgagaaggtgcggactaacgatcggaaagagctgggggaagttcgagtccagtacactggaagagacagtttcaaggcattcgctaaagccctgggagttatggatgacctgaagagcggcgtccctcgagctggttaccgcggaatagtcacctttcaatttagagggagaagagtgcacctggcccctcccctcacctgggagggctacgatccttcctggaactag

SEQ ID NO: 229551 - DNA, 1338 bp, Artificial Sequence
  Description of Artificial Sequence: Synthetic coding sequence
atgctcaaaaaacagtccgcaggtcttgtcttgtggggagctatcctctttgtcgcatggaacgcgctgctactcttgttcttctggacacggccagcccctgggcgacctccatcggtgtcagcactggatggggaccccgcatccctgactcgagaagtcattagactagcgcaagacgctgaggttgaactcgaaagacaacgtgggttactccagcaaatcggagacgccctttcttctcagcggggaagagtgcctaccgcagcccctccagctcagccccgtgtccctgtgacaccagcacccgcagtcataccaattcttgtcattgcttgtgatcggtcaaccgttcggagatgcctagataagctgttgcactaccggccttcagccgagcttttcccaattattgtgagccaagattgtggccatgaagagaccgcacaggccattgcctcctatggctctgccgtgactcacatccgccaacccgacctatcgtccatagctgtgccgccagaccatagaaagttccaggggtactacaagatcgccagacactatcgttgggcacttggccaggtattccgccagttccgctttccggcagcagtcgtggtcgaagacgatctcgaagtggcaccagacttctttgagtacttccgtgccacctaccccttactcaaagccgatccctccctgtggtgtgtgagcgcatggaatgataacggtaaggagcagatggttgatgctagtcgccctgagctcctgtaccggacagattttttccccggtctcggctggctgctcctggccgagttgtgggccgagcttgaacctaagtggcctaaggcgttttgggatgattggatgcgtaggcccgaacagaggcagggcagagcctgtattcggcctgagattagccgcaccatgacattcggacggaaaggtgtcagccatggacaattctttgatcagcacctcaagtttatcaaacttaaccagcagttcgttcatttcactcagctggacttgagttacctgcaaagagaggcctacgatcgggacttccttgccagagtgtatggggctccccagctccaagtcgaaaaggtgcgtaccaatgatcgcaaagagctgggtgaagtgcgtgttcaatataccggaagggacagctttaaagccttcgcaaaggcccttggtgtcatggacgacctcaaaagcggtgtgcctagagcaggctataggggcatcgtcacatttcagttccggggaagacgcgtgcatctggccccacccctgacctgggagggatatgaccctagttggaactag

SEQ ID NO: 229552 - DNA, 1338 bp, Artificial Sequence
  Description of Artificial Sequence: Synthetic coding sequence
atgcttaagaagcagtctgccggactggtgctgtggggtgcaattctctttgtcgcttggaatgcactccttctgctgtttttctggacacgcccagcgccaggaagacctccctccgtgagtgctctggatggcgacccagcatctctgactagggaggtcatacggctcgcccaggacgccgaggtggagctcgagcgccagagggggttacttcagcagattggagacgcactctcatctcagaggggcagggtgccaaccgctgccccacctgctcaacccagggtgcccgtcaccccggcaccagccgtcattcccatcctggtcattgcctgtgaccgcagtacagtacggcgatgtctcgataagctgctgcattaccggccttctgctgaactctttcctatcatagtgagtcaggattgcggacatgaggaaacagcccaggccattgcaagttatgggtccgcagttacccacatacgccagcccgacctctcctccatcgccgtcccaccggatcacaggaagtttcagggatactacaagatcgcaagacactaccgttgggccctggggcaagtcttccgccagttcagattcccggcagcggttgttgtggaggacgatctcgaggttgccccagactttttcgagtactttcgggctacttacccgctcctgaaagccgacccctccctgtggtgcgtaagcgcctggaacgacaatggcaaagaacaaatggtggacgcatctaggccggaactgctgtatagaaccgactttttccctggcctcggttggctcctcctcgccgagctgtgggctgagttggaacccaagtggccaaaggcgttctgggatgactggatgcgacgacctgaacagcgacaggggcgagcctgtatacgacctgaaatcagtaggaccatgacattcggacgaaaaggtgtctctcacggccaattttttgaccagcatctcaaattcatcaaattgaaccagcaatttgtgcactttactcagctggacttgtcgtatctgcagagggaggcttatgatagggattttctggcccgtgtgtatggtgcaccccagctccaggtcgagaaagtgcggacgaacgatcggaaggaattaggcgaggtgagggttcagtataccgggcgagacagttttaaggccttcgcaaaggccctgggggtgatggacgatcttaaatctggggtcccacgcgcaggatataggggaatcgttacattccagttccgcggacgccgtgttcatctggcccctccactaacctgggagggatacgaccccagctggaactag

SEQ ID NO: 229553 - DNA, 1338 bp, Artificial Sequence
  Description of Artificial Sequence: Synthetic coding sequence
atgctcaaaaagcagtctgccggattagtattatggggcgcaatcctgtttgttgcctggaacgccctgcttctgctatttttctggacgcggccagctccaggtcgtcccccatccgtgtcagcactcgatggcgacccagcctccctcactcgggaagtgatcaggctggctcaggacgcagaggtcgagctggagcgtcagaggggcctgctgcagcagattggcgacgccttgtcaagccagagaggcagagtacctactgccgcacccccagctcaacctcgggttcctgttacacctgcacccgcagtgattcctattctggtcattgcatgcgatcggagcacagtgagacggtgtctggataagctgctgcattatcgacctagtgccgaactgttcccgatcatcgttagccaagactgtggccatgaggagaccgcccaggctatcgcaagctacggcagtgcagtaactcacatccgacagccagatttaagcagcatcgcagtacccccagaccatcgcaagtttcaagggtattacaaaattgcacgtcattaccggtgggcactcggtcaggtcttcagacaatttcgattcccagcagcagtggtggttgaggatgatttggaggtagcaccagacttttttgagtacttcagggcgacctatcccctgcttaaagccgacccaagcctttggtgcgtgtcagcctggaacgataacggtaaggagcagatggtcgatgcaagtaggcctgagctgctttacaggacagatttctttccagggctgggctggcttctgttggccgagctgtgggcagagctggagcctaagtggcctaaggccttttgggacgattggatgagaagacccgaacagagacagggcagggcttgcatccgtcccgaaatatcccggacgatgacttttggaagaaaaggcgtttcccacgggcagttctttgatcagcacttgaagttcatcaaactgaatcagcagttcgtgcatttcacccagctggacctgtcctatctccagcgcgaggcatacgatagagatttcttggccagagtctacggggctccacagctgcaggtggagaaggttaggaccaatgatcggaaggagctgggcgaagtgagagtgcagtacacaggacgagatagttttaaggccttcgcaaaggcccttggcgtcatggacgatctgaagagcggcgtgccgagagccggttatcgcggaatagtaacattccagttccgcggtaggagggtgcacctggccccacccctgacttgggaaggatatgatccctcatggaattag

SEQ ID NO: 229554 - DNA, 909 bp, Artificial Sequence
  Description of Artificial Sequence: Synthetic coding sequence
atgcttaaaaaacagagtgccggactggtgttatggggggcaattctgtttgtggcttggaatgcacttctgctgctgttcttttggacgcgccctgcccctggcaggccaccatcagtctccgccctggatggagatcctgcatccttgacaagggtcttcaggcagttcagatttccagcggctgtggtggttgaagatgatctcgaggtggccccagactttttcgagtacttccgcgcaacttatcctcttctcaaagcagacccttctctgtggtgcgtgagcgcttggaacgacaatggtaaagaacagatggtggacgcctcccgaccagagcttctctatcggaccgatttcttcccgggactgggttggctactccttgccgaactctgggctgaacttgagcctaagtggcctaaagccttttgggacgactggatgcggaggcctgagcaacgccaggggagagcatgtatccggccagaaataagtcggacaatgactttcggtagaaagggcgtaagtcatggccagttcttcgaccaacacctcaaatttataaaattgaaccaacagtttgttcacttcacccagctggacctgagctatcttcagagagaggcctatgaccgcgactttttggcgagggtatacggggctcctcagcttcaagtggaaaaggtgcggacgaacgaccgcaaggagctgggggaagtccgagtgcagtacacaggcagggacagcttcaaggcctttgccaaagccttgggggtgatggatgatctgaaatcaggggtcccaagagctgggtacaggggtatcgtgacgtttcaattcagggggaggcgagtgcacctggcacccccactcacctgggagggttatgatccgtcatggaactag

SEQ ID NO: 229555 - DNA, 312 bp, Artificial Sequence
  Description of Artificial Sequence: Synthetic coding sequence
atgcttaagaaacagtccgctgggctcgtgctgtggggcgcaattttgttcgtggcctggaatgccctgctgctgttattcttctggacaaggcccgcacccggtaggccgccaagtgttagcgcgctggatggggatccggcaagcctcaccagggaggtgattcgactcgcacaagatgctgaggtggagttagaacggcaacgtgggctgcttcagcagatcggcgacgccctgtccagtcaaaggggcagggtgcctactgctgcccctccggctcagcctcgggtcccggtcactcctgccccatag

SEQ ID NO: 229556 - DNA, 600 bp, Artificial Sequence
  Description of Artificial Sequence: Synthetic coding sequence
atgttaaaaaagcaatccgccggtttggtgctttggggcgcaatactgttcgtggcctggaatgccttattactcttgtttttctggactcggcctgccccaggcagaccaccttcagtgtccgccctggacggagaccctgcaagtctcacaagggaggtgatccggctggcccaagatgcggaagtggaactcgaaagacaaaggggactcctccagcagatcggcgacgcactgtcttcacagaggggacgggttcctaccgccgctcccccagcccagccacgcgtacctgtcaccccagcacccgctgttatcccaatcctggtaatagcgtgcgacagatctactgtgagaaggtgcctggacaagctgctgcattacagaccctcagccgagcttttccctattatcgtgagccaggattgtggtcatgaagagaccgcccaggcgatcgcctcctacggctccgcagtaacccatatccgccagcccgacctgagtagtatcgccgtcccacccgaccatcgcaaatttcagggatattataaaatcgcgcgacactataggtgggccctgggacaggtgttccgccagtag

SEQ ID NO: 229557 - DNA, 336 bp, Artificial Sequence
  Description of Artificial Sequence: Synthetic coding sequence
atgctgaaaaagcagagcgcaggtcttgtcttgtggggcgctatactcttcgtcgcatggaatgccctcttactgctgtttttttggacaaggcccgctccaggaagacccccatctgtgtccgctttggacggtgaccctgctagcctcacccgagaagtgattcgactggcccaggacgctgaggttgaactggagcggcagagaggtttactgcaacagattggggacgctctttcgtctcaacgcggaagggtgcccactgccgctcctcctgcacaaccccgagttcctgtgacccccgctcccgctgtaatccccatcttggtgatatag

SEQ ID NO: 229558 - DNA, 465 bp, Artificial Sequence
  Description of Artificial Sequence: Synthetic coding sequence
atgctcaagaagcagagtgcaggcctcgtgctttggggagctattctcttcgtcgcgtggaatgcactcctactcctctttttttggactcgccctgctcctggtagaccacctagcgtatcagccttggacggcgatccagcatctctgacacgcgaggttatcaggctggctcaggacgcagaggtggaacttgaacgccagcgaggcttgctgcaacagatcggtgatgcgctcagctcgcaaagaggtcgggtccctactgccgctcccccagcccaacctcgggtgccagtaactccggcacctgcggttatccccattctagtgattgcatgtgaccgaagcacagtgagaagatgcctggataaactgttgcactaccggccttctgcggagttgtttcccatcatcgtgtcacaggattgcggacacgaggagacagctcaggccatagcctcatag

SEQ ID NO: 229559 - DNA, 105 bp, Artificial Sequence
  Description of Artificial Sequence: Synthetic coding sequence
atgctgaaaaaacagtcagctggtctcgtgctatggggagccattttatttgtggcttggaacgccctcctcctgctgttcttttggaccagaccagccccatag

SEQ ID NO: 229560 - DNA, 348 bp, Artificial Sequence
  Description of Artificial Sequence: Synthetic coding sequence
atgcttaagaaacagagtgcaggcctggtgctttggggtgccatcctcttcgtggcttggaatgccctgttgctcctgtttttttggacacgccctgccccaggtcgcccaccgagtgttagcgcgctcgacggtgaccccgcttctcttacaagagaggtgatccgtcttgcccaggatgccgaagttgagctggagcgccagaggggactgctgcagcagattggagacgcactgtccagtcaaaggggtagggtgcctactgccgctcctcctgcacagcctagagtgcccgtgacccccgctccggctgtaattcctattctggtgattgcttgtgaccgctag

SEQ ID NO: 229561 - DNA, 288 bp, Artificial Sequence
  Description of Artificial Sequence: Synthetic coding sequence
atgttgaagaagcagtctgctgggctggttctatggggcgctattctatttgtcgcttggaatgcactcctgttgttgttcttttggacccgccctgcccctggtagacccccttccgtttcggcactggacggggaccccgcaagcctgacacgagaggttatacgcctagcccaggacgccgaagtagagctcgaaaggcagcggggattgctacagcagatcggcgatgccctctcctcacaaagaggcagagttcctactgccgcaccgcctgcacagccttag

SEQ ID NO: 229562 - DNA, 384 bp, Artificial Sequence
  Description of Artificial Sequence: Synthetic coding sequence
atgttgaagaagcagagtgctgggcttgtgctttggggggctattctgttcgtggcctggaacgccctcctcctcctattcttttggacaaggccagctccaggaagaccgcctagcgtgagtgcactggatggtgaccccgcttcactgactagggaggtgatacgcctggcccaggatgccgaggtggagctggagcgccagagggggctcctgcagcagattggagacgcccttagttctcagaggggacgcgttccaaccgccgctcctcctgcacaacccagagttccagtaacccctgcgcctgccgtgatccctatccttgtcatcgcatgcgaccgcagtaccgtacgcaggtgcttggataagcttctgcactag

SEQ ID NO: 229563 - DNA, 318 bp, Artificial Sequence
  Description of Artificial Sequence: Synthetic coding sequence
atgctcaaaaagcagtcagcaggtttggtcttgtggggggcaatcctgttcgtagcctggaatgccctgctgctgcttttcttttggactagacccgcaccgggtcggcctccctcggtcagcgccctggatggtgatccagcgagccttactagagaggtcattaggttggctcaggatgcagaagttgaactggaaaggcagcgtggcctcctccagcagatcggtgacgccttgtccagccaaaggggcagggtacccaccgctgcgcctccggctcagcccagggtgccggtcacccctgcacccgctgtctag

SEQ ID NO: 229564 - DNA, 1608 bp, Artificial Sequence
  Description of Artificial Sequence: Synthetic coding sequence
atgcgactcagaaacggcacggtggccactgccctagcgtttattacgtcttttctgaccttgtcatggtacactacatggcagaacgggaaggagaaactgatcgcctaccagagggagtttttggccctgaaggagcggctcagaattgccgaacaccggatttctcagaggagctctgaacttaacacaatcgttcaacagtttaagcgtgttggtgctgagacaaatgggagcaaggatgctcttaataagttcagcgataatactctaaaactgcttaaggaactgactagtaaaaaaagcctccaggtgccaagcatatactaccatctgccgcatttgctcaaaaatgaagggagcctgcagcctgccgtacaaatcgggaatggtcggaccggcgtgagcatcgtaatggggattcccaccgttaaacgcgaggtcaagtcctatcttatcgagactttacatagtctgatcgacaacctatatcctgaggagaaactggattgcgtgatcgttgtgtttataggcgaaaccgacattgattacgtgcacggagtggtagccaacctggaaaaggaattttcgaaagagatcagttcaggtttggtggaagtaatcagcccgcctgaatcgtactatccagacctgaccaacctgaaggaaacttttggggatagtaaggagcgtgtcagatggcgcaccaagcagaatctggattattgcttcttgatgatgtatgcacaagaaaagggaatctattatatccagctggaggatgatattatcgttaagcagaactacttcaatacaatcaagaacttcgcacttcaactaagctcagaggaatggatgatcctggaattcagccagctgggttttattggaaaaatgtttcaggccccagacctgacacttatcgtagaatttatttttatgttttataaggagaagcctatagattggttactggatcacatcctttgggtgaaggtctgcaatcctgagaaggatgctaagcattgtgatcgacaaaaggctaatcttagaataaggtttcggccatcattattccagcacgtcgggctgcatagtagtctttctgggaagatccagaagctgactgataaagactacatgaaaccactgcttttaaagattcacgtgaatccgcctgctgaagtgtcgacatcgttaaaagtctaccaggggcacactcttgaaaaaacatacatgggggaagactttttctgggcaatcactccgatcgctggcgactacattctgttcaaattcgacaagcccgttaatgtcgaatcatatttgttccattcaggaaatcaagaacacccaggggatatccttttaaatactaccgtcgaggtcctgccctttaagtcagagggcctcgaaatcagtaaagaaacaaaagataagcgtcttgaggatggctacttccggattgggaaattcgagaatggtgtcgctgagggcatggtggaccctagcctgaacccaatctccgccttcaggctctccgtcatccagaactcagctgtgtgggcaattctgaacgagatccatattaagaaggccactaactag

SEQ ID NO: 229565 - DNA, 1608 bp, Artificial Sequence
  Description of Artificial Sequence: Synthetic coding sequence
atgaggctgcgtaatgggaccgttgctaccgccctcgcctttatcacgagctttctgacgctgtcctggtatacgacatggcagaacggcaaggagaagctgatagcctaccagcgcgagttcctggcactaaaggagcggctccgaattgcagaacatcgtatatcccagagatcctctgagctaaataccatagtgcagcagttcaagcgcgtgggcgcagagaccaacggaagcaaggacgccctgaacaagtttagtgataataccttgaagctactgaaggagctgacatccaaaaagtccctacaagtcccgagtatttattatcatctgccccatctcttaaaaaacgagggctctttgcaacccgcagtccagataggcaatggcaggaccggcgtcagcattgtcatgggaattccaacagttaagcgtgaggtaaaatcttatttaatcgaaaccctccactccctgatcgataacttataccctgaagaaaagcttgattgcgtgatagtcgtatttatcggagagacggacattgattatgtccatggagtggtggccaatttggagaaggagtttagtaaagagatcagttccggcttagtggaggttatatccccccctgaatcatattaccctgatttgacaaatctgaaggagacatttggcgattcaaaggagcgggtgcggtggcgtacgaagcaaaacctggattactgttttctgatgatgtatgcgcaggagaagggcatatattatattcagctggaagacgacatcattgtgaagcagaattatttcaatactattaagaactttgctcttcagcttagcagtgaggagtggatgattctggagttttcccagttgggctttatcggcaagatgtttcaggctcccgacctcacactaatcgtggaatttattttcatgttttacaaggagaagccaattgactggctcctagatcatattttgtgggtgaaggtgtgtaaccccgagaaagacgcaaaacactgcgatagacagaaagcaaacttaaggattcgctttcgcccaagcctgtttcaacatgtgggtctccacagcagcttatcaggcaagattcagaagttgacagataaggattacatgaaacccctgttactgaaaatacatgttaaccctccggctgaggtgagcacaagtctgaaggtctatcaaggccacactttggaaaagacatatatgggagaggacttcttttgggctattacacctatcgctggcgactacattctgtttaagtttgacaaacccgtgaatgtggagagctacctgtttcattctgggaaccaggaacaccccggtgatattttattaaacaccacagtggaagtgctccccttcaagtctgaagggctggaaattagcaaagaaactaaggataagcggcttgaggatgggtactttcggatcgggaagtttgaaaacggcgtggccgaaggcatggttgatccaagccttaatccaatctccgcctttcgcctctctgtgattcagaacagcgcagtgtgggctattctgaatgagatccacatcaagaaggctacgaattag

SEQ ID NO: 229566 - DNA, 1608 bp, Artificial Sequence
  Description of Artificial Sequence: Synthetic coding sequence
atgcggcttaggaatgggactgtggccactgcacttgccttcattacatctttcctgactcttagctggtacaccacttggcagaacggtaaagagaagcttatcgcctatcagcgcgagtttttggccttgaaggaacgcctcaggatcgctgagcatcgaatttcacagaggtcaagtgaattgaatactattgttcagcagtttaaaagagttggcgctgaaactaacggatctaaagacgcgctgaacaaattctccgataacaccttgaaactgctgaaggagttgacatcaaaaaagtcccttcaagttccttctatctattatcatctacctcacctgttgaagaatgaaggttcccttcaacccgcagttcagatcggcaacggtcgaaccggggtgagcatcgtgatggggatacctactgtcaagcgtgaggtcaagtcttacctgattgagactctgcactccctaatcgataacctttatcccgaggagaaattggactgtgttatagtggtgttcatcggtgaaacagacattgactatgttcacggggttgtcgctaaccttgaaaaggaattttcaaaagagatatcttctgggctggtggaagttatttcccctccagagtcgtactatcccgatctgacaaatctgaaagaaactttcggagatagtaaggagagggtccggtggaggacaaagcagaatctcgattactgttttttaatgatgtacgcccaagagaaagggatatactatatccagcttgaggatgatatcatagtgaaacagaattatttcaataccataaaaaatttcgccctccagctgtctagtgaagagtggatgattctggaattctcccagctgggattcatcggaaagatgttccaagccccagacctgactctgatagtggagtttatttttatgttctataaggagaaaccaattgattggctcctcgaccatattttatgggtcaaagtctgcaatcctgaaaaggatgcaaagcattgcgaccggcagaaggcaaacctgcgaatccgctttcgaccctcactgttccagcatgtcgggctccactcctctctatcaggcaagatccagaagctgaccgacaaagactatatgaagccactgctgttgaaaatccacgtgaaccccccagcagaggtttccacatcgctcaaagtgtaccagggtcacacgttagaaaaaacatatatgggtgaggacttcttttgggccatcactcccatcgcaggggactatatcctgtttaaatttgacaagcccgtcaacgtggaatcttacctcttccattcaggtaaccaggagcatccgggtgacattctgctcaatactactgtggaggtgctgccattcaagagcgaaggactggaaatctccaaggagaccaaggacaaaaggctggaggacggatacttcagaatcggaaagttcgaaaacggggtggcagaggggatggttgacccaagcctgaaccctatctctgcatttcgtctctctgtgattcagaattcggccgtctgggccattcttaatgagatccacattaaaaaggctacaaactag

SEQ ID NO: 229567 - DNA, 1272 bp, Artificial Sequence
  Description of Artificial Sequence: Synthetic coding sequence
atgaattactccatcacagtcagcatagtaatgggcattcctactgttaagcgggaggtgaaaagttacttgattgagacactgcattcgctaattgacaacctgtaccctgaggaaaagctggactgtgttatagtggttttcatcggtgaaaccgatatcgattacgttcatggcgttgtcgctaatctggagaaagagttttcaaaagagatatcatcagggctggtagaagtgatctcccctcctgagtcctactatcccgatctgaccaacctgaaggaaacgttcggggactcgaaggagagggtacgctggcgcacaaagcagaacttggactattgctttctgatgatgtacgcacaggaaaaggggatttattacatccagctagaggacgacattatcgtcaaacagaactattttaatactatcaagaacttcgctctgcaactgagttcagaggaatggatgattctggagttttcgcagctgggatttattggaaaaatgttccaggctcccgacctgacgcttatcgtggaattcatttttatgttctacaaagagaaaccaattgactggctcctggaccacattctttgggtcaaagtgtgtaatcccgagaaggacgccaagcactgcgatagacaaaaagccaaccttaggatccgttttcgaccttccctgttccaacacgtgggcctgcattctagcttaagtggcaaaatccagaaacttactgataaggactatatgaagcccctccttctcaaaatccatgtaaatccgcctgcagaggtgagcacatccctaaaagtgtaccaaggacatacgctggagaaaacgtatatgggcgaagattttttctgggcaataacaccaatcgctggagactatatcttgtttaagtttgataagcctgtgaacgtggagtcctatttgtttcattccggaaatcaggaacatcccggtgacattctcctgaatacgaccgttgaggtgctcccctttaaaagtgagggattggagattagtaaggagacaaaggataaaaggctcgaagacgggtatttcaggatcggcaagtttgagaatggcgtcgcagaagggatggtagatccttcactcaatcccatttccgcgttccgactaagcgtcattcagaattcagccgtgtgggccatattgaatgagcagagggttttttctggatggtggcagaaatcacgtgacaaggccgagggccctcaggctccactgctcttttag

SEQ ID NO: 229568 - DNA, 1647 bp, Artificial Sequence
  Description of Artificial Sequence: Synthetic coding sequence
atgagactcagaaacgggaccttcttgacactactccttttttgcctgtgtgcatttctgtccctgtcgtggtacgccgctcttagcgggcagaaaggcgacgtggttgacgtttaccagcgtgagtttctagccctccgcgaccgactccatgcggctgaacaagagtcccttaaaaggagtaaagagctgaacctcgtgcttgacgagattaagcgagctgtctcagagcgccaggctctgagggatggggacggtaaccggacctggggcagactcactgaagatcctcggcttaaaccttggaatggttctcataggcacgttctacatctgccgaccgtttttcaccacctgccacaccttctggcaaaggaatcctctcttcagcctgcggtgagagttggccaaggccgtaccggagtgtccgtcgtaatgggaatcccgtccgtgagaagggaggtccattcctacctgactgatacgctccactccctgatttctgagttgagcccccaagaaaaagaggatagcgtgattgtggtgttgattgcggagaccgactcacaatatacatctgccgtaaccgagaacatcaaggctctctttcctacagaaatccactccggcctccttgaggtgatctctccatcacctcatttctacccagacttttctaggctgcgggagagcttcggagatcctaaagagagggtgcggtggcggacaaagcagaatctggattactgcttcctgatgatgtatgcacagagtaaagggatttactacgtacaattagaagacgacatagtagccaagcctaactacctcagtacgatgaagaactttgcactccaacagccatcggaggactggatgattcttgaattcagccagcttgggttcatcggcaagatgttcaagtcactggacttatcccttatagtagagtttatcctcatgttttatcgtgacaagcctatcgattggttgctagaccacattctttgggtcaaagtgtgcaatcctgagaaggatgctaagcactgcgaccggcagaaggctaacctaagaattcgatttaagccctccctcttccaacacgtgggaacacattcatccttggccggaaaaattcaaaagctgaaggacaaagatttcgggaagcaggctttacggaaggaacatgtgaatcctcccgctgaagtctcgacatctttgaaaacttaccagcactttactttggagaaagcttatctgcgtgaggacttcttttgggccttcactccggctgccggtgatttcatcagatttcgcttctttcagccccttcgcctggagagatttttcttcagatccgggaatatcgagcatccagaggataagctcttcaacaccagcgtcgaggtcctgccattcgacaaccctcagagcgataaggaggccctgcaggaggggagaactgctaccctccgctacccaaggtcccccgacgggtacctgcaaattggctctttttacaagggagtcgctgagggggaagtggacccggcttttggaccattagaggccttgaggttatccatacagacggactcacccgtgtgggtcatcttgagcgagatctttctcaagaaggcagactag

SEQ ID NO: 229569 - DNA, 1692 bp, Artificial Sequence
  Description of Artificial Sequence: Synthetic coding sequence
atgagcagggtcgccggaacccgaacggacgtaaacgagctgctgcagaggtggacacccagatgcgtacggtggcacaccggaggcgctcgcagagtagccctcgaccggcctctggtaaccgcctgccttcctcccgctggagatgtggtcgatgtctaccaacgggaatttctggcccttagagaccggctccacgctgcagagcaggagagtctgaagcgtagcaaagagctgaatctggtcttggacgagataaagagagctgtgtcagaacgccaggccctcagagacggggatggaaaccggacctgggggagactcacagaggacccccgattgaagccatggaatggatcacacagacacgtgcttcacctaccaaccgttttccaccatctaccacacctcctggccaaggagagcagcctccaaccagctgtcagagtgggccaaggaagaactggagtcagcgtggtgatgggtatcccgagcgtgcggcgagaagttcattcctatctgacggacaccctccatagccttatcagcgagttgagcccccaggagaaagaagacagcgtgatcgtggtgttaatcgcagagaccgattcccagtacactagcgctgttaccgagaatataaaggccctgttccccacggaaattcattcaggtttgcttgaggtgatttctcccagtccacatttttaccctgatttttctaggctgcgggagtcctttggcgaccccaaggaacgcgtccggtggcggacaaaacaaaacctggattattgctttctcatgatgtatgcccagtccaagggaatctattacgtgcagctggaggacgatatcgtagccaaacccaattatttgtcgaccatgaagaacttcgccctgcagcagccaagcgaggattggatgatactggaattttcccagcttgggtttatcggaaagatgtttaagtcactcgacctgtcactgattgtcgaattcatcctaatgttctaccgggataaacccattgattggctgctcgaccacatactctgggttaaggtctgcaatcccgagaaggatgctaagcactgcgaccgtcaaaaggccaacctgcgaatacgctttaaaccctctctgttccagcatgtggggacccattcgagtctcgctgggaagattcagaaacttaaagacaaagacttcggcaagcaggccttaagaaaagagcacgtgaacccccctgccgaagtgagcacctccctgaagacataccagcacttcaccctcgaaaaggcatacctccgagaagactttttttgggcattcacgccagccgctggcgatttcatcaggttccgatttttccagccactgagactggaacgctttttttttagaagtggaaatattgaacatcccgaagacaagcttttcaacacaagcgtcgaagtgctgcctttcgacaatccacagtctgacaaggaagccctgcaagagggcaggaccgccaccttgcggtatcctaggtctcccgatggttatctccaaatcggcagcttttacaaaggtgttgcagaaggtgaggtggaccctgctttcgggccattagaggccctgcgtctgagcatccagacagatagtcccgtctgggttatcctctcagagatttttttaaaaaaggctgattag

SEQ ID NO: 229570 - DNA, 1344 bp, Artificial Sequence
  Description of Artificial Sequence: Synthetic coding sequence
atgcgcttccggatctacaaacggaaggtgctgattctcactctggttgtggccgcttgcggctttgtgttgtggtcttctaacggaagacaaagaaaaaatgaggcgctcgcccctcccttgctggacgccgaacccgcacgcggagcagggggacggggaggagatcatcctagtgtcgctgttggcatccggagggtgtctaatgtttccgccgcttcgctagtccccgcagtaccccaacccgaagctgacaacctgaccctacgctatcggtcgctggtctaccagcttaattttgatcagactctgcgaaacgtggataaagcaggaacctgggcacctagagagttggtgctggtagtgcaggtacacaaccgtccagagtatctgagattgctgctcgactccctgagaaaagcccagggcattgataacgtactggttatcttctctcacgatttttggtcaactgagataaaccaacttatcgcgggagtgaatttctgtcccgtgctacaagtattcttcccctttagcatacagttatatccaaacgaattcccgggatcagacccccgagactgccccagagatctgcctaagaatgctgctctcaagctgggatgtattaatgccgaataccccgattcattcggccactatagagaggccaagttctcccaaacaaagcaccattggtggtggaaactgcactttgtttgggaacgggtgaaaatactgagggactatgcaggactaattctgttcctggaggaagatcattatttagcgccagatttttatcatgtgtttaagaagatgtggaagttgaaacagcaggagtgtcccgaatgcgacgtgttaagtctcgggacctatagtgcgtcccgatctttttacggcatggcagataaggtggatgtcaaaacctggaaatccaccgagcacaacatgggcttggctctcactagaaatgcctaccaaaagctaattgagtgcaccgacacattctgcacatacgacgattacaattgggactggactttgcagtaccttactgtgtcttgcctgccaaagttctggaaagtgctagtgccccaaatccctaggatttttcacgccggtgattgtggcatgcaccataagaaaacttgcaggccctccacgcagagcgcccagatagagagcctgctgaacaacaataagcagtacatgttcccggagacgctgacaatctccgaaaagttcaccgtggttgcaatctctccgcctaggaagaacggaggctggggagatatccgagaccatgagctgtgtaaatcttatcgaagactccagtag

SEQ ID NO: 229571 - DNA, 1362 bp, Artificial Sequence
  Description of Artificial Sequence: Synthetic coding sequence
atggagagaactgaaacaatgcgctttcgcatctataaaaggaaggtgctgatcctgacacttgtggtggccgcttgcggctttgtgctttggtcctccaatgggaggcagcggaagaacgaggccctggcccctcctttactggacgccgagcccgctcgcggagccggaggacgcggaggcgaccatccgtccgttgccgtgggcattcgccgtgtcagtaacgtctcagccgcaagcctggtcccagcagtaccacagcctgaggccgacaatctgaccctgaggtaccggtcgttagtgtatcagctgaatttcgaccagactctcagaaatgtggacaaagccggtacgtgggctccccgagaactagtcctcgtggtccaggtgcataatcgtcctgagtatctgcggttgttactcgacagcctgcggaaggcacaggggatcgataacgtcctggtcatcttctcacacgacttttggtctactgagattaatcagctgattgctggtgttaatttctgcccagtcctgcaggtgtttttccccttctccattcagctataccccaatgagttcccagggtctgatccgcgtgattgtcccagggacctgccaaaaaacgcagccctgaaactcggctgcatcaacgccgagtaccccgactcattcggccattaccgtgaggcaaaatttagccaaactaaacaccactggtggtggaaactgcacttcgtgtgggaacgggtcaaaattctgagagactatgccggactcattctgttcttagaggaggaccactacctcgcgccagatttctaccacgtattcaagaaaatgtggaagcttaaacagcaggagtgtcccgaatgtgacgttctgagcctgggaacttacagcgcctcaagaagtttctatggcatggctgataaggttgacgtcaagacatggaagagcaccgaacacaacatgggtttggcactgaccagaaacgcttaccagaagctgattgagtgcacagacaccttttgtacttatgacgactacaattgggattggacactacagtatctcacagtctcttgtctccctaagttttggaaggtgctggttccacaaataccaagaatctttcatgctggcgactgtggcatgcatcataagaagacttgtcggcctagcacccagtctgcccaaatcgagagtctgctgaacaacaataaacagtacatgttcccagagactcttacaatatccgaaaagtttaccgtggttgcaatctcaccgcctcggaaaaacgggggatggggtgatatcagggaccatgaactctgcaagtcctaccgacggcttcagtag

SEQ ID NO: 229572 - DNA, 2373 bp, Artificial Sequence
  Description of Artificial Sequence: Synthetic coding sequence
atgatcacagtgaaccccgatggaaagattatggtgcgacgctgcttggttaccctgcgccctttcagactgttcgtgcttggcataggtttctttacgctgtgcttccttatgacctctcttggcggacagttttccgccaggcggcttggtgattctcctttcacaatacggactgaggtgatgggtgggccagagtcacggggagtacttaggaaaatgtctgacctgctggagctgatggttaagcgtatggatgccctagctagactcgagaattcatctgagctgcatcgcgcagggggtgacctgcacttccccgcagatcgtatgcctcctggtgccggtctgatggaacggatccaggcaatcgctcaaaacgtctccgacatagctgttaaggtcgaccagatcctgcgacacagtttgcttctgcacagcaaggtgagtgaagggcgacgggaccaatgcgaagctccctccgatccgaaatttcctgactgctccggcaaggtggagtggatgagggcccgatggacttctgatccatgctacgccttttttggcgtcgacgggaccgagtgtagtttcctcatctatctcagcgaagttgaatggttctgtccacctctgccttggaggaaccaaacagctgcccaacgcgcacccaagccgttacccaaggtccaggctgtgttcagaagcaacctttcacaccttcttgaccttatgggatccgggaaagagtcactgatcttcatgaaaaagaggaccaaacggctgaccgcgcaatgggccctcgccgcacagagattggcccagaagcttggcgctacacagcgcgaccagaagcaaatcttagtgcatatcgggtttctcacagaagaaagcggggatgtattcagccctagagtgctgaaaggcggaccgctcggagaaatggtacaatgggcagatatcctcactgctttatatgttcttggacatggactgagagtcacggtgagcctgaaggaattacagtcaaaccttggcgtcccacccggtagaggcagctgccctcttaccatgcccctgcccttcgatctgatctatacggattatcacggtctccaacagatgaaacggcacatgggtctgagttttaaaaaatataggtgtagaatccgtgtcatcgacacattcggtaccgaacctgcctacaatcatgaagaatatgccactctgcatggctataggaccaactggggatactggaaccttaaccccaagcagtttatgacgatgttcccacacactcctgataacagcttcatgggatttgtgtctgaagagctgaacgagaccgaaaagagactaattaaggggggaaaagcctctaatatggctgttgtatacgggaaagaggcgtcaatttggaagggcaaggagaagtttctgggcatcttaaataaatacatggagatacatggaacagtgtactatgaatcacagaggccccctgaagtgccagccttcgtaaagaatcacggactgctcccccagccagagttccaacagctgctacgaaaagctaagttgtttatcggcttcggcttcccatatgagggcccagctccacttgaagcaattgccaatggatgtatttttttacagagccgcttttctcctccccacagctcactgaatcacgagttttttcgcggaaaacctacttccagggaagtattctcccaacatccatacgcagagaattttatcgggaaacctcacgtttggacggtcgactataacaattccgaggaatttgaggccgcaatcaaggccatcatgaggacccaggtggatccttatctgccgtacgaatacacatgcgaagggatgcttgagaggatccacgcctacattcagcaccaggatttttgtagagcacccgatcctgctctccctgaagcccatgccccacagtcacccttcgtcctggccccaaatgcaactcacctggagtgggctcggaatacatcccttgccccaggagcctggccccctgcacatgcccttcgtgcttggctggccgtgccgggacgtgcttgtaccgacacatgcctggaccatggcttgatttgcgaaccgtcttttttccccttcctgaactcccaggacgcttttttgaagttgcaggtgccttgcgactctacagaatctgaaatgaaccacctgtaccctgcatttgcccaaccaggtcaggaatgttacttacaaaaggaaccactcttgttcagctgtgctggttctaacacaaagtatcggagactgtgtccctgccgggattttcgtaagggacaagtagccctctgccagggatgtctgtag

SEQ ID NO: 229573 - DNA, 1185 bp, Artificial Sequence
  Description of Artificial Sequence: Synthetic coding sequence
atgataaccgttaatcccgacggaaaaattatggttagacggtgcctggtgacgctgaggccttttaggctgtttgtactaggcattgggttttttacgctgtgtttcctgatgaccagcctgggaggacagttctcggccagacggctgggggatagccccttcacaatcaggacagaggttatgggcggacccgagtcccggggagtcctgcgtaagatgtctgatttgctggagctcatggtgaaacggatggatgccctggccaggctagagaactcgagcgagttgcatagggcaggcggagatctacactttccagccgaccgcatgccaccgggagccggtcttatggagagaattcaagcgatcgcccaaaacgtgtctgatatcgctgttaaggtggaccagattctaaggcattccctgctactccattctaaagtgagcgagggccgaagagatcaatgtgaagcacctagcgatcctaagttcccagactgttccggcaaagtggaatggatgagggccaggtggacgagcgatccctgttacgctttttttggcgtggacgggactgaatgcagctttcttatctacctctctgaggttgaatggttttgtcctccactcccctggagaaatcagactgccgctcagcgtgctcctaagcccctacccaaagtgcaagcggttttccgaagtaatttgagccacttgctggatttgatggggagcgggaaggaatccttgatcttcatgaaaaagcgtacaaaacgtctgaccgctcagtgggctctggcggctcaacgcctggcccagaagttgggcgctactcaaagggaccagaaacagattctggttcacattggattccttacagaggaatccggggacgttttttcacccagagttctgaaggggggtcccttgggtgagatggtgcagtgggccgatatccttacagctctctacgtcctggggcatggtctaagggtcaccgtctcactcaaggagctgcaacgacagcggcgactgaggtcgtcccaagagcaggcccgttgtggagtcatgggcgcatgtgaaaaaatgctgctcgagggagatgtagcctctaacacactactgattgagaaaccctcaaaaaaggagacagagaagtgtcccaagaatctagtgacttag

SEQ ID NO: 229574 - DNA, 2406 bp, Artificial Sequence
  Description of Artificial Sequence: Synthetic coding sequence
atgcactcctttgtcaaacacttgtgcagcaggtatgtggtggaaaggcagggaacgatggctctgcccgctttactcaccaggctccttcctctgcgacgtctcttcgtgctggggattggcttctttactctttgctttctcatgactagtcttggtggacagttttccgcaagacggctgggagacagcccctttactattaggacggaagtgatgggcggtccggaatctagaggagtactgaggaaaatgagcgatctcctggagctgatggtcaaacggatggacgctctggccaggttagaaaattcttcagaactccacagggctggaggtgacttacactttccagccgatagaatgcccccaggagcaggactgatggaaaggatccaggcgattgcccagaatgtgtctgatatcgctgtcaaagtggaccagattttgagacactcactattgctccacagtaaagtgtcagaaggtagacgcgaccagtgtgaagctccctccgaccccaaatttccagactgcagtggcaaagtcgagtggatgagagctcgttggaccagtgacccttgctatgcatttttcggtgtggacggtaccgagtgctcattcttgatttacctcagcgaggttgagtggttctgccctccactgccgtggcgaaaccagactgctgcccaacgtgcccctaagcctctaccaaaagttcaggccgtgttccgttccaatctgagtcacctgctggatcttatgggaagcgggaaggaaagccttattttcatgaagaagaggactaaaagactcactgcacagtgggcgctggccgcacagcggctcgctcaaaagctcggcgctactcagcgggatcagaaacagatcctagtgcatataggctttttgactgaagagtctggcgatgtattcagtcccagagtacttaaggggggacctcttggagagatggtccagtgggcagatatcttgacagccttgtacgttcttgggcacggcctgcgagtcactgtctctctgaaagagctgcagagcaacttgggcgtcccaccaggacgaggatcttgtccactaactatgcccctgcccttcgatctaatctacaccgactaccacggccttcagcagatgaagcgacacatgggcttatcattcaagaaatatagatgtaggatcagggtgattgacacctttggaactgaaccagcttataatcatgaagaatacgctacattgcatggatatcggaccaattggggatactggaacctgaaccctaaacagttcatgacaatgttccctcacactcctgataatagcttcatgggatttgtgagtgaagagctcaatgaaacagagaagaggctcattaaaggcggtaaggcaagcaatatggctgttgtgtacggaaaagaagcctccatctggaaaggcaaagaaaaattcttggggatcctcaacaaatatatggaaattcacgggactgtttattacgaatctcagcgccctccagaagtgcccgcttttgtgaagaaccacggcctgttgccgcagcccgaatttcagcagctcttgcgtaaggcaaaattgttcattgggttcggtttcccctatgaaggacctgccccacttgaagcaatcgcaaacgggtgcattttcctccagagcagattctcgcctcctcatagttctctgaatcatgagtttttccggggaaaacccacgtctagagaagtgttctcccagcatccctatgcggaaaacttcatcggaaaaccccatgtgtggacggtagactataacaactccgaagaattcgaggctgcgattaaagcaatcatgagaacacaggtggacccatacttgccgtatgagtacacctgcgaaggtatgcttgaaaggatacacgcttatatccagcatcaagacttttgccgcgctcccgaccctgccctgcctgaagcacatgccccacagtccccgttcgtcctggccccaaacgccactcatctggaatgggccagaaacacttctctcgccccaggagcctggccccctgctcacgcacttcgggcatggctggctgttcctggacgggcttgcacagacacgtgtctagatcatgggttgatttgtgagccaagcttcttcccgttcctcaattcacaagacgcctttttaaagctgcaggtgccatgtgatagcaccgaatcagaaatgaatcacctgtacccggctttcgcccaaccgggacaagaatgttacctgcaaaaagaaccactgctgttcagttgcgccggatccaacacaaaataccggagactctgcccatgtagagattttaggaagggccaagtcgccctgtgccagggttgcctgtag

SEQ ID NO: 229575 - DNA, 1602 bp, Artificial Sequence
  Description of Artificial Sequence: Synthetic coding sequence
atgaagatgcgtaggtacaagctgttcctgatgttttgtatggcagggctatgtctcatcagctttttacatttcttcaagacactgtcttacgtgacttttccccgagaactagctagtctgagtccgaatcttgtgtccagtttcttctggaataacgcacccgtgacgcctcaggcgtccccagagccagggggtcctgatctgctgagaacgccgctttactcgcattcacccctactccagccattgcccccttccaaggctgccgaagagttgcatcgagtggatctggtcttgcctgaggataccactgaatacttcgttcgaaccaaggccggaggcgtgtgctttaaacctgggacaaaaatgctggaacggcctccacccggacgcccagaagagaagcctgagggggcaaacggctctagcgcccgtcgcccacctcgatacttactttcggccagagagcggactggaggacgcggagcgaggcgaaaatgggtggaatgtgtgtgcctgcctggatggcacggaccatcctgtggggtgcctactgtagttcaatacagcaatctgcccactaaggagcggctggtgccccgtgaagtgcctcgacgggtcatcaacgcgatcaacgtgaatcatgagtttgacctcctagacgtgaggtttcacgaattgggcgacgttgtggatgcgttcgtggtttgcgagagtaatttcacagcctacggagagccgaggcctctgaaattccgcgagatgttaacaaacggaaccttcgaatacatccggcacaaggtgctgtatgttttcctcgaccatttcccgcctggaggccgacaggatggttggattgcagatgattacctgagaactttccttactcaggacggggtttcaagattacggaatcttagaccagatgacgtttttatcatcgacgacgcagacgagattccggctagagatggcgtgctttttctcaagttgtatgacggctggactgagcccttcgcatttcacatgcgtaaatccctctacgggtttttctggaaacagccgggtactctagaggttgtgagcggttgcaccgtcgatatgttacaggcagtttatgggttggacgggataagactaagacgcaggcaatactatactatgcccaactttcgtcagtacgagaaccgcaccggacacattcttgtgcagtggtccttaggcagtcctctccacttcgctggttggcactgctcctggtgttttacgcctgaggggatttacttcaagttggtgtccgcacagaatggggattttccaaggtggggggactatgaggataagcgagatctaaattacattcgaggcctaatccgtaccggagggtggttcgacggcactcagcaggaataccctcccgcagatccatctgaacacatgtacgctcctaagtatctcctgaaaaactacgacagatttcactatcttctcgacaacccctaccaggaaccacggtctactgctgctggtggttggaggcaccgaggtcccgaaggccgaccacccgcaaggggaaaactggacgaggccgaagtgtag

SEQ ID NO: 229576 - DNA, 327 bp, Artificial Sequence
  Description of Artificial Sequence: Synthetic coding sequence
atggaatcctgttcgtgccaccccggaagcggcgtgcagtggagggaccacggaagcctgcagctgccgccaccaggctttaagatgaagatgaggagatacaaactgtttctgatgttctgcatggccggactctgcctgatctcttttctgcatttcttcaagaccctttcttacgtgacctttccacgggagttggctagtcttagtccaaatctggtttcgagttttttttggaataatgccccagtgaccccccaggcgtctccagagccaggcggacccgacctgcttcggaccccgctttatagccattcccctttgtag

SEQ ID NO: 229577 - DNA, 486 bp, Artificial Sequence
  Description of Artificial Sequence: Synthetic coding sequence
atgaaaatgaggaggtacaaactgttcctgatgttttgtatggcaggcctctgtcttatatcgttccttcatttctttaagaccctttcctatgtgactttccccagggagctggccagtttaagcccgaatctggtgtcatcctttttctggaataacgcacctgtaaccccccaggcttctcctgagccgggagggcctgatttgttgcggacaccgctttattctcacagtcccctcctgcagcccctgcctcccagtaaagccgcagaagagctgcatcgcgtggacctggtcctccctgaagatactactgagtattttgtcagaaccaaggccggaggggtttgtttcaagcccggtaccaagatgctcgagcgcccacccccagggcgaccagaggagaaacctgaaggagctaatggctctagtgcacggaggccaccccgttacctgctgtcagcacgggagcgcactggcggatag

SEQ ID NO: 229578 - DNA, 1044 bp, Artificial Sequence
  Description of Artificial Sequence: Synthetic coding sequence
atggtctccagtcaaaaactggaaaagcctatcgaaatggggtcctcagagccattgcccatagctgacggggatcgcagaagaaagaagaaacggaggggccgtgccaccgacagcctgcccggtaaatttgaggacatgtataaattgaccagcgaactgttgggcgaaggcgcttacgccaaggtccaaggagccgtgtcactacagaatggaaaggaatacgccgttaagataatcgagaaacaggctgggcacagccggtcaagggtttttagggaggttgagacactgtaccagtgccaggggaacaagaacatcttggagttaattgaatttttcgaggatgatactagattttacctggtgtttgagaagctacaagggggaagcattctggcccacattcaaaagcaaaagcatttcaacgagagggaggctagtagggtggtgagagacgtggcggctgcactggacttcctgcataccaagggaattgcacaccgtgatctcaagccagagaacatcttgtgtgaatctcccgagaaggtgagcccggtgaagatatgtgatttcgatctgggcagcgggatgaagctgaataacagctgcactcccatcacaaccccagagctcaccacgccttgcggctcagcagaatacatggcacccgaggtggtggaagtgttcactgatcaggccaccttttacgacaagcggtgcgacctgtggtccctgggcgttgtgctctatatcatgttgagcggctatcctccctttgtgggtcattgcggggctgactgtggctgggatcgcggagaggtatgtcgagtgtgccagaataagctattcgaatccatacaggaaggcaaatacgagtttcctgataaggactgggcccacatcagctccgaggccaaagacctgatcagtaagttgctggtaagagatgccaaacagcgtctgtcagccgcacaggtactccagcacccatgggtgcagggggagcagcaacacaacggacccgacgcactgaggtcctag

SEQ ID NO: 229579 - DNA, 990 bp, Artificial Sequence
  Description of Artificial Sequence: Synthetic coding sequence
atggcgaaatcaatgccatctaaatccagcagaaacaagcagggcaccgttggagtaggatgctttgagagatggcgccgatgcatctccgtgagagaaacctcctctatcctggcccatattcagaagcaaaagcacttcaacgaacgcgaggcctctagggtcgttcgggatgtcgccgctgccctagatttccttcatacaaaagggatagctcatcgggacctcaagccagagaacatcctttgtgagtcccctgagaaagtatctccagtgaaaatatgtgactttgatctgggcagcggcatgaaactcaacaactcttgtacccctatcactacccccgaactaaccaccccctgtgggtccgccgagtacatggccccagaggtagttgaagtgttcactgaccaggctacattttatgacaaacggtgcgacctatggtctctgggggtggtgctctacatcatgttgagcggatatccccctttcgtgggacattgcggcgctgactgtggatgggaccgcggtgaggtgtgtcgggtgtgtcaaaataaactgtttgaatccatacaagagggcaaatatgaatttcctgataaagactgggctcacatcagctccgaggcaaaagacctcataagcaagctccttgtacgcgacgccaagcagcgactaagcgccgcacaggttctgcagcacccgtgggtccaggggcaggccccagagaagggactgcccaccccacaggttctgcaaaggaactctagcacaatggaccttacactgtttgcagcagaggcaatcgctctgaaccgtcaattgtctcagcatgaggagaatgagcttgcagaagagcccgaggccttggcagatggtctatgctctatgaagctatccccaccttgcaaatccaggttggccagacggagagctctggcacaggccggtaggggtgaggacaggtcccccccaactgcactgtag

SEQ ID NO: 229580 - DNA, 1275 bp, Artificial Sequence
  Description of Artificial Sequence: Synthetic coding sequence
atggtgagttcacaaaaactggagaagccaattgaaatggggtcatctgaaccactgcccatcgccgacggtgatcgccgaaggaagaaaaagcgccgaggccgagccaccgactcactgccgggtaagtttgaagatatgtacaagctgaccagcgagctgctgggcgaaggtgcctatgcaaaagttcagggcgcagtgagtcttcaaaacggcaaggagtatgcggttaagatcatcgagaaacaggccggacactcgaggtctcgtgtttttagggaagtcgagacgctgtaccaatgccaggggaacaagaacattcttgaactaatcgagtttttcgaagatgataccaggttctacctcgtatttgagaagttgcagggcggaagcatcctggcacatatccagaaacagaaacacttcaacgagcgcgaagccagcagggtcgtgcgtgatgtggcggctgctctcgatttcctccatacgaaaggaatcgcacacagggacctgaagcctgagaatatcctctgtgaaagtcctgagaaggtttcgcccgtgaagatttgtgactttgacctcgggagcgggatgaaacttaataactcgtgcacgcccattactacaccagaactcaccaccccctgtggttctgctgagtacatggcgcctgaagtcgtagaagtctttacggatcaggccactttctatgacaaacggtgcgacctctggtctcttggggtcgtactgtatattatgttgtctgggtatccaccttttgtcggccattgcggggcagactgtgggtgggaccgaggggaagtctgtagagtttgtcagaataagctattcgagagcatccaggaagggaagtacgaatttcctgataaagattgggcacacatcagctccgaagccaaggacttgatcagcaaactcttagttagagatgccaaacagcggctctcggccgcacaggtgcttcaacatccttgggtgcaggggcaggctcctgagaagggattgcccacacctcaggtcctccagcgtaattcatcaacaatggatctcacgctctttgcagcagaagccatcgcacttaacagacagttaagccaacacgaggaaaatgagcttgctgaggaaccagaggcgctcgcagatggcctctgctcaatgaaactgtctccaccttgcaaatccaggttggccaggagaagagctcttgcacaggccggacgcggagaggatagaagcccaccaactgccctatag

SEQ ID NO: 229581 - DNA, 1398 bp, Artificial Sequence
  Description of Artificial Sequence: Synthetic coding sequence
atggtatcctcccaaaaactggagaagccaattgaaatggggtcttccgagccccttcccatagcggatggagaccggaggaggaaaaaaaagagacgaggaagagccaccgattctttgccaggtaaattcgaagacatgtacaagctgacaagtgagctcctgggcgaaggagcatacgctaaggtgcaaggcgctgtgagcctacaaaatggcaaggaatacgccgtgaagatcatcgagaagcaagccggtcatagcaggtcccgcgttttccgtgaggtggaaaccctgtaccagtgccaaggcaacaaaaacatcctggaactcatcgaatttttcgaagacgatacaaggttttacctagtcttcgaaaagctgcaagggggtagcattctggcacacatccaaaagcagaaacatttcaatgagcgagaagcgtcacgcgtagtcagggacgtggcagccgctctggattttctgcacactaaagataaggtgtccttgtgccatctggggtggagtgcaatggccccttccgggctgaccgctgcaccaacctctttggggtcctcagaccctccaaccagcgctagtcaagttgccggtaccaccggcattgcacaccgtgacctcaaaccggagaatatcctgtgtgagtctccagaaaaggttagcccggtgaagatatgcgactttgatctgggcagcggtatgaaattaaacaattcctgtactcccattactactccggaactcactacaccttgcggttcagccgaatatatggcccctgaggtggtggaggtattcacagaccaggccactttctacgataaacgttgtgacctgtggtctcttggtgtggtcttatatattatgctgtcggggtacccaccattcgtcggacactgtggagccgattgcggatgggataggggcgaggtctgcagggtgtgccagaataagctctttgaaagcatacaggaaggcaagtacgagttccctgataaagactgggcccatatttcatctgaggctaaggacctaatatcaaagttgctcgtccgagatgccaaacaacgcctaagcgccgcacaagtgctccagcacccctgggtgcagggtcaagcacccgagaagggcttaccaacaccccaggtacttcagagaaattcctcaacaatggacctgacgctatttgccgctgaggccattgccctcaatcgccagctgtcacaacacgaagagaatgaactcgcagaggagccagaagcgctcgccgacggcctatgctcaatgaagttgagccctccatgcaagagtaggctagcccgtcgccgagcgctcgcccaggccggtagaggtgaggatagatctccaccaactgcgctgtag

SEQ ID NO: 229582 - DNA, 1044 bp, Artificial Sequence
  Description of Artificial Sequence: Synthetic coding sequence
atggtgagctctcagaagctggagaagcccatagagatgggatcctcagagcctttaccaatagctgacggagaccgcaggcggaaaaagaaaaggcgcggacgcgcaacagatagcctccccggaaaattcgaagatatgtacaagttaacttcggagttgctgggtgaaggcgcttatgccaaggtacagggtgcagtgtcacttcagaacggaaaagagtacgcggtcaaaatcattgaaaagcaagctggtcatagccgaagtagagtgttcagggaggtcgaaacactatatcaatgccagggcaacaaaaacatccttgagctgattgaatttttcgaggacgacacacgtttttaccttgtgttcgagaaactacagggtggatccatcttggcccatatccaaaagcagaagcacttcaacgagagagaggccagccgcgtcgtaagagacgttgccgctgccctggacttcctgcatacaaaaggcatcgcgcaccgggatttgaagcccgagaacatcctgtgtgaatctccagagaaggtcagccctgtcaagatttgcgacttcgatctgggtagcggcatgaagttaaacaattcctgcacaccaatcactacacccgaactgaccaccccctgcggcagcgccgagtacatggctccagaggtggtcgaggtctttacggaccaagctacattctatgataaacgttgtgatctgtggtctttgggcgtagtcctttatatcatgttgtctgggtacccccctttcgtaggccactgcggggctgattgcgggtgggatcggggtgaggtatgtagggtgtgtcaaaataagctttttgaatcaattcaagagggcaagtatgaatttcccgacaaagactgggctcatattagctccgaagccaaggacctgatctctaaactgttagttagggacgcaaagcagaggctgtcagccgcacaggtgcttcagcacccgtgggtgcagggcgagcagcaacacaatggtcccgatgcccttcgctcctag

SEQ ID NO: 229583 - DNA, 537 bp, Artificial Sequence
  Description of Artificial Sequence: Synthetic coding sequence
atggtgtcatctcagaaattggagaaacccattgagatgggctcaagcgaaccactgccaatcgcagatggagaccggagacggaagaagaagcgcagaggcagggcgacagatagcctacccggaaagtttgaggacatgtacaaactgacgtctgaattattaggagagggggcttatgccaaagtacagggggcagtaagcctccaaaacggaaaggagtacgctgtcaaaattatcgagaagcaggccggacacagtcggtcacgggtatttagggaagtcgagacactgtaccagtgccagggcaacaaaaatattttagagctgatagaattctttgaagacgatacccggttctacctggtgttcgagaaactccaaggtgggtccatactggcgcacatccagaaacagaaacatttcaacgagcgagaggcatccagagtggtccgtgacgtggcggcagctttagacttccttcatacaaaaggaatcgcacatcgggatcttaagcctgagaacattctgtgctag

SEQ ID NO: 229584 - DNA, 306 bp, Artificial Sequence
  Description of Artificial Sequence: Synthetic coding sequence
atggtttccagccagaagcttgagaaaccaatagaaatgggctctagcgagccactgccaatcgcggatggagaccgcagacggaagaaaaagcgcaggggacgcgctactgattccctgcccggaaagttcgaggacatgtacaaactgactagcgagctgctgggcgaaggcgcttatgcgaaagtgcagggagcggtgagcctgcagaacggcaaagagtacgccgtgaagattatcgaaaagcaggcagggcactccagaagccgggtcttcagagaagtggagactctgtaccagtgctag

SEQ ID NO: 229585 - DNA, 303 bp, Artificial Sequence
  Description of Artificial Sequence: Synthetic coding sequence
atggtttcatcacagaaacttgagaagcctatcgagatgggaagcagtgaaccactgccaatcgccgatggagaccgtaggcgaaaaaaaaaaaggcgtggccgagcaaccgattctcttccagggaagttcgaggacatgtacaagttaacatctgagttactgggagagggtgcttacgccaaagtacagggcgcagtttcccttcagaatggaaaggagtacgcagtaaagattatcgaaaagcaagcaggccactctaggtcaagggtgttccgagaggttgagactctgtatcaatag

SEQ ID NO: 229586 - DNA, 402 bp, Artificial Sequence
  Description of Artificial Sequence: Synthetic coding sequence
atggtgtcttcacagaagttggagaagcctatagaaatgggcagtagtgaacccttacccatagctgacggggataggcgaagaaagaagaagcgacggggtcgcgcaactgatagtctgccaggaaagttcgaagacatgtacaaacttactagtgagctgttgggcgaaggcgcttacgcaaaggttcagggagcagtgtccctgcagaatgggaaggagtacgccgtgaagatcattgagaagcaggcaggtcactcccggtcccgtgtcttccgagaggtggagaccctctatcagtgccagggtaataaaaacatacttgaactgatcgaatttttcgaggacgacactcggttctatttggtgttcgaaaagctccagggaggtacgtatcgctag

SEQ ID NO: 229587 - DNA, 1398 bp, Artificial Sequence
  Description of Artificial Sequence: Synthetic coding sequence
atggtgcaaaaaaaacccgcagagcttcagggctttcaccgatcatttaagggtcagaatcctttcgagctcgcgttttccctcgatcaacctgatcacggcgacagtgacttcggtctacagtgcagcgctcgacccgacatgccagctagtcagcctatagacattcctgacgctaaaaagcggggtaagaagaagaaaagagggagggcgactgatagctttagcggccgatttgaggacgtctatcagctgcaggaggatgtgctgggtgagggggctcacgctcgcgtccagacatgcatcaatctgattacgagccaggaatacgctgtgaaaattattgaaaagcagcccggacatatcagatcaagggtgttcagggaagtagaaatgctttaccagtgccagggccatcgcaatgtactggagctgatagaattcttcgaagaggaggaccgcttctatctcgtgtttgagaagatgagaggcggtagtattttgagccacatccacaagcggaggcacttcaatgaacttgaagcctccgttgttgttcaggatgttgcctctgcactggactttctacataataagggcatcgcccacagagatttgaagcctgaaaatatactctgtgagcatccaaaccaggtgtcacctgtgaagatttgcgacttcgacttgggaagtggtataaagctcaatggagactgcagtcctatctctacgcctgagcttctgacaccatgcggatccgcagaatatatggctcccgaagtggtagaggcttttagcgaggaagccagcatttatgacaagcggtgcgatctctggagcctcggtgtcatactgtatattttgctcagcggctatccaccatttgtaggacggtgcggctccgattgtggatgggatcggggagaagcctgccctgcctgtcagaatatgttgttcgaaagcatacaagagggcaaatacgagttcccagacaaagattgggcacatatctcttgcgcagctaaagacttgatctcaaagctgctggttagggacgccaaacagcggctgagtgccgctcaggtgctccagcatccttgggtccaaggttgtgccccagagaatacattgcctactccaatggtcctgcaaaggaacagttgcgccaaggacctcaccagcttcgccgcagaagctatcgccatgaatagacagctcgcgcagcatgacgaggatctggccgaagaggaggcagccggacagggccaacccgtcctcgtgcgggctacgtctaggtgcctccagctgagcccgccaagccaatccaagctcgctcagaggcggcagcgcgcaagcctgtcctcagctccagtggttctcgtgggcgatcatgcctag

SEQ ID NO: 229588 - DNA, 1245 bp, Artificial Sequence
  Description of Artificial Sequence: Synthetic coding sequence
atggtgcaaaaaaagccggctgaactgcaaggatttcaccggtcctttaaaggccaaaaccctttcgagctcgcgttctctttggaccaacccgaccatggtgattcagacttcggccttcagtgttccgcgagaccggacatgccagcatcacagcctattgatatcccagacgccaaaaagaggggcaagaagaaaaagaggggcagagcaacagacagctttagcggtcgctttgaagacgtctaccagctgcaagaggatgttctgggagaaggggctcacgccagggtgcagacttgtattaatctgatcacaagccaagagtatgcggttaaaatcatagagaaacagccaggacacattcgttcccgcgttttccgggaagtggaaatgttgtatcaatgccagggtcaccgcaacgtgcttgagttaatcgaattcttcgaagaggaggatcggttctatctagtgtttgagaaaatgcggggtggctcaatattgagccacattcataagaggcgacactttaacgaattagaagcctctgtggttgtacaggacgtcgccagcgcactggacttcctccacaataagggcatcgctcacagggacctgaagccagaaaacatattgtgtgaacatcccaaccaggtgagccctgtcaagatctgcgatttcgacctaggctccgggatcaagttgaacggcgattgcagtcctatctctacccccgagcttctcacgccatgcgggtcagcggagtatatggctccagaggtagtggaggctttctctgaagaagcgtctatctatgataagcggtgcgacttatggtctctcggcgtgattctatatatcctgttgagtggctacccaccctttgtgggcaggtgtgggagtgactgtggctgggaccggggtgaagcctgccccgcttgccagaacatgctgttcgagtcaatccaggaaggaaagtatgagtttcccgacaaagattgggcccatatttcttgtgctgccaaggacttgatctcaaagttgctggttagggatgcgaaacagagactgtctgccgcacaggtgcttcagcatccctgggtgcaggggtgcgccccagaaaacacccttcctacccctatggtgctgcagagatgggattcccatttcctgcttccgcctcacccatgtcgcattcacgtcaggccgggaggcctggtgcgtaccgtcaccgtgaatgaatag

SEQ ID NO: 229589 - DNA, 1005 bp, Artificial Sequence
  Description of Artificial Sequence: Synthetic coding sequence
atgctgtaccagtgccagggtcatcggaatgtcttggagttgatagagttcttcgaagaggaagatcgtttctatcttgtttttgaaaaaatgaggggagggagtatcctgagccatatccacaaacggagacattttaatgaactcgaggcttccgtggtggttcaggacgtggcctcggccctggacttcctccacaacaaaggcatcgcgcaccgagacttgaaaccagaaaatatcctgtgtgagcaccctaaccaagtcagccccgtaaaaatctgcgactttgatttggggtcgggtattaagctgaacggcgattgctccccaatcagcacaccggagctcttgaccccctgtggatccgctgagtacatggcacccgaagtggtggaagccttttccgaagaggcatctatttacgataaaaggtgcgacctgtggagtctgggtgttatcctgtacattctgttgagtggataccctcctttcgtgggtcgctgcggatcagactgcggctgggacagaggtgaggcctgccctgcatgccagaatatgctgtttgaatccatacaggaaggcaaatacgagttcccagataaggactgggcccacatcagctgtgccgcaaaggacctgatctcaaaattactggtcagagatgccaagcagagattaagtgcagcccaggtgttacaacacccttgggtccagggatgtgcacctgagaatacactgcctacccccatggtgctccagagaaactcgtgtgcaaaggatcttacctcatttgccgctgaggcaatcgccatgaacaggcagcttgcgcaacacgacgaggacctggcagaagaagaggcagccggacagggacagcccgtactggtgcgggcaacctctcggtgcttacagcttagcccgccaagtcaaagcaagctcgctcagcgcaggcagcgcgcatctttatcctcggcgccagtggttctagtgggggatcacgcatag

SEQ ID NO: 229590 - DNA, 1218 bp, Artificial Sequence
  Description of Artificial Sequence: Synthetic coding sequence
atgccagcttcacagcctattgatatccctgatgccaagaaaagaggtaagaaaaagaagcggggacgggcaaccgactccttttcaggtcgctttgaagacgtctaccagttgcaggaggacgtcctaggggagggcgcacacgccagggtgcagacctgtattaatctgattacaagtcaggaatacgccgtgaaaattatcgagaagcagccgggtcatataaggtcccgcgtctttagagaagttgagatgctctaccagtgtcagggccaccgcaacgttttggagctgattgaaaagatgagaggtggttccattttgagccatatccataaacgtcgacacttcaatgaacttgaggcttcagtggtggttcaagatgtggcctctgcattagacttccttcacaacaaggggatcgcacacagagatttgaagcccgagaacatactttgcgaacatccaaaccaggtgagtcccgtaaagatttgtgattttgacctgggcagtggcatcaagctgaatggcgactgctctcccatatcaacaccggaactgctgaccccttgtggctccgcagagtatatggctcccgaagtggtggaggccttcagcgaggaagcatccatctacgataaaagatgcgacctttggtccctcggcgttatactctacatcctgctgagcggctatcccccttttgtcggcagatgtggttccgattgtggctgggataggggagaggcttgccccgcatgtcagaatatgctgtttgagtctatacaggaggggaagtatgagttcccagacaaggactgggctcacattagctgcgccgcaaaggacttgatctcgaagctcctcgtgcgcgatgctaaacagaggttaagcgctgcgcaagtcctgcaacatccttgggtccagggatgtgccccagaaaacacgttacctaccccgatggtgctgcaaaggaactcatgcgccaaggacctaacttcctttgctgccgaggctatagccatgaatcgtcagttggcccagcatgatgaggacttggcagaagaggaggccgcaggacagggccagcctgtcctcgtgcgggcaacctcaagatgcctgcagctgagtccgccttcccagagcaagttagcccagaggagacagcgggcaagtctgagctctgcgccagtcgtgttggtgggagatcatgcttag

SEQ ID NO: 229591 - DNA, 2388 bp, Artificial Sequence
  Description of Artificial Sequence: Synthetic coding sequence
atgtccgccagaacgccccttccaaccgtcaatgagcgggacactgagaaccacactagtgtcgatggatatactgaaccacacatccagcctacaaagtcctctagtcgacagaatattcctaggtgccggaactccatcacctccgctactgatgagcaaccccatatcgggaattaccggttacagaaaaccattggaaaaggcaattttgcaaaggtgaaactggccaggcatgttcttactggcagagaagtggccgttaagatcattgacaaaacacaactaaatcccacctccctgcaaaaactttttcgagaagtacggattatgaagatcctgaaccatcctaatattgtcaagctgttcgaggtcatagagacagaaaaaacgctctatctggttatggaatatgcttcaggcggtgaagtctttgattacctggtggctcacggtcgcatgaaggaaaaggaggcgagagcgaaatttagacagattgtgagcgcggtgcagtactgtcatcagaagtatattgtgcatcgggacctcaaagccgaaaacctcctgttagacggcgatatgaatattaaaatcgcagatttcggcttttccaatgagttcactgtcggcaataagttagacacattttgtggcagcccaccgtatgcggcacctgaactgtttcagggtaagaaatacgacggccctgaggtagatgtctggtcattgggcgttattttatataccctggtgagcggctcgttaccattcgatgggcagaacctgaaggagctacgtgaaagagttctgcggggtaagtatagaataccgttttatatgtcgactgactgcgagaacctcctcaagaaactgcttgtgcttaatcccattaagcgcggatcactagagcagattatgaaggaccggtggatgaacgtgggacacgaggaagaggaactcaagccatacaccgaaccagatccagatttcaacgacaccaagaggatcgacatcatggtgacgatgggattcgctagggacgaaatcaacgatgccctgatcaaccagaagtatgacgaggtgatggctacgtatatcctgctggggaggaagccacctgaattcgaggggggagaatcactcagtagtggtaatctgtgtcaacggtcaaggccaagctcagacctcaacaactctactttgcaatccccagctcacctgaaagtgcaaaggtctattagcgcaaatcagaaacagaggcggttcagtgatcacgcgggtccaagcataccgcctgcggtttcttacacaaaaagacctcaggccaactcagtagaaagcgaacagaaggaggaatgggacaaagacgtagcaagaaagttggggtccactactgttgggagtaaatctgagatgactgcatccccacttgttggtcccgaaagaaagaagtctagcacgattcctagtaataatgtttattctggaggtagtatggcacgacggaatacatatgtgtgtgagaggacgacagataggtacgtagccctacagaatgggaaggactcctcccttaccgaaatgtctgtgagttccattagcagtgcgggatcaagcgtcgcttccgctgttccctctgccaggccacggcaccagaaaagcatgtctacttcaggccacccaatcaaggtcaccctgcctaccataaaggatgggtccgaagcgtatcgccctgggacaactcagagagtgccagccgcaagcccttccgctcattcgatttccactgccactcccgacaggacaaggttccctaggggatcttccagccggagtaccttccacggagaacagcttcgagagcgcaggtcagtggcctacaacggcccaccagccagtccatctcatgagacaggggctttcgcccacgctcgacgtggtacttccacaggaataattagtaaaatcaccagcaagttcgtccgtcgcgatcctagtgagggtgaggcatccgggagaaccgataccagcaggtctacaagcggcgaaccgaaagagagagataaggaggaggggaaagattccaagcccagatccctgagatttacctggtccatgaaaacaacatccagcatggaccctaacgacatgatgagggaaatccggaaagtcctggatgctaacaactgcgactatgaacagaaagagcgattcctcctgttctgtgttcacggcgacgcgcgtcaagactccttggtccagtgggagatggaggtctgtaagctgccacgtttaagtttgaacggcgtaagattcaagagaatctccgggacatctatcgcattcaagaacattgcttctaagattgccaacgaactgaaactatag

SEQ ID NO: 229592 - DNA, 2277 bp, Artificial Sequence
  Description of Artificial Sequence: Synthetic coding sequence
atgtctgcaagaaccccactgcctaccgtcaatgagagggacactgagaatcatactagcgtcgatggctataccgaacctcacatccagccaacgaaatctagcagtcgacagaacattccacgctgtcgcaattccatcacaagtgcgacagatgaacaacctcacattggcaactaccggttacagaaaactatcggaaaagggaactttgccaaggtcaagctggcgagacacgttctcaccgggagagaagtagcagtgaagataattgataaaactcaactcaaccccacaagtctacagaaattgttccgggaagttcgtatcatgaaaattctgaatcaccccaatatcggggaggtgttcgactatttagtcgcccacggcagaatgaaagagaaggaagcaagagccaagtttcgccaaatcgttagtgccgtgcaatactgccaccagaagtatattgtgcatcgagacctgaaggctgaaaacctccttctggacggggacatgaacatcaagatagctgactttgggttttccaacgagttcaccgtgggaaacaagctggacacattctgcggcagcccgccttatgccgctccggagctgttccagggaaagaagtacgatgggcctgaggtagacgtctggtctctcggcgtgatcctgtataccttggttagcggaagcctgccatttgatggccagaatctcaaagagctaagggaacgggtcttgagggggaaataccgcattcctttttatatgtcaacagactgtgagaacctgttgaagaaactgcttgtgctcaatcccattaaacggggatccctggagcaaattatgaaggaccggtggatgaacgtgggccatgaagaggaagaattgaaaccatataccgagcctgatcctgacttcaatgatacaaagcgcatcgatattatggtgaccatgggtttcgctcgggacgaaatcaacgatgcactcataaaccaaaagtacgacgaggtcatggcaacctatatcctcctggggagaaaaccacccgaatttgaaggaggagagagtctttctagcgggaatctgtgccagcgtagtcggccatccagcgacctgaataacagcaccctgcagtctcctgctcacctcaaagttcagaggagcatttccgctaaccagaaacaaaggagatttagcgatcacgctggcccttcgatccctcctgcagtgtcctatactaaacgcccacaggccaacagcgtggagtccgaacagaaggaagaatgggacaaggacgttgcccgaaaattgggctccaccaccgtgggatccaagagtgagatgaccgcaagcccacttgtgggccctgagaggaaaaagtcctctacaatcccttcaaacaatgtttactcgggtggatccatggcgaggcgaaatacatacgtgtgcgaacggactacagaccggtatgtggcgctgcagaacggaaaggatagttcactgacagagatgagcgtgtcatctatctcgtccgccggatccagtgttgcttcagccgtgccgagcgcacgtccgcgacatcagaaatctatgtcgacctcaggccacccaattaaggtaacccttcccaccattaaagatggtagcgaggcgtatcggcctggcacgacgcagcgggtgcccgcagcctcaccttccgcgcacagcattagcacagcaacccctgaccgaaccaggtttccacggggaagctcatctcgcagtactttccacggggagcaactccgggagcgtcgctccgttgcgtataacggacctcctgccagcccgtctcatgaaaccggagcttttgcacatgccaggcgcggtactagcaccgggatcatttccaagatcacttccaagttcgtgcgacggagcacctctggagaaccgaaagaaagagacaaggaggaaggaaaagactcgaagcctagatccctccgattcacttggtccatgaaaaccacctcttccatggatccaaacgatatgatgagggagattaggaaagtgctagatgcaaacaattgtgactacgagcagaaagagcgcttcctgctgttctgcgtccatggagacgcccgtcaggactctctggtccagtgggagatggaagtgtgcaagcttccgcgtctcagcttgaatggtgtgagatttaaacgtataagtggcacctcaattgcttttaagaacattgctagcaagattgccaatgaactcaagctgtag

SEQ ID NO: 229593 - DNA, 1938 bp, Artificial Sequence
  Description of Artificial Sequence: Synthetic coding sequence
atggaatatgcctcaggaggcgaagtgttcgactacctagtagcacatggacgcatgaaagaaaaggaggcccgagctaaattcaggcagattgtgagtgcggtgcagtactgtcaccaaaagtacatcgtccacagggaccttaaagctgaaaatctgctcctggatggtgacatgaatatcaagattgccgactttggtttctctaatgaatttacagtgggaaacaagcttgataccttttgtggatcacccccttacgcggctcctgaactctttcaaggcaagaaatatgatggtcccgaggtggacgtgtggtccctaggcgtcatcctgtacaccctagtctcagggtccctgccctttgatggtcagaacttgaaggagctgagggagagagtgctaagaggcaaatacaggattcccttctacatgtccaccgactgtgagaatctgttgaagaagttactggtgctgaatccgatcaaacggggttctctcgagcagatcatgaaggacagatggatgaacgtgggacacgaggaagaagagcttaagccttatacagagccagacccagatttcaacgatacaaagcggattgacatcatggtgacgatgggattcgccagggatgaaattaacgatgctctgatcaaccaaaaatacgatgaagtaatggctacctatatccttctaggcagaaaaccccctgagttcgaaggtggcgagagccttagctccggcaatctctgtcagaggagtcggcctagttcagatctgaacaactccacgttgcagtcccccgcacacctgaaagtgcagcgctcgatttcagccaatcagaagcagaggcgctttagcgatcacgcaggcccaagtattcctcccgctgtgtcttataccaaaaggcctcaagccaattctgtagagtctgaacaaaaagaggagtgggacaaggacgtggcacgcaagcttgggagtaccacagttggcagcaagagtgagatgacagcttcgccactggtgggacctgagcggaaaaagagcagcaccattccatcaaataacgtctattccgggggttccatggccaggagaaatacatacgtgtgcgagaggacgaccgacaggtatgtcgccctccaaaatggcaaagactccagcttaacagagatgagtgtctcctccatctcttcagccggatcatcagttgcatcagctgtgcccagcgctagaccgaggcatcagaaatctatgtcaacatcaggacacccaatcaaggtcaccttacccacaattaaggacgggtcagaggcctatcgccctggcacgactcaaagggtgcccgcagcctctccatccgcccactctatctctacggccacaccagaccggaccaggtttcctcgagggagtagctctcggtctacttttcacggagagcaactgagagagcgaagaagtgtggcttacaatgggccacccgcaagccctagtcacgaaactggcgcttttgcccacgcgagacgaggaacaagcaccggcattattagtaaaataacgtcaaaatttgtccgacgatcaacctccggagagcctaaagagagagacaaagaggaggggaaggactccaaaccgaggtctctgaggtttacctggtccatgaagacgacctcttccatggaccccaatgacatgatgagggagatacgcaaggtgctggacgccaataattgcgattacgagcaaaaagagcggttcctcctgttctgtgtgcatggtgatgcccgtcaggacagtctggtccaatgggagatggaggtttgtaagctgccaagactgtcccttaatggagtaagattcaaaagaatttccggaacctccatcgcattcaaaaacattgcctccaaaattgctaacgaactcaagctgtag

SEQ ID NO: 229594 - DNA, 2340 bp, Artificial Sequence
  Description of Artificial Sequence: Synthetic coding sequence
atgagctccgcccgaacaccactgccaaccctgaacgaaagggacactgaacaacctacactcggccacctggacagtaaacccagctccaagtcaaatatgatcagggggaggaactctgctacgagcgcggacgaacagcctcacattggcaattatagactacttaagaccatcggtaagggaaatttcgcaaaggtgaagttggcccgtcatattctgacaggcaaggaagtggctgtcaagattatcgacaaaactcagttaaattcttcttccctccaaaaactgttccgcgaggtgcgcattatgaaagttctcaaccaccccaatatagtgaaactgttcgaagtcatcgaaactgaaaagactctctacctggttatggaatacgcttcaggcggtgaggttttcgattatctggtggctcatgggagaatgaaggaaaaagaggcaagggccaagttccggcagatagtcagtgccgtgcaatactgccaccagaagtttattgtgcaccgggatctgaaagctgagaatctgctcctggacgccgatatgaatatcaaaatcgctgatttcggattttctaatgaattcaccttcgggaataagctcgacactttttgtggatcccctccgtatgcagcacctgagcttttccagggaaaaaaatacgatggccctgaggtggacgtatggagcctcggggtgatcctttacaccttggtctccggatcgcttccctttgacggccagaatctgaaggaattgcgcgagagagtgcttcggggaaagtaccggattcctttctacatgagtaccgattgtgagaacctgttaaagaaattcctgatactgaatccctcaaagagaggcaccctcgagcagatcatgaaagaccgatggatgaacgtcggacacgaagacgacgagctgaaaccttacgtggagccactgcccgactataaggacccaaggcgcaccgaactgatggtgagcatgggttacacccgagaggagattcaggactccctggtggggcagaggtataacgaggtgatggcaacataccttttactaggttacaaaagctcagagctggagggagataccatcacactcaagccgagaccctccgctgacctgacgaacagtagcgccccatctccctctcacaaggtgcaacggagcgtatcagctaaccccaaacaaagacgattttcagatcaggctgctggtccggctatcccaacgtcaaacagttacagcaagaagactcagtcaaataatgccgaaaacaagcggccagaggaggatcgtgaaagcggccgaaaagccagtagcacagccaaagtgccggcttctcccctgccaggtttggagcgtaaaaaaaccaccccgacaccatctaccaattccgtgctatcaacaagtaccaataggtcacggaactccccacttctggaacgggcatcactgggccaggcgtctattcagaacggcaaggatagtctgaccatgccgggatcacgggctagtacggcctcagcttccgccgctgtttccgccgcacggcctcgccagcaccagaagtccatgtccgccagcgtgcaccccaataaggctagcggactgcctcctaccgaaagtaactgcgaagtcccgagaccatccacagccccacagcgcgtgcccgtggcttctccctccgctcataacatttctagctctggcggagcccctgacagaactaacttccccaggggtgtgagttcccggagcacattccatgcaggtcagctaagacaggtgcgggatcagcaaaatcttccttacggcgttacgccagcttccccatctgggcatagtcaaggacggagaggtgctagtggtagtatcttcagtaaattcacaagcaaatttgttcgacgcaatctgaatgaacctgaatcaaaagatcgggtagaaacactaaggcctcatgtagtaggttctggcggaaatgacaaagagaaggaagagttccgggaagccaagccgcgtagtctgaggttcacctggtccatgaaaacgacatcatcaatggaacccaacgagatgatgcgagagatacgtaaagtcctggatgccaactcatgtcagtccgaacttcacgagaagtacatgctgctgtgcatgcatggaacacctggacacgaggactttgtccagtgggaaatggaagtgtgcaagcttcctcgactatcactaaacggtgttcggttcaagcgtatctctggcacaagcatggccttcaaaaacattgcttctaagatcgcaaacgaactcaaactttag

SEQ ID NO: 229595 - DNA, 2130 bp, Artificial Sequence
  Description of Artificial Sequence: Synthetic coding sequence
atgtctagcgcccgaactccactgccgactctgaatgagcgcgacacagagcagcccacgctgggacacctggatagcaagccgtcctccaagtctaacatgatccgcggacgcaatagcgctacgtcagctgacgagcagccccacattggtaactaccgcctgctcaagacaattggtaaaggaaactttgccaaggtcaaattggccaggcatatccttaccggtaaggaggttgccgttaaaatcatagacaagactcagctcaatagctctagtctgcagaagctctttagagaggtaagaatcatgaaggtgctcaatcacccaaacattgtcaagttgtttgaggtgattgagaccgagaaaacgctctacttggtgatggagtacgctagcgggggagaagtgttcgactaccttgttgcccatggaaggatgaaggagaaggaggccagagccaaattccgtcaaatcgtttctgctgtgcagtactgccaccagaagttcatcgtccatcgggacttaaaggcagaaaacctgctgttggacgccgatatgaacatcaagatcgccgacttcggtttcagtaatgagttcaccttcggcaacaagctggacaccttttgcggctcccccccatacgctgcacccgagcttttccaaggaaagaagtatgatggacctgaggttgatgtttggtctctgggcgtcatcctctacacactggtgagcggctccctacccttcgatggccaaaacttaaaggagctgagagagcgagtcctcagaggcaagtatcggatccccttctacatgtccaccgattgcgagaacctgctcaagaagtttttgattcttaatccttccaaaagaggaaccctcgagcagatcatgaaggacaggtggatgaatgtcggacatgaagacgacgagctgaaaccctatgttgagcccctcccggactacaaggaccctcgaagaaccgagttgatggttagtatgggctacaccagagaagagattcaggattctctggtcggccagagatataatgaagtgatggctacttacctattactgggttacaaaagttccgagctggaaggtgatacaattacgctgaaacctagacccagtgccgaccttacgaactcaagcgcaccctcaccatctcataaagtgcagcgcagcgtgtccgccaacccaaagcagcggagatttagtgaccaggccggtcctgcgatacccacctcaaactcgtacagcaaaaagactcagagcaataatgccgaaaacaagcggcctgaagaggatcgggagtccggaaggaaggcatcatctacagcaaaggtgccggcatcacctctgccaggacttgaaaggaagaagaccaccccaacgccatccacgaacagcgttctatctacctccactaataggtcgcgcaacagcccactgcttgaacgagcttctctcgggcaagcttctattcaaaacggcaaagacagcacagctcctcaaagggtgccggtggcttccccaagcgcacataacataagtagctccggtggcgctcccgaccgcaccaattttcccaggggagtatcgagcagatcaacatttcatgcgggacagcttcggcaagttagagatcagcagaaccttccatacggggtgactccggcatccccttcgggccatagccaggggcgtcgtggtgccagtggcagcatatttagcaagttcacctccaaattcgtgcgccgtccccacgtcgttggctccggtggaaacgataaggagaaggaggagttcagagaagccaagcctcgaagcctgcggttcacatggtcaatgaaaacaaccagcagcatggagcctaacgagatgatgcgggaaatccgcaaagtactggacgctaacagctgccaatctgaactgcacgaaaagtacatgttgctgtgcatgcatggcacacccggacacgaagacttcgtgcagtgggaaatggaagtctgtaagttgcctcggttgtctctgaatggagtacgctttaagaggatcagcggaacaagtatggctttcaaaaacatagcctccaaaatcgctaacgagctaaagttgtag

SEQ ID NO: 229596 - DNA, 2160 bp, Artificial Sequence
  Description of Artificial Sequence: Synthetic coding sequence
atgtccagtgctcgcacaccactgcccacactcaatgaacgggataccgaacagccaaccctgggtcacctggacagtaaaccctcctctaagtccaacatgatcagaggacgcaatagcgctacgtccgcagatgaacagccccacatcggcaactaccggctgctgaagacgatagggaagggcaacttcgccaaggtgaaactggcccgtcacatacttaccggcaaagaggtggctgtcaagatcattgataaaacccaactcaactcatcttcgcttcagaagctctttagagaagtgcgaatcatgaaggtcctgaaccaccctaatatagtgaagctgttcgaagtgatcgaaacagagaagaccctctacctcgtgatggaatatgctagcggaggcgaggtcttcgattacctggttgcccacggcaggatgaaagaaaaagaggctcgtgcgaaattcaggcagatcgtttccgctgttcagtattgtcaccagaagtttatcgtgcaccgtgacctcaaagcagaaaacctcttactcgatgccgatatgaacataaagattgccgattttggattttcaaatgaatttactttcgggaataaattggatacattctgcggaagccctccttacgctgctcccgaactgttccaggggaaaaagtatgacggaccagaggtggacgtatggagcttaggagtcatcttatataccctggtgtcagggagcctccccttcgatggacagaacctgaaagagctgagagaacgggtgctgcggggaaagtatcgtatccccttttacatgtcaaccgattgcgaaaacctgttgaagaagtttctgatactgaacccgagcaagcggggaaccttagaacaaattatgaaagaccggtggatgaatgtgggtcatgaggacgacgaactgaagccctacgttgagcccctgccggactataaagatccaaggcgaaccgagcttatggtctctatgggctatacccgggaggaaatccaagattcgctggtcggccagaggtacaacgaagtgatggctacctatctgcttctcggttacaagtctagcgaactggagggggataccattacactgaaacccaggcctagtgctgaccttaccaactctagtgccccaagtccgagccacaaagtacagagatccgtgtccgccaacccgaaacagcgacgcttctctgatcaggccgctggacctgccatccctacaagtaacagctactcgaaaaagacgcaatcgaataatgccgagaataagaggccagaagaggatagagagtcagggagaaaggcttcatctacagcaaaagtgcctgctagtcctctcccagggttagaaaggaagaagacaacacccacgccgtctacaaactcggtgctttcgacatccacaaatcgcagccgcaacagccctttgctcgagcgcgcatccttaggccaggctagcatccagaatggtaaggattctaccgcccctcaaagagtgcccgtggcttcgccttccgcacataatataagctcgtcagggggagccccagacagaacaaacttcccgagaggagtgagcagccggtcgacttttcacgccggtcagctgcggcaggtgcgggaccagcagaatctgccgtatggtgtgacccctgcttccccttccggccactcacaaggacggagaggagcgtcaggatctatttttagtaagtttacctccaaatttgtgcgccgaaacttgagctttagatttgccagacgtccacacgtcgtgggaagtgggggtaacgataaagagaaggaggaattcagagaggccaagccaagaagcctgaggttcacctggtctatgaaaactacctcatcgatggaaccaaatgaaatgatgagggaaatacgcaaggtcctggatgcaaattcatgccagtctgagcttcacgagaagtacatgttactgtgcatgcatggtacaccaggccatgaggattttgttcaatgggaaatggaagtgtgtaaactgccacgcctttccctgaacggggtgagatttaagaggataagcggcacgtccatggcctttaaaaacatcgccagcaagatagctaacgagctcaagctgtag

SEQ ID NO: 229597 - DNA, 2322 bp, Artificial Sequence
  Description of Artificial Sequence: Synthetic coding sequence
atgagctctgcaaggacaccgctcccaactttgaatgaacgagacacagaacagcccactttaggacacctggactcaaagccctctagtaaaagcaatatgattaggggcagaaacagcgccactagtgccgatgaacaaccacatatcgggaactatagactcctgaaaacaatcgggaagggaaatttcgcaaaagttaagctggccaggcacatcctcactgggaaggaagtggccgttaagatcattgataagacacagcttaactccagtagcctacagaaactttttagggaggtgcggataatgaaggtgctgaaccatcccaacatcgtgaaactcttcgaagtgatcgaaaccgagaagaccctctatctggtgatggagtacgcctcaggaggagaagtcttcgactacttggttgcacatggcagaatgaaagaaaaagaggctagggccaagttccggcagatcgtgtccgctgttcagtactgtcatcagaagttcattgtgcaccgagatttgaaggccgagaatctgcttctcgatgccgatatgaacataaagatagcagacttcgggttcagtaatgaatttactttcgggaacaagttagatactttctgtggcagccccccatacgctgcgcctgaactatttcagggtaagaagtatgatgggccagaagtagacgtgtggagcctgggagtgatcttgtatacgctcgtgagcggctccctccccttcgacgggcaaaatctgaaagagctgcgcgagcgtgtactccgaggcaaatatcgaatccccttctatatgagcacggactgtgagaacctgctgaagaagttccttattttgaatccctcaaagcggggtaccttggagcagatcatgaaggaccgttggatgaatgtgggccacgaagacgatgagctgaaaccctatgtagaacctctgccagattacaaggacccacgcaggactgagctgatggtgagcatgggctacaccagagaagagatccaagattcactcgtggggcagcggtacaacgaagtaatggcgacttacctgctcctcgggtataagtcgtctgaactggagggagatacgatcacgctcaaaccccgtcccagtgccgatctcaccaactccagtgccccaagcccttcgcacaaggtgcagcgctcagtgtctgcaaacccaaaacagcgcaggttctctgatcaggccgcaggcccagccatccccactagtaactcatactcaaagaaaacacaatcgaataacgctgaaaataagcgacccgaggaggatcgggagagcggacgaaaagcctcttcaacagccaaagtcccagcatctccattgcccggactggaacgaaaaaaaactacgcccactccatctaccaacagtgtgctgagcacgtcaaccaataggtccaggaacagcccactccttgagagagcctccctgggccaggccagcatccaaaatggaaaagattcactcaccatgcctgggagcagagcttctaccgcaagcgcctcggccgctgttagtgccgctcggcctcgccagcaccagaagtccatgtcagcaagtgttcacccaaataaggcgtcaggcctccccccaaccgaaagtaactgtgaggtgccgagacctagtaccgctcctcaacgcgttccagtcgcttccccatccgcacataatatttccagttcgggtggcgctcctgatagaacgaattttccccgtggtgtgtcttcccggtcaactttccatgccggacaattgaggcaggtgcgtgaccagcagaacctgccgtacggcgtgacgcccgcatcccccagcgggcattcccaggggaggcggggagccagtggtagcatttttagtaagtttacctctaagttcgtgcggcgaaacctgtcctttagattcgcacggagaccccatgttgtgggcagtggcggaaatgataaagagaaagaggagtttcgcgaggcgaagccccgttcgctgaggtttacctggtcgatgaaaactacatctagtatggagccaaatgaaatgatgcgggagatcaggaaagtgttggacgctaactcttgccaatcagagttgcatgagaaatatatgctgctctgcatgcacgggaccccgggacacgaagactttgtacagtgggagatggaagtctgcaaactacctagactctccttgaatggtgtacgcttcaagaggatctctggcaccagcatggcttttaaaaatatcgccagtaaaatcgcgaacgaactcaaactctag

SEQ ID NO: 229598 - DNA, 2076 bp, Artificial Sequence
  Description of Artificial Sequence: Synthetic coding sequence
atgatccggggaaggaactccgccacctcagccgacgaacagccacatattggcaactatcgcctgctaaagacaattggcaagggcaactttgctaaagtgaaattagctaggcacatcctcaccggtaaagaagtggccgttaaaatcatcgacaaaacacagttgaatagctctagccttcagaagttgttccgggaggtcagaatcatgaaggtgttgaaccatcccaacatcgtaaaattatttgaagtgatagagaccgaaaaaaccctctacctagtgatggaatatgcgtcaggtggcgaggtcttcgactacctcgtcgcacatggtcggatgaaagaaaaggaggcacgggcaaaatttcggcagattgtgtctgccgtgcagtactgtcatcaaaagtttattgttcacagagatcttaaagccgagaatttactgctggacgctgacatgaatattaaaattgccgattttgggttcagcaacgaatttaccttcggtaataagctcgatacattctgtgggtcccccccatacgccgcacccgaactgtttcaggggaagaaatatgacggccctgaggtcgacgtatggagcctcggcgtgattctctatactctggtttccggtagcctgccatttgacggtcagaatctgaaagaactgagggagcgggtgttgcgaggcaaatatcgcattcccttttatatgagtaccgactgtgagaacctgttaaaaaagttccttatactgaatcccagcaagagggggactctggagcagatcatgaaagaccgatggatgaacgtggggcatgaggatgacgagctgaagccctacgtggagccacttccagattataaagaccctcgcaggactgagttgatggtttcgatgggatatacaagggaagagattcaggacagccttgtggggcaacgatacaacgaagtaatggccacctatttgctactcggctataagtcaagcgagctggagggagacacaatcactctgaaaccgaggccatctgcggacctcacgaacagctcggccccatctccctctcataaagtgcagcgttcagtgtccgccaaccccaaacagcgccgattctcagatcaggccggacctgcaattccaaccagcaattcttatagtaagaaaacccagtccaacaacgccgagaacaagaggcctgaggaggatagggaaagtggaagaaaagccagctcaaccgccaaagtccctgcatccccgctgccgggactggagaggaagaaaaccactcctactccaagcaccaactccgtcttatctacatccactaatcgcagccgcaattcacctctacttgagcgagcctcactgggccaggccagcatccagaatggcaaggattctactgcgccacaacgcgtgccagtcgcatctccatccgcccataatatctcaagcagcgggggagcccctgaccggacaaactttcccaggggcgtttcaagccgttccactttccacgctggccagctgaggcaggtgcgagaccagcagaacttgccgtacggggtcactcctgccagccctagtgggcattcccaaggccgaaggggcgcaagtggtagcatattttcgaagttcacttctaagttcgtgcggaggaaccttaatgagcctgaatcaaaggatcgagtagagactctgaggccccacgtagtcggatcaggaggaaacgacaaggaaaaagaagagttcagggaagcaaaaccaaggtcgctaagatttacctggagcatgaagaccacaagctctatggagccgaatgagatgatgcgggaaattaggaaggttctggacgccaactcctgtcagagtgagctccatgagaaatacatgctcttgtgcatgcacgggacacctggccatgaggatttcgtgcaatgggaaatggaggtctgtaagctgccaagactctctctaaacggcgtgagatttaagagaatcagcgggaccagtatggcctttaaaaacatagcaagcaagatcgctaacgagctcaaactgtag

SEQ ID NO: 229599 - DNA, 2367 bp, Artificial Sequence
  Description of Artificial Sequence: Synthetic coding sequence
atgtcctccgcgagaacgcctctccccactcttaatgagagagatacagaacaaccaactctcggccacctggattcaaaaccatcttcaaaatctaatatgatccgcggtcgcaactccgccaccagcgctgacgagcagccccacatcggtaactaccgcctcctcaagactatcggaaaggggaactttgccaaggtaaagttagcccgacacatcctcaccgggaaagaagttgcggtgaaaatcatcgacaagacccagctgaacagctccagcctccaaaaactgtttagggaggtgcgcattatgaaggtcctgaatcacccaaacattgtcaaactgtttgaagtgatcgaaactgaaaagactctgtaccttgttatggagtatgcgtcaggaggggaggtttttgactacttagtcgcccacggcagaatgaaagagaaagaagcaagagccaaatttaggcaaatcgttagcgcagtgcagtattgccaccagaaattcatcgtccacagggacctgaaagctgagaacttgctgctggacgccgacatgaatatcaaaatcgccgatttcgggttttcaaacgaatttacgttcggcaacaagctggatactttttgcgggtcccctccctacgctgcgccagaattgttccaaggcaagaaatatgacgggccagaagtggatgtttggagtctcggcgtgatactgtacactttagtttccgggtccctgcccttcgatggacagaatctcaaagaacttagagagcgggtgctcaggggaaaatacaggattcctttttacatgtcaaccgattgcgagaatctcctcaagaagtttctgattctgaacccgtctaagagaggcacattggagcagatcatgaaggatagatggatgaacgtaggacatgaagatgatgagctaaaaccctacgtggagcctttgcccgactacaaggaccctcgcaggacggaattaatggtgtccatggggtacacccgggaggagattcaggattccctggtaggccagcgctataacgaggttatggcgacatatctgctgcttggatataaatccagtgagctggagggagatacgatcaccctgaagcccagaccaagcgccgacctgactaactcatccgcaccttcaccctctcataaggtgcagaggtcggtgtctgctaaccccaagcaaaggcggttctcagatcaagccgcaggtcccgcaattccaacatcaaactcctatagcaagaagacccaatccaacaatgccgagaataagcggccagaggaggatagagagagtgggagaaaggccagttccaccgcaaaagtgcccgcaagcccccttcccggattggaacgcaaaaaaacaacaccaaccccttccaccaattccgtcctttcaacaagcacgaatcgctccagaaattcccctcttctggaaagggcctccctgggccaagcatccatacagaacggcaaggacagcctaaccatgccaggcagtagagcatcgactgcatctgcctcagctgcagtatccgctgctcgcccaagacaacatcagaaatccatgagtgcttctgtccaccccaacaaggcctccggactaccacccactgaatccaactgcgaagtcccacgaccatcgacagcgccacagcgggttcccgtcgcgtcccccagcgcacacaacatctcctcctcaggcggagcccctgacagaacaaacttcccgcgaggcgtgagttccaggtcaacgtttcatgcaggccagctgcgtcaggtccgggaccagcagaacctgccttacggtgtaacccctgctagcccttcaggacactcccagggaagacgtggggcaagcggttctatcttttcaaaatttacatctaaattcgtgcgccgtaacctctcttttcggttcgcgcgaagaaatttaaatgaaccagaatccaaagatagagtggagactctccgcccacacgtagtcgggtccggaggcaacgacaaggagaaagaggagtttcgggaagccaaacctaggagcctgcggttcacatggtccatgaagaccaccagctccatggagccaaatgagatgatgcgcgaaattaggaaagtccttgacgctaattcttgccagagcgagcttcacgaaaagtacatgctgctttgcatgcacggcacccccggacatgaggattttgtacagtgggagatggaagtctgtaagcttcccaggctgtctctgaacggagtcaggttcaagagaatttcgggaacttccatggcctttaagaacatagccagtaaaatcgcgaacgagctgaaactgtag

SEQ ID NO: 229600 - DNA, 2076 bp, Artificial Sequence
  Description of Artificial Sequence: Synthetic coding sequence
atgatccggggacgaaactccgcgacctcagctgacgagcagcctcacattgggaactataggctgctgaagaccatcggaaagggcaacttcgctaaggtgaaattggccaggcatattctgacaggtaaggaagtcgctgtaaagatcatcgataaaactcagttaaactctagcagtcttcaaaagctctttcgggaggtccggataatgaaagtgctgaatcatcccaacatagtgaaactcttcgaagtcattgaaacggagaaaaccttatacctcgtaatggaatacgcctctggaggagaggttttcgactacctcgtggctcacggccgtatgaaggaaaaggaagccagggcaaagtttagacaaattgtaagtgctgtgcaatactgtcaccagaaattcatcgtccacagggatttgaaagccgaaaatcttctgttggatgccgacatgaatataaaaatcgccgacttcgggttttctaacgagtttacgttcggcaacaagttggacactttttgcggctcacctccctacgccgctccggagctgttccaggggaagaaatacgatgggccagaggtagatgtttggtccctgggggttattttatacacactcgtgagcggttccctgccgtttgacggccagaacctcaaggagttacgcgagcgggtgctcagagggaagtacagaataccgttctatatgagtacagattgtgaaaatttactgaaaaaatttttgatcctcaatcctagtaaacgcggaaccctcgagcaaataatgaaagatcgttggatgaatgtaggccatgaagatgatgaacttaagccctacgtcgaacccctgcccgactataaagatcccagaaggaccgagctgatggtgagtatgggctatacgcgtgaggaaatacaggatagcctggtcggtcagcgatataacgaggtgatggccacttacttgttgctcggctataagagctccgagctcgagggggacactatcacactgaagcccaggccctcagctgatcttaccaattcctccgcgccttcaccgtcccacaaagtgcaacgttctgtgtcagctaacccaaaacagcgacgcttcagtgatcaggcagggcctgcaatccctacatccaacagctacagcaaaaaaactcagagcaataacgcagaaaacaagcgcccagaggaggacagggagagcggacgcaaggccagctccaccgctaaggtacccgcaagtcctcttcccggactagaacggaaaaagaccacacctacccctagcacaaactccgtgctaagcactagcactaataggtcacgcaacagcccactactcgagagagcttccctcgggcaggcgtccatccagaacggcaaggatagcacagctcctcagcgagtgcccgtggctagtccaagtgcccataacatctcaagctccggtggtgcccctgatcggaccaactttcccaggggcgtgagctcccgttcaacttttcacgcgggacaactgaggcaagtaagagatcagcagaacctgccttacggcgtcacccccgcatcaccaagtggccattcacaagggaggcggggtgcctctgggtcaattttctctaaattcacatctaaatttgtgaggaggaatctaaatgagcctgaatccaaggatagagtagagactctgaggcctcacgtggtgggtagtggaggtaatgacaaggaaaaggaagaattcagagaggcaaaaccgaggtccctacgttttacgtggtccatgaaaaccacatcctccatggagccaaacgagatgatgcgagaaattcgcaaggtgctcgatgccaatagctgccaatcagaactccacgagaagtatatgcttttgtgcatgcacgggacacctggccacgaggacttcgtccagtgggaaatggaggtttgcaagctgcccagactgtcgctgaacggcgtcaggtttaagcgcatatcagggacttcaatggcatttaagaacatcgctagtaagatagcgaatgaattaaagctgtag

SEQ ID NO: 229601 - DNA, 2205 bp, Artificial Sequence
  Description of Artificial Sequence: Synthetic coding sequence
atgtctagtgccagaacacctctgcctacactgaacgaaagagataccgaacaaccgaccctcggacacctggatagcaaaccctcttctaagtccaatatgatccgagggagaaactctgccacgtccgcagatgaacaacctcatattggtaactaccgactactgaagaccatagggaaagggaacttcgccaaggttaagctcgctcgccacatcctcacagggaaggaagtggcggtcaagatcattgacaaaacccagctgaattcttctagcctccagaagctgttccgtgaagtgcgcatcatgaaggtgttgaaccaccctaacattgtgaagctattcgaagtcattgaaacagagaagacattgtatctggtgatggaatacgcatctggaggagaagtttttgactacctggtagctcacggtagaatgaaagagaaggaggccagggcaaaattccgccagatcgtgtccgccgtacagtattgtcaccagaaattcatagtgcacagagatctgaaagccgagaatcttcttctggatgctgacatgaatataaaaatagcagactttggtttctctaatgagttcaccttcggcaataagttagacacattctgcggaagccccccatacgccgcaccagaactgttccagggaaagaaatatgatggacccgaggttgatgtttggagtcttggcgtcatcctgtatacactcgtctcaggctctctgccttttgacggacagaatctgaaggaactcagagaaagggtgcttcgagggaagtaccgcattcctttctacatgagtacagactgtgagaacctcctcaaaaagtttctgatcctgaacccaagtaagcgcggaacactggagcagatcatgaaggataggtggatgaatgtgggacatgaagatgacgaactgaaaccctatgtcgaacctcttccagactataaagatcctcgacggacagaactcatggtcagcatgggatatacacgggaagagatccaagactcactggtcggacagcgatacaatgaggtgatggcaacttatttgttgctgggatataagtctagcgagctggagggggacaccatcaccctcaagcctagaccaagtgcggaccttacaaactcatcagctccgagcccctcgcataaagtccagagatcagttagcgcaaatccaaaacaacgacggttcagcgatcaggctgcagggcctgccatccctacctcaaatagctacagcaagaagactcagtcaaataatgccgagaataagaggccagaagaggatagagaatcgggacgcaaagcaagctccaccgcaaaggtgcctgcaagtcctctccccggtctggagcgaaagaagacaactccgaccccaagcaccaactctgtcttgagtacctccacaaatcggtcccggaactcccccctgctggagagggccagcctggggcaggcaagcatccagaatggaaaagatagtaccgcaccacagcgtgtccccgtggcgtctccatccgcacataatataagcagttctgggggagcccctgatcgcacgaacttcccacggggagttagttccagatcgacattccatgccggacagcttaggcaggtgagggatcaacaaaacctgccctacggtgttacccctgcatcaccgagtggacacagccagggccgtcgcggagcctccgggagcatattctccaaatttactagtaagttcgtccgacgcaatctgtctttccgattcgccaggagaaaccttaacgagccggaatctaaggatagagtcgagactttacgaccccacgtggtcggcagtggtggcaacgacaaagaaaaagaagaatttagagaggcaaagccgaggtccctgcgctttacctggtccatgaaaaccacatcttcaatggagccaaatgagatgatgagagaaataagaaaagtgctggacgccaattcatgtcaaagcgaactgcacgagaaatatatgctgctctgcatgcatggaacacctggtcacgaggatttcgtacagtgggaaatggaggtttgcaagctccctaggttgtcactgaacggagttagattcaaaaggatctccggcacctctatggcatttaagaacatcgctagcaaaattgctaacgagctcaagctctag

SEQ ID NO: 229602 - DNA, 2343 bp, Artificial Sequence
  Description of Artificial Sequence: Synthetic coding sequence
atgtcttctgccaggacaccattaccgacactgaatgaacgcgacactgagcagccaacactggggcatttagattccaagccctcttctaagtcaaatatgatcaggggcagaaactcggccacctccgcagacgagcaacctcacattggtaattacagactcctcaagaccatcgggaagggaaattttgccaaggtcaagctggcgagacacatccttacaggaaaggaagtcgcagttaaaattatcgacaaaacccagctgaatagcagctccctgcagaagctgttcagggaggtccgcatcatgaaggtgctgaatcatccgaatatcgtgaaactcttcgaggtcatcgaaaccgaaaagaccctgtacctcgttatggaatacgcttcaggcggtgaagttttcgactaccttgtagctcatggaaggatgaaggaaaaagaagccagagccaaatttcggcaaattgtgtccgctgttcaatattgccaccaaaaatttattgtgcaccgcgacttgaaagccgaaaatcttctcctggatgccgacatgaacattaagatcgccgatttcggcttctctaatgagttcaccttcggtaataagctggacacgttctgtggctctcctccgtatgcggctccggaattattccaaggaaaaaaatatgatggccctgaagttgatgtgtggtccttgggtgttattttgtacacccttgtgagcggatctttgcccttcgatggtcagaatcttaaggagcttcgagaacgcgtcctccggggaaaatatcgcataccattctatatgtccaccgattgcgagaatcttctcaaaaagtttctgatactcaatccatccaagcgaggcacattggaacaaattatgaaagaccgctggatgaatgtggggcacgaggacgacgaattaaaaccctacgtcgagcccctcccagattacaaagaccccagacggaccgagctgatggtctcgatgggatatacccgggaggagatccaggactctttggtaggccaacggtacaacgaagtcatggccacatatttactgctgggttacaaaagcagtgagctggagggagataccataacactgaagccacgtcccagtgccgacttgactaacagtagcgccccaagtccttcccataaagtgcagcgctccgtatcagccaacccgaaacagaggaggttttcagaccaggccggtcccgctatccccacaagtaacagttattccaaaaaaacgcagtcgaacaatgccgagaacaaaaggcctgaagaggatcgagagtcaggaaggaaggcaagcagtaccgccaaggttcctgcaagtcccctccctggcctcgagcgcaaaaaaacaaccccgacgccaagcaccaacagcgtgctttcgacgagcactaataggagcaggaactccccgctgctggaacgtgcttcactgggacaggcaagcatccagaatggcaaggactctctcacaatgcccggttcacgagcaagcaccgctagcgcctccgccgctgtgtccgcagctaggccacgccaacatcagaaatcgatgtcagcatccgtacacccgaataaagcctctggcctccccccaaccgaatctaactgcgaagtccctcgacctagacaggttaccgcccctcagagagtgcctgtcgcttctcccagtgcacataacattagcagctctggaggtgcgccagatcgcaccaactttcctaggggcgtatcgagccggtccacttttcacgcaggccagttgcggcaggtgcgcgaccagcaaaacctgccttacggcgtgacccccgcttctccttcaggccattcgcagggacggaggggggcaagtggctctatttttagtaagttcacctcgaaattcgtgaggcgcaatctgaacgagcccgagtccaaggatcgcgtggaaacactcagaccacatgtggttgggtccgggggaaacgacaaggaaaaggaagagttccgggaggccaaaccccgatctcttagattcacctggagcatgaaaacgacatcttccatggagccaaatgagatgatgcgagaaataagaaaagtactcgatgctaacagttgccagagcgaactgcatgaaaaatatatgttgctgtgcatgcacggtacaccaggtcacgaagattttgttcaatgggagatggaagtatgcaaacttccacgtctgtctctcaacggagttcgcttcaaaagaataagtggcacatccatggctttcaaaaatatcgcctccaaaatcgcgaatgagttaaagctgtag

SEQ ID NO: 229603 - DNA, 126 bp, Artificial Sequence
  Description of Artificial Sequence: Synthetic coding sequence
atgtccagcgcacgaactccactgcccactcttaacgagcgggacacagagcagcctaccctgggacacctggactcgaagcccagttctaagtccaatatgatccgagggaggaatagcgcatag

SEQ ID NO: 229604 - DNA, 2175 bp, Artificial Sequence
  Description of Artificial Sequence: Synthetic coding sequence
atgtcctccgctcgcacccccctgcctactttgaatgaaagagacacagagcaaccaactctcggacatctcgactccaagcccagttccaaaagcaatatgatacgagggagaaattcggccacctcggcagatgagcagccacatattggcaactataggttactgaagaccatcggaaaagggaatttcgcaaaagtcaagctggcgcgtcacatactaacgggcaaggaagttgccgtgaagatcattgataaaacacagcttaactcctcaagtcttcaaaaactgtttcgagaggtccggattatgaaggtcctaaaccaccctaacatcgttaagttatttgaggtgattgagactgaaaaaacactgtacctggtgatggagtatgcctccggaggggaggttttcgattacctcgttgcacacggtcgtatgaaagagaaagaggccagggccaagttccgtcagatcgtgagcgccgtacagtattgtcatcagaaattcatcgtgcatagggacttaaaagccgaaaacttactgctggacgcagatatgaatatcaaaatcgcagactttgggttcagcaatgagtttacctttggaaataagctcgacaccttttgcggctctccaccctatgcggcacctgaactgttccaggggaaaaagtacgatggaccagaggtggacgtttggagcctgggcgtgatcctctacacactggtgagcggtagccttccatttgatggtcagaacctgaaagagctgcgggaacgggtcttgcggggtaaatataggatccccttctacatgagtacagactgcgaaaacttactcaaaaaatttctgatactgaacccttccaagagagggacactggaacagatcatgaaggaccggtggatgaatgtgggacatgaggacgatgagcttaaaccgtacgtcgaacccctgcccgactataaggacccacgcaggacggaattaatggtgtcaatgggatatactcgggaggagatccaggacagcctggttggacaacgctataacgaggttatggccacctacttgctacttgggtacaagtcatctgaattggaaggtgatacaattactctgaagcccaggccaagtgccgacctcactaattctagcgcccctagtccatcacacaaggtccagaggagcgtgagtgctaatcctaagcaacgccgattttcggaccaggctggacctgcaattcccacttctaacagctatagcaaaaaaacacagtccaacaacgcagagaacaagcgtcccgaggaggaccgtgaatccggtcgcaaggcctcctccaccgcaaaggtaccagcgagcccccttcctggcctggagcgcaagaagaccacccccactccgtcgacgaactcagtgttgagcaccagtaccaatcgtagtagaaattcacctttgctggagcgtgccagccttgggcaggcctccatccagaacggaaaggattctaccgcccctcagagggttcctgtggcatctccaagtgcgcataatatctccagcagcgggggtgcaccggaccgcacaaatttccctcgcggagtgtcgtccaggtcgacttttcacgctgggcagctgagacaggtgcgcgaccaacagaacctgccttatggcgtgactcccgcatcgccctccggacattctcaaggacgacgaggggcatccgggagtattttctctaaattcacaagcaaatttgtcaggaggaacctgaatgagcctgagtccaaagatagagtcgagacactgcggcctcacgtggtgggaagtggaggaaatgacaaagagaaagaggaattcagggaggccaagccaaggagtctccggttcacttggagcatgaagacaaccagttctatggaacctaatgaaatgatgcgggagatccggaaggttctcgacgccaatagctgccagagcgagttgcatgaaaagtacatgctcctctgtatgcacggcacacccggtcacgaggactttgtgcaatgggagatggaagtgtgtaaattaccccgtctgtcactgaacggggtccgctttaagcgcatctctggtacaagcatggcctttaaaaacattgctagtaagatagctaacgaattaaagctgtag

SEQ ID NO: 229605 - DNA, 186 bp, Artificial Sequence
  Description of Artificial Sequence: Synthetic coding sequence
atggaagtagctggctcccccttcccctttttgcaatccgtggcctgtcttctgacactggctcatatccccgctgttggaaacatactgcagcatagacgtcgaggagcaggtcctactctaggacatctagacagcaagccgtcttccaaatccaatatgattagagggcgaaactccgcctag

SEQ ID NO: 229606 - DNA, 339 bp, Artificial Sequence
  Description of Artificial Sequence: Synthetic coding sequence
atgatccgtggtcggaatagcgcgacgagtgcggatgagcagccgcatatcggcaattacagacttttaaagactatcgggaagggcaatttcgccaaggtaaagctagcacgacatatcctcactggaaaagaagtagccgtgaagattattgataagacccagctgaacagttccagcttgcagaagttgttcagggaggtcaggataatgaaggtgcttaatcacccaaatatagtgaagctgttcgaagtcatcgaaactgagaaaacactctacctggtcatggagtatgcgtccggcggtgaggtgttcgattacttggtggcccacgggtag

SEQ ID NO: 229607 - DNA, 486 bp, Artificial Sequence
  Description of Artificial Sequence: Synthetic coding sequence
atgataagaggcaggaacagcgccacaagtgcggatgagcagccccacattggcaactacagactattgaagacaattggtaaggggaatttcgcgaaggtcaagttggctagacatatcctgaccgggaaggaagtagccgtgaagattattgataaaactcaattaaactcctcgtctctccaaaaactgttcagggaggtgcggattatgaaagtgctgaaccatcccaacattgtaaaactcttcgaggttatcgagactgaaaagaccctgtacctggtcatggaatacgccagtgggggagaagtgttcgactatttggtcgcccatggcaggatgaaggagaaggaagcaagggccaagtttaggcagatcgtatcagcagtccagtactgtcaccagaagttcattgtccatagagacctcaaagcagagaacttactgctggacgccgatatgaatattaagatagccgatttttag

SEQ ID NO: 229608 - DNA, 276 bp, Artificial Sequence
  Description of Artificial Sequence: Synthetic coding sequence
atgggtggccagaggaacaccagcgtcggcaatattgtccagcgctggcgagatcatgttgtgtgccagaaagccggagtaatctattccggcagaaaggcccaggaacatggaactggcagaaccgatttcacacctgcgcagagactcatgatgcccaccttgggacatctggactctaagcccagttcaaagtcgaatatgatccgcggaagaaactccgccacgtcagccgacgaacagccccacataggcaactaccggcttctgaagtag

SEQ ID NO: 229609 - DNA, 2238 bp, Artificial Sequence
  Description of Artificial Sequence: Synthetic coding sequence
atgattcgcggtagaaatagcgcaactagtgccgacgagcagccacacatcggcaactaccggttgctgaaaacaattggcaaagggaacttcgctaaggtcaaactggctaggcacatcctcaccggcaaagaggtggccgttaagatcatcgataaaacccagctgaatagctcatcactgcagaagctgttcagagaggtgagaatcatgaaggtgcttaaccatcccaacatcgttaagctattcgaagttattgagactgagaagaccctgtacctggtgatggaatatgcttccggaggggaggtgttcgattacctcgtcgcccatggacggatgaaggaaaaggaagccagagctaaattccgccagattgtctctgccgtgcagtactgccatcagaagtttatcgtgcacagagacctgaaagccgagaatcttctcctggacgcggatatgaacattaaaattgcggacttcggatttagtaacgagttcacctttggaaacaagcttgacactttttgcggatcaccaccttatgcagccccagagcttttccagggaaaaaagtatgatggacccgaagtggatgtgtggtccctgggcgtcatactatatactctggtgtctggaagtctcccattcgatggtcagaacttaaaagagctccgggagcgggtgctgagagggaagtatcgcattccattctatatgtcaactgattgcgaaaacctgctaaagaaatttctgatcctcaacccttccaaaagggggaccttggagcagatcatgaaggacaggtggatgaatgtcggtcatgaggacgacgagttaaaaccgtatgtggagcctctgcccgattataaggatcctcgacgaaccgagcttatggtgtccatgggttacactagagaggagatacaggattcccttgtggggcagcgctataatgaggtgatggcgacttatctgctgctgggatacaaatcttctgaactggaaggagacacaatcacactgaaacccagaccatccgccgatcttacaaactcatctgccccttccccttcacataaagtgcagaggtccgtttcagcaaaccctaagcaacggcgattctcagatcaagcaggacctgccatccctacttcgaattcctatagtaaaaagactcagagcaataatgcagaaaataagcgaccggaggaggaccgtgagagcggtcgaaaggcgtcctctaccgccaaggtccctgcatcaccactcccgggattggaacgaaaaaagacaaccccaacacctagtacaaatagcgtgctgtccacatcaaccaatcgtagcagaaactcgccgctgttagaaagggctagcctggggcaagcttctatccagaacggtaaggattcactgaccatgcctggatcaagggcctccaccgcatccgcctcagccgcagtgagtgccgctcgacctcggcagcaccagaagtccatgtcagcttctgtccacccaaataaagcatccggacttcccccaacggagagtaactgtgaggttccacgcccatccaccgctccccaacgcgtacctgtggcatctccatcagctcacaatatttccagctcaggcggagccccagatcgcactaattttcccagaggcgtatcgtcccgttccaccttccacgctggccagctaagacaggtgagagaccaacagaacctgccctacggcgtaactcccgcttctccaagcgggcactcccagggccgacgaggcgcttctgggagcattttttcgaagttcacatccaagtttgtgcgtaggaatctgaatgagccagagtccaaggatcgcgtggaaaccctccgtccccatgtcgtgggtagcgggggaaatgataaagagaaagaggaattccgcgaggccaagccacgatccctgaggttcacatggtcaatgaaaactacttcaagcatggaacctaacgagatgatgagagagattaggaaggtgctcgacgccaacagttgccagtcagagcttcatgaaaagtatatgttgctctgtatgcacggcaccccagggcatgaagactttgtgcagtgggaaatggaggtctgcaagctgccgagattgtccctaaatggcgtccgcttcaagcgcatctctggaacgagtatggcctttaagaatatcgctagcaagattgctaatgagttgaagctgtag

SEQ ID NO: 229610 - DNA, 4128 bp, Artificial Sequence
  Description of Artificial Sequence: Synthetic coding sequence
atggagggcgatagggtggctgggaggcctgtgttgtcttcactgcccgtcctgctcctattacccttgctgatgctgagagctgcagcccttcaccctgatgaactgttcccccacggcgaaagttggggagatcagttgttgcaagaaggggacgacgagagctctgctgtagtgaagctggccaatcccctgcatttctacgaggctcggttcagcaacttatatgtaggaacaaacggtattatttccacacaggattttcccagggagactcagtacgtggactatgacttccctactgacttcccagccatcgctccttttttagctgacatcgatacctcccatgggaggggcagggtcctgtatcgggaagacacctctcccgcagtcctcgggttggctgcgcgttacgtgcgggcagggttcccacgaagtgcaaggttcaccccaactcacgctttcctggcaacgtgggagcaagtgggggcttatgaggaggtcaaaagaggagcactgccatccggcgagcttaacacttttcaagccgtgctggccagtgatggcagtgactcctacgccctctttctgtacccagccaacggcctgcaattccttggcacccggcctaaggagtcctacaacgtccagcttcaactgccagcaagagtgggattttgtcgtggtgaagccgacgatctgaagtcagaaggcccatacttctcgctgaccagtacagaacagtctgtcaagaacctgtaccagctctccaaccttggaatccctggtgtctgggctttccatattggcagcacttcaccactggacaatgtgcggcctgctgctgtaggggacctgtcagccgctcattcctccgtaccgctgggcaggtccttttctcacgccaccgcactcgagtctgactacaatgaggacaacctggattattatgatgtaaatgaggaggaggccgaatatctgcctggagaaccggaagaggccctcaacgggcacagctcgattgacgtgagcttccaatccaaagtggataccaagcccctggaggagtcaagcacattggatcctcatacaaaggagggaacctccttaggagaggtggggggacctgaccttaagggccaggtggagccatgggacgaacgcgaaacccgcagccccgctcctcccgaagtcgatcgtgatagtctggcgccttcctgggagacgcctcctccatatcctgagaatggctccatccaaccctatccagacggtgggccagtcccatccgagatggatgtccctccggctcacccagaggaggaaatcgtgttgagaagttaccccgcttccgggcacactactcctctgagccggggaacgtacgaagtcggtctggaggataacattggatctaacacagaggtgtttacatacaacgcagcaaataaggagacgtgcgaacacaatcacagacaatgcagcagacacgcattttgtactgattatgctacaggcttttgttgccactgtcagtctaaattctatggtaacgggaaacactgtctacccgagggggctccacatagagtcaatgggaaggttagcggccatctccacgtcggacacacacctgtacactttactgacgttgacctccacgcatacatcgttgggaatgatggacgcgcatataccgcaatctcccatatccctcagcctgctgctcaggcccttttaccgctgacaccgatcggaggcctgttcgggtggctgttcgccctggaaaaacccggttcagagaacggtttcagtctggccggagctgcttttacgcatgacatggaagtgaccttctacccaggagaagaaacggtaagaataactcagacagcagagggattggaccccgagaattatctgtctattaaaacaaatattcagggacaggtgccatacgtgtctgctaacttcacggctcacatctcaccctataaggaactgtaccactatagtgactctactgtcacctccaccagctccagagattattctcttaccttcggtgctatcaatcagacgtggtcctaccgcatccatcagaacataacctatcaagtgtgccggcacgcccctcgtcacccctcttttcccacgacccaacagctcaacgtggacagggtttttgccctgtataatgacgaggaacgggtccttagattcgccgtgacaaaccagattgggccagtgaaagaggatagcgatccaacacctgggaatccgtgttatgacggttctcatatgtgtgacaccaccgccaggtgccatccagggactggagtcgactacacttgcgagtgcgcatctgggtatcagggggacggaagaaactgcgtggacgagaatgagtgtgctacgggctttcatcgatgtgggcctaactccgtgtgtatcaacctgcctgggtcctatcggtgtgaatgccggtccggatacgagtttgcggacgacagacatacttgcattctaataacccccccagctaacccatgtgaggatggcagtcacacttgcgcgcctgccggacaggcccgttgtgtgcaccacgggggttctacatttagctgtgcttgcctccccggttacgccggagatgggcaccagtgcaccgacgtggatgaatgcagcgagaatagatgccatcccgcagcaacctgctacaacactcctggatctttctcctgtagatgccagccaggatactatggcgacggctttcagtgcataccggactcaacatcaagcctcaccccatgtgaacagcagcaaagacatgcccaggcccaatacgcatatcccggagccaggttccacataccgcaatgcgatgaacagggcaacttcctacctctgcagtgtcatgggtccacaggattttgctggtgcgttgacccagacggtcacgaagtacccggaacacaaactcctccgggaagcactcctccacactgcggcccttctcccgaaccaacccagcgcccaccaacaatctgcgagcggtggcgtgagaacctgctcgagcactacggtgggacccctcgcgatgatcaatacgtccctcaatgcgacgacctggggcatttcatccctttgcaatgtcacggcaagtccgatttctgttggtgcgtcgataaggacggtagggaggtgcagggaacccgttcgcagcctggtacaactccagcctgcatccctaccgtcgcaccacccatggttagacccacaccacggcctgatgtgacccccccttctgtcggcacctttctgctgtacacccaggggcaacagattggttaccttccactcaacggcactcgtttgcaaaaagacgccgcaaaaactttgctcagcctccatgggtccattatcgttggaatcgactacgactgccgtgaaagaatggtgtactggacagacgttgccggtcgtactataagccgcgcaggattagagctgggagctgaaccagagacgatcgtgaattccgggctcataagtcccgaaggcctggccatcgatcacatcagacggaccatgtactggaccgattccgtgctcgacaagatcgaaagcgcactgctggatggaagtgaaaggaaagttctcttctacacggatctggtcaatccccgagccatcgcagtggatcccattcggggtaacctgtattggactgattggaaccgggaggcccctaagatcgagacctccagtctggatggtgagaatcggagaattctcatcaacaccgacatcggattgcctaatggtctcacttttgaccctttctccaaactgttgtgctgggccgacgccggaaccaaaaagctcgagtgtactctccctgatgggaccggtcggcgagttatacagaacaatctcaaatatcccttcagcattgttagctatgcagaccatttctatcacacagactggcgcagagacggcgttgtatcagtgaacaagcactctggtcaattcactgacgagtacctccctgaacaacggagtcatctctacggaatcaccgcagtgtacccttactgtcccactggacggaaatag

SEQ ID NO: 229611 - DNA, 2190 bp, Artificial Sequence
  Description of Artificial Sequence: Synthetic coding sequence
atgtccacaaggacccccctccctactgtgaacgaaagggatactgaaaaccatacatctcatggagacggccgtcaagaagttacatctcggacctcacggagcggcgctagatgtagaaattccattgctagctgtgctgacgagcaaccccacattggtaattaccgcctattgaaaaccatcggaaaaggaaatttcgccaaggtgaagctggccagacacatcctgactggcagggaagttgctatcaagattattgataagactcaactcaacccaactagtcttcagaaactattccgagaggtgcggatcatgaaaattctgaatcaccccaacattgtgaagctatttgaggtgatcgaaacagagaaaacgctttatctgataatggagtatgcatcagggggtgaggtgttcgactatctggtggctcatgggaggatgaaagaaaaggaagctagaagcaagtttaggcagatagtttcagctgtgcagtattgtcaccaaaaaaggatagtccaccgagacctcaaagcagagaatttgctgttagacgccgatatgaacataaaaatagccgactttggtttttctaacgagtttacggtgggcggaaagcttgacaccttctgcggatcacctccatacgccgcacctgaactatttcagggcaaaaagtatgacggtccagaagtggatgtttggtcgctaggtgtcatactatacacattggtgagtggatccctgccttttgatgggcagaatctcaaggaactgcgcgaacgggtcttgcgcggaaagtatcggatccccttttacatgtccacggactgcgagaacctcctgaaaaggttcctggtgctgaacccaatcaaacgtgggacgctggaacagattatgaaggatcgttggatcaacgcaggccatgaagaggatgagttgaagccgttcgtggaaccagagttggatatcagtgaccaaaaaaggatcgatatcatggtgggcatgggatactcccaggaagagattcaggagtcattgtccaagatgaaatacgacgagattaccgccacctatctactgctcggcaggaagagcagcgaactggacgcaagtgatagttctagttcatcaaatctatctctcgccaaagtccgcccttccagcgatctgaataactcaaccggacaaagccctcaccataaagtgcagaggtcagtcttttcctctcaaaaacagagacgttatagcgaccacgctggccctgccatcccatccgtggtggcctatcctaaaagatcacagacaagcacagccgactcagatctcaaagaggatggcatctcgtcccgcaagagcagtgggtccgctgtggggggaaagggaatcgcccctgcctctcccatgctgggcaacgcctcaaacccaaacaaagctgatattcccgagagaaagaagtcgtccacagtaccctccagtaacaccgctagcggcggtatgaccaggagaaacacttacgtatgtagtgaaagaaccaccgctgatcgccatagtgtcattcagaacggtaaagagaacagtaccatccctgaccagcgtacaccagtcgcaagcacacactcaatcagctccgcagccaccccggatagaatccgctttcctcgcggaacagcctcgaggtcaacctttcacggacagcctcgagagcgcaggactgcgacctataacggtcccccagccagcccctcactgagtcatgaagctactccactgtcccagacccgaagccgaggctctacaaatttgttcagcaagttaacaagcaagttgacccgatcgaggaatgtgtcagctgagcagaaagatgagaacaaggaggccaagccccgatcactaagatttacttggagcatgaaaaccacttcttctatggaccctggagatatgatgcgagagatccgaaaagtcctcgatgctaacaactgtgattatgagcagagagaacgattcctgctgttctgcgtgcacggggacggccatgccgaaaaccttgtccagtgggagatggaagtgtgtaagctgccgagactcagcctcaatggcgtccggtttaaaagaatctctggcacatctatcgcattcaagaacattgctagtaagattgcgaacgaacttaaactgtag

SEQ ID NO: 229612 - DNA, 1338 bp, Artificial Sequence
  Description of Artificial Sequence: Synthetic coding sequence
atgaagtacgatgaaattactgcaacgtacctcctgttaggtcgaaagtccagcgagttggacgcttcagactcatcctcatcttctaacctgagcctggctaaagtgaggccttcatctgacctgaacaattcaaccgggcagagcccccaccacaaagtgcagagatccgttttttcctcacagaaacagagacggtactctgatcacgccggaccagccattccttccgtagttgcctacccaaaacggtcccagacttctacagcggacagtgatttgaaggaggacggaatcagcagtcggaaatcatctggcagcgccgtggggggtaaaggtattgcccctgcttctcccatgctcgggaacgcttctaacccgaataaggccgacattcccgagcggaaaaagtcatctacggtcccgagttccaatactgcatccggagggatgaccaggcggaatacctatgtatgcagtgagcgaaccacagctgatcgccactccgtgattcagaacggcaaggaaaattccctgacagaaatgtttgcgtacgccgcaagccctgcatctgtgtgcacttctacctgtcgactgcgccatcagaaaagcatgtcaatgagcgcaagtggccaccctaagatgatgttacctcctatcgatagtgaaggggacaatttcaaggccatcacaatccctgaccaacggaccccagtggcaagtacacattcgatctcctctgccgctacccccgacagaataaggttccccaggggcacggcctcgcgctctacattccacggacaacctagggagaggcgaactgccacgtataacggacctcctgcttccccatctctttcacacgaagccacaccattgtctcagacccggagcaggggaagcactaacctgttttccaaactaaccagcaaactgacgaggcggctcccgacagaatacgaacggaacgggagatatgaggggagcagccgaaacgtgtccgcagagcagaaggatgagaataaggaggctaagcctagatcattaagattcacatggagcatgaagaccacaagctccatggatcccggagatatgatgcgcgagatccgaaaagtcctggacgccaacaactgtgactatgagcagcgtgaacgctttctcctcttctgcgtccacggtgatggacatgcagaaaaccttgttcagtgggagatggaggtttgcaaactgccccgattatctctcaatggcgttcgttttaagaggatcagtggcacgtctattgctttcaaaaatatcgccagcaagatcgcgaatgaactgaagctgtag

SEQ ID NO: 229613 - DNA, 2259 bp, Artificial Sequence
  Description of Artificial Sequence: Synthetic coding sequence
atgagcacccgcacccccctcccaacggtgaatgaaagagacacagagaatcacacctctcatggcgacggaagacaggaggttacctcccgcacctcgcgatccggtgcgcgatgcaggaactcaatcgcctcctgcgctgatgagcaacctcatatagggaattataggcttctgaagacgatcggtaagggcaacttcgcaaaagtgaaactggcacgtcatatcctgaccgggagagaggttgccattaagattatagataagacgcagctcaatcccacctctctgcagaaactttttcgggaggtgagaattatgaagatcctcaatcatcctaacatcgtgaagctgtttgaagtcatcgaaacagaaaagactctctacctgattatggaatacgcctccggtggtgaagtctttgactatttagtcgcacacgggcgaatgaaggaaaaagaggcgagaagcaagttccggcagggctgccaagctggacagacgataaaagtgcaggtgagttttgatttgctatcactgatgtttacctttattgtgagcgctgttcagtactgccaccaaaagcgaattgtgcatcgcgatttaaaggccgagaacctccttttggatgccgatatgaacatcaagattgcagatttcggcttcagcaacgaattcactgtagggggaaaactggacaccttctgtggctcacctccatatgccgctcctgaattgttccagggcaagaagtacgacggacccgaggtggacgtttggtctctgggggtgatcctctacacccttgtgtcaggatcattgccattcgacgggcaaaacttaaaagagcttcgtgaacgcgtgttgcgcggaaagtatcgtattcctttttatatgtcaaccgactgtgaaaatctgctcaaacggttcctcgttcttaaccctatcaagcgtggcacgctagaacagattatgaaagatcgatggatcaatgctggccatgaagaagacgagcttaagccattcgtagagcccgagctggacatctcagaccagaaaagaatagacattatggtgggcatggggtactcacaggaggaaatccaggagtccctcagtaagatgaagtacgatgagatcacagccacatacctgttgctgggtcgaaagtcttccgagctagacgctagtgatagcagctcctcatcaaatctgtctctggctaaggtgagacctagttccgatctaaacaactccactggccagagtccccatcacaaggttcagagaagtgttttctcgtcccagaagcagaggaggtacagcgatcacgcaggtcctgccattcccagtgtcgtggcatatcctaagaggtcacagactagcaccgccgattccgatctgaaagaagatggtatttcttcaagaaagtccagcggctccgcagttggcggaaaaggaattgcgccagcctctccaatgctcggcaacgcatctaaccccaacaaagccgatattcccgagcgcaagaaatcatccacagtgccgtcttcaaacactgcctccggcggaatgaccaggcgcaacacatacgtatgttccgagcgaaccacagccgaccgccacagcgttattcagaacgggaaagaaaactccacgattcccgaccagcggactccagtcgcaagtacccattctattagttctgctgcaacccccgatcggatccggttcccccgaggcaccgctagccggtcgacttttcacggccagccgagagagcgcagaaccgcgacttacaatggtccccctgcttccccttccctttcccatgaagcaacgcccctgagccagactagatcccgaggcagcaccaacttgttctctaaattgacctccaagttgaccagaagtcggaatgtctccgcggaacagaaggacgagaacaaagaggcgaagccaagatctttgcggtttacatggagcatgaagaccaccagctccatggatccaggcgatatgatgagagagataaggaaggtgctggatgcgaataattgcgattatgagcagcgggagagatttcttctcttctgcgttcacggagacggccacgccgaaaacctggtccaatgggaaatggaagtttgtaagttgcctaggctgtccctgaacggcgtcaggttcaagcgcatctccggtacatcgatcgcgtttaagaacatcgcttcaaagattgccaacgagctgaaactgtag

SEQ ID NO: 229614 - DNA, 2262 bp, Artificial Sequence
  Description of Artificial Sequence: Synthetic coding sequence
atgtccacccgtacaccgctccctacggtgaatgagcgagacacagaaaatcacacttcgcacggcgacgggagacaagaagtgactagcaggacctcccgatccggggctaggtgtcggaatagtattgcctcctgcgcagatgagcaacctcatataggaaattataggctgctgaagacaattggaaaaggaaatttcgccaaagtgaaactggcaaggcatatcttgactgggcgtgaagtcgcaatcaagattattgacaagacccagctgaacccaaccagtctccaaaagctgttccgggaggtgaggattatgaagatcctgaaccatcctaacatcgtgaagctgtttgaggtgattgagacggagaaaaccctctacctaatcatggagtacgcatccgggggtgaggtttttgactatttggtcgcccatggaagaatgaaggagaaggaggctcggtcaaagttcagacaaattgtttccgccgtgcagtattgtcaccaaaagcggatcgtacatagggacctgaaggctgaaaatctcttacttgacgctgatatgaacattaagattgcagacttcggcttttcaaatgaatttacggtcggcggaaagctcgataccttttgcgggagccccccttacgcagcacccgagctctttcagggaaagaaatatgatggcccagaagtggacgtgtggtccctcggagtgatactttacacccttgtatctggcagcctgccgttcgatggccaaaacctgaaagagctgagggaaagagtcctgagaggaaagtatcgtattccattttatatgtcaactgactgcgagaatttattgaagcgcttcctggtattgaaccccattaagcgcggaacactagaacagattatgaaagatagatggattaatgcaggacatgaagaggatgagctgaaaccattcgtcgagcctgagcttgatatcagtgatcaaaagcgcattgatatcatggtggggatggggtatagccaagaagaaatccaggagtctctgtctaaaatgaagtacgacgagatcactgccacctatttgctgctgggaaggaagagcagcgagctcgatgcttccgattcctccagttcaagtaacctcagtctcgccaaagtgcgaccgtcttctgacttgaacaactcaacgggccagtccccccatcataaggtccagagatctgtgttttccagtcagaagcagagacgctactcggaccatgcaggaccagctattccatccgtggtggcgtaccccaaaaggagccagacatctaccgccgacagtgatctaaaggaggatggcatcagttcccgtaagagcagcgggtcggcagtagggggaaaagggattgctcctgcatctcccatgctcgggaatgcaagcaaccccaacaaggccgatattccggagaggaaaaaaagttccacggtacctagttccaacaccgcctcgggtggcatgactcgacgaaatacgtacgtgtgcagcgagcggaccactgctgaccggcacagcgtgatccaaaacgggaaagaaaattctacaatccccgaccagagaaccccagttgcctcgacccacagcatctcttcagccgctacccctgatagaatccggttccccagagggaccgcctcccgcagcaccttccacgggcagccacgggagcgacggacggccacttacaacggaccacctgctagtccaagcttatcacacgaagctaccccactaagccaaaccaggtctcggggatcaacaaacttgttctctaagctcacctcaaagctcacccggcgaaatatgtccttcagatttattaagagattgcccacagagtatgaaaggaacgggaggtatgagggttccagcaggaatgtatccgcagagcagaaagatgagaataaagaagctaagcctcggagcttgagatttacttggtcaatgaaaaccacctcaagtatggaccctggagacatgatgcgcgagatcagaaaggtcctggacgctaacaattgcgattatgaacagagggagcggttcttgctcttctgtgtccacggcgacgggcatgcagaaaatctggtacagtgggaaatggaagtttgcaagctccccaggctgtccctgaacggcgtgagattcaaaagaatttcagggacctctattgcttttaaaaacatcgccagtaagatcgcaaacgagctgaagctgtag

SEQ ID NO: 229615 - DNA, 1980 bp, Artificial Sequence
  Description of Artificial Sequence: Synthetic coding sequence
atgtctacacggacccccctgccaaccgtgaatgagcgggatactgagaaccacacaagccacggcgatgggcgacaggaagtaacaagccgaactagtaggtccggggcacgttgtagaaactcgattgcttcctgtgccgatgaacagcctcacatcggcaactaccggctcctgaagacaatcgggaaaggaaatttcgccaaggtaaaactggcccgacacattctgactggccgagaagtggcaattaagattattgataagacccaactcaatcctaccagtctccaaaagttgttcagagaggtgcgtatcatgaaaatactgaatcatcctaatattgtcaagctgtttgaagtgattgaaaccgagaagactctatatttgattatggaatatgccagcggtggtgaagtctttgattatctcgtggcacacgggaggatgaaggagaaagaagcccgatcaaagtttcggcaaatcgttagcgctgtccaatactgccaccagaagaggattgtccatcgcgaccttaaggagctgagagaaagggtactgagagggaaataccggatccctttctacatgtctacagactgtgagaatctactaaagagattcctcgtgctcaaccctataaagcggggaactttggaacagattatgaaggatcggtggattaacgctggtcatgaagaggatgagttgaaaccgtttgtcgagcccgagttagatatcagcgaccagaaaaggattgacatcatggtgggaatggggtactcacaggaagagatccaggagtcactaagtaagatgaaatacgacgaaattacggcgacatacctgctcctgggacgcaagagctccgaattagatgcttcggactcatcatcctcgagcaatttaagcctggcgaaagtgcgcccatccagcgacctcaacaactcaactgggcagtccccacatcacaaggtccagcgatccgtgttcagtagccagaagcaacggcgttattctgaccatgccggaccagccattccgtccgtggtggcctaccctaagcgctctcagacctcaaccgctgattcagacctcaaagaggacggcatttcatccaggaagtcttccggcagtgcggtgggcggaaagggtattgctcccgcatctccgatgctggggaatgcctctaaccccaataaggctgatattcccgaacggaaaaagtcttcgaccgtaccaagttccaacactgcctctgggggtatgaccaggagaaacacctacgtgtgctctgagcgaacaactgccgacaggcactctgtcatacagaacgggaaagagaatagtacaattccagaccagagaacccccgtggcgtctactcatagcataagctccgcagccacaccggaccggatccgattcccaagaggcaccgcttcgcggtctaccttccatggtcagccacgtgagagacggacagcaacctacaatggcccaccagctagcccatcactctcacatgaagcaacacccctgtctcagacaagatctagaggttccactaacttgttctcaaagctcactagcaagctcacaagacgaaacatgtcgtttcgatttatcaagtcaagaaatgtcagcgccgaacagaaagacgaaaataaggaagcaaagccccgtagtctgcggttcacctggtctatgaaaactacctcaagtatggatcctggagacatgatgcgcgaaatccgaaaggtactggatgcgaacaattgtgactatgaacagagagagagatttctgcttttctgtgtccacggtgatggacacgccgagaatctggtccagtgggaaatggaggtctgtaagcttcctcgcctgtcactgaacggggtgaggttcaaacggatctcaggtaccagtatcgcttttaaaaacatagccagtaaaatcgcaaacgagctaaagttgtag

SEQ ID NO: 229616 - DNA, 2235 bp, Artificial Sequence
  Description of Artificial Sequence: Synthetic coding sequence
atgtctactcgtaccccccttcccacagtgaacgaaagggacaccgagaatcatacatcacatggcgacggtcgccaggaggttacatcccgcaccagtcggtccggtgccaggtgtcggaacagcatcgcgtcctgcgcagatgagcagcctcacattggcaactatagattacttaagactatcggcaagggtaattttgctaaagtgaagctggcccgacacatcctcacaggccgagaagtggccataaagataatcgacaaaacccaactcaaccccacttctctacagaaactttttcgagaagtcagaataatgaagatcttgaaccaccctaacatcgtgaagctgttcgaggtcatcgaaactgagaaaactttatatttgatcatggagtatgcttctggtggtgaggtattcgattacctcgtggcacacggccgtatgaaagaaaaggaggcacggtctaagttccggcagattgtgtcagccgtgcagtactgccatcagaagaggattgtgcaccgggacctcaaagccgaaaacctcttgctggatgcggacatgaatattaagatagcagacttcggcttctcaaacgagtttaccgtgggaggaaagcttgatacattctgcggctctcccccttatgccgctcccgaactgttccagggaaagaagtacgacggtccagaggtcgatgtgtggtccttgggggtgatcctctacactctggtctcaggtagtcttccgttcgacggccagaacctcaaagagctgagagagagggtcctccggggtaagtacaggattccgttctatatgtcgacggactgcgagaacctgctcaaacggttcctggtcctcaatcctatcaagaggggaaccctggaacagatcatgaaagaccggtggatcaacgccggtcacgaagaggatgagctgaagccttttgtcgagcctgagctggacatttcggatcagaagagaatcgacataatggtcggcatgggctactcacaggaagaaattcaagaatcgctctctaagatgaaatatgatgagatcaccgcgacctatcttctgctgggcaggaaaagcagcgagttggatgcctctgattcatcctcttcttccaatctttcactcgcaaaggtccgaccttcaagtgacctgaataactcgacagggcagagcccacaccacaaagtgcaacgcagtgttttctcctcccagaagcaacgaagatactccgatcacgcaggcccagctattccatcagtggtggcctacccaaaacgatcacaaacgagcacggccgacagcgatctgaaggaggacggaatttccagcagaaagtcttccgggagtgctgttggaggtaaggggattgcaccggcttctccgatgttagggaatgcatccaaccctaacaaggctgacattccggagcgaaaaaagtcgagtactgtgcccagtagcaacactgccagcggcggtatgacacgaagaaacacctacgtgtgcagtgagcgcaccaccgctgacagacactcagtcattcaaaatggaaaagaaaactccacaatacctgatcagagaactccggtggcatcgacgcacagtatttcatctgctgcaacgcccgaccgcattcgcttcccccgagggactgcatcacggtcgacgtttcatggacagcctagagaaaggcggaccgctacatataacggcccacccgcttcgccatcactctcacacgaagccacccccctcagtcagacacgcagtcgtggctcaaccaatctgttctctaaacttacctccaagctcacacgcagattaccgacggagtacgaacgaaatggacgctacgaaggtagttcccgaaacgtgtccgccgagcagaaggatgaaaataaggaggccaaaccgcgttcattaagattcacatggtccatgaagactacttcttctatggacccaggcgacatgatgcgcgagatcagaaaggtgctggacgctaacaattgcgactatgaacaacgcgaaaggtttctgttgttctgtgtgcacggcgatggccacgcagaaaatctcgtccaatgggagatggaggtgtgcaaattaccaaggctctctctcaacggggtgaggtttaagaggatttccggaacgtctatcgcgttcaaaaatatagcaagtaaaattgctaatgagttaaagctgtag

SEQ ID NO: 229617 - DNA, 1518 bp, Artificial Sequence
  Description of Artificial Sequence: Synthetic coding sequence
tgagtggatgtgtggtcactgggtgtcatcctctataccctggtgagcggatcactcccattcgacggccaaaatctgaaagagttacgagagagagtgctcaggggtaaatatcggattcccttctacatgagcactgattgcgaaaatttactgaagaggttcctggtccttaaccctatcaaacgaggcacactggagcagattatgaaggacagatggattaacgcgggacacgaggaggacgagctgaagccattcgtggagcccgaattggacatctccgatcaaaagcgaattgatataatggtgggtatggggtatagtcaagaagagatccaagagtcacttagcaagatgaagtacgatgagatcactgctacatacctgctgctgggacggaagagttcggaagttcgaccctctagtgacctgaataatagcacaggtcagagcccccatcacaaggtgcaacgatctgtgttcagtagtcagaaacagaggcgctatagtgatcatgcagggccagccataccttcagttgtggcttatcccaagcgctctcagacctccacagcagactccgacttgaaagaggacggaatctcatcaagaaaaagctcagggagcgccgtcggcggaaaaggcattgcccctgcaagccccatgctcggcaatgcatccaatccaaacaaggcagatattccggagcggaagaagagttctacagtgcccagtagcaatactgccagcggcggaatgacccgcagaaatacctatgtgtgttctgaacggaccaccgccgatcggcattctgtcattcagaatgggaaggaaaattctactattcccgaccagcgaacccccgtggcttcgactcacagtatctcaagtgccgcaacacccgacagaatcagatttcctcgagggacagcatccagaagtacctttcacggccagcctcgagaacgaaggactgcaacctataacggcccacctgcctcgccttcactctctcatgaggcaacgccattatcccaaacacgctctcgaggatcaaccaatctgttctccaagttaacatccaagttaacacgacggaacatgagcttcagatttatcaagcgcctgccaacagagtacgaacggaacggcaggtatgaaggatctagtcggaacgtgtcagccgagcagaaagacgaaaacaaggaagctaaacctcggtcactcagatttacatggagtatgaaaacaacaagttctatggaccccggtgacatgatgcgagaaattagaaaggtgttggatgctaataactgtgattacgagcagcgtgagcgatttctgctgttctgcgtgcacggggacgggcatgcagaaaacctggttcaatgggagatggaagtatgtaaattacctcggctgtccctgaatggggtgagatttaaacgcatcagcgggacgtccatagcattcaagaatattgcctcaaaaatcgctaatgagctgaagctctag

SEQ ID NO: 229618 - DNA, 2259 bp, Artificial Sequence
  Description of Artificial Sequence: Synthetic coding sequence
atgtcgagtcggactgtcctggctccgggaaatgacaggaatagcgatacgcacggtactcttgggtctggacggtcctcagacaaaggaccaagttggtcttccagatcccttggggcacgctgtcggaattcaattgcatcctgcccagaggagcaaccacacgttgggaactatcggctgctacgtacaatagggaaggggaatttcgctaaggtgaagctcgcacggcatatactgacaggacgcgaggttgctatcaagatcatagataagactcagctcaacccttctagcctgcaaaaactttttcgcgaggttagaatcatgaaaggactcaaccatcccaacatcgtcaaacttttcgaagtgattgagaccgagaaaaccctgtatcttgtgatggagtatgcttcagccggtgaggtgttcgactatctcgtgagccacgggaggatgaaggaaaaggaggctcgagccaagttccgccagattgtttccgcggtgcactattgccaccagaagaacattgttcaccgtgatctgaaggcagagaacctgctgctcgacgccgaagccaacattaagattgccgactttggcttctctaacgagttcaccctgggtagcaagctagacaccttttgcgggagtccaccctatgcagcacctgagctatttcaaggcaagaaatatgacggtcccgaggtcgatatctggtcactgggagtcatactgtacaccctggttagcgggagcctccctttcgatgggcataacctgaaggagttacgcgagagggtcctgagaggcaaatacagggttccattttacatgtccaccgattgcgaaagtatacttaggcgtttcctagtgcttaatccagctaagcgctgcacgctcgagcagattatgaaagacaagtggatcaatatcggttacgaaggggaggagttaaagccttacacagaacctgaagaggactttggcgacaccaagcggatcgaagtaatggtcggcatgggttacactcgcgaggagatcaaggagagtctaacctcacagaaatacaacgaggtaaccgcaacttatctattattagggcgtaagacagaagagggtggagaccggggtgctccagggctcgcgttggctcgggttagagcgccttcagacactaccaacgggacaagctcgtccaagggaacctcccactctaaggggcaaaggtctagcagctcaacgtaccatcgccagcgaagacattccgatttttgtggaccgtcccctgcacccctgcaccccaaaaggagtcctactagtacaggcgaagcagaactgaaggaggagcggctcccaggaaggaaagcctcgtgtagtaccgctgggagtggctcccgcggactgccaccttcgagcccgatggtgtcgtcagcccacaacccgaacaaggccgaaatccccgagcgcagaaaggactccacatcgacgcctaacaatcttccgccttcgatgatgacgcgacgaaatacatacgtgtgcactgaacgccctggggcagagaggccttcccttctccccaatggcaaggagaacagttcaggcaccccaagggtgccacccgcatccccaagcagccacagtttagcccctccgagtggcgagcgcagccgcctcgccagaggatccacaattcgcagcacattccatgggggacaggtgcgcgatcgcagggctgggggaggcggaggcggtggcgtgcagaatggccctcccgctagccctacgcttgctcatgaggctgctcctctgccggctggtcgccctcgcccaaccaccaacctgttcaccaagttgacctcgaagttaacccggagggttgcggacgagcctgagcgcattggcggtcccgaggtgacctcttgtcacctaccctgggatcagaccgagactgcccctcgtctgctcaggttcccttggtcagtgaagctgacttctagccggccacccgaagccctgatggccgctttgcggcaggcaactgccgcagctagatgtcgctgccgacagcctcagcccttcttgctggcctgtctgcatgggggtgcaggaggcccagagcctctcagccacttcgaggtcgaggtttgtcagctacctcgcccaggtttgaggggtgtgcttttcagacgtgtggccggaactgcactcgcttttaggacattggtcacgagaatctcaaatgacctggaattgtag

SEQ ID NO: 229619 - DNA, 1389 bp, Artificial Sequence
  Description of Artificial Sequence: Synthetic coding sequence
atgagttcaaggacagtcttggccccaggcaatgacagaaattccgatacacacggcacactgggctctgggaggagcagtgataaaggtccgtcctggtcctctagaagtcttggcgctagatgtagaaacagtattgcctcatgccccgaagaacagccacatgtgggaaattataggctactgagaacgatagggaagggaaattttgccaaggtgaaactagctcgccatatcttgaccggcagggaggtagccataaagatcatcgacaaaacccagctcaatccttccagcctccagaaattattccgagaagtaaggattatgaagggactgaaccaccccaatatcgtcaaactgtttgaagttatcgagactgagaaaacattatacctcgttatggaatacgcttcagcaggcgagcctccaacactgtccgctttgccactatgccacctgcctctgcccctgcacctgactttgacacccttgggcttgtgtccagctggggaggtgtttgactacctggtgagccacggacgaatgaaggagaaagaagcccgagcaaagttcaggcaaattgtgagcgccgtgcactattgtcaccagaagaacatcgtgcatagagatctgaaggccgagaacttactgctggatgccgaagcaaatatcaagattgccgacttcgggttcagcaacgaatttaccctcggaagcaagctggacacattctgtgggagtcccccttacgccgctcccgaactgtttcaagggaagaagtatgacgggcctgaggtggatatctggagtctgggtgtaatcctgtatacccttgtgtctggtagtctccctttcgacggccacaaccttaaagaactacgagagagggtcctgagggggaagtaccgcgtgcctttttacatgagtaccgactgtgagagtattttgagaaggttcctcgtattaaatccagccaagagatgtacactggagcagataatgaaggacaagtggataaatattgggtatgagggcgaggaactgaaaccctatactgagcccgaggaggattttggcgataccaagcggatcgaggtgatggtgggcatgggttatacccgagaggaaatcaaggagtcattaacaagccagaaatataatgaagtgactgcaacctacctactgctgggtaggaagacagagcctgacgagcatgggggaggtggcgctgaaggaggagccgctgccagacccgaaggtgagctacaacaccggggagaatgggagtccagggctgcacctctgcagccccacggccagcagcgcccacaaccacaacaaggtagagatccaagagccgctgagggccaacacgagcacccctag

SEQ ID NO: 229620 - DNA, 2067 bp, Artificial Sequence
  Description of Artificial Sequence: Synthetic coding sequence
atgagcagtcgcaccgtgctggctccgggaaatgacagaaacagtgacactcatgggaccctcgggtccggacgtagctccgataaggggccttcatggagcagtaggtccctcggcgctaggtgccgcaattctatcgcctcatgtccagaggaacaaccccacgttggcaactaccggcttctgaggaccatcggcaaggggaacttcgccaaggtgaaactcgcccgtcacatcttgacaggaagggaagtggccattaagattatcgataagacccagctgaatcctagttctttacagaaactctttagagaagtaagaatcatgaagggactgaatcatccgaatatcgtcaagctgttcgaagtcatagagactgaaaagacactatacctggtcatggagtacgcttctgctggcgaggtgtttgattacctggtttcacatggtcggatgaaggaaaaagaagccagggccaagtttcgccagatcgtctctgcggtgcattactgtcatcaaaagaacattgtgcacagagatttgaaggcagagaacctgctgttggacgctgaggctaacattaagatagccgactttggttttagcaatgaattcacactggggtctaagctcgacaccttttgcggttcgcccccttatgcagcgcctgaactcttccagggcaaaaagtatgatggtcccgaggtggacatttggagcctaggagtcatcctgtatacgctggtgtccggatcacttcccttcgatggccacaacctgaaagaactgcgcgaacgagtgcttcggggtaaatacagagtacccttttatatgtctactgattgcgagagcattttgcggaggttcctggtgctgaaccctgcaaagcggtgtaccttggaacagatcatgaaagataagtggattaacattgggtatgagggagaagaattgaaaccctacacagaaccagaggaggatttcggtgacacaaaaaggattgaagttatggttggcatggggtatacacgggaggagataaaagaaagcctcaccagtcagaagtataacgaagttacagcaacctaccttctgctggggagaaagacggaagaggggggagatcggggtgctcccggactcgccctcgccagggtcagagctccaagcgacaccactaacggaaccagtagtagtaagggcacctcacacagtaaaggtcagcggtccagcagctcgacataccacagacagagacgccactctgatttctgcggccctagcccagccccactccatcccaagagatcaccgaccagcacaggagaagccgagttaaaagaagagcggctcccaggccgaaaagcatcatgttccaccgctggaagtggttcgcggggactgccccctagtagcccaatggtctccagcgcccacaatccaaacaaagctgaaatccccgaacgcagaaaagattctacgtcaactcctaataacctgcctccctcgatgatgactcggcgaaacacctatgtatgtactgagcgtcccggtgccgaacgcccttcactgcttcctaatggtaaagaaaattcctcaggcactccaagggttcctcccgcttcaccctcttcccactctcttgccccacctagcggggagcgttccaggctggcgcgaggctctaccattcgctcaacgtttcacggaggacaggtcagagatcgtcgggcaggagggggtggcggtggcggagtccagaatggccctcccgcaagcccgacgctagctcatgaggcagcacccttgcctgccggaaggcctcggcctactaccaacctctttaccaaactaactagtaagctgaccaggcgcgtgacactggacccaagtaagcgtcagaacagtaaccgatgcgtaagtggagcctccttgcctcagggcagcaagatccgctcccagacaaacctgagggagtcgggcgacttaaggtcccaggtagcaatttatctagggattaagcgaaagccccctcctgggtgctcggattctccaggggtttag

SEQ ID NO: 229621 - DNA, 240 bp, Artificial Sequence
  Description of Artificial Sequence: Synthetic coding sequence
atggcagcacttagacaagcaaccgcagccgctaggtgcagatgtcgccagcctcagcctttcctgctcgcttgcctccatgggggtgcagggggacccgaacctctcagccactttgaggtggaagtttgccagctgcctcgacccggactgcggggagtgctgtttcggagggtggccggaactgctctagctttccgcaccctcgtgacaagaatttctaacgacctggaattatag

SEQ ID NO: 229622 - DNA, 1032 bp, Artificial Sequence
  Description of Artificial Sequence: Synthetic coding sequence
atggcagctgccacggagctgaacaggccctctagtggggaccgaaaccttgaacggagatgccggccaaacctgagcagagaagtcctttatgaaatcttccgctcactccacaccttggtcggccagttggacctaagggatgacgttgttaagatcaccatcgattggaataaactacagtctctatccgcgttccagccagccctgttgtttagtgcgctggaacagcacattctttatctgcagcctttcctggccaaactgcaatcccctatcaaagaggaaaatactaccgcggtcgaggagatcggaaggaccgagatgggcaacaaaaacgaggtaaacgataagttttctatcggtgacctgcaggaagaagaaaagcacaaggaaagcgatctgcgagacgtcaagaagactcaaatacactttgaccccgaggttgtccaaattaaagccggaaaagccgagattgacagacggatcagcgcctttatcgagcgaaagcaagcggagataaacgaaaataatgtgcgggagttttgtaatgtcattgattgtaaccaagagaacagttgcgcccgtaccgatgctattttcacaccttacccgggattcaaatcacacgtgaaggtttcccgcgtggttaatacctacggaccacagacccgtcccgagggcattcctgggtcaggtcacaaaccgaattccatgttacgcgactgtggcaaccaggcagtggaagaacgtctgcagaatatagaagctcacttgcggctgcagacaggcggacccgtgcctcgggatatctatcagcgaatcaagaaactagaggacaagatcttagagctggagggaatctctcctgagtactttcagtccgtctccttttctggcaaaaggcgcaaggtgcagcccccacaaaactactctcttgctgagttggatgagaagattagcgcgctcaagcaggctcttttgaggaagtctcgggaagcagaaagcatggctacccaccacttaccttag

SEQ ID NO: 229623 - DNA, 1035 bp, Artificial Sequence
  Description of Artificial Sequence: Synthetic coding sequence
atggcagctgccaccgaactgaatcgcccttctagcggcgatcgaaacctcgagaggaggtgtcggcctaacctgagcagggaagtcctgtatgagatctttcgcagtctgcacacccttgtaggacaactggacttacgggacgacgtcgtgaaaatcacgatagactggaacaaactgcagagtctttctgcttttcagcctgctctgctgttctccgcactggagcagcacatcctctatctgcagccctttctggcaaagctgcaatctcctatcaaggaggaaaacaccacagcagtagaagagatcggcaggactgaaatgggaaataagaacgaagtcaacgataaattctcaattggagatctgcaggaggaagaaaaacacaaagagtcagatctcagggatgttaaaaagacccagattcacttcgaccctgaggtggtccagattaaagcaggtaaggctgagattgacaggaggatctcagccttcatagaaaggaagcaggctgaaataaacgagaacaacgtacgggagttctgcaatgtgatcgactgcaaccaggagaacagttgcgcccgaacggacgcaatcttcactccctacccaggcttcaagtcacatgtgaaagtctcccgcgtggtaaatacctacggaccacaaactcggccagaaggcatccccggatctgggcataaaccaaatagcatgcttagagattgtggcaaccaggcagtggaggagcgcctgcagaacatagaagcccatctgaggctgcagacagggggacccgtgcctagagatatataccaacgaataaaaaaacttgaagacaaaatcctcgaactggagggcatttccccggaatactttcagagcgtgagtttctctggcaagcgtcggaaagtccagccacctcaacagaactattccctggcagagctggacgagaagatttcggctctgaagcaggctctgctacgaaaaagtagagaggccgaaagcatggctacccatcatttaccctag

SEQ ID NO: 229624 - DNA, 4944 bp, Artificial Sequence
  Description of Artificial Sequence: Synthetic coding sequence
atggttcaaaagaagaagttctgtcccagacttcttgattacctcgtgattgtgggcgctaggcacccatcctcagattccgtggcccagacccctgaactgttacgcagatacccactcgaagatcacaccgagtttccactgccccctgacgtcgtctttttctgccagccagagggctgtctgagtgtgcgccagcgcaggatgtcactgcgtgatgatacttcattcgtgttcacactgactgataaggacactggcgtcactaggtatggtatttgtgtgaatttctacagatccttccagaagcggatctcaaaggaaaagggcgagggcggtgccggttctagaggcaaagaaggcacacatgcaacatgtgctagcgaagaggggggtaccgagtcttctgagtccggtagctccctgcaaccattgtctgccgacagcacacctgacgtgaatcagtctcccagaggcaaacgtagggccaaagccggaagtcgcagtagaaatagcaccctgacttccctatgtgttctgtcacactacccttttttctccacattccgtgagtgcctgtataccttaaaaagacttgtcgactgctgctccgagcgtctgctaggcaaaaaactcggcatcccacgaggggtgcagcgggataccatgtggcggatctttaccgggagtttgctcgtcgaggaaaaaagctctgctctgctgcacgacctgcgcgagatcgaggcatggatctacagattactgcggtcaccagttcccgtgtccgggcagaagagggtggatatcgaggtacttccccaggagttacagcccgctctgacattcgcgctaccagacccctccaggtttacactggtggactttcctctgcacctccccttagagctgttgggagtagacgcttgcctccaggtcttaacttgcatactcctagaacataaagtcgtgctgcagtcccgggactacaatgccctatctatgtccgtgatggcgtttgtcgccatgatttatcccctggaatatatgttccccgtgatcccactgctcccgacatgtatggctagtgccgagcaattactgctggctccaacaccttatattattggagtaccagcgtcttttttcctgtataagctggattttaagatgcccgacgatgtgtggttggtcgatcttgactcaaacagagttattgcacccacgaacgccgaagtccttccaatcctacctgagccggagtcactcgagctcaagaagcatttgaaacaggctttagcgagtatgtcactgaacacccagcctatcctgaacctggaaaagtttcacgaaggtcaggagatccctctgctgctggggcgaccctctaatgacctgcagtccacccctagcaccgagtttaaccccctgatatacggcaatgacgtagacagtgtggatgttgcaaccagagtcgctatggtcagatttttcaacagtgcaaatgtgctacaggggttccagatgcataccagaactcttagactattccctaggcctgtggtggcattccaggcgggatcgttcctggcgtcacgtcccaggcaaacccctttcgccgaaaaattggcaaggactcaggctgtagagtacttcggggaatggatcctgaatcctacaaactacgcttttcagagaatccacaataatatgttcgacccagcactcatcggggataaacctaagtggtatgctcatcagctgcagccaattcactatcgagtatatgactccaacagccagctcgccgaggccctatccgtgccgccagaacgcgactccgatagtgaaccaacagacgacagcggctcagacagcatggactacgacgacagctcctcatcttatagctcacttggggacttcgtcagcgaaatgatgaaatgcgacatcaacggagacactccaaacgttgatcccctcacccacgcagccctcggggatgccagcgaagtcgagatcgacgaactccagaatcagaaagaagcagaagaaccaggccctgacagcgagaactcccaggagaatccaccactgagaagcagctcatcaacaactgctagcagcagtcctagcacagtgattcatggggcaaatagtgaacctgcagattcaactgaaatggatgataaggctgcagttggcgtgagcaagcccctccccagcgtccccccaagcatcggtaaaagtaatgtcgataggcggcaggccgagatcggagagggctcggtgagacggaggatctatgataacccttacttcgagcctcagtacggctttccccctgaggaagatgaggacgagcagggcgagtcctacaccccacgattctcccagcatgtttctggcaatagggcgcaaaagttgctaaggcccaattcactgcgtttggcctccgactctgatgcagagagtgactccagggcgtcatctcccaactcaacagtgtccaacacctctaccgagggcttcggtggcattatgtcattcgcgagcagtttgtacagaaaccactcaacatcattttctctgtctaacctgaccttgccaaccaagggcgctcgtgaaaaggctacgcctttcccctccctcaaagtgttcggactaaatacgctgatggagattgtgactgaagccggtccgggttcaggcgagggcaaccgcagagcccttgtggatcagaaatcgagcgtgattaaacactcaccgacagtgaagagagaaccgccaagcccccaggggaggagcagcaacagtagcgaaaatcaacagttcttgaaggaggtcgttcatagcgtgctggatgggcagggagtgggatggctgaatatgaaaaaagttaggcggttattagagagcgagcagctcagagtgttcgttctatcgaaactgaacaggatggttcaatcagaggacgacgcccgacaagatatcattccagatgtggagattagtcgcaaagtctataaggggatgctggatttgctgaagtgtacagtcctgtccctagaacagtcatacgcacatgctgggctcggaggaatggcatctatttttggcctgcttgagattgcccagacacattattactccaaggagcccgacaaaaggaaaagatctccaactgaatctgtgaacacgccagtcggaaaggatcctggcctcgccggtagaggagatccaaaggcgatggcacaactgcgcgttccacaactgggaccacgtgcccctagcgccacagggaaaggtcccaaggagttagacacacgcagcctcaaagaagaaaactttatcgctagcattgagttgtggaacaaacatcaagaggttaagaaacaaaaggctctggaaaagcagcggcctgaagtgataaagcccgttttcgacctgggggagacagaggagaagaagtctcagatctccgccgattccggcgtcagtctgacatcttcttcacagcggaccgatcaggattccgtcatcggagtgtctcctgccgtgatgatcaggtcctcctcacaggactcggaggtgagcacggtcgtgtcaaatagcagcggagagacacttggagcggattccgacttatcctctaatgcaggggatggtccagggggagaaggcagtgtccacctggcgtcctccagagggacactaagcgactcagaaatagaaacaaatagcgcaacctcgaccatcttcggcaaagcccactctctgaagcccagcatcaaggagaagctggccggaagtccaattagaacaagcgaagacgttagccaaagggtctatctctacgagggtctcctcgggagggacaagggaagtatgtgggaccagttagaagacgctgctatggaaactttcagcatttccaaggaacgatcaacactgtgggaccagatgcagttctgggaggatgctttcctcgatgctgtcatgttggagcgtgaaggaatgggcatggaccagggccctcaggagatgatagaccgctacctatccctgggcgagcatgatagaaagcgcttagaagacgacgaggaccgcctgttggctaccctccttcacaatcttatcagctacatgctcctaatgaaggttaataagaacgacattcgaaaaaaagtacgcaggcttatgggaaagagtcatattggcctggtgtatagccaacagatcaatgaggtgcttgatcagctggccaatctgaacgggagagatctctccatctggtcctctggatcccgccatatgaagaagcagactttcgtggtgcatgcgggaaccgacactaatggcgacatctttttcatggaagtgtgtgatgactgcgtggtcctgcggagcaacatcggaaccgtgtacgagcgctggtggtacgagaagctcattaatatgacctactgccccaagaccaaggttctgtgcttgtggaggcggaatggaagtgaaactcagctaaataaattttacaccaagaagtgccgagaactgtactactgcgttaaggactccatggagcgggctgctgctaggcagcagtcgataaaaccgggtcctgagctgggcggagagtttcctgtacaggatttgaagacaggcgagggcggtctcttgcaggtcacgcttgaaggcattaatctgaagttcatgcacaaccaggttttcatagagctgaaccacatcaaaaaatgtaacacagtccgcggagtttttgtgctggaggagttcgttccagagattaaagaggtggtcagccacaaatacaagacccctatggcacacgaaatttgttattcagtattatgtctcttttcctatgtggccgctgttcattcatcagaggaggatctcagaacaccgccacgcccagtcagctcctag

SEQ ID NO: 229625 - DNA, 4767 bp, Artificial Sequence
  Description of Artificial Sequence: Synthetic coding sequence
atggttcagaagaaaaaattctgcccacggcttttggattacctggtgatagtcggtgcgagacacccatcaagcgactctgttgcccagactcccgaactcctgaggagatatccattggaagaccacacagagtttcccctgccaccggacgtggtctttttttgtcagcccgaggggtgcttaagcgtgaggcagaggcggatgagcctgcgggatgacacctctttcgtctttactttaaccgacaaagacacgggtgttacaaggtacggaatatgcgtgaatttttatcggtcttttcaaaagcgcatcagcaaggaaaaaggagaaggcggtgcagggtctagaggtaaagagggcacccacgctacatgcgcgtctgaggaaggcggtaccgaaagctcggagtccggctcaagcttgcagccactctctgccgatagcacccctgacgtgaatcaaagccctcgtgggaaacgaagggcaaaagccggaagtcgaagcagaaacagtaccctcacctctctgtgcgttcttagtcattatccattcttttctacattccgtgaatgtttatataccttaaaacgcctggttgactgttgctcagaaaggctcctgggcaagaagctgggaattcctaggggagtacagcgagatacgatgtggcgaatcttcaccgggagccttctagtagaggaaaagagtagcgccctacttcacgacctgagggagatagaggcatggatctatcgcctgcttcgtagtcctgtccccgtgtccggccagaaacgtgtcgatatcgaagtgctgccccaggagctccagcccgcactcaccttcgccctgccagacccctctcgatttacactagttgacttcccactgcacttgccattagagcttctcggcgtagacgcttgtctccaagtcctgacctgcatcttactcgagcacaaagtcgtccttcaaagtcgggattacaatgctctcagtatgtccgtcatggcattcgtggctatgatctaccctcttgagtacatgttccccgtaatacccttgctgccaacatgcatggctagcgcagagcagctgctgttggccccaaccccctatatcatcggggtacctgcatccttctttctttacaaactggacttcaaaatgcctgacgatgtatggttagttgacctggactccaaccgtgtgattgcccctacaaatgcagaggtgcttcccatattaccagagcccgagagcttagagctgaagaagcacctgaagcaggctctggcttctatgtcgctgaacacccagccaatcttgaacctggagaagtttcatgaaggtcaagagatccctctgttgctgggcagacccagtaatgacctgcagagtaccccttccacggaattcaaccccctcatttatggaaatgacgtcgactccgtggacgttgctactcgagtcgctatggttcgtttttttaatagcgccaatgtgttgcagggattccaaatgcacaccaggacccttcgcctgttcccgaggcctgttgtggctttccaggccggttcttttctggcttcgagacctcgccaaaccccctttgcagaaaagttggcccgaacgcaggcggtggagtactttggagagtggatcctgaaccctactaactatgctttccaaaggattcataataatatgtttgacccagctttgataggagataagcctaagtggtatgcccaccagttgcaacccatccactatcgcgtctacgactccaactcacagctcgccgaggcactctctgttccaccagagagggatagtgattccgagcctaccgatgactctggcagtgactccatggactacgacgattcaagctctagttattcttccctgggagatttcgtcagtgagatgatgaagtgcgacatcaatggtgatactcccaacgtcgacccactcacacacgctgcattgggagacgccagcgaagtagagattgatgagttgcagaatcagaaggaagctgaagaaccgggacccgattccgaaaatagtcaagagaaccccccactgaggagcagctcctctacaacagccagcagctctcctagtaccgtcattcacggtgcaaattccgagcccgcagactctactgagatggacgacaaagctgccgtgggggtttcaaagccactcccctccgtccctccctcaatcggaaagtctaatgtggaccggaggcaggccgagatcggcgaggggagtgtcaggaggcggatctatgacaacccgtatttcgaaccgcagtacggctttcccccagaagaggacgaggacgaacagggggagtcatacaccccacggttttctcagcacgtgagcggcaatagggctcagaaactcctgcgaccaaacagcctgcgacttgcatcggattcagacgcggagagcgatagtagagccagtagtccgaatagcaccgtttctaacaccagcacagaaggatttgggggaatcatgtcattcgctagcagtctttataggaatcattctaccagctttagcctgtccaacctgaccctaccaacgaagggggcacgggaaaaagccactccctttccgagtcttaaagggaatagaagggcccttgtggaccagaagagctccgtgatcaagcactctcctacagtgaagcgggagccaccctctccccaggggagaagcagcaatagttcagagaaccaacagttcctgaaggaggtcgtccatagcgtcttggacggacagggcgttggctggctgaacatgaagaaggtccgccgactgctagaatctgaacagctgcgggtattcgttctgtctaagctgaaccgtatggtgcaaagcgaggacgatgcacggcaggatatcatccctgacgtagagatcagcagaaaggtatacaaaggcatgctggacctgttaaaatgtacagttctgagtcttgagcagtcctacgcccacgctgggctggggggaatggcctcgatatttggcctactcgaaatcgcccagacccattattacagcaaggaacctgacaagaggaagagaagcccgactgaaagcgtaaataccccagtgggcaaggatcccggactggcaggtcgcggagaccctaaagctatggcacagctaagggtaccacagctcggccctagggcaccctccgcaacgggcaagggaccgaaagagctcgacacaagatccctcaaggaagagaattttatagcctcaatcggacctgaagtcatcaagcccgtctttgatctaggagagactgaagaaaagaaatctcaaatcagcgcagattccggggtttccttgacgtcgagcagtcagcgcacagaccaggacagtgtgatcggggtttccccggcagtcatgatccggtcaagtagtcaagacagtgaggtgtccacagtggtgagcaattcttcgggggaaaccctgggcgcagattccgatctttcctctaatgcaggggatggcccaggtggggaagggagcgtgcatctggcgtccagtagggggaccttgagtgactctgagattgagacgaattcagccacttccactatttttggtaaggcccactctctgaagccttcgatcaaagaaaaattagcaggctctcctatccgcacatccgaagatgtcagtcaaagagtctacctttacgaaggcctgctgggaaaggagcgctctacgttgtgggatcagatgcaattctgggaggacgctttcttggacgccgtaatgctggaacgtgagggcatgggcatggatcagggacctcaggagatgatcgatcgatacctatcgctgggggagcacgacagaaagaggctagaggacgatgaagacagactactggcgacactgctgcacaatctaatttcttatatgctgctaatgaaggtcaataagaatgacatccggaaaaaggtaagacggctcatgggtaagagtcacatcggcctggtttatagtcagcagataaatgaagtactggaccagctcgcaaatttaaacggccgagatctcagcatctggtcatctggcagccgccatatgaaaaagcagacttttgtggtccacgcagggacagacacaaatggggatatattttttatggaggtgtgcgatgactgtgtcgtgcttcgaagcaacatcgggacagtgtatgagcgctggtggtatgaaaaactaatcaacatgacctattgtccaaagacaaaagttctctgtttgtggcgacgcaacggatcagagacacagctcaataagttctatactaagaagtgcagagaactgtattattgtgttaaggattcaatggagagagctgccgctcggcaacagtctataaagccaggtccagagcttgggggagaatttcctgtgcaggacctcaagacaggggaaggcggtttgctgcaggtcaccctggaaggaatcaacttgaaatttatgcataaccaggtatttatagagctcaatcatatcaaaaagtgcaacactgtgcgaggcgttttcgtcctggaggagttcgttccggaaatcaaggaggttgtcagccacaaatacaaaaccccaatggctcacgagatttgctacagcgtcctgtgtctgttttcctacgtggctgctgtccactccagtgaagaggatctaaggacaccaccaagacctgtaagcagctag

SEQ ID NO: 229626 - DNA, 4827 bp, Artificial Sequence
  Description of Artificial Sequence: Synthetic coding sequence
atggtacaaaagaaaaagttttgcccgaggctcttggactatctcgtaatcgtgggagctagacatccctctagtgatagtgtcgcgcagaccccagaattgctgcgcagatacccgctggaggaccacacagagtttcccctgccacctgacgtggtctttttctgtcaacctgagggctgcttatccgtaagacaaaggaggatgagtctccgcgatgacacatcttttgtttttacactgacggataaggacactggagtcacaagatatggaatctgtgtgaacttctaccgatcttttcagaagcgcattagcaaggagaaaggtgagggaggtgccggtagcagagggaaggagggtacccatgcaacttgcgcctccgaagaaggagggactgaaagtagtgagtctggcagttctctgcaaccactctctgcagattccactcccgacgtcaatcagtcaccacgaggcaaacgcagggcgaaggcagggagccgctctcgaaattctacactgacctccctgtgcgtcctcagccattaccccttttttagtacatttcgggagtgcctttataccctaaagcgcttagtggattgctgttccgagaggctgctcgggaaaaaacttggcatccctcgtggagtgcagagagacaccatgtggcggatttttacgggctcgctcctggtcgaggaaaaatcatccgctctgcttcacgatctgcgcgaaattgaagcctggatataccgcctactgagatccccagtgcctgtgtccggtcagaagagggtggacattgaggtgctccctcaggagctacagccagcacttacttttgctttgcctgatccttcacggtttactctcgtggattttccgctgcacctgccgctggaactgctgggagtggacgcctgcctgcaggtactgacctgcattcttctggagcataaagtagtgctgcagagtagggattataacgccctgtccatgagcgtgatggcattcgtggccatgatatacccacttgagtacatgtttccggtgattccattactgcctacctgtatggccagcgctgaacagttactactcgcgcctactccatacattataggagtgccggcaagcttcttcctatacaagttagactttaagatgccagatgacgtctggctcgtagatttggacagcaatcgggtcattgcacctacaaacgccgaagtgctccccattttgccggagcccgaatctctcgagctgaagaagcatctcaagcaggccctcgcctctatgagccttaacactcagcccatcctgaatctagagaaatttcatgagggtcaagaaatcccattattgctggggaggccttccaacgacctgcaatccactccttcaactgagtttaaccctctcatttatggaaatgacgtggactccgtagatgtggccacacgggtggcgatggtacgctttttcaactccgccaacgttctgcaaggttttcagatgcacactcggactctaaggctgtttccacgcccagtcgtcgctttccaggccggatcattcctggcctcccggcctcggcagacacccttcgccgagaaactggcgaggacccaggcagttgaatacttcggggaatggattctgaatcctacaaactacgcctttcaaagaatacataacaatatgtttgatccagcgctgattggcgacaagccaaagtggtatgcgcaccaacttcaaccaattcactatcgtgtctacgactccaactcccagctggcggaggcactatccgtcccccctgaaagagactctgactccgaacccactgacgactcaggctcagattctatggactatgatgattccagttcatcttactcctcccttggagatttcgtgtccgagatgatgaagtgtgacatcaacggtgacacccctaacgtcgaccctcttactcacgccgctctaggagatgcatctgaagtggagatcgacgaactgcagaaccaaaaggaggcggaagagcccggacccgactctgagaactcccaggagaaccccccattacgatccagttccagtaccactgcatcatctagtccttccacagtaatccacggcgctaattcagagcctgcagactcaaccgagatggacgacaaggccgctgtgggagtctcgaagcccttgccttctgtcccgccatccattggcaagtccaatgttgaccgcagacaagccgagatcggagagggctctgtgcgaagacgaatttatgacaatccatattttgagccacaatacggcttccctcccgaggaggacgaggatgaacagggtgaatcatatactccacgtttctcccagcatgtatccgggaatcgggcacaaaagttattgagacctaatagtctccgcctagccagtgacagcgatgccgagagcgactctagagccagctctccgaacagtacagtctccaacacttctactgaaggcttcggcggaattatgagttttgcctccagcctctaccggaaccacagtacttccttctcgctatctaacttgaccctccccacaaagggtgccagggaaaaagctaccccatttccaagcctgaaagtgtttggcctgaacacactgatggaaattgtgacggaagcagggcctgggtccggagagggtaaccgtcgagcactggtcgatcagaagtcttccgtgatcaaacactcccccactgtgaaaagagaacctccaagtccgcagggaagatcatctaacagcagcgaaaaccagcagtttctaaaagaggtggtacactctgtcctggacggacaaggcgtcggctggttaaatatgaaaaaggttagaaggctcctcgaaagtgagcagctccgggtgttcgtgctatctaaactcaatcgtatggttcagagtgaggacgatgcgagacaagacattattccagacgtcgaaatctcgcgaaaagtatacaagggtatgctcgacctgctgaagtgcacagttttatctctagagcagtcttacgcccacgccggactcggtggcatggcaagcattttcggcctgttagaaattgcgcagacccactactacagtaaggaacctgataagcgtaaacggtcccctactgagagtgttaatactcccgttggaaaggaccccggtttagcaggccgtggggatcccaaagccatggcgcagttacgcgtgccccagttggggcctcgggcaccctcagcaacagggaaaggcccaaaagagctggacaccaggtcactcaaagaggagaatttcattgcatcaatcgggccagaggtaattaagcctgtttttgacctcggagagacagaggaaaagaaaagtcagatttccgccgattccggtgtctcattgacatcatcgagccagcggactgatcaagacagcgtgatcggagtgtcgcccgcagtgatgatccgctcaagctcccaggacagtgaggtgtccacagtggtgtctaatagctcaggagagacgttgggcgcagactcggacttgagtagcaacgccggagatggacccggaggcgaagggtccgttcacttggccagttcgcgtggaacactgtccgatagtgaaatagaaaccaacagcgctacgagtactatattcggcaaggcccattctctgaagccatcaatcaaagagaagctggccggatcacccatcagaacaagtgaagacgtgtcacagcgagtgtatctgtacgaaggattgctcggtaaagagcggtctactctgtgggaccagatgcagttttgggaggatgctttcctggatgcagtgatgcttgagcgagaggggatgggaatggatcagggcccacaggagatgatcgatagatacctctctctgggcgagcacgatcgcaaaagattagaggatgatgaagacagacttctggccacactcctccacaaccttatatcatacatgcttcttatgaaggtgaataagaacgatatcaggaagaaggtgcgcagactgatgggcaagtcacacatcggactggtctattcccagcaaataaatgaggttctggatcaattagctaacttgaacgggcgtgacctttccatttggtcctcggggtcaagacatatgaaaaaacaaacatttgtcgtacacgctggaaccgacactaacggtgatatcttttttatggaggtctgtgatgattgtgtcgttttgagatcaaacattggaacagtgtacgagcgttggtggtacgagaagttgataaatatgacctactgccccaaaaccaaggtgctgtgcctttggcgaaggaacggcagcgagactcagctgaataaattctatacaaagaagtgcagagagctttattattgtgtaaaagacagtatggagagggccgctgcccgacaacaaagtattaagccgggtcccgaacttggaggagagtttcctgtgcaggatcttaagaccggcgaaggtgggctgttacaggtgacgctggaaggtattaacctgaaatttatgcataatcaagttttcattgaactcaaccacatcaaaaagtgtaataccgtacggggtgtgttcgtgctggaagagttcgttcccgagattaaggaagttgtctcccataagtataagacaccgatggcacacgagatctgttatagtgtgttatgtcttttcagctatgtggcggcagttcacagctctgaagaggacctaaggacccctccacgccctgtgagctcctag

SEQ ID NO: 229627 - DNA, 4746 bp, Artificial Sequence
  Description of Artificial Sequence: Synthetic coding sequence
atggtccagaagaaaaaattctgtccacgcctcctggactacctagtgattgttggagcgagacatccaagctcagattccgtagcccagaccccagagcttctccgcagataccccctggaggatcatactgagtttccactgccgcctgatgtcgttttcttttgtcagcctgaaggctgcctatccgtacggcaacgccgtatgagcttaagggatgacacttccttcgtcttcactcttacagacaaagatacaggagtgactaggtacggaatctgtgttaatttttaccgttcatttcagaaacgcatctcaaaagagaagggtgaggggggtgccggaagccggggaaaggagggcacccacgcaacctgcgcctcagaggagggcggaactgagtcctccgagtccggttcaagcctgcaaccactcagtgctgacagtacgccagacgtgaaccagagtcctcggggaaaacgccgagccaaggccggttctcgctctcgcaatagcactcttacctcactgtgcgttttgagtcactacccattctttagcactttccgagaatgtctgtataccctcaaaagactagttgactgttgttccgaacgtcttctcggaaagaaattgggcataccgcgaggagtccagagggatacaatgtggaggatttttaccggcagcctgctggtagaagagaagtcgtccgcccttctgcatgatttacgagagatcgaggcatggatttatagactcctgagatctcctgtccctgtcagcggacaaaagcgcgtggacatagaggtactcccacaggagctccagccggctctgacttttgcactacctgatccgtcccgattcactctggtagacttcccacttcacttacctttggagctccttggtgttgatgcctgtctgcaggttctgacctgtatcctgttagagcacaaggtcgtcctgcagtcaagagattacaacgcactcagcatgtctgttatggcctttgtagctatgatctatccgttagaatatatgtttcccgtgatccctctgctgccaacctgtatggcctctgccgagcagttgctgctcgctccgaccccctatatcatcggcgttccggcttctttttttctatacaagctcgattttaagatgccggacgatgtgtggctggtggacctcgactctaaccgtgtcatcgccccaaccaatgccgaggtcctccctattctcccagaaccagaaagcttagaactcaaaaagcacctgaagcaggctttggcctctatgagtttaaatacacagcctatcttgaacctggaaaaattccacgaaggccaggaaatcccgcttttgctcggacgcccatccaacgacctgcagtctactccaagcaccgaattcaaccctttaatatacggcaatgacgtggatagcgtagatgtcgccactcgggtggccatggtgcgattctttaattccgccaacgtgctccagggcttccagatgcacactagaactttgcgactttttccgagaccagtcgtggctttccaggctggatcctttttagcaagcagaccccgacagacccccttcgccgagaaacttgcgaggacccaggctgtcgaatacttcggtgaatggatcctgaacccaaccaactacgcgtttcagcgcatccacaacaatatgttcgatccagccctgatcggcgacaagccgaagtggtatgctcatcaactccaaccaatccactaccgggtctatgacagcaattctcaactggccgaagcgctcagtgtgccacccgagagggactccgacagcgagccaacagatgactccggatcagatagcatggattacgacgatagttcttcatcatattcttccctaggggacttcgtgtcggagatgatgaaatgcgatataaatggagacactcccaatgtggatcccctgacacacgcagcgctcggcgacgcttccgaggtggagattgacgagttacagaatcaaaaggaagctgaagagccaggcccagactcggagaactcccaagagaatcctcctctgcggagctccagcagcacaaccgcttccagcagtccgagcaccgtgatccatggggctaatagcgaacctgccgatagcaccgagatggacgacaaggcggctgttggagttagcaaacccctccccagtgtcccgccatccattggaaaaagcaacgtggaccggaggcaggcagagattggggaaggtagtgttaggaggaggatttacgacaacccctatttcgaaccccagtacgggtttccccctgaggaggacgaggacgagcagggcgagtcctacacccctcggtttagccagcatgtatccgggaatagggcgcagaagctgcttagacccaactctttgagactggcttctgattccgacgccgaatctgactcaagggcaagctcacccaactcaacagtgagcaacacctcaacagagggtttcgggggaatcatgtcattcgccagcagtctgtatcggaaccactcaacatcgttcagtttgagtaacctgacgttgccgaccaaaggggctagggagaaagcaaccccctttccctctttgaaggtgttcgggctgaacacgttgatggaaatcgttaccgaggcaggacctggctcgggcgaggggaacaggcgtgccctggtggatcaaaaaagcagcgttataaagcattcaccaacggtgaaaagggaaccgccttccccccagggacgctcttccaacagttcagagaaccagcagtttctgaaagaagtcgtccactctgtcctggatggtcagggggtaggttggcttaacatgaagaaagtgagaaggctgttagagtctgaacagctgcgtgtttttgtgctctccaagttgaaccgaatggtccaaagcgaggatgatgcaaggcaggacattatcccagacgttgaaatttcacggaaggtctataagggcatgctcgatctgctaaagtgcaccgtccttagcctggagcaatcctatgctcacgctggtcttggcggaatggcctcaatctttggcctgctagaaattgcccagacacattattatagcaaggaacctgacaaacgcaaacgcagcccaacagagtcagtaaatacgcccgttgggaaggatccgggtctggctggaagaggagaccccaaagcgatggcgcagctccgcgtcccccagctggggcctcgtgctccctccgcgactggcaagggccctaaggagctggatacccgctctctcaaagaggaaaactttatagcatcaatcgaactgtggaacaaacaccaagaagtgaagaagcagaaagcattggagaaacagagacccgaggtgatcaagccagtctttgacctgggagagaccgaagaaaaaaagagccaaatttctgccgattctggcgttagcctgaccagcagctcgcagaggactgatcaggatagtgtgatcggagtgtcccccgctgtgatgattcgatcttcctctcaggacagtgaagtctcaaccgtagtgagtaattcctcgggcgagactcttggggcagacagtgacctgtccagcaacgccggagacggacctgggggtgagggaagcgttcatctcgcttcatcaaggggcacgctgagtgacagcgagatcgagaccaattcagctacttccactatattcggcaaagcgcacagcctgaagccttcaatcaaggagaagttggccggtagccctatccgcacatccgaggatgttagtcagcgtgtgtatctatatgagggactccttggcagagataagggctccatgtgggaccagctggaagatgctgcaatggagacatttagcatcagcaaggaaaggtcaaccctctgggatcagatgcaattctgggaagacgcatttctagacgccgtcatgttggagagagagggaatgggcatggaccaaggcccacaagagatgatagacagatatctgtcactgggcgagcatgacagaaagagacttgaagatgatgaggacagactgttggctaccttgctccacaatcttatctcttatatgctgttgatgaaagtcaataagaacgacattcgaaaaaaggtgagacgcttaatgggaaagagccatattggactggtgtattcccaacaaattaatgaagtgttggaccagctggcaaatctcaatggcagagacctgtcaatctggagtagtggcagcagacacatgaagaagcagacatttgttgttcacgcaggcactgataccaacggagacatcttcttcatggaagtgtgcgacgactgcgtcgtactccgcagcaacatcgggacagtatatgaaaggtggtggtatgagaaactgatcaacatgacatactgccccaagacaaaggtcctttgtctctggagacgcaatggctctgagactcagttaaacaagttctacaccaagaaatgccgggaactgtactactgcgttaaggatagtatggaaagggctgccgcacggcagcaatctatcaagcctgggccagaactgggcggagagtttccggttcaggacctgaagactggagagggcggattgcttcaagtcactctggaaggcatcaatctcaaatttatgcacaatcagttcctgaaactgaagaaatggtag

SEQ ID NO: 229628 - DNA, 4440 bp, Artificial Sequence
  Description of Artificial Sequence: Synthetic coding sequence
atggtgcagaagaaaaagttttgcccaaggctgttagactatctggtcatcgtgggcgcacgccatcctagtagcgacagtgtcgcccaaactcctgaactacttcgacggtatcccctggaagaccacaccgagtttccactgccccctgacgttgtattcttttgccagccagagggatgtttatccgtccgacagagacgcatgagtctgagggacgacacatcgttcgtttttactctcaccgataaagataccggcgtgacgaggtatggtatttgtgtgaacttttatcgctctttccagaagcgaatcagcaaggagaaaggagaaggcggagctgggtctcgcggaaaggaagggactcatgccacttgtgcctcagaggagggcggaacggagtctagtgaaagtggatcttcattgcagcctctgtcagcagacagcacaccagatgtgaaccaatctccccgtggcaagaggcgcgcaaaggccggtagtcggtcccggaacagtacactgacatcgctgtgtgtcctcagtcactatccgttcttttctacatttagagagtgtctatatacactgaaaaggctcgtggattgctgtagcgaacggcttctaggtaaaaaactcggaattccacggggagtacagagagacaccatgtggaggatcttcaccggatccctgctcgtggaggagaagtcctctgcgctgctccatgatctgcgggaaatcgaagcgtggatctaccgcttgctgaggtccccagtgccagtgtcgggccagaagagggtcgatatcgaagttctccctcaagagctgcaaccggcattgacgttcgccctccccgacccgtctaggtttaccttggtcgactttcccttacatcttccactggaactcctgggcgtggatgcttgtctgcaagtcctgacgtgcatactgctggaacataaggttgtactgcagtcgcgcgattataacgccctttctatgtctgtaatggcttttgtcgctatgatctatcccctggagtacatgttcccagttataccattgctgccgacttgtatggcatctgctgagcagctattgctggcaccgaccccgtatatcatcggcgtccccgctagctttttcctatataagcttgattttaagatgccagatgacgtgtggctggtggatttagactctaaccgtgttatagcacctaccaatgctgaggtgctgcccattctcccggagcccgagagcctggaactcaaaaaacacctgaagcaggctctcgcatcaatgtcccttaacactcagcctatcctgaacctggaaaaattccacgaggggcaggaaatccctctgcttctgggcagaccatctaatgatttacagtctactcccagtactgagttcaacccccttatttatggtaacgacgtagatagcgtcgacgtggcgacaagggttgcgatggtgcgtttcttcaactctgcgaacgtcttacagggcttccagatgcatacccgcacactgcgactctttcctaggccagtggtagcatttcaagctgggtccttccttgcttcccggccacgacaaacaccgttcgctgagaagcttgcaagaacacaggccgttgaatatttcggggagtggattctcaaccccactaattatgcatttcagagaatccacaataacatgttcgatcctgcgctaattggagacaaaccaaaatggtacgcccatcagctgcagccaattcattaccgagtgtatgacagtaatagtcaactggccgaagctctgagcgtcccacctgagcgagactcagattccgagccaaccgatgactccggtagcgacagcatggactacgacgacagctccagtagttattcgtcgcttggggactttgtttcagagatgatgaaatgcgacataaatggggacacccctaatgtggatccccttacccacgcagcactgggagatgcaagcgaggtggaaatcgacgaacttcagaatcagaaggaagcggaagagccaggccctgactccgagaacagtcaagagaatccacccctgcgctccagtagttctacaactgcttcatcaagtccatccactgtgattcatggagctaactcagaacctgcagatagcaccgaaatggatgataaggcagccgtcggcgtgtctaagcccctgccctctgtgcctccgagcattggaaaatcaaatgtggacaggcggcaggctgagataggagaaggcgcacagaaactgctgagacccaattcacttcggcttgcctctgacagcgatgcagagtcagattccagggcaagctctcctaattcaactgtgagcaatacaagtacagagggtttcggaggcattatgagctttgctagcagcctgtacaggaaccactctacatcattctccttatctaacctgaccctgcccacgaagggagcacgagaaaaggccacgccattccctagcttgaaaggcaaccgacgcgctcttgtggaccagaagtctagcgtgatcaaacattctcccaccgttaagcgggaaccgccaagcccccagggccgaagcagcaattcttcagaaaatcagcaattcctgaaagaagttgtgcatagcgtgctggacgggcagggagtcgggtggctgaacatgaagaaggttcgccgtctgctcgaaagtgaacagctgcgcgtgtttgtgctctctaagttgaacaggatggttcagtccgaagacgacgcacgacaggacattattcctgatgtcgagatttcgcggaaggtttataaagggatgctggatctgctcaaatgtacagtcctctccctggagcagagctacgcccacgctggactgggcggaatggcaagtatttttggcctgctggaaatcgcccaaacacattactatagcaaagagcccgacaagcggaaacgaagcccaaccgagtctgtaaatacacccgtcggtaaggacccaggccttgccggtcgtggtgaccccaaggctatggctcagctgagggtaccacaactgggcccacgggcaccctctgcaaccggcaagggacccaaggaactagatacacgctcgctgaaggaggagaacttcatcgcctccattggccctgaagttataaagccggtgttcgatctcggggagacagaagaaaagaagagccagatttccgcggacagtggggttagcctgacgtcctccagtcagcgcacagatcaggattcggtaatcggagtcagtcctgcagtgatgatccgttcgagcagccaggactctgaggtgagcacagttgtgtctaactcctccggcgagactctgggtgcagattccgaccttagcagcaatgccggagatggaccaggaggcgaaggcagtgtccacctggccagttccagagggacgctgtctgactcagagatcgagacaaactcggcaacaagcaccatcttcggtaaggcccattcccttaaacccagcatcaaagagaaacttgcaggtagtcctatccgtacctcagaggatgtatcccaaagagtctacctctatgagggcctattaggtaaggaacgttcaaccctgtgggaccagatgcaattctgggaagatgccttcctggacgcagtgatgctcgaaagggaggggatgggcatggaccagggccctcaggagatgattgacaggtacctgtctctaggtgagcatgaccggaagcggctggaggacgatgaagatcgcttgctcgccacacttctgcacaatttgatctcctacatgttgttgatgaaagtcaataagaatgatatccggaagaaggtccgtcggctgatggggaaaagccacatcgggctggtttactcccagcagataaacgaggtcctggatcagcttgccaacctcaatggcagagatctgtccatttggtcatcaggctcccgtcatatgaagaagcagacgttcgttgtccacgctgggaccgatactaacggggatatattcttcatggaggtctgtgatgactgcgtggttctacgctctaatattggtaccgtgtatgagcggtggtggtatgaaaagctgattaatatgacatactgtccaaagactaaagtcctgtgtctgtggaggcgcaatgggtcagagacccagctcaataaattttacactaagaagtgccgggaactttactattgcgtcaaagatagcatggaacgagccgctgctaggcagcagtctattaaacccggtcctgaactgggaggcgagtttccagtgcaggacctcaagaccggtgagggcggactgctgcaagtgaccttggagggcattaacctgaaatttatgcacaaccaactacttcgacggctgcgttggtag

SEQ ID NO: 229629 - DNA, 4626 bp, Artificial Sequence
  Description of Artificial Sequence: Synthetic coding sequence
atggtccaaaagaagaaattctgtccccgactgttagactatctggtgatcgtgggagctcggcatccctcgtccgactcagtggcccaaacaccggagcttctgaggcgctacccacttgaggaccacactgaattcccactgccacctgacgtggtgtttttttgtcagcctgaaggttgtctgtctgtgagacagagacgcatgtcactacgcgatgataccagtttcgtttttacactcacggataaggataccggtgtgactcgttatggcatctgcgtgaacttctacagaagctttcaaaagcggatctccaaggaaaagggggaaggtggcgcaggatctcgtggaaaggaaggtactcatgccacatgtgcctctgaggagggcggaaccgagtcaagcgagtccgggtcctccctccaaccactctctgctgattccacgccagacgtcaaccagagcccaagaggaaagagacgtgctaaagccggatccaggagcaggaatagcacacttacgtccctgtgtgttctgagccattatccttttttctccacgttcagagaatgcctatatacattgaagagactggttgattgttgcagcgaacgcctgcttggcaagaaactgggcatacccaggggcgttcaacgagacaccatgtggaggatctttaccggtagcctgctggtggaggagaaatcctcggctctcttacatgacctccgcgaaatagaagcctggatctatcgactgctcaggtccccggtccctgtctccggacagaagcgggtcgacattgaggtgctgcctcaggagctgcaacctgcactgactttcgctcttcctgatccctctaggtttactctagtggattttcccttgcacctgccactggaactactgggggttgacgcttgtctccaagtgctgacatgtatcttgctggaacacaaggtggtcttgcaaagtagagactataacgcgctgtctatgagtgtcatggcgttcgtggccatgatctacccactggagtacatgtttcccgttatacctctccttccaacgtgcatggccagcgctgagcagctcctgctcgcgccaacaccatacatcattggggtgcccgcatcgttcttcctttataaactcgacttcaagatgcccgatgacgtgtggctagtggaccttgactccaaccgcgtaatcgccccaaccaatgcagaggtacttcctatcttacccgagccagaatccttggagctgaaaaagcatcttaagcaggcacttgcctccatgtctttgaacacacagcccattttgaacctggaaaagttccacgaaggccaggagatacctctgctcctcggccgaccctcgaacgacttacaaagtacgccatcaacagaattcaatccactgatctatggcaatgacgtggacagtgtggacgtggcgaccagggtcgctatggtcaggttttttaactcggcaaacgtgctgcaaggtttccagatgcacacccggactctgaggctgtttccaagacctgtcgtcgcctttcaagcaggtagctttctcgcaagccgtcctcgacaaactccctttgctgagaagttggccagaactcaggcagtggaatatttcggagagtggatcctgaatcccacaaattacgcttttcaacgaatccacaataatatgttcgatcccgctctgattggagacaagcccaaatggtatgcccaccagttgcaaccaattcattaccgcgtttacgattctaacagccaattagccgaggctctgtccgtccctcctgagcgagattcagatagcgagcccactgatgactcaggttctgatagtatggactacgacgatagctccagtagctattcctcattaggcgactttgtcagcgagatgatgaagtgtgatatcaacggggatactccaaatgttgatcccctgacgcatgccgcattgggggacgcgtccgaggtcgagatcgatgagctgcagaaccaaaaagaagctgaggaacccggaccagactccgaaaactctcaggaaaatcctcctctaaggagcagctcatcgactactgcctccagctcacctagcaccgttattcacggagccaactccgagcccgcagacagtacagagatggatgataaggccgcagtgggagtctctaagcccctaccatctgtgcctccaagcataggcaagtccaatgtggaccgtaggcaggctgagatcggggagggcgcacaaaagctgttacgtccaaatagcctacgtctcgcatcagatagcgacgcggagtctgattctagggctagcagccccaattctactgtgtcaaatacctctacagaaggattcgggggaattatgagtttcgctagctctctctaccgtaaccacagcacttccttctctctgtcaaatctcacattgccaacaaaaggcgctcgcgagaaggccaccccctttccgtcactcaaaggcaaccggagagctttggtcgaccagaagtcctctgtgatcaaacatagtccaacagttaaacgcgaacctccctcacctcagggaaggtccagcaactcgtctgagaaccagcagtttctgaaggaggtggtgcattccgtgctggacggccagggagtcgggtggcttaacatgaaaaaggtccgtcgcctgttggagtcagagcagctcagagtgttcgttctatctaagctgaacagaatggtgcagagcgaagacgatgctagacaggatatcattccagacgtagagattagccggaaagtgtacaaagggatgctcgatctgttaaaatgcaccgtactgagcctggagcagtcctacgcccatgccggtcttggtggaatggcttccatctttgggctgctggaaatcgcccagacccattactactccaaagagccagacaaacgcaaaagaagtcctacggagagtgtgaatacccccgtcgggaaagacccaggactggccggacggggtgatcccaaagcaatggcccaattgcgagtacctcagctgggacctagggccccatccgctacaggtaagggtcctaaggagctggacacaaggtctctgaaagaggaaaatttcatcgcgagcattggccctgaagtgattaaacctgtgttcgatttgggcgagaccgaggaaaaaaagagtcagatttccgccgattcgggagtgtccctcacctcttctagtcagcggaccgaccaggattcagtgattggagtcagcccagccgtcatgattaggagcagttctcaagacagcgaggtgtctaactcctcaggagagacactgggggctgattctgacttgagttctaatgccggtgacggccctgggggagaagggagcgtgcacttggcttcctcgaggggcaccctgtctgattcagaaatagagactaattcagccacatccaccatattcggcaaagcccactctttaaagcctagcatcaaggagaaattagctggaagcccaattagaacttctgaagacgtgtcccagcgcgtttatttgtatgaaggcctgctggggaaggaacggtcaacgttgtgggaccaaatgcaattctgggaagatgcattcttggacgccgtgatgctcgagcgcgagggcatggggatggatcagggcccacaggagatgattgatcggtacctgagcctaggtgaacatgatcgcaaacgcttagaggatgacgaggatcgacttctcgcaacgctgttgcataacctgatctcctacatgctgttgatgaaagtgaacaagaacgatataagaaagaaagtcagaagactcatgggcaagtcacacatcggattggtgtatagccaacagattaatgaggtgctggatcagctggccaacctgaacggacgggatttgtccatatggtcttctgggagccgacacatgaaaaagcagacattcgtcgttcacgccggtacagataccaacggggatatttttttcatggaagtgtgcgatgactgtgtggtcctgcgatctaatatcgggaccgtttacgagcgatggtggtacgagaagctgataaacatgacttattgccccaagactaaggtgttatgcctgtggcgtcggaacggatcagaaacgcaacttaataaattttacacaaaaaaatgtagagagctgtactactgcgtcaaggattcaatggagagggcagccgctcggcagcagtctattaaaccaggacccgagctcggtggtgagttccctgtgcaggatctgaaaaccggggaagggggactgcttcaggtgaccctggaaggcatcaacctaaagttcatgcacaaccaagtgtttattgagctcaatcacattaagaagtgtaacactgtgaggggggttttcgtgctggaagaattcgttcctgaaatcaaggaagtcgtaagccacaagtataagacccccatggcccacgagatatgttattcagtactatgcttattctcttatgtcgctgccgttcattctagcgaggaggatttgcgtacgcctcctcggccagtcagttcttag

SEQ ID NO: 229630 - DNA, 4764 bp, Artificial Sequence
  Description of Artificial Sequence: Synthetic coding sequence
atggtgcagaaaaaaaaattttgccctaggctcctcgattatctcgtaatcgtgggggcacggcatccaagcagtgatagcgtggctcagactcctgaactgctgagacggtacccacttgaagatcatactgaattccccctgcctcccgacgtcgtattcttttgccaacccgaaggttgcctgagtgtgcgtcagcggagaatgtccttaagagacgacactagcttcgtctttactcttacagataaagataccggggtcacacgttatggaatttgcgtgaacttctacagaagttttcaaaagaggattagcaaggagaaaggcgagggcggagccggttctcggggaaaagagggcacccacgccacatgcgcctccgaggagggaggtactgagagttctgagtccggatcttctctgcagcctctgtccgcagattccactccagatgtgaaccagagtcctcgcggtaagcgaagagctaaggcaggctccagatctcggaactctaccctgaccagcttgtgcgttttgagccactacccatttttttctactttcagagaatgcctgtatacgcttaagcgactggtggactgctgcagtgagcgcctgctcggaaaaaaacttgggatccccagaggcgtgcaaagagatactatgtggcggatcttcaccggaagcctcctggttgaagaaaagagctcggccctgttgcacgacttacgtgaaatcgaggcatggatataccgcctgctgagatcacccgtacctgtgtcaggtcaaaagagagttgatattgaagtcctgccccaggagttgcagcccgcattgacgttcgcgcttcccgacccaagtagattcaccctggtcgacttcccactgcacctccccctggagctgctcggtgtggacgcttgcctccaggtactgacatgcatcttgctggagcacaaggtagtgctgcaaagccgggattataacgcgctttctatgtcggtgatggcttttgtagcgatgatctacccactggagtacatgttcccggtcatccccctcctacccacgtgcatggcatccgctgagcagctcttgcttgcccctactccgtacataataggtgtgcctgcctcattcttcctgtacaagctcgacttcaaaatgcccgacgatgtgtggctggtcgacttggattccaaccgggtgattgctccaacaaacgcagaggtcctgccgattcttcccgagccagagagtttagaactgaaaaagcatctaaaacaggccttggcctcgatgtcgttaaacacacaacctatcctgaatttggagaagttccatgagggtcaagaaattcctctgctgttgggcaggccgagtaatgatcttcagtctacgccgagcactgaattcaaccccctgatctatgggaacgatgtcgattccgtcgacgtggctaccagagtagctatggtcaggttttttaacagcgcaaatgtgctgcagggtttccagatgcataccaggaccctgaggctttttccacgcccagtagtggcatttcaagcaggctccttcctcgcttcccggccaaggcagaccccatttgcagagaaactggcacgaacgcaggccgttgagtattttggcgagtggattctcaacccaacgaactatgcttttcagcgaattcacaacaacatgttcgaccccgctctcatcggcgacaagcccaaatggtacgcacatcagctgcagcccattcactaccgtgtctatgatagtaatagccagctggctgaagctctgtctgtaccaccggaaagggattcagactccgagcccacagacgactccggctctgactctatggactacgacgactcgtctagctcttactctagcctgggagacttcgtgagcgagatgatgaaatgcgacattaatggggacaccccaaatgtcgatcccctgacgcacgctgccctgggtgacgctagcgaggtagaaattgacgaattgcagaatcagaaagaagccgaggagccgggacctgattctgagaacagccaggagaatccccctttacggagctcttctagtaccacggctagctcttctccttccacagtgattcatggtgccaattccgaacctgcagattcgacggaaatggatgataaagccgctgttggggtgagcaagccactgccctccgtgcccccttccattggtaagtccaacgtggatagaagacaggccgagattggagaaggatcagtgaggcggaggatctacgataatccgtatttcgaaccccagtacggcttccctccagaagaggatgaggatgaacaaggggaatcatacacccccaggttcagtcagcatgtatcggggaaccgagctcaaaagctgcttcggccaaatagtcttagactagcatccgattccgacgcggagagcgactcccgggctagcagccccaacagtactgtgtccaatacatctacggagggatttggcggaattatgagctttgccagctctctataccggaatcactctacctcattctcactgtccaatctgacattacccacaaaaggagccagggaaaaggcaacaccatttcctagcttaaaaggcaatcggagggccctggtcgatcaaaaatcttcagtgatcaaacactcacctactgtcaaacgcgagccccctagccctcaaggacggtcatccaattccagcgagaaccagcagttccttaaagaggtggtgcatagcgtcctggacggccaaggcgtgggctggctgaatatgaaaaaagtcagacgactgttggagtccgagcagctgagggttttcgtcctaagtaagttgaatcggatggtccagagcgaggacgacgcccgacaggacatcataccggacgtggaaatttctaggaaggtgtacaaaggcatgctggacttgttgaagtgtacagtactgtcacttgagcagagttatgcacatgccggtctgggagggatggccagcatctttggccttttagaaattgctcagacccactactatagcaaggagcccgacaaaaggaagcgcagtcccactgaatccgtcaacactccagtggggaaggaccctgggctagctggacggggtgatcccaaagcaatggcccagcttagagtcccccaactgggacctcgcgcaccctccgccaccggcaagggacctaaagaactagacacccgctccctgaaggaggaaaacttcatcgcaagcatcggacctgaggtcataaagccggttttcgacttaggagaaaccgaggagaagaagtcccagatcagtgccgactcaggggttagcctaactagctcctctcaacgcacggaccaggactccgtgatcggagtctccccagctgtaatgatcaggagcagcagtcaggacagcgaggtgagtaccgtgagcaatagctccggcgaaacccttggcgctgactctgacttgtcaagcaacgcaggggatggtccgggaggcgagggtagcgtacacctggcctcctccaggggtaccttgagcgactctgaaattgagacaaatagtgccacaagcaccatcttcggcaaagctcattccctcaaaccgtccatcaaggagaagttagccggttccccgatccgaacatcagaggatgtttcccagcgcgtgtacctgtacgaagggctcttaggcaaagaacggtccaccttatgggatcagatgcagttctgggaagatgcctttcttgacgccgtgatgctagagcgggaaggcatgggcatggaccaaggaccccaggagatgatcgacaggtacttgagtttaggcgagcatgaccgcaagcgtctggaagacgacgaagaccgtttactcgcaactttgctgcacaacctgatttcttatatgctgctgatgaaggttaataaaaacgacatcaggaaaaaggtgcggaggctaatggggaaaagccacatcggccttgtttattctcagcaaatcaatgaagtattggaccaattggccaacctgaatggccgtgacctgagtatctggagtagcggttcgcgccatatgaaaaagcagacattcgtcgtgcatgccggaaccgatacaaacggcgatatatttttcatggaggtctgtgacgattgtgtggtcttaagaagcaacattgggacagtttacgaaagatggtggtacgagaagcttataaacatgacgtactgcccaaagactaaagttctgtgcttgtggagacgtaacgggtcagaaacacagctgaataaattttatactaagaagtgtagggaactgtattactgcgtgaaggacagcatggaaagagcagcagctcgtcagcagtcaatcaagccgggacccgaactggggggtgaattccctgtccaggacctgaagacaggagaggggggtctcctccaggttacgcttgaaggcataaatctaaaatttatgcataatcaggtgttcatcgagctgaatcacattaaaaaatgcaacaccgtgaggggtgtgttcgtacttgaggaatttgtgccagagattaaagaggtggtgagtcacaagtataaaaccccaatggcacatgagatatgctatagcgtactttgcctgttttcatatgtcgcagcagtccattccagcgaggaagacctacgaacccccccaagacccgtgagcagttag

SEQ ID NO: 229631 - DNA, 4638 bp, Artificial Sequence
  Description of Artificial Sequence: Synthetic coding sequence
atggtgcagaagaaaaaattttgccccagacttctagactatcttgtcattgtgggcgcaaggcatcctagttcggatagcgttgcccagacccccgagcttttgcgcagatacccgctggaagaccatacagagttccccttacccccagatgtggttttcttctgtcagccggagggctgtctttcggtgaggcagaggagaatgtcgctcagggatgataccagcttcgtgttcacccttaccgacaaggacactggggttactcgctacggtatatgtgtgaacttttacagaagctttcaaaagcgcatctctaaggagaagggcgaaggcggagcagggtctcgtggaaaagagggaactcatgccacctgcgctagcgaagagggaggaaccgaatcttcagaatctggaagctctctacagcccctctctgctgattcaacgcccgatgttaatcagagccctcggggtaaacgacgggcaaaggcaggctcccgctcaaggaactctacattgacaagtctgtgtgttctatctcactacccgttcttttcgaccttcagggaatgcctgtacacgcttaaaaggttggtcgactgctgtagtgaaaggcttctaggtaagaaacttggaatccccagaggtgtccagagggataccatgtggcggatctttacggggtccctattggttgaggaaaagagttctgctttgttgcatgacctgcgtgagattgaggcatggatctaccggttactacgctcccccgtgcccgtttctggccaaaagcgggtggacattgaggtgctgccacaggagctccagcctgcgctcacattcgccctgcctgatcctagccggttcacacttgttgattttccactgcatttaccactagaactgctcggagtcgacgcttgtctgcaggtactgacttgcattcttctagagcacaaggtggtcctgcagtccagagattataatgccctctccatgagtgtgatggctttcgtcgcaatgatatacccactggagtacatgtttcccgtgatccccttattgccaacatgtatggctagtgcagagcaactgctgcttgcacccaccccatacatcattggcgttccggcttcattcttcctgtacaagctggatttcaaaatgcccgacgacgtgtggctggtcgacttagattctaatagggtgatagcaccaactaacgcagaggtgctgcctattcttcccgagcccgagagtttggagctgaagaagcaccttaaacaggcacttgcaagcatgagtctaaatactcaacccatcctgaaccttgagaagttccatgagggccaagagatacccctcctgctgggcaggccttctaatgacctgcaatctacccctagcacggagttcaaccccctgatatacgggaatgatgtggatagtgtggacgtggcaacccgggtcgccatggtgcggttcttcaatagcgccaacgtgctgcaaggattccaaatgcacactcggacactacgactcttcccacggcctgtagtcgctttccaagcaggctcttttctggccagccggccacgccagacacccttcgctgaaaaattggcacgcacccaggctgttgagtacttcggcgagtggatcctgaatcccacaaattatgcctttcagagaattcacaacaatatgttcgaccccgctttaattggagacaaacccaaatggtacgcccaccagctccagcctattcattatcgagtgtacgatagcaacagccaactcgccgaagcactgtctgtgccaccagagagggacagcgattcagagcccactgacgactccggttctgactctatggattacgacgattcctcttcgagctactcaagtttaggagatttcgtgtctgaaatgatgaagtgtgatatcaacggagatacaccaaatgtggatccactgacccacgccgcactgggggacgcctctgaggtggagatcgacgagcttcagaatcagaaagaggccgaggagccaggtccagacagcgaaaactctcaggagaatcctccccttagatccagctctagcaccactgctagctcctccccctctaccgtgatccacggggctaatagcgagcccgcagactccaccgagatggatgataaagccgctgtaggcgtttctaagcctcttcctagcgtgcccccttctattggcaaaagtaatgtggacagaagacaggccgaaatcggagaaggtgctcagaagctgctgagaccaaactcccttcgactggcatccgattccgatgcagaaagtgattcacgcgcttccagcccaaacagcacagtctcaaatactagcactgaggggttcggaggcattatgtccttcgcttcgtccctgtacaggaaccattccacctctttcagccttagtaaccttactctgcctacgaagggggctcgcgagaaagccacaccttttcccagccttaaggggaatcgcagggcactggtggatcaaaaatcgtccgtaatcaagcattcccctacggtgaaaagagagccaccttcacctcaaggtcggagcagcaacagctcagagaatcagcagttcctcaaggaagtggtgcattcagttttggacgggcagggggttggctggctcaacatgaaaaaggtccgacgtctgttggaatctgaacagttgcgagtgttcgtgctgtccaagttgaatcgaatggtccagagcgaggacgacgcgagacaggacattattccagatgtagaaattagccgtaaggtgtataagggcatgctggatcttctcaagtgtacagtcctttcccttgagcagtcctacgctcacgctggcctagggggaatggctagtatctttggcctgctggagattgcacaaactcactattactcaaaagagcccgacaagagaaaacggagcccaacagaatccgtcaacactcccgtgggcaaagaccccggactggctggcagaggcgatcctaaagcaatggctcaattacgggtgccacagctgggcccacgcgcacccagcgctacaggaaagggcccaaaagagctggatactcggtcattgaaggaggagaacttcatcgctagtatcggaccagaggtcatcaagccagttttcgacctgggagaaactgaagagaagaagtcacagatttcggcagactccggagtctctcttacaagctcttcacagaggaccgaccaggacagcgtcataggagttagccctgcagtaatgatcagatccagtagtcaagacagcgaggtcagcaccgtggtcagcaactccagcggcgagaccctgggcgcagactctgacctctcatccaacgctggcgacggacccggaggggaggggtcggtacatttagcaagtagcagggggactctgtcagacagtgagatcgaaacgaattcagccacttcaaccattttcggcaaggcacacagcctgaaaccgtcaataaaagaaaaacttgccggttcgccaatccggacttctgaagatgtctcccagagagtttacctctacgagggcctcctcgggaaagaaaggtctaccctctgggaccagatgcagttctgggaggatgcgttcctggatgccgtaatgctggaaagagagggcatgggcatggaccagggccctcaagaaatgatcgatcgctatctttctctgggtgagcatgacagaaagcggttagaagacgatgaagatcgattgcttgccactctgctgcataatcttatctcttacatgctgctgatgaaagttaataaaaatgacattcgaaaaaaggtgcgcaggttgatgggaaagtctcacataggtctcgtgtacagtcagcagattaacgaagtgctggatcagctcgctaacctgaacgggagagacctgtctatctggtcgagtggcagtaggcatatgaaaaagcagacctttgtggtccacgcaggcaccgacacgaacggagacattttttttatggaagtgtgtgacgactgcgttgtccttcgcagcaacattgggacagtgtacgaaagatggtggtatgagaaacttatcaacatgacctactgcccaaagactaaagttctgtgcctgtggcggaggaatgggtctgagacccaactgaacaaattctacacaaaaaaatgcagagagctatactactgtgtaaaagacagtatggagagagcagcagccaggcagcaaagtattaagccgggaccagagttaggtggcgaattcccagtgcaggatctgaagactggcgaaggaggactcctccaggttaccctcgagggcatcaatctgaaattcatgcataatcaggtcttcatcgaactgaatcatattaagaaatgtaacaccgtgcgcggagtgttcgtacttgaggaattcgttcctgagattaaagaagtggtgtctcacaagtacaaaacgcccatggctcatgagatttgctattccgtgttgtgtctgttttcctacgtggcagctgtgcatagttccgaagaagacctgaggacccctccaagacctgttagttcctag

SEQ ID NO: 229632 - DNA, 4440 bp, Artificial Sequence
  Description of Artificial Sequence: Synthetic coding sequence
atggtgcagaagaaaaaattctgcccgcgacttctcgattatctcgtgattgtgggagcacgccaccccagttccgactcggttgcgcagacaccagagttattgagacgatacccattggaggatcacacagagttccctcttccccctgacgttgtgttcttttgccaacctgaaggttgcctgtctgtgcggcagaggcgtatgtcgcttcgcgacgacacatccttcgtgtttactctgaccgacaaagacactggcgtgacccgctacggcatctgtgtgaacttttacagaagttttcaaaagcggatcagcaaggaaaagggagagggaggagctggtagcagaggaaaagaggggacacatgcgacctgcgcctccgaggaagggggaaccgagtcatctgagagtggatccagcctgcaacccctgagtgctgattcaactcccgacgtgaatcaaagcccccgtggaaaacgccgtgccaaggctgggtcacgctctcggaacagcactctcacttcattgtgcgtgctgtcacattacccgttctttagcacattccgggaatgcctttacactttaaaaaggttggttgattgttgcagcgagaggctgttaggaaagaaattggggatccctcggggtgtgcagcgggacaccatgtggaggattttcaccggctctttgctcgtggaggaaaagagctcagcccttctgcatgacctgcgagaaatcgaagcatggatttacagattacttagatcaccggtgcctgtgtccgggcagaagcgtgtggacattgaagttctgcctcaggaattgcagccagctctcacattcgcacttcccgacccatcacgtttcactctcgtagacttcccgctacatctgccgttggagctgctgggggtggacgcatgcctccaggtgcttacatgcattctgttggaacacaaagtggtcctccaatctagggactacaacgccctctcaatgagtgtcatggcttttgtggccatgatttatcccctggaatatatgtttccggtgattccgcttctgcccacttgcatggcctcggcagagcagttactgctggcaccaaccccctacattatcggggttcccgctagtttctttctgtataaattggacttcaaaatgcccgatgatgtgtggctagtggacctagactctaacagagtgatcgccccaacgaacgccgaagtgctgcccatcctcccagagccagagagtctagagttgaagaagcatctcaagcaagccctggcaagcatgtccttgaatacacagcctattctcaatctcgagaaattccatgagggccaggaaattcctctgctgttgggaagaccaagcaacgaccttcagtcaaccccttctactgaattcaacccattaatatacggaaacgatgtggacagcgtcgacgtcgcaacgcgcgtggcaatggtgagatttttcaatagcgccaacgtgttgcaggggtttcagatgcacaccagaactttgaggctgttccccagacccgtggttgcattccaggctggctcgtttctggcttccaggccccgacagacacccttcgctgaaaaactagccagaactcaggctgtcgagtatttcggtgaatggatcttgaatcctacaaactatgcctttcagagaatccacaacaacatgtttgatccagcattgatcggggataagcctaaatggtacgctcaccagctccaacccattcattacagagtttacgacagcaacagtcagctcgcggaggcactgagtgtgccaccagagcgagacagtgacagtgaaccaacagacgattcaggcagtgacagcatggattatgatgattcaagttcctcctatagttccctgggggacttcgtgtcagagatgatgaagtgtgacatcaatggcgatacccctaatgtcgacccgctgacccatgctgctctcggagacgctagcgaagtcgagatagatgaactgcaaaaccagaaggaagctgaagagcctgggcctgactcagaaaatagccaagaaaacccaccactgcgctcctccagctcgacaaccgcgagttcctcaccatcaacggtcatacacggggcaaattcagaacctgccgatagcacagagatggacgataaagccgcagtgggcgtatccaaacccctgccttccgtcccgccttctataggaaagtcaaacgtggatcgccgacaggcagagataggcgagggcgctcagaagctgctgaggccaaactctctgagactggccagtgacagtgacgccgaatcagactccagagcttcatcgccaaacagcactgtgtcgaatactagcaccgagggatttggagggattatgtcatttgcctcatcactctaccggaaccactcaacgtctttcagtctctccaatctgacacttcctacaaaaggcgctcgtgaaaaagccactccattcccctccttgaaaggtaatcggagggctttggtggatcaaaagagcagtgtgatcaaacattccccaactgtcaagcgcgaacctcccagcccacagggcagaagcagcaattcatctgagaatcagcagtttctcaaggaagtggtgcactcagtgcttgacgggcagggggttggatggttgaacatgaagaaggtccgcaggttactcgagtccgagcagctgcgcgtttttgtcctgtcgaagctaaatagaatggtgcagtccgaagatgacgcgaggcaggatattatccctgacgtcgaaatctcacgcaaggtgtacaagggcatgcttgacctcctaaaatgcacagtcctgtctctggagcagtcgtatgcccatgccggtctggggggaatggcaagcatcttcgggctcttagagatcgctcaaacacactactatagtaaggagccagacaagaggaaaaggtcgccgactgaatctgtgaatactccagttggtaaggatcctgggttagccggaaggggcgatcctaaggctatggcccagctccgagtgccgcagcttgggccacgcgctcccagtgccaccggaaaaggacctaaggagttagacacgcggtcactgaaggaggagaactttatagcttcaattggtcccgaggtcataaaacctgtgttcgatcttggcgagactgaggagaaaaagagtcagatttccgccgactccggagtatcacttacatccagttcccaacgcaccgaccaggacagcgtgatcggagtgtccccagccgtgatgatcagatctagttcccaagactcggaagttagcaccgtcgtctcaaacagcagcggcgagaccctaggtgccgacagtgatctctcaagtaacgcgggagacgggcctggcggtgagggaagcgtgcatctggcaagctcccgtgggacactcagcgactccgagatcgagacaaattctgctacctccactatcttcggaaaggcgcatagcctgaaaccatcaattaaggagaagctggccggaagtcctatcaggacatcagaagatgtctcccaacgcgtgtatctgtacgaagggctgctgggaaaggagagatcgaccctctgggatcagatgcagttttgggaggatgcctttttggatgccgtgatgctcgagcgtgaaggtatgggaatggatcaaggccctcaggagatgatcgatcgctacctgtctctgggcgagcacgataggaaacgcctcgaagatgacgaggaccgcctcttggctactctgttgcacaacctgatcagctatatgctgttgatgaaagttaacaaaaacgatatccgcaagaaagttagacgactcatgggtaaaagccacatcggcctcgtgtacagccagcagatcaacgaagtactcgaccaactagcgaatttgaatgggagagacctttctatatggagctccggatctaggcacatgaagaaacaaacattcgtggtgcatgccggtacagatactaacggagacatcttcttcatggaagtatgcgacgactgcgtggtactcagaagcaatattgggacagtgtacgagcgatggtggtacgaaaaactgatcaacatgacctattgccccaagaccaaagtgctgtgcctgtggcggagaaacgggagcgagacacaactcaacaagttctacacaaagaagtgccgcgagctgtattactgtgttaaggatagcatggagagagcagcggctcgccagcagtctattaagcctggccctgaactaggtggagagttcccggtgcaggatttgaagaccggcgaaggcggtctcttacaggtgaccctcgaaggcatcaatctgaaattcatgcacaatcagttcctgaaactcaagaaatggtag

SEQ ID NO: 229633 - DNA, 4698 bp, Artificial Sequence
  Description of Artificial Sequence: Synthetic coding sequence
atggtccagaagaagaagttctgccccagattgttggactacctggtgatcgtcggcgcacgccatccgagtagcgacagcgtggcccagacacccgagctgttaaggaggtacccgcttgaggaccataccgagttccctctcccccctgatgtggtctttttctgtcagcctgaagggtgtctgagtgttaggcaaaggcgtatgagtcttagagacgacacatcctttgtttttaccctgactgacaaggatacaggggtaacacgctatggcatttgtgtgaatttttacaggagctttcagaagcggatctccaaggagaaaggagaaggtggcgctggtagccgcggtaaggaggggacccacgcaacatgcgctagtgaggaagggggaaccgagagctcggaaagcggctcctcactgcagccactctctgctgacagcaccccggacgtgaatcagtctccccgtggtaagcgacgggctaaggccggttccagaagtagaaattcaaccctgaccagcctgtgcgttctttctcattaccctttcttctccaccttcagagagtgtctgtataccttaaagcggcttgtggactgttgctccgagcggctgttgggcaagaaacttggaattccacgaggcgtgcagagggacacgatgtggagaatcttcaccggatctctgctagtggaagaaaaatcatctgccctacttcatgacctcagggagatcgaagcttggatctacaggctacttcggtctccagtacctgtgagtggacagaagagagtcgacatcgaggtacttcctcaggagctccagcctgccctgacatttgccttgcctgacccttcaagattcactctcgttgattttcctctgcatttgccgctcgaactgctgggtgtggacgcctgcctgcaggtgctgacatgcatcctgctggagcacaaggttgtgctccagtccagggattacaatgccctatccatgagcgttatggctttcgtggccatgatctatccccttgagtacatgtttcctgttatccctctgctgcctacttgcatggccagcgccgaacagcttcttttggcacccaccccatacatcataggtgtgccggctagcttcttcctctataagctggacttcaagatgccagatgatgtctggttggtcgacctcgactctaatcgggtcattgcacctacaaatgcggaggtcctcccgatactcccggaacccgaatcactagagttaaaaaagcatctgaagcaggcccttgcatccatgtctctcaacacccagccaattctgaacctcgagaaattccatgaaggtcaagaaattccactgctattgggcaggccttctaacgacttgcagagcacccctagcactgaatttaatcccctcatttacggcaatgatgtagactcagttgacgtggcaacacgagtggccatggtccgcttcttcaactccgcaaacgtcctccaagggtttcagatgcacactcgtaccctgagactattcccccgaccagttgtagcctttcaggcgggtagcttcctggctagcaggccacgccagaccccttttgcggagaaacttgcacggacccaggccgtggaatacttcggggagtggatcttaaacccaacaaactacgctttccaacggatccacaacaatatgttcgatccggctctgatcggcgacaagcctaagtggtacgctcaccagttacagccgatccactatagggtatatgacagtaacagccagttggccgaggcgcttagcgtgccacccgagagagacagcgactctgagcccacagacgactccgggtccgatagcatggattacgatgattcaagcagcagctatagcagcctcggcgatttcgtgtccgaaatgatgaagtgtgatataaatggggatacaccaaatgttgatccgctcactcacgcggcactcggcgatgcttccgaggtggaaatcgatgaactccaaaaccagaaagaagctgaagaaccaggccctgatagtgagaattcacaagagaatccaccactcagatcctcaagctcaacaacggcaagctcttcaccctccaccgtcattcacggagctaacagcgagcctgccgactctaccgaaatggatgataaagccgctgtgggggtgtctaaaccgctgccgtctgttcctccatctatcgggaagtctaatgtggaccggaggcaggcagagattggcgagggggctcagaaactgctgagacctaattctctgcggctggcatctgattccgatgccgaatctgacagtcgggctagctctcccaacagcacggtatccaacacaagcacagagggctttggaggtatcatgtcgtttgcaagctccttatatcgcaatcattccacaagctttagcctcagtaatttaacactccctactaaaggtgctagagagaaagctaccccctttccatctctgaaggtgtttggattgaataccctgatggaaatcgtcactgaggcgggacccggaagcggggaaggtaatagacgggcactagtggaccagaagtcctccgtgataaaacattcccctacagttaagagagagccaccttctcctcagggcaggagttctaacagcagcgaaaatcagcaattcttaaaggaagtcgtccatagtgtactagacggccagggcgtcggttggctgaatatgaagaaggtacggagattactggagtcagagcagctcagagtcttcgtccttagcaaactcaatcggatggtgcagagcgaggatgacgcccgtcaggacattatcccagacgtggagatctcaagaaaggtgtataaaggcatgttggatctgctgaaatgtactgtcctgtctctggagcagagctacgcccacgccggtctgggtggcatggctagcattttcggcctgctggaaattgcacaaacacactactatagcaaagagccagataagcgtaaaaggagccctacagagtcggtcaatacacctgtcgggaaagatcccggtctggctggccgaggagaccctaaggctatggcacagctgcgtgtgccccagcttggccctagggctccgagtgcgactggcaaaggaccgaaagaactagatacccgtagcctgaaagaagagaacttcatcgcctccatcggtcctgaagtgatcaaacctgtattcgacctcggcgagactgaagaaaaaaaatctcaaatttcagccgactctggcgtatctctcacctcaagtagccagcggacagatcaggactcagtgatcggcgtaagtcctgcagttatgatccggtcatcttcccaggactctgaagtatctaccgtcgtgagcaattctagcggtgaaacactcggagccgatagtgacttatcttccaatgcgggtgacggccctggtggagagggctctgtccacctcgcgtcttcccgcggaacactgtcggattctgagattgagaccaactcagccacctccactatcttcggcaaagcccattccctgaaaccctccataaaagaaaagctggctggcagcccaatccgcactagtgaagacgtgagccagcgagtatacctgtatgagggcttgctgggaaaagaaagaagcacactgtgggatcagatgcagttttgggaggacgctttcctggatgcggtgatgctggagcgggagggcatgggcatggatcaggggcctcaggagatgattgatcggtatttgagtcttggtgagcacgaccgcaaacgactcgaagatgatgaagatcgcctgctggctactttgttgcacaacctgatttcatacatgctcttgatgaaagtgaataagaatgacattcggaaaaaagtgcgcagattgatgggtaaatctcatatcggccttgtgtattcccagcagattaacgaggtgctggatcagctggcaaatcttaatggaagagacctgagtatctggtcatcaggttcccggcacatgaaaaagcaaacatttgttgtccacgctggtacggacactaacggcgatatttttttcatggaggtgtgcgacgattgcgtagtcctgcgaagcaatatcgggaccgtttacgaacgatggtggtatgaaaagctcattaacatgacttattgccccaaaaccaaggtgctgtgcttgtggaggcggaatggctcagaaacacagctaaacaagttctacaccaaaaaatgtcgggagttatactattgcgtgaaggacagcatggagagagccgctgctcgccagcagtccattaaacccggacctgagcttggaggagagtttcctgtccaggacctcaagaccggagaaggaggactgctgcaagtaacactggagggaataaacttgaagttcatgcacaatcaggtttttattgagctcaatcacatcaaaaagtgcaacactgtgcgcggagtcttcgtcctcgaggagtttgttcctgaaattaaagaagtggtgtcgcacaaatataagacccctatggcacacgagatctgctacagtgtcctatgcctcttttcctacgtggccgctgtacacagctctgaagaagatttaaggacaccacctcgccctgtttccagctag

SEQ ID NO: 229634 - DNA, 588 bp, Artificial Sequence
  Description of Artificial Sequence: Synthetic coding sequence
atgggaagtcagtcatcaaaggccccaaggggggacgtgacagccgaagaggctgccggtgcatcgccggctaaagctaacgggcaggaaaacggccatgtcaaatctaatggggatctttctccgaagggtgaaggtgaaagtccacctgttaacgggactgatgaggcagcaggtgcgaccggggatgcaattgagcccgctccccctagtcagggagctgaggccaagggggaggtgccaccaaaggagacaccgaagaagaaaaaaaaattctcattcaaaaagccttttaagctctcgggcctgagtttcaaacggaaccgaaaagaaggcggtggagacagttccgcttccagccccactgaagaggagcaggaacaaggagagataggcgcatgtagcgatgaggggacggcccaggaaggcaaagccgcagcaacacccgagtcacaagagccgcaggccaagggagcagaagcttcagccgcaagtgaagaagaggcagggcctcaggctaccgaaccatccaccccctctgggccagagtctggccctaccccggcttctgccgagcaaaatgaatag

SEQ ID NO: 229635 - DNA, 1377 bp, Artificial Sequence
  Description of Artificial Sequence: Synthetic coding sequence
atgtccaacgatggcagatctcgcaatagagacaggcggtatgacgaagtgccttccgatctgccttaccaagataccacaatcagaacacaccccacattgcacgatagtgaaagggcggtatctgccgatcctttgccgcctccccctctgcccctccagcccccatttggcccagacttttatagttctgacactgaggagccagctattgctcccgacctgaagcccgtgcgaagatttgtgcctgattcttggaagaatttctttcgcggaaagaagaaagatcccgagtgggacaagcccgtgtctgatattcggtatatcagcgatggagttgagtgtagcccccctgcttctcccgcacgaccgaaccaccgatcaccgctgaactcctgtaaggatccttacgggggaagcgagggaactttctctagccgcaaggaagccgacgcagtctttcccagagacccgtatggaagtctggataggcacacgcaaacggtaagaacatactctgaaaaggtcgaagaatataaccttagatattcctatatgaaatcttgggcagggctcttgcgaatcctcggcgtagtggagttacttcttggggctggcgtctttgcctgtgtcaccgcctacattcacaaggactccgagtggtacaacctgttcggctactcacagccttatgggatgggaggggtggggggactggggagcatgtacggcggatactactacaccgggccaaagacccccttcgtactggttgttgcaggccttgcttggatcacaacaatcattatcctcgttcttgggatgtctatgtactaccggactattcttctcgacagtaactggtggccactgactgagttcggtataaatgttgccctctttattctgtacatggccgctgccatagtctacgtcaatgatacaaacagaggcggtttatgttactacccccttttcaacaccccagtaaatgcggtcttctgccgggttgaggggggacaaatcgccgctatgatattcttattcgtgaccatgattgtctacctgatctcagccctggtgtgtctcaaattgtggaggcatgaagccgcacgcaggcacagggagtacatggaacagcaggaaatcaatgaacctagtctgtcctctaaacggaagatgtgcgagatggccactagcggggacagacagcgggactctgaagttaactttaaggaattgaggacagccaagatgaaacccgagctcttgtctggccatatcccccctcctcgccctgcaaactttttcgtcttcctcgttgagatgggctttcaccgcgtgagccaggacgatttggaccttctgacttcgtag

SEQ ID NO: 229636 - DNA, 1677 bp, Artificial Sequence
  Description of Artificial Sequence: Synthetic coding sequence
atgtctaacgacggacggtctcggaaccgcgaccggagatatgacgaggtgccttcagatctgccttatcaggacaccacaattcgtactcaccctaccctgcatgactctgaacgcgctgtttccgccgacccactccctccacctcccctgccattgcagcccccattcggtccagacttttactcctctgacaccgaagagcccgctattgcacccgatctgaagcccgtgaggagatttgtgccagactcatggaaaaactttttccgcggaaagaaaaaggatcccgaatgggacaaaccagtcagtgatattagatacatctcggacggcgtggaatgttctccgccagctagtccggctaggccgaatcaccgctccccattaaactcatgcaaggacccctatggcggaagcgaaggcactttctccagtaggaaggaagcagacgcagtctttccacgagacccttatgggtccttggatcgccacactcagaccgttaggacgtattctgagaaggtggaggagtataacctgcgctactcttatatgaagtcgtgggctgggctcctgcgtattcttggggttgtggagctgttgctgggagctggggtgtttgcttgtgttacagcctatatccacaaagacagcgaatggtacaatctgttcggctatagtcagccctatgggatggggggagtagggggtttgggcagtatgtacggaggctattactatacagggcctaaaactccatttgtgttagtagtagccggactggcctggattactacaatcataattctggtcctgggtatgtccatgtattacagaacgatcttgctagatagtaattggtggcccttgaccgaattcggcatcaatgtagcactgttcatcttgtatatggccgcagctatagtctatgtgaacgataccaaccgagggggattgtgttattatcccctcttcaacactcccgtcaacgctgtgttttgccgagtggaaggcggacagattgccgcaatgatctttttgtttgtcactatgatcgtatacttgatcagcgcgcttgtgtgcctgaaactgtggcggcatgaggcagctaggcgccacagggaatacatggaacagcaggagatcaacgagccttcgctctcatcaaagaggaaaatgtgcgagatggctacctccggggatcgacagagagactcagaggttaatttcaaggaactgcggaccgcgaaaatgaagccagagctcctttcaggccacatcccgccagggcatatccctaagcctattgttatgcctgactacgtcgcaaagtacccagttattcagaccgacgatgagcgcgagcggtacaaggctgtgttccaagatcagttcagcgaatacaaggaactctcggctgaagtgcaggctgtgttgagaaagttcgatgagctggatgccgtaatgtcccgcctcccacaccacagtgaatccaggcaggagcacgaacgcattagtcgcatccatgaggagttcaagaagaaaaaaaatgatccgacattcctcgaaaagaaagagaggtgcgattatctgaaaaataaactctcgcacataaagcagcgtatccaagaatatgataaggtgatgaactgggacgtgcaagggtatagctag

SEQ ID NO: 229637 - DNA, 1329 bp, Artificial Sequence
  Description of Artificial Sequence: Synthetic coding sequence
atgtcaaatgacggcagatctagaaatcgagatcggcgatatgatgaggtaccgtctgacttgccctatcaagacactactatccgaacccatccaactctgcacgacagcgagagggcagtgtctgcagatccgctgcctcctcctccactgccactgcaacccccattcggaccagatttctattcaagtgatacagaagaacctgctattgcacctgatttgaagccagtgcgacgattcgtaccggactcctggaagaacttttttagaggcaaaaagaaagacccggagtgggataagcctgtgtccgacatccgctacattagcgatggggtagagtgcagccctcccgcttcacctgctaggcccaatcatagaagcccacttaactcttgcaaggatccttacggcggatccgaaggcacctttagctctagaaaggaagctgatgctgtgtttcctcgagacccctatggatctttggatcgccatacacaaacagtcaggacttactctgaaaaggtggaggaatataacctgagatactcatacatgaagtcctgggccggactcctgcgaatactgggggttgtggagcttcttttgggggcaggggtgtttgcatgcgtgactgcatatatccacaaagattcagagtggtataacctgttcggatacagtcagccttatggaatgggcggagtgggcggacttggctccatcgctttggtttgtctcaaactctggaggcacgaggctgcaagacgccacagagaatatatggagcaacaggaaattaatgaaccaagcctcagctcgaagagaaagatgtgcgagatggccacctcgggagaccggcagagggattctgaagtgaattttaaggaattgcgaactgccaaaatgaagcccgagttgctcagcggccacattccacctggtcacattccaaagcccattgttatgcctgattatgtggcgaaataccccgtgatccaaacagacgatgagagggagaggtataaggcagtttttcaggaccaattttccgagtataaggagctgtccgctgaggtccaagcagtcttgagaaagttcgacgagttagacgcagtgatgagcagattgccccaccacagtgaatcgagacaagagcatgaacgcatctctcggatccacgaggagttcaaaaagaaaaagaatgacccaactttcctcgaaaagaaagagcgctgcgactacctcaagaataagttgtctcacatcaagcagcgaatccaggaatatgacaaggtcatgaattgggacgtgcaggggtacagctag

SEQ ID NO: 229638 - DNA, 1641 bp, Artificial Sequence
  Description of Artificial Sequence: Synthetic coding sequence
atgtccaatgatgggaggagcaggaatcgggatcgcaggtacgatgaggtacctagtgatctcccttaccaggatactaccatcagaacgcatcccacactgcacgattccgagcgcgctgtctccgcggaccctctcccccctccacctctccccttgcagcctccgtttggcccagacttctatagcagcgacaccgaagaacctgctatcgctcccgacctcaagcctgtccgccgatttgttccggactcatggaagaactttttccgcggaaagaaaaaggaccccgagtgggataaaccagtgagtgatatccggtatatatcggacggcgtggagtgcagtccaccagccagccccgcacgaccaaaccacagatcgcccctgaatagctgtaaagacccttacggcggatcggagggaaccttctctagcaggaaggaagcagacgccgtctttccccgagacccttatggatcccttgatagacatactcaaaccgttagaacttactcagagaaggtggaggaatataacctgcgatacagttatatgaagtcttgggccggactcctgcgaatcctgggagtcgttgaattgttactcggggctggagtctttgcatgcgtgactgcctacatccataaagacagcgaatggtacaacctgttcggctactcacagccttatgggatgggcggagtaggaggattgggctccatgtacggcggatactactacaccggaccgaagactccctttgttctggtggtcgccggactggcctggataaccactatcattatcctggtgctggggatgagcatgtactatcgcacaattctgctggacagcaattggtggcccctgacagagttcgggatcaacgtggccctattcatcctgtacatggctgcagctattgtgtacgtgaacgatactaaccggggtggcctgtgttattacccactctttaacacccccgtgaatgccgtgttctgccgggtcgaagggggacaaatcgcagcaatgatctttctgttcgtgaccatgattgtgtacctcatatctgcccttgtctgcctgaagttgtggcgccacgaggcggctagaaggcaccgagaatatatggagcagcaggaatgcgaaatggcaaccagtggtgacaggcaaagggatagcgaggtcaacttcaaagaactacgtactgcaaaaatgaaacctgaattgctgtctgggcacataccacccggtcatatcccgaaacccattgtgatgccagactatgtcgcaaaatatccagtgattcagaccgacgatgaaagggagcgatacaaagcagtctttcaggaccagttcagcgaatacaaggagttgagcgccgaggtccaggccgttctgagaaagtttgatgaactcgacgccgtcatgtcaaggctgcctcaccactcagagtctaggcaggagcacgagcgcattagccgtatccacgaagagtttaaaaagaaaaagaacgaccctacttttctcgagaaaaaggaaaggtgtgactacctgaagaataagctgtctcatatcaagcagcggatccaggagtacgataaagtgatgaattgggatgtccaggggtacagttag

SEQ ID NO: 229639 - DNA, 1551 bp, Artificial Sequence
  Description of Artificial Sequence: Synthetic coding sequence
atgagtaacgatgggagatcgagaaaccgggataggcgatacgacgaggtgccctctgatctgccctatcaggatacaaccataagaacccatcccacgctccacgactccgagagagcagtctctgcagatcctcttccccctcctcctctgcctctccaaccaccctttgggcctgacttctattcaagcgatacagaggaacccgcaatcgcacccgatcttaagcccgtgagaaggtttgtacccgattcctggaagaatttcttcaggggtaaaaaaaaggaccctgagtgggacaagcccgtgagtgatattagatacatatctgatggggttgagtgcagcccccctgcatctccggcacgccctaatcatcgcagccccttgaattcctgcaaggacccatacgggggttccgaagggacgttttctagccgcaaggaagccgacgctgtctttccacgggacccctacggaagtctcgacagacacacgcagaccgtaagaacctattctgagaaagtcgaagagtataatctccgctattcatacatgaagagctgggctggactgctgcggatactaggcgtggtagagcttctcctgggggcaggggtgttcgcttgcgtgactgcctacattcacaaggactctgaatggtacaacctgtttggctactcacagccctacggaatgggaggagtaggaggcctcggtagcatgtatgggggatattactacactggcccaaagactccctttgttctggtggtcgcgggactggcctggattaccacaataatcatacttgtccttggaatgtcaatgtactaccgcacaattctcctagatagtaactggtggcccctcactgagtttggcattaacgtggccctcttcatcctgtacatggctgcggctattgtgtacgtgaacgacactaatcgcggtggcttgtgttactaccctctcttcaatactccagtgaatgcagtcttttgtcgggtggaaggcggtcaaatagcagccatgattttcctgtttgtcactatgatcgtctatttgataagtgccctggtgtgccttaaattgtggcggcatgaagccgctcgaaggcaccgggagtacatggagcagcaggagatcaatgaaccttccctctcctccaaaaggaagatgtgcgagatggccacatctggcgatcgtcagcgggattcagaagtgaatttcaaggagctcagaaccgccaagatgaagccggagctgctgagtggccacataccacccggtcacattcctaaaccaatagtgatgcccgactacgtggcaaaatacccagtgattcagactgatgacgaaagagaacgatataaagccgtctttcaggatcagttttccgagtacaaagagctgagcgctgaggttcaggctgtgctgcggaaatttgacgaactggacgcagtcatgagtaggttgccacaccattctgaaagcaggcaggagcacgagagaattagtaggatccatgaggaattcaagaaaaagtag

SEQ ID NO: 229640 - DNA, 438 bp, Artificial Sequence
  Description of Artificial Sequence: Synthetic coding sequence
atgtctaacgacggcagaagcagaaatcgcgaccgccgatacgatgaagtgccatcagacctgccttatcaggatacgacaattaggactcatcctacattgcacgactcggaacgtgccgtaagcgcggatccattaccgcctccgccactgccgttgcaacctccatttggccctgatttctatagtagcgataccgaggaaccagcaattgcgccagatttaaagcctgttcgtcggtttgtccctgactcctggaagaacttcttcagggggaaaaagaaggatcccgaatgggacaagcccgtatctgatatcagatacataagcgatggcgttgaatgttctccccctgcaagtcccgctcgcccaaaccaccggagcccactgaatagctgcaaagatccatatggcggaagcgaagggacatttagttag

SEQ ID NO: 229641 - DNA, 1206 bp, Artificial Sequence
  Description of Artificial Sequence: Synthetic coding sequence
atggaagacccctcaggcgcaagagagcccagggctcgacccagggaaagggaccctggtcgccgtccccatccggaccagggcaggactcatgaccgtcccagagatagacctggggaccccaggagaaaacggagctcagacggcaaccgacgacgcgatggcgatagggatcccgagagagaccaggagcgggatggcaacagggatagaaatcgagacagggagcgggagagagaaagagaacgggacccagacaggggaccaaggagagatacacaccgggacgctgggccacgcgcaggggaacatggggtgtgggaaaagcccagacagagccggacacgagatggagcacggggactgacttgggatgccgctgcacctcctggccctgccccttgggaagcccctgagccaccgcagccacagcgaaaaggtgaccctggtagacgaaggccagaatctgaaccgccttcggagcggtatctcccaagcacaccgagacccggaagggaggaagtggagtactaccagtcggaagctgagggactcctagagtgtcacaaatgtaagtacctttgcacaggacgagcctgttgtcagatgttggaagtgctactgaacctgctgattttggcatgctcttccgtgtcctattcaagcaccgggggatacacgggcattacttcattagggggaatttattactatcagtttggaggcgcttattctgggtttgacggcgcagatggagagaaggcacagcagctggacgtgcagttctaccagctcaagctccccatggtcacagtcgcaatggcatgtagtggcgcacttactgcactgtgttgtttgtttgtggctatgggtgtgcttcgcgtgccctggcattgccccctgctcttagtcaccgaagggttgcttgacatgttgatagcgggtgggtatatccctgcactgtacttttatttccattatctcagtgctgcatacggatcgcctgtatgtaaggagaggcaggctctttatcagagtaagggatactctggatttggttgtagctttcacggcgcagatattggggctgggatctttgcagctcttgggatagtggtgtttgccttaggagctgtgctggccattaaaggttaccgcaaggtcaggaaactgaaagagaagccagcagagatgttcgagttctag

SEQ ID NO: 229642 - DNA, 1233 bp, Artificial Sequence
  Description of Artificial Sequence: Synthetic coding sequence
atggaagatccctctggggcacgagagccaagagccagacctcgcgagagggatcccggtaggcgccctcaccctgatcaggggagaacacacgaccggcctcgtgataggccaggagaccctcgccgaaagagatctagcgatggtaaccgtcgaagggatggtgatagggatcctgagagggatcaggagcgggacggtaacagggacaggaatagagacagggagagagaacgggaacgggagagagatcctgatcgcggtcctaggagagatacacatcgcgatgcaggtcccagagctggggagcatggcgtgtgggaaaaacctcggcaatcacgtacaagagacggtgcccgaggcctgacatgggacgcagcggcaccccctgggccagctccctgggaagctcccgagccgcctcagccccagcgtaagggcgatcccggtcgacggaggccggagtcagaaccaccgagcgaaaggtacttgccttctacccctcggccagggagggaggaggtggagtattaccaaagcgaggccgaaggcttactggagtgtcacaaatgcaagtacttatgtacaggtcgcggtgtcgtgcaaattgttgaggttgtcctcaacggtatggtgctgatctgtattgtggcctcctacttcgtccttgccggttttagtgcttccttttcatcaggcggagggtttggcaacaattactactcaccgtttgaggggactgagctagagcaggtccggcagctggaccaacagtataccatcctgcgaagcccgctcatatatgggggtgtggctgtgtcgctggggcttggggtgctgaccatgggcgtcttacttcaaggcgctaagagcaggaccatgctgtccggaaaatggttactgacagaagcagcgttcagccttttggcagcggtgggttactgcacagggatcggcgtttacctgcacgtggcacttcaaatcaactctacagacacttgcaagactcgggagcgactgtatgcaaggaaagggctgacatggatggattgtcagctggcaggaacggatggggcagctgctactttcgcttgcctcttggtaattatgtatggcgctagcgtcgtgctggccctgcgaagctatcgcgaacagaaacgctataaggggagccgtgagcagcccggatcatacagtgatgcacccgagtatctttggagtggcactctatag

SEQ ID NO: 229643 - DNA, 978 bp, Artificial Sequence
  Description of Artificial Sequence: Synthetic coding sequence
atggatgggtccaacgtcaccagtttcgtggtggaggagcctacaaatatttctactgggaggaacgcatctgttggtaatgcccaccgccagattccaattgtgcactgggtgattatgtctatttcccccgtgggattcgtggaaaatgggatccttctatggttcctctgcttccgaatgaggcggaaccccttcaccgtgtatatcacccatctatcgatcgcagatatatccttgctcttctgcatatttatcctcagcatagattacgccttggattacgaactctcatccggccactattacacaatcgtaactctgtccgtgacgttcctctttggctacaacacgggtttatatctccttaccgccatatccgttgaaagatgtctgagcgtcctttacccgatctggtaccgttgccatagacctaaatatcagagtgccctggtttgtgctctgctgtgggccctcagctgtttggtcacgaccatggagtacgtgatgtgtatagaccgtgaggaggaaagccacagtcgcaatgactgcagagccgtgattatcttcattgctattctctcttttctcgttttcacccccctcatgctggtgtcttccacaatcctggtggtgaagatacgaaaaaatacatgggcctctcactccagcaaactgtacattgtcatcatggtgacaatcattattttccttatcttcgccatgcccatgagactcctctacctcctatattatgagtactggtcgacattcggtaatttgcatcacattagcttgcttttcagtaccattaattctagcgccaatcctttcatctatttttttgtgggcagctctaaaaaaaaaagatttaaggaaagcctcaaagtagtgttgacccgggcttttaaagacgaaatgcaacccagacgccagaaagacaattgcaatactgtcaccgtggagacagtcgtctag

SEQ ID NO: 229644 - DNA, 1137 bp, Artificial Sequence
  Description of Artificial Sequence: Synthetic coding sequence
atggtgtggggaaaaatatgctggttttcccagcgagctgggtggactgtattcgccgagagccagatcagcttgtcctgtagcctctgtctgcactcaggtgatcaagaggctcagaatccaaacttggtgtcacaactttgtggcgtgtttttacagaatgagaccaatgaaaccattcatatgcagatgtccatggcagtgggccagcaggccctccccctcaatatcatcgcccctaaggccgtgttagtgagcctgtgcggggtactgcttaatggcaccgttttttggctcctgtgctgtggtgccacaaatccgtacatggtttacattctgcacctggtggctgccgatgttatttatctgtgctgcagcgcggtgggcttcttgcaagttacgctgctaacttaccacggcgtcgtcttcttcatcccagacttcctggcgatcctctccccatttagcttcgaggtatgcctctgtctgctcgtcgcaatctcgacagagcgctgcgtgtgtgttctcttccccatatggtatcggtgccatcggcctaaatacacgtccaatgtggtgtgtacactgatttggggtctacccttttgtatcaatatcgtgaagtctctcttcttaacatattggaaacacgtaaaagcttgcgttattttcctgaagctgtctggcctcttccatgccatcctgagcctcgtcatgtgtgtgagctcactgactctcctaatccgatttctgtgctgcagtcaacaacaaaaagctacccgtgtgtacgcggtggtgcagataagcgcaccaatgtttctgctgtgggccttgcctctgtcagttgccccactcatcacagatttcaaaatgtttgtgaccactagttacctgataagccttttcctcattatcaattcatccgctaacccaatcatttactttttcgttgggagcttgcggaagaagaggctgaaggaaagcctcagggtcattctccagagagccctggcagataagccagaggtcggaagaaacaagaaagctgccggaattgaccccatggaacagccccactccacccagcatgtggagaatctgttgccccgagaacacagagttgacgtggagacctag

SEQ ID NO: 229645 - DNA, 1137 bp, Artificial Sequence
  Description of Artificial Sequence: Synthetic coding sequence
atggtgtggggcaaaatctgctggttctcacagagagcaggatggactgtgtttgcagagtcccagatttctctgtcctgcagcctttgtcttcactccggcgaccaagaggcgcagaacccaaatctggtgagccagctgtgcggcgtctttttgcagaatgaaacaaacgaaacaattcatatgcaaatgagcatggccgttggacagcaggcccttcccctaaatatcattgctcctaaagctgtgttagtgtccctttgcggcgtgttgcttaacggaacggtcttctggctgttgtgttgtggtgctacaaatccatacatggtgtatattctgcaccttgttgccgcagacgtcatttacttgtgttgtagtgccgtagggtttctgcaagtcacactgctgacctatcacggagtcgtgttctttatacctgatttcctcgcgatactgagtcctttctctttcgaggtgtgtctttgtctgctcgtcgcgatcagtactgaaaggtgcgtgtgtgtgctgtttccaatttggtacagatgtcaccggccaaaatacacttctaatgtcgtttgcaccttgatttggggtctgccgttttgcataaacattgttaagtccctgtttctcacctattggaagcatgtgaaagcttgcgtcattttccttaagctctctggcttgtttcacgcgatactgagcttggttatgtgcgtgagctcactgaccctcctgatcaggttcttgtgttgcagtcagcaacaaaaagcaacccgagtttatgctgtagtgcagatttccgcccctatgttcctgctctgggctttgccactaagtgtggcacctctgatcacagactttaagatgtttgtgactacttcctatctaatcagcctgtttctgattatcaacagcagcgccaatcccattatttatttttttgtcggcagtttgcgcaaaaagcggttgaaggagtccttgcgcgtgatattacagcgcgcacttgctgataaacctgaagtggggaggaataagaaagctgcaggcatcgatccaatggagcagcctcattctacacagcacgtcgaaaacttgttacctagggagcatcgcgtcgatgttgagacttag

SEQ ID NO: 229646 - DNA, 1137 bp, Artificial Sequence
  Description of Artificial Sequence: Synthetic coding sequence
atggtgtgggggaaaatctgctggttttcacagagggccggatggacagtgttcgccgaatctcagatttcactcagttgctccctgtgcctccacagtggcgatcaagaagcacagaatcccaacctggtatctcagttgtgtggggtgttccttcagaatgagactaacgaaaccatccacatgcaaatgagcatggctgtggggcagcaagctcttcccttgaacatcattgcaccaaaagccgtgctggtcagcttatgcggcgtcctcttgaatggcaccgtgttctggctcctgtgttgcggtgccacaaacccttatatggtgtatatcctgcatctggtagccgctgacgtcatttatttgtgctgtagcgcagtgggcttcctgcaggtgacgctgctcacataccacggtgtggtgttttttatcccagattttttggccatcctctcaccttttagcttcgaggtgtgtctctgccttcttgtggctatctcaaccgagaggtgcgtgtgtgtgctgtttccaatatggtatcggtgtcatcgtccgaaatacacaagcaacgttgtctgtactctcatctggggattgcctttctgcattaacatcgtaaagagcctgttcctgacttactggaagcatgttaaggcatgcgtcatcttcctaaaattaagtggcctgttccatgccattctgtcgttagtaatgtgtgtcagtagtctgacactcctcatacgattcctctgctgtagtcagcagcaaaaggcaaccagagtgtatgccgtggtacagatatccgcgccaatgtttttattgtgggccctgccattgtctgtcgcgcctctgattacggactttaagatgttcgttaccacaagctacctgatcagtctgtttctgataattaattcgagcgccaaccccataatatatttctttgtcggctctcttcgaaaaaaaagactgaaagagtccttaagggtaatcctccagagggctctcgccgataaaccagaggtaggtcgaaacaaaaaggctgctggcatagaccccatggaacagccacactctacccagcacgtggagaacttgctcccgcgtgaacaccgggtggacgtggaaacatag

SEQ ID NO: 229647 - DNA, 1137 bp, Artificial Sequence
  Description of Artificial Sequence: Synthetic coding sequence
atggtgtggggcaaaatttgctggttcagtcagcgagccggatggaccgtcttcgccgaatcccagataagcctctcttgttcactttgcttacacagtggggaccaggaggcacagaaccctaacctggtatctcagctgtgcggggtgttcctacaaaacgagacaaacgaaacaattcacatgcagatgagcatggccgtggggcaacaggcccttcctctgaacataattgccccaaaggccgtgttggtgtcattgtgcggtgtgcttctcaacggcacagtcttttggctcttatgctgtggcgcaaccaacccatatatggtctacatactgcacctggtggccgctgacgtgatctatctttgttgcagcgctgttggtttcctgcaagtgacgctgctcacctaccatggggtggtattcttcatcccggattttctcgctatcttgtcccccttttcgtttgaggtctgtctgtgtctgttggtggctatctctactgagcggtgtgtctgcgtcctgtttcccatctggtacagatgccatcgacccaagtatacgagtaacgttgtgtgcactctgatttgggggttgccattttgcatcaacattgtaaaaagtctttttttgacatactggaaacacgtcaaggcttgtgtcatattcttaaaactgtcggggctgttccatgccatcctgtcacttgtaatgtgtgtgagttcattgaccttgctgatccgctttctgtgctgctcacagcagcagaaggcgaccagggtttacgccgttgtgcaaatcagcgcacccatgtttctactttgggccctgcctttaagtgtagctccactgatcacggactttaagatgtttgtgaccacctcatacctgatttccttattcttgataatcaacagttcggctaaccccatcatttactttttcgttggatctctgcgtaaaaaacggctcaaagagtcactgagggtaatcttgcaaagagcgcttgccgataagcccgaggtcgggcgaaacaaaaaggcagcagggatcgatccaatggagcagcctcactcgacacagcacgtagaaaatctcctccctcgagagcaccgcgtcgatgttgaaacatag

SEQ ID NO: 229648 - DNA, 1137 bp, Artificial Sequence
  Description of Artificial Sequence: Synthetic coding sequence
atggtatggggaaagatctgttggttctctcagagggccggatggaccgtattcgctgagtcacagatctccttgtcttgctccttgtgcctgcactccggcgatcaggaagcacagaatccgaacctggtgagtcagttgtgcggcgtttttctgcagaatgaaaccaacgagacgatccacatgcagatgtctatggcagtgggtcaacaggccctacctttaaacatcatcgccccaaaggctgtgctcgtgtcgttgtgcggggtgctgcttaatggtactgtgttctggctgttgtgttgcggcgcaactaacccatatatggtttacatcctgcacctggtggcagccgatgtgatttacctgtgttgtagtgctgttggatttcttcaagtcaccctgctcacgtaccatggtgtggtctttttcattcctgacttcctggcaatcctgagcccttttagcttcgaggtttgtctgtgcctcttggtagccatttcaacagagagatgtgtgtgtgtgctgttccctatatggtaccggtgtcaccgcccaaagtacacgagcaacgtcgtgtgcaccttgatctggggattgcctttctgtattaatattgtgaaatcgctctttctcacatattggaagcacgtcaaggcttgcgtgatctttctcaaactcagcgggttgtttcacgctatcctgtccttagtaatgtgcgtaagctctttaacattacttattcggttcctgtgctgctcccaacagcagaaggccacacgcgtttatgcagtggtccagatcagcgcacctatgttcctgctctgggctcttcctctgtcagttgcccctctaattacagactttaaaatgttcgtcacaactagctatctcatcagcctcttcctgatcataaattccagtgccaacccaatcatctacttcttcgtgggatcgcttcgcaagaagcggctcaaggaaagccttagggtgattctgcaaagagcattggccgataaacccgaggtcggcagaaacaagaaagccgcaggcatcgatcccatggagcaaccccattctacacagcacgtggaaaacctgttgcccagagagcatagagtggacgtcgagacttag

SEQ ID NO: 229649 - DNA, 1137 bp, Artificial Sequence
  Description of Artificial Sequence: Synthetic coding sequence
atggtgtggggcaagatctgttggttctcacagcgggctggatggaccgtgttcgcagagtcgcagattagtctgtcctgtagcctctgcttgcatagtggggaccaggaggctcaaaatcctaacctggtgtcccaactgtgtggcgttttcctgcaaaatgaaactaacgagacaattcacatgcagatgtcaatggccgtgggacaacaggcgctgccactgaatattatcgcccctaaggccgtcttagtaagcttgtgcggagtgctcttaaacgggaccgtgttttggctcctctgttgtggcgcaacaaatccttatatggtgtacattctccacctagtggccgctgatgtcatctacctgtgctgcagtgctgtggggttcttacaggtaactttgcttacttatcacggagtagtattttttattcccgacttcttggccatcctcagccctttcagtttcgaggtctgtctgtgtctgctggttgccatatctaccgagcgatgcgtctgtgtcctgtttcccatatggtaccgatgccacaggcccaaatacacatcgaacgtggtctgtaccttaatctggggcttgcctttctgcattaacatagtgaagtctctgttcctcacctactggaagcacgtgaaagcttgcgtaatttttctgaagctgtccggattgttccatgccatcctcagcctggtgatgtgcgtgtcctcgctaacactgctgattaggttcctatgttgcagccagcaacaaaaggctaccagagtctatgccgtggtgcagatatccgcccctatgttcctgctgtgggccttgcctctctcagttgcccctcttataacagactttaagatgtttgttacaacctcatacctaatctctctttttctaatcatcaactcctcagccaaccctatcatatacttcttcgtcggctctctccgaaagaaaagactgaaggagtccctccgagtgatcctccagcgcgcactggcagacaagccagaagtgggaaggaacaagaaggcagccggaattgacccgatggagcagccccactctacgcagcacgtcgaaaacctcctgcccagggaacacagggtagatgtggaaacctag

SEQ ID NO: 229650 - DNA, 1137 bp, Artificial Sequence
  Description of Artificial Sequence: Synthetic coding sequence
atggtctggggtaagatctgctggttcagccagcgagccggatggactgtgtttgctgagtcccagataagtctgtcctgctccctctgcctccattcaggcgaccaggaggctcagaaccctaatctcgtttctcaactatgtggagttttcctacaaaacgagacaaacgaaacaatccacatgcagatgtcaatggctgtaggacagcaggctctgccactgaatataatcgctccgaaagccgttctggtaagcctgtgcggcgtgcttcttaacggcacagtgttttggctgctttgttgtggcgctacaaacccctacatggtttatattctacatctcgtggccgctgacgttatctatctgtgctgttccgccgtgggcttcttgcaagtgacgttattgacgtaccatggtgtggtcttttttatacctgatttcctcgcgatcctgtcccctttttcattcgaggtttgtctatgtctactggtcgcaatcagtaccgaacggtgcgtttgtgtactgttcccaatctggtataggtgtcacaggccaaaatacacatccaatgtggtatgcacccttatctggggactgcctttctgcattaatatcgtgaagtccttatttctcacttattggaagcatgttaaagcctgtgtgatttttcttaaactgtctggcctatttcacgccattctgagcctcgtgatgtgtgtctcttcacttacactactgattaggttcctgtgttgtagtcagcagcagaaggccacgcgggtttacgccgtagtgcagatatcggcccctatgtttctcctgtgggcgttgcctttatcggtagctcctcttatcaccgactttaagatgtttgtgacaacgtcgtatttgatctccttatttcttataatcaattcttccgctaatcctatcatctacttcttcgttggatccctccgcaagaagcgtcttaaagagtcactgagagttatcctgcaacgtgctttggccgacaagccggaggtgggaaggaacaagaaagcggcagggatagaccctatggagcagccccactcaacccagcacgttgagaacctcctgcctagggagcaccgagtggatgttgagacttag

SEQ ID NO: 229651 - DNA, 1137 bp, Artificial Sequence
  Description of Artificial Sequence: Synthetic coding sequence
atggtttgggggaagatctgctggttctcgcaacgagcgggttggactgttttcgcagaaagtcagatcagtctgagctgttctctgtgcctgcattccggggaccaagaggcccagaacccaaacttggtgagccagctctgcggtgttttcctccaaaacgagacaaacgaaaccattcacatgcagatgtcaatggctgttggccaacaggctctccctctgaacatcatagccccaaaggctgtgcttgtgagtttatgcggtgtactgttaaatggcaccgtgttctggctgctgtgctgcggagctactaacccatatatggtttatatcctgcacttagtggcagccgatgtgatctatctatgttgttctgcagtcgggttcctacaggttaccctgctaacatatcatggggtggtgtttttcattcctgactttctagcaatattatcgcctttcagctttgaagtctgtctgtgtcttctggtggcaatttccactgagcgctgcgtttgcgtgttgtttcctatatggtatagatgtcaccggccaaagtacacctctaacgtagtttgcactttgatttggggcctgccattctgtatcaatattgtgaagtccttatttttaacatactggaaacacgttaaagcctgtgtgattttcctaaagctttcggggctctttcacgcaatactgtctctcgtaatgtgcgtcagttctctcacactgttaattcggttcctctgctgctcacaacaacagaaagctaccagagtatatgctgtagtgcagatctcagctcccatgttcttgttgtgggccttgccactgtcagtagctcccctgataaccgatttcaaaatgtttgtgacgacgagttatctcatctctctattcctgatcattaactcttctgctaatcctatcatctacttttttgtcggaagtctgcgcaaaaagaggctgaaggagagccttcgtgtcatactccaacgcgctctggctgacaagcctgaagtcggaagaaataagaaagccgctggtattgaccccatggagcagccccattcaacccagcatgttgagaatctattaccacgcgaacatcgggtagacgtcgaaacctag

SEQ ID NO: 229652 - DNA, 966 bp, Artificial Sequence
  Description of Artificial Sequence: Synthetic coding sequence
atgaaccaaaccttgaactcgtctggcaccgtcgagtccgcccttaactatagccgagggtccactgtccataccgcttatctcgtactatcctcactggcaatgtttacttgtttatgcggcatggcaggtaacagcatggttatatggttgttaggcttccggatgcatcgcaatccattttgcatttacatcttaaacttggccgctgctgatctgctgttcctgttcagcatggcgagtacactcagcctggagacccagccactggtcaacaccaccgataaagttcatgaactgatgaagagactaatgtactttgcttacacggtggggttgagtctattgactgccatctcaacgcagaggtgcctctccgtcctgttcccgatatggtttaagtgtcataggccgagacatctgtcggcctgggtttgcggattgctttggactctatgcttgttaatgaacggcttgacatcgtccttctgtagtaagttcttgaaatttaatgaggaccgctgcttcagagtagatatggtgcaggcagctctgataatgggagttttaacccccgtcatgactctttccagcctaaccctttttgtctgggttcggcgttcttcccagcaatggaggcgccagccaacaagactgtttgtggtcgttctcgcctctgtactggttttcttaatatgttctctcccgctgagcatctattggttcgttctctattggttatcattacctcccgaaatgcaggtcctgtgttttagcctcagccggctttcaagctctgtcagttcatctgccaatccggtgatatatttcctcgtgggatcgcggcgtagccatcggttgccgactagaagcctgggcacagtactgcagcaggctctgcgggaggagcccgaactagagggcggtgagaccccgactgttggcactaacgaaatgggggcatag

SEQ ID NO: 229653 - DNA, 936 bp, Artificial Sequence
  Description of Artificial Sequence: Synthetic coding sequence
atggaaccccgtgaagccggacagcacgtcggagcggctaacggggctcaagaagatgttgcttttaacttgattatcttgagtctcaccgaggggctcggcctgggaggactactgggcaacggggctgtgctatggctactcagctccaatgtttatcgcaacccctttgcaatttatttactggatgtcgcctgcgccgatttgatttttctaggatgccatatggtggccattgtgccagacctgctgcagggtagacttgactttccagggtttgtgcaaactagcctcgccacccttaggtttttctgttatattgtgggactgagcctgctcgctgcagtgtctgtcgagcagtgcctggcggcactgttccccgcatggtatagttgccgaaggcctcgtcaccttaccacttgtgtgtgcgcactcacctgggcgttgtgtttgcttctgcatctattgttgagtggcgcttgcacccagtttttcggagagccgagtcgccatttgtgccggacactgtggctcgtggcggcagtgttgttggcgctcctgtgttgcaccatgtgcggagcttcactcatgctgctgctgcgggtagagcggggaccccagagaccccctccgaggggctttcctggcttaatcctgttgaccgtactgctgtttctgttttgcggtctgccattcggcatttactggttgagtaggaatcttctatggtatataccccattacttctatcattttagctttttgatggctgccgtgcactgtgctgcgaaaccagtcgtttatttctgcctaggctctgcacagggacgtcgcctgccgctccgcctcgtgttgcaacgtgctctgggcgacgaggctgagttgggagctgtgagagagacaagtcggcgagggctcgttgacatcgccgcatag

SEQ ID NO: 229654 - DNA, 939 bp, Artificial Sequence
  Description of Artificial Sequence: Synthetic coding sequence
atgatggagcccagggaggccggtcagcatgtcggcgcagctaacggcgcacaggaggatgttgcctttaacttgattattcttagcttgaccgaaggcctgggtctgggtgggctgctgggcaacggggctgtactgtggctgctgagctcaaatgtctaccggaacccctttgcgatctacctcctggatgtcgcctgtgccgacctgatcttcttggggtgtcacatggtggccatcgtcccagacctgttgcagggcagattggactttccaggatttgtgcagacatctttggctacgctcaggtttttttgctacatcgtcgggctgagcctgttagcggcagtgagtgttgagcagtgcctcgcagcgctgttccccgcttggtacagctgtagacgacccaggcatcttacaacgtgcgtctgcgccctgacgtgggccctctgtttgctactgcatctgttgctgtctggagcatgtacacaattttttggcgaaccctctagacatttgtgccggaccctctggctcgtggccgcagttctgctggccctgctgtgctgcaccatgtgcggcgcaagtctgatgctactgctgcgagttgagagaggccctcaacggccaccacctcggggattccccggactgattctcctgacggtgctattgttcctgttttgtggattgcccttcggtatctactggctctcccgtaacctgctgtggtatataccacactatttctatcacttttccttcttgatggccgcagtacattgcgccgcaaagccagtggtgtacttctgcctgggatctgcccagggccgtcgtttgccattgcgtctggtgctacagagagctctgggtgatgaggctgagcttggtgcagtgcgcgaaacctctcggaggggactggtggacatcgccgcatag

SEQ ID NO: 229655 - DNA, 1032 bp, Artificial Sequence
  Description of Artificial Sequence: Synthetic coding sequence
atggccggaaactgctcttgggaagcccacccagggaatagaaacaaaatgtgtcccggactcagcgaggctcccgaactctactccagggggttcctgacaatagagcagatcgccatgttgcctccacctgcagtaatgaactacatctttctgctcctgtgcctgtgtggccttgtggggaatggtctcgtgctgtggtttttcggtttttcaatcaaacggaatcccttctcaatctattttttacatcttgccagcgccgacgttggctacctttttagcaaggcagtgttctccattctcaacaccggcggattcctcggcacttttgcagattacattcgctcggtttgccgtgtgctcggactatgcatgtttttaactggggtctccctgctgcctgcagtttctgctgaacggtgtgctagcgtgatatttccagcctggtactggcgccgtcggccaaagaggttgagcgcggtcgtctgcgccttgctatgggtactgtccctgttggtcacctgtcttcataactacttttgtgtcttcctggggaggggagcgcctggtgccgcatgtaggcacatggacattttcctgggcatcctgctgttcttgctttgttgccccctcatggtgctgccctgtttggccctcatactgcacgtggaatgtagagcccgaaggaggcagaggtcagctaaactcaaccacgtcattctggccatggtgtccgtctttctggtgtcctctatttacctaggcatagattggttcctcttttgggtgtttcagatccctgctcctttcccagagtacgtcaccgatttgtgcatatgtataaacagcagcgcaaagcctatcgtctacttcttggcaggacgcgacaagagccagcggctctgggagcccctccgagtggtctttcagcgggctctccgcgacggcgctgaactgggggaggctgggggttctaccccaaatacggtcaccatggagatgcagtgccccccaggcaacgccagttag

SEQ ID NO: 229656 - DNA, 948 bp, Artificial Sequence
  Description of Artificial Sequence: Synthetic coding sequence
atggccggaaactgctcatgggaagctcaccccggtaatagaaacaaaatgtgccccggtctctctgaggctcccgaactgtattcacggggtttcctcaccatcgagcaaatcgcaatgctgcctcctccagcagtgatgaactacattttcctgcttctatgtctgtgtggactggtggggaacggcctcgtgctgtggttttttggattttccatattaaacaccggtggcttcctagggacattcgcggattacatcaggtctgtgtgcagggttctgggtttgtgcatgtttctgactggcgtgtcacttctacccgctgtttctgctgaacggtgtgcctcagtgatctttcccgcatggtactggaggcggaggcccaagagactctcagccgtggtttgcgctctactgtgggtgctcagccttctcgtaacctgtctccacaactatttttgtgtcttccttgggaggggcgcacctggcgcagcttgccggcacatggatattttcctgggtatcctgctgtttttactgtgctgtcccttgatggtactcccctgcctggccctcattctgcatgttgaatgtcgcgcaagaagacgccagcggagcgctaaactcaaccatgtcatcctcgctatggtgtcggtgttcctggtcagctcgatctaccttggcattgattggtttttgttctgggtctttcagatccctgccccttttccggaatacgtgacagatttatgcatatgtatcaacagttccgctaagcctatagtctactttctggccggaagagataaatctcagcgactctgggagcctctgagagtggtgttccaacgagccctcagagatggcgctgagttgggcgaggctgggggatcaacacctaataccgtgactatggagatgcagtgcccaccagggaacgcaagttag

SEQ ID NO: 229657 - DNA, 1032 bp, Artificial Sequence
  Description of Artificial Sequence: Synthetic coding sequence
atggccggtaactgttcctgggaagctcatcccggtaataggaataaaatgtgtcccggactgtctgaggcacctgagctgtacagtcgtggtttccttacaattgaacagatcgccatgcttccaccccctgcagttatgaactacatattcctgttgctctgcctctgtgggcttgtgggaaacggtctggtcctctggtttttcggtttcagcatcaagcgaaacccattcagcatctacttcttgcacctcgcctctgccgacgtaggctacttattctcaaaggccgtctttagcattctcaatacagggggattcctgggaaccttcgctgattatatccgctctgtctgcagagttctaggcctgtgtatgtttctgactggcgtgtccctcttgccggctgtgtccgcagaacgctgcgcaagcgttatattccctgcgtggtactggcgccgaagacctaaacgattatccgctgttgtctgtgcactgctatgggtgctttcgctcctggtcacctgcctccataactatttctgtgtcttcctgggacggggagcacccggagctgcctgccgtcacatggacatcttcctcggcatcctgctttttttactgtgctgtcctttaatggtgttgccttgtctagcactgatcttgcatgttgagtgtagggccaggcggcgtcagcgatctgcgaagctgaaccacgtgatcctggctatggtttctgttttcttggtgtcctctatttacctgggcatcgactggttcttattctgggtcttccaaattccagccccattccccgaatacgtcacagacctctgcatttgtatcaacagttctgctaagccaatagtttacttcttagcgggacgcgacaagagccagcgactttgggagcctttgagagtggtgttccagcgagcactgcgggacggagcggaacttggcgaggcgggaggtagtacgccaaataccgtcaccatggagatgcagtgcccccctggtaatgccagctag

SEQ ID NO: 229658 - DNA, 870 bp, Artificial Sequence
  Description of Artificial Sequence: Synthetic coding sequence
atgttcggtctcttcgggctgtggagaacctttgactcagtggtattttacctgacgctcatcgttgggttgggaggcccagtgggcaacggcttggttttatggaaccttggcttccggatcaagaagggacctttttctatctatctgctgcacctggctgctgccgacttcctgtttctctcctgtagagtaggtttttctgtggctcaggcggcactcggagcccaggatacactgtactttgtgttaactttcctgtggttcgcagtggggctgtggctgctagcagccttttccgtcgaacggtgtctctcagacctcttccctgcttgttaccagggttgtaggcctaggcacgcctctgcggtgctttgcgctttagtttggacacccactttgcctgccgtccctttgcctgccaacgcatgtgggctccttcgaaatagcgcgtgcccactggtgtgccccaggtaccatgtggcaagcgtcacatggttcctggttctcgcgagagtagcctggactgccggagtggtactcttcgtgtgggtgacatgctgtagcacgcgcccaaggccacgcctctacggtattgtcctaggagctctccttctgctctttttttgcggcctgccgtccgtgttctactggtctctccagccactgcttaactttctgttaccagtgttttctcccctggcaacgctcctggcatgtgtgaatagctcatcaaaacccctgatatacagcggactgggccgtcagccaggtaagcgggagcctctacggtcagtgttacgaagggctcttggagaaggtgcggagctgggggctagagggcagtccctgccaatgggtcttctgtag

SEQ ID NO: 229659 - DNA, 969 bp, Artificial Sequence
  Description of Artificial Sequence: Synthetic coding sequence
atggacccaacaatctcaacccttgacactgagctgactcccatcaacgggaccgaagagacactgtgttataaacagactctcagccttacagtgctcacctgcatcgtcagtctggttggcctcactggaaatgccgttgtgctttggctgttgggttgtaggatgcggaggaacgcctttagcatctatatcctcaatctagcagctgccgactttctgttcctgtccggaaggttaatttattccctcttgagcttcatttcaatcccccacacaatttctaagatactgtaccccgttatgatgtttagctattttgccggactgtcctttctgagcgctgtttcgactgagcgctgtctgtctgttctgtggcctatctggtacagatgtcatcgacccacgcatctgtcagccgtggtctgtgtgctcctgtgggccctctcactgcttaggtcaattttggagtggatgctgtgtggctttcttttttccggagctgacagtgcatggtgccagacaagcgatttcatcacagtggcttggctgattttcctgtgtgtggtactttgtggcagttcactggtgctgctcatcaggatattgtgcggtagcaggaaaattcctttgacaagactctacgtaaccattctgttgacagtgctcgtttttcttctctgcgggctgcccttcggcatacaattctttctgtttctttggatccacgtggaccgggaagtgctcttttgtcacgttcacctggtgtctatctttctgtccgcgttaaactcatccgcaaatcccatcatatatttcttcgtcgggtcgttcagacagagacaaaaccggcagaacctcaaattagtcctgcagcgggctctgcaggatgccagcgaggtagacgaaggcggaggacagctaccggaggagatcctagagctcagtggctcaagacttgaacagtag

SEQ ID NO: 229660 - DNA, 993 bp, Artificial Sequence
  Description of Artificial Sequence: Synthetic coding sequence
atggaccccaccactcccgcatgggggactgaatcaaccacggtgaatggcaatgatcaggcgctcctcctgctctgtgggaaagaaaccttgataccggttttccttattttgtttatcgcactggtagggctcgttggtaatggctttgtgctatggctgcttggatttcgaatgcgaaggaacgcgttttctgtgtacgtgctgtcccttgcaggggcagacttccttttcctttgttttcaaattattaactgcctggtgtatctgagcaactttttttgtagcatcagtattaacttcccatctttctttactaccgtcatgacctgcgcatatctcgccggacttagcatgctgagtaccgtaagcaccgagcgctgcctgagcgtgctgtggcccatatggtatcgctgtaggaggcctcgacaccttagcgcagtagtgtgcgtcctcttgtgggccctcagcctgctgcttagcatcttggagggaaagttctgcggcttccttttcagtgacggagattcgggttggtgtcagacattcgactttataaccgccgcttggttgatctttctgtttatggttctgtgcggtagcagcttggccctgctcgtccggattctctgcgggagccgcggacttcctctgaccaggctttatctcactattctccttacagttcttgtcttcctgctttgtggattaccattcggtattcagtggttcctgattttgtggatctggaaggacagcgatgtgctcttctgtcacattcaccctgtgtcagtagtcctgtcctccttgaattcttctgcaaatcctatcatttacttctttgtagggtcctttcgaaagcagtggcgcctacagcagcccattctaaagttagcccttcaaagagcgctgcaggatattgcagaagttgatcactcagaaggttgcttccgacagggcacccccgagatgtccagatctagtttagtctag

SEQ ID NO: 229661 - DNA, 969 bp, Artificial Sequence
  Description of Artificial Sequence: Synthetic coding sequence
atggactcaaccatacctgtgctggggacggagctgacacccataaacgggcgagaggagacaccttgttacaaacagaccttatccttcacaggcttgacgtgtattgtgagcctggtggcactcactggaaatgcagtggtattgtggctgttagggtgccgaatgcgcagaaatgccgtcagcatctacatactgaacctggttgccgcagactttctctttctctctggccacatcatctgctcccctctgaggctcattaatataaggcatccgatcagtaagattttgagcccagtgatgacgttcccctacttcataggtctgtcaatgctctctgctatctcaactgagcgctgtttgagcatcctctggcccatctggtaccattgtagaagaccaaggtacctctcctccgtgatgtgcgtgctgctttgggccctgagtcttctgcggtccatcttggagtggatgttctgcgacttcctgttttcaggcgcaaattctgtttggtgcgaaacctctgacttcatcaccattgcttggctcgtgtttttgtgtgtggttctgtgtggttcctctctcgttcttctggtgcgtatactttgcggctcacgcaaaatgcccctgacgcggttgtatgttacaatcctgcttaccgtgctcgtgtttttactctgtggcctacccttcggtatccagtgggctctctttagtcgtatccacttagattggaaagtgctattctgccacgttcatctggtaagtatcttcttatcagccctgaacagctcagctaaccccattatctacttctttgttgggtcatttagacagcgtcagaaccgtcaaaacctcaaactggtcctgcagagagccctgcaggataccccagaggtggacgagggaggaggatggctgccgcaggaaacacttgagctgtcaggcagcaggttggaacagtag

SEQ ID NO: 229662 - DNA, 741 bp, Artificial Sequence
  Description of Artificial Sequence: Synthetic coding sequence
atggatagcacgatcccagttttgggaaccgagcttactcccatcaacggaagggaagagacaccttgctacaaacaaactctgtcatttacgggcctgacttgcatagtgtctcttgtggcactcaccgggaacgcagtggtgctttggctgcttgggtgtcgtatgcggagaaacgctgtctccatttatatcctgaatctcgtggcagctgatttcctgttcctctcaggtcacatcatctgctcaccgctccgtctgataaatatcaggcacccaatctcaaagattctttcacccgtgatgaccttcccttattttattggtctgtctatgttgagcgctatttctactgagagatgtctgtccattctgtggcctatatggtatcactgtcggaggccaagatatctgtcatctgtcatgtgcgtgctattatgggctctatctctgctccggagtattctagaatggatgttttgcgattttttgttctcaggtgccaatagcgtctggtgcgaaacatcagacttcataaccatagcgtggttagtttttctgtgtgtggtgctttgcggctcctcactggtattgttggtgcgaatactgtgtggcagtaggaaaatgccactgactagattgtacgtgaccatcctcctcaccgttttagtgtttctgctttgtgggcttccttttggcattcagtgggcccttttcagccgcatccacctggattggtag

SEQ ID NO: 229663 - DNA, 969 bp, Artificial Sequence
  Description of Artificial Sequence: Synthetic coding sequence
atggatcctaccgtgccagtctttggtaccaagttaacacctattaacggccgagaagagactccatgctacaaccaaacattgtcttttaccgtgctcacgtgtattatctcgctggtgggactcaccggaaatgctgtggtgctttggcttctggggtaccgtatgcgaagaaatgccgtgagtatatacattctgaatttggctgccgctgactttctgttcctttctttccagataatccggcttcctctgagacttatcaatatctctcatctaatccgtaagattctcgtatcggtgatgacattcccttatttcaccgggctgtcaatgctgagtgccatcagcaccgagcggtgtctctcagtgctctggcccatatggtataggtgtcgtagaccaacccacctgtcggctgtcgtgtgtgtgctgttgtggggcctgtctctgctattttcaatgttagaatggcggttttgcgactttctgttctctggggcagattctagctggtgcgagacctccgactttatcccagtcgcctggctcatattcctgtgcgtggtgttatgtgtgagttccctcgtcctcctggtaagaattctgtgcggtagccggaagatgccactgacacgtctgtacgtgaccatcctcctgacggtacttgttttccttctgtgtggactgcctttcggcattcttggagcccttatttaccggatgcacctgaacctcgaagtgctgtactgtcatgtgtatctcgtctgcatgagcctgtcctctctgaattcgtctgccaaccccatcatctactttttcgtgggttcttttcggcagagacaaaacaggcaaaatcttaaactggtcctgcaacgcgcactgcaggacaagccagaagtcgataagggcgaggggcagctcccagaagagtcactagagctctcaggaagcaggctggggccatag

SEQ ID NO: 229664 - DNA, 3051 bp, Artificial Sequence
  Description of Artificial Sequence: Synthetic coding sequence
atggtgttacctacctgtccaatggctgaatttgccctgcctcggcactccgccgtaatggaacgtctgaggcgcagaattgagctatgccgcaggcatcactccacttgtgaagcccgttacgaagccgtttccccagaacggttggagctggaaaggcagcataccttcgcgttacaccagcgctgtattcaagccaaggcgaagagggcgggaaagcatagacaaccccctgctgctaccgccccagcccctgccgctccagctccaaggctagacgcagccgatggacctgaacacggcagaccagctactcaccttcatgatacagtgaagcgcaacctcgactcagctactagtccccagaatggcgaccagcagaatgggtacggagacctgttccctggccacaagaagacccggcgagaggccccactaggcgtggccatcagttcaaacggcctgccgccagcctcccccctgggccagtcagacaaacccagtggagctgacgcactccagagcagcggcaaacactccctggggctagacagtctcaacaagaagcgcctggccgatagctcactgcacttgaacgggggaagcaacccctctgagtcattccccctgtccctcaacaaggagttaaagcaggaaccggtggaggacctgccctgcatgattacagggaccgttggctcaatctcacagagcaatctgatgcctgacctcaatctcaatgaacaggaatggaaagaactcatcgaggaactgaaccgcagtgtgccggacgaagacatgaaggacctttttaacgaagacttcgaggagaagaaagaccctgagtcgtcggggtcagcaacccaaaccccactggctcaggatattaacattaagaccgagttctctccggctgcattcgaacaggagcagctgggttcaccacaggttcgagccggatccgccggacagacctttctggggccatcaagcgccccagtttccaccgattcgccttctctgggaggatcacagaccctgtttcacacatcaggacaaccaagagctgataatcccagccctaatctaatgccagcttccgcccaggcacagaatgcacagagggccttagctggagttgtgctgccctctcaggggcctggtggggcaagtgaattgtcatccgcacatcagctccagcagatcgccgctaagcagaagagggaacaaatgctgcagaatcctcaacaggctacgcctgcaccagcccctggccagatgtctacatggcagcaaacagggccatctcattcctctttggacgtgccttacccaatggaaaaacctgctagtcctagcagttacaagcaggatttcaccaattctaagctcttgatgatgccttcagtaaataaaagtagccctaggcctggaggcccatacctgcagcccagtcacgtcaatctgttgagtcatcagccaccgagtaatttgaaccagaacagtgctaacaatcagggctcagtgctagactatggcaatacgaagccgctgtctcattacaaagcagattgcggacagggttcaccgggatccggccagagcaaacccgcacttatggcctacctacctcagcagctgtcacacatcagccatgaacagaattctctctttctgatgaaacctaaaccaggaaacatgccttttcggtccctggtgcccccaggccaggagcagaacccgagttctgtacccgttcaggcccaggccacaagcgttgggactcagcctcccgctgtgagtgtggccagcagccacaattcttccccttatctgtccagccagcagcaggcggcagtgatgaaacagcaccagctgctcctcgatcaacagaagcaacgcgagcagcagcagaagcacttgcaacagcaacaattcctgcaacgacagcagcatctcttggccgagcaggaaaagcaacaattccaaaggcacctgacccgacccccaccacagtaccaggatcccactcaagggtcattcccacaacaagtgggccaatttacagggtcgagcgctgcggtcccagggatgaatactctaggtccaagcaattcatcttgtcctagagtatttccacaggctggaaatctgatgccaatgggccctggtcacgcctctgtctctagcctccccaccaactccggtcaacaggatcgcggagttgcacaatttccaggtagccagaatatgccacagtcctctctatacggaatggcatccggaattacacagatagtggcccagccacccccacaggctacgaacggccatgcccacatacccagacagaccaacgttgggcagaatacaagcgtgtcagccgcatatggccagaatagcttggggtcttcaggactgtcacaacagcacaataaggggaccctcaaccccggtctcacgaagcccccagtccctcgcgtgtcccccgctatgggcggtcagaacagctcctggcaacaccaggggatgcccaacttgtctggtcagactcccggtaattccaacgtctcaccatttaccgccgcatcctcttttcacatgcagcagcaggcgcacctgaaaatgtcatccccgcagttcagccaggcagtaccgaatcgtccaatggcaccaatgtctagcgcagctgcagtggggagcctgttaccgccagtgtccgctcagcagaggacctccgccccagccccagccccacctcccaccgcgccacagcagggtttgcctggcttatcacccgcaggcccagaacttggtgctttcagtcagtccccagcaagccagatgggtggtagagccggattgcactgtacccaggcctatccagtgagaacggccggacaggaactgcctttcgcttactctggccagcccggtgggtctggcttatcatcggtcgccggtcacactgatctgattgacagcctgctgaaaaatagaacctcagaagagtggatgagcgatcttgacgacctgctgggctctcagtag

SEQ ID NO: 229665 - DNA, 2286 bp, Artificial Sequence
  Description of Artificial Sequence: Synthetic coding sequence
cgcggaaagcagtggggcagggggggaggtgagaggccgagactggaagtggggagtaagcggagacttggcgtcgggccatctggagccggagggaaacccgctgccgcacgggaaccagccccactgcctagtggagcctggaggggaagggaagccgagcggggatcaagaggggaaagatctccacagtgccagcccgctcctaggggaccagctccaggtccagcaagggccgcaagaggcccatggtgctgccctcccgctccttggcggtcaagtcggtgtaggggtaccgcaagatcctggagtgctttcgccggtgccagcagttgtgctggtgcaacaaccgcccctgctcgaccagcggcacctgctcccaggctggacgctgccgatggccctgaacatggccgtccagcaactcatctgcatgatacagttaaaagaaaccttgattctgccacgagcccccagaacggggaccagcagaacggttacggagacctatttcctggccacaaaaagacaaggcgcgaagctcccctcggagtggccattagttcaaacggtctccccccagcgtctcctctcggccagtcggacaagccttcaggcgctgacgctctacagtcatcgggcaagcattcactcggcttggattccctgaacaaaaaacggttggctgactctagcctgcacctgaatggaggttctaatccgagtgagtcatttcccctttctctaaataaggaattaaagcaggagccagtcgaagacctcccctgcatgattactggaactgttgggagcataagtcagtccaacctaatgccggatctgaatctgaatgaacaagaatggaaagagctgatcgaggagctaaacaggtccgtgcccgacgaggacatgaaagatctttttaacgaagattttgaagagaagaaggaccccgagtcaagtggctccgcaacacagacaccgctggcacaggacattaatatcaaaacagagttctctccagccgctttcgagcaagagcaattgggctcaccacaggtccgagcagggtcagctggacaaaccttccttgggccatcatcggcgccagttagcactgatagtcccagtctaggtggaagccagaccctgttccataccagcggtcagcctagggctgataatcccagtccaaacctgatgcctgcctcggcccaagcacagaacgcccagcgtgctctggccggtgttgttcttccttcccaagggcctggaggagccagtgagctcagtagtgcacaccagctgcagcagatcgccgctaaacagaagcgagaacaaatgttgcaaaacccacagcaagcaacccctgcccctgcaccaggccagatgtcaacatggcaacagaccggacctagccacagttccttggacgtcccgtaccccatggaaaaacctgccagtcccagctcatataaacaggacttcaccaatagcaagctattaatgatgcctagcgtgaacaaatcctctccaagacccggaggtccatatctccagccatcacacgtgaatctcttatcacaccagcctcccagcaatctgaatcagaatagtgcaaacaatcagggctctgtacttgattacggcaataccaagccccttagccattacaaggcagactgtgggcaaggtagccccggaagcggacagtccaagcctgctctcatggcatatctgcctcagcaactgtctcacatcagccatgagcagaatagtctttttttaatgaagcccaaacccggtaatatgccatttcggtccttggtgccgcctggccaagagcagaatccttccagtgtgccagtgcaagcccaagccacatcggtagggacccaaccacctgctgttagtgttgcctccagccacaatagcagcccctacttgtcatctcagcagcaggcagcggtgatgaaacagcatcagctcctgctggatcagcagaagcaaagggaacagcagcagaagcacctgcagcagcagcagttcttgcagaggcagcaacacctcctggcagaacaggagaaacagcagttccagcggcatcttacgagaccccctccgcaatatcaggaccctactcagggctcttttccacagcaggtgggtcagttcacagcccagggactctcctgcgctctgccaatgatccatagtacagaggtcctcattagcagtctttgcaacggatcagcaggtctgtccgcggcacagagatcctggtag

SEQ ID NO: 229666 - DNA, 3471 bp, Artificial Sequence
  Description of Artificial Sequence: Synthetic coding sequence
atgggagacaccgctcctccccaggccccagccggtgggctggggggtgcttccggtgcaggcctcttaggaggcggtagcgtgactcccagggttcattccgccatcgtggagcgattacgggctcgtatcgccgtctgtcgccagcatcacctctcctgtgaaggtcggtacgagcgaggacgcgcagaatcgtccgatcgcgaaagagaatctacactgcagctgctttctctcgttcagcatgggcagggagctagaaaggccggtaagcatacaaaggccactgccaccgctgcaaccacaacagcacctccccctccacctgcggcacctcctgccgcttcccaggcagcagctactgccgcaccgccacctccacctgattaccaccatcatcaccagcagcacttgctgaattcatcgaacaatggaggatccggaggcataaatggtgagcagcaaccacccgcatccactcctggggaccagaggaattcagctttgattgctttacagggcagcctaaagcggaaacaggtggtgaacctctctccagccaactcaaagaggcccaatgggttcgtcgacaactcattccttgacattaagcggatcagagtcggcgaaaatctgtccgctgggcagggaggtctgcagataaataatggtcaatcacaaatcatgagcggaacgttaccgatgagccaagcacccctgagaaagacaaatacactcccaagtcacacacactcccctggcaacggcctgttcaacatggggctaaaggaagtcaaaaaagagccaggagaaacactctcgtgtagcaaacacatggacggccagatgacccaggagaacatctttcctaacaggtatggcgacgaccccggagagcaactcatggatccagagttacaagagctctttaacgagctgaccaatatatcagtgcccccaatgtcagacctggaactcgagaatatgattaacgcaaccatcaagcaagacgacccatttaatatagacctgggacagcagtcgcagcgtagtacgcctagaccctcgctccctatggaaaaaatagttataaaatcagaatatagtccgggtctgacacaggggcctagtggcagtccacagttgcggcctccaagtgcagggcctgcattctctatggccaacagcgctctgtccacctcttctccaatcccttcagtaccgcagagccaagctcaacctcaaacaggaagcggcgcttctcgtgccctgcctagttggcaggaggtgtcccacgcccagcaactcaaacagatcgcagccaacaggcagcagcatgctagaatgcagcagcaccaacagcagcaccagcctaccaattggtccgcccttccatcgagtgcaggtcctagcccgggaccttttggacaggagaagattcctagtccatctttcgggcaacagactttttcaccccagtccagcccaatgcctggggtggcaggcggaagcggtcagagtaaagtgatggccaattacatgtacaaagcaggcccttctgcacaaggcggacacctggacgtgctgatgcagcagaagccacaagacttgtcccggtcttttattaacaaccctcatcctgcaatggaaccgagacagggcaacactaagccgcttttccactttaatagtgatcaggcgaatcagcagatgccctctgtcttgccgtcacagaacaagcctagtctgctgcactatacacagcaacagcagcaacaacaacagcagcagcagcagcagcagcaacagcagcaacagcagcaacaacagcagcaacaacagcagcaacagcagcagcagcagtcctcaatctccgcacagcagcaacagcagcagcagtcctcaatctccgcgcaacagcagcaacagcagcaacagcagcagcagcaacagcagcagcagcagcaacagcaacagcagcagcagcaacagcagccatcatctcagccagcgcaatccctgccctctcagccattactgcggtcgcctcttcctcttcagcagaaattgctactgcagcaaatgcagaaccagccgattgccggaatgggataccaagtgagccagcagcaacgccaggatcaacattccgtggttggccagaatactggccctagccccagccctaatccttgcagcaaccccaataccggaagcggatatatgaactctcagcagagcctgctgaaccagcagttgatgggaaaaaaacagaccctacagcgccagattatggaacaaaagcagcaactcctcctccaacagcagatgttagctgatgcggagaagattgcgcctcaggatcaaatcaatcggcatctctcccgcccacccccagactataaagatcaaagaaggaacgtcgggaatatgcagcctacggctcagtatagcgggggtagctctaccatcagcctcaatagtaatcaggccttggccaaccctgttagtacacatacaattcttacacccaattcttctttgcttagcacatcccacggaacaaggatgcccagcctgtccaccgctgtgcagaatatgggaatgtatgggaacctgccttgcaaccagcctaatacttattccgttacctcaggtatgaatcagttgactcagcagaggaaccctaaacagctgttggcaaatcaaaacaaccccatgatgccccgaccaccaaccctgggcccatctaacaacaataatgtggccacattcggtgccggaagtgttggcaattctcaacagctcaggcccaacctgacacactctatggccagcatgcctccccagaggaccagtaatgtcatgataacgtccaatacaacagcccctaattgggccagtcaggagggtacttccaagcaacaggaggcactgacgtctgcaggcgttcggtttcccactggcacccctgcagcctatactcctaatcagagcttgcagcaggctgtgggatcacaacagttcagccaacgagccgtcgcaccacccaatcaactcacccccgcagtccagatgcgcccaatgaaccagatgtcgcagaccctgaacggtcagaccatgggcccactacgcggtctgaacctgcgaccaaaccaactcagcactcaaatcttgcccaatctgaatcagtcaggaactggcctgaaccagagccgaactggcatcaaccaacctcccagcttgacaccatcaaatttcccgagtccaaatcagagcagcagggcattccaggggacagatcattcctcggacctggcattcgattttttgtcccagcagaacgacaacatggggccagctctaaattccgacgccgactttatcgactccctgctaaagacagagccgggaaacgacgactggatgaaagatatcaatctcgatgaaatcctgggaaacaacagttag

SEQ ID NO: 229667 - DNA, 3471 bp, Artificial Sequence
  Description of Artificial Sequence: Synthetic coding sequence
atgggggatacagcgcctccccaggcccctgcaggcggacttggtggagctagcggtgcgggtctcctggggggaggtagcgttacccctcgtgtgcattcagcaatagtggagcgcctgcgagccaggatcgctgtttgtagacagcaccacctctcctgtgaaggaagatatgagcgcggacgagcagagtccagcgacagggagagagaatctactctgcaactgctgtcactggtgcagcacggccagggcgctcggaaggcgggtaaacacacaaaggctaccgccactgctgccaccactacagcacctccccctccacccgcagcccctcccgctgcctctcaagccgcagccactgccgcacctccgccaccacccgattaccaccatcaccaccagcagcacctgctcaacagctcaaacaatgggggaagcggaggtatcaacggtgagcagcagccacccgcatcgacccctggcgaccaacggaacagtgccctcattgcattgcaaggcagtctaaaaagaaagcaagtcgtgaacctgagtcccgcaaacagtaagcgtcctaacggctttgtggacaatagctttctcgatatcaaaagaattcgtgtgggcgagaacctgagtgccggtcagggtgggctacagattaacaacggtcagtctcagattatgtccgggactctacctatgtcccaggcacccctccgaaagaccaatacattaccaagccacacgcattcacccggaaacggccttttcaatatggggctgaaggaagtgaagaaggaacctggcgaaactttatcctgtagtaaacacatggacggtcaaatgacccaggagaacatctttcctaatcgatatggcgacgatcccggagaacagctgatggatcccgagttgcaggagctgttcaacgagctgaccaacatttccgtacctcctatgtccgatctggaattggagaatatgataaatgccactattaaacaggacgatccattcaatattgatctgggccaacagagtcagcggtcaacgcccaggccgagcttacctatggagaagattgttataaagtcagagtactcccccggtctgacccagggtccttcagggagtccacaattacgcccaccaagcgccggaccagcgttcagtatggccaatagtgccctgtcaacttcaagccctatcccgtctgtaccgcaaagccaagcccagccacagacggggtctggtgcttccagagccctaccatcttggcaagaagtcagtcacgcacagcagctaaagcagatagccgctaacaggcagcagcatgcacgcatgcaacagcaccagcagcagcatcagcctaccaattggtccgccctgccttcttccgcaggtccctctccaggcccattcggccaagaaaagattccttctccttcctttgggcagcagactttcagtccacaaagcagtcctatgccaggagttgctggcggatccggccagtccaaggtcatggccaattacatgtataaagcaggcccttctgcccaggggggacacctcgatgtcctgatgcagcagaagccccaggacctctcccgcagtttcatcaacaatccccaccccgctatggaaccacgccaggggaacacgaagcccctgtttcactttaattcggaccaggcaaatcagcagatgccctcagtgctgccctcccagaacaagccttcattgctgcactacactcagcaacaacaacaacaacagcagcagcagcagcaacagcagcagcagcagcagcaacagcagcagcagcagcagcaacagcagcagcagcagcagcagcagtcttcaatctctgcccaacagcagcagcagcagcaaagtagtatctctgctcagcagcagcagcaacagcagcagcaacagcagcagcagcagcagcagcagcagcagcaacagcaacagcagcagcagcagcccagctcacagcctgctcagtccctgccctctcagcctttgctccgtagtccactgccactgcagcaaaagcttctgctacaacaaatgcagaatcagcccatagccggtatggggtaccaggtgtcgcaacagcagagacaggaccagcacagtgtcgtgggccagaacaccggtccgtccccctccccaaacccatgcagtaaccccaatactggctccgggtacatgaattcccagcagtcattgctaaatcagcagcttatgggcaagaagcagacactgcaacgccaaatcatggagcagaaacagcagttactgctccagcagcagatgctcgctgatgcagagaaaatcgcccctcaagatcagataaaccgccacctgagtcgaccccctcccgattacaaggaccaacggaggaatgtgggtaatatgcagcctaccgcccaatactcaggaggctcttctacaatctctcttaacagcaatcaggccttggccaaccccgtcagcacacacacaattctgacgcctaactcgagtctgctctccactagccatgggacccgaatgcctagcttgagcacagccgtgcaaaatatgggcatgtatgggaatctgccttgcaatcagcctaacacctactcagtcacctctggtatgaaccagctgacccagcagaggaacccgaaacagctgctggcaaatcagaacaatcccatgatgcccaggccgcctactctcgggcctagcaataataataacgtcgccacgtttggagcaggtagcgtgggtaatagtcagcaactgcgtcccaatcttacgcacagtatggcctccatgccaccgcagcgaacgtctaacgttatgataacaagcaataccaccgcacccaattgggccagtcaggagggcacttccaaacagcaggaggcgctgacaagtgccggagttcggttccccaccggaactcctgcggcatataccccaaaccagtcactccagcaggcggtgggcagtcagcagttttctcagcgagctgtcgccccacctaatcaactgacacctgcagtgcagatgagacccatgaaccaaatgtcgcagacgttgaatggacagaccatgggacctctacgcggactgaatttgagaccaaaccagctgtcaactcaaatcctgccaaacctcaatcaaagtgggacgggcctcaatcagtcaagaacaggcattaaccaacctccatcccttacgccctctaatttccccagccccaatcagagctctagagctttccagggtactgaccactcctccgatctcgcgtttgacttcctttctcagcaaaatgacaacatgggccctgcactgaactcggacgctgattttattgatagtcttctgaaaacggaacctggaaatgacgactggatgaaagacattaatctggatgaaattctgggcaataatagttag

SEQ ID NO: 229668 - DNA, 1632 bp, Artificial Sequence
  Description of Artificial Sequence: Synthetic coding sequence
ttgcaggaaacggtaaagagaaagctcgaaggcgcaagatcccctctgaatggggaccagcaaaatggggcatgcgacggcaacttcagtcccaccagcaaacggattcggaaggacattagcgcaggaatggaggccatcaacaatctaccaagcaacatgcctctgccatctgcgtccccactgcatcagttggacctgaaaccctccctacccctccagaacagtgggacgcacacacccggactgctcgaggatctgagcaaaaacgggcgactgcctgagattaagttgcccgtgaatgggtgctctgacctagaagactccttcaccatattgcaatctaaggacctcaaacaggagcctctagacgatcctacctgcattgataccagtgagacctccttatcaaaccagaataagctcttttccgacattaacctgaacgatcaagaatggcaggaattaattgatgagttagctaatacagtgccggaagatgatatccaggacttgtttaacgaggatttcgaggagaagaaggaacccgaattcagtcagcctgccactgagactccgctgagccaggaatccgcttcagtcaagagtgatccgagccatagcccgtttgcacacgtcagtatgggtagcccccaggctaggccatccagctccggtcccccattttctaccgtatcaacagccacctcgcttccttcagtggctagcacaccggctgcgcctaaccccgctagttcacccgctaattgcgccgtgcagtcaccacagacccccaatcaggcgcatactccaggccaagctccacctagacctggaaacggctacctgctcaatccagccgctgtgactgtggccggttccgccagtggaccagtagcggtcccaagcagtgatatgtcaccagccgagcagctaaaacagatggcagctcagcagcagcaacgggcaaagcttatgcagcaaaagcagcagcagcagcagcagcaacagcagcagcagcagcaacagcagcagcagcagcagcagcagcagcaacagcaacacagcaaccagacgtcaaattggtctccactgggacccccatcaagtccgtatggggctgcctttacagcagaaaaacctaatagccctatgatgtacccccaggcattcaacaatcagaacccaattgtgcctcctatggcaaataacctccagaaaactaccatgaacaactacctaccccaaaatcatatgaatatgataaatcagcagcctaacaacctgggaaccaattctctgaacaaacagcacaacattctgacttacggaaatacgaagccactgacccatttcaatgcagatctgagccagcggatgaccccccctgtagccaaccccaataaaaatcctctcatgccatacattcagcagcagcagcagcagcagcagcagcaacagcagcagcagcagcagcaacagccgcctccgccacaactgcaggcccctagggcacatctgagcgaagatcagaaaaggctgctcttgatgaagcagaagggcgtaatgaatcaaccgatggcctacgccgcacttccctcccatgggcaggagcagcagcccgtggggtag

SEQ ID NO: 229669 - DNA, 831 bp, Artificial Sequence
  Description of Artificial Sequence: Synthetic coding sequence
atgtcgccggcagaacagctgaaacagatggccgcacaacagcagcagcgggctaagctgatgcaacaaaagcaacagcagcagcagcaacagcagcagcaacagcagcagcagcactcgaaccagactagcaattggtcgccactcggccctccatcctctccgtacggcgcagcctttaccgccgaaaagccaaattccccaatgatgtacccccaggctttcaacaatcagaacccaatcgtccccccaatggccaataacctgcagaagaccacaatgaacaactatctgcctcaaaatcacatgaatatgattaaccagcaacctaataatctggggacaaattcgctgaacaaacaacacaacattttaacgtatggaaataccaagcctcttacccatttcaacgccgatctgtcccaacgtatgactccaccagtcgctaatccgaacaagaaccctctaatgccctatatccagcagcagcagcagcagcagcagcagcagcagcagcagcagcagcaacagcaaccgccacccccacaactgcaggcaccacgcgctcacttgtctgaggaccagaaacgcctcctgctgatgaagcagaagggagtgatgaaccagcccatggcctacgcggcactaccctctcacggtcaggtgtcagtgaaagtgacacattcctctagttcctcatgtggggcttttgactgcaggtgcgtaatgttctataagagcacagtcgttggctcaaactgcctccagaagacatctctgcaccctcaggtggtggcgagattcggcgtattcttttttcacttcagttag

SEQ ID NO: 229670 - DNA, 3417 bp, Artificial Sequence
  Description of Artificial Sequence: Synthetic coding sequence
atgggagattttgcagcccctgctgccgcagccaacggcagctccatatgtatcaactccagtcttaactcctctctcgggggagccggaataggagtcaataacacgcccaacagtactcccgcagctccctctagtaaccacccggctgcagggggttgcggcggttccggtggacccggaggcggaagtgcggctgtccccaaacacagcacagtggtggaacgactgaggcagcgcatcgaggggtgccggcgtcaccacgtcaattgtgagaatagatatcaacaggcccaagtggagcagttggaactggagcgcagggataccgtctcactttaccagagaacactcgagcagcgagctaaaaagtccggggcaggcacaggaaagcaacagcatccatcaaagccacagcaggacgccgaggcagcatctgctgagcagcgcaatcacaccctgataatgctgcaagagaccgtcaaaaggaaacttgaaggcgctcggagccctctcaacggagaccaacaaaacggcgcatgcgatgggaacttctcgccaactagcaaaagaatccgtaaggatatttccgccggtatggaggctataaataatctccctagcaacatgcccctccctagcgctagccctttgcatcaacttgacctaaagccaagtctacctttgcaaaacagcggcacccatacaccgggactcctggaggatctgtcaaaaaacggcagactgcccgaaattaagttacctgtgaacggatgctctgatctagaagattctttcacaattctgcaaagtaaggatctcaagcaggaacctctcgatgaccccacgtgcatagacactagcgagaccagtcttagtaatcagaataaattgttctcagatattaatcttaacgaccaggaatggcaggagctgattgacgaacttgctaatacagtgcccgaggacgacattcaggatctgtttaacgaagatttcgaggagaaaaaggagcctgaatttagtcagccagcaaccgagactcctcttagccaagagtccgcctccgtgaagtcagatccgtctcactccccgttcgcccacgtctcaatgggatcccctcaagcacgcccttctagtagcggccctccattctccactgtttccaccgccacctcgctgccctctgtagcatcaaccccggctgccccaaacccagcttcatctccagccaactgcgctgtacagtcgccacaaacacccaaccaagcacatacaccagggcaggctccgcctcgtcctggtaacggatacctgctgaatcctgccgctgtcacagtagccggttcggcctcaggccctgttgctgtccctagctcggatatgtccccagccgagcagctcaagcagatggccgctcagcagcaacagcgggctaagctgatgcagcagaagcagcagcagcagcagcagcagcagcaacaacagcagcaacagcagcagcagcagcagcaacagcaacaacaacagcactccaaccaaacgagtaactggtcccctctgggaccccctagttcaccttacggggcagccttcaccgcagagaagcccaatagtcccatgatgtatccacaagctttcaataaccagaatcccatcgtccccccaatggcgaataacctacaaaaaacaactatgaataattacctaccacagaaccatatgaacatgatcaatcagcagccaaataacctcggcactaacagcctgaacaaacagcataacatcctcacgtacggaaataccaaaccactgacccatttcaacgctgatttgtctcagagaatgactccacctgtcgctaatcctaacaagaatcctctcatgccatatatacagcagcagcagcagcaacagcaacagcagcagcagcagcagcaacagcaacaaccccctcctccacagctccaggccccacgggcacacctctccgaagaccaaaagagacttctgttgatgaaacagaaaggggtgatgaaccagcctatggcatacgctgccctccccagtcatggtcaggaacagcacccggtgggcctcccaaggactaccggtccgatgcagagcagtgtgcccccaggctctgggggtatggtctccggggcttctcccgctgggcctggtttcctggggagccaacctcaggcagccatcatgaaacaaatgctgatcgaccaacgtgcccaactcattgagcagcagaaacagcagttcctcagagagcaaagacagcagcaacaacagcaacagcagcagattctggctgaacagcaacttcaacagtctcacctcccgaggcagcatttacagccacagcgtaatccctatccagtacagcaggttaaccagttccaaggaagcccccaggatatcgccgctgtcaggtctcaggccgctttacaatccatgagaacatcgcgactgatggcacagaacgcgggaatgatgggtataggaccaagtcagaatcccggtacgatggcaactgccgctgcccagtctgaaatgggtttggccccttactcaactacgcctactagccagcctgggatgtacaacatgagtacaggcatgacccagatgttacaacatccaaaccagtccgggatgagcataacgcacaatcaggctcaggggccacgccagcctgccagcggacagggggtgggaatggtgtctgggtttgggcaatccatgctggtcaacagtgcaatcacacagcagcatccccagatgaaaggaccagtcggtcaggccctcccacgtccacaggcacctccaagattgcaatctttaatggggaccgtacagcagggagcccagtcttggcagcagcgcagtctgcagggtatgccgggaagaacctccggggagctggggccatttaacaatggggcatcctatcctctgcaagccggacaaccccgattgaccaaacagcacttcccccaggggctatcacaatcagtggttgatgctaacaccggaacagtgcggacgttaaaccccgctgccatgggacggcagatgatgccgtcgctccctgggcaacaggggacctcacaagcacggccaatggttatgagtggactctctcagggagtgccgggaatgccggcattctctcagcctcccgctcagcagcagattccctccggcagcttcgccccttcgtcacagtctcaagcgtacgagcggaacgcacctcaggacgtgtcctataactactccggagatggcgctggcggaagctttccaggactacctgatggtgcggatcttgtggattctatcattaaagggggacctggagatgaatggatgcaagagctagatgagttgtttggaaacccatag

SEQ ID NO: 229671 - DNA, 1338 bp, Artificial Sequence
  Description of Artificial Sequence: Synthetic coding sequence
gagcagcatcccgtaggtctgcccaggactacaggtcctatgcagagctccgtcccccctggatcaggaggcatggtgagcggagcatcaccggctggcccagggttcctcggctcgcagcctcaggcagctatcatgaagcaaatgctcattgaccagcgagcgcagctcatcgagcagcagaagcagcaatttctgagggagcagcgacaacaacagcagcagcagcagcagcagatcctggccgaacagcaactgcagcagtctcacctcccaaggcagcacctacaaccccagcgcaacccctatcccgtgcaacaggtaaaccaattccagggcagcccgcaagatatcgccgctgtgagatcacaagccgcactgcagagtatgcggacctcacgtctgatggcccaaaacgcgggtatgatgggtattgggccaagccagaatcctggaacgatggccacggcagccgctcagagcgagatgggtctagccccatattccactacccctacttctcaacctggcatgtataatatgtccactggcatgacccagatgcttcagcaccctaaccaaagtggcatgtccatcacccacaaccaggcacaaggaccaagacagccagcgagtggccagggcgtaggcatggtgtccggtttcgggcagagcatgctcgtgaacagcgccattacccagcagcatcctcaaatgaagggccctgtagggcaggctctgcctcgaccgcaggctcctcccaggctccaatccctgatggggaccgtacagcaaggggctcaatcttggcagcagcgcagcttacaggggatgccaggacggacctcaggcgagctcggccctttcaataacggcgcatcttacccacttcaggctggccagcctaggctcaccaagcagcattttccccagggcctgagtcagtccgtggtcgatgcaaacactggaaccgttaggactcttaacccagccgcaatgggtagacagatgatgcccagcctcccaggacaacagggcacttcccaagccagacccatggttatgtctggactttcccagggcgtgcccggaatgcctgccttcagccagccacctgcccagcagcagatcccctccggctcctttgcacccagctcccaaagtcaggcttacgagagaaatgctcctcaagatgttagttacaactattcgggggacggtgctggaggcagtttcccaggattgccagacggagccgacctggttgatagcatcatcaaaggtggtcccggagacgagtggatgcaggaactcgatgaacttttcggaaacccctag

SEQ ID NO: 229672 - DNA, 2325 bp, Artificial Sequence
  Description of Artificial Sequence: Synthetic coding sequence
atggatgattggaagtctcgtttagtcataaagagcatgctaccccactttgctatggttggtaatcgacaagaaccccgaaaacttcaggaatccgggaaaaagccctcctggatggaggaagaggatctgagcttcctctataagtccagtcctggcaggaagcatcagggcactgtaaaaaggaggcaggaggaagatcactttcagttccctgacatggccgacggtggctatcctaacaagatcaaacgcccatgtttggaggatgtcacattagccatgggtcctggcgctcatccaagtacagcctgcgccgagctccaagttccccctctgacaatcaacccctctccagccgctatgggggtcgccggacagagccttcttcttgagaataacccaatgaacgggaacatcatgggcagcccctttgtagtgccgcagaccaccgaagtggggctgaagggtcctaccgtcccctattatgaaaagatcaattcagtcccagccgtggaccaggagctgcaggagctgctggaagagctaacaaagatccaagacccatcccccaacgaactggacctggaaaagatcctcggcaccaaacctgaggagcccttagtgctggatcacccacaggccactctgagcaccacacccaaacctagcgtgcagatgagccacctagagagcctggccagtagtaaggaattcgcgtccagctgtagtcaggtaacgggcatgagtctgcagattccatcatcctcaactggcatcagttactctattccttctacatcgaaacaaatcgtgtccccttcaagttccatggcacagagcaagagccaggtgcaggctatgctgcctgtggctctccccccactgcctgtcccacagtggcatcatgctcatcagcttaaggcactagcagctagcaaacagggatccgctaccaaacagcaggggccaacaccgagttggagcggtctgccaccacccggtctgagcccgccataccggccagttcccagtccacaccccccaccacttcccttacctccaccaccacctcctttttcgccgcaatccctgatggtgtcatgcatgtccagcaatacgctttcagggagtacactgagggggagcccaaacgctctgctcagttcaatgacctccagcagtaatgccgctctgggacctgccatgccttacgccccagagaagctgccctctccggctttaacacagcagccccagtttgggccacagagctcaattctcgctaacctgatgtcaagcacaatcaaaactccacagggacacctgatgtctgccctcccagcttctaaccccggaccaagtcccccttataggcctgaaaaattaagctcacccggtctgccgcaacagagctttacgccccagtgcagtctgatccgatctctgacacccacaagtaatttgctgtctcagcagcagcagcagcagcaacagcaacaacaggctaacgtgatatttaaacccatctcatcaaacagctctaagactctaagtatgattatgcagcagggtatggcatcaagttcccctggggctaccgaaccgtttactttcggaaacaccaaaccactgtcacacttcgtcagcgagccaggtccccagaaaatgcccagcatgcccaccacaagtcggcagccgtctttactgcactacctgcagcagccaactccgactcaggcttcgagcgcaactgccagcagtaccgccaccgcaacactgcagctgcagcagcagcagcagcaacagcagcagcagcccgatcatagctccttcctcctccagcagatgatgcaacagccccaacggttccagcggtccgtggcttctgattcaatgccggctctaccccgtcagggctgctgtcatctgttcgcgtggacctccgccgctagcagcgtcaagccccagcatcagcacgggaacagtttcacatcaagacaagacccgcagcccggagacgtatccccctccaatatcacccatgtggacaaagcctgcaagttaggtgaggctagacacccacaagttagccttggcagacagcccccttcttgtcaggctttgggctccgaatccttcctgccaggaagtagtttcgctcacgagctggccagggtgacatctagctattccacaagcgaagctgcgccttggggttcctgggatcccaaagcttggcgccaggtacctgcaccactcttgcctagttgtgatgcaactgcaagaggcaccgagatccgctcttatgggaatgatccctag

SEQ ID NO: 229673 - DNA, 411 bp, Artificial Sequence
  Description of Artificial Sequence: Synthetic coding sequence
atggacgactggaagagtagactcgtgattaaatccatgctgccacactttgccatggtgggaaaccgacaggagcctaggaagttacaggagtcaggtaaaaaaccttcctggatggaggaagaagatctgtcctttctgtacaagagctccccaggcaggaagcaccagggtactgtcaagaggaggcaggaagaagaccacttccaatttcccgatatggctgatggcggataccctaataagataaaacggccttgtctggaggatgtgaccctggcgatggggcctggagcacatcccagcaccgcctgcgccgagctgcaggtgcccccactcactatcaatccctcccctgccgcaatgggggtcgcaggtcaaagcctgttacttgagaataatcctatgtag

SEQ ID NO: 229674 - DNA, 2325 bp, Artificial Sequence
  Description of Artificial Sequence: Synthetic coding sequence
atggacgattggaagtcccgtttggttatcaaatccatgctgccccatttcgctatggtgggaaaccggcaggaaccacgcaagctgcaggagagcggaaagaagccatcttggatggaagaagaggatctgtccttcttatacaagagctcccctggacggaagcaccaaggtactgttaagagacggcaagaggaggatcacttccagtttcctgacatggccgatggagggtaccctaacaagatcaagcgcccttgcctggaggacgtgaccctggcgatggggcctggagctcacccttcgactgcttgcgctgagctgcaggtgccccctctgaccattaacccttcccctgccgcaatgggggtggctggccaatcgttgctgcttgaaaacaatcctatgaatggcaatatcatgggttctccatttgtggtgccccagacgaccgaggtgggcctcaaaggcccaaccgttccgtattacgagaaaatcaatagcgtacccgcagttgatcaggaattacaggagctattggaagagttgacgaagattcaggatccaagccccaacgagttagacttagaaaagatactgggtacaaaaccagaagaaccattggttctcgatcatccccaggctaccctcagcactacacctaagccgtccgtgcagatgagccaccttgagtctctggcctcctccaaagagtttgcaagtagttgcagtcaggtcacaggcatgtctcttcagataccctcgagcagcacagggatttcttactccatccctagcacttccaaacagattgtttcaccatcaagctcaatggcccagtccaagtcacaggtgcaagctatgctgccagtggcccttcccccactgcctgtgccacagtggcatcatgcccatcagttaaaagccctggctgcctcaaaacagggaagcgctacaaagcagcagggacccacaccatcctggtctgggttgccccctcccggtcttagccccccttaccgtcctgtaccatctccacatcccccacccctgcccctgccccctcctcccccacccttttcaccacagtcactgatggtgtcctgcatgtcctcaaacaccctgagcggctctacactccgaggaagccctaacgctctgctctcctccatgacttcttccagcaacgcggcattgggaccggcaatgccttatgcaccagagaagcttccctctccagccctgacccagcagccacagttcgggccacagtctagtattcttgctaatctaatgagctcaacaattaagactccccaggggcatctcatgtcagctctgcctgcaagtaatccgggaccctctccgccatatcgcccagagaagctatcatcccctgggctaccgcagcagtccttcacaccgcagtgttccctaatcagatccttgacccctacatcgaacctgctgtcccagcagcaacaacagcagcagcagcagcaacaggccaatgtaatctttaaacctatatcttccaacagtagcaaaaccctgagtatgatcatgcagcaagggatggcctcctcctcccccggtgccaccgaacctttcacattcggcaacacaaaacccctgtcacacttcgtctctgaacctgggcctcagaaaatgcctagcatgcctaccacaagccgtcagccatcactcttgcactacctgcagcagccgacacctacacaagccagcagcgcaactgcttctagcacagccactgctacgctgcagctccagcagcaacaacagcaacaacaacagcagcccgatcactcttcgttcctcctgcaacagatgatgcagcagccacagaggtttcagcggtccgtggctagtgacagcatgcctgctctgcccaggcagggttgttgccacctgttcgcttggaccagtgcggcttcttccgtaaagcctcagcatcagcatggcaacagctttaccagccgtcaagatcctcagcccggagatgtaagcccctccaatataacacatgtggataaggcatgcaagctaggagaagcgcgtcatccgcaagtttcactgggacgccagcccccttcctgtcaggctctagggtctgagagctttctgcctggttcttcgtttgcgcatgagctagctcgggtgacctcctcttattccacgtcagaggcggctccatggggctcatgggaccccaaggcctggcggcaggtgcctgctcctctgctgccaagttgtgacgcaacagctcgcggtaccgagattagatcttacggcaatgacccctag

SEQ ID NO: 229675 - DNA, 2250 bp, Artificial Sequence
  Description of Artificial Sequence: Synthetic coding sequence
atggacgactggaaatctcggcttgtcatcaaatctatgctccctcactttgccatggtgggtaaccgacaggaacctaggaagcttcaggagtcaggaacagtgaagcgccgtcaagaggaggaccactttcagtttcctgatatggccgatggtggctatcctaacaaaataaagcgcccttgcctggaagacgtgaccctggccatgggcccaggcgctcaccctagtacagcctgtgcagagctgcaggtgccaccacttacaattaatccctctcccgcagccatgggcgttgcgggacagtcccttctgctcgaaaataatccaatgaacggaaatataatgggaagcccatttgtggttccccagaccactgaggtaggtcttaagggcccaactgtgccatattacgaaaaaatcaattccgtccccgcagtggaccaggagctgcaggaactgctcgaagagttgaccaaaatccaagacccttctccgaatgaattagatttggagaagattctcggcaccaaacccgaagagcctctcgtgctggaccacccccaggccacattatcgacaacacccaagccctcagttcagatgtcacacctggaatcactcgccagtagcaaagaatttgctagttcctgcagccaggtgacaggaatgagcctgcagatccccagcagttccacaggaatctcctacagtattccgagtacaagtaagcagatagttagccccagtagcagtatggcccagtcaaaatcccaggtgcaagctatgctgcccgtcgctctgccacccctgcctgtgccacagtggcaccacgctcatcagctcaaggctcttgccgctagcaagcagggttctgctactaagcagcagggacctactcctagctggagtggcctccccccacccggtctgtctccaccgtaccgaccagtgccctcaccacatcctccacccctgcctttgcccccacctccaccacctttctctccccagtcattgatggtatcctgtatgtcctcaaatacccttagcggtagtaccctgaggggtagtccaaatgcccttctgtcatcaatgacatcgtcttcaaatgcagctctgggaccagccatgccttatgccccagaaaagctcccttctcccgcactgacccagcagccgcaatttgggcctcaatcctcaattctcgccaacctaatgtcatctaccatcaaaactccccagggccaccttatgtcagccctgccagctagcaacccgggaccgagcccaccctataggcctgaaaagctctccagtcccggattgccacagcaaagtttcacaccccagtgcagccttataagaagcctgactccaacctctaacctgctgagccagcagcagcaacaacagcagcagcagcagcaagccaatgtcatctttaagcctatctcctctaattcctcaaagacgctgagtatgatcatgcagcaaggtatggcatcatcatcacccggagcgaccgagccattcactttcggaaataccaaacctctgtctcacttcgtatctgagccgggacctcagaagatgccatctatgcctacaacttccagacagccttcccttctacattacctccaacagccgacaccaacacaagcttctagcgctacagcaagttcaacagctaccgccacactgcagctgcagcagcagcagcaacagcagcagcaacagccagaccatagcagttttctactgcaacaaatgatgcaacagcctcagagattccagcggagcgtggcttcggactccatgcctgcccttcctcgccaaggttgttgtcatctattcgcctggacctcggccgcttcaagcgtgaaaccccagcatcagcacggcaactcattcacgtcaagacaagatccgcagcctggcgatgtctctccgtccaacataacccacgtggacaaggcgtgcaagttgggcgaggcccgacaccctcaggtgtcattaggcagacagcccccttcatgccaagctctgggctctgaatcctttctacccggtagcagtttcgcgcatgagttggcacgggtcacaagtagctactccacgtccgaggctgcgccatggggcagctgggacccgaaggcctggcggcaagtcccagccccactgctcccgagctgcgacgctactgcaaggggtacagaaatccgcagctacgggaacgatccatag

SEQ ID NO: 229676 - DNA, 2997 bp, Artificial Sequence
  Description of Artificial Sequence: Synthetic coding sequence
atggatgattggaagtcacggctggtgattaagtccatgcttcctcatttcgctatggtcgggaataggcaggagcctagaaagttgcaggaaagcggaaccgttaaacgcagacaagaagaagaccactttcagtttccagacatggccgatggtggctaccctaacaagattaagagaccctgcctggaggacgtgactttggccatgggacctggggcacatccgtccaccgcctgtgcagagctccaggtaccgcctctgactatcaatccttctccggctgctatgggggttgcaggccaatccctgctgcttgagaataaccctatgaatgggaatatcatgggatcgccttttgtagtaccccagactaccgaggttggcctcaagggcccaactgtgccatactatgaaaaaattaattctgtgcctgctgttgatcaggagctccaggagctgttggaggagctgacgaaaatccaggaccctagcccaaacgagctggatctggagaagatcctcggcaccaaaccagaggaaccactcgtgctggaccacccccaggctacactgagcacgaccccaaagccctctgtccagatgagccatttggaatcacttgcctcttctaaggagttcgcgagcagctgtagccaggtcaccggcatgtcacttcagatcccttcgtccagcaccggcatttcttattccatcccctcgacttcaaagcagatcgtttctccttcaagctccatggctcagtctaaaagtcaggtgcaggcgatgctgccagtcgctctaccccctctccctgtgccacagtggcatcatgcccaccagctgaaagctctggccgcatcaaagcagggctctgcaacaaaacagcagggccctacaccctcctggagtgggctcccgcctccaggtctgtcacccccatacaggccagtcccatcaccacaccctcccccactcccactccctcccccaccccctcctttttctccccaaagtcttatggtatcctgtatgtccagtaacactctatccggatctacactcaggggaagccccaacgcattactctccagtatgacaagctcatctaatgcagcccttggccctgccatgccctacgcaccggagaaactgccctcccctgctctgacccagcagccacaattcggcccacagtcaagcatcctcgccaacctcatgtcctctacaatcaagacaccccaagggcatctcatgtccgctctgccggctagcaacccgggacccagcccaccttataggcctgagaaactgtcatcccctggattgccacagcagagttttaccccccaatgcagcttgatccgaagcctgacacccacgtcaaatctgctttcacagcagcagcagcagcaacagcagcagcagcaggctaacgttatcttcaagcccatctctagcaactctagcaagaccctctcgatgatcatgcaacagggtatggcctcttcttcaccaggcgctacagagccattcacctttggtaacaccaagccacttagtcactttgttagcgaaccgggtccacagaaaatgccatctatgccaacgacctctcggcaaccctccctattgcattatctgcaacagccgacccctacgcaagcttcaagcgcaactgccagttcaaccgccacggcaacattgcagctgcagcaacagcagcagcaacagcagcaacagccagatcacagctcgttcctcctgcaacagatgatgcagcaaccccagcggttccagcgtagcgtggcaagcgatagcatgcctgcccttccacgacagcaagaggaacagcgcagtgggctgatggccatgacccccgaaaggcaaaatgcctatatcagccaacagatgagccccttcgaggctgttcaggaacaagtcacttctaagtgcagcagaatcaaggcttcacctccatccagcaagcacttgatgccccctaggactgggctgctccagaacaacctttctcccggtatgataccacttacacggcatcagtcctgcgagggaatgggggtaatatctccaaccctgggtaaaaggcagggcatcttcactagctccccacagtgtcccattctgtctcattccgggcagaccccgcttggacgtttagacagtgtttgtcagcatatgcagagcccaaaggctacacccccagaagtgcctttgcccggattttgtccaagctccctcggaacacagtccctgtccccacaccagttgcgcagaccatcagtccctagaatgcccacagcgttcaacaacgctgcctgggtgaccgccgctgctgcggtgaccacggccgtgtccggcaaaactccgctgagtcaggttgacaatagcgtgcaacaacactccccatcgggacaggcctgccttcagcgcccatctgattgggaagctcaggttccggctgccatgggaacccaggtgccactggccaacaatccatccttcagtctattggggtcgcagtcattgcgccagtctcccgttcagggccctgtgcctgtcgcgaacactacaaaattcctgcagcaaggaatggcctccttctcacctctgtctccgattcagggtatcgaaccaccgtcttacgtcgcagcagccgcaactgccgctgcagcaagtgcagtagctgcaagccaatttcctggtccctttgacagaacggacatccctcccgagctcccaccggcagactttctgagacagccgcagcccccacttaacgaccttattagctcccctgactgtaatgaagtggatttcatcgaggctctgctgaaggggtcatgcgtgtctcctgatgaggactgggtgtgtaacctgcgcctcattgacgatatcttggaacagcatgcggcagcccagaacgccacagcccagaactcaggacaggtcacccaggacgccggagcgctctag

SEQ ID NO: 229677 - DNA, 1941 bp, Artificial Sequence
  Description of Artificial Sequence: Synthetic coding sequence
atggaagaggaagatttgtcctttttgtacaagtcttcccccggacggaagcaccagggaacagtcaagcggcgacaagaggaggaccactttcagttcccggatatggcggacggtggatacccaaacaaaatcaaaagaccctgcctggaggatgttacccttgccatggggcctggggcacaccccagcaccgcttgtgccgaactgcaggtgccccctcttactataaatccttcccctgccgctatgggagtggcaggacaaagcttactgcttgaaaataaccccatgaacggcaatattatgggttctccattcgtggtacctcagacaacagaggtgggtctgaagggtcccaccgtcccctactacgagaagatcaacagtgtcccagccgtggaccaggaacttcaggaactgttagaggagctaacaaagattcaggacccatctccaaatgagctagatctcgaaaagatcctcggcactaagccggaagagcccttggtgttggatcatcctcaggcaacacttagtacaacgcctaagccatctgtccaaatgagccacctcgagtctctggcaagctctaaggaattcgcatcttcatgttcccaggtgacgggcatgagccttcagatcccctccagcagcacaggaatttcctactcaatcccgagcacttcaaagcaaattgtgagtccttcctcatctatggcccagtctaaatcccaggtccaggcaatgctcccggttgcactgcctcccctgcctgtgccccaatggcaccatgcccatcagctgaaggcgttggccgcttccaagcagggtagcgctacaaaacagcaaggccctaccccctcgtggtccggcctgccacctcccggtcttagtcctccctacagaccagtgccttcaccacatccacccccactgccactgccaccaccacctcccccttttagcccccaaagcctgatggtgtcctgtatgagtagcaacactctgagcgggagcacactgcgcggaagtcccaacgccctgctctcgtctatgacctccagctcaaatgctgccctgggcccagccatgccatatgccccagagaaactaccatcgccagccctgacccagcagcctcaattcggacctcagagtagcatcttagctaatctgatgtcttcaacaataaaaacaccgcaaggacatctcatgtctgctttacccgcttcaaacccaggtccctctccaccatatcggccagagaaactgtccagccctggactgccccaacaaagcttcacgccgcagtgtagcctgttacattatctgcagcagccaacacctacccaggcctccagcgctacagcttctagtactgctaccgcaacactgcagctgcaacagcagcagcagcagcagcagcaacagcccgaccattcctccttcttgctccagcagatgatgcagcagcctcagaggttccagcgaagcgtagctagtgatagtatgcctgccctcccacgccagggctgttgccacctctttgcatggacatcagcagcgtcatcagttaagcctcagcatcagcatggaaactctttcacatcacgtcaggacccccaacccggtgatgtctccccaagcaacattacccacgtcgacaaggcctgcaagttgggggaggccaggcacccccaggtgagcctggggaggcagcccccaagttgccaggctctaggcagcgaatctttccttccaggttccagttttgcccacgaattggctcgcgtgacctccagctactctacctcagaagcagccccttggggttcctgggaccccaaggcttggcgccaggttcctgctcccttactgccgtcttgcgacgccacggctagggggaccgagattagaagctatggaaatgatccatag

SEQ ID NO: 229678 - DNA, 645 bp, Artificial Sequence
  Description of Artificial Sequence: Synthetic coding sequence
atgattatgcagcagggaatggcctcgtcgagtccgggagctacagagccatttaccttcggtaacactaagccactgagtcacttcgtaagtgaacctggcccacagaagatgcctagcatgccaacaacctccaggcagccgtctctgctgcactaccttcagcagccgacacccacacaggcttcatccgccactgcctcatctacagctacggcaactttgcagttgcaacagcaacagcagcagcagcaacaacagcctgatcacagcagctttctcctgcaacaaatgatgcagcagcctcagagatttcagcgatctgtggctagcgatagcatgcccgctctcccgcgtcagactcacgtagacaaagcctgcaaattaggggaagccagacacccacaagtaagtctggggaggcagcccccatcatgccaggctctgggaagcgagagctttctgcccggatctagcttcgctcacgagctagctcgcgtcacaagcagctattcgacatctgaggctgcgccttggggttcatgggatcccaaagcttggcgccaggtgcccgcacccttgctgccgagttgcgatgccacagccagaggcaccgaaatcaggtcatatggcaatgatccgtag

SEQ ID NO: 229679 - DNA, 1956 bp, Artificial Sequence
  Description of Artificial Sequence: Synthetic coding sequence
atgaaggattacgacgagttgttgaagtattacgaacttcatgagactatcggcactggcggattcgccaaagtgaaactggcctgtcacatcttgactggcgagatggtggctatcaagatcatggataaaaacactcttggcagtgatctgccaaggattaagactgaaatcgaggccctgaagaatttgcggcaccaacatatttgccagttgtatcacgtccttgaaaccgctaacaaaatatttatggttttggagtactgtccaggcggtgaactgttcgattacatcatcagccaggaccgactcagtgaagaggaaacccgcgtggtcttccgccagatcgtcagcgcagtggcttatgttcatagccagggatacgcccaccgcgacttgaaaccagaaaacctccttttcgatgaataccacaaacttaagctgatcgacttcggcctgtgcgctaaacccaaagggaataaggattaccatcttcagacttgttgcggatccctggcctacgctgccccagagctgatccagggaaaatcatatctgggtagcgaagccgatgtgtggagcatgggcatcttgctctatgtgctgatgtgtggctttctgccctttgatgacgataacgtgatggccctgtataaaaagatcatgcgcggtaagtatgacgtcccaaagtggctgtctccctcctctattctgttactccaacaaatgcttcaagtggaccccaagaagcgcatatcgatgaagaatcttcttaaccacccctggattatgcaggattacaattatcctgtcgagtggcagtctaaaaatccttttattcaccttgatgatgattgcgtgaccgaattgtcagtgcatcataggaataacagacagacgatggaagacctgattagcctctggcagtacgatcacctcaccgccacatatctgctgctcctcgctaaaaaagccagaggcaagccagtgcgcctgcggctgtcatccttcagttgcggccaggcttccgccacaccttttacagacataaagtcaaataattggtccctggaggacgttacagccagcgacaaaaactacgtcgccggactaatcgattacgactggtgtgaagatgatttgagtacaggcgctgccactcccaggacatctcagttcaccaagtattggaccgagagtaacggagtcgagagtaagtcgcttactcccgcactgtgtcgaactccagccaacaagcttaaaaataaagagaacgtgtatacacctaaaagcgccgtcaaaaatgaggagtacttcatgtttcccgaaccaaagactccagtgaacaagaaccagcataagcgcgaaatacttaccacccctaacagatatactaccccatctaaagctcgtaatcaatgtctcaaagaaactccaattaaaataccagttaacagcaccggaacagataagctgatgactggagttatctccccagagcggaggtgcagatctgtggaacttgatctcaaccaggctcacatggaggagacccccaagcggaagggcgcaaaagtctttggctccctggagcgtggtttggacaaggttatcaccgtactgactcgaagtaagagaaaaggcagcgccagagacggacccagacgtcttaaactgcactataatgtaaccaccaccaggcttgtcaacccggaccagttgctgaatgagattatgagcattctacccaaaaagcatgtggacttcgttcagaagggatataccttgaaatgtcagactcagagtgatttcggtaaggtaactatgcagtttgagctggaggtgtgtcagttgcaaaaacccgacgtggtcgggataagaaggcagagattgaaaggcgatgcctgggtgtacaagaggctcgtggaggatatactgagctcctgcaaagtgtag

SEQ ID NO: 229680 - DNA, 1743 bp, Artificial Sequence
  Description of Artificial Sequence: Synthetic coding sequence
atgatgaatttctcaaatatcatgaactatatgaaacttttaggccaatattgcccaggtggtgagctgtttgactacattataagtcaggatcgtctgagcgaagaggaaacaagggtagtcttccggcagatagtttcagcagtggcctacgtacactcacagggctatgcacatagggatctaaaaccagaaaacctcctgttcgatgagtatcacaagctaaaactgatcgactttggcctgtgtgcaaaacctaaagggaacaaggattatcacttgcagacctgttgcggctccctggcttacgcagcccctgagttaatccaggggaagtcctatctgggaagcgaagctgacgtgtggtccatgggcatcctgttatatgttctcatgtgcggattcttaccattcgatgatgacaatgtgatggctctgtataagaagattatgcgcggtaaatatgacgtccctaaatggttgtcaccatccagtatattgctgttgcagcagatgctgcaggtcgaccctaaaaagagaatcagtatgaagaacctactgaatcacccctggatcatgcaggactacaactaccctgtggaatggcagagcaagaaccccttcatacacctcgacgatgattgtgtgactgaacttagtgtccaccaccgcaacaatcgccagaccatggaggacctgatttctctgtggcaatatgaccatctcacagccacatatcttctgctcttggccaagaaagcacgcggtaagcctgtccgcctccggctctcaagctttagttgcgggcaggcctcggccaccccttttactgacatcaagtccaacaactggagccttgaggatgtgactgcatcagataaaaactatgtggctggactcatcgattatgactggtgcgaagatgacctttcaactggggctgccactccaaggactagccagtttacaaagtactggaccgagagcaatggcgtcgaatctaaaagcttgactcctgctttatgccgtacaccagctaacaagctgaagaacaaggagaacgtatatacccctaaatctgccgtgaaaaatgaagagtacttcatgttccccgaaccaaaaaccccggttaataagaaccagcacaagcgggagatcctcacaactcctaatagatacacaacccccagcaaggccaggaatcaatgcctgaaggagacccctatcaagatccccgtgaatagcactggcactgataagctgatgaccggtgtgatatcgccagaaaggcgttgccgcagtgtggaactcgatcttaaccaggctcatatggaagaaacaccaaagcgtaagggcgctaaggtgtttgggtccctggaacggggtcttgacaaagtcattaccgttctgaccagatctaaaagaaagggctctgctagggatggcccacgcaggttgaaattgcattacaacgttacaacgacccgactggttaatccagatcagctcctgaatgagattatgtctatccttccaaagaagcatgttgactttgtgcagaagggatataccctgaaatgccagacccagagcgactttgggaaagtgactatgcagtttgaactggaagtgtgccagcttcagaagcccgatgttgtcggcatcagacgccagagactgaaaggagacgcgtgggtttacaagaggctggtggaagatattcttagctcatgcaaggtgtag

SEQ ID NO: 229681 - DNA, 1812 bp, Artificial Sequence
  Description of Artificial Sequence: Synthetic coding sequence
atgaaggactacgatgagctgctgaagtactacgagctgcacgaaacaattggcaccggcggattcgctaaggtcaagcttgcgtgtcatatccttacgggggagatggtggccatcaagattatggataaaaacacgctgggctctgaccttcctaggataaaaaccgaaatcgaggcactaaagaatctaaggcatcagcacatctgccagctgtatcacgtcttggaaaccgccaataaaattttcatggtgcttgaagaaaacctgttgttcgacgagtatcacaaattgaaactgatagatttcggcctgtgtgcgaagcccaaggggaacaaggattatcatctgcaaacctgttgtggctctctggcctatgccgctcctgaattgatccagggtaagtcatatctgggctcagaggccgacgtctggtctatgggcatcctcttgtatgttctgatgtgtggatttctgcccttcgatgatgataatgtcatggctctgtacaagaagataatgcgaggaaaatatgatgtcccgaaatggctatcaccctcctccatcttattgcttcaacaaatgctgcaggtggatccaaaaaagagaatttctatgaaaaatttactgaaccacccctggataatgcaagattacaattaccccgtagaatggcagtcaaagaacccattcatacatctggacgatgattgtgtcactgagttgagcgtgcaccacagaaataacaggcagaccatggaagatctgattagcctgtggcagtacgaccatcttactgcaacttacctgctgctgctggcaaagaaggccagagggaaacccgtgaggcttagactgagtagtttttcctgtggacaggcctcggcaacgccttttaccgatattaagagcaacaactggtctctcgaggacgtgacagcgtcagacaagaactatgtggcaggtttgatagactatgattggtgcgaggatgatctgagtacaggcgctgctacacccaggacatctcaatttaccaagtactggactgaatctaacggggtggagagtaaaagcctgacacccgctttgtgccgtactcctgccaataagctgaaaaacaaggaaaatgtctacacgccaaagagcgccgtgaaaaatgaagaatacttcatgtttcccgaacctaaaacacctgttaacaagaatcagcacaagagagaaattctgactactccaaaccgctatacaacgccatcaaaggcccgtaatcagtgcctcaaagaaacccccatcaagattcctgtcaactcaacgggtactgacaagcttatgacgggcgtgattagtcccgaacgacgatgccgcagcgtcgagttggaccttaatcaggcccacatggaggagaccccgaagaggaaaggcgcaaaggtcttcggttctttggaacggggattggacaaagttataactgtgttgacccggagtaagcgcaagggaagcgcaagggatggccctaggaggctcaaactccactacaatgtaaccaccacacgccttgtgaatcctgaccagctgctgaatgagattatgagcatcttgcctaaaaagcacgtggatttcgtgcaaaagggttacacactgaaatgccagacacagagcgactttggaaaagtcaccatgcagttcgagttggaagtttgccagctgcagaagccggacgtagttggaatccgacgccagcgactcaagggtgatgcatgggtctacaagcgtctggtggaggacatcctctcaagctgtaaagtgtag

SEQ ID NO: 229682 - DNA, 1563 bp, Artificial Sequence
  Description of Artificial Sequence: Synthetic coding sequence
atggtgctcgaagagaatttgctgttcgacgaatatcacaagcttaaactgatagactttggtctctgcgctaagcccaaaggaaacaaggactaccaccttcagacttgctgtggctctctggcttatgcagctcctgagctcatccaggggaagtcctaccttggttccgaggcggacgtgtggtccatgggcattctgctgtatgtgctgatgtgcggttttctcccatttgatgatgataatgtgatggccctctacaagaaaatcatgaggggaaagtatgacgttccgaagtggctctccccttcctctatattacttttgcaacagatgctgcaggtggaccccaaaaagcgtatttcgatgaagaatctgcttaaccacccctggattatgcaggactacaactaccctgtagagtggcagagtaagaacccgttcatccatctggacgacgattgtgtaactgaactatcagtgcaccaccgcaacaatcggcagactatggaagatctgatctccctgtggcagtacgaccacctgacagccacgtacttgctcctgctagccaaaaaggcccgtggaaagccagtacgactgcgcctgtctagtttctcgtgtggccaggcttctgccactccgttcaccgacataaaaagcaacaattggtcactagaagacgtgactgccagtgataagaactatgtggctggcctgattgattacgattggtgtgaagacgatctgtcgacgggagcagccacccccaggacctcccagttcacaaagtactggacagagtcgaacggcgtggaatctaagtctttaacacctgcactgtgcagaaccccagccaataagctgaagaacaaagaaaatgtgtacacgcccaagtccgccgtgaaaaacgaagaatactttatgttccccgaacctaaaacgccagtgaataaaaatcagcacaaaagggagattttaacaacacccaatagatacacaactccctccaaagcccgaaaccagtgcttgaaggagactcctatcaaaattcctgtcaattcgactggaacagataagctcatgaccggggtgatcagtcccgagcgaagatgcaggtctgtagaattggacctgaatcaggcccacatggaagaaacccccaagagaaaaggcgctaaagtgttcggcagcttggaacgcggactcgacaaagtgatcaccgtactcacaaggtccaagaggaaaggtagcgccagggacggcccacgcagactcaaacttcactataacgtgaccaccactcggctcgtgaatccagaccagttgctgaacgagataatgtctatcttaccaaagaagcacgtggactttgtgcagaaaggctacactttgaaatgccagactcaatcagattttgggaaggtgacgatgcaattcgaactggaggtgtgtcaactccaaaagccagacgtggtgggaatccgtcgacagcggttgaagggcgacgcatgggtatacaagaggctggttgaggacatcctgtccagctgcaaagtctag

SEQ ID NO: 229683 - DNA, 1374 bp, Artificial Sequence
  Description of Artificial Sequence: Synthetic coding sequence
atgggcatcctcctgtacgtcctaatgtgcggcttcctgcccttcgatgacgacaacgttatggctctgtacaaaaaaatcatgcgcggaaaatatgacgtgccaaaatggctgagcccttcttccattctgcttctgcagcaaatgctgcaggttgatccaaagaagagaatctcaatgaaaaatctgttgaaccatccttggattatgcaggattataattaccctgtggaatggcaatctaaaaaccctttcattcacctggacgatgattgtgtgaccgaactgtctgtgcaccaccgtaataataggcagaccatggaggacctaatttcgttgtggcagtatgaccatctgaccgctacttaccttcttctactggccaaaaaagctagaggaaagcccgtgcggctacgactatcaagctttagctgcgggcaagccagtgccactccctttaccgatatcaagtctaacaattggagccttgaagacgtgaccgcctcagacaaaaattacgtggctgggctgatcgactatgattggtgtgaagacgaccttagtacaggcgctgccacccccaggacctctcaattcaccaagtactggacagaaagcaacggcgtagagtctaagtctcttaccccagccttatgtagaactcccgctaataagctcaaaaacaaagagaacgtttacacacccaagtctgccgttaagaacgaagagtatttcatgtttccagagcccaaaacgccggtaaacaaaaatcagcataaacgagagattctgactacacctaaccgatacacaacccccagcaaggctcgcaaccagtgcctgaaggagactcccatcaagataccagtcaacagcacaggaaccgacaagttgatgaccggggtgattagcccagagcgcagatgcagatccgtcgagttggatcttaaccaggctcatatggaagaaacgccgaagcgtaaaggcgctaaagtattcggctctctagaacgcggactcgataaggtgattacagttctgactcgttctaaaagaaaaggatctgcacgcgacggcccacgacgcttgaagctccattataatgtgaccacaaccagactggtcaaccccgatcagttgttaaatgaaattatgagtatcctcccaaaaaagcatgtggactttgtccaaaagggttatacgctcaagtgtcaaacccagtcagactttgggaaagtgaccatgcaattcgagcttgaggtctgtcagctccagaagccggacgtggtcgggattcgcagacagcgactgaaaggcgatgcctgggtctataagcgcctagttgaggatatcttatcttcatgcaaggtgtag

SEQ ID NO: 229684 - DNA, 1833 bp, Artificial Sequence
  Description of Artificial Sequence: Synthetic coding sequence
atgaaggattatgatgagttactgaagtactatgaactgcacgaaacgattgggactgggggattcgcaaaagttaaactagcgtgccacatcttgacgggggagatggtcgctataaagatcatggacaagaatacgcttggttccgacctgcctcgaatcaaaaccgagatcgaggccctcaaaaatttgcgccaccagcacatctgtcagttgtaccacgtcctggaaactgctaataagatctttatggttctcgagtactgcccgggaggggaattattcgactacattatttcgcaagacaggctgtcagaagaagagactagggtggtcttcaggcagattgtgagtgcagtggcgtacgtgcactcgcagggctacgctcatcgagacctgaaacccgagaacctgctcttcgacgagtatcacaaactcaaactgattgatttcggcctttgcgcaaagcctaagggtaacaaggactatcacctgcaaacatgctgcggtagcctggcctacgccgcaccagaactaattcagggaaaaagctatttgggatctgaagcggacgtgtggtcaatgggtattctactctacgtgctaatgtgcggttttctgccattcgatgacgacaacgttatggccctgtacaagaaaattatgcgcggtaaatacgacgtgcctaagtggctttccccttcctcgatccttctgcttcagcagatgctccaggttgacccgaagaaaagaatcagcatgaaaaacttgctgaatcacccttggatcatgcaggattacaactaccccgtggagtggcagagcaagaatccatttatccatctggatgacgactgtgtaacagagctgagcgtgcaccacaggaataatagacagacgatggaagatttgattagcctgtggcagtatgatcacctgacagcaacttatttgcttctgctggccaaaaaagccagggggaagcccgtgcggcttcggctctcgtccttctcttgcggccaggctagcgccacccctttcaccgatatcaagtttaccaaatactggaccgagagcaatggggtggaaagcaagtcccttacccctgccctgtgtaggactcctgctaataagctgaagaacaaagagaatgtgtatacgcctaagagcgctgtaaagaacgaggagtatttcatgttccctgaacccaaaaccccagttaacaaaaaccagcataagagggagattcttactacacctaacagatacacaactcccagcaaggctcggaatcagtgcctgaaggagacaccaataaaaattcccgtgaattctactggcaccgacaaactgatgacgggtgttattagtcccgagcggaggtgcagatctgtagagctcgacctgaaccaggcccatatggaagagacacctaagcggaaaggggcaaaggtcttcggaagccttgagcgtggcctggacaaggtgatcacagtgctcactaggagcaagagaaagggaagcgctagagacggcccacgacgactgaaacttcactataacgtcaccacgacgcgcttagtaaacccggaccagctgttaaacgaaatcatgtctattcttcccaaaaagcacgtagactttgtgcagaaggggtacaccctgaaatgccagacccagtccgattttggaaaggtcactatgcagttcgagttagaggtgtgccagctccagaaaccagatgtcgtaggtatacgtcggcagaggctgaaaggcgatgcttgggtttataagcgactggttgaagacatcctctcaagctgcaaagtttag

SEQ ID NO: 229685 - DNA, 1860 bp, Artificial Sequence
  Description of Artificial Sequence: Synthetic coding sequence
atgatgaatttcagtaacatcatgaactatatgaagctcttgggccaaagcgacctgcccagaatcaaaactgaaatcgaagccctcaagaacctcagacaccagcatatctgccagttgtatcacgtcctagagacggccaacaaaattttcatggtgctcgaatattgccctggtggggaactgttcgattatatcatctcacaggatagactgagtgaagaagagacgagagtggtgtttaggcaaatagtcagcgccgtcgcctacgttcacagccaggggtatgcccacagagacttgaagccggagaacctgctgtttgacgagtatcacaagctgaaactaatcgattttggtttatgtgctaaacccaaaggtaataaagattaccacctgcagacctgttgcggctccctggcttacgctgcacccgaacttattcagggcaagagctatttaggaagcgaggccgacgtctggagcatggggatactgttgtacgtattaatgtgtggcttcttacccttcgatgacgataatgtcatggctctgtacaaaaaaatcatgagggggaaatacgacgtgccaaaatggctttctccgagcagcattttgcttctgcagcagatgcttcaggtggaccctaagaaaagaataagtatgaaaaatttgctgaatcacccttggataatgcaggattacaactaccctgtggaatggcagtctaaaaatcctttcattcacctggacgacgattgtgttacggagctgtccgtgcatcatagaaataaccggcagaccatggaagacctgatttcattgtggcagtatgatcacctgactgctacctatctgctgctgttggctaagaaggcccgtggcaaacctgtcagattacggctgagttcttttagctgtgggcaggcctccgcgacaccatttaccgatataaagagcaacaattggagtttagaagatgtcacagccagcgacaagaactacgtcgccggtctcattgattacgattggtgtgaggacgacctgagcaccggggcagctactccacggacatcccagtttaccaaatactggacagagtctaacggggtggaatccaaaagcctcacccctgctctgtgtaggacgccagccaacaagcttaagaacaaagagaacgtctacaccccaaagagcgctgtgaaaaacgaagagtatttcatgttcccagaacccaagaccccagtcaacaaaaatcagcacaagagggaaatcctaacaacaccgaacaggtataccacacccagtaaagctcgcaatcagtgtttaaaggaaacaccaatcaagattccagttaactcgactgggacagacaaactcatgactggcgtgataagcccagagcgtaggtgtagaagcgtggagcttgatttaaaccaggcccacatggaagagactcctaaacggaagggtgcgaaggtgtttggatccctcgaaagaggactggacaaggtgatcactgtactcaccaggtctaagcggaaaggttctgccagggacggccctagacgtttaaaacttcattataatgtgacaaccacaagattggttaacccggatcagctgttaaacgagattatgtcaattttgccgaaaaaacatgttgactttgtgcagaagggctacactctgaagtgccagacacagagcgattttggaaaagtcaccatgcagtttgaactcgaggtctgccagttacaaaagcctgatgtggtcggaattagacgccagcgccttaaaggggacgcttgggtgtataagaggctcgtcgaagacattttgtcatcttgtaaggtatag

SEQ ID NO: 229686 - DNA, 1743 bp, Artificial Sequence
  Description of Artificial Sequence: Synthetic coding sequence
atgaaagattacgatgagcttctaaagtattatgagctgcatgaaaccatcgggacaggaggtttcgccaaagtgaaacttgcatgccatatactgacgggtgaaatggtggccatcaagatcatggataagaatactctgggctctgaccttccccgaatcaagacagagattgaagccttgaaaaacctgcgacatcaacatatctgtcagctttaccacgttctggaaactgccaacaagatttttatggtccttgaaggcaacaaggattatcatttacagacctgttgcggatctcttgcatacgctgctcctgagctgatacaggggaagagttacctggggtctgaggctgatgtttggtcaatgggcattttactttacgttctcatgtgcggttttctcccatttgatgacgataacgttatggccctgtacaaaaagataatgcggggtaagtacgatgtccctaaatggctcagcccgagtagcatcctgctgcttcaacagatgctacaggttgacccaaaaaagagaatctctatgaagaacttgctgaatcacccttggattatgcaggattataattaccccgtagaatggcagagcaagaatcctttcatccacctggatgacgattgtgttactgagctttccgttcaccataggaataataggcaaacgatggaggatttgatctctctatggcagtatgatcacctaaccgccacataccttctgctgctcgcgaaaaaggctaggggtaaacccgtcagactccgtctatcatccttctcctgcggccaggcttcagccacgcctttcacagatattaagagcaacaattggagtctggaagatgtgaccgcctctgataagaactatgtggccggactgattgactatgactggtgtgaagacgacctgagtacgggtgccgcaacccctcgaactagccaatttacaaagtattggaccgagtccaacggcgtcgagtcaaaaagtttaacccccgctctctgtcgcacccccgctaacaaactgaagaataaagagaacgtgtacacgccgaagtctgcggttaagaacgaggaatactttatgtttcccgagcctaagacaccggtgaacaagaatcagcataagagagagatcctcacgacgccaaaccgctacaccacaccgtcaaaagcgagaaaccagtgtcttaaggaaacccccattaaaattcccgtgaattccactgggaccgataaactcatgacgggcgttataagtccagaacggcgatgtcgatctgttgagctagaccttaaccaggcacacatggaggaaacacctaaacgaaaaggagccaaggttttcggctcactcgaaaggggcctggacaaagtaataaccgttctgacgaggagcaaacgcaagggatccgctcgggatggaccacgacggcttaaactccactacaacgtaacaacaacccggctagtcaaccctgatcagttgttgaacgaaataatgagcattctccctaaaaagcacgtggacttcgttcagaagggctacacacttaagtgtcaaacacagagcgatttcggaaaggtgaccatgcagtttgagctggaagtgtgccagctccagaaacctgatgtcgttgggatccggaggcaaaggctgaagggtgacgcgtgggtgtataagcgcctcgtagaagacatattgtcctcttgcaaggtgtag

SEQ ID NO: 229687 - DNA, 1491 bp, Artificial Sequence
  Description of Artificial Sequence: Synthetic coding sequence
atgcgagttctgtctggaaccagtctgatgctgtgtagcctcctgctcctcttacaggcattgtgttctcctggactggcccctcagtcccgcggtcatctttgtcgaacccggccaactgatctggttttcgtggtggactcatctagaagcgtccgtccagtcgagtttgaaaaggtaaaggttttcctcagccaagttatagagtcccttgacgtcggcccaaatgcaactcgggttggaatggtaaattatgccagcactgtaaaacaggaattctctctgcgggctcatgtctccaaagcagccctgctacaggccgtgcggaggattcaaccactgagcactgggaccatgactggtttggcaatacagtttgctatcaccaaggcctttggcgatgcagagggtggcagatcccggagcccagatatctcgaaggtggttatcgttgtcactgatgggaggccccaggactccgtacaggatgtgtccgcaagggccagggcttctggagtggagcttttcgctatcggggtgggatctgtcgacaaggctacactgaggcagatcgcttcagagccccaggacgaacacgttgattatgtagagtcgtactcggtgatcgagaagctgtccagaaagttccaggaggccttttgtgtcgtgagcgatttgtgcgcaaccggcgaccacgattgtgaacaagtttgtatatcttcccccggttcgtacacctgtgcctgccacgaaggctttaccctcaattccgacggcaaaacatgtaatgtgtgtagtggtgggggaggtagcagcgcgaccgacctcgttttcctcattgacggctcaaagagcgttagacctgagaacttcgaactggtgaagaaattcatcagccagatcgtcgacacccttgatgtgtcggataagctggctcaggtggggctggtgcaatattcgtcctccgtcagacaggaattccctctgggtagatttcacacaaaaaaggatataaaggcagctgtccggaatatgagctatatggagaagggcactatgaccggggctgccttgaaatacttaattgacaactcctttactgtttcaagtggtgctcgcccaggggcacagaaggttgggatcgtcttcaccgacgggagaagtcaagattatatcaacgacgccgctaagaaggccaaagacctgggatttaaaatgttcgctgtgggtgtaggtaacgctgtggaagacgaactccgggaaatagctagcgagccggtggcagagcactatttctataccgcggatttcaagactataaatcagatcggtaaaaaactgcaaaagaaaatctgcgtcgaagaggacccctgcgcctgcgaatcccttgtgaagttccaggcaaaggtggagggccttttacaggcacttaccagaaagctggaagccgtttctaaaagattggcaatcttagaaaacactgtggtctag

SEQ ID NO: 229688 - DNA, 2874 bp, Artificial Sequence
  Description of Artificial Sequence: Synthetic coding sequence
atggagaagatgctggccggatgtttcctgttgatactgggacagattgtgctgttgccagccgaggccagagagcgttctcggggaaggtctatttcccggggacggcatgcacgcacccacccccaaacagctctgctggaatcgagctgtgagaataaaagagctgatctggtgttcatcattgattctagtcgcagcgtgaacacccacgactatgcaaaggtcaaagagttcattgtggatatactgcagtttctagacattggcccagacgttacacgcgtaggcctgttacaatatggaagtactgtgaaaaacgagttttctctgaagacgttcaaaaggaagagtgaagtcgagagggccgtgaaacgcatgaggcatctttccacaggaactatgaccggattggctattcagtatgctttgaatatcgctttttctgaagccgaaggagccagacctttgcgcgagaacgtccctcgggttataatgattgttacggatggcaggccgcaggattctgtggccgaggtggccgcaaaagcgcgtgacaccggcattttgatctttgccatcggcgtgggacaggttgactttaatacgctgaaaagtattggatcagagcctcacgaggatcatgtcttcctagttgcgaacttctcccaaattgagactctgacttcggtgtttcaaaagaagctgtgcactgcccatatgtgttcaactcttgaacataattgcgcacacttctgtattaatatcccgggaagctacgtttgtcgttgcaagcagggttatatcttgaattcagatcaaacaacatgccgaatccaggacctgtgcgcgatggaggaccacaattgcgagcagttgtgcgtgaatgtaccaggctccttcgtctgccaatgctattccggttacgccttggcagaagacgggaagcgatgcgtggccgtggactactgcgcctccgaaaatcacggatgtgaacacgagtgcgtaaacgctgatggctcgtacctgtgtcaatgtcatgagggtttcgcgctcaatccagacaagaagacatgtactaagatcgactactgcgcctcttcaaaccatggatgccagcacgagtgcgtcaacaccgatgattcttactcatgccattgcctgaagggctttaccctgaacccggacaagaagacttgtcgccgaataaattactgtgcattaaacaagccaggctgtgagcacgaatgcgtaaatatggaggaatcttattactgtcggtgtcatcggggatatacgttggatcctaacggaaaaacttgcagcagggttgatcactgtgcccagcaggatcacggatgtgagcagttgtgcctgaacaccgaagacagtttcgtatgccagtgttccgagggattcctgattaatgaggatctgaagacgtgcagtagggttgattattgtctactcagcgatcacggttgcgagtacagttgcgttaacatggaccggagtttcgcatgccagtgtccggaaggacatgtccttcggagcgacggtaaaacttgcgctaaactggattcctgtgcgctgggggatcacggatgcgaacactcatgcgtgtcaagcgaggactccttcgtgtgtcaatgtttcgaagggtatattctccgcgaggacggcaagacctgcagaagaaaggatgtgtgccaagctatcgaccacggctgtgagcacatctgtgtgaacagcgatgacagctatacctgtgaatgcctggagggattccggctagctgaggatggtaagagatgccgacggaaagatgtctgtaagagtactcaccacggctgcgaacatatctgtgtgaacaatgggaactcctacatttgcaaatgttccgagggcttcgtgctggccgaagacggccgacgttgcaaaaagtgtactgagggtcctattgacctggttttcgtgatcgatggctccaagtccttaggcgaagagaattttgaggtggtgaaacagttcgtgactggaatcatcgattcgctgacaattagccccaaggctgccagagtggggctgttacagtatagcactcaggtacacacagaattcacactgcggaatttcaatagcgcaaaagacatgaagaaggccgtcgcccatatgaaatatatgggaaagggcagcatgaccgggttagccctgaagcacatgttcgagagaagcttcacccaaggtgagggtgctagacccctatccacacgtgtcccgagggccgctatcgtgttcactgacggcagggcccaggacgatgtttctgagtgggcctccaaagcaaaggcaaacggaataacaatgtacgccgtcggggtgggaaaggcaattgaggaagaattgcaggagatcgcctccgaaccaaccaataaacatctgttttacgcggaagatttcagtacaatggacgagatctctgaaaagttgaaaaagggcatctgcgaggccttagaggacagtgatgggcgacaggattcacccgctggggaactgcccaaaacagtccaacagccgactgaatctgaacctgttacgattaatatacaggacctcctatcctgctccaattttgccgtccagcacagatatctgttcgaggaagataatctgcttagaagcactcagaagctaagtcacagcacaaaaccgagcggctctcctctcgaggagaaacacgaccagtgcaagtgcgaaaacttgattatgtttcagaaccttgcaaatgaggaagtgcgtaaacttacccagcgcctgctggaggagatgacccagaggatggaagccttggagaatagacttcgttacagatag

SEQ ID NO: 229689 - DNA, 2754 bp, Artificial Sequence
  Description of Artificial Sequence: Synthetic coding sequence
atggaaaagatgctggccggttgctttctactcatactgggacaaatagtactgttaccagctgaagctagggaaagaagccgcggacgaagcatttccagaggcagacacgccagaactcatccccagacggctctgctggagtcttcctgcgagaacaagagagctgatttagtgttcataatcgacagctctagatccgttaacacacatgattacgctaaggtcaaagaatttatagttgatatactgcagttcttggacataggccctgacgtcactcgtgtagggctgctccaatacggctctacagtgaagaatgaatttagtctcaagacatttaaacggaaatctgaggtggagcgcgctgtcaagaggatgcggcatttgtctacgggcaccatgaccggattggccatacagtatgcgctcaatatcgccttctcagaggctgagggggctcgtccattaagagagaatgtgcctcgggttatcatgatcgtcacagacggcagaccccaggatagcgtggctgaagttgcagccaaagccagggatacaggcatactgattttcgccatcggagtcggccaagtggacttcaatacactgaaatccattggcagcgaaccccatgaggatcacgtctttctagtggccaacttcagccagattgaaactctgacgtccgtgttccagaagaagttatgtactgcccacatgtgtagtacactggaacacaattgtgcacatttctgcattaacatcccagggagctatgtgtgtcgctgcaaacagggttacattctgaatagcgaccagactacgtgtagaattcaagatctttgtgcaatggaggatcataattgcgaacagctgtgtgtgaacgtgcctggctctttcgtctgtcagtgctattccgggtatgctctggccgaagatgggaaacgatgcgtcgcagtcgactattgtgctagtgaaaaccatggctgcgagcatgagtgcgtgaatgccgacggcagctatctgtgccagtgtcacgaaggattcgccctcaatcctgacaaaaaaacgtgcacgagaatcaattattgcgcgttaaataagcctggatgtgagcacgaatgtgtcaatatggaagagagttattactgccggtgccacagaggatacacccttgatcccaatggaaagacctgttccagggtggaccattgcgctcagcaggaccatggctgtgaacaactgtgcctgaacacggaggatagttttgtctgccaatgttcagagggttttctcatcaatgaggacttgaagacgtgctcccgggtcgactactgtctgctttccgatcacgggtgcgagtactcctgcgtcaacatggataggagtttcgcctgccaatgccccgaaggtcatgttctccgatcagatggcaagacatgtgccaagctcgactcgtgcgccctaggcgaccacggttgcgagcacagctgtgtcagctcagaggactctttcgtgtgtcaatgttttgagggctacatcctgcgggaggacggtaagacctgtcggagaaaggatgtgtgtcaggccattgatcacggctgcgagcacatctgtgtgaattcagacgactcatatacatgcgaatgtcttgaggggtttcggttggctgaggacggcaagcgctgcaggaggaaagatgtctgcaaatctactcaccacggctgtgaacacatatgcgtgaacaatgggaactcatatatctgtaaatgcagcgagggctttgtgttggccgaagacggccgaaggtgtaaaaaatgcactgaagggcctatcgacctggtgtttgtgatcgacggtagcaagagtttgggcgaggaaaattttgaggttgtgaagcaatttgtgaccggaatcatcgacagcctgaccatctcaccaaaggctgctagagtgggcctcttacaatacagtacccaggtacacactgagtttaccctacgcaatttcaactccgccaaagacatgaaaaaggccgtggcccacatgaagtacatggggaagggtagcatgacaggacttgccttgaaacacatgtttgaacggagcttcactcaaggggagggcgctcgccctctgtccactagagtgccacgcgctgccatagtcttcaccgatggccgagcccaggatgatgtctccgagtgggcatcaaaagctaaggcgaacggaatcaccatgtatgccgtcggagtcgggaaggcaatcgaagaggagttgcaggaaatagcctcggagccgactaacaagcatttgttttacgcagaggatttctcaaccatggacgagatatctgaaaagctgaagaaaggtatttgtgaggctttggaggattcagacggacgccaggacagcccagcgggagaattgcccaagaccgtgcagcagcctaccgaatccgaacccgtgactatcaatattcaagaccttttgtcatgcagcaacttcgctgtgcagcatcgttacctcttcgaggaggataaccttctgcgttcaacacagaaactcagccattccactaagccttccggctcccccctggaggaaaagcatgaccaatgcaaatgcgagaacttgataatgtttcagaatctcgcgaacgaggaggtgaggaagctcactcagaggtatttattggaggagatgactcagagaatggaagctctggaaaacagattgcgatacagatag

SEQ ID NO: 229690 - DNA, 348 bp, Artificial Sequence
  Description of Artificial Sequence: Synthetic coding sequence
atggaggatcacaattgtgagcagctttgcgttaacgtcccaggatcattcgtatgccagtgctattctggctatgccctggcggaagatggaaaaaggtgcgtggcagtggattattgcgcctcagaaaaccacggatgcgaacacgagtgtgtgaatgctgacgggagctacctgtgtcagtgtcatgagggatttgctctgaacccagataagaaaacctgtaccaagattgattactgcgcaagctccaatcacggatgtcaacatgagtgtgtcaataccgacgattcatattcgtgccactgcctcaagggcttcactctgaacccagacaagaagacatag

SEQ ID NO: 229691 - DNA, 2871 bp, Artificial Sequence
  Description of Artificial Sequence: Synthetic coding sequence
atggagaagatgcttgccggatgttttctgctcattctagggcagattgtgctcctgcccgcagaagccagggaaaggagcaggggccgatctataagtaggggcaggcatgccaggacccatccacagactgcactgctggagtcttcctgcgaaaacaagcgagccgacctggtcttcatcattgatagttctagaagcgtcaatactcacgattatgcaaaagtcaaagagttcatcgtggacatccttcagttcttggatattggccctgacgtgacaagagtgggactgctgcagtacggatccacggtcaagaatgagttctccctgaaaacttttaagaggaagtcagaggtggaaagggccgtgaagagaatgaggcatctcagtaccgggacgatgaccgggctggccatccagtacgccttaaacatcgcctttagcgaggcagagggtgctaggcccctaagagaaaacgtccctcgggtcattatgatagtcacagacggcagaccacaggattcagttgccgaagtcgccgctaaggcccgtgacacaggcatcctgatttttgccatcggagtcgggcaggtcgacttcaacactctgaaaagcatcggcagcgaaccgcacgaagaccatgttttcctggtggctaatttttcccagatcgagacgctcacgtcagtcttccagaagaagctctgcacagcacacatgtgcagtactctggagcataattgtgctcatttttgcatcaatataccaggctcttacgtctgtagatgcaagcaggggtatatcctgaactccgatcagaccacatgtcgaatacaagatttatgcgccatggaggaccacaactgcgagcagctttgcgttaatgtgcccggaagctttgtgtgtcagtgctactccggatatgcactcgcggaggatggaaaaagatgtgtggccgtggattactgcgctagtgaaaaccacgggtgcgaacacgagtgtgtaaatgcagacggttcctatctgtgtcagtgccatgagggttttgctctaaaccccgataaaaagacttgcacaaagatcgattattgcgcgtcttctaaccacggttgccaacacgagtgtgtgaacacagacgacagttactcctgtcattgcctcaaaggatttactctgaaccctgataagaagacttgcagaagaatcaactattgtgccctgaataagccaggttgcgaacacgagtgcgtgaacatggaagaatcctattactgtcggtgtcaccgtgggtataccttggaccctaacgggaagacctgctcgagagtggaccattgcgctcagcaagatcacgggtgtgagcagctctgtcttaacaccgaggatagcttcgtgtgtcagtgctctgaaggattcctgatcaacgaggaccttaagacctgcagcagggttgattactgcctgctgagcgatcatggatgtgaatattcctgtgtgaatatggatcgcagcttcgcatgccagtgtcccgaaggccacgtcctccgaagcgacggtaagacatgtgcaaaattggattcttgtgcactcggggaccacggctgcgagcattcttgtgtgagctctgaggactctttcgtttgccagtgttttgagggctacattctccgagaagacgggaagacctgccgacggaaggacgtatgccaggccatcgatcacggatgtgagcacatatgcgtgaacagcgacgatagttacacctgtgagtgcctggagggcttcaggttggcagaggatggaaagcgctgccggagaaaagacgtctgtaagtcaactcatcacggctgtgagcacatatgcgtaaacaacggaaatagttacatctgcaagtgcagcgaggggttcgtactcgccgaggatggtagaaggtgcaagaaatgtactgaaggaccaattgatctggtgtttgtgattgatggatcaaagagtctgggcgaggaaaacttcgaagtggtcaagcagtttgtgacgggcatcattgacagcctgactatctcgcccaaggctgcaagggtgggccttctgcagtactctactcaagtgcacaccgaatttacactgagaaatttcaacagcgctaaggacatgaagaaggccgtggcgcatatgaagtatatgggtaagggttcaatgacaggcttggctctcaaacacatgtttgaaaggagtttcacccagggtgagggggcacgccctcttagcacccgtgttccacgggctgccatcgtgttcacggacggaagagcccaagatgatgtgagcgagtgggcgtcgaaggccaaggccaacggcataaccatgtatgctgtgggcgtcggaaaagctatcgaggaagagctgcaggagatagcaagcgagcctactaacaagcatctcttctatgccgaagacttctccaccatggatgagataagtgaaaagttaaaaaagggcatatgcgaggcactggaagacagcgatggtcgccaggacagtccggctggggagctgcccaaaactgtgcagcagccaacggaatcagagccagttacaattaacattcaggacctgctgtcttgcagcaacttcgccgtccagcataggtatctcttcgaagaagataacctgttaaggtccacacaaaagttgtcccattctacaaagccatccggcagtccactcgaggagaagcatgatcagtgtaagtgtgagaaccttatcatgtttcagaatctcgctaatgaagaggttcgcaaacttacccagcgcctcgaagaaatgactcagcgcatggaggccctggaaaaccgccttcgataccgctag

SEQ ID NO: 229692 - DNA, 2814 bp, Artificial Sequence
  Description of Artificial Sequence: Synthetic coding sequence
atggagaaaatgctggctgggtgctttttactgattctggggcaaatcgtgctattgcccgctgaggccagggagagatctagaggacgtagtatctccaggggcagacacgcgaggactcacccacagactgccctgctggagagttcttgcgagaacaagcgcgctgatcttgtctttatcatagactcgtcgaggtctgtcaatacccacgattatgccaaggtgaaagagttcatcgtggacattttgcaatttctagatatcggcccagacgtgacacgggttggattgctccagtacggatccaccgtgaagaatgaattctccctcaagacttttaagcgtaagagcgaagtggaaagggccgtgaagagaatgagacacttaagcaccggcacgatgaccggcctggctatacaatacgcacttaatatcgccttctcagaggcggagggtgcaagacctctccgggaaaatgtcccaagggtcatcatgattgttaccgacggaagacctcaggacagcgtggctgaggtggccgctaaggcacgggataccggcattctcatctttgcaatcggagttggccaggtagacttcaacactctcaagtccatcggaagtgaaccccatgaagaccacgtcttcctggtagcaaatttttcgcagatcgagactctgacttccgtgtttcagaaaaaactgtgcacagcgcatatgtgtagcacccttgagcataactgcgcgcacttttgtatcaacattccgggttcctatgtgtgtcgctgtaagcagggatacattctgaactccgatcagacaacctgccgtattcaggacctctgcgcgatggaagaccacaactgtgagcagttatgcgtaaacgttcccggatcattcgtttgtcagtgttatagcgggtatgctctggccgaagacggcaaacgttgcgtggcagttgattattgtgcctcggagaaccatggatgtgaacatgagtgcgtcaatgctgatggttcctatttgtgtcagtgccacgagggattcgcgctgaaccccgataagaagacttgcacgaaaattgattactgtgcttccagcaatcatggatgccagcatgagtgcgtgaatactgacgacagttatagctgtcactgcctgaaaggcttcactctcaatccagataaaaagacatgcagacggatcaactactgcgccctgaacaagcctggttgtgagcatgaatgtgtgaacatggaggaaagttattactgcaggtgccatcgaggctacactctggatcccaatggcaagacctgctcccgggtggatcactgcgcgcagcaggatcacggatgcgaacaactgtgcctgaatactgaggacagttttgtttgccagtgctcagaaggtttcctcattaatgaggacctgaaaacctgttcaagagtggattactgcctgttaagcgaccacggttgtgagtattcgtgcgtgaatatggatcgctcttttgcgtgtcagtgccctgaaggacatgtacttcggtccgacggcaagacttgtgccaaactggatagctgcgcgctgggcgatcacggatgtgagcacagttgtgtcagctctgaggacagctttgtgtgccaatgtttcgaggggtacatcctgcgggaagatggcaagacctgccgcaggaaggacgtgtgccaagcgattgatcatggctgcgaacacatttgcgtaaatagcgacgactcttatacctgcgaatgtctcgagggctttcggctggcggaagacggcaagcgatgtagacgcaaggatgtgtgtaagtcaacacaccacggttgtgaacacatttgtgtaaacaacggaaactcgtacatctgtaaatgtagcgaaggcttcgtgctagcagaggatgggagacggtgcaaaaagtgtaccgagggcccaatcgacctcgtatttgttattgatggatccaaatctttgggggaggaaaattttgaagtcgtgaaacagtttgtcaccggaattatcgattctctcaccatctccccgaaggccgctcgtgttggtctactccaatacagtacacaggtgcacaccgaatttacactcaggaacttcaactcagctaaggatatgaagaaggccgtagcacatatgaagtacatgggaaaagggtcaatgactgggctagcactgaagcacatgttcgagagaagctttacacagggcgaaggtgcaaggcccctgagcacgcgcgtgcccagggctgccattgtatttacggatggtagggcacaagatgacgtgtccgaatgggcttcaaaagctaaggctaatgggattactatgtatgccgtcggcgtggggaaggctattgaggaggagctgcaggagatcgcttccgagcctacaaataaacacctcttttatgcggaagatttttctaccatggatgaaatatcagagaaactgaagaagggcatctgcgaggcgctggaggatagtgatggcaggcaggactcccctgcaggtgagctccccaagaccgtgcaacaaccaacagtgcagcacaggtacctgttcgaggaagataatctgttgcgttctactcagaagctgagccacagcaccaagccctcaggatcgcccctcgaggaaaagcacgaccagtgcaagtgtgagaacctgatcatgtttcagaatctggccaacgaagaagtccgaaaactaacacagcgcctggaagaaatgacccagcgtatggaagctttggagaacaggctccgataccgctag

SEQ ID NO: 229693 - DNA, 2019 bp, Artificial Sequence
  Description of Artificial Sequence: Synthetic coding sequence
atggaagaccataactgtgaacagctgtgtgttaatgtccctgggagcttcgtttgccagtgttacagcgggtacgcactggccgaagacggcaagagatgtgtagccgtcgactactgcgccagcgaaaatcatggctgcgaacatgaatgcgtcaatgcagacgggtcttacctatgtcagtgccacgagggctttgctctgaatcctgacaaaaaaacttgcaccaagatcgactactgcgccagttctaaccatggttgtcaacatgaatgcgtgaatacagatgatagctattcctgtcactgtctcaagggatttacattaaatccagacaagaaaacatgccggagaataaattattgtgctctcaacaaacctgggtgcgaacacgaatgtgttaacatggaggaatcctactactgccggtgccataggggctatacactcgaccctaatggaaagacatgcagccgggtggaccattgtgcacaacaggatcatggctgcgaacagctgtgcctgaatactgaagattcttttgtttgccagtgctctgagggcttcctcatcaacgaagatcttaagacttgctcacgcgttgactactgcctgttgtcggatcacggatgtgagtatagctgcgtaaatatggacagaagttttgcctgccagtgccctgagggacatgtgctgagatccgacggcaagacgtgcgcaaaactggatagctgtgcccttggcgatcacggttgcgaacacagctgcgtgagttctgaggacagctttgtgtgtcagtgttttgaggggtatatcctgagagaggatggtaagacttgcagacgcaaggatgtttgtcaggctatcgaccacgggtgcgagcatatctgcgtgaatagcgatgactcctacacctgcgagtgtctggagggattcaggcttgcggaggacgggaagcggtgtagacgcaaagacgtgtgtaaatcaacacatcacggttgtgaacatatctgtgttaataacggcaactcttatatttgtaagtgctcagaaggttttgtcctcgcagaggatggaagacgatgcaagaaatgcacagaagggcctattgacctggtttttgtcattgatgggagtaagagtctgggtgaggagaattttgaggttgtaaaacagtttgtcacgggaatcatcgattcactgacaataagccctaaggctgctcgggttggtcttttacagtattctacacaggttcataccgagttcaccctgaggaacttcaacagtgctaaagacatgaagaaggcggtggcacacatgaagtatatggggaaggggtccatgacaggtctcgcactcaaacacatgtttgaaagatcctttactcaaggcgagggggctaggcctttgagtacccgcgtccctcgggctgctatcgtttttacagatggacgagcgcaggacgatgtgagtgaatgggcttctaaggcgaaggcaaatggaatcaccatgtacgctgtcggcgtcggtaaggctattgaagaagaactgcaagagattgcctccgagcctacgaataagcacctcttttacgccgaagacttttccacgatggacgagatctctgagaaattgaagaagggtatatgcgaggcattggaagacagtgatggcaggcaggatagccccgctggggagttgccaaagactgtacaacagccaaccgagagtgaaccagtcactataaacattcaggacctgttgtcctgttccaatttcgcagtccagcaccggtacttgttcgaagaggataacctcctgcggagtacccagaagctgtcccacagtacaaagccctccggtagtcctctggaggagaaacatgaccagtgcaagtgtgaaaacctgattatgttccagaatctcgccaacgaagaggttcggaaattaacacagagactggaggagatgacccagcgaatggaagccctcgaaaaccgtttgcgataccgctag

SEQ ID NO: 229694 - DNA, 2748 bp, Artificial Sequence
  Description of Artificial Sequence: Synthetic coding sequence
atggaaaaaatgcttgccggatgttttctgctgattttggggcagattgttttgcttccggctgaagcgagggaacgctctcgaggtaggtcgatctcccggggtcgacatgcccgtacccatcctcagacagcacttctggaatcctcttgcgagaacaaaagagccgacctggtgtttattattgatagctccaggagtgtcaacacacatgactatgcaaaggttaaggagttcatcgtggacatactccagttcctcgatatcgggcctgacgtaacaagagtcgggctcctccagtacggaagcactgtcaaaaacgaattcagtcttaaaacctttaaaagaaagtcagaggttgagagagctgtcaagagaatgcgccacctgagtactggaacaatgaccggactggccatccagtacgccttgaacatcgccttcagtgaggctgaaggggctagaccattacgcgaaaatgtgccgagagtcatcatgattgttaccgatggtcggccacaggactcggtcgccgaggtggctgccaaagccagagataccggcattctcatcttcgcaattggtgttgggcaggtggattttaacacgctgaagtccattggtagtgaaccccatgaagaccacgtgttcctggtggccaacttctcacagatcgagacactcacttccgtctttcagaaaaagctgtgtacagctcacatgtgttcaactttagagcataactgcgcacacttctgtataaacattcctgggtcctatgtctgtagatgtaagcagggctatatcctcaactcagatcagacgacttgtagaatccaggatttgtgcgccatggaggatcacaattgcgaacaactctgcgtgaatgtaccaggatcttttgtgtgtcagtgttattccgggtacgcgttggccgaggacggaaagcgctgtgtagccgtggactattgtgcatctgagaaccatggatgcgaacacgaatgcgtcaatgctgacggatcatacctctgccagtgccacgaaggcttcgccctcaatcccgacaaaaagacttgtacacggatcaactactgtgctctgaataaacccggatgcgagcatgaatgtgtcaatatggaagagtcctactactgccggtgccacaggggctacaccctcgatcccaatggcaaaacatgtagccgggtggatcattgcgctcagcaagaccatggatgcgagcagttatgtttgaatacggaagatagctttgtgtgtcagtgttcagaagggttcctgattaatgaagatctgaagacctgctctagagtcgattattgcctgctgtctgatcatggatgcgaatattcttgtgtgaatatggatagatcctttgcatgccaatgccccgaggggcatgtgctccgctcagatgggaaaacttgcgcaaagttagactcgtgcgctctcggagaccacgggtgcgagcatagttgtgtttcctcagaagatagctttgtatgccagtgcttcgagggctatattttgcgcgaggatggtaaaacatgccggcgtaaggatgtttgtcaggcaatcgaccacggatgcgaacacatttgtgtaaattccgatgattcctatacatgtgaatgtctggaaggattccgtttggcagaggatgggaaaagatgcaggcgaaaagatgtgtgtaaatctactcaccacggatgcgagcacatctgcgtgaacaatgggaacagctacatctgcaagtgtagcgagggctttgttctggccgaggatgggcgaagatgcaagaagtgcacagaagggccaatagatctggttttcgtgattgacggctcaaaatctctcggcgaggaaaactttgaagtagtaaagcagttcgtgacggggattatagactctcttactatctctccgaaggccgctcgcgtgggcctgctgcagtactctacacaggtgcacaccgaattcacattaaggaactttaactcagccaaagacatgaagaaggctgtcgcccatatgaagtatatgggcaaagggagcatgacaggccttgctttgaaacatatgttcgagcgaagctttacccaaggcgaaggcgctcggcctctgagtactcgggtgcccagagcagctatagtattcaccgatggtcgcgcacaggacgacgtctcagaatgggcatccaaagcgaaagccaacggcataacgatgtacgctgtgggcgtgggcaaggccattgaggaggaattgcaggagattgcctcggaacccactaacaaacacctcttttacgctgaagattttagcaccatggacgagatctccgagaaacttaagaaagggatctgtgaggctctcgaggactccgatgggagacaggacagcccagcaggtgaacttcctaagactgttcaacagcctactgagagcgaaccagtgactatcaacatccaggatctcctatcttgttcaaacttcgcggtgcagcatcgctatctgtttgaggaagataatctgctgcggtctacccagaaactttcacactctaccaagcctagcggatcacccctggaagaaaaacacgatcaatgtaagtgcgagaaccttataatgttccaaaatctcgccaacgaagaggtgcggaagttgacccagagactggaggagatgactcagcgaatggaggcactcgaaaatcggctgaggtatcgatag

SEQ ID NO: 229695 - DNA, 1461 bp, Artificial Sequence
  Description of Artificial Sequence: Synthetic coding sequence
atgcctcgccctgccccagccagaagactgcctggactcctactcctgctgtggccactcctgctgctgccttctgctgctcctgatcctgtagcgcgacctggcttccgacgccttgaaaccagagggccagggggatccccagggcgtcgtcccagcccggctgccccagacggagcacctgcatcaggcactagtgagcctggacgggcaagaggcgcaggcgtgtgcaagagtcgtccactggacctcgtgttcattattgactcctcacggtcagttcgtccgttagagttcacgaaagttaagacttttgtgagcagaatcattgatacactggacatcggccctgcagatacccgtgtcgctgtggtgaactacgcctcaaccgtcaagatagaatttcagctgcaggcatacacagacaaacaaagcctgaaacaagccgtgggtagaattactcccctctccactggtaccatgtcaggcctagcaattcagacagctatggatgaggcgtttaccgtcgaggctggcgctagagaaccaagcagtaacattccgaaagtggcgattatcgtgaccgacgggagacctcaagaccaggtgaacgaagttgctgctcgggcacaggcatcgggaattgaattgtatgcggtgggcgtggaccgggctgatatggcctccttgaagatgatggcctctgaacctttagaagagcacgttttctacgtagagacttatggtgtgatcgaaaagttgagctcacgctttcaggagacattttgcgcacttgacccatgcgtgctcggaacccatcagtgtcagcacgtctgcatttctgacggggaggggaagcatcactgcgagtgctctcagggctacaccctgaacgccgataagaaaacatgtagcgcactcgatcgctgcgctttgaatacccatggctgtgagcacatctgtgtgaatgatcgctccgggagctatcattgtgagtgttacgaaggatacacattgaacgaagacagaaagacgtgtagcgcccaggacaagtgcgctctaggaactcacggttgccaacacatctgcgtgaacgaccgaactgggtcgcaccattgcgagtgctacgaaggctatacgctgaacgcggataagaagacctgcagcgttcgggataagtgcgccctcggatcccacgggtgccagcatatttgcgtctccgatggggctgcgtcctatcactgtgattgttacccagggtatacgctgaacgaggacaagaagacatgcagcgctacagaggaggcgcgaaggctcgtttcaacggaggatgcttgtgggtgcgaggctaccctcgcattccaagacaaggtctcgtcttacctacagcgtctaaatactaaactggacgacattctggaaaagctgaaaatcaatgaatatggacaaattcatcggtag

SEQ ID NO: 229696 - DNA, 1335 bp, Artificial Sequence
  Description of Artificial Sequence: Synthetic coding sequence
atgccccgtcctgctcccgcaaggcggctgccaggtcttcttctccttctatggcctctattattattaccaagtgcggctccagacccagtcgccagacccggattcaggagacttgagacgagaggtccaggcggtagtcccggacgtaggccatcgcccgctgcgccagacggtgccccagcttctgggaccagtgaacccggtcgcgcacggggagctggtgtgtgcaaatcccgcccactcgacctggtgttcattatcgactcttccaggagtgtgcgccctctcgaattcaccaaagtgaaaacatttgttagtcggatcattgacactttggacatagggcctgcagatactcgggtggcggtggtcaactatgcgagcacggtcaagattgagttccagctgcaggcatacacagataaacagtccctgaaacaggctgtcgggcgaatcacaccattgagtacgggaaccatgagcggccttgccatccagactgcaatggacgaagcattcaccgtggaagctggggcaagggaacctagttcaaatatacccaaagtagcgattattgtaacagacgggagacctcaagaccaggtgaacgaggtggctgcaagagcccaggcctctgggatcgaactgtacgcagtgggagtggaccgggcagacatggcgtcactcaaaatgatggccagcgagccactggaagagcatgttttttacgttgaaacctatggagtaattgagaaactcagttccagatttcaggagactttttgtgcgctggacagatgcgctctgaatacccacggctgcgagcatatatgtgtaaacgaccgcagcggttcctaccattgtgagtgctatgagggttatacccttaacgaggacagaaaaacgtgcagcgcccaggacaaatgcgctctgggcacccacggttgccaacacatctgcgtgaacgatcgcaccgggagtcaccattgcgagtgctatgaaggatatacactgaacgcggacaagaaaacttgcagcgtccgagataaatgcgcgttgggatctcacggttgccaacacatttgcgtatccgatggcgctgcaagctaccactgcgactgctatcctggctataccctcaatgaagacaagaagacttgctccgccacagaagaggcccgtcggcttgtctctactgaggatgcttgtggatgcgaagcaactctggcctttcaagataaagtctcctcatacctgcaaaggctgaataccaagctggacgacatcctagagaaattaaaaatcaacgagtatggtcagatccatcgttag

SEQ ID NO: 229697 - DNA, 1869 bp, Artificial Sequence
  Description of Artificial Sequence: Synthetic coding sequence
atgcggggtttactttgctggccggtcctgctcctgctgcttcaaccttgggagacccagttacagctcaccggtccccgttgccacacgggccctttggaccttgttttcgtgattgattccagccgatccgtgcgacctttcgaattcgagacgatgcggcagtttctgatgggcctgctccgtgggcttaacgttggacccaatgctacacgcgtgggcgtaatccagtactcctctcaagtacaaagcgtgtttccgctccgagcttttagtcggagggaagatatggaacgagctataagagatcttgtccccctggcccaaggcaccatgaccgggctggctattcagtacgccatgaatgtcgccttctctgtagcggagggtgctcggccacccgaggagagagtgcccagggtcgcagtcatcgtgacagatggcagacctcaggaccgggtggccgaggtggccgcacaggcgagagccaggggtattgagatctacgccgttggtgtgcaaagggccgatgtgggtagcctccgtgcgatggctagccccccactggatgaacacgtgttccttgtagaaagttttgacctcattcaggagtttggtctgcaattccagtctagactctgcgggaaagaccagtgcgcggaaggcggtcacggctgccaacaccaatgtgtgaacgcctgggctatgtttcactgtacctgtaatcctggttacaagctcgccgctgacaacaaatcatgtctggccatagatctttgtgccgagggaactcatggctgtgagcaccattgcgtgaattcccctgggagttacttttgtcattgtcaggtgggctttgtgctgcagcaggaccagcgcagttgtcgcgcaattgactattgctctttcggtaaccacagttgccaacatgagtgcgtgtctacgcccggtggacccaggtgtcactgcagagaggggcatgatcttcagcccgatggcagaagctgtcaggtgcgcgatctgtgcaacggggtcgaccatggttgcgagtttcagtgcgtttccgagggcctctcttatcggtgtctttgccccgaggggcgtcagcttcaggctgacggtaaatcctgcaacaggtgtcgggaaggtcacgtggacctggttctgctagtggacggttcaaagtctgtgcgccctcagaatttcgaacttgttaagagattcgttaatcagatcgttgactttctggacgtatcccctgagggtaccagggttgggcttgtgcaatttagttctcgagtacggacagagttccctctgggacggtatggaaccgccgcagaggtgaagcaggccgtactggccgtggagtacatggaacgtggaactatgactggactcgccctccgacatatggtggagcacagtttctcagaggcccagggggcacgtccacgtgccctaaacgtgcctcgcgtgggactggtgtttacagacgggcgtagccaggatgacatatcagtctgggcggctcgggcaaaagaagaaggtatcgtcatgtacgccgtcggagtggggaaggcggtggaagcggagctgcgggaaatcgcctcagagccggctgagctgcatgtgtcttacgcacccgactttggaacaatgacccacctgttagaaaatctgcggggtagcatttgtccggaggaaggcatcagcgccggtactgagctgcgcagcccttgtgaatgtgaaagtctagtagagtttcaaggcagaacgctgggagcacttgaaagccttactcttaacctcgcacaactgacagctcgcctcgaggacctagaaaaccagttagccaatcagaagtag

SEQ ID NO: 229698 - DNA, 1746 bp, Artificial Sequence
  Description of Artificial Sequence: Synthetic coding sequence
atgcgaggcctcctatgttggcccgtgctgttgcttctcctgcagccttgggagacccaacttcagctaacagggcctcgctgccacacagggcctttggacctcgtctttgtaatcgatagctccagatcagtgaggccttttgagttcgaaaccatgagacagtttctgatgggccttctcaggggtctgaatgttgggccaaacgcaacacgggtgggcgtcattcagtattcttcacaagtgcagagcgtatttccattgagagcgttcagccggagagaagacatggaacgagcaatccgagatttggtgcctttggcgcagggaactatgactggattggctatacagtacgctatgaatgtcgccttctctgttgcagagggggcacgcccaccggaggaacgcgttccgagagtggcagtaatcgtcactgacggacggccacaagacagggtcgccgaagttgccgcacaggctcgggctcgcggtattgagatctacgctgtcggtgtgcagagagccgacgtgggctcattgcgcgctatggctagtcctccacttgacgagcacgtgtttcttgtggaatccttcgatctgatacaggagttcggactgcaatttcaatctcggctgtgtgccatagatctgtgcgccgaaggcactcacgggtgtgagcatcattgcgttaatagcccaggttcttacttctgtcattgtcaagtggggtttgtcctccagcaagaccagcgaagctgtcgtgctattgactactgttcttttgggaatcactcatgtcagcacgagtgtgtttcaactcctggtgggccaagatgtcattgccgggaaggacacgatctgcagccagacgggagaagttgtcaggtgcgagacctgtgcaacggcgtggatcacggttgcgagtttcaatgtgtgtctgaggggctgtcataccggtgcctctgccccgagggcaggcaactgcaggccgatgggaaaagttgcaacagatgtagggagggccatgtggatttggtattactggtggatgggagtaaaagcgttcggccacagaacttcgaactcgttaaacgatttgtcaaccagatcgtggactttctcgacgtgagccctgaaggcactcgggtgggacttgttcagttctccagtagagtgcgcacagaatttcctttaggcaggtacggtaccgccgcagaggtgaagcaagctgtgctcgccgtcgagtacatggaaagaggaacaatgaccggattagcccttcgacacatggtcgaacatagcttctctgaagcacagggcgctcggcctcgcgctcttaacgtgcctagggtcggcctggtattcaccgatggacgctcccaggatgacatttccgtgtgggcggcaagggctaaagaagaggggatcgtaatgtacgccgttggtgtgggaaaagctgtcgaagccgaactgcgcgagatagcttcagaacccgcagaactccatgtgtcctacgcccctgacttcggaacgatgacccacctccttgaaaacttgagagggtcaatttgcccagaggagggcatatccgcgggaactgagctccggtccccctgcgagtgcgaaagcctggtggagttccaggggagaaccctgggcgctctcgagtccctgactctcaacttggcacagctgactgcaagactggaggacttggagaaccagctggccaaccagaaatag

SEQ ID NO: 229699 - DNA, 1500 bp, Artificial Sequence
  Description of Artificial Sequence: Synthetic coding sequence
atgaggggcctactgtgctggccggtccttctgcttctgctgcagccctgggaaacacagttacagctcactgggcctagatgtcataccgggccacttgatctcgtgtttgtaattgattctagcagatctgtgagacctttcgagttcgaaaccatgcgacagtttcttatgggcctgcttcggggtcttaacgtcggacccaacgcaactcgggtcggggtgatccaatacagttcacaggtgcagagcgtgtttccgctgcgggcattttctcggagggaggacatggaaagggcaatccgggatttagttcctctggcccaggggactatgaccggcctggcgatccagtatgcgatgaacgtcgccttttccgtggcagaaggtgcgagaccacccgaagagcgagtcccacgggtggctgtaattgttacagacggccgtcctcaagatcgagttgccgaggtggctgctcaagctagagctaggggcattgagatttacgcagttggggtgcaaagagcggatgtgggctctttgcgcgcaatggcgtctcccccactggacgagcatgtgttcctggtggagtccttcgatctaattcaggagttcgggctgcaatttcagtcccggttatgtgtccgggacctgtgcaatggagtggaccatgggtgcgaattccagtgcgtgtcagaaggcctaagctacaggtgtctgtgcccagaagggagacagctccaggcagatggaaaatcctgtaatagatgccgggaaggccacgtggatctcgttcttcttgtcgacggttctaagtcagtgaggccacagaatttcgagctcgtcaaacgcttcgttaaccagattgtagacttcttagatgtctctcctgaaggtacacgcgtgggcctagtccaattctcttccagagtgagaacagagtttcccctcggaagatacggaaccgctgcagaggtgaaacaggccgtcttagcagtcgaatatatggaaagaggaacgatgaccggattagcactaaggcacatggttgagcactccttctccgaggcacagggcgctcggccaagagccctaaatgtgccaagggttggtctcgtgtttactgatgggagatcacaggacgacatttcggtgtgggccgcacgggcaaaggaggaaggcatagtgatgtatgccgtgggcgtgggcaaagctgtggaggcggaactccgggagatcgcctccgagcccgctgaactgcacgtcagctatgcgcctgatttcggcaccatgacccaccttctggagaatttgcggggatcaatctgccctgaggaggggatttccgcgggtactgagttgcgttccccctgcgaatgcgagagcctcgttgaattccagggcaggacacttggggctttggagagtctcactttgaacttagcacagttaactgccaggctggaagatctggagaaccagttggctaatcaaaagtag

SEQ ID NO: 229700 - DNA, 1623 bp, Artificial Sequence
  Description of Artificial Sequence: Synthetic coding sequence
atgcgaggtcttctttgctggcccgtcctgcttttgctcttgcaaccttgggagacccagctacaacttacgggcccaagatgtcacacaggacccctggatctggtcttcgtgatcgactcctctaggtccgtgcggccattcgagtttgagactatgagacagttcctgatgggtctcctgagggggttaaatgtggggccaaatgctacaagagtgggcgttatccaatactcttcacaagttcagagcgtgttcccgctgagggctttctcaaggagggaagacatggagcgcgctattcgggacctggtgccactggcacagggcacaatgaccggccttgccatacagtacgctatgaatgttgcttttagcgtggcagagggggcaaggccacctgaagaaagagtgcctcgcgtggcagtgatcgtgacggacggacgcccacaggacagggtggctgaagtagctgcccaggccagagcaaggggaatcgagatctatgcggtgggagtgcaacgggcagatgtgggatctcttcgggctatggcctccccacccctggacgaacatgtgtttctcgttgagtccttcgatctcatccaggaatttggcctgcagtttcaatcccgcctgtgcgcaattgactattgttcttttggtaatcactcctgtcaacacgagtgcgtaagcacccccggagggcctagatgccactgcagagagggccacgacctccagccagacggtcgctcctgccaggttagagatttgtgcaatggcgttgatcacggttgcgaattccagtgtgtatccgagggcttatcctacaggtgtctgtgtcccgaggggcgacagctgcaagctgacggaaagtcctgtaacagatgccgcgaaggccatgtcgacctagtgttactggtggatggtagcaagagtgtcagacctcagaactttgaattagtcaagcgcttcgtgaatcagatagttgactttctggatgtctccccagaaggcacacgggtgggccttgtgcagttttccagccgggtgcggacggagtttcctctgggaagatacggaactgccgcagaagtcaaacaggcagtccttgctgtggagtatatggaaagaggcaccatgaccggtcttgcactgagacatatggtggagcacagctttagcgaagcccaaggggctcggcctagggctcttaacgtccccagggtcggcctagtcttcaccgatggacgatcccaggatgacatctccgtttgggcagcaagggctaaggaggagggtattgtgatgtacgccgtaggggtcgggaaggcggtcgaggccgaactgagggagatcgcctccgagccggctgagctgcatgtctcatatgccccagacttcgggaccatgacacacctgcttgagaatcttcggggatccatttgcccggaagaagggattagtgcagggaccgaactgaggagtccatgtgagtgcgagtcactagtggagtttcagggcaggacgctgggggcacttgagtctctgaccctcaacttggcacaactgacagctaggctggaggaccttgaaaatcagcttgccaatcaaaaatag

SEQ ID NO: 229701 - DNA, 1299 bp, Artificial Sequence
  Description of Artificial Sequence: Synthetic coding sequence
atgcggggtctcctgtgttggcccgtgctcctccttcttctgcagccttgggagactcagctgcagctcacaggtaaggatcagtgcgccgagggtggccacgggtgccaacatcagtgtgtgaatgcatgggccatgttccactgtacctgcaacccgggttataagctcgcagctgataataaatcctgcttggctattgacctgtgcgcagagggcacccacggatgtgaacaccattgtgtgaattccccaggctcctacttctgccattgtcaagtgggattcgttttgcagcaagatcaacgtagttgtcgggctatagactactgctctttcggaaaccattcctgtcagcacgagtgcgtgtcgacaccgggaggccctaggtgccactgtcgggaaggtcatgatctgcagccagatgggagaagctgccaagtgcgtgacctctgcaacggtgtggaccacggctgcgaattccagtgcgtcagtgaagggttgagctataggtgcctgtgccctgaaggcaggcagctccaggctgatgggaaaagctgcaaccgttgtagggagggacatgtcgacctcgttcttctggtggatggctctaagtcagttcgaccgcaaaactttgagctagtgaagcgtttcgtaaaccagattgtggacttcctggacgttagcccagagggaacgagagtcgggcttgtgcagttttcaagtagagtgaggacagagttccctctgggaaggtacggaacagctgctgaggttaaacaggctgtgttggccgtggaatacatggagcgcggtacaatgactggccttgcccttcgccacatggtggaacactctttttccgaagctcagggtgccagaccccgagccctgaacgtccccagagtcggattagtgttcacagacggacggtctcaggacgacatcagcgtttgggccgctagggccaaggaagaaggtatcgttatgtatgcagtgggcgtcggcaaggccgtagaggccgagcttcgcgagatagcctctgagcctgccgaacttcacgtgagttacgctcccgacttcggtacaatgactcacctcctggaaaaccttcgcggatccatatgccctgaggaaggcatctccgctggaactgaactccgctctccttgtgagtgcgaatccctcgtggagttccagggtaggacgctgggcgctctcgagagtttaacactgaacctggcccaactcactgcccgtctggaagatctggagaatcaactggccaaccaaaagtag

SEQ ID NO: 229702 - DNA, 1299 bp, Artificial Sequence
  Description of Artificial Sequence: Synthetic coding sequence
atgcgcggtctcctgtgttggcccgtcttactgctgctactacagccgtgggagacccagctgcaattgaccggtaaggaccagtgcgccgaggggggtcacggttgtcaacaccagtgtgttaatgcatgggccatgttccactgcacatgtaatcccggatacaagctggccgcagacaataagagttgcctagctatcgatctctgcgcagaaggtacgcatggatgtgaacatcactgtgtgaattctcccggaagctatttctgccactgccaagttggatttgtccttcaacaggatcagaggagttgcagagcaatcgactattgcagctttggtaatcactcctgtcaacacgagtgtgtgtctaccccagggggacccagatgccattgccgagaggggcacgacctgcagcccgatggtcggagctgtcaggtgcgtgacctctgtaacggcgtcgatcatggttgcgaatttcagtgcgtctccgagggcctctcttacagatgtctgtgtccggagggacggcaactgcaagccgacggcaagtcatgtaatagatgtagagagggccacgtcgatttggtgttgctggtcgatgggagtaaaagtgtgaggccacagaatttcgagctggtgaagcggttcgtaaatcagatcgtggattttctagatgtctccccggaggggactcgggtggggcttgtccagttctccagcagagtaaggactgaatttcccttagggcgttatggaaccgctgccgaggtgaagcaagcggtcctggctgtggagtatatggagagaggaacgatgaccggacttgcgcttcgccatatggtagaacattcctttagtgaggcccaaggagctcggcctcgtgcactcaacgtgcctagggttggtctggtttttaccgatggccgaagccaagacgacatttctgtgtgggcagcacgcgcaaaggaagagggcatcgtgatgtatgccgttggggtcggtaaggctgtcgaggcagagctccgggaaattgcgtctgagcccgcagagcttcatgtctcctatgcacctgactttggcacaatgactcatctgttagagaacctgcggggttctatttgcccggaggagggcatcagcgctgggactgaactccgatctccgtgcgaatgtgaaagtttagtggaattccagggcaggactttgggcgctcttgagtctttgaccttgaacttggcgcagctcacagcccgtctggaggaccttgagaatcagctcgccaaccagaagtag

SEQ ID NO: 229703 - DNA, 1869 bp, Artificial Sequence
  Description of Artificial Sequence: Synthetic coding sequence
atgagaggattgctgtgctggccggttctgctgctcctgcttcagccgtgggaaacccagctccagttgacaggccctcgctgccataccggacccctggacctcgtctttgtgatcgatagttctaggagcgttaggcccttcgagttcgagaccatgaggcagtttctgatgggacttctccgtgggctgaatgtagggccaaatgctacacgcgtaggtgtcatacagtattcttcccaggttcagagcgtcttcccactccgcgcattcagccgtcgagaggacatggaaagggccatacgggatttagtgcccctggcgcaaggaaccatgactggtttggccattcagtacgccatgaatgttgcattttctgtggcagaaggggcaagaccacccgaagagagagtcccccgtgtggccgtgatagtcacagatgggaggccacaggacagggtggccgaggtggccgctcaggccagagcccgaggcatcgagatatacgccgtgggagtgcaacgtgctgatgtaggctcactgcgcgctatggcctctccccctctggatgagcatgtgttcttggtcgaatcattcgacctcattcaggaatttggcctgcagtttcagtccaggctgtgcggcaaggaccagtgcgcggaaggtggacacggatgccagcatcagtgcgtcaacgcgtgggccatgtttcactgtacttgcaaccctggctataagctcgccgcagacaataaaagttgcctggcgatcgacctatgcgccgaaggaacacacggctgcgagcatcattgcgtgaattccccagggtcctatttttgccactgtcaggttggtttcgtgttacagcaagatcagcgaagttgtcgtgcaatagactactgttcattcggcaaccactcatgccagcacgagtgcgtgtccacccctggcggtccaaggtgccattgcagggagggtcacgatctgcagcccgacggacgaagctgccaggtgcgggacctctgtaatggggtagatcacggctgtgagttccagtgtgtctctgaagggctttcctacagatgtctctgcccagagggtcggcagttgcaggccgacggtaaatcatgtaacaggtgccgggaggggcatgtggatctggtgctgcttgtggacggttctaaaagcgttcggcctcagaatttcgaacttgtaaaacgtttcgtgaatcagatagtagactttctcgacgtgtctcccgaaggcacaagggtcggactggttcagttcagtagccgggtccggactgagttcccactcgggaggtatggcactgccgctgaagtcaagcaggccgtgctggccgtggagtacatggagcggggaacgatgaccggcctcgccctccgacacatggtggagcatagcttcagtgaagcacagggagctagaccaagggccttgaacgttcccagagtgggactcgtattcactgatggcagatcacaggacgatatcagtgtgtgggcagcaagagcgaaggaagagggcatcgtcatgtacgccgtgggagtgggaaaggccgtggaggcggagttaagggaaatcgccagcgaacccgcagagctccatgtatcttatgccccagattttggcacaatgactcaccttctagagaatctcaggggaagtatatgccctgaggaaggcatttccgctgggaccgagctgagatcaccttgcgaatgcgagtccttggtagaattccagggacggaccctaggcgctctggagtctctgacgttgaatctcgcccaactgactgccagactggaagacctggaaaatcagctggcgaatcagaagtag

SEQ ID NO: 229704 - DNA, 1746 bp, Artificial Sequence
  Description of Artificial Sequence: Synthetic coding sequence
atgcgaggtctcctttgttggccggtcctgctgttgctgctccagccgtgggagacacagttgcaactcactggccctaggtgtcacaccggccctctggatctagtttttgtcatcgacagttcacggagcgtgaggcctttcgagtttgaaacaatgaggcaattcctcatggggctgcttagggggctgaacgttggacccaacgccacaagggtgggagtcatccaatactcttcccaggttcaatcggtcttccccctgcgggcattttctcggagagaggacatggaacgggctataagagacctcgttcctctggctcagggcacaatgactggcctcgcaatccagtacgccatgaacgtggcttttagcgtcgcagagggggctcgacccccagaggagcgggtcccacgcgtggcagtcatagtcactgatggcaggcctcaggatcgggtggcagaggtggcggctcaagctcgggctagaggaatcgagatctacgcagtgggggtgcagcgtgcagatgtaggctctttgagggccatggcaagtccgccattagacgagcacgtgttcctggttgaaagcttcgatcttatccaagaatttggactacagttccagtcacgactttgtgcaatcgacctttgtgccgagggaacacacgggtgcgaacaccattgcgtcaattcccctggttcctacttttgccactgtcaggtggggtttgtgctccagcaggaccagcggagctgtcgggcaatagattattgtagtttcggaaaccattcatgccagcacgaatgcgtgtccaccccagggggtccacgctgccattgcagggagggacacgacctccagccagatgggcgatcatgccaagtgagggatctctgcaatggtgttgatcacggctgcgaattccagtgtgtcagtgaagggctgtcttacaggtgcctgtgcccagaaggcagacaactgcaggctgacggcaagagctgtaataggtgtagggagggccacgtagacctagtcctgctcgtagatggaagcaagtcagtcagaccccagaattttgaactcgtgaaacgttttgtcaatcagattgttgactttctcgatgtgagccccgaggggacccgagtgggccttgtgcagttttctagccgggtgaggactgagttcccacttggacggtatggaacagctgccgaggtaaagcaggcagtcctggcagtggaatacatggaaagagggactatgactggcctcgccctgcggcatatggtagaacactccttttccgaggctcagggggctaggccaagggccctgaatgtgcctagggtcggcttagtgtttaccgacggccgatctcaagatgacatcagtgtgtgggccgcaagggccaaagaggaggggatcgtaatgtacgctgtgggggtcggcaaagcagtcgaggccgagctgagagagatagcttcggaaccggcagagttacacgtgtcatacgcaccagatttcggcacaatgactcatctactagagaacctgagaggctcaatttgtcccgaagaagggatttctgccggaaccgagcttaggagtccctgcgagtgtgagagcctagttgagtttcaggggcgtactttgggcgcactggaatctctcacactgaatcttgcccagcttacagctcgcctcgaagacctggagaaccagctggccaatcagaagtag

SEQ ID NO: 229705 - DNA, 852 bp, Artificial Sequence
  Description of Artificial Sequence: Synthetic coding sequence
atgtctaaaagctttcagcagtcttctctgagcagagactcacaaggccatggccgagatctgtctgccgcaggcataggcctcctagctgctgcgacacagtctctgagcatgttgcttgaaagcgaagacgagctactggtcgacgaagaagaggcggctgcgttattggaaagcggaagttcagtaggcgacgagactgacctcgcgaatctaggagatgtggcctcagatggcaagaaagaaccatcagataaagcagttaagaaggatggcagtgcctcagccgcagccaagaagaaattaaagaagcggagatttccaggctccatggaagggtttgttaccctcgatgaagttggcgatgaggaggactctgaactgcagaaactgcggaagtcagggatggcatttaagtccggcgacaagaacgacgacggacttgtggagattaaagttgacaaaatcgaagaactggaccaggagaatgaggctgctcttgaaaatggaataaagaatgaggaaaacacagaacccggagccgagtcctcagaaaacgctgacgaccctaataaagatacatctgaaaacgccgatggtcaaagcgatgaaaataaggacgactataccattccagatgagtaccgcatcggcccttaccagcctaatgtcccggtaggaattgattatgtgattcctaagacaggcttctactgcaagctgtgtagtctgttctatacaaatgaggaagtggcaaaaaatacacattgctcttctcttccgcattaccagaaactaaaaaagtttctgaataaacttgccgaggaacgcaggcagaagaaagaaacgtag

SEQ ID NO: 229706 - DNA, 2544 bp, Artificial Sequence
  Description of Artificial Sequence: Synthetic coding sequence
atgagcaagagtttccaacagtcaagcttaagcagagactcccaggggcacggtcgcgacctgagcgccgctggcattggcctacttgccgctgccactcagtccctgtccatgcccgcttctctcggccgaatgaaccaggggacagcccgactggcgtctctaatgaacctcgggatgtcttcttcgctgaaccagcagggggcacattcagcgcttagtagtgccagtactagctctcataacttgcagagtatctttaatattggttcccggggaccacttcctctctcatcccagcatcggggtgatgccgatcaggctagcaacatactcgcgtcatttggtctgtccgcgagggatctcgacgagctcagccgctatcctgaggataaaattactcccgaaaacctgccccagattcttttacaattgaaaagacgcaggaccgaggagggccctactctgtcctacgggagggacggacgctctgccacaagagagcccccatatagggtaccacgggacgactgggaagagaagagacatttcaggagggatagcttcgatgatcggggtccctccttgaacccagtgctcgattacgaccacggatctcggtcccaggaatccggttattatgaccggatggattacgaggacgatagactccgggacggagagcggtgtagggacgattctttttttggtgaaacgtctcacaactatcataaatttgactctgagtatgaaaggatggggaggggcccaggcccactgcaggaaagatctttatttgaaaagaagagaggcgctccccctagcagcaacattgaagatttccatggcttgctgcctaaggggtatcctcacctctgttccatctgcgatctacctgtccacagtaacaaggaatggagccagcacattaacggcgcaagccattcccgcagatgtcagcttctgctcgaaatctacccagagtggaacccggacaatgataccggccacacaatgggagacccttttatgctgcaacagtccaccaacccagccccaggaatccttggcccaccacccccttcattccacctcggtgggcctgctgtcggcccacgcggtaacctcggcgctgggaatggcaatctgcagggccctcgccacatgcagaaaggtagagttgagaccagccgggtcgtgcatatcatggacttccaacgcggtaagaatttaagataccagttgctgcagctggtggaaccctttggagtaatttccaatcaccttatcttaaacaagattaatgaggcgttcatagaaatggcaaccactgaagacgctcaggcagcagtggattactatactactacccccgctcttgtgtttggaaagcccgtccgggtccacctgtctcagaagtacaaacggataaagaagcccgaggggaagccggatcagaaatttgatcagaagcaggagcttggccgtgtgatacatctcagtaatttgcctcactccggctattccgattccgccgtcctcaagctagctgagccatatggaaagatcaaaaattatattctgatgcgcatgaaatctcaagcgtttatcgaaatggagactagggaggacgcaatggcgatggtagaccattgtctgaagaaggcactgtggtttcaaggcaggtgcgtgaaagtagacctgagtgagaagtataagaagctagtgctaagaatcccgaatcgagggattgatttgcttaaaaaagacaaatctcgcaagaggtcatacagccccgatggaaaggagtccccctctgacaagaagagtaaaacagatggatctcagaagacagagtcatcaacagagggtaaagaacaggaggaaaaatcaggagaggacggggagaaggacaccaaagatgaccagaccgagcaggaacccaatatgctgctggagtccgaagatgagctactcgtagacgaagaggaagcagccgcattgctggaaagtgggagttccgttggagacgaaacagacctcgctaatcttggcgatgttgcttctgatggtaaaaaggagccatcagataaggccgtgaagaaggatgggagtgcttccgctgccgcaaagaaaaaacttaagaaggttgataagattgaagagttggatcaggagaacgaggcggctcttgaaaatgggatcaaaaacgaagagaacaccgaacctggggctgaatcttctgagaacgcggatgatccaaacaaggacactagtgaaaatgctgacggccagtccgatgaaaataaagacgattacaccattcccgatgagtacaggattggcccttaccaacctaacgtcccagtgggcattgattatgtcatcccgaaaacaggtttctactgcaagctctgttccctgttttatacaaatgaggaggttgctaagaatacgcactgttcctcactgccccactatcagaagctaaaaaagtttttgaacaaattggcagaagagagacgacagaagaaggaaacctag

SEQ ID NO: 229707 - DNA, 2544 bp, Artificial Sequence
  Description of Artificial Sequence: Synthetic coding sequence
atgagtaagtccttccaacaaagttcattgtcaagagatagccagggacacggtagggacctgagcgccgcagggatcgggttattggccgctgctacccagtcactcagcatgcccgcttcactagggagaatgaatcaaggtactgctaggttggcatcactgatgaatctgggaatgtctagctcactgaatcaacaaggcgctcattcagctttatcttctgcctccacatccagccataacctgcagtccattttcaacattggcagccgaggacctctgcccctgtccagtcagcaccggggagatgcagaccaagcctctaacattctggcctcattcgggctttccgcgagggatctcgacgagttgagcagatatcccgaggacaagattactcccgaaaatctacctcagatcctcctacaactgaagcgccgacgtactgaggaagggcctacactgagttacgggcgagacggacggtctgcaactagggagcccccttacagagtgccacgcgatgactgggaggagaagcgtcacttccgcagggattccttcgatgaccggggacctagcctgaatcccgtgctcgactacgatcatgggagccgcagccaggagtcaggatattacgacaggatggattacgaggatgatagactgagagacggggagaggtgtcgcgacgactcattctttggcgaaaccagtcacaactaccacaagtttgattctgagtacgagagaatgggcaggggccctggaccactgcaggagcgcagcttgttcgagaagaagaggggtgccccaccttcatctaacatcgaagatttccatggactcctcccgaaagggtaccctcacctgtgctccatctgtgacctgcccgttcactcaaacaaagagtggagccagcacatcaatggagcgtcacattcacgcagatgccagctcctgctggagatttatccagagtggaacccagacaatgataccggccatactatgggggatccttttatgcttcagcagagcacaaatcccgctcccggaatcttggggcctccccctccctcttttcatttagggggacccgcagttggccctaggggcaatctgggtgctggaaacggcaacctccagggacccaggcacatgcaaaaagggagggtggagacgtccagggtggtccacattatggactttcagcgcggtaagaatctgcggtaccaacttttgcagcttgtggagccctttggtgtgatcagcaatcacctgatcctgaataagatcaacgaggccttcatcgaaatggccacgacagaggacgcccaggccgctgtcgattactacacaacaaccccagccctcgtgttcggcaaaccagttcgcgtccatctctcccagaaatacaaacgaattaagaagcctgagggaaagcccgaccagaaatttgatcagaaacaggagcttgggagggtcattcatttgtcaaacttacctcattctggttacagcgactctgcggtcctcaagctggctgagccgtacggcaagattaagaattacattctgatgagaatgaagtcgcaggcatttattgaaatggagaccagagaggacgcaatggccatggtcgaccattgcctgaaaaaagctctctggttccaagggcgttgcgtgaaagtggacctcagcgaaaaatataagaaactcgtgttacggattccgaatagaggtattgatctactgaagaaggataagagtagaaagagatcttatagcccagacggaaaggagtccccgtcggataaaaagagcaagacagacggtagccagaagacggagtcatctactgaaggcaaagagcaggaagagaaatcaggcgaggacggggaaaaggacactaaggatgaccagaccgagcaggagcccaacatgttgctcgagtcagaggacgaactgcttgttgatgaggaagaggctgctgcgctcctggagtcaggttccagcgtgggcgatgagaccgacttggccaacttgggggacgtggccagcgatggaaaaaaagagccttccgacaaagccgtgaaaaaagatggaagtgcaagcgcggctgccaagaaaaagctgaagaaagttgacaagatagaagaactcgatcaggaaaatgaggctgccctggagaacggcataaaaaacgaggagaatactgagcccggtgctgaatcatctgagaacgctgacgatcccaataaggatacaagtgagaacgctgatggacagtccgatgaaaataaagacgactatactatcccagacgagtatcgcattggcccataccagcccaatgttcccgtgggcatcgattacgtaattcctaaaaccggtttttattgtaagctctgttctttgttctataccaatgaggaggtggctaagaacacccattgttcgtcattgccgcattatcagaagttgaagaaattcctcaacaagctggccgaagagcgccgacagaagaaggagacctag

SEQ ID NO: 229708 - DNA, 300 bp, Artificial Sequence
  Description of Artificial Sequence: Synthetic coding sequence
atgtccaaatccttccagcagagtagcctcagtagagattctcagggacatggcagagacctgagcgctgccggaatcggactccttgctgccgcaacccagtcgttgtccatgccagcttcgctgggaagaatgaatcaaggtaccgccaggctggcctccctgatgaacttggggatgagtagcagtctgaatcagcaaggtgcgcactctgccttaagtagcgcaagcacaagttcacataacttgcagtctatctttaatatcggaagccgcggacccctgccactgtcaagctag

SEQ ID NO: 229709 - DNA, 1530 bp, Artificial Sequence
  Description of Artificial Sequence: Synthetic coding sequence
atgggcgatccattcatgctgcagcagtctaccaatccggcacccggtatccttggcccacccccaccctctttccatctggggggtccagcagtaggccctagaggcaatctgggagccggaaatggcaacttgcagggtcccaggcacatgcagaaaggaagggtggagacctcaagggttgtacacattatggacttccagcgcggaaagaatctgcgctaccagctgttacagctcgtagagccttttggtgtgatctctaaccacctcatacttaacaagataaatgaggccttcatcgagatggcaaccacagaggatgcacaggcagctgtcgactactataccaccacccccgctctggtgtttgggaaacctgtccgcgtacatctctcccaaaagtataaaaggatcaagaagccagaaggcaagccagatcagaaatttgaccagaaacaagagctgggaagggtgatacatttgagtaatctgccccatagtggctatagtgattcagctgtgctaaaactcgcagagccttatggcaaaattaagaactacatcctgatgcgcatgaagagccaggctttcatcgagatggagacccgagaagacgctatggcaatggtcgatcactgtctcaagaaggctctgtggttccaaggacgttgcgtgaaggtggatctgagcgagaagtacaaaaagttggtgctgagaatcccaaaccggggaatcgatctgctgaagaaggacaagagtaggaagcgcagctactcccccgatggcaaggagtcaccttccgacaaaaaatctaaaaccgatggcagccagaaaacagaatcatctacagagggcaaggagcaagaggaaaagtccggcgaggatggggagaaagacacaaaagacgaccagacagagcaggagcccaatatgctgctggaaagcgaagacgaacttctggtggacgaggaggaagccgcagccctcctggagtctggcagctcagtcggggacgagactgatctggctaatctgggagacgtcgcttcagatggcaaaaaggagcccagtgacaaggcagttaaaaaggatggctctgcttctgccgctgctaaaaagaagctgaagaaagtggataaaattgaagaactggaccaagaaaatgaggctgcacttgaaaacggaataaagaatgaagagaacacagagcctggtgcagagtcctcagagaacgccgacgaccccaataaagacacatcagagaacgcggacgggcaaagcgacgagaacaaagatgattacactatacctgatgagtacaggattgggccttaccaacccaatgttcccgtcggaatcgattatgtgatcccaaagaccggcttctactgcaaactgtgtagcctgttctacacgaatgaagaagtcgcgaagaatacccattgtagttcactgccacactaccaaaagctcaagaagtttctcaataaattagctgaagagcggcgtcagaaaaaggagacttag

SEQ ID NO: 229710 - DNA, 264 bp, Artificial Sequence
  Description of Artificial Sequence: Synthetic coding sequence
atgagtaagagttttcagcaaagcagtctgtccagagatagccagggtcacggccgtgacttgagcgccgctggaatcggtcttctggctgccgcaacccagagcctttcaatgcctgcctcgttggggcgtatgaatcagggaaccgccaggctcgcctctctcatgaatctggggatgtccagctctcttaaccagcaaggtgcacactctgcactctctagtgcctccacaagttcccataacttacagagcattttctag

SEQ ID NO: 229711 - DNA, 1680 bp, Artificial Sequence
  Description of Artificial Sequence: Synthetic coding sequence
atgctcggggcacagtggagacgtaatcagccaagccgggctgccgaggaatggagccagcatattaacggcgctagtcattcccgtaggtgccaactcttactcgagatatatccagagtggaaccccgacaacgacacaggccataccatgggcgacccttttatgcttcagcagtcaacaaatcccgcacccggaatactggggcctccacccccatcatttcacttgggcggacctgcggtgggcccaagggggaacctgggagcgggaaacggcaacctgcaaggacccagacatatgcagaaggggagagtagaaacctctcgagtggtacatattatggactttcagaggggcaaaaaccttcgctaccagctcctacagctagtggaaccctttggtgtgatcagcaatcatcttattcttaataagattaatgaagctttcatcgaaatggctaccacagaggatgcacaagcagctgttgattattacactaccacgccggcacttgtctttggaaagccagtgcgcgtccatttaagccagaagtataaacggatcaagaagcccgaaggtaagcctgaccagaagttcgaccaaaagcaagaattggggagagtcatccacttgagtaacctgccacactctggttacagtgactctgcggtactcaagctggccgagccctatggcaagattaaaaactatattctaatgagaatgaagagccaggcattcatcgagatggagaccagagaggatgccatggccatggtcgatcattgtctgaaaaaggccctctggttccaggggaggtgcgtgaaagtggaccttagcgaaaaatataagaagctcgttcttagaatccccaataggggcatagaccttctgaagaaggacaagtctcgtaagcggtcctattcaccggatggtaaagagtccccctctgacaaaaagagtaaaaccgatggatcacagaaaaccgaaagcagcactgagggtaaagagcaggaggaaaagtcgggcgaggatggagagaaggataccaaagatgaccaaacggagcaggaacccaacatgctgctcgaatctgaggatgagctgttggtggacgaggaagaagcagcagccctactggaatctgggagcagtgtaggcgacgagacggacctggcaaacctgggtgatgtggcttccgacgggaagaaagagccttccgacaaagcagtcaagaaggacgggtcggcttctgcagccgctaaaaagaaactgaaaaaagtagacaagatcgaagagctagatcaggagaatgaggccgcattggaaaacggcataaagaacgaggagaatacagagcctggcgctgaatcttccgagaacgccgatgatccgaataaggatacttctgaaaatgccgatggacagtctgacgagaataaagacgattatacaattccagacgaataccgaatcggaccctatcagcccaatgtgccggtaggaattgattacgtcataccgaagacaggcttctactgtaaattgtgttcattattttacacaaacgaggaggtggccaagaacactcactgctcatctttaccacattatcagaagctaaagaaatttttgaataaattagccgaagagagacgccagaaaaaggaaacctag

SEQ ID NO: 229712 - DNA, 237 bp, Artificial Sequence
  Description of Artificial Sequence: Synthetic coding sequence
atgagcaaatctttccagcagtcatccctctccagagatagccaggggcacggtagggatctgtcagccgcaggaattggcttgttagcggctgccactcagtctctatccatgccggcatccttaggtaggatgaatcagggcaccgcccgattagcctctcttatgaatttgggcatgtcatcctccctgaaccaacagggggctcactccgccctctcatccgcttcaacttag

SEQ ID NO: 229713 - DNA, 1302 bp, Artificial Sequence
  Description of Artificial Sequence: Synthetic coding sequence
atgagcaagagcttccaacagtctagcttgtcaagggattcacagggccatggcagggacctctcagcggcaggtattggcctgctggcagcagccacgcaaagtctgagtatgccagcatccctgggaagaatgaaccagggaacggctaggctggccagtcttatgaatcttggaatgagttcgtctctgaaccagcaaggcgctcacagtgccctgtctagcgcatccacgagttctcacaacctgcagtccatcttcaatattggatcgagagggcctctgcctctcagttcccagcatcggggagacgcagatcaggcgtccaacattctggcatcattcggcctgtctgctcgggatctagatgaattaagtaggtaccccgaggacaagatcacacctgagaaccttcctcagattctgctccagcttaaacgcaggcgcacggaagaggggcctacgctgtcctatggacgtgatggtcgttccgctacccgcgagcccccttatagggtgccacgtgatgattgggaagaaaagcggcattttcgaagggattccttcgatgaccggggtccatcattaaatccggtgctcgactacgatcatgggtcgcgctcgcaggagtcaggctattacgatagaatggactacgaggatgaccgtctaagggacggcgaacggtgccgtgatgactctttttttggggagacttcgcacaactaccataagtttgacagcgaatacgaacgcatggggcgaggtcccggaccactgcaagagcgaagcctgttcgagaagaaaagaggcgctcctccctccagcaatatagaagattttcatggactgttgcctaagggatatccccacctgtgctcaatctgcgatctgccggtccactctaacaaagagtggagccaacatatcaacggtgctagccatagtagaagatgccagctgctcttagaaatttaccctgagtggaaccctgataacgataccggccatacaatgggtgatcctttcatgctgcaacaaagtactaatcctgctccagggatcttggggccacccccaccaagctttcatctggggggtccagccgtcggtccccgaggcaatctcggtgccggaaacggcaatttgcagggccctcgtcatatgcaaaagggcagagtcgagactagccgcgtggttcacattatggactttcaacggggtaagaatcttcggtaccagctcctccagttagtcgagccattcggtgtgataagtaaccacttgatcctgaataaatag

SEQ ID NO: 229714 - DNA, 1530 bp, Artificial Sequence
  Description of Artificial Sequence: Synthetic coding sequence
atgggcgaccctttcatgctgcaacaatctaccaaccccgctccaggaattcttgggcctccccctcctagctttcacctcgggggacccgctgtaggacctagaggaaacctgggggctggcaatgggaatttacagggcccaaggcacatgcaaaagggcagggtcgagacgtccagagtcgtgcacattatggacttccagaggggcaaaaatctcaggtaccagctgttgcagctcgtggagcccttcggtgttatctccaaccacctcatcctcaacaaaatcaacgaagcatttatcgagatggcaactactgaagatgctcaggccgcagttgactattacacaacaactcccgctctggtgtttggcaaaccggtcagagtgcacctatctcaaaaatacaagaggattaagaaaccggagggaaaacccgaccagaaatttgaccaaaagcaggagttggggagagtgattcatctgtcaaatctccctcattcagggtattcggatagcgcagtgctcaagttggccgagccttacgggaaaatcaagaattatattctcatgagaatgaagtcacaggccttcatagagatggaaactagagaagatgctatggcgatggtggatcattgcctcaagaaagctctctggttccagggcagatgtgtgaaggttgatttgagcgaaaagtacaagaagcttgttctcagaattccaaacaggggcatcgacctactgaagaaagataagtcccgtaaaaggagttatagccctgacggaaaagaaagcccttccgacaaaaagagcaagaccgatggatcccagaaaaccgagagtagcaccgagggcaaggaacaagaggagaaatccggagaggatggagagaaggatacaaaggacgatcaaacagagcaggaacctaatatgctccttgagtccgaagacgagcttcttgttgatgaagaggaggctgctgcactgcttgagtccggcagttccgtgggggacgaaacggacctcgctaatctgggggacgtggcctccgatggtaaaaaagagccttctgacaaagccgtgaagaaggacggaagcgctagcgccgctgcgaaaaagaagctgaaaaaagtagacaaaatcgaggaattggatcaggagaatgaagcggctttggaaaatggaattaaaaacgaggagaataccgaacccggtgccgagagctccgagaatgcagacgatccgaacaaggacaccagcgagaatgctgacgggcagtctgacgaaaataaagacgattacacgatccccgatgagtatagaattgggccttatcagccaaacgtacctgtgggcattgactacgttattccaaaaacgggtttttattgcaagctatgctcgctcttctacaccaatgaggaagttgcaaaaaacacccattgctcttccttgcctcattatcaaaaacttaaaaagtttctgaataagctcgctgaagagagaagacaaaagaaggaaacctag

SEQ ID NO: 229715 - DNA, 144 bp, Artificial Sequence
  Description of Artificial Sequence: Synthetic coding sequence
atgtccaagtcatttcagcaatcgagtttgtccagagacagtcaaggacacggaagggatctgtctgctgctggcatcggcttgctggccgctgccactcagtccctaagcatgccagcttcgcttgggaggatgaaccagtag

SEQ ID NO: 229716 - DNA, 237 bp, Artificial Sequence
  Description of Artificial Sequence: Synthetic coding sequence
atgtcaaaatcgttccagcagtcaagcttgagcagggactcccagggccacggtagagacctgtctgcagctggtattggacttctcgccgcagcaacccagtccctcagcatgccggcatcccttgggaggatgaatcagggtacagcgcgtctcgcgagcctcatgaacctgggcatgtctagctccctgaaccagcaaggcgcacactctgcattgagctccgccagcacctag

SEQ ID NO: 229717 - DNA, 2544 bp, Artificial Sequence
  Description of Artificial Sequence: Synthetic coding sequence
atgagtaagagtttccagcaatcctctttaagtagggactcccaggggcatggaagagatctgagcgctgcaggcatcggactcctagctgcagccactcagtccctctctatgcctgcaagcttaggccgaatgaatcaaggaacagcacggctcgccagcctgatgaatctcgggatgtcctcatccctgaaccagcaaggggcacactccgcactttctagcgccagtacctcaagccataacctgcagtctatcttcaacataggctcccggggtcctctgcctttatcttctcagcataggggtgatgccgatcaggcctcaaacattctggcttcctttgggttatctgcccgtgacttagacgaactgtcccgatatccagaggacaagatcacacccgagaatcttccacaaatcctcctgcaactcaaaaggcgacggacggaggaaggtcccacgttgtcttatggaagagacggacgttccgccaccagggagcccccttacagagtcccacgcgacgactgggaggagaagcgccatttccgaagggattctttcgacgataggggccctagcttgaaccccgtcctggattatgatcacggttcacggtcccaggagtccgggtactacgacaggatggactatgaagacgatcgcctcagagacggcgaaagatgtcgcgatgactctttcttcggagagacttcacataattatcataaatttgactctgagtacgagcggatggggagaggaccgggtcccctccaggagagatccctcttcgagaagaagaggggtgcacctccatcaagcaacatcgaggattttcatggactgcttcctaagggctatccacatctgtgcagtatatgtgacctgcccgtgcacagcaacaaggaatggtcacaacacattaacggagcatcccactcccggcgttgccagctgcttctggaaatctacccagaatggaacccagacaatgacacagggcataccatgggcgacccctttatgctgcagcagagtactaatcctgccccaggcatcctagggccaccccctcctagtttccatctcggcggtcctgccgtgggaccacggggtaacctgggtgccggaaatggaaatctccagggtcccagacacatgcagaagggacgggttgagacatctcgtgtggtgcacataatggactttcagaggggcaagaatctacggtaccagctgctgcagctcgtggagccctttggagtgatttccaatcacctgatactcaataagattaatgaggcctttattgagatggcaaccaccgaggatgcccaagccgcagtggactactacactactaccccagctttagttttcggaaaaccagtgagggtacacttgtcccagaagtacaagcgcattaaaaaaccagagggcaaacccgatcagaaatttgaccagaaacaggagctgggtcgcgtgatacacctgtctaacttgcctcactcaggatacagcgatagtgccgtgctcaagctagccgaaccctacgggaagatcaagaactacattctgatgagaatgaagagccaagctttcatcgaaatggaaacaagggaagatgccatggcaatggtggaccactgcctgaaaaaggccctctggttccagggaagatgtgtcaaggttgatctttcagaaaagtacaaaaaattagtgcttcggattcccaacagaggcatcgatctgttgaaaaaggacaaatccaggaagaggtcatacagccccgacggcaaagagagtccatcagacaaaaaaagcaaaaccgacggttcacagaaaacagagagctctaccgaagggaaggagcaggaagagaaatcgggcgaggacggtgagaaagataccaaggatgatcaaactgagcaggaaccaaatatgctgctcgagtctgaagatgagctgcttgtcgatgaagaggaggctgccgctctgctggagtccggctccagcgtcggtgacgagacggacctcgcaaacctcggagacgtcgcctcggatgggaagaaggagccgagtgacaaggccgtgaagaaggatggttccgcatctgcagccgcaaagaagaagcttaaaaaggtagacaaaattgaggagctggatcaggagaatgaagcagctttggagaacggcattaagaacgaagagaacactgagcctggagccgagtcctctgagaatgctgacgacccaaacaaggatacttcagagaacgccgatgggcagagcgatgagaacaaagatgactataccatacccgatgagtacaggatagggccatatcagcctaatgtgccagtcggcattgactacgtcatacccaaaacaggcttttattgtaaactgtgcagtctcttttataccaatgaagaagtggccaagaacactcattgcagtagcctacctcactatcagaagctgaagaagtttctgaataaactggccgaagaacggaggcagaaaaaagagacttag

SEQ ID NO: 229718 - DNA, 30 bp, Artificial Sequence
  Description of Artificial Sequence: Synthetic coding sequence
atgtccaagtctttccagcagtcctcttag

SEQ ID NO: 229719 - DNA, 303 bp, Artificial Sequence
  Description of Artificial Sequence: Synthetic coding sequence
atgtccaagtctttccagcagagttcattatcccgggacagccaggggcacggacgagatctcagcgcagctgggattggcttgcttgccgcagccacacagtctctgtctatgccagccagcctaggacgcatgaatcagggaacagctaggctggcatccctgatgaatctagggatgtcgtcatctctgaaccagcagggcgctcatagcgcactctccagcgcctcaacatcctcacataatctgcagagcatcttcaacattggttcacgcggacccctacccctcagcagtcagtag

SEQ ID NO: 229720 - DNA, 324 bp, Artificial Sequence
  Description of Artificial Sequence: Synthetic coding sequence
atgagtaaatccttccaacagtccagcctaagtagagattcccagggccatgggagggacctgtcagcagcaggcattggcctgctggcagcagctacacagtccctgagtatgccggcaagccttggcaggatgaaccaggggacggccaggttagcatccctgatgaatttggggatgtcttcttctctgaaccagcagggtgcccacagtgcactctccagcgcatccacctcttcccataatctccaaagtatcttcaacattggatccagggggccactgccactttccagccagcatcggggagacgctgatcagtag

SEQ ID NO: 229721 - DNA, 1578 bp, Artificial Sequence
  Description of Artificial Sequence: Synthetic coding sequence
atgcgagttttttgtgtgggattgctgttattcagcgtgacttgggcggctcctaccttccaaccacagacagagaagacaaaacagtcatgcgtggaagagcagagacaggaggaaaagaacaaggataacattggattccatcacctggggaaaaggatcaatcaggagttgagctctaaagaaaacatcgtccaggaacgtaagaaggatttgtccctctctgaagccagtgagaacaaaggtagcagtaagtcccagaattattttaccaacagacagagattaaacaaggaatatagcatatcaaacaaagaaaatacccacaacggtttgcgaatgtccatatatcctaaaagcaccggaaacaaagggtttgaggacggtgacgacgctataagtaaactacatgatcaggaggagtacggtgccgcactgatccggaataacatgcagcacatcatgggccctgtcacagccatcaagctgttgggagaggagaataaggaaaacaccccgagaaatgtcctgaacataatacccgcttctatgaactatgctaaggcccattccaaagacaaaaagaagccacagagagactcccaagcacaaaagtccccggtgaagtctaagagtactcaccgaatacagcataatatcgactaccttaagcatctctctaaagttaagaaaattccctctgacttcgagggctcaggctataccgacctacaggaacgtggagacaatgacatttccccattcagcggggacggccagccatttaaagacatcccaggcaagggcgaggcgaccggaccagatctcgaaggcaaggatatccagacgggtttcgcgggtccttctgaggccgaaagcactcacttagatacaaagaagccaggatacaacgaaattcctgagcgagaggaaaatggagggaataccatcgggacacgggacgaaacggcaaaggaggccgacgcagtagacgtgtcattggtggagggttccaacgatattatgggtagcactaacttcaaggagctgcccggacgcgaagggaacagggtcgatgccggatcccagaatgcgcatcagggcaaagtcgaattccactacccacctgccccttcaaaagagaagcgcaaagaagggtccagcgacgctgcggaatcaacaaattataatgagattcctaagaacggaaaaggttccacaaggaagggggttgatcattccaaccgcaaccaggctacactgaacgagaagcagaggtttccaagcaaagggaagagccagggtctaccgatccccagtcggggacttgataatgagatcaagaacgagatggattcgtttaatggaccttctcacgagaacatcattactcatggccgtaagtatcattacgtcccccacaggcaaaataattccacccggaataaagggatgccccaggggaagggatcttggggcagacaacctcactccaatagaagattctcttctcgtcgtcgagacgactcaagcgaaagctccgatagcggatctagcagcgagtccgacggcgactag

SEQ ID NO: 229722 - DNA, 1578 bp, Artificial Sequence
  Description of Artificial Sequence: Synthetic coding sequence
atgcgggtgttttgtgtcggccttctgctcttcagcgtgacttgggccgctcctacatttcagccacaaacagagaagactaagcaaagctgtgtggaggagcagcggcaggaagagaagaataaagacaacatcggctttcaccacttgggcaagagaattaaccaagagttatcctcaaaagagaacatagttcaggaacgcaaaaaggatttatctctcagcgaggcaagcgaaaacaaaggcagctccaaatctcagaattatttcaccaataggcagaggctgaacaaagagtattccatcagcaacaaagaaaacacccacaacggcttgcggatgagcatctaccccaagagcacgggtaacaagggcttcgaggatggggatgatgccatctctaagctacacgaccaggaggaatacggggcagctttaatccgcaataacatgcagcacattatgggccctgttacagccatcaagttactgggagaggaaaataaggagaatacccctagaaacgttcttaacataattccagctagtatgaactacgcgaaagcacactcaaaagataaaaagaaaccgcaacgcgattcacaggcacaaaaatcaccagtaaagtccaagtccacgcaccggattcaacacaacatcgattacttgaagcacttgtccaaagtcaaaaagattcctagcgatttcgaagggtctgggtatacagacttacaagagcggggagataatgacatttccccttttagtggcgatgggcagccattcaaggacatacctggaaagggggaagcgactggacctgatctcgagggtaaagacatccagaccggttttgcaggcccttccgaggctgagtccactcatctggacaccaagaagcctgggtacaatgaaattcccgaacgagaagaaaacgggggaaacacaattgggacgcgcgatgagactgcaaaggaggccgatgccgttgatgtgagtcttgtggaagggagcaatgatatcatggggtctactaactttaaggagctgcctgggagggaaggtaacagggtggacgccggttcccagaacgctcatcagggtaaggtggaatttcactaccctcctgctcctagtaaagagaagcgtaaggagggttcatcagacgctgcggagtctacaaactacaatgagatacccaagaatgggaaggggtcaacgcgcaagggagtggatcatagtaaccggaatcaagcgacattgaatgaaaagcagagattcccctctaaagggaagtcccaggggctgcccattcccagccgaggactcgacaatgagatcaaaaacgaaatggacagctttaatggcccaagccatgaaaatattataacccacgggaggaagtaccactatgtaccccatcgccaaaacaactctactcgcaataaagggatgcctcagggaaaaggatcttggggcagacagccccattcaaataggagattttcaagtcggagaagagacgattcctctgagtcatccgactccggctcttcgtctgagagtgacggagactag

SEQ ID NO: 229723 - DNA, 828 bp, Artificial Sequence
  Description of Artificial Sequence: Synthetic coding sequence
atgagagtgttctgtgttgggctcctgttgttcagtgtcacctgggccgctccgacctttcagccgcagacagagaagaccaaacagtcatgcgtggaagaacaacgacaggaggagaagaataaggataatattggctttcatcacctcggaaagaggatcaatcaagaacttagttcgaaggaaaacatcgtgcaggaacgtaaaaaggatctctctctttctgaagccagcgagaataagggttctagtaaaagtcaaaattactttactaaccgccaaaggctgaacaaggaatatagcatcagcaataaagaaaatacacataatggtttgagaatgagcatttatccgaagtctactggaaataagggcttcgaggacggcgacgacgctatttccaaacttcacgaccaagaggagtacggggctgcacttattcggaacaatatgcagcacataatgggtcccgtaacagctatcaaattgctaggtgaggaaaataaggaaaacacaccgcgaaacgttctgaatataatccccgcttcaatgaattacgctaaggctcattccaaggacaaaaaaaagccccagcgcgactcacaagcccaaaaatctcctgtcaaatcgaaatccacgcatcggatccagcataatatagactatctgaagcacctgagtaaagtcaagaagattccaagcgactttgagggctccggctacacagacctacaggaacgaggagataacgatatcagcccctttagtggaacggcaaacctactgcgcaccttcctcgttaaggagaagcttctggtgctgacttag

SEQ ID NO: 229724 - DNA, 1239 bp, Artificial Sequence
  Description of Artificial Sequence: Synthetic coding sequence
atgtcaatataccccaagagcactggcaataagggtttcgaggatggtgatgatgccatatcgaaactgcacgatcaggaagaatacggcgcagcactgatccggaataacatgcagcatattatgggcccagtgactgctataaaactcctcggtgaggagaataaagagaacacccccagaaacgtgctgaacatcattcctgccagcatgaactatgcaaaggcacactccaaagataagaagaagccccagagggactcacaggctcaaaagtcccccgttaaatccaaaagcacccataggattcagcacaatatcgactacttgaagcacctgtctaaggttaaaaagattccgtccgatttcgaagggagtggttacactgatttgcaggagagaggagacaacgatatctctccctttagcggagatggccagccttttaaagatatacctggaaagggcgaagccactgggcctgacttagaggggaaagatatccaaaccggctttgcaggcccttctgaggccgaatccacacacctggataccaagaagcctggctataacgagatccccgaaagggaggagaatgggggtaacacaataggcacccgggacgagaccgccaaggaggcagacgccgtagatgtctctctcgttgagggctctaacgacatcatgggttcaaccaatttcaaggagctgccgggacgagaggggaatagagtggacgctggatcacaaaacgcccatcagggaaaggtggaattccactacccgccagctccttctaaagagaagcggaaggagggcagctcagacgcagccgaatctacaaattacaatgagattcctaaaaatggcaagggctccacgagaaagggcgtcgatcactccaaccgaaaccaggcaaccctgaacgagaagcagcggttccccagcaaagggaagtctcagggtctgcctatcccctcccggggactggataacgaaatcaagaacgagatggatagttttaacggtccaagtcatgagaacattatcactcacggcaggaaataccactacgtccctcaccggcaaaacaactcaactcgaaataagggcatgccacagggcaagggctcgtgggggaggcagcctcattcgaatagacggttttcaagcaggaggcgtgatgactcaagcgaatcaagcgacagcgggtcgtcttcggagtctgacggcgactag

SEQ ID NO: 229725 - DNA, 1239 bp, Artificial Sequence
  Description of Artificial Sequence: Synthetic coding sequence
atgagtatttaccccaaaagcacaggaaataagggatttgaagatggtgacgatgcgattagcaagttacatgaccaggaagagtatggggctgctctgatacggaataatatgcagcatatcatggggccagtcacagctattaaactgctcggcgaagagaataaagagaataccccgcgaaatgtgttgaatatcattcccgctagtatgaattatgcgaaagctcattccaaagataagaagaaacctcaacgcgactctcaggctcaaaaatccccagttaaaagcaagtccacccaccgtattcagcataatatagattacctgaaacacctctcaaaagtcaagaaaatccccagtgacttcgaaggctctggttataccgacctgcaggaaagaggggacaacgatatatcgcctttctccggagacggccaaccattcaaggacatacccggtaaaggcgaagccaccgggccagacttagagggcaaggatatacaaaccgggttcgccggacccagcgaggcggaaagtacccacttggatactaaaaagccgggatacaacgaaatccccgagagggaggagaacggcggaaacaccataggtacccgagatgagaccgccaaggaagcagatgccgtggacgtgtcgctggtggagggatccaatgatatcatgggcagcacaaattttaaggagcttcccggaagagaggggaatagagtagacgcgggatcccagaatgcgcatcaggggaaggtagagttccactatccccctgcaccatctaaggaaaagagaaaagagggcagctcagatgccgcagaaagtactaattataatgagatccctaaaaacgggaaaggcagcacacggaagggagtcgatcattccaatagaaatcaagcaacgctcaacgagaaacagagatttccgagcaagggcaaatcacagggccttccaatccctagcaggggcctcgataacgagataaaaaacgagatggactcctttaatggccctagccatgaaaacattataacacacggtcgcaagtaccattacgtgccacacaggcagaacaactctacgcgcaacaaaggcatgccccaaggtaaaggcagttggggccgtcagccacattcaaatcgacgcttttcttctcgccgacgggacgacagcagcgagagttctgacagtgggagtagtagtgaatctgacggggactag

SEQ ID NO: 229726 - DNA, 312 bp, Artificial Sequence
  Description of Artificial Sequence: Synthetic coding sequence
atgaaatcccttatactgctggctatactggccgcattggctgttgtgacgctctgctacgagtctcatgaatccatggagagttacgagctgaacccattcattaatcgcaggaacgcgaatactttcatttccccacaacaacggtggcgcgctaaggtccaggagcggattcgggaacgtagtaagcccgtacatgaacttaacagggaggcatgtgatgactaccgcttgtgcgaacggtacgccatggtgtacggatataatgctgcctacaatcgctatttccggaaacgaaggggtacaaaatag

SEQ ID NO: 229727 - DNA, 945 bp, Artificial Sequence
  Description of Artificial Sequence: Synthetic coding sequence
atgggcccactcatcaaccggtgtaaaaagatcctcctgcccaccaccgtgccacctgctactatgcgaatttggctcctcggaggactgctgccttttctcctgctgctttccggcctgcagagacctactgaagggtctgaagtagccataaaaatcgacttcgacttcgccccaggctctttcgacgaccagtatcagggctgcagcaagcaggtcatggagaagctgacgcaaggcgactatttcactaaggatattgaagcccagaagaattactttaggatgtggcagaaggcccacttggcatggctcaatcaggggaaggtcctgcctcagaatatgacaacaacgcatgccgttgcaatcttgttttatacactgaactccaatgtgcacagtgactttacccgggctatggctagtgtcgcccgaaccccacagcaatacgagcgaagttttcactttaaataccttcattactatctgacttctgctattcagttacttcgcaaagactcaatcatggaaaacggaacactctgttatgaggtgcactaccggactaaggacgttcacttcaatgcttacacaggtgccacaataagattcggccaattcctgagtacatccttactgaaagaagaggcacaggagtttggcaatcagacgctcttcaccatctttacctgtctcggggcacccgtccagtactttagcttaaagaaagaggtactcatcccaccctacgagctatttaaggtaattaacatgagctaccaccctcgcggtgattggctacaactgagatctaccggaaatctgagcacctacaattgccagctgctgaaggcgtcttcaaagaagtgtattccggaccctattgccatcgcttctctatccttcttaaccagcgtcatcatcttctctaagtctcgcgtttag

SEQ ID NO: 229728 - DNA, 1749 bp, Artificial Sequence
  Description of Artificial Sequence: Synthetic coding sequence
atgagcatcgagaccttgttggaggcagccagattcctggagtggcaggcccagcagcaacagagggccagagaggaacaagagagactgcgactcgagcaggaacgagagcaagaacagaagaaagccaactccctggcgcgactcgcccataccctgcctgttgaggagcccagaatggaagctccccctctcccattgagtccaccagcccctccgcctgctcccccacctcctctggcaaccccagcgccactgaccgtgatcccaatcccagttgtgaccaacagccctcagcctttaccacccccacccccactgccggcagccgcacaacctctgcccttggcacctcgccagccagctttggtgggtgcccctggcctatctattaaggagcctgctccgctgccttcccgccctcaggtgcccactcctgctccattgctgccggactccaaagccactattccccctaacggaagtcctaaacccctgcagcccctcccaactcctgttctgactattgctccacatcccggtgtccagccacaactcgctcctcaacaacccccacctcccacattgggaacgcttaagttggcccctgccgaggaagtgaagtcatctgagcagaagaagaggcccggtggcatcggtactagggaagttcataataaattagaaaaaaatcgcagggcccacttgaaggagtgctttgaaaccctcaaaagaaacatccctaacgtagatgataagaaaacaagcaacttgtctgtgctccgaactgccctccgctacatccagtcactaaagcgaaaagagaaagagtacgaacatgagatggaaaggctggccagagagaaaatcgcaactcagcaaaggctggcggagctcaagcacgagctctcacagtggatggatgtcctcgagatcgatagggttctccgacaaacgggacagcctgaggatgatcaggcgtctacctctacagctagcgagggcgaggacaatatcgacgaggacatggaagaggatcgggcaggtttggggccacccaagttatcccatcgcccacaaccggagctgttgaaaagtacattgcccccacccagcactactccagccccattgccgcctcacccacaccctcaccctcatagcgtggctctgccccctgctcacctccctgtccaacagcaacagccacagcagaaaacccctctgccagctcccccacccccacctgccgctcctgctcagaccctcgtccccgctcccgcacacttagtggccacagcgggtggcggtagtactgtgattgcccacacagcaactacacacgccagcgtgattcagactgtgaatcatgtgttgcaggggccagggggaaagcacatcgcacacattgccccatcggccccttctccggcagtgcagctggcaccagcaacgcctccgataggccacatcaccgtgcatcctgcaacactgaaccatgtggcgcacctgggttcacagctgccactgtatccccagcccgtggccgtgtcccatatagcccacacattgtctcaccaacaggtgaacggcacagctgggctaggtcctcccgctaccgtgatggcaaagccagccgtgggcgcacaggtagtacatcacccacaattagtagggcaaactgttttgaacccggtgacaatggtaactatgccctcatttcctgtctctaccctcaagctggcctag

SEQ ID NO: 229729 - DNA, 1749 bp, Artificial Sequence
  Description of Artificial Sequence: Synthetic coding sequence
atgtccatcgaaaccctgcttgaggcagcacgctttctggagtggcaggcacagcagcagcaaagggccagagaggagcaggagaggctaagactggagcaagagagagagcaggaacagaaaaaggcgaactctctcgccagactcgctcacactcttcccgtggaggagcccagaatggaggcgcctccgctgcctctgagtccgccagctcctccccctgcaccacccccacctctggccacaccagctcccctcaccgtcatacccatcccagtggtcaccaatagtccacaacctctcccgccacctccaccactccccgcagccgcacagcccctacccctcgcccctaggcaacccgcactggtcggagcgccagggctatcaataaaagaaccagccccactgccttcccggcctcaggtacctacacccgcacctttgcttcccgactcaaaagctaccatcccaccaaacggctcaccgaaacctcttcagcctcttccgacgcccgttctgaccatagctcctcaccccggtgtgcaacctcagcttgcgccacagcagcccccacctcctactttgggcaccttaaagctagcacccgctgaggaggtgaaaagcagtgaacagaaaaaacgccctggaggtatcggcaccagagaagtacataacaagctcgagaaaaacaggagggctcacttaaaagaatgctttgaaacattaaaaaggaacatccctaacgtagacgacaagaagacatctaatctgtctgtcctgagaactgctttgcgctatatccagagcctcaaacgcaaagagaaggaatacgagcacgagatggagagactggcacgtgaaaaaatcgccactcagcagaggcttgcggaacttaagcacgagcttagccagtggatggacgtcctcgagatagacagagtcctgaggcaaaccggacagcccgaagatgatcaagccagtacgtccacagcttctgagggtgaagataatatcgacgaagatatggaggaggacagagctggtctcggccctccgaaactgtcgcatagaccgcagccagagctgttgaaaagtaccctccctcctccatcgactacgcctgcccctctccctccgcatccacacccgcaccctcattctgtggcactgcctcccgcacacctgccagtgcaacagcaacaacctcaacaaaaaactccattgccggcaccgcctccgccaccagccgcaccagcccagacattggtgcccgcaccagcccacttggttgcaaccgctgggggtggatccactgttatcgctcatactgctaccacacatgccagcgtgattcaaactgtcaatcatgttctccagggcccagggggaaagcacattgctcatattgcccctagcgccccatcacctgccgtccaactcgccccagcgaccccacctatcggacacattaccgtgcacccagcgacacttaaccacgtcgcgcacctgggctcacagctccctttgtatccccagcctgtggcggtgtcccatattgctcacactctatcacaccagcaggtcaacggaacggcagggttgggcccacccgcaactgtgatggcaaagcctgctgtgggggctcaagtggtccaccacccccagctggtcggtcagaccgttctgaatccggtgaccatggtgaccatgccctccttccccgtgagtacacttaagctggcctag

SEQ ID NO: 229730 - DNA, 594 bp, Artificial Sequence
  Description of Artificial Sequence: Synthetic coding sequence
atggaaccgctggcatcgaatatacaggtgctgcttcaagcggcagaatttctggaaaggagagaacgggaggctgagcatgggtacgccagcctgtgcccacaccgatcccccggtcccatccaccgtcggaaaaagcggccacctcaggctcccggtgctcaggatagcggacgctggcgcgcacagctgaaaagatgccttgagagactaaagcagcaaatgccattgggagcagactgcgctcggtacactactctgagtcttttgcgacgggctagaatgcatatccagaaactggaggatcaggaacaacgcgcaaggcagctcaaggagaggttgcggtctaagcagcaaagcctgcagagacagctggaacagctgcgcggtctggctggggctgccgaaagagagaggttgcgggctgactcactggatagctcaggtctgtcaagcgagcggtctgattccgaccaggaggaactcgaggtggatgtggaatcacttgtctttggcggagaggccgagctgctgcgtggcttcgtggcaggacaggaacactcttattcacacggcggaggggcttggctttag

SEQ ID NO: 229731 - DNA, 1167 bp, Artificial Sequence
  Description of Artificial Sequence: Synthetic coding sequence
atggaacccctagcttcaaatattcaagtgctcctgcaggcagcagagttcctagaaagacgcgaaagggaagccgagcatggctatgctagcttatgcccacacaggtcccccggacccattcatagaagaaaaaagcggcctccccaggctccgggagcgcaggattctggaaggtccgtgcataacgaactggaaaagcgacgcagagctcaactgaagcgctgcctggagaggctgaagcagcagatgccactgggcgcagactgtgcccgttacacaacactatccctgctgcggagggcacgaatgcatattcagaaactcgaggaccaggaacagcgcgcacggcagcttaaagagcgactacgttctaaacagcagtcactgcagcggcagttagaacaactgaggggcttggccggagcagccgaacgagagagattgcgggcagactcccttgactcgagcggactgtcctctgagcggtccgattcagaccaaggagagtgccctgaggccgagggattgtgtggacctcgcggtgagccaggtctccttacaggaccgttacccgctcagaggtcctggaggtggatgtggagggcttggtgcctgggcgtcaggccatcttgttgtggagcctcttcacctgctaggagtacagccacccgtacggccgctgccccagggtacgacgttccccaccccggaagggcttccgccctctattcttgtcaggcccaccttccaggacgttccccgcctcaagcttttagggctgccagaagccatcttctggagtggacaaaacgaactctcgtctgggagcaggttcttcctaaacacccggctgcaggctgccaggccggtcctctggaaggcaagggccaggattcatcggggccaccatggacacccgctggacaggccgcatgggcacgagcgcaagcctttggtagtgctgcacccaaggggacgggttccctactggggttattcccctcctggactaggcccccagcttttgctagccacaaactctattctatttttatcaagtcactgtttcacaatttcccctccatcgtgttgcctaatgagaacggaggcactcccaatcacaggccaacaggcagaggcaacaacatatcgtcgcaccattag

SEQ ID NO: 229732 - DNA, 582 bp, Artificial Sequence
  Description of Artificial Sequence: Synthetic coding sequence
atggagcccctggcatctaatattcaggttttgctgcaggcagccgagtttctcgagcggagagagagggaggccgagcatgggtacgccagcctgtgccctcataggtcccccggacctatccacaggcggaagaagaggccccctcaggcaccaggcgctcaggattctggaagaagcgtgcataacgaactggaaaaacggaggagagcccaattaaaacgatgcctcgagagacttaaacaacagatgccactgggggctgattgcgccagatacactaccctctctcttctcaggagggctaggatgcacatacagaagctggaggatcaagagcaaagagcaaggcagctgaaagagcgactgcgatcaaaacagcagagcttacagagacagttggaacagctgcgcggattggccggagccgctgaaagggagcggctccgagccgactcgttggactcaagtggcctttcttcggaaaggtcagatagcgatcaggtgctgccaaacgagaatgggggtactcccaatcacaggcctacgggcaggggtaacaacataagttcccatcattag

SEQ ID NO: 229733 - DNA, 621 bp, Artificial Sequence
  Description of Artificial Sequence: Synthetic coding sequence
atggaacctctcgctagcaacatccaggtgctgcttcaggccgctgaatttttggagcgaagagagcgcgaggctgagcatggctacgccagcctatgcccccacaggagtccgggtccaatacatcgacgaaagaaacgcccacctcaggctcccggagctcaggattctggccgtagcgtgcataatgaactggagaagcgcagacgtgcccagttgaaaaggtgtctcgagaggctgaaacagcagatgcccctgggggctgactgcgcgaggtatacgacactcagtctgctgaggagggccagaatgcatatacagaagctcgaagatcaggaacaacgcgctcggcagttaaaggagcgtttgcggagtaagcaacagtccctgcagagacagctggaacagttaaggggactggcaggcgcagcagagcgcgaacggctcagagcagattcattggacagctcagggcttagctctgagaggtctgatagtgaccaggaggagctggaggtcgacgttgagagcctcgtgttcggcggagaagctgaacttctgagaggttttgtggccggacaggagcactcctattctcacggagggggtgcctggctgtag

SEQ ID NO: 229734 - DNA, 621 bp, Artificial Sequence
  Description of Artificial Sequence: Synthetic coding sequence
atggaaccactggccagcaacatccaggtccttttgcaagcagccgagttcctggagagaagggagcgggaggctgagcatggttatgcatcgctctgcccccatcgctcaccaggaccaattcatcggagaaagaaaagaccaccacaggcaccgggagcccaggattcaggccgatccgtgcacaacgagctggaaaagcgaagaagggctcaactgaagaggtgtctggagaggctcaagcaacaaatgccactcggggcagattgcgctcgatacaccacattgagtttgctgaggagggccaggatgcatatccagaagcttgaagatcaagagcagcgggctagacaactcaaagagcggctgaggtccaaacagcagtctctacagaggcagctggagcagctgcgtggcttagccggagctgccgaacgagaaagattaagggctgatagcctcgacagttcaggcctaagttcggagaggtccgacagcgaccaagaggagctggaggttgatgtggagagcctagtcttcggaggggaggccgagctgctgaggggtttcgttgcaggccaggagcactcttacagccatggaggaggggcttggctgtag

SEQ ID NO: 229735 - DNA, 768 bp, Artificial Sequence
  Description of Artificial Sequence: Synthetic coding sequence
atgatacaggccatacaagttctcaggttccatcttctcgaactggaaaaagtacatgagttatgcgataacttttgccaccgttacatctcatgtttgaaggggaagatgcccattgacttggtcattgacgagcgcgacggatcctctaagtcagaccatgaggaattgagtggatcaagtaccaaccttgctgatcataaccccagcagctggcgcgatcacgatgacgcgacgagcacccactctgccggaacccctggcccaagctccggaggccacgcatctcagagtggcgacaactctagtgagcagggagacgggctggacaactcagtagcctcaccaggcacaggagatgacgacgaccccgacaaggacaaaaaacggcaaaagaagcgaggaatcttcccaaaggtagctaccaatattatgcgggcttggttattccagcacctgacgcacccgtacccgagcgaggaacagaaaaaacaacttgcgcaggacactgggctcaccatcctccaggtaaacaattggttcattaatgctcggcgaagaatcgtgcagcccatgatcgatcaatcaaaccgagccggtttcttgctcgacccttccgttagccagggcgctgcatacagcccagagggacagccgatgggctccttcgttcttgatggacaacagcatatgggaataaggccggcaggaccaatgtccgggatgggaatgaatatgggaatggatggtcagtggcattacatgtag

SEQ ID NO: 229736 - DNA, 9080 bp, Artificial Sequence
  Description of Artificial Sequence: Synthetic coding sequence
atggaagaaaagcagcagattattttagctaatcaggatgggggaacggtggccggagccgcacctacattcttcgtgattcttaagcaaccaggcaatggcaaaacggaccaaggaattctggtcaccaatcaggatgcttgtgcgctcgcctcaagcgtgagtagtcccgtgaagtccaaaggaaagatttgtctacctgctgattgcaccgtggggggtattaccgtaactttggacaataactcgatgtggaacgagttctatcaccgaagcactgagatgatcctgactaaacagggaagaagaatgttcccttattgccgctattggattaccggactggactctaatctcaaatacatcctcgtcatggatatcagtccagtggacaatcaccgttacaagtggaatggccgttggtgggagccaagcgggaaagccgagcctcacgtgctgggaagggtcttcattcatcccgaatccccaagtaccggacactattggatgcaccagcccgtgagcttctataaattgaaactgaccaacaatactctggaccaagagggacacattattctgcactctatgcatagatatcttccaaggctgcacctggtgcccgcagagaaggccgtcgaggtgatccagctgaacggcccaggcgttcataccttcacctttccacagactgaatttttcgctgttactgcctaccagaacattcagattacccagctcaagatcgactataacccattcgctaaggggttccgagacgatggtctgaacaacaagccccaacgcgatgggaagcaaaaaaacagctctgaccaggaaggtaataacatctcctcatctagcgggcaccgtgtccgtctgaccgaaggccaggggagcgaaatacagccaggagatctggaccccctatcccggggacacgagacgagcggaaaaggcctcgaaaaaactagcttaaacataaagcgggatttcttagggtttatggatacggattccgctttgtcagaggttccccaactgaagcaagaaattagcgaatgccttatagcatcgtcattcgaggatgattcgagagtagcatcccctctggatcagaatggatccttcaatgtggtcatcaaagaggaaccactggacgattacgactatgagctcggcgagtgtcccgagggtgtgacagttaagcaggaggagacggacgaagaaacagatgtctacagcaacagcgacgacgacccgattctggagaagcagctaaaacgccacaataaggtggacaacccagaagcagaccatttgagtagcaagtggctccccagcagcccgagcggggttgccaaggccaaaatgtttaagcttgacacgggaaaaatgcccgtcgtgtacctggaaccttgtgccgtaacaaggagtaccgtcaagatttctgagctccctgataatatgctgagcacaagcaggaaggacaagagttcgatgctagctgagctagagtatctgcccacatacatcgaaaattctaacgaaacagctttttgtcttgggaaagagtccgagaacggactgcgcaaacatagcccagatcttcgagttgtgcaaaagtatcctctgctcaaagagccccaatggaagtaccctgacatttctgacagtatttccactgagcgcattttggatgacagtaaggatagcgtgggggatagcctgagtggcaaagaagaccttgggagaaagaggacaactatgctgaaaattgctactgctgcgaaggtcgtgaacgctaaccaaaatgccagcccaaacgtgcccggaaaaaggggaagacccaggaagctgaagttatgtaaggccggacggccaccgaagaatacaggaaagtctctgatctcaacaaagaatactcctgtatcccccggaagtacttttccagatgtgaaacccgacctggaagacgtcgacggagtgctcttcgtgtcgttcgaatccaaagaggccctcgacattcacgctgtggatgggacaaccgaggagagcagttctcttcaggcctcaaccacaaacgatagtggataccgagcccgtatttcacagctggaaaaagaactgatcgaggacttgaagactctgaggcacaagcaggtaatccatccgggtctgcaggaagtcgggttaaaattgaattcggtggaccctacaatgagcattgatttaaagtacttaggcgtgcagctccctcttgcccctgcgactagctttccattttggaacctgacaggcaccaaccccgcaagtcccgacgcaggcttcccttttgtcagcaggacaggcaaaaccaatgactttacaaagatcaaagggtggcgcggtaagtttcactctgccagcgccagtaggaacgagggcggaaacagcgaatcttcgctgaaaaataggtccgcgttctgctccgataaacttgatgaatacctagagaatgaaggaaaactcatggagacctctatgggcttttcatcaaacgcaccaacgagtccggttgtttatcaacttcctaccaagtctacttcctacgtgaggaccctggattcggttttgaaaaaacagagcaccatctcaccaagcacctcatattccttgaaaccccacagtgtccctcccgtcagcaggaaggctaagtcacagaatcgtcaggcgaccttttccggccgaacaaagagcagctataagagcatcctaccttaccccgtttctcccaaacagaaatatagtcacgtgattctcggcgacaaagttactaaaaattcctcaggtattatatccgagaaccaagccaataacttcgtcgtaccaaccttggacgaaaacattttcccaaagcaaatttccctccgacaagctcagcaacagcagcaacagcagcagggctctcggccacctggccttagtaaaagccaagtgaaacttatggacctcgaagactgcgctctctgggaagggaagcctcgcacatacatcacagaggagagggccgacgtgagtcttacaacacttcttacggcacaagctagcctgaagacaaaacccattcatactatcataaggaagcgggctcctccttgtaataacgacttttgtcggctcggatgcgtgtgctcatctctcgcgctggagaaaagacaaccagcccactgcaggaggccagactgtatgttcggttgcacatgcttgaagcgtaaagttgtgcttgtgaaaggaggaagcaagaccaagcacttccagcgaaaagccgcacaccgcgaccccgtattttacgatacgttaggagaagaggcaagggaggaagaggaagggatccgagaagaggaggagcagctgaaagagaagaaaaaaaggaagaagttggagtacaccatctgtgaaaccgaacctgagcagcctgtccgacactatcccctgtgggttaaggttgaaggcgaagtggaccctgagccggtgtatatccccacacccagcgtgatcgaacccatgaaaccacttctactcccacaaccagaggttctgtcacctacagttaaaggaaagctgctgacggggattaaaagtcctaggtcttatacccctaaacccaaccctgtgatccgggaggaggataaggaccccgtgtatctgtacttcgagtccatgatgacctgcgcacgggtgcgcgtgtacgaaaggaagaaggaggatcaaaggcagccatctagttccagttcaccctcaccctcctttcagcagcagactagttgtcattcaagtccggagaaccacaataacgcaaaggagccagattctgagcagcagcctctgaagcagcttacctgtgacctggaagatgatagtgacaaactccaggaaaagtcctggaagtccagctgtaacgagggtgaatcatctagtacatcctacatgcatcagagaagtcctggtgggcctaccaagttaatcgagatcattagcgattgcaactgggaagaggatcgcaacaagattttgagtattctttctcagcacattaatagcaacatgccccagtcgctgaaagtgggaagcttcattattgagctggcctcccagcgtaagagcagaggcgagaagaacccacctgtgtacagttcccgcgtcaagatttcaatgccaagctgccaggaccaggacgatatggctgagaaatccggtagcgagacaccagatgggcctttgagccccggtaagatggaggacatatcgcccgtccagactgacgccctggactccgtgagagagaggctgcacgggggtaaggggctccctttttatgccggtctcagcccggctggtaaactggtcgcctacaagagaaagccctctagtagtacttctgggctgattcaggtggccagcaatgccaaggtggctgcatctcgtaagccacgcacactgctgccttctacaagcaactcgaaaatggccagctctagcggaacagcaaccaataggcccggaaagaatttgaaagcgtttgtacccgctaagcgtccgatcgccgctagaccttcgcctggcggagtattcacccaattcgtgatgtctaaggtcggcgcactccagcagaagatcccgggtgtctccaccccccaaaccctcgcaggtacgcaaaagtttagcattaggccatcgcctgtgatggtggtcacccccgtggtctcctctgaaccggtacaggtatgctcccccgtgactgccgctgtgaccacaacaacacctcaagtctttttggagaacaccactgccgtcacccccatgaccgcaatcagcgacgtcgagaccaaagagacaacatactcctctggtgccacaacaactggcgtggtggaagtgagtgagaccaacacttctacatctgtcactagtacccagagtaccgccactgtgaacctgacgaaaaccacgggcataactacccctgtggctagcgttgcctttcctaagagcctggttgcctcaccttccacaattaccctgcccgttgcgtccactgcttctacgtccttggttgttgtgactgccgctgcctccagcagcatggtgacgaccccaacttccagtctggggagcgttcccatcattctgtcagggattaatgggagccctccagttagccagaggcctgaaaacgcagcacagatcccggtcgccactccgcaggttagcccaaacacagtcaagcgagccggtcccagactcttacaccctaatggccagattgtgcagctcttgcccctccatcaactacgaggctccaatacacagcctaacttacagcccgtaatgtttagaaaccccggaagcgtgatgggtatccgcctgcctgcacctagcaaaccatctgaaacacctccaagtagtacatcatcatcagctttcagtgtcatgaatcctgtgatacaggcagtgggatccagttctgcggtcaatgttatcactcaagccccatccctgttatcttctggtgcttcttttgttagtcaggccggaaccctcaccctgagaatatcgccccctgagccccagtcattcgccagcaaaaccggctctgagaccaagattacatacagttccggaggacaaccagtgggtacggcctctcttatccctttgcagagcgggtcatttgctctgttgcaactccctggtcagaagcccgttcccagctcaattctacagcatgtcgcgagtcttcagatgaagagagaatcccagaatcctgatcagaaggatgaaaccaactctatcaaacgcgagcaagagaccaagaaggtgctgcaatccgaaggagaggcagtcgaccccgaggcaaacgtgattaagcagaactcaggggctgcaaccagcgaggagactctgaacgatagcctggaggataggggcgaccacttggatgaggagtgcctgcctgaggaaggctgtgcgactgtgaagccctcagagcatagctgcattactgggagtcataccgatcaagactacaaagatgtgaatgaggaatatggagccaggaatcgaaaaagctctaaggaaaaagtggctgtgcttgaagttcgaaccatctcagagaaggcctcaaacaagacagtgcaaaatctttcaaaggtgcaacatcaaaagctgggggatgttaaggtggaacaacagaaggggttcgacaaccctgaagagaactcatctgaattccctgtcactttcaaggaggaaagcaaattcgagctgagcgggagcaaagtgatggagcagcagtccaacctgcagcctgaagcaaaagagaaagagtgtggcgactctctggagaaggacagagaacgatggaggaagcacctgaaaggcccattgactcgcaaatgcgtgggggcaagtcaggaatgcaagaaagaagccgacgaacagctgatcaaggaaacaaagacctgtcaggaaaactccgatgttttccagcaggaacagggcatctctgatctgctgggaaaatccgggatcacagaggatgcacgcgtcttgaaaacggaatgtgactcctggagcagaatcagcaatccttctgctttctccatcgtaccacgaagagccgctaaatcgtctcggggtaatgggcacttccagggtcacctcctgttgccaggcgagcagatccagccaaaacaggaaaagaaggggggtcgcagtagcgccgattttaccgttctcgatttagaagaggatgatgaagacgataacgaaaagactgacgattcaattgacgagattgttgatgtggtcagcgactaccagtccgaggaggttgacgatgtggagaaaaataactgtgtggaatacatagaagacgacgaagagcatgttgatattgaaaccgttgaggagctgtctgaggagatcaacgttgctcacctcaaaaccaccgcggctcacacacagtctttcaagcaaccaagctgtacgcatattagtgccgatgaaaaggctgccgagaggagcaggaaggcccctcccataccgctgaaactaaaacctgattattggtctgacaagctacagaaggaagctgaagctttcgcctattataggagaacccatacagcaaatgaacgcagaagaaggggagagatgcgagacctatttgagaagctcaaaatcacgctcggattactgcacagctccaaggtgtcaaaaagtctgattctgactcgtgctttctcggaaatccagggattgactgatcaagccgacaagctgatcggccagaagaatctgcttacccggaagcggaacatcctcatccggaaagtgtcttctctgtccgggaagacagaggaggtcgtgctaaagaagctggagtacatatatgccaagcagcaggcgttagaagcccagaaacggaagaaaaagatgggcagtgacgagttcgatatctccccacgtatctcaaaacaacaagaaggcagctctgcctcatcggttgacttaggacagatgttcatcaataatagaagaggaaagcccctgattctaagccgcaagaaggatcaggccactgagaatacatcgccactcaacactccacatacctccgctaatcttgtaatgaccccccagggccagttgctgactctaaagggaccattattcagcgggcctgttgtagctgtgtcccccgatctgttggagtccgatctcaagccacaggtggctggctccgccgttgcccttcctgaaaacgacgacctgttcatgatgccaagaatcgtcaacgtgacgagtcttgccactgagggtgggttggttgatatgggcggttcaaaatatccacatgaggtccctgatagcaaaccctccgaccacctcaaggatacagtccggaatgaagataacagtcttgaggataaggggaggatctcctctcgcggtaacagggatggaagggtgaccctcggccctacacaggtgttcctggccaacaaagactctggatacccacagatcgtggatgtgtcaaatatgcaaaaggctcaggaattcctgcctaagaagatctcgggagacatgaggggcatccagtataaatggaaggagtccgaatcccggggagaacgggtcaaaagcaaagattcgtctttccataaactgaaaatgaaagacctaaaagacagcagcatcgagatggagctgcgtaaggtgacctcagcaatagaggaggcggcactcgattcttccgaattgcttacaaacatggaagatgaagacgacacggacgagaccttgactagcctgcttaacgaaatagccttcttaaatcagcaactgaacgatgacagcgtcggccttgcagagttgccgagtagtatggacaccgaattcccgggtgatgccaggcgggcttttatatctaaggtccccccaggctcccgcgctacattccaagtggagcatctgggtaccggcctaaaagagctcccggacgtgcagggggagtccgattctatcagcccactgctcctccatctggaggatgacgatttttcggagaacgaaaaacaattggctgaacctgcctccgaaccagatgtgctgaagatagtgatcgactctgagattaaggactcactgctctctaataaaaaagccatcgacggcggtaaaaatacctctggcctgcccgctgagcctgagagcgtgtcttctccacccactctccatatgaaaacgggcctggagaattcaaacagcactgatacactgtggaggcccatgccgaagctggcccctctgggcctgaaggtcgctaatcccagctcagacgccgacggccagagcctcaaagtgatgccatgcctcgctccgattgctgctaaagtcggatccgtgggtcacaagatgaacttgaccggtaatgatcaggagggtagagagtccaaggtcatgcccactctggccccagtcgtggcgaaactgggcaacagtggtgcctcacccagcagtgccggtaaata

SEQ ID NO: 229737 - DNA, 8570 bp, Artificial Sequence
  Description of Artificial Sequence: Synthetic coding sequence
atggaggagaagcagcaaatcatcttagccaatcaggacggcggtaccgtggccggtgcggctcccaccttcttcgtgatactcaagcagcctggcaatggaaaaactgatcaggggatcctggtgacaaaccaagatgcctgtgccctggcctccagcgttagttcccctgtcaagtcaaaggggaagatctgtctgccagccgactgcactgtcgggggtataacagttacactggacaataattctatgtggaacgaattttaccaccgctctacagagatgatcttaacaaagcagggacgaagaatgttcccttattgcagatactggatcaccggactggattctaatctgaagtacattctcgttatggacattagtcccgtagataatcatcgatacaaatggaatggcagatggtgggaaccatcagggaaagcagaaccccacgtcctcggtcgagtgtttattcacccagagtcgccaagcacaggccactactggatgcaccaacctgtctccttctacaagctgaagcttacaaataataccctggaccaggaggggcacatcatcctccactccatgcatcgttacctcccgaggttgcatctggttccggcagaaaaagctgtggaagtgatccagctcaatggcccaggagtgcacacattcactttcccccagacagaatttttcgccgtaactgcctaccaaaacatacagattactcaactgaaaatcgattacaatccatttgctaagggctttcgcgatgatggtcttaataacaagccccagagagacgggaagcaaaaaaactcatctgatcaggagggaaataatatcagttctagcagcgggcatagggtccgtctgacagagggccagggatctgagatccaaccaggggatctggaccctttgagtcgagggcatgagacctccgggaaagggttggaaaagacaagcctgaatataaagagagacttccttggtttcatggacaccgatagcgccttgtctgaagtgccacagctgaaacaggaaatttccgaatgtctgatcgcaagttccttcgaggacgactccagggtggccagtcccctggaccagaacggctccttcaacgtagtgattaaagaagaaccccttgacgattatgactacgaactgggggagtgcccagagggggtcacagtaaagcaggaggagacagatgaagagactgatgtgtatagtaactccgatgatgaccccatcctggagaagcaactgaaacgccacaacaaagtggataacccagaggccgaccacttgagctcaaagtggctgccatcttctccgagtggggtggctaaggccaagatgtttaagttagacacaggcaagatgcccgtggtttacctggagccatgcgccgtgaccaggagcacggtcaagattagtgaactacctgacaatatgctaagcacatctcgaaaggataaatctagcatgttggctgaactggagtacttgcccacctatatcgagaattcaaacgaaacagctttctgcctcggcaaggagagcgaaaatgggcttaggaagcacagcccagatttgcgcgttgttcagaagtacccattactgaaggagcctcagtggaaataccctgacatttcggattccatctctacagaacgaatactggacgattccaaagattctgttggtgactctctaagcggaaaagaggacctcggccgaaaaaggacaaccatgcttaaaatcgccactgcagcaaaggtcgtgaatgcgaatcaaaatgcatcccctaatgtgcctggaaaacgtggtagaccccgaaagctcaagttgtgtaaagccggtcgtcctcccaaaaataccgggaaaagcctcattagtacgaaaaacacccctgtgagtccgggatctacctttccagatgtcaagccggacctcgaggatgttgacggcgtattatttgtgtcttttgaatctaaggaagccctggatatacacgctgtagatggaactacagaggaatcttcctccctgcaggcttctaccaccaacgactctggctatagagctcgaatatctcagttggagaaagaactgattgaagacttgaaaacattgaggcacaagcaggtgatccaccctggcttgcaagaggtggggctgaagttgaactccgtggatccaacaatgtcaatcgaccttaaatacttgggcgtgcaattgccgcttgcccctgccactagctttcccttctggaacctcactggaacaaatcctgccagccccgacgcgggtttccctttcgtgtcacgtaccggtaaaactaatgacttcaccaaaatcaagggatggcgcggaaagttccacagcgcaagtgccagcagaaatgaaggcggaaacagtgagagcagtctcaagaacaggagtgccttttgcagcgacaagctggacgaatatttagagaatgaaggaaagctcatggaaacatctatggggttctcttccaacgcaccaacgtctccggtagtttatcagctgcctaccaagagtacctcctacgtcagaacgctggattcagttcttaagaagcagtcaacaatctcaccctccacttcttactctctgaagcctcacagcgtacctcctgtttcccgaaaggccaagtcacagaacagacaggcgacgttcagcggcaggaccaagagttcatataaatccatcctgccatatcccgtttcccctaaacagaagtactctcacgttatattaggggacaaggtcacaaagaactctagcgggatcatctcggagaaccaagccaataattttgtagttccaacacttgacgaaaatatcttccccaaacagattagcctccgacaagcccagcagcagcagcaacagcagcaggggtccaggccacctggactgagtaagagccaggttaagttaatggatttagaagattgcgccctttgggagggtaagcctcgaacctatatcactgaggaacgagccgatgtgagccttacaactttgctgacagcccaagcttccttgaagactaagcctatccataccattatccgaaaacgggctcctccatgcaacaacgacttctgccggcttggttgtgtatgttctagcctggctttagaaaagcgacagccagcccactgtcgtagacctgattgtatgtttggctgcacttgtctgaagagaaaggtggtgctcgtgaaaggaggttctaaaacaaagcactttcaacgtaaagccgcacacagagatccggtgttctacgacaccctaggcgaggaggcccgagaagaagaagaaggtattcgagaagaggaggagcagctgaaagagaagaagaaacgtaagaagttggagtatacgatttgcgagaccgagccagagcagccggtgagacactatccactgtgggtaaaagtggagggggaggtggaccctgagcctgtttatattcccacacctagcgtaattgaaccaatgaaacctttactgttaccccaacctgaagttctgtcacccacagtgaagggtaagctgctgaccggtattaagtcccctagatcttatactccgaaaccaaaccccgtaatccgggaagaggacaaggaccccgtgtacctgtactttgagagcatgatgacttgcgccagagtccgggtttacgagaggaagaaggaagaccaaagacagccttcatcgtccagtagcccgtcacctagctttcagcagcaaacttcctgccacagcagccccgagaaccacaataatgccaaagagcctgattccgaacagcagcctctcaaacagctgacctgtgatctagaggacgacagcgataagctgcaggagaaatcatggaaaagttcttgtaacgagggggaatcatcgagtacctcatatatgcatcagcgctcccctgggggaccaacaaagctgatagagatcatctcagattgtaattgggaggaagatcgtaacaaaatcctgagtatcctctcacagcatatcaatagcaatatgccacagtccttaaaagttggtagttttatcatcgagctggcttcccagcggaagagcaggggggaaaagaatcctcccgtgtactccagccgtgtgaaaatttctatgccgagttgtcaagaccaggacgacatggctgaaaagagtggctcagagaccccggatggcccattaagtccaggcaagatggaagatattagcccagtacagacagatgccctggactctgtgagagagcgattgcacggaggaaagggcctgcctttctatgccggtctgagtccagccggaaaattagtagcatacaaacggaagcccagcagttcgacttccggtcttattcaggtagcctctaacgcgaaagtcgccgcttcacgtaaacctcgcacactgctgcctagtaccagtaattccaaaatggccagctcttcgggtacagcgactaaccgccctggaaagaacctaaaagccttcgtacctgctaaacggccaattgagaatgctgctcagatcccagtggctacaccccaggtgagtcctaacacagtcaagcgcgctggccctaggttgctgttgattcccgtgcagcaaggctccccaacgctaaggccggtttctaatacccaactgcaggggcaccggatggtgctgcaacctgttaggagcccctcagggatgaacctatttcgtcaccccaatggccagatcgtgcagcttctgcccctgcatcagcttagaggttcaaacacccagccaaacttgcagcccgtgatgtttaggaatccaggaagcgtcatgggaatacgcctgcctgccccaagtaaacccagcgaaactccgccatcatccacctctagcagcgcattctctgttatgaatccagtgattcaggctgtgggctcgtcctccgcggtgaacgtgatcactcaggccccttccctgctgagctctggcgcttcctttgtttcccaggcaggtacgttgactttgcgaattagtccacctgagccacagtcattcgcatcgaagactggttctgaaaccaagatcacttattccagtggtgggcagccggtgggcactgctagccttatcccactgcagagtgggagctttgctttgctccagctcccgggtcaaaagcctgttcctagcagcatccttcagcatgtggccagcctgcagatgaagagagaatcacagaaccccgatcaaaaggatgaaacaaactctattaagagggagcaggaaacaaagaaggttctgcaatccgagggcgaagcagtcgacccagaagccaacgtcatcaagcagaactccggtgctgctacttcagaggagacactgaacgacagcttggaagatcggggtgatcacctagatgaggaatgcctccctgaagagggatgtgccactgtcaagccttcggagcactcttgtatcacaggtagccatacagatcaagattacaaggacgtgaatgaagagtacggtgccaggaatagaaaatcgtccaaggaaaaggtggctgtcctcgaggtacgcaccatttcagagaaggcttctaataaaacagtccagaacctcagtaaagtccagcatcagaagctcggggacgtgaaggttgaacagcagaaagggttcgataacccagaggaaaacagtagtgaattcccagtcactttcaaggaggaatctaagtttgagctatcaggcagtaaggtaatggaacagcaatccaacctgcaacccgaggccaaagagaaagagtgtggcgactcgttggagaaagacagagaacgctggcggaaacatttgaaagggcctcttacgagaaagtgcgtgggggctagccaagagtgtaaaaaggaggctgacgagcagctcatcaaggaaaccaagacttgccaggagaatagtgacgttttccagcaggagcagggcatctctgatcttctcggaaaatccggtataaccgaagacgccagagttctaaagaccgagtgcgactcctggagtagaatatctaatccctccgctttcagcattgtgcctcgcagggcggcaaaatcgtctaggggaaacgggcatttccaaggtcatctactgctgcccggagagcagatccagcctaagcaggaaaaaaagggaggacgttctagcgctgacttcacagtactggatttggaggaggacgatgaggacgacaacgaaaagactgacgactccatagatgaaatcgttgatgttgtcagcgattatcagtcagaagaggtcgacgatgtagagaagaacaattgcgtggaatacatagaggatgacgaagaacatgtagatatcgaaaccgtggaggaattgtctgaagaaataaatgtcgcacatctcaagacaaccgctgctcacacccagagttttaagcagccgtcctgcacacacatttcagcagacgagaaggcagccgaacgaagccgaaaggcaccccctattccactgaaactgaagcctgattactggagtgataaactccagaaagaagcagaggctttcgcatattatcgcaggacacacactgctaatgagagacgaagacgcggagaaatgagagacctctttgaaaaattgaagatcacattaggactattgcattcttccaaggtctcaaagtctctgattttgactcgagcattctccgagatccagggcctcacggaccaggctgataagctgataggccaaaaaaacctgcttacacgaaagcggaatatcctgattcgaaaggtttcatccctcagcggcaagaccgaagaagtcgttctgaagaagctggaatacatttatgcaaagcagcaagctttggaggcacagaaacgaaaaaagaagatgggctccgacgaatttgatatcagcccgcgaatctcgaagcagcaggagggcagcagtgccagctccgtggacctggggcagatgtttattaataatagacgaggtaagcctttgattctttctcgaaaaaaggatcaggcgactgaaaataccagcccgctgaacacgccgcacacttccgccaaccttgttatgaccccgcagggacagctgctcactctgaagggacccctgtttagtgggcctgtagtggccgtgtcacctgacttacttgagtctgacctcaagccccaggttgctgggtctgcagtggctctgcctgagaatgatgatctgttcatgatgccacgaatagtgaatgtgacatcgctcgctactgagggcggactcgtggacatgggtggtagcaagtacccccacgaggtccccgattccaaaccaagcgatcacctcaaggataccgtcaggaacgaggataattctctggaggacaagggaagaattagcagccgcggtaatcgtgacgggagggtcaccctgggaccaacccaagtgttcctggcaaacaaggatagtgggtaccctcagatcgtcgatgtgtcgaacatgcagaaagcccaggagttcctgccaaagaagatttccggcgacatgaggggaatccagtacaagtggaaggagtccgagtcgcgcggtgagcgagtcaagtccaaagacagcagcttccacaaactgaaaatgaaggacctaaaagattcctcgatcgaaatggagcttagaaaggtgactagcgctatcgaggaggccgcacttgattcctcagaactgctcacaaacatggaggacgaagatgacactgacgagaccctgaccagtcttctaaatgagatcgcctttcttaatcagcaactcaatgatgattctgtcggcctggcagaacttcctagttctatggatacagagtttcctggcgacgccagaagagcgtttatctctaaagttccacctggctcccgcgctacattccaggtggagcacctaggcaccggcctgaaagaacttcccgacgtccagggagagtctgattctatctccccactacttctccatctagaggatgatgatttctctgaaaatgaaaagcagctcgcagagccagcctctgaacccgacgttcttaagatcgtgattgactcagaaatcaaagatagcttgctctctaataagaaggccatcgacggcggaaagaacaccagcgggttgcctgccgagccagagtccgtgagtagcccacccacactacatatgaaaaccggcctggagaactccaactcaactgatacattatggcggccaatgccaaagctggccccattgggcctgaaagtagcaaaccccagttccgatgcagacgggcaaagtcttaaggtcatgccttgccttgctcctattgccgcaaaggtaggtagcgtgggccataagatgaacctgaccggcaacgaccaggaggggagagagagcaaagtcatgcctaccctggcccctgtggtggcaaagttagggaattcaggagctagcccttccagtgccggaaaata

SEQ ID NO: 229738 - DNA, 687 bp, Artificial Sequence
  Description of Artificial Sequence: Synthetic coding sequence
atggagagagtgaagatgatcaatgtccagaggctgctcgaagcggcagagttcctggaacgcagagaaagagagtgtgagcacggttacgccagctcatttccttccatgcccagtccaaggttgcagcacagtaagccgccacggaggttatccagagcccaaaagcactcgtccggttccagtaacacatctaccgccaaccggagtacgcataacgagctggagaagaatcgacgtgcccaccttcgcctgtgcttagaacggttaaaagtcctcatccctttggggcctgactgcacgagacacaccactctaggactgctcaataaagctaaggcccatatcaaaaaacttgaggaggccgagaggaaatcccagcaccagctggaaaacctcgagcgcgagcaacggttcctgaagtggcgacttgagcagctgcaagggccacaagagatggagagaatccgcatggactccataggctccacaattagttctgatcgcagcgactctgagcgggaagagattgaagtggacgtggaatccactgaattctcccatggcgaggtggacaatattagcaccacttctatctctgacatcgacgaccactcctctttacctagtatcggttcagacgaaggatactcatctgcaagtgttaagctgtcatttacttcctag

SEQ ID NO: 229739 - DNA, 888 bp, Artificial Sequence
  Description of Artificial Sequence: Synthetic coding sequence
atgggaaagagggggaggccgaggaaggaggcgcgttgcgagggggctggacttgctccggctgctccacccgctgtgccccctgcggtcgctgccccacagccccctgcactgcccgaagatcctgccggagcaaaaccccgttgtccatttagcgatatttttaatacctccgagaactccatggagaaacacattaacactttcttgcagaacgtccagattcttctggaggcagccagctatttggagcagatcgagaaagaaaataaaaagtgtgagcatggctacgccagttcctttccatccatgccttcccctagactgcaacacagcaagccacctcgccgactgagtagggcgcagaagcattcctcagggtcatccaacacatctactgcaaaccgaagcacccacaacgaactcgaaaaaaatagaagagctcatttacggctgtgccttgagcggctgaaggtcctaatcccgctcggacccgattgcaccaggcacacaacattgggcctgctgaacaaggccaaggcccacattaaaaaactagaagaagccgagaggaagagccagcatcagttagaaaaccttgaaagggaacagagattcctgaagtggaggctggaacagcttcagggaccccaggagatggagcggatcaggatggacagcattggttcgactatctcctctgatcgcagcgacagcgaacgcgaagagattgaagtagatgtggagtcaactgagttctcccacggagaggtagataatataagcactacctcgatatcggatattgatgatcactcttcattgccctctatcgggagcgatgaagggtatagctccgcaagcgtgaagctctcgtttactagctag

SEQ ID NO: 229740 - DNA, 549 bp, Artificial Sequence
  Description of Artificial Sequence: Synthetic coding sequence
atgccgagccctagattgcagcattcaaaacctcctaggaggctttcccgtgcacagaaacacagctcgggatcaagcaatactagtacagctaacaggcgcgcacacctgcgcctctgcctggaaagacttaaagtgctcattcctttgggccctgactgcacccgtcacaccactctgggacttctgaataaagccaaggcacacatcaaaaagctagaggaggcggaacggaagtcccagcatcagctggaaaatctggaacgggagcagaggttcctgaagtggagactggagcagctccaaggtcctcaggagatggagcggattcgcatggattccatcggaagtacgatttcatctgacagatctgactcagaacgggaggagattgaggtggacgtggaatctactgagtttagccatggagaggttgataatatttccactacctcaatttcagatatcgatgatcacagctcgcttccttccatcggatctgatgaagggtactcttcggcaagtgtcaagctaagctttacttcatag

SEQ ID NO: 229741 - DNA, 579 bp, Artificial Sequence
  Description of Artificial Sequence: Synthetic coding sequence
atgccgagtccgagactccaacactccaagcctccgcgaagattgtcacgcgctcagaagcattctagtgggtcttccaacacctcaaccgctaatcgctctacccataacgagctggagaagaacaggagagctcatctgagactgtgcttggagcgtctgaaagtacttattccgttgggccctgattgcacacgtcacactaccctgggtctgctcaacaaagccaaagcccacattaaaaagttggaggaggccgaacggaagtcccaacaccaactcgagaacctcgaacgggaacaaaggtttctgaagtggcgtttggagcagctgcaggggccacaagagatggagcgcatccgcatggattccatcgggtcgacgatctccagcgaccgttctgactccgagcgggaggaaatagaggtcgacgtggagtctacggagtttagccacggcgaggttgacaatatctctaccacgtctatttcagatattgacgatcatagttctcttccttcaatcggcagcgacgaggggtattcttctgcgtcagtgaagctgtcattcacgtcatag

SEQ ID NO: 229742 - DNA, 579 bp, Artificial Sequence
  Description of Artificial Sequence: Synthetic coding sequence
atgccatccccacgattgcagcacagcaaaccccctcggcgactgagtagggcacagaagcattcatccggatccagcaacaccagcacagcaaatcggtcgacacacaacgagctcgaaaagaacaggagggctcacctgagactgtgtctcgagcggctcaaagttcttatcccactcggacccgactgtacgcgccacaccactctaggcctgttaaacaaagctaaggcgcatattaagaagcttgaggaagccgaaaggaaaagccagcatcagcttgagaatctcgagagggagcaaaggttcttaaaatggcgcctagagcagcttcagggccctcaggagatggagcgcatccgcatggattctatcggcagcaccatcagttccgaccggagcgactcggagcgagaggaaatagaggtcgacgttgagtctactgaattctcccacggagaagttgacaatatctccactacgtctattagtgatatcgacgatcattctagcctgccctccattggatccgacgagggatattcctctgcttctgtgaaactgtcttttacttcttag

SEQ ID NO: 229743 - DNA, 579 bp, Artificial Sequence
  Description of Artificial Sequence: Synthetic coding sequence
atgccttctcctaggctgcaacacagcaagcctccgcgtaggctgagcagagcccagaaacatagcagtggcagttccaacacctccaccgccaatcgaagcacccacaacgaactggaaaagaatagacgcgctcacctgagactctgtctcgagcggctcaaggtcttgattccactcgggccagattgtaccagacatactactctcggattgctcaataaggcgaaggcacatatcaaaaagctggaggaagccgagagaaagtcacagcatcaactggagaacctggagagggagcagcggtttctgaaatggcgcctggaacagttgcaggggccacaggagatggaacgcattagaatggatagtatcggatcaaccatttccagtgaccgctcagacagtgaacgcgaggaaatagaagtggatgtggaatccaccgagttctctcacggggaagtggacaacatttcaacaacgtccatctccgatattgatgatcattcttctttgccctctattgggagcgatgaaggctactcaagcgccagcgtgaagttgtcatttacgagttag

SEQ ID NO: 229744 - DNA, 657 bp, Artificial Sequence
  Description of Artificial Sequence: Synthetic coding sequence
atggaaagggtgaaaatgatcaatgtccagcgattgctggaagctgctgagttccttgaaagacgcgagagagagtgcgaacacgggtatgcctcctcgttcccgtcgatgccttctcccaggctgcaacacagcaaacccccacggagactgagccgggctcagaagcactctagcggttcttcaaacacttctaccgcaaacaggagagcacatctgcgcttgtgtctggaaaggctgaaggtccttatccccctcggtcctgactgtacccgccatacaaccttgggcttactgaacaaagctaaagcccacataaagaagcttgaggaagctgagagaaagtcccagcaccagcttgaaaacctggagcgcgaacaaagattcttgaagtggaggctggagcagctgcagggaccgcaggaaatggagcggattcggatggactctataggatcaacaatttcatctgatagatctgacagcgaaagggaagaaattgaggtggatgtcgaatctacagagtttagtcacggagaggtggataatatctcaaccactagcatctccgacattgatgatcactcatccctgccgagtattggatccgacgagggttacagctccgcatcggtcaagctctcattcaccagttag

SEQ ID NO: 229745 - DNA, 657 bp, Artificial Sequence
  Description of Artificial Sequence: Synthetic coding sequence
atggagagggtgaagatgatcaacgtacaaagactgctggaggccgctgagtttctggagagacgcgagagagagtgtgaacatggatatgcctccagctttccctcaatgccctccccacggctacagcacagcaagccccctcgacgattgagcagagctcagaagcacagctcaggcagttctaatacatccaccgccaaccggagggcgcatctcagactgtgtctggagaggctgaaagtcctcatccccttgggcccagattgcacgcggcacaccaccctggggctgctgaacaaggcaaaagcacacatcaagaagttagaggaggcagagcgaaaaagtcagcaccagctagagaacctcgagagggagcagagatttctcaaatggcgcctggagcaattgcaaggtcctcaggaaatggagaggatcaggatggattctatcggatcaactatctcttcggatcgcagcgactctgaacgggaggagatagaggttgatgtggagagtactgagttttcacatggggaagtggataacatttctaccacatccatcagtgatatcgatgatcactctagcctgccatcgatcggcagcgatgaagggtactccagtgcctccgtgaaactgtccttcactagttag

SEQ ID NO: 229746 - DNA, 357 bp, Artificial Sequence
  Description of Artificial Sequence: Synthetic coding sequence
atgccaagtccaaggttgcaacatagtaaacctcctcggcgtctgtctcgagctcaaaaacactcgtccgggtcgtccaacaccagcactgctaatagatccacccataacgagttggagaaaaaccgtcgcgctcacctgcgcctctgcctggaacgcctgaaggtcttgattcccctcggacccgattgcactcgtcacactacactaggcctgcttaacaaggctaaagcacatatcaagaagttggaggaagccgaacgtaagagccaacatcaactcgagaatctcgagcgggagcaaagattcctgaaatggcggcttgagcaactgcaggggcctcaggagatggaatag

SEQ ID NO: 229747 - DNA, 681 bp, Artificial Sequence
  Description of Artificial Sequence: Synthetic coding sequence
atgggtaagagaggccgtccgcgtaaggaagcgagatgtgaaggggctgggttagctcccgctgcccctccggcagtcccccctgccgtggccgctccccagcctcctgcattgcccgaagaccccgcaggcgctaaacctaggtgccctttcagtgacatttttaacacaagcgagaactccatggaaaagcacatcaacactttcctccagaatgtgcagatcctgcttgaggccgctagctatttagaacagatcgagaaagaaaacaagaagtgcgaacacggttatgcatccagcttcccttccatgccttctcctcgcttgcagcactccaaacctcccaggaggcttagtcgcgctcagaagcacagcagcggctccagtaacaccagcacggccaaccgccgtgcacacctgagactgtgtctcgagcgacttaaagtcctcatacccctcgggcctgactgcactaggcacacaaccctcgggctacttaacaaagccaaggcccatatcaaaaaactggaggaagccgagaggaagagtcaacaccagctggagaacctcgagcgggagcaaagatttctgaaatggaggctagagcagcttcagggtcctcaagagatggagcgcatccgaatggatagcattgggtctaccattagcagcgacagatag

SEQ ID NO: 229748 - DNA, 897 bp, Artificial Sequence
  Description of Artificial Sequence: Synthetic coding sequence
atgaccgaacccggtgccagccctgaagatccatgggtgaaggctagccctgtcggggctcacgctggggaggggagagctggcagagcacgcgcacggaggggagcgggacgtcgaggcgcttccttactatctcctaaatcaccaaccctcagcgtgcctagaggatgccgggaagactcctcacaccctgcatgcgccaaagtggaatacgcttacagcgacaactctttagatcccggactattcgtggagtctacccgtaaggggtcagttgtgtcccgggcaaacagtataggatctacgtcagcgtcctccgtccccaacacagacgacgaggattctgactatcaccaggaggcctataaggaatcttacaaagaccgccgtagaagagctcacacacaggctgagcagaaaagaagggatgcgattaagcggggttacgacgacctacagactatagtccctacttgtcagcagcaggatttctccattggctcccaaaagctaagcaaggccatcgtcctccagaaaaccatcgattacatccagttcctgcacaaggaaaagaagaagcaggaagaggaggttagcaccctccggaaagatgtaaccgccttgaaaatcatgaaggttaactatgagcaaattgtgaaggcacatcaggacaacccccacgagggtgaggaccaggtgagtgaccaggtgaaattcaatgtttttcagggcattatggactcccttttccagtcgttcaatgcatcaatatctgtagcttcattccaggaactgtccgcctgcgtattctcttggattgaggagcactgtaaaccacagactcttagggaaatcgtgataggcgtgcttcaccagttaaagaatcaattgtactag

SEQ ID NO: 229749 - DNA, 645 bp, Artificial Sequence
  Description of Artificial Sequence: Synthetic coding sequence
atgacagagcccggagcttcgcctgaggacccctgggttaaggtcgagtatgcctactcagacaattctctcgatcccgacgacgaagatagcgactaccaccaggaagcttataaagagtcttacaaggacagacgcaggagggctcatacccaggctgagcaaaagagacgcgatgccatcaaacggggatatgacgacctgcaaaccatcgtccctacttgtcagcaacaggacttctcgattggaagtcaaaaattgtccaaagcaatagtgttgcagaagactatcgattacattcagttcctacacaaagagaaaaaaaaacaagaggaggaggtgtccaccctgagaaaggatgtcacggcattaaagataatgaaggttaactatgaacagattgtaaaggctcaccaggacaacccccacgagggggaggatcaagttagcgaccaggttaagtttaacgtgttccaagggatcatggactcacttttccagtcctttaacgcttccatctccgtcgcctctttccaggagctatctgcttgcgtgttcagctggatagaggagcactgcaaaccccagacgcttagagagattgtgattggggtgctccatcagctgaagaatcagctttactag

SEQ ID NO: 229750 - DNA, 735 bp, Artificial Sequence
  Description of Artificial Sequence: Synthetic coding sequence
atgaccgaacccggtgcctcaccagaggacccttgggtgaaggttgaatacgcctacagcgataactctttggacccaggcctgttcgttgaaagtacacgaaaggggagcgtggtttccagggctaactccattggctcaacctcagcctcttccgtcccaaacactgatgacgaggattccgattatcatcaagaagcctacaaggaaagttataaggaccgtcgcaggcgggctcacacccaggcagaacagaaaaggagggacgcaatcaagagggggtatgacgatctccagactatcgtcccaacatgccagcagcaggattttagcataggatctcagaaactaagcaaggccattgtgctacagaagacaattgactacatccagttccttcataaagaaaaaaaaaagcaagaggaagaagtatcaacactgaggaaggacgtgactgctctgaagattatgaaggtgaattatgaacagatagtgaaagcccatcaggacaatccccacgagggcgaggatcaagtctcagaccaggtcaagttcaacgtattccaggggatcatggattctctgtttcaatccttcaatgcgagcatttccgtggcttcgttccaggagctatccgcctgcgtctttagttggattgaagaacactgcaagccacagactttgagggagatcgtcattggcgtgctccatcagctgaagaatcagctgtattag

SEQ ID NO: 229751 - DNA, 2826 bp, Artificial Sequence
  Description of Artificial Sequence: Synthetic coding sequence
atggccgaggcaaacccacgtcgcggaaagatgcgctttcgcaggaacgctgcgtcctttcccggaaaccttcacctcgttctggtgctgcggcctacctcattcctacaaagaacctttactgatatcggcttctggttttcccaggaggactttatgctgaaattgccagttgtgatgctcagctcagtctctgacctactcacttatatcgatgataaacagttaactcccgagctagggggaacactccaatactgccattcagagtggattatattccgcaatgccatcgaaaacttcgccctgactgttaaggaaatggcccagatgttgcagagtttcggtacggaactggccgagacagagcttcccgacgatattccttccatagaggaaatcctcgctattcgcgcagaacgatatcacctcctgaagaacgacatcacagctgtgaccaaggagggcaagattctgctgaccaacctggaggtgcctgatactgaaggtgccgtgtctagtagattagagtgccaccgccagatcagcggtgactggcagacaattaacaagctcctaacccaggtgcacgacatggagacggcctttgatggattctgggagaagcaccagctgaagatggagcaatatctgcagttgtggaaatttgagcaggactttcagcaattggtcacagaggtggagttcctgctgaaccaacaggctgaacttgcggacgttactggaacaatcgctcaagtgaagcaaaagattaagaagttagagaacttagacgagaacagccaagaactcctttctaaggcacagttcgttattctccacggacataaacttgctgctaaccaccactacgccctcgaccttatctgccaacggtgtaatgagctccggtatctgagcgacatccttgttaatgaaattaaggccaagaggatccagctatccaggaccttcaaaatgcataagttgctgcagcaggcccgacagtgttgtgatgagggagaatgccttctggctaatcaagagatcgacaaattccagtctaaagaggatgcccagaaggcacttcaggatatcgagaacttcctcgagatggcactccccttcatcaactatgagccagagacccttcagtacgagttcgatgtcatcttgtcacctgagctcaaggtgcagatgaagacaatccagctgaagctcgaaaatattcgctcaattttcgagaaccaacaagctgggttcaggaatctcgctgacaaacacgtcaggccaatccagttcgtggtgccaacccccgagaacctggtcacctctggtacaccctttttttccagcaaacaggtcggtgtggggtattcgttttttcaagcctgcaagctgttttccaaaggtaagaaaacatggaggcagaatcagtctaacctcaagattgaagttgtccctgattgtcaggagaagcgcagtagtggcccttcatcgagcttggacaacggcaactcccttgacgttctgaagaatcatgtgcttaatgagcttattcagaccgagcgtgtgtacgttcgcgagctgtatacggtgctgctcggatatcgagccgagatggacaatcctgagatgttcgatttaatgccacctctactgcgtaataagaaggacatactatttgggaatatggctgagatctatgagtttcacaacgatatttttctgagctccctggagaactgcgcacatgcgcctgaaagggttggaccttgttttctcgagagaaaggacgattttcagatgtatgctaaatactgccaaaacaagcctagatctgagacaatctggcgtaagtactcagagtgtgcattctttcaggagtgtcagcgcaagctcaagcatcggctccgcctggatagctatcttctgaaacccgtccagaggatcacaaagtatcagttgcttttgaaggaactcctgaagtatagtaaggattgcgaagggagcgccctcctgaagaaagcactggacgccatgctggatctcttgaaatctgtgaacgactccatgcaccagattgctatcaacggatatatcgggaatttgaacgaactcgggaaaatgatcatgcagggaggattctccgtttggatcggtcacaagaaaggtgcaacaaagatgaaggacttagcccgattcaagcccatgcaaaggcatctgttcctgtatgagaaagccattgtcttctgcaaacggagagtcgagtcaggtgaggggtcagaccggtaccctagctattccttcaagcactgctggaagatggatgaggttggcatcacggaatacgtcaaaggcgacaatcggaaatttgaaatatggtacggggaaaaagaagaagtttatatcgtccaggcttcgaacgtcgacgtgaagatgacatggctcaaggagattcggaatattctactgaagcagcaggagctgctgaccgttaagaagcgtaagcagcaggaccagttaaccgagcgagacaaattccagatcagtcttcagcagaatgacgagaaacagcagggtgcattcatcagcaccgaggaaactgagctagagcacacgtctacagtcgtggaagtgtgcgaggctatcgcaagcgtgcaggctgaggcaaataccgtttggaccgaagcatcgcagtcagccgaaatttcagaagagccagcagaatggtcctccaactatttttatcctacatatgatgaaaatgaagaggagaacagaccattgatgcggcctgtgagtgagatggcattgttatattag

SEQ ID NO: 229752 - DNA, 2583 bp, Artificial Sequence
  Description of Artificial Sequence: Synthetic coding sequence
atggccgaggccaacccccgaagggggaagatgcgattccgaagaaatgccgctagctttccaggaaatctgcacctcgtgctggtgctccgccctactagctttctgcaacgaacttttaccgatattggcttttggttttcccaggaggacttcatgctaaagttacccgtggtaatgttgagcagcgtctccgacctcttgacatacattgatgataagcaactcacccctgaattagggggtaccctccagtattgccactccgagtggatcatattcaggaacgccattgagaactttgccctgaccgtcaaggaaatggcccaaatgcttcagtccttcgggacggagctggccgaaactgaactccctgacgacattcctagcatcgaggagatccttgctatccgagcagaaagataccatctccttaagaatgacattaccgccgtgaccaaggaaggtaagattctccttaccaacctggaagttcctgacacggagggagctgtctccagtaggcttgagtgccaccgtcagatttccggggattggcagacaattaacaaacttctgacccaagtgcacgatatggagactgcttttgatggtttctgggagaaacaccagctcaaaatggaacagtatctccaactttggaagtttgaacaggactttcagcagctggtcacagaagtggaatttctgctgaatcagcaggcggaattggccgatgttactggaacaatagctcaggtgaagcaaaaaattaagaaactggagaacctggacgaaaattcccaggagctgcttagcaaggcgcagtttgtgatcttgcatggccacaaactcgctgccaatcatcactatgctctggatttaatctgtcagagatgcaacgagttaagatatctcagcgacatcctggtaaacgagattaaggctaagcgcatccagctgtcccggacattcaaaatgcacaaacttctccagcaggctcgtcagtgttgcgatgagggtgagtgtctgctggccaaccaggagatcgataagtttcagagcaaggaggacgcccagaaagcactgcaggacatcgaaaatttccttgagatggccttgccatttataaattacgagcccgagaccctccagtacgagttcgacgtgatcctctctcccgagctgaaagtgcaaatgaagaccatacagctgaagctagagaatataagatcgatctttgagaatcagcaggcgggattccgcaacctcgccgataaacatgtgcggccaatacagtttgttgtccctaccccagagaatttggtcactagtggtacacctttcttctccagcaagcaggggaaaaaaacgtggcggcagaatcaaagtaatctgaagatcgaagtagttccggactgccaggaaaagcgaagtagtggcccatctagctctctggataatggaaactccctggacgtgctgaaaaaccacgtcctgaatgaactgatacagaccgaaagggtttatgtgagggagctctataccgttctcctcggataccgtgctgaaatggacaatcctgaaatgttcgacctgatgccgcctcttctacggaataagaaggacatcctcttcgggaatatggctgagatttatgaatttcacaacgacatattcctgtccagccttgagaactgtgcgcatgctccagaacgggttggcccttgttttttggagcggaaggatgacttccaaatgtatgccaagtactgccagaacaagccacggagtgaaacgatatggagaaagtactctgaatgtgccttcttccaggaatgccaacggaaactgaaacacagacttaggctggattcctacctcctgaagcccgttcagagaattaccaaataccaactcttactcaaagaacttcttaagtatagtaaggactgcgaaggatcagcactcctgaagaaagcccttgatgcaatgctcgatctcctcaaaagcgtcaatgactctatgcaccagatcgctataaacggatatattggcaatctgaatgaactggggaaaatgataatgcagggagggttttccgtttggataggtcacaaaaagggcgcaactaaaatgaaggacctggccaggtttaagccgatgcagagacaccttttcctttatgagaaggccattgtattctgcaagaggcgagtggagagtggagagggaagcgaccggtatcctagttattccttcaaacattgctggaaaatggacgaggtggggatcacagaatacgtcaagggcgataaccgcaagtttgaaatttggtatggggaaaaggaagaggtctacatcgtacaagccagtaacgtagacgtgaaaatgacttggctgaaggaaatcaggaatatactcttgaaacagcaggagcttctgaccgtaaagaaaagaaaacagcaagatcagttgaccgagagagacaagtttcaaatcagcctccaacagaacgacgaggatctgtgccggaggtggttatcctacattgatgaagcaacaatgtcaaacggaaagtag

SEQ ID NO: 229753 - DNA, 2778 bp, Artificial Sequence
  Description of Artificial Sequence: Synthetic coding sequence
atggccgaagccaatccacgaagggggaaaatgagattcaggaggaacgccgcatcgtttcccggaaacttgcacttggtactggttctgaggcctacttcgttcctgcagagaaccttcacagacatcggcttttggttttcccaagaggacttcatgttgaagctaccggtggtaatgctatcgtcagtgtcggacctactgacgtatattgatgacaaacagctgacacctgagttaggaggcacactccagtattgccattccgagtggattatcttccgcaacgccatcgagaactttgcacttactgtgaaggagatggcacagatgctgcagagcttcggaacagaactggccgaaacggagctccctgacgacatcccaagcatcgaagaaattctagctatacgagcggaacgatatcatctcttaaaaaatgacataaccgcagtgaccaaggaagggaagatcctgctcaccaatctcgaagtccccgataccgagggtgccgtgtcatcacgattggaatgccacaggcaaatttccggcgactggcagaccatcaataaacttcttacgcaggttcatgatatggaaacggcctttgacggattttgggaaaaacatcagcttaagatggagcagtacctccagctgtggaagtttgaacaggacttccaacagttagtgactgaggtggagtttctattaaaccagcaggcggagctagccgacgtgactggcacaatagcccaggtgaaacagaaaattaagaagctggaaaacttagacgaaaactctcaagagctgctgagtaaggcccagttcgttattcttcacggtcataaacttgccgcaaatcaccactatgcattagaccttatttgccagcgatgcaatgaactgaggtacctgtctgacatcctggtcaacgagataaaggcaaaaaggatacagctgtccaggacttttaagatgcacaagttattacagcaagcaagacagtgctgtgacgagggcgaatgtttgcttgccaatcaagagattgacaaattccagtctaaagaagatgcccaaaaggcacttcaagacatcgaaaattttctcgaaatggctcttccttttattaactatgaacctgaaacgctgcaatacgagttcgacgtcatcctgagtcctgaactgaaagtgcaaatgaaaaccatccagcttaaactggagaacatccgctcaattttcgagaaccagcaggccggatttaggaatctagcggacaagcatgttcgtcctatccaattcgtggttcccacacccgagaacctggttacctctggcaccccatttttcagcagcaaacaaggaaagaagacctggcggcagaaccagtccaacttgaagatcgaagtggtgcccgactgccaggaaaagcggtctagcggcccatcatccagcctcgacaacggcaattcccttgacgtgcttaagaaccatgttctcaacgagctcatacaaacggaaagagtttacgtgcgggagttgtacacggttctgctaggataccgtgctgaaatggacaacccagagatgtttgacctcatgccaccactgctgcgcaacaaaaaggacattctcttcggaaacatggcggaaatctatgaattccataatgatatcttcctgagcagtctcgagaattgcgcacatgctcctgaaagagtcgggccttgctttctcgagcggaaggatgattttcaaatgtacgccaagtattgtcaaaataagcccaggtcagagacaatctggagaaaatatagcgagtgcgcattctttcaggaatgccagcgcaaattaaagcacaggttaaggttggatagctacctgctcaagcccgtgcaaaggataactaaataccagctactcctgaaagaactccttaagtacagcaaggattgcgagggctcggctctgctcaagaaggcactcgacgccatgctggacctgcttaagagtgtgaacgattctatgcaccagatcgctatcaacggatacattggcaatctgaacgaacttggcaagatgatcatgcaggggggtttttctgtatggataggccacaaaaagggggctaccaagatgaaagatcttgccaggttcaaacccatgcagaggcacttgtttctctacgagaaggccatcgtcttttgtaaaaggcgagtcgaatctggcgagggaagcgaccggtacccatcttattcctttaagcattgctggaagatggacgaggttggtattaccgaatatgtgaagggcgataatcgaaagttcgagatttggtatggcgagaaggaggaagtctatatcgttcaggccagtaacgtagacgtcaaaatgacttggctcaaagaaatcaggaacatcctcctgaagcagcaagagctcttgaccgttaaaaagcgcaagcagcaggaccaactgaccgaaagggacaaatttcagatcagcttgcagcagaatgacgaaaaacagcagggtgcattcatatctaccgaggagacagagctcgagcatacctcaactgtcgtggaagtatgcgaggcgatagcctcagtgcaggccgaggccaacaccgtgtggacagaggctagccagtccgccgaaatttcggaggaacctgctgagtggtcgagtaattacttctacccgacctatgacgagaacgaggaagaaaataggcctcttatgcgtcctgtttccgagatggctctcctctattag

SEQ ID NO: 229754 - DNA, 3213 bp, Artificial Sequence
  Description of Artificial Sequence: Synthetic coding sequence
atgccccaggcagctgcttccgccccatggacctcagtttcctgcgggaggatccccggactcccacagaaccctgatggatgcacctttatgccaatcgcacaggcgattccactccaggtggatatggccatggcgttgcagcgggtgcggatcgcagagaaatatgggaaaaactacttatgccttctgcaggccgtctttgtagctgagactgacctcttgttgcggataaaagatataagtcactttctcatgcaagatatcgcattcctgtccggcggtagagggaaggacaatgcctggatcattacctttccggagaattgtaacttccgctgcattcctgaagaagttattgccaaagtgttgacttatctgacctcaatcgccaggcaaaatggatcagactccagattcaccataatcctggatcggaggcttgacacatggtcctctctcaagattagcctgcagaaaatcagtgctagcttccctggcaacctccatctggtcctggtgctgagacccacatccttccttcagagaacgttcacagacatcggattctggttctcccaggaagattttatgctgaagctacccgtagtcatgttatccagtgtgtcggacctgttaacctatatcgacgacaaacagttaactccagagctcgggggtacactccagtactgccactccgagtggataatctttcgcaacgccatcgaaaattttgcactgaccgtaaaagaaatggcccagatgctacagtcatttggtacagagctggcagagaccgagctgccagacgatattccaagtattgaagaaattctcgctattagggcggaacggtaccatttgcttaagaatgatataaccgccgttacaaaagaaggcaagattctgctgacaaatctggaggtgcctgacacagagggggctgtgagctctcgcctggaatgccaccggcaaatctcaggggactggcagacaattaacaagttgctgacccaggtgcacgatatggagacggcattcgatggattttgggaaaagcaccagctgaagatggaacagtatctgcagctgtggaagttcgaacaggatttccagcagctagtgacagaagtggaattcctactgaaccagcaggcagagctggccgacgtgacggggacaatcgcacaagtaaagcaaaaaatcaaaaaactggagaacctagatgagaatagtcaggagttgctctccaaggcccagttcgttatcttgcatggccacaagttggccgctaaccatcactatgcactcgatctgatctgccaacggtgcaatgagctcagatatctgagcgatatcctggtcaacgaaataaaagccaagaggatccagttaagccgaacatttaaaatgcacaagctgttgcagcaggcacggcagtgttgtgatgagggggagtgcttgctcgccaaccaggaaatcgataaattccaatcaaaggaagacgcgcagaaggcactgcaggatatcgagaactttctggaaatggccttacctttcatcaattacgagccagagacgctgcagtatgaattcgacgtaattttaagtccagagctgaaagttcagatgaaaaccattcagctaaagttggagaacatccggtcaatcttcgagaaccagcaagcagggtttaggaacctggccgataagcacgtgcgccctattcagtttgtggtacccacgcccgaaaatctcgtgacaagcgggaccccgttcttcagttctaagcaaggaaaaaaaacgtggcggcagaatcagtctaacctgaagatagaggttgtgcctgattgtcaagaaaagagaagttccggtcccagctcctcactggacaacgggaactccttggatgtgcttaagaaccacgtgctgaatgagcttattcagacagagagggtgtacgtgagagagctctacaccgtcctactcggataccgcgcagagatggataaccctgagatgtttgacctgatgcctccgctcttgaggaacaaaaaagacatactgtttggaaatatggccgagatttacgaattccacaacgacattttcctgtcgtcgctggagaattgtgcccacgcacctgagcgagttggcccatgctttctggagcgcaaagatgactttcagatgtatgctaagtattgccagaacaagccccgaagtgaaacaatctggcgcaaatattcagagtgtgcctttttccaggaatgtcagcgtaaactgaagcatcgcttacgactagactcttatctcctcaagcccgtccaaaggatcaccaagtatcaactgcttttaaaggagcttctgaaatatagcaaggattgcgagggctccgccctgctcaagaaggcacttgatgccatgcttgacctgctgaaatcagttaatgacagtatgcatcagatcgcaattaatggatacataggcaacttaaatgagctgggcaagatgatcatgcagggtggcttcagtgtctggataggccacaaaaagggtgcaactaagatgaaggatctcgccagattcaaacccatgcaaaggcacctgtttctatatgagaaggctatagtgttctgtaaacgacgcgtggaatctggcgaaggctccgatcgatatccatcttacagctttaaacactgctggaagatggacgaggtgggtataaccgaatatgtgaaaggagataacaggaaatttgaaatatggtacggggagaaggaggaggtctacattgtgcaagctagcaacgttgacgtgaagatgacatggcttaaggaaatcaggaacattctgttgaaacagcaggaactcctgactgtcaagaagaggaagcaacaggaccagctgactgaacgcgataaattccaaatcagcctgcagcaaaatgacgagaagcagcagggggcattcatttccactgaagaaaccgagttagaacacacatctaccgtagtagaagtttgtgaggcgattgctagcgtgcaggctgaagctaacacagtgtggaccgaggccagccagtcggccgaaatcagtgaggagccagccgaatggtcatctaattatttttaccccacttatgacgagaatgaagaggagaaccggccacttatgagacccgtatcggagatggctctgctgtattag

SEQ ID NO: 229755 - DNA, 2958 bp, Artificial Sequence
  Description of Artificial Sequence: Synthetic coding sequence
atgcaggatatcgctttcctgtccggcggtcgaggtaaggacaacgcttggatcatcacctttccagagaattgcaatttcagatgtatacccgaggaggttattgcaaaggtgcttacatacttaaccagtatcgcccgacagaacgggagcgacagtcgcttcaccatcatcctcgaccgccgtctggacacatggagctcattaaagattagccttcagaaaatctcggcatcttttccgggaaatctacacctggtcttagtgctcaggccgacttcctttctccaacggaccttcactgacattgggttctggttctctcaagaagatttcatgctcaaactgccggtggtgatgctatcttcagtatctgacctgctcacttacattgatgataaacaactcaccccggaactggggggtactttacagtattgccatagcgaatggattatctttaggaatgctatcgaaaacttcgctcttacggtgaaggagatggcacagatgttgcagtccttcggaactgaattagcagagacagagttgcctgacgatattccttccattgaggaaatcctcgcaattagagccgaacggtatcacctgctgaaaaatgatatcaccgccgtgaccaaggaaggaaagatactcctcacgaacctcgaggtgccagacaccgaaggagcggtctcaagccgtttggagtgccaccgccaaatctctggagattggcaaactatcaataagctgctgacccaagtccatgatatggaaaccgccttcgacgggttctgggaaaagcaccaacttaagatggagcagtacctacagctctggaagtttgaacaggatttccaacagctcgtgacggaagtggagtttttgcttaatcagcaagccgagctagccgatgtgaccggtaccattgcccaggtcaagcaaaaaatcaagaagctggagaacctggatgagaacagccaggaactgcttagcaaagcccagtttgtgatcctccacggtcacaaactggcggcaaaccatcactatgccttggacctgatctgccagaggtgtaatgagctgcgatacctttcagatattcttgtcaatgagattaaggctaaaaggatccagctgtcaagaacctttaaaatgcataagctcctgcagcaagccagacaatgctgtgacgaaggcgaatgcctcctagcaaatcaggagattgataaattccagagcaaggaggacgcgcaaaaggcactgcaagacattgaaaatttcctggagatggccctcccatttatcaactacgagcccgagacccttcagtacgagttcgatgtgatcctgagtccggagctcaaggtccagatgaaaactattcaactgaaactcgagaatatcagatctatcttcgaaaaccaacaggcaggttttcgcaatctggccgataagcacgtgcggccaatacagtttgtggtacctacccccgagaatctggtgacatctggtacacccttcttcagctctaagcaggggaagaagacctggagacagaatcagagtaacctgaaaatcgaagtggttccagattgccaggaaaaacgctccagtggacccagcagctcgcttgacaacggaaattcgctcgacgtgcttaaaaaccacgtgctcaacgaactgattcaaacggaacgcgtatatgtgagggagctgtacacagtattgctgggctacagggcggagatggacaacccagagatgttcgatctgatgccgccactcctgcggaacaagaaggacatactgttcggcaatatggccgagatttatgagttccacaatgatatctttctttctagcctggagaactgtgctcacgctcctgagagagtggggccttgctttctggaaagaaaggacgattttcagatgtatgccaagtactgccagaataaaccacggtccgagactatctggcgaaaatacagcgaatgtgcattctttcaggagtgtcagcgaaaacttaagcacagattaaggctggacagctacctattgaagccagtccagcggattacaaaatatcaactgctgcttaaagagctgctgaaatactctaaggattgtgaaggaagcgctttactaaagaaggctctcgatgccatgctcgatttgctcaagtcagtgaatgacagcatgcatcaaatcgctataaacgggtacattggcaatctcaacgagctgggaaaaatgattatgcaaggcggattctctgtgtggattggccataaaaaaggtgcaaccaaaatgaaggatcttgcgcgatttaagccgatgcagaggcatttgtttctgtacgagaaggccatcgtcttttgtaagcggagagtggagtccggcgaaggctctgacagatatcccagctactccttcaaacattgctggaagatggacgaagtggggatcacagaatacgttaagggtgacaatcgaaaattcgaaatttggtatggcgagaaggaggaggtgtacattgttcaagcgtcaaatgtagacgtcaaaatgacgtggttgaaagaaattcgcaatattctcctgaagcaacaggagcttcttacagtcaagaagagaaagcaacaggatcagcttactgagagagataagtttcaaatttcactccagcagaatgatgaaaaacaacagggggctttcatcagtacagaagagaccgaattagaacatacgagcactgtggtcgaggtgtgtgaggccatagcgtctgtacaggccgaagcaaatacagtgtggacagaagcctcgcagagcgccgagatcagcgaggagcccgcagagtggagtagcaactatttttacccaacgtatgatgagaacgaggaagaaaatcggcctctgatgcggccagtgtctgagatggccctactttattag

SEQ ID NO: 229756 - DNA, 1290 bp, Artificial Sequence
  Description of Artificial Sequence: Synthetic coding sequence
taacacgtcctaaatgaactcatccagacagagagagtgtacgtgagagagctctataccgtgctactaggataccgagcagagatggataacccagaaatgttcgatcttatgccacctctgctgcgcaacaagaaagacattctattcggcaatatggctgaaatctatgaattccacaatgacatttttctctcgagcctggaaaactgtgcccatgcccctgaaagggtcggcccttgcttcttagagagaaaggatgatttccagatgtatgcgaaatactgtcagaacaagccccgtagcgagaccatctggaggaaatattcggagtgcgcgttcttccaagagtgtcagagaaaattgaaacacagactacgccttgattcctacctgctcaaacccgtgcagcgaatcacgaagtaccagctgctcttgaaagaattactgaaatattccaaggactgcgagggatcagctcttctgaagaaggccctcgatgccatgctggatctgctcaagtctgtgaatgatagcatgcatcagattgccataaatggatacataggaaaccttaatgaattgggcaaaatgatcatgcaagggggatttagtgtctggatcgggcataaaaaaggagcaacaaagatgaaagatctggccagatttaaacccatgcagcgccaccttttcttgtacgagaaagctattgtgttctgcaaaagaagggtcgagtcgggcgaggggagtgaccgctacccctcatatagcttcaaacattgttggaaaatggatgaggtcggcattaccgaatacgtgaagggggacaacaggaagtttgaaatctggtacggagaaaaagaggaggtgtatattgttcaggcttcaaacgttgacgtcaagatgacttggctcaaagaaatccgcaatatcttgctcaagcagcaagaacttctgaccgtaaagaaacggaaacagcaggaccagctcacggagagggataagtttcaaatttcgttacaacagaacgacgagaaacagcagggcgcttttatttccaccgaggagaccgagctcgaacatacctcaaccgtagtagaagtctgtgaggccattgccagtgtccaggccgaggcaaataccgtctggaccgaggcctcccagtctgccgagattagtgaggagcccgcagagtggtcctcaaattacttctatcctacttacgacgagaacgaagaggagaaccgaccactcatgaggcctgtttcagagatggctctgctgtactag

SEQ ID NO: 229757 - DNA, 1587 bp, Artificial Sequence
  Description of Artificial Sequence: Synthetic coding sequence
gttcagatgaagacaatccagctgaaactggagaatattcgcagtatatttgaaaatcagcaagctggctttaggaacctggctgataagcacgtgcgccctatacagttcgtggtgcccacacccgagaacctggttactagtggcacaccctttttcagcagcaagcagggcaagaaaacttggcgtcagaaccagagcaacttgaaaatagaggtggttcccgattgtcaggaaaagagatcttctggaccaagctcaagcttagacaatggtaattccctggatgttcttaagaaccacgtactcaacgaactcattcagacagaacgtgtgtacgtccgggaattgtacaccgtcctgctcggctaccgggctgaaatggataaccctgagatgtttgatctgatgccaccccttttacgcaataagaaggacatcttattcggaaatatggccgaaatttatgaattccacaatgacatttttcttagtagtttggaaaattgcgctcacgcgccagagcgtgtgggcccatgttttctggagagaaaagacgatttccaaatgtacgccaagtattgccagaacaagcctagatcggagaccatctggaggaagtattctgaatgcgctttctttcaagagtgccaacgcaaactgaaacataggttgcgcctagactcctacctgcttaagcctgttcagcggattacaaaataccaacttcttttgaaggaactgttaaagtatagtaaggactgtgaaggctccgccctgctgaaaaaggccctggatgccatgctcgatctcctcaagagtgttaacgatagtatgcatcagatcgctattaatggctacattggaaatctgaatgaattaggaaagatgatcatgcaagggggtttttccgtgtggatcggtcacaagaagggggctactaaaatgaaggacctcgcccgattcaaacctatgcagcgccatctatttctgtacgagaaagccatagtgttttgcaagcgaagggtcgagagtggcgaaggaagcgacaggtacccctcctattcctttaaacactgttggaagatggacgaggtcggtattaccgaatacgtcaagggcgataacagaaaatttgagatctggtacggagagaaagaagaagtctatatcgtgcaggcaagcaacgtcgatgtcaagatgacatggttgaaagaaatccgaaacatcctgctgaagcaacaggaattgttaaccgtgaagaagcggaaacagcaagaccagctaactgaacgcgacaaattccaaatcagtctgcagcagaatgatgaaaagcagcaaggcgcttttatctctactgaggagacagagctggagcacacctctacagtggtggaagtgtgcgaagctattgcgtcggtccaggccgaagcaaacacagtatggacggaagccagccagtccgcagagatctctgaagaaccagccgagtggtcatcaaattacttctacccaacgtacgacgagaatgaggaggaaaacagacccctgatgaggccagtcagtgaaatggccctgctgtactag

SEQ ID NO: 229758 - DNA, 3006 bp, Artificial Sequence
  Description of Artificial Sequence: Synthetic coding sequence
atgcaggacatcgcttttctgtccggaggcagaggcaaagacaacgcctggattattacattccctgagaattgcaacttcaggtgtatcccagaagaagtaatcgcaaaagtgcttacatatctcacatccatagctagacagaacggctctgacagcagattcaccatcatccttgaccggagactggacacctggtcatcgctgaaaatatctctgcagaaaatttcagcttccttcccgggaaacctccatctggtgctggtcctgcggccaacaagctttctgcagaggacattcacagacataggcttctggttcagtcaggaggacttcatgctgaaactccccgttgttatgctttccagtgtctctgacttgctgacgtatatcgacgacaaacaattgacaccagaattaggaggaacacttcagtactgtcattctgaatggattatatttcgtaacgctattgagaatttcgccctaaccgttaaggagatggcccaaatgctacagtctttcggcacagagctagcagagactgaactgcccgacgacatcccatctatcgaagagattctggcaattagagccgaaagatatcatctattaaaaaatgatataaccgcggtgaccaaggagggcaagatcctcttaaccaacctggaggttcccgatacagagggggctgttagcagccggcttgaatgccacagacagatttccggcgattggcagactattaataaactgttgacacaggtgcacgatatggagacagcgttcgatggattttgggagaaacaccagctgaaaatggaacagtacttacagctgtggaagttcgaacaagattttcagcagcttgtgacagaggttgaattcttactgaaccagcaggcggagcttgccgatgtcacaggaacaatcgctcaagtgaagcaaaagattaagaagcttgagaacttggacgaaaattcccaggaactgcttagtaaggcacagtttgtgatattacacgggcacaagctggcagccaaccaccattacgcacttgatttgatatgtcaaagatgcaacgaactgcgctacctgtctgacatcctcgtgaatgaaattaaagcgaagaggatccagctctcccggacgttcaagatgcataagcttctgcagcaggccagacagtgctgcgacgagggcgaatgcctcctcgcaaaccaggaaattgacaaatttcagtcgaaggaggatgcgcagaaagctcttcaagacatcgagaatttccttgagatggccctgccttttatcaactatgagccggagacgttgcagtatgaattcgacgtgatcctgagtcccgagctaaaggtacagatgaaaacaattcagctgaaactagaaaacatcaggtctatttttgaaaaccagcaagcgggttttaggaacctcgcagataagcacgtaaggcctatccagtttgttgtacccacccctgaaaaccttgtcacaagcggtacacctttttttagctctaagcaggtgggagtggggtactccttcttccaggcctgcaaattattctccaagggcaagaagacttggcgacagaaccaaagtaacctgaagattgaggtggtccctgactgccaggaaaagcggtcttctgggccatcctcatcactggacaacggaaactcactggacgtcctcaaaaatcacgtgctcaatgaactgattcagacggaaagagtatacgtcagggaactgtacaccgtgctcctgggctatcgggcagaaatggataacccagagatgttcgacttgatgcctcccttgctgcgcaacaaaaaggatatcctgttcggcaacatggctgagatctacgagtttcataacgacattttcctgtcttcactggagaactgtgcacatgctcccgagagagtgggaccatgcttcttggaacgcaaagacgactttcagatgtatgcgaagtactgccagaataaacctcggagcgaaactatttggcgaaagtacagcgagtgcgctttttttcaggagtgccagagaaagctgaagcaccgacttcgactagactcgtacctgctgaaaccagtccaaagaatcaccaagtatcagctcctgttgaaggagttgctcaagtactccaaggattgtgaaggcagcgccttacttaagaaagccctcgacgccatgttggatttactgaagtccgtgaatgattctatgcaccagatagccattaatggttatatcggaaacctgaacgaactggggaagatgatcatgcagggaggtttttctgtttggataggtcataaaaaaggggcaacaaagatgaaggatttggctaggttcaaacctatgcagcgccatctgttcttgtatgagaaggccattgtgttttgcaaaagaagagtcgagtcaggtgagggaagtgatagatatccgtcatatagcttcaagcactgctggaaaatggatgaggtcggaattaccgaatacgtgaaaggcgataatcgaaaattcgaaatctggtatggagagaaagaggaagtgtatattgttcaggcgtcgaatgtcgacgtcaagatgacgtggctcaaggagatcagaaacattctcctcaaacagcaggagttattgaccgtcaaaaagagaaaacagcaagaccaacttactgaacgagataaatttcagatttctctgcagcagaacgacgagaagcagcagggcgcattcatcagcaccgaagaaaccgaactagagcatacctccacagtggtagaagtctgcgaggctatcgccagtgtgcaagctgaagccaacactgtgtggaccgaagccagccaaagcgccgaaatctctgaggaacctgcggagtggagtagcaactacttttatccaacttacgacgaaaacgaggaagaaaatcggcctctgatgagaccggtttctgaaatggcattactgtactag

SEQ ID NO: 229759 - DNA, 2958 bp, Artificial Sequence
  Description of Artificial Sequence: Synthetic coding sequence
atgcaagatatcgcctttctgtccggcggaagaggaaaagacaatgcatggattataacatttcctgagaattgtaacttccgctgtattccagaggaagtgattgcaaaggtgctcacctatctaactagcatagccagacaaaacggatctgattctcgatttacaattattctggatcgacgcctggatacatggtcctccctgaagatctctctgcagaagatttccgcatctttcccaggcaacctgcacttagtgttggtacttaggcccacttcgttcctgcagaggacttttactgatattgggttttggtttagccaggaagactttatgttaaaactgccagtggtgatgctcagcagcgtttccgatttgttgacatatatcgacgacaagcaattgacccccgaactggggggtacgcttcagtattgccattctgaatggattatattccgcaatgccattgagaacttcgcactcactgttaaggagatggcgcaaatgctgcagagcttcggaacggagctggccgaaaccgaacttcccgatgacatcccaagcattgaagaaattctcgcaatccgcgctgaacgataccacctcctcaaaaacgatataacggccgttactaaggagggaaaaatacttctcaccaatctggaggtgccggacaccgagggagccgtatctagtaggctggaatgtcacaggcagatttcaggggactggcagaccatcaacaaactgttaactcaggtccatgatatggagacagccttcgatggattctgggaaaaacatcagcttaagatggaacaatacttacagctttggaaattcgaacaggacttccagcaactggtaaccgaggtagagttcctgttaaaccagcaggctgaattagctgatgtgactggcactatcgcacaggttaagcagaagatcaagaagctggagaatctggatgagaactctcaggaacttctgtcaaaagctcaatttgttatcctgcacggacacaaacttgcagcgaaccaccactacgctttagatctcatttgccagcggtgcaatgagctgagatatctgagcgacatcttagtgaatgagattaaagccaagcggatccagctgagcagaacatttaaaatgcacaagcttcttcagcaggccagacagtgttgcgacgagggagagtgtctgctggccaaccaggaaattgacaagtttcagtccaaggaggacgcacagaaagcattgcaagatatcgagaattttctggagatggccctgccattcatcaattacgagcctgagaccctgcaatatgaatttgacgtgatcctgtcacccgagctcaaggtccagatgaaaaccattcaacttaagctcgagaacattcggagcattttcgagaaccagcaggcgggttttagaaatcttgctgacaagcacgttcgacctatacagttcgttgtccctacccctgagaatctcgtgacctcaggcacccccttcttctcatctaagcaaggaaagaagacgtggaggcaaaatcagtccaatctgaagatcgaagtggtgcctgactgtcaagaaaagcgttcctctggtccctcatcttcactggataacggcaattcgctggacgtgctcaaaaatcatgtgctgaacgaactaatccagactgagagggtctacgtgcgggagttgtacaccgtcctgctgggatatagggctgagatggacaatcctgagatgttcgacctgatgccacctttattaagaaataagaaagatatcctcttcggcaatatggctgaaatctatgagttccacaacgacatatttctgagttctcttgaaaattgcgctcatgcacccgaacgcgttggcccatgcttcttggagagaaaggatgattttcaaatgtacgccaaatactgccagaacaaaccaaggagtgaaaccatctggcgaaaatactccgaatgtgccttctttcaggaatgccaacggaagctgaaacatcggttacgactggatagctacctcctgaagcctgtccagagaatcacgaagtaccagctgctcctcaaggagctcctgaaatatagtaaagactgcgagggctccgcgctacttaagaaggctttggacgctatgctggacctgttgaaatcagtgaatgactctatgcaccagattgcaatcaacggctacatcgggaacttgaatgagctcggaaagatgattatgcaggggggattcagtgtgtggatagggcacaagaaaggcgctacaaaaatgaaagatttggcaagatttaagcccatgcagcggcatctttttctgtacgagaaagccatagtattttgtaagagaagagttgaaagtggcgaaggaagtgaccggtacccgtcttattcatttaaacactgttggaaaatggacgaggtcggtataaccgagtacgtgaagggcgacaacaggaagttcgagatttggtacggtgagaaggaagaggtttatattgtgcaggcctctaacgtcgacgtgaagatgacctggctgaaggaaattcgcaatatcctactcaaacaacaagagttgctgaccgtcaagaagagaaaacagcaggaccagctgaccgaacgggataagttccagataagtctgcaacagaatgacgagaagcagcagggggcttttattagcacagaggagacagagctggagcacaccagcacagtagtggaggtgtgtgaggccattgcctctgtccaggccgaggctaacaccgtctggacggaggcttcacagtctgcggagatcagtgaggaaccagctgaatggtcttccaattatttttaccctacttacgacgagaatgaagaagaaaacagacctctgatgcggcctgtctcggaaatggctttgctgtattag

SEQ ID NO: 229760 - DNA, 2466 bp, Artificial Sequence
  Description of Artificial Sequence: Synthetic coding sequence
atggccgaagctaacccccgacggggaaagatgaggttcagacgcaacgcggcatccttccccggtaacctgcacctcgtcctggtactcaggcctactagcttcctgcagcgaaccttcacagacatcggattttggttctcacaggaagatttcatgctgaagctgccggctatagagaatttcgccctgaccgtgaaggagatggctcaaatgctgcagtcttttggcaccgagttagcagagaccgagctgccggacgacattccgtcaattgaggagatccttgcaatacgagcagagcgttatcacctgctcaaaaatgatattactgccgtgaccaaggaggggaagattctcctgactaacctggaggtaccagatactgagggtgctgtgagctctaggctcgaatgtcatcgccagatctccggtgactggcagaccattaataagctgttaacccaggtgcatgacatggagacagctttcgatggcttctgggaaaaacaccagttgaagatggaacaatatctgcagttgtggaaatttgaacaagatttccagcaactcgtgaccgaggtggaatttctgctgaatcagcaggccgaactggcagacgtgaccggtacaatcgcacaggtgaaacagaagattaagaagctagaaaaccttgatgagaatagccaagagctgttaagcaaggctcagttcgtgattctccatggtcacaaactggcagctaaccatcactacgcactggacttaatctgccagaggtgcaatgaattgcgttatctgtcagatatattggtgaatgagatcaaagccaaaaggatccagctctcaagaaccttcaaaatgcacaagttgctgcagcaggcacgccagtgctgcgatgaaggagagtgcctactcgcgaaccaggagatagacaagtttcaatctaaggaggacgcacagaaggccctgcaggatattgaaaatttcctggaaatggcccttcctttcataaactacgagccagagaccctccagtacgaattcgatgttattttgagcccggagctgaaagttcagatgaagacaatccagcttaaactagagaatattagatcaatctttgagaaccagcaagcgggttttcgcaacctggctgataagcatgtcagacccattcaatttgtagtgcctactcctgagaacttggtgaccagtggtactccgtttttctcatctaaacaaggcaaaaagacttggcgccagaatcaaagtaatttgaagatcgaggtggtgccagactgccaggagaagagatcttcagggcctagctcatcactggataacggaaactctttggacgtgctgaaaaatcacgttcttaatgagctcatccagacagagcgtgtgtatgtgagggagctgtacacagtcctacttgggtatagagcggagatggacaaccccgagatgttcgaccttatgccgccactcctccgcaacaaaaaagacattcttttcgggaacatggccgagatatacgaattccataacgatatttttctcagttctctggagaattgtgctcatgcccctgagcgcgtgggcccttgctttctcgagaggaaagacgactttcagatgtacgctaagtattgccagaataaacctcggagcgagactatctggcggaagtacagcgaatgtgctttttttcaagaatgccagcggaagctcaaacaccgacttaggctagactcatatcttcttaagcctgtccagaggatcacgaaatatcagctgttgctgaaagagctgctaaagtattccaaggactgtgagggatccgcgctcctcaagaaagcgctggacgccatgttggacctcctgaaaagcgtgaatgatagcatgcaccagatcgctattaacgggtacatcggcaatctgaatgaactcggcaagatgataatgcaggggggattttctgtttggatcggccacaagaagggggcaaccaagatgaaagaccttgcccgattcaaacctatgcaaaggcatctgtttctgtacgagaaggctattgtgttttgcaagcgacgagtggaaagcggtgagggaagcgatcgatatccatcgtacagctttaaacactgctggaagatggacgaggtcggcatcacggaatatgtgaaaggggataaccgcaaattcgagatctggtacggggaaaaggaggaggtttacatcgtacaagcatcgaatgtagatgtgaaaatgacgtggctgaaggagatcaggaacattctcctgaaacagcaggaactgttgactgttaagaagagaaagcagcaggatcagttgacggaacgagacaagttccaaatttccttacagcagaacgatgaagacctgtgccgacggtggttatcttacattgatgaagcaacaatgtccaacggtaagtag

SEQ ID NO: 229761 - DNA, 2955 bp, Artificial Sequence
  Description of Artificial Sequence: Synthetic coding sequence
atgaccgtacggaggctgtcactactttgcagagacttgtgggcactctggctactgttgaaagccggtgccgatgagataatgcaccaagacatcgtgcctttgtgcgctgccgatatccaggatcagctgaagaagaggtttgcctacctatccggagggcgaggacaagacggctcgcctgtcatcacatttcccgattatcctgcgttcagtgaaatcccggacaaggagttccaaaatgtgatgacatacctgacaagtattcctagtctgcaggacgctgggatcggtttcattttggtaattgaccgccgacgggataaatggacaagcgttaaggcctctgtactccgaatcgcggcatcattccccgctaatctccagctagttttggtgctccggcctaccgggttctttcagaggaccctatctgatatcgcgttcaaattcaacagggacgactttaaaatgaaagttcccgtgattatgctcagcagcgtgcctgatttgcacggctacatagacaagagtcagctcactgaagatttaggagggactctggactactgtcattccagatggctgtgtcagcgcaccgcaattgagtcttttgcccttatggtcaaacagactgcacaaatgcttcaatcctttggcactgaactagcggagaccgaactcccaaacgatgtgcaatccacctccagcgttctgtgtgctcacacggagaaaaaggataaagcaaaggaagacctcaggcttgcattgaaggagggccattccgtcctcgagtctctaagagaactccaggctgagggctcagaaccaagtgtgaatcaggaccagctcgataatcaggcaacggtgcagagactactggcccagctcaacgagactgaagcggcattcgatgagttctgggccaagcaccaacagaaactggaacagtgtcttcagttgcggcacttcgagcagggattccgagaggttaaagcgatcctcgatgccgcttctcagaaaatagcgactttcactgacattggaaatagcctggcgcacgtagagcatttgctgcgcgatctggcgtcttttgaggaaaagagcggagtggctgtagagcgggctcgtgccctgagtctggatggcgaacagctgatcggaaataagcattacgcggtcgattcgatcagaccaaagtgccaggaactcagacatctgtgtgaccagtttagtgccgaaatagcccgtaggagaggattgctgtctaagtcactggaactccaccggcgactggaaacttcaatgaaatggtgtgacgaaggcatctacctcctggcttcacagccagtggataagtgccagagccaggatggcgcagaagcagctctgcaggaaatcgaaaaattcctcgaaaccggcgctgagaacaagatccaggagctgaatgctatttacaaggagtatgagagtattctcaatcaggacttgatggaacatgtccggaaggtgttccagaagcaagcttcaatggaggaagtctttcaccgacggcaggcttctttgaagaaactggcagctaggcagactcgacccgttcaacctgttgctcctcggccagaggctcttgccaagagtccttgtccgagtcccggaattaggaggggctcggaaaacagctcatcagaaggcggagctctgagaaggggaccataccggagggccaaatcggaaatgtctgaaagtcgacaaggaagggggagcgccggtgaagaggaggaaagcctggctatcctgcggaggcatgtcatgtcagaacttctagacaccgagagagcgtatgtagaggagctgttgtgtgtcctggagggctacgcagcagaaatggacaatccgcttatggcacatctcctttctaccgggctgcacaacaagaaggatgtcctgttcgggaatatggaggaaatttatcacttccataacagaattttcctccgtgagctggagaattacacagattgtccagagctcgtcggccgatgcttcctggagcgtatggaggacttccagatatatgaaaagtattgtcaaaataaacccagatctgagagtctttggaggcagtgcagcgattgccccttcttccaggagtgccagcgaaagctggaccacaagttgagcctcgactcgtatctcttaaagcccgtccaacgcatcaccaagtatcagctgcttttgaaggaaatgctaaagtacagccgcaattgcgaaggggcagaagacctccaagaggccttgagctccatcctgggcattctgaaagccgtcaatgacagtatgcatctgattgccattactggttatgatgggaatctcggagatttggggaagctgctaatgcaaggaagctttagcgtttggactgaccacaaaagagggcacaccaaagtaaaggagctcgctcgctttaaaccaatgcagcggcacctctttctgcacgaaaaggctgtgctgttttgcaagaaacgggaggaaaacggagagggctacgaaaaggccccttcatactcctacaagcagtctttaaacatggccgctgttggaatcaccgaaaacgtgaagggcgatgctaaaaagtttgagatttggtacaatgctcgagaggaggtctacattgtccaggcacccacccccgagatcaaagccgcatgggtgaacgaaatcaggaaggtgctgactagccagctacaagcatgccgagaagctagtcagcacagagccctggaacagtcacaatccctgcctctcccagctcccacatcaactagtccaagcagagggaactcacgaaacattaagaaactggaggaaaggaagactgatccactgtccctggagggttatgtgagcagcgccccattgaccaagccccctgagaagggcaaggagccatag

SEQ ID NO: 229762 - DNA, 3390 bp, Artificial Sequence
  Description of Artificial Sequence: Synthetic coding sequence
atggccgagaagggcgcttccagaggaactctgaggcgcctgtggtcgttgccaaggagaaggcgtggtaccgcaggaaggtcacgccctgatgagatcatgcatcaggatatagtgcctctgtgtgcagctgacatccaggatcaactgaagaaacggtttgcatatctctctggcggaagagggcaggatggctcacccgtcatcacttttcccgattaccccgcatttagcgagattccggacaaagaattccagaacgtgatgacctatctcaccagcatcccatccttgcaggacgcgggaatcgggtttatccttgtcatcgaccgcagacgggacaagtggactagcgtcaaagcctctgtccttcgcatcgctgcttctttcccagcaaacttgcagctggtattagtccttcgcccaaccggattctttcagagaactctctcagatatcgcttttaaattcaaccgtgacgacttcaagatgaaagtgccagtgattatgctgagcagtgttcccgacctccatggatacattgacaagtcccagctgactgaggacctcggaggcacacttgattactgccattcgcgatggctgtgccagaggaccgctattgagtccttcgctctgatggtgaagcagactgcccagatgctgcaaagtttcggaacggaacttgccgaaacagagttgcccaacgacgtgcaaagcacttcgagcgttctgtgtgctcatacggagaagaaagataaagctaaagaagatctgagattggctctcaaggaaggccactccgtgctcgagagtctgcgcgaactccaggctgagggcagcgaacccagcgtcaaccaggatcagcttgacaaccaggctacagtgcagcgtctcctcgcacagctcaatgagaccgaagcagcgttcgacgagttttgggctaagcatcagcaaaaactggagcagtgcttacaactacgccatttcgaacagggattccgggaagtaaaagccatcctggacgcagctagccagaaaatcgccactttcaccgacatcggaaactcactagcacacgtggagcatttgctgagggatctggctagcttcgaagagaagtccggcgtggctgtggagagggcgcgagcactgtctctggacggcgagcagctgattgggaataaacactacgctgtcgactcaattaggccaaaatgtcaggagttgcgacatctttgcgatcagttctctgccgaaattgcccgtaggagaggcttgttgagtaagagcctcgagctccaccgcaggctagagaccagtatgaaatggtgcgatgaaggcatttatttgctggcatcccagccggtggacaagtgccaaagccaggacggcgctgaagcagctctgcaggaaatcgaaaaatttttagaaaccggggctgagaacaaaatacaggagctcaacgccatctataaggagtacgaaagcatcctcaatcaggatttaatggagcacgtgaggaaagtatttcagaagcaagcctccatggaggaggtgtttcacagacgacaggcctctcttaagaaactggcagcccgacagacccgtcccgtacaaccagttgccccaaggccagaagcactggctaaaagtccatgtccttctccgggaataaggcgtggttctgaaaactcttcctcagagggcggagctctgcgcaggggaccctaccgcagagccaaatctgaaatgtccgaaagccgccagggtaggggatctgctggggaagaagaagaatcgctggccatcctgcggaggcatgtcatgagcgagctgctggacaccgagagggcatatgtcgaggagctcttgtgcgtcctcgaggggtatgctgccgagatggataacccactgatggcacacctgctgtcaactggcctgcataataaaaaggacgtgctatttggtaatatggaagagatttatcattttcacaaccggatattcctacgcgagttggaaaattatactgattgcccggagctggtgggacgatgtttcctcgaaagaatggaggatttccaaatttacgaaaaatactgtcagaataagcccaggtctgagtccctatggcgtcagtgctctgattgccctttctttcaggaatgccagcgtaagctggatcataaattaagtctggacagctatctacttaagcccgtccagagaatcactaaatatcagttactgctgaaagagatgctgaagtacagcaggaattgtgaaggcgcagaggaccttcaagaggctttaagctctatcctgggcatccttaaagccgtcaacgatagtatgcatttgattgctatcactggttacgatggaaacctgggagaccttggaaaactcctaatgcaggggagttttagcgtgtggacagaccacaagcgtggccacactaaagtcaaggagctcgcaagattcaaaccaatgcagcggcacttatttctccatgagaaagctgtgttattttgtaaaaagagggaagagaatggcgaaggttacgagaaagcaccttcgtactcttacaagcagtccttgaacatggctgcagtgggcatcactgagaacgtaaagggggacgcaaagaaatttgagatttggtacaacgccagggaggaagtctacatcgtccaagcacccacccctgagatcaaggctgcgtgggtgaatgaaatacggaaggtcctgactagccagctgcaggcctgcagggaggcgagccagcatcgcgcacttgagcagagtcagtcattgccactcccggctcctactagcaccagcccaagccgtggtaactcccgcaatatcaagaagctggaggaacggaagactgacccactctctttggaaggatatgtctcttctgccccacttactaagccccctgagaaggggaagggctggagcaagactagccactcactggaggctccagaggatgatgggggttggtcctctgccgaagagcaaattaattcctccgacgcagaggaggacgggggtctaggccctaaaaaattggtgccaggaaaatatactgttgtggccgaccacgaaaagggcggtcccgacgctctacgggtgcgctccggtgacgttgtggagctcgtgcaggagggcgacgaagggctctggtacgtgagagacccgactaccgggaaggagggttgggtacctgcctcatctcttagtgtacgtctgggcccaagtggttcagcccagtgtctgagcagctccgagtcatctcctggttcagcagtcctgagtaactcgtcaagctgctctgaaggaggccaggctccattcagcgacctgcagggatag

SEQ ID NO: 229763 - DNA, 3549 bp, Artificial Sequence
  Description of Artificial Sequence: Synthetic coding sequence
atggctcgtgttgagagcccagtccccgcagctcgggcatccttaactggaagttgcgttttgggccaggctatgccgctgaggggaggcgcaggcccttctcccgcatctcatggccctacgcatggcccttcggaccctcgcacatgtcttccaggaagaggagcagggggaatgaggccccacggccgaggtgccctcgggtgttgtgggctgtgctctttttacacttgtcacggcgcagctggagatgagataatgcaccaggacatcgtgccactttgcgcagccgacatccaggatcagttaaaaaaaaggttcgcttacctgtcaggaggtcgcggtcaggacggctccccagtgataaccttcccagattaccctgcattctccgaaataccagacaaggaatttcagaacgtgatgacctaccttacgagtattccaagccttcaggacgcgggaataggctttatattggtgatcgatcggcgaagggacaagtggacttccgtgaaagcttccgttctgcgcatcgccgcttccttcccggctaacttgcagctggtgctagttttaaggccaacggggttttttcagcgcacattgtcagacattgcatttaaattcaatagggacgatttcaaaatgaaggtgcccgtgattatgttatcttcagtaccagacctgcatggttacattgataagagccagctcacagaggaccttggcggaactctcgactactgccattcacgatggttatgccaaagaacagccattgagagttttgcactgatggtgaaacagactgctcagatgctccagagctttgggacggagcttgccgagactgagttgccaaacgacgtccagtctacctcttccgtactgtgcgcccatactgaaaaaaaagataaggcaaaggaagatctgcgcttggccttgaaggaaggccatagcgtcttggaaagcctgagggagctccaggccgaggggtccgaaccctcagtcaaccaggaccagcttgataaccaggccacggtgcagagactgctggcccagctgaacgaaacagaagcagccttcgacgaattctgggcaaagcaccagcaaaaactggagcaatgtctacagctacgccactttgagcaaggatttagggaggtaaaggcaattcttgacgcagctagtcagaagatcgcgactttcactgacattggcaacagtctcgcacacgtggaacacctgctgcgcgatctggcttcctttgaagagaagagcggggtggccgtagaacgggctcgtgcacttagcctggatggcgaacaactgatcggaaacaagcactatgccgttgatagtatccgaccaaaatgccaggagctgagacacctgtgtgaccagttttctgcggaaatagctcgccgacggggactactctccaaaagtctggagttacatagaagattagagacttctatgaaatggtgcgatgaaggaatctatctactcgccagtcagcctgtggataagtgccagagtcaagacggagcagaagcagcattacaggagatcgagaaatttctggagaccggagccgagaataagatacaggagctgaatgctatttacaaagaatacgagtcaatccttaatcaagatctgatggaacatgtgaggaaagtgttccaaaagcaagctagcatggaagaggtgttccatagaagacaggcaagcctgaaaaagttagcagccaggcagacacgcccagtgcaacctgtggctccccgaccagaagcactggcaaaatccccttgccctagccctgggattagaagagggagtgaaaacagctcgagtgaaggtggtgcactgcgacggggtccttatcgccgagctaagagcgagatgtccgaatcacgacaaggcaggggttccgccggtgaggaagaagaatcactcgcgattttgcggagacatgtcatgagcgaactgcttgatacagaaagagcatacgtcgaagaattgctgtgcgtactagaaggttacgccgcagaaatggataaccctcttatggcacatctgctgagcaccggcctgcataataagaaagacgtcctcttcggcaacatggaggagatataccacttccacaatagaatctttctgcgcgagttggaaaactatactgactgccctgagctggtcggtaggtgcttcctagaacgaatggaggacttccaaatttatgagaagtactgtcaaaacaaaccacgctccgaatctctttggcggcagtgctccgattgtccattctttcaggagtgccagcggaaactggatcataaattaagtcttgactcttacctgcttaaacccgtacagcgaattacaaaataccagctgctcctcaaggagatgctgaaatattctcgcaactgcgaaggagccgaggatctgcaggaggccctgtctagtattctgggaatcctgaaggcggtaaatgactcaatgcatcttatcgccattacaggatatgacgggaatctaggggacctcggtaagctgttaatgcaggggtcgttctccgtctggaccgaccataaacgcggacacactaaggtgaaggaactcgccaggtttaagcccatgcaacggcacctgttcttgcacgaaaaggcagtcctgttttgtaagaagcgagaagagaacggggaaggatacgaaaaggcaccaagctatagctacaaacagtccctgaatatggcggctgtgggtattaccgagaacgttaagggagacgccaagaagtttgaaatctggtataacgccagagaagaggtgtacatcgtgcaggctccaacaccggagattaaggcagcttgggtgaacgaaatccgcaaggtcctgacatctcaattacaggcctgtcgggaggccagccagcaccgtgctttggaacagtcgcaaagcctgccccttcctgcaccgacctcaaccagcccgagcagaggtaacagccgcaacatcaagaagctggaggagagaaaaacagacccattaagtctcgaaggctacgtgagtagcgcgcctctgaccaaacccccagagaagggcaaagggtggagcaaaacctctcatagcttggaggcccctgaggacgatggaggatggtctagtgctgaggagcaaatcaatagttccgatgcggaggaggatgggggactgggacctaaaaagcttgtgcctgggaagtacactgtcgtcgccgaccacgagaagggaggccctgacgcactaagagttaggagcggtgatgtcgtagaactggtgcaggagggagatgaggggctgtggtacgtgcgagaccctaccaccggaaaggaggggtgggtgcccgctagttccctgagtgtgcgcctgggcccaagtggctcagcccagtgtctgtcatcgtccgagagcagtcccggttctgctgtcttatcaaattccagctcatgcagcgaagggggacaggcaccttttagtgatctccagggctag

SEQ ID NO: 229764 - DNA, 3414 bp, Artificial Sequence
  Description of Artificial Sequence: Synthetic coding sequence
atgtttgactgctggcggttcatcctctgtaaacggcctgggtctaatagctactcgtcccctcagcggcctaatgaagctaaaaaggaagaaacggaccaccagatcgacgtcagtgacgtgatccggttagtacaggatacgcctgaagcaacggcgatggctacggacgagatcatgcaccaagacatagtcccactttgcgctgcggatatccaagatcagctaaaaaaacggtttgcgtatcttagcggcggaagaggtcaggatggatccccagttataacctttcccgattatcccgcattttcagagattccggataaagagtttcaaaacgtgatgacctacctgaccagcattccaagcctccaagacgccggaattggcttcatactcgtgatcgaccgccgacgagacaaatggacatcagtgaaggcctcagtccttcgcattgcagcgagtttcccagcaaatctccagctagtcctggtgcttcgaccaacgggctttttccagaggaccctaagcgacatcgcttttaagtttaatcgggacgattttaagatgaaggtgcctgtgattatgctaagttccgtgccagatctacatggttacatcgataagtctcagctcactgaagatctgggcggaaccctggactattgccattctcggtggttgtgccagcgcaccgccatcgagtctttcgccctcatggtgaaacagacagcccaaatgctccaatcttttgggaccgagctggcagagacagaactgcctaacgacgtgcagtcaacctcatctgtgttgtgcgcacacaccgagaaaaaagataaggctaaggaggacctgcgtcttgcactaaaagagggtcattctgtattagagagcttgcgcgaactccaggctgagggctcagagccatccgtgaatcaagaccaacttgataaccaggccactgtccaacgattgttggcacaactcaatgagacagaagctgcatttgatgagttctgggctaagcaccaacagaagttagaacaatgcctgcagttgagacactttgagcagggtttccgcgaggtgaaagcaattctcgatgctgccagccagaaaattgccaccttcactgatattggcaacagtctggctcatgtggagcaccttctgcgtgacctagcctctttcgaggaaaaatctggtgtggccgtggagagagccagggccctgagcctggatggggaacagctaataggtaacaagcactacgctgtcgacagtatccgtcccaagtgccaggagctgaggcatctttgtgatcaattctcagctgaaatagctcgaagacgcggtctcctgtccaagtccctggagctacaccggcgtctggaaaccagcatgaagtggtgcgacgagggaatctacctgctggcgagtcagccagtcgataaatgccagtctcaagacggcgcagaagctgctcttcaggaaattgaaaagtttctggaaaccggtgccgaaaataagattcaggaacttaacgcaatatacaaggagtatgaatcaattctcaaccaggacctaatggagcatgtcaggaaggtgtttcaaaagcaagcgtccatggaagaggtgttccacaggaggcaggctagcttgaagaaactggctgctaggcagacccgccctgtgcagcccgtggccccacggcctgaagcattagcaaaatcgccatgtccttctccaggtataagacggggttcagagaattcctcttcagaaggaggggctttgagacgaggcccttatcgccgagcgaaaagcgaaatgagcgaaagcaggcagggcagggggtccgcgggagaagaggaagagtcattggcgattctcaggcggcacgtcatgtccgaattacttgatacagagcgtgcctacgtggaagagctcctatgcgttctggagggctatgctgccgaaatggacaatccgttgatggcccacctgttatctactggactgcacaataagaaagatgtgctgttcggcaatatggaggagatttaccattttcacaatcgtatctttttacgcgagctggaaaactacacagactgcccagaactggtaggtaggtgtttcctggagaggatggaagatttccagatatatgaaaaatactgccagaacaagccacgaagcgagtcactgtggcgccagtgctctgactgtcctttctttcaggaatgccagagaaagctcgaccacaaactatcactggattcctacctcctcaagcccgtgcagaggatcactaagtaccaactgctcctgaaggagatgctgaagtactccagaaactgcgaaggagctgaggatctccaagaagccctgtcatccatactgggtatcctcaaagccgtcaatgactctatgcatcttatcgcaattacgggctacgatggaaatctgggggatctggggaagctgctgatgcaaggctccttttcagtctggacagaccataagaggggacacacaaaggtgaaagaactcgcccgatttaaaccaatgcaacgccatctgtttctgcacgagaaggccgtgctgttctgcaagaaaagggaggaaaatggcgagggatacgagaaagcaccatcgtactcatacaagcagagcctcaatatggccgctgtgggcattaccgagaacgtcaaaggggacgctaagaagtttgagatctggtataatgcaagagaggaagtctatattgtgcaggccccaaccccagagatcaaagccgcttgggtgaacgagattagaaaggtacttaccagtcagctacaggcttgtcgagaagcctcgcagcatcgcgctttagaacagtcacagtcactgcctcttcctgctcccacatctacatcaccatctcggggaaattcgcgaaacattaagaaattggaggaacgtaaaacagaccctttgtcattagagggatatgtcagttctgcgccattgaccaagccaccagaaaaaggaaagggctggtcaaaaacatctcactcgctggaggcccctgaggacgatggcggttggtcatccgcagaagagcagatcaactctagcgatgccgaagaagacggtgggctaggccctaagaagttggtccctggcaagtacacagtggttgccgatcatgagaaaggagggcctgatgctctgcgggtgcggtccggggacgtggtcgaactagtgcaggagggcgatgagggcctctggtatgtgcgggacccaacaactggcaaggagggctgggtcccagcttcttccctttcggttcgcctgggaccaagcggctctgctcagtgtttgtcctcctcaggaaaagcacacgtgccgcgagcccacccttag

SEQ ID NO: 229765 - DNA, 2382 bp, Artificial Sequence
  Description of Artificial Sequence: Synthetic coding sequence
tagagtcagaaaattgcgactttcaccgatataggcaattcacttgctcatgtagaacacctgttacgggacttggcctcattcgaagaaaaatcaggggtggccgtagaaagagcccgtgccttgtctttggatggagaacagttaatcggaaacaagcattacgccgttgatagtataagacctaaatgtcaggagctgcgccatctctgcgaccaattctcagcggaaattgccaggcgcagaggcttactgtctaaaagccttgagctgcaccgaaggctagagacatctatgaaatggtgcgacgagggtatatacctacttgcctcacagccagtggacaagtgccaatcacaggatggcgcagaggccgctctgcaggagatagagaaattcttggagactggcgctgagaataagatccaggaactgaacgcaatctataaggagtacgaatctatcctaaaccaggacttgatggagcacgtcaggaaagtattccagaaacaggcttcaatggaggaagtgttccaccgcagacaggcctctttaaaaaagcttgccgcacgtcagaccagaccggttcagcctgttgccccaaggcccgaggcacttgccaagtcaccatgtccctcccccggaatacgccgtgggagcgaaaactcatcttctgagggaggggcactgagacggggtccctaccgaagagcaaaatcagaaatgagcgagagccgacagggcagggggtccgctggagaggaagaggaatcactggccattttgaggcgccacgttatgtctgagcttttggataccgaaagagcttatgtagaagagctgctttgcgtcctagagggttacgccgcagagatggacaatccccttatggcccatctcttgtcaactggactgcataataagaaggacgtgctgttcgggaatatggaggaaatctaccacttccacaacagaattttcctgagagaacttgaaaactacaccgattgccctgagcttgtgggacggtgcttcctggaacgcatggaggatttccagatttatgaaaagtattgtcaaaataaacccagatccgaatctctgtggcgccagtgttctgactgccctttttttcaggagtgccagcgaaaactggaccataaattaagcctggactcctatctgctcaagccagtgcaacggataactaagtatcaactgctgctgaaagaaatgctcaagtattcacgcaactgcgaaggagcagaagatctgcaggaagcactcagctctattctcgggattttgaaggctgtcaatgactcaatgcacctgatcgcaatcaccggttacgatgggaatcttggcgacctgggcaagctgcttatgcagggttccttttccgtgtggactgaccataaaaggggccacacaaaggtgaaggaattggcccgtttcaaaccaatgcaaaggcatttgtttctgcacgaaaaggcggtgctcttctgtaagaagcgggaagaaaacggtgaaggctacgaaaaggctccctcttattcgtataagcagagcctcaacatggcagcggtgggaattactgagaatgtcaagggagacgcgaagaagtttgaaatttggtacaacgcgagagaggaagtctacatcgtgcaggccccaacccctgaaattaaagctgcctgggtgaacgaaatcaggaaagtgctcacttcacagctacaggcctgtcgcgaagcctctcagcaccgagcgctggaacaatcacagagtcttcctcttcctgcccctacaagtacgtctccaagccgtggtaattctcgcaatatcaagaagttggaagaacgtaagactgatccacttagtctggaggggtacgttagttcagcccctttgacaaaaccacctgagaaaggaaaggccagtcctacgagccctgacaagaaggcaaagagacacgaggtaaaatcggaccctaccccatttggcgttcggggatggagcaaaacgtcgcactccctggaagccccagaggacgatggaggctggagcagcgccgaggagcagattaactccagcgacgccgaggaggatggagggttagggcctaaaaaattagtccccggtaaatataccgtggtcgccgatcacgaaaagggaggcccagacgccctgcgcgtccggagcggagatgtggtagagcttgttcaggagggcgacgagggtctctggtacgtcagagatcccacaacggggaaggaagggtgggtaccagcgagcagcctgtccgttcggctcggacctagcgggtctgcccagtgcctgagttcgtctggcaaagcgcacgtgcctcgcgcacacccttag

SEQ ID NO: 229766 - DNA, 3291 bp, Artificial Sequence
  Description of Artificial Sequence: Synthetic coding sequence
atgccgcttcggggtggagctggacccagtcccgcatcccatggtcccactcatggaccaagtgacccaaggacatgtctgccagggagaggagcaggcggtatgcggccacacgggaggggggctctgggatgctgcggcctgtgctctttttatacctgccatggcgctgcaggagatgagattatgcatcaggacatcgtgccactctgcgctgccgacattcaggaccaactaaagaagcgttttgcttatttgagtgggggtagggggcaggatggttctcccgtgattacattccctgactatccagccttctctgagattcctgataaagagtttcagaatgtcatgacataccttacgtcaatcccatctctccaggacgctgggatcgggtttatcctcgtgattgaccgcaggagagacaaatggaccagcgtgaaggccagtgtgctgcgaatagcagcaagcttcccggctaacttgcagcttgtgctggttcttaggcccactgggttctttcagcgtaccctttccgacattgcgtttaagttcaaccgcgatgattttaaaatgaaggtgcctgtgatcatgctgtcaagcgtgcctgatctgcacggctacatagataagtcacaactgactgaggatctgggcggtaccttggactactgccactctcgatggctgtgccagaggaccgccatagagtccttcgccctaatggtaaagcagaccgcccaaatgctgcaatcatttgggaccgagctggctgagacagaactccccaatgatgtgcagtctacgtcttccgtactctgcgcccataccgaaaagaaagacaaagcgaaagaagacctgcggctcgccctgaaggagggtcatagtgttctcgagtctctcagagagctacaggcagaaggttctgagccaagcgtcaaccaggaccaacttgacaatcaggctactgtgcaacggctcctggctcaactgaatgaaacagaagctgcattcgatgagttttgggccaaacaccagcaaaaactggagcagtgcttgcagcttcgacactttgaacaggggttcagagaggtgaaagccatattagacgctgctagtcagaaaatcgccacctttacagacatcggcaactcactggcccacgtcgaacacttactgcgagaccttgcgagtttcgaggagaagagcggggtggctgtagaacgggcaagagcactcagcctggacggcgagcagctcattgggaataaacattacgcggtagattcaatccgtcctaaatgccaggagctacgccacctgtgtgaccaattcagcgccgaaatagcaagacgaagaggtctgctctctaaatctctcgagcttcatcggaggttggagacatctatgaagtggtgtgacgaagggatctacctgctagcctcccaacccgtcgacaaatgccagtctcaggacggcgcagaagccgctttacaagagatcgagaaattcctcgaaactggagcggagaacaaaatccaggaactgaatgccatctataaggagtacgagagcatcctcaaccaggacctgatggagcacgtacgaaaggtgttccagaagcaagcctcgatggaggaggttttccacagaaggcaggcatctctcaagaagctggcagccagacagacaagaccagttcagccagtggcaccaaggccagaggcactggccaaatctccatgcccctctccagggatccggaggggatcagagaattcatcatctgaggggggagctctgcggcgaggcccttataggcgcgcaaagagcgaaatgtctgaatctcgacaggggagaggctctgccggtgaggaagaagaatcattagcgattctcagaaggcacgttatgtcggaactcctcgacactgagagagcatacgtcgaggagcttctgtgcgtgctagagggctacgctgccgaaatggataatccactgatggcccacctgctatctactggtttgcacaataaaaaagatgtgctctttggcaatatggaggagatctatcacttccacaatcgcatattcctgcgtgagctcgagaattatacagattgccccgagttggtgggacgctgcttcctcgagcgcatggaagactttcagatctatgagaagtattgtcagaataagcccaggagcgagtccctctggaggcagtgcagtgattgtcccttttttcaggaatgccagagaaaactcgatcacaagctctccctcgattcctatttactgaaaccagtgcagagaattaccaaataccaactgctattgaaggagatgcttaaatacagtaggaactgtgaaggggctgaagatctccaggaggccctgtcgtctattcttggtatattgaaggccgtcaatgatagcatgcacctgatagcaattacggggtatgacggaaatctgggcgacctgggcaaactcctcatgcagggatccttttcagtgtggaccgatcataagaggggccacactaaggttaaggaactggcgagatttaaaccaatgcaaaggcatcttttcttgcatgaaaaggccgtccttttttgcaagaaacgcgaagaaaacggggaggggtacgagaaagctccaagctacagctataaacagtcactgaacatggctgccgtgggaattaccgaaaatgtcaaaggagacgcaaagaaattcgagatctggtacaatgcccgtgaagaggtgtacatcgtgcaggcccctacacccgagataaaggctgcctgggttaacgaaatccgcaaagtgttgaccagccagctgcaggcctgtcgcgaagcaagtcagcaccgtgccctggagcagagtcagagcctgcctctgccagctccaacatccacctccccctcccggggaaactcaaggaacataaaaaagttggaggagcggaaaaccgatccacttagcctcgaaggctatgtcagctccgctcctctcaccaagcccccagagaaagggaagggttggagcaaaacatcacatagcctggaggcacctgaggatgacgggggatggtcgagcgccgaagagcagataaattcttctgatgctgaggaggatgggggactggggcctaaaaagctcgtcccgggtaaatacacagtagtggcagaccatgagaagggagggccagacgccctgcgggtcaggtcaggggatgtggtggagcttgtccaggaaggcgatgagggcctctggtag

SEQ ID NO: 229767 - DNA, 411 bp, Artificial Sequence
  Description of Artificial Sequence: Synthetic coding sequence
atgcaccaggacatcgtgcctttatgcgcagcagacattcaggatcagctgaaaaagcggtttgcttacctgagcggaggcagagggcaggacggatctccagttataacctttcctgactatcccgctttttccgagattcccgacaaggaatttcagaacgtgatgacatatctaacttcaatacctagcctgcaggatgcgggtatcggctttatcctggttattgacaggagacgagataaatggacaagtgttaaagcaagcgtgctgagaattgccgcttctttccctgccaatttacaactcgtgttggtgctgagacctaccggcttcttccagagaacattaagcgacatcgcctttaagttcaatcgagacgactttaaaatgaaagtacctgtgatctag

SEQ ID NO: 229768 - DNA, 3372 bp, Artificial Sequence
  Description of Artificial Sequence: Synthetic coding sequence
atgacagtccgcaggctgtctctcctgtgcagggacctgtgggccctctggctcctgttgaaagcgggagcagacgagataatgcatcaggacatcgtcccactgtgtgcagcggacatacaggaccagcttaagaagagatttgcctatctctcagggggtaggggccaggacgggagtccggtgatcacttttcccgactaccccgctttttcagagatccccgacaaagagtttcaaaacgttatgacttatctcacatccatccctagccttcaggacgctgggatcggcttcattctggttatcgacaggagaagggacaaatggacatccgtcaaggcttccgtccttcgaattgccgcatcctttccagcaaatttgcagctcgtcctggtcctcaggccaaccggctttttccagcggacactcagtgatatcgcctttaagttcaacagagacgattttaaaatgaaagtacccgtcataatgctctcctctgtccccgatttacatggatacattgataaaagtcaacttaccgaggatctgggtgggactctagattactgtcattcacggtggctgtgccaaaggactgccatcgaaagcttcgcattaatggtgaagcaaaccgcacagatgttacagtcttttggaacggagttggccgagacggagctacccaacgatgtccagtcaaccagctcagtgttgtgcgctcacacggagaagaaagacaaagccaaagaagaccttagattggctctgaaagaaggtcattctgtcctggagtccctcagagagctccaggccgagggaagcgaacccagcgttaatcaagatcagctggacaatcaggctactgtgcagagactgctggcccagctgaacgaaactgaagccgcttttgatgagttctgggccaaacaccagcaaaagctcgagcagtgtctccagctgagacattttgagcagggcttccgggaagtgaaggcgattttagatgcagctagtcagaaaattgctacgtttacagatatagggaactccctggctcatgtggaacatctcctgagagatctggctagtttcgaggagaagagcggggtagcagtggaacgggctagggccctttccctagacggcgaacagcttatcggaaacaaacactacgctgtcgactcgatacgacctaaatgtcaggagctcagacacctctgtgatcagtttagcgccgagatcgcaagaaggaggggtctcctgagcaaaagcctggaactgcacaggcgccttgagacgtcaatgaaatggtgcgacgaggggatttacctgctggcctcccagccagtggacaagtgccagtcgcaggacggcgctgaggcagcactccaagaaattgaaaagtttcttgagaccggggcagaaaataagatccaagaattgaacgcaatctacaaagagtacgaatccatcctgaatcaggacttgatggagcacgtacgcaaagtctttcagaaacaggcaagtatggaagaagttttccaccgcagacaggcttctcttaagaagctggccgctaggcaaacacggccagttcagcccgtggcgcctcgcccagaggctcttgccaaaagcccatgcccaagccccggaatccgacggggttccgaaaattcctccagcgaaggcggagccctcaggcgtggaccgtaccggagagctaagtccgaaatgagcgagtctcggcagggaaggggctctgcgggtgaagaggaagaaagcctggcaatcctgaggaggcacgtgatgagtgagctgctggacaccgagcgagcgtacgttgaagaactgttatgcgtgctggaggggtacgcagctgaaatggacaatcccttgatggctcacctcttaagcacaggcctgcacaataagaaggatgtgttatttggcaacatggaggagatttaccacttccacaaccggatcttccttagggagctcgaaaattacactgactgccctgaactggtcggaagatgttttttagagcgtatggaagacttccagatctacgagaagtactgccagaacaagccacgttcagagagtctgtggcgtcagtgcagcgattgtcctttctttcaggagtgccagcgaaaactggatcataagctatcgttggatagctatcttttgaagccggtccagcggataacaaaatatcagctgctcctcaaggaaatgctaaagtattcaagaaattgtgagggcgcagaagacttgcaggaagctctatctagcattctcggaatcctgaaagcagtgaatgactccatgcacctaatcgccattaccggttatgacggtaacctcggcgacctaggaaagctgctgatgcagggatcctttagtgtctggaccgaccacaaaaggggccataccaaggtgaaggagcttgccaggttcaaacctatgcagagacatctgttccttcacgaaaaagccgttctcttttgcaaaaagcgagaagagaatggggaggggtatgagaaagcgccaagctacagctacaaacagagcttgaatatggctgctgtgggtatcaccgaaaatgtcaagggcgacgccaagaagttcgagatttggtataatgccagggaggaagtgtacatcgttcaggcgccaacgccagagattaaggccgcatgggtgaacgagatcaggaaggtgctgacgagccagctgcaggcatgccgtgaggcctcacagcatagagcgctggagcagtcccaatccctccccctgcctgcgcctacctccacttcaccatcacgaggcaattcacgaaatatcaaaaaactggaagagcgcaaaactgatccactatcactggagggctatgtgagctccgcaccactgacgaagcctccagaaaagggcaagggctggtctaagacctctcattccctagaagctcccgaagacgacggcggttggagtagtgcagaggaacagattaatagctctgatgcagaggaagatggcggactgggcccaaaaaaacttgtgcccggaaaatacactgtggtcgctgaccatgagaagggcggaccagatgccctgcgcgtgaggtcaggtgacgtggttgagctcgtccaagaaggagacgagggcctgtggtacgtgcgggatccgaccaccgggaaagagggatgggtacccgcatcttctctgtcagtgagactgggtccatccggttcagcacaatgtctcagtagctcagaatcttcgccaggcagcgcggtgctaagtaatagctcctcttgctcagaggggggacaggcccctttttcagatttacagggatag

SEQ ID NO: 229769 - DNA, 741 bp, Artificial Sequence
  Description of Artificial Sequence: Synthetic coding sequence
atgcgtttctggctgcggactgaggagatggcactcgaggaaatggtgcagcgcctgaacgccgtgtccaaacacactgacgagatcatgcatcaggatatcgtccccttgtgtgcggctgacatccaggaccaactgaagaaaagatttgcctacctttcagggggacgtggccaggacgggtccccagttatcaccttccccgactatccagctttttccgagatccctgataaggagttccagaatgtgatgacatacctgacctcaattcccagtctgcaggatgcaggcattggcttcatcctggtgatagatcggcgaagagataaatggacttccgtaaaggcctccgtgctgaggattgcggcaagcttccccgcaaaccttcaattggtgctggttttacgcccaacaggcttctttcaacgcaccttatcagatattgctttcaagttcaaccgcgacgatttcaagatgaaagttcctgtgattatgttaagttcggttccggatctgcatggctacatcgataaatctcagctcacagaagatcttggagggacacttgattattgccactcaagatggctttgccagagaacagctattgagtcctttgctctaatggtgaagcagactgcgcaaatgctccaaagtttcgggaccgaattggctgagaccgagctcccgaatgatgtgcagtctacctcctcagtcttgtgtgctcatactgagtag

SEQ ID NO: 229770 - DNA, 3342 bp, Artificial Sequence
  Description of Artificial Sequence: Synthetic coding sequence
atgggagatggcaaggccgtaagaatatccgtcgctgagatgaaatcctattacctatactctgaatggtgttcgtggctcctgagcgtggctgaggacgaaatcatgcatcaggatatcgtacctctgtgcgccgctgacattcaggaccagctgaagaagcgcttcgcgtatctcagcggtggtcgcggacaggacggctcacccgtaattacattccccgattatcctgcgtttagcgagatccctgataaggagtttcagaatgtcatgacatacctgaccagcattccctccctacaggacgctggaattggtttcattctggtgatcgataggcgtcgagacaagtggacatcagtgaaagctagcgttcttcggatcgcggcaagcttccccgcaaatctgcagctggtcttggtcttacggcctactggcttcttccagcgcacgctgtctgatatcgcttttaaattcaatcgggacgacttcaagatgaaggtgccagtgattatgttgtcctcagtccccgatttacatggctacatagacaagagtcagctgacagaggatctgggcggaactttggactattgtcacagccggtggctttgccagagaacagcgatcgaatccttcgccctgatggtgaagcagactgcccagatgttgcagtccttcgggaccgagctggccgagacagagctgcccaacgatgttcagagcacctcctccgtcctgtgtgcccacaccgagaaaaaggataaggccaaggaagatttgcgcctggcactgaaagagggacatagcgtgcttgagtccctgagagagttacaggccgaggggagcgaaccatctgtgaatcaagaccaattggataaccaggccaccgtacagcgtctgctcgcacagctgaatgagacagaggcagcatttgatgaattctgggccaagcatcagcagaagttagagcaatgcctgcagctccgacacttcgaacagggatttagagaagtcaaggctattctcgatgctgcgtcacagaaaattgccactttcacagatataggaaactctctggcccatgtggaacatctgctgcgggatctggcctctttcgaagagaagagtggggtcgccgtggagagagcgagagccctgtcactcgacggagagcagctgattggcaataagcactatgcagtggactctattcggccaaagtgtcaagagctgaggcacctgtgtgaccaattctcagcagagatagcaaggcggagaggcctcctctcaaagagcctggagctgcacaggagacttgaaacttccatgaagtggtgtgacgagggcatctaccttctcgccagccagcctgttgacaagtgccagtctcaggacggtgctgaagctgccctccaagagattgagaagtttctggagacaggcgctgagaataagattcaggagctcaatgcgatatataaggagtacgaatctatcctaaaccaggacctgatggagcatgtcagaaaagttttccagaaacaagcctctatggaggaggtgttccatcggagacaggccagcttgaagaaactggccgcaagacaaacaaggcctgtgcaacctgtggcccctcggccagaggctctggctaaatccccctgcccgtcccctggcattcggcgaggatctgagaactccagctcggaaggtggtgcccttcggcgtggcccttatcggagggccaagagcgagatgagtgaatcccgacaaggtcgcggatcagctggagaggaggaagagtcccttgctattcttcgtcggcatgtcatgagcgagctcttggacaccgaaagagcctatgtggaggaactcctgtgcgttctcgagggctacgcagccgagatggataatcctctgatggcccatctattgtccactgggctccacaacaagaaggatgtgctctttggtaacatggaggagatttaccacttccacaatagaatatttctcagggagttagaaaactacactgactgtccagagttagtgggacggtgtttcctggaaagaatggaggatttccagatctacgaaaagtattgtcagaacaagccacgcagcgagagtctttggcgtcagtgtagtgactgtccattcttccaggaatgtcagcgtaagcttgatcacaagctgtcactcgactcttatctgctgaagcccgtccagagaattacaaaatatcaactcctcctgaaggagatgctaaagtatagtcgcaactgtgagggtgccgaagatttacaggaagcccttagctcaattctggggatcctaaaggccgtcaacgacagcatgcatttaattgctatcaccggatacgacgggaatctgggtgatttaggcaagctccttatgcaaggatctttcagcgtctggacggaccacaagcgcggtcacaccaaagtgaaagaactggctcgcttcaaacccatgcagcggcacctgttcctgcatgagaaggcggtcttattttgcaagaaacgggaagaaaacggggaagggtacgagaaggctcccagttacagctataagcagagcctaaacatggccgctgtgggtattacagaaaatgtgaagggagatgcaaagaagttcgagatatggtataatgctagggaagaggtgtacattgtccaggcccctactcctgagattaaagccgcatgggtgaatgaaattaggaaagtgcttacctcccaactgcaggcatgtagagaagccagtcagcatcgggctctggaacaatcccaatctttgccattgccggcacctactagtaccagcccctcccggggtaacagccggaatattaagaagcttgaggagcggaaaaccgatccactgagcctcgagggatacgtgagcagtgccccactgactaagccacctgagaagggcaagggatggagcaaaacttcacacagcctagaagcacctgaggatgacggaggctggtcatccgcagaagagcaaattaattccagcgatgccgaagaagatgggggactaggcccaaaaaagctggtgccaggcaagtatacagtcgtcgctgaccacgagaagggtgggcctgatgcactgagagtgcgtagcggggacgtggtagagctggtgcaggaaggagacgaggggctctggtacgtgcgggaccccaccaccggtaaagagggttgggtgcctgcgtcttcgttgagcgtgcggcttggaccatcaggaagtgcacaatgtctgagttcatcagggaaagcacacgtgcctagggcccacccctag

SEQ ID NO: 229771 - DNA, 2712 bp, Artificial Sequence
  Description of Artificial Sequence: Synthetic coding sequence
ttgaagatgcccgtgattatgctcagctccgtgcccgatctccacggctatattgacaaatcccagctgactgaggacctgggaggaactctcgactattgtcattccagatggttgtgccagaggacagctatcgaatctttcgccctcatggtaaaacagactgcccagatgctgcagtcctttggaaccgagctggctgagaccgaactgcctaatgatgttcagagcacttcaagcgtgttgtgcgcgcacaccgaaaagaaggacaaggccaaggaagaccttcgcctggctcttaaagaaggacactccgtgctcgagagtttgcgagagcttcaagcagaggggagcgagccatcagttaaccaggatcagctagataaccaggccacagtccagcgcctgcttgcgcagcttaatgaaactgaagccgctttcgatgagttttgggccaagcatcagcaaaagctcgagcaatgcttacaactgcgccatttcgagcagggcttccgcgaagtcaaggccatcttggacgcagcttctcaaaaaattgccacatttaccgatatagggaattctttggcccacgtggaacatctattgcgcgatctggcttctttcgaggagaagagcggcgtcgctgtagagcgggcacgcgctctgtccctagacggcgagcagctgattggaaacaaacattacgctgttgactcgatcaggccgaaatgccaagagctccgccacctctgcgatcagttctcggctgaaattgccagaagacggggactgttatccaagagcctcgagttacatcgaagattggagacatccatgaagtggtgtgacgagggaatctatctgctggcttctcaacccgtggacaaatgtcagtctcaggatggagccgaggcagcattgcaggagatagaaaagtttttggaaacaggagctgaaaataagatccaggaactgaacgcaatctataaggagtatgagagtatcttaaaccaagacctcatggaacatgtgcgtaaggtgttccagaagcaggcatcgatggaagaggtgttccaccggaggcaggctagcttgaagaaactggccgctaggcaaacaagacctgttcagcctgtggcaccacggcctgaagcactggccaagtccccatgcccatctccaggaatccgcagaggaagtgagaacagctcatccgaaggtggcgcactccgcagaggtccatataggcgggctaaatcagagatgagtgaaagtagacaaggccgaggctctgctggggaagaagaagagtcgctagcaatccttagaaggcacgtaatgagtgagctgctggataccgaaagagcttacgtcgaggagcttctatgcgtgctagaaggatatgcagcagagatggataaccctctcatggcccatttgttgagcacagggctgcacaataagaaggacgttttatttgggaacatggaagagatctaccactttcataaccgaatattcctgcgggagctagaaaattatactgattgcccagagctggtgggcagatgcttcctggaacggatggaggattttcagatctacgagaaatactgtcagaataagcctaggagtgagtccctctggaggcagtgcagtgactgcccattcttccaggaatgccaacgtaagctcgaccacaaactttccctagattcttacctgttgaaaccggtccagcgtatcacaaaataccagctgttactaaaggagatgcttaagtatagtcgaaattgcgagggagccgaggatcttcaggaggctctgagttcaattctcggtatcctcaaagccgtcaacgacagtatgcacctcattgcaattacaggctacgacggtaatttgggagatctgggtaaactccttatgcaggggagctttagcgtatggactgatcacaaaagaggacatacgaaggtgaaagagttagctcgattcaaaccaatgcagaggcacctgttcctccacgaaaaagcagttcttttttgtaagaagcgggaggagaacggcgagggatacgagaaggctccttcatattcatataagcagtccctaaacatggcggcagtcggcatcaccgagaatgttaagggcgatgccaagaagttcgagatttggtacaatgctcgggaagaagtgtacatcgtccaagccccaacccccgagataaaggctgcatgggtcaacgaaattcgcaaggtgctgacttcccaactccaggcatgtcgtgaagcctcacagcacagggccttagagcaatcccaaagtctgcccctgcctgctccaacttcgaccagcccatcccggggaaacagccgcaacattaagaaactggaggaaagaaaaacagatccgctgagtctggagggttacgtcagctcagccccactcacgaaaccaccagaaaagggtaaaggctggtctaagaccagccacagtctagaagctcctgaggacgatggtggctggtcctccgctgaagagcaaatcaactcatccgatgctgaagaagacggcggtttagggccaaaaaaacttgtacccggaaagtacactgtcgtggctgaccatgaaaagggtgggccagatgccctgcgtgtgcggtctggcgacgtggtcgagctggtccaggagggcgacgagggcctttag

SEQ ID NO: 229772 - DNA, 3414 bp, Artificial Sequence
  Description of Artificial Sequence: Synthetic coding sequence
atgttcgattgctggagatttatactctgcaagcgaccaggcagtaactcctatagctcccctcagcgcccaaacgaggcgaaaaaagaagagacggaccatcagatcgatgtaagcgacgtcattcgcctggtgcaggacacccctgaggccacagccatggctacggacgagataatgcaccaggatatcgtgcccctgtgcgctgcagatatccaggatcagctgaagaaacgcttcgcttatttatctggcggacgaggtcaggacggcagccccgtcatcacatttcccgattaccccgctttttcagaaatacctgataaggagttccagaatgtgatgacttaccttacttcaatcccttctctgcaagacgcgggaatcgggttcatcctggtaattgataggagacgtgataagtggacatcggtcaaagcatccgtcttgaggatcgctgcaagctttcctgctaatctccagttggtcttagtgcttagacctacagggttttttcagagaaccctgagtgatattgcattcaagtttaatagagacgatttcaagatgaaagtgcccgttattatgctgtcctctgtgcccgacttgcacgggtatatcgataaatcccagttgacagaggacttgggcggaaccctagattattgccattctcgatggctgtgtcaaaggaccgccatcgagagctttgcattgatggttaagcaaaccgctcaaatgcttcagagcttcggtactgaactcgccgagaccgaacttccaaacgatgtgcagtccacttcttctgttttatgtgcacacacagagaaaaaggacaaggcaaaagaggacctgagactcgccctgaaggaggggcattcggtcttagaatcgctgagagaattacaggcagaaggctccgaaccctccgttaaccaggaccagctggacaatcaggcaacagttcagcggctccttgctcagctcaacgagactgaggctgccttcgatgaattttgggccaagcatcagcagaagctggagcaatgtcttcagctgcgacactttgagcagggtttccgagaggtaaaagcgattctggacgcagcctcccagaagatcgccactttcactgacattgggaattccttggcacacgtcgagcacttgttaagagatctagcatcctttgaagaaaaatccggagtggctgtggaacgcgctcgcgctctgagcttggatggtgaacagctgattgggaataaacactacgccgttgactccattcgacccaagtgccaggaactgcgacacctctgcgatcaattcagtgcagagatcgcacgaaggcggggtctcctgagcaaatcactcgagctgcaccgcagactggagactagcatgaaatggtgtgacgaagggatctacctgttggcctcccagcccgtggacaagtgtcagtcacaggacggtgccgaagccgctttacaggagatcgaaaagtttctggaaacgggcgcagagaataagatccaggagctcaacgctatttataaagagtatgaaagcatcctgaatcaggacctcatggaacacgtcagaaaggtgttccagaaacaggcttcaatggaagaagtgtttcaccgtcgacaagcgagcctgaagaaactggccgcaaggcagacccgcccagtccagcccgtcgctcctcggccagaagcactggcaaaaagcccctgtccctctcccggaataaggcgcggaagtgagaactcctcctccgagggaggggcactgcggcgaggaccgtacaggcgggcaaagagcgagatgtctgagtctcggcaggggcgtgggtcagccggtgaagaagaggaaagtctggcaattctcaggcgccacgtcatgagcgaactgttggacacagagcgggcttatgtcgaggagcttctgtgcgttttggaaggctatgccgctgaaatggacaatccactgatggcccatttgctgagtaccgggctgcacaataaaaaggatgttctgttcggcaacatggaggagatttatcacttccataataggatctttctgcgcgaactggagaactacactgattgccctgaactggttggcaggtgttttctagagcggatggaagacttccagatctacgagaagtactgtcaaaacaagcctaggagcgagagtctttggcggcaatgttctgattgtccattcttccaagaatgtcagaggaagctcgatcataagctgagtttggatagttatctactgaaacccgtgcagcgtatcacgaagtaccagctcctgcttaaggaaatgttgaaatattcccgcaactgtgagggagctgaagacctgcaggaagcactgtccagcatactgggcatcctgaaggcagtgaacgatagcatgcatctcatcgccattacaggatatgatggaaatctgggggaccttggcaagttgctcatgcaaggttctttttctgtgtggacagatcacaagcgaggacacactaaagtaaaagaattggcccgatttaagcccatgcagaggcacctctttctgcacgagaaagctgtgttgttttgcaagaaaagagaggagaacggtgaggggtatgaaaaagcacctagttactcatacaaacagagcttgaacatggccgctgttggaattactgaaaatgtgaagggcgatgcaaaaaaatttgagatatggtataatgctcgggaggaagtgtacatcgtgcaggcccctacacccgagataaaagcagcatgggtcaatgagatcaggaaggtcctgacatcccagctgcaggcgtgccgggaggccagtcagcaccgagcgttggaacaatcccagtcactgccattgccggctccaactagcacttccccatctcgcggtaactccagaaatatcaagaaacttgaggagcggaaaacagatcccctttccctagagggttacgttagcagtgcccctttaacgaagccacctgaaaagggtaaggggtggagcaaaacaagccatagtctggaggctccagaggacgatggcggatggtctagcgccgaggagcagatcaattcttcggacgccgaggaggatgggggactgggccctaagaagcttgtcccaggtaagtacacagtagtcgccgatcacgagaaagggggaccagacgccctccgggttaggtcaggagatgtggtggagcttgttcaggagggggacgagggcctgtggtacgtgcgcgacccaacgacagggaaggaaggatgggttccagctagcagtctctcagtccgcctgggaccatcaggatccgctcagtgtctgtcatcatccggaaaggcacacgttcccagggctcacccctag

SEQ ID NO: 229773 - DNA, 3378 bp, Artificial Sequence
  Description of Artificial Sequence: Synthetic coding sequence
atgcgcttttggcttcgcaccgaagaaatggccctcgaggaaatggtgcagagactgaacgcagtgagcaagcacacagatgagattatgcatcaggacatcgtgcctttgtgcgctgctgacatccaggaccagctaaaaaaacggtttgcatacttgagcggaggtagaggccaggacggctcacctgtgattacatttcctgactaccccgcatttagcgaaattcccgacaaggagttccagaacgtgatgacgtatctgacatcaatcccaagcctacaggacgcgggaataggattcatcttggtcatcgaccgccgtcgcgacaagtggacaagtgtgaaagcctctgttctgcgcatagcggcaagctttccagccaatttgcagctggtattagtgctgcgcccaaccgggttttttcagcgtaccctctcagatattgcctttaagtttaacagggacgatttcaagatgaaggtgccagtcatcatgttatcttccgtgccagatcttcacggctacatagataaatcccagctgaccgaggacttgggaggaaccctagattattgtcattcccgatggctctgccagaggacagccattgaatcctttgcattgatggttaaacagacagctcagatgctgcaaagcttcggaacagagctggccgagacagaactcccaaatgacgtccagagcaccagctctgtgctttgtgcccacacagaaaagaaagataaagctaaagaggaccttagacttgcgttgaaagaggggcattctgtgttggagagcctgagggagctgcaagcagaaggatccgaaccatccgtgaaccaggatcaactggataaccaagcgactgtgcaacgcttactagctcaattgaatgaaacagaggccgcattcgatgagttttgggccaagcatcagcaaaaattggagcagtgcttgcagttgcgtcactttgagcagggcttcagagaggtgaaagctatcctcgatgccgcttcccaaaaaattgccacattcaccgacattggaaatagcctggctcacgtggagcacttgctgagggatctggccagctttgaggagaagagcggagtggcagttgagcgcgctagggccctgtccttagacggagaacagctgattggcaacaagcattacgccgtggacagtattcgcccaaagtgtcaggaattacggcacttatgtgaccagttctccgccgagatcgcacgcaggcggggattgctgagcaagtctttggagctccatcgcagactggagacatccatgaagtggtgcgatgaaggtatttaccttctggcaagccagcctgttgataaatgccaatctcaggatggggctgaggccgcactgcaggagatcgagaaattcctggaaaccggggcagagaataagatccaggagctcaacgcaatctataaagaatacgaaagcatattgaaccaggaccttatggagcacgtgagaaaggtgttccaaaagcaggctagcatggaggaggtatttcataggaggcaggcaagcttaaaaaagttggccgcaagacagacacggcctgttcagccggtcgcacctaggcccgaggccctcgcaaagtccccatgtccatccccagggataaggcgtgggagtgaaaatagtagcagtgagggcggtgcgctccgaagaggcccttacaggagagccaagagtgagatgagtgaaagtcggcagggaagaggcagcgccggagaagaggaggaatcattggctattctgcgtcggcacgttatgtcagagctgctggataccgagcgagcatacgtcgaagagctcctatgcgtactggagggttacgctgcagaaatggacaatccactaatggcacatcttttgagtacgggtctgcataataaaaaggatgttctttttggcaatatggaggagatttaccattttcataacagaatttttcttcgggagcttgagaactacacagattgtcccgagctagtgggtcgctgtttcctggagcggatggaggacttccaaatttatgaaaaatactgccagaacaaaccacgttccgagtccctttggagacagtgcagtgattgcccatttttccaggaatgtcaaaggaagcttgaccacaagctgtctctggactcttacctcctgaaaccagtgcagaggatcaccaagtaccagttgctgctcaaggagatgctgaaatacagcagaaactgtgaaggcgctgaagacctgcaggaggcactgtcatccattttgggaattcttaaggccgtcaatgattctatgcacctgatcgccatcaccggctacgatggcaaccttggggacctaggcaaactgttgatgcaagggagcttttccgtgtggaccgatcacaagcgaggccacaccaaagtaaaggaattggccagatttaaacctatgcaacgtcatctcttcctgcatgagaaggctgttctgttctgcaaaaaaagagaggagaacggggaggggtacgaaaaggccccatcctacagttacaagcaatcccttaatatggctgccgtgggtataacagaaaatgtgaaaggtgacgcgaagaagtttgaaatttggtacaacgctcgggaagaggtttatattgtgcaagctcctactccggagatcaaagccgcttgggtgaacgagattcgaaaggtcctgacctcacagctgcaggcttgcagagaggcttcacagcatagagcacttgaacagtctcagtccctccctctccccgctcccacgtctacttccccatcacgagggaattccaggaatatcaagaaattggaggaacgtaagactgaccctctctccctggaaggctacgtgtccagcgctcctctgactaaaccgccagagaaggggaaagggtggtccaaaacttcgcatagtcttgaagcccctgaggatgatgggggatggtcctccgcagaagagcaaatcaacagttctgatgccgaggaggacggtgggctaggtcctaagaagctcgtgccaggtaagtatactgtggttgccgatcatgaaaaggggggacctgatgccctgagggtccgttcgggggacgtagtggagcttgttcaggaaggcgacgaagggctgtggtacgtgagggacccaacaacagggaaagaaggctgggtgcccgcaagcagcctgtcagttcgactgggcccatccggcagtgctcagtgtcttagttcgtcagagtctagccccggaagcgccgtactgagcaactctagctcatgttccgaagggggacaggcacccttctccgatctgcagggctag

SEQ ID NO: 229774 - DNA, 1713 bp, Artificial Sequence
  Description of Artificial Sequence: Synthetic coding sequence
atgagccgattggaagctaagaagccaagtctctgtaaaagcgagccactgacaacagagcgggttcgcaccactctgagcgttctaaaacgcatcgttacctcatgctacgggccatctggacgattgaaacagctgcacaatggcttcgggggatacgtgtgcactacctctcagagttctgccttgctcagtcacctgctcgtgacccatcctattttgaaaatcctgacagcctccatccagaatcatgtgtctagcttttctgactgcgggctgtttacagccattctttgctgtaacctgatcgagaatgtgcagagattgggtttgacgcctactaccgtgattcggctgaacaaacatctgttaagcctctgcattagttacctaaagagtgagacttgtgggtgtcgtatccctgtggatttttctagtacgcagatcctgctgtgcctagttcggagcatcttgacgtcgaaacccgcatgcatgttgaccagaaaggagacggaacacgtctctgccctcatactgagggcgttccttctcacaataccagagaatgcggagggccatatcatcctcggaaagtcactgatagttcctctgaagggacagagggtaatcgacagtaccgttttgcccggaattctcatcgagatgtccgaggttcagctcatgaggctcctacccatcaagaagtccaccgccctaaaggtggcccttttttgcactacccttagcggggacacatccgacactggagaagggacagttgttgtctcgtacggcgtctccctggagaacgcagttctggatcagcttcttaatctgggaagacagctgatctccgaccacgtcgatctggtcctctgtcagaaggtaatacatccctcactaaagcagtttttgaacatgcataggattatagccatagatcgcatcggggtgaccctgatggagcccctgaccaagatgacaggcactcagccaattggatcattgggttcgatttgtcccaattcctacggcagtgttaaggacgtgtgcaccgccaagttcgggtcgaagcattttttccaccttatcccaaacgaagctaccatctgcagtctacttctgtgcaaccgaaacgatacggcatgggatgaactaaagctgacatgtcagacggccctgcacgtcttgcaactgactttgaaggaaccgtgggccctgctgggcggagggtgcaccgaaacgcaccttgctgcgtatatcagacacaaaacacacaacgaccccgaatctattcttaaggacgacgagtgcactcaaaccgaactccagctgatcgccgaggcattttgtagtgcactcgaaagcgtggtcggcagtctggagcacgacggtggggagattctcacggacatgaagtatgggcacctctggtctgtgcaggctgattctccttgtgtcgctaactggcccgatttgctttctcagtgtggctgcggattgtacaactcacaagaagaactgaactggagcttcctgcgctccacacgcagaccatttgtgcctcaatcatgtctgccccatgaagctgttggctctgctagcaatctgacacttgactgcctgaccgccaaattgagtggcctgcaagtcgctgtggagacggccaatctgatcttggacctgtcttacgtgattgaggataaaaactag

SEQ ID NO: 229775 - DNA, 1713 bp, Artificial Sequence
  Description of Artificial Sequence: Synthetic coding sequence
atgagtcgtttggaagcgaaaaaaccaagcctgtgcaaaagcgagcctcttaccaccgaacgagtgagaacaacactgagcgtcctcaagcgcatcgtcacatcttgctatggcccatccggccgtttaaagcaactgcataatgggtttggtgggtacgtctgtactacgtcccagagttccgccctgctgagccacctgctggtcacacatcctattttgaaaattctgactgcctcaatccagaaccatgtgtcatccttcagcgattgtgggctctttacggcaattctttgttgtaacctgattgagaacgtccaacggctcggcctgacaccaaccaccgtgatccggcttaataagcaccttctgtccctgtgtatttcttatttgaaatccgagacctgtgggtgcagaataccagtggatttttcttccacccagatcctcctgtgcttagtccgaagtatactgacttctaaaccagcttgcatgctcacgaggaaagagaccgagcatgtctctgccctgattctcagagccttccttctgacaattcccgaaaatgccgaagggcatattattctcggcaaatcactgatcgtgccgctcaaaggacagagagttattgacagcactgtgctgccgggaatcttaattgagatgagcgaggttcaactgatgcgactgctacccattaaaaaatcaaccgcgctgaaggtggccctgttttgcacgaccctttccggtgatacttctgataccggcgaggggactgtcgtggtttcttatggggtgtccctggaaaatgctgtgctcgaccagttactcaatttaggtcgacaactcataagcgaccacgtggatcttgtactctgtcagaaagtgattcaccccagtctcaaacagttcctcaatatgcatcggattatcgcgattgatcgtattggcgtcaccctgatggaacctctcacaaagatgaccgggacccagccaatcggaagtctgggatcgatttgtccaaatagttacgggtctgttaaagacgtgtgtacagcaaagttcggttcaaaacacttcttccatctgatccccaatgaggcaacaatatgttcgctacttctgtgtaacaggaacgacacagcctgggatgaattgaagctgacctgtcaaacagctctgcacgtcttacagctaaccctgaaggagccctgggctctcctgggaggtgggtgcactgagacgcaccttgctgcttatatccgacacaagacccacaacgaccctgaatcaattctcaaagacgatgaatgtacccagaccgagcttcagctcattgcggaggctttctgtagcgccttagaatcagtcgtggggtcgcttgagcacgacggaggagaaatcctgacagacatgaaatacgggcatctgtggtccgttcaggccgactcaccatgtgtcgcgaattggcccgaccttctgtctcagtgcggatgtgggctttacaacagccaggaagagcttaattggagtttcctccgatcgacccggcgaccctttgtccctcaatcctgcctgccacacgaggcagtcggatccgcctctaatcttactcttgactgtcttaccgcaaagctgagcggactacaagtcgccgtagagacagctaacctgatcctggacttatcatacgtgatcgaggataaaaactag

SEQ ID NO: 229776 - DNA, 2145 bp, Artificial Sequence
  Description of Artificial Sequence: Synthetic coding sequence
atgcctgtgagattcaaaggcctgtcagaataccaacgaaatttcctttggaaaaagagctacctttcagagtcctgtaattcaagcgtgggcagaaaatacccatgggccggacttagatcggatcaactgggcatcacaaaggagccttctttcatttcaaaaagacgggtaccctaccatgaccctcaaattagcaagagtctcgagtggaatggtgccatcagcgagagcaacgtcgtggccagcccagaacccgaggcccctgagactcctaagtctcaggaggctgagcagaaagatgttacccaggagagagtacactctctggaggcctccagggtccccaagaggactcgcagtcactcagccgacagtcgggcagaaggcgcttctgacgtggagaacaacgagggcgttacaaaccacaccccagttaatgagaatgtcgaacttgaacattccacgaaggtcctgtctgagaacgtcgacaacggcctggatcggcttctccgcaagaaagcaggactcacagtggtgccaagttataacgcactgcggaatagcgaataccagcgccagtttgtctggaaaacgtctaaagagactgcaccagcctttgcggctaatcaggtgttccataataagagccagttcgttccaccttttaagggcaacagcgtgatacacgaaacagagtataaacggaatttcaaaggactgtcaccagtcaaagagccaaagctgcggaacgacctgagggaaaacagaaatctggaaaccgtgtcccctgaacggaagtctaacaagatcgacgacagacttaagctcgaggcagagatggagttgaaggatctccatcagcccaagcgaaaactcacgccttggaagcatcaacgtctgggaaaggtgaacagcgaatatcgagcaaagtttttatctcccgcacaatacctgtacaaagctggcgcttggactcatgtcaagggtaacatgcccaaccaagtcaaagagttgagagaaaaggcggagttctatagaaagcgcgttcagggcacgcacttctcccgagaccacctgaatcagatacttagtgactcaaactgctgctgggatgtttcctccacaacgagctccgaaggcaccgtgagtagcaacataagagcgctggacctcgccggagacccaacctcccataagacgctgcagaaatgtcccagcaccgagccggaagaaaagggaaacatagtagaggaacagccccagaagaataccacagagaagcttggagtgtccgccccaactattccagtgaggcgtcgcctggcttgggatactgagaacactagcgaggacgtacagaagcagcctggtgaaaaagaggaagaggacgacaacgaggaagaaggtgataggaaaaccggcaaacaggcattcatgggggagcaggaaaagcttgatgtgagggagaaatctaaggccgacaaaatgaaagaaggtagtgactctagtgtcagtagcgaaaagggcggtcgactgcccacaccaaaactgagagagcttggtggaatccagcggacccatcacgatctcacaaccccagccgtgggaggtgctgtcctggttagtcccagtaagatgaaacctccagctccggagcagcgtaagcgtatgactagtcaagactgtctggagacctccaagaatgacttcaccaaaaaggagtctcgagcggtcagcctgttaacttctcccgctgccggaataaagacagtggatcctcttccgcttagagaggattccgaggacaacatacacaagtttgctgaagccactctgcctgtgagcaagattccaaaatacccgacaaaccctccaggccaactcccgtccccaccgcacgtgccatcctactggcatccgtctcggagaattcaggggtctctgcgggaccccgaatttcagcacaacgtggggaaggctaggatgaataacctacaactaccccagcacgaggcttttaacgacgaagacgaagacaggttgtccgaaatcagcgcccgtagtgccgcttccagcttgcgtgctttccagacactcgcaagagcaaaaaaaagaaaggaaaacttttggggtaaaacatag

SEQ ID NO: 229777 - DNA, 210 bp, Artificial Sequence
  Description of Artificial Sequence: Synthetic coding sequence
atgcccgttaggttcaaaggcctttcggagtaccagagaaacttcctgtggaaaaaatcctacctgtccgaatcttgtaatagcagcgtggggagaaagtatccatgggcaggtttgagaagcgatcagctaggcaatcaaggaagatgcagaacgaagatacaacactctgatatcagctctctgctgattctggtctgcagtacttag

SEQ ID NO: 229778 - DNA, 669 bp, Artificial Sequence
  Description of Artificial Sequence: Synthetic coding sequence
atgcccgtgcggtttaaaggcctgtcagagtatcagcggaacttcttatggaaaaagtcgtatctgtcagaatcttgcaacagtagtgtcgggagaaaatacccttgggctgggcttcgctctgatcagctcggcatcacgaaggaaccttcatttatctcaaaaaggcgcgtgccatatcatgacccccaaatttcgaaatcgttggaatggaatggagccatcagcgagtctaacgtagtggcatcccctgagcccgaggctcccgagactccaaaaagccaggaggctgagcaaaaggatgtgactcaagaaagagttcattccctcgaagcctctagagtgccgaagcgcacccggagccatagtgcagactccagagccgaaggtgcatccgatgtcgagaacaacgaaggcgtgaccaaccatacgcccgtgaatgagaacgtggaactcgagcactcaacaaaagtcttaagtgaaaacgtggataacggcgtggggattttcactgccttcctttttaagtctattgagttcttcattggattcatcgtcatctcggtaattctgcactttgtcttccagaacttccccttactcttttcttgccttatgtctattagaatagttgataaccgattgcttaccctcgtcattgtcaattag

SEQ ID NO: 229779 - DNA, 2040 bp, Artificial Sequence
  Description of Artificial Sequence: Synthetic coding sequence
atgcctgtgagattcaaaggtctctctgagtaccaaaggaacttcctgtggaaaaaatcatatctttcggaaagctgtaattcatccgttggtcgaaagtatccctgggccggtttgagatccgaccaattaggcattaccaaggaacccagcttcataagtaagcggcgagtaccttatcacgatccgcagatatctaaatccctcgagtggaatggggcaatcagtgagagcaacgtagtggcaagccctgaacctgaggcccctgaaacccctaaatcacaggaggctgagcaaaaggatgtaacccaggagagagttcattcattagaagctagcagagtccctaagaggactcgcagccactctgcagatagcagagcagaaggagctagtgacgtcgagaataacgaaggcgtcactaaccatactcccgtcaacgagaacgtcgaactggagcacagtacaaaggtgctgtctgagaatgttgataacggagtatttcacaataaaagtcagtttgtgccacctttcaaaggcaattctgtgatacacgagacagaatacaaaaggaactttaaaggcctgtctcctgttaaagaaccgaaactccggaatgacttgcgggaaaataggaatctggagacagtgagccccgaaagaaaatccaacaagatcgacgacaggttgaaacttgaggcggagatggaactaaaggatctgcatcagccgaagagaaagctaacaccatggaagcatcagaggctgggaaaagtgaattctgaatatcgtgctaaattccttagcccagctcagtatctctataaggccggagcttggacacacgttaaaggcaacatgccgaatcagggctccctcaacgctatgtggtacgccgaggttaaagaattgcgggagaaggccgagttttatcgcaagcgggtgcaaggaacacacttcagccgcgaccacctcaaccagatcctaagcgactccaattgctgctgggacgttagctctactacctcctcagaagggaccgttagcagcaatattagggccctggatcttgctggggatccgacctcccataagactctgcagaagtgtccaagcacggagcccgaggaaaaggggaacatagtggaggagcagccccagaagaataccactgagaaactgggcgtgagcgctccaactatacctgtcagacgtcggttggcttgggatacagaaaacacaagcgaggatgtgcagaagcagccaggagaaaaggaggaggaggatgacaatgaggaggaaggcgacaggaaaacgggcaaacaggccttcatgggagagcaggagaaactggatgtccgggaaaagagtaaagcagacaaaatgaaggaaggcagcgacagctctgtgtcatccgaaaaggggggaaggctgcctactcctaagctgcgtgagttgggtggcatacaacgaacccatcatgaccttaccacaccagccgtggggggtgccgtgctggtgtcaccaagtaagatgaagcctccggcacccgagcagcgcaagagaatgaccagccaggattgtcttgagacttccaagaatgactttacgaaaaaagaatcccgcgctgtatctttgctgacctctcccgctgccggaatcaagacagtggatccattaccactgcgcgaggacagtgaggacaatatccacaaatttgcggaggccactctgcccgtgagtaaaattcctaaatacccgacaaaccctccgggacagctgccctcacctccccacgtgcctagttactggcacccttcccgaaggatacaggggtccctcagagaccccgagtttcaacacaacgtgggaaaggcaagaatgaataatctgcagctaccacaacacgaggcatttaacgacgaggatgaggataggttgtctgagatttctgcaagaagtgcagcgtctagtctccgtgcttttcagactctggcgagagcaaaaaagaggaaggaaaacttttgggggaaaacatag

SEQ ID NO: 229780 - DNA, 2715 bp, Artificial Sequence
  Description of Artificial Sequence: Synthetic coding sequence
atggacaggtacctgcttttagtgatttggggggaaggcaaattcccctctgccgcatccagggaagccgagcacggccctgaagtaagcagcggagagggtacagagaaccagccagactttacagccgctaacgtgtaccacctgctaaaaagaagcatcagcgcttctattaatcccgaagatagcacattccccgcatgtagtgtgggaggtattccagggtccaagaaatggttttttgccgtgcaagcaatctacggcttctaccagttctgctcctccgattggcaggagatccatttcgatacagagaaagacaagatcgaggacgttctacagacgaatattgaggaatgcctcggcgctgtggagtgctttgaagaggaggacagtaactcccgtgaatcactgtctctcgccgatctctacgaggaagcagctgagaacctgcaccagctctccgacaagctgcctgcgccaggacgggctatggtggatattattctcttgctgtccgataaggaccctccaaagctgaaggactacctcccaacagtgggagccctcaaacacttgcgagagtggtatagtgccaagataacaatcgccggaaatcactgcgagatcaattgccaaaagatagctgaatacttatctgccaatgttgtgtcgctggaggacctgcggaatgtcatcgattctaaagaactgtggcgcggtaaaatccagatatgggagcggaaattcggtttcgaaatttcattccccgagttctgtcttaaaggagtgaccctgaagaacttttccacatcgaacctgaataccgattttctggctaagaagattattccctccaaggacaagaacattctccctaaggtttttcactattatggccctgcgctggagtttgttcagatgattaaactgtctgacctccccagctgctatatgtcagacatagagttcgagctgggcctgactaacagcaccaagcagaactctgtgctcctgctggagcagataagctccctgtgcagtaaagttggagctctgtttgtgctcccctgcacaatttcaaacattttgattccccctcccaaccagctctcatctaggaagtggaaggaatacattgcgaagaagcctaagacaatcagcgttccagacgtggaagtaaagggagaatgttcctcatactacttattgctgcagggcaatggcaaccgacgctgcaaggctacacttatacacagtgccaaccagatcaacggttcttttgccttgaacctgatccacggcaaaatgaagaccaagacagaggaggccaaactgtcatttccctttgatttgctgagtctcccacattttagcggtgaacagatcgttcagagagagaaacagcttgctaacgtccaggtgctcgctctcgaggagtgcctaaagcggagaaaattggctaagcagcccgagaccgtcagcgtagccgagttgaagtctctgctcgttctcacccgaaaacactttctcgactacttcgatgctgttattcccaaaatgatcttgcgcaagatggacaagatcaaaaccttcaatattctgaacgatttcagtcccgtggagccgaactctagtagtttgatggaaactaatccgttagagtggccagagcgccatgtcctgcaaaacttagagacttttgaaaaaaccaagcagaaaatgaggactgggagcctgccgcattcatctgaacagctgctgggccacaaggagggccctcgggattccattacactgcttgacgctaaggaacttttgaagtacttcacctccgatggtctgccaatcggagatctacagcctctgcctatccagaaaggagagaaaactttcgttctgacccctgaattgagtccagggaaactgcaggtgctgccatttgagaaagccagtgtttgccattaccacggcatcgagtactgcttggatgaccgcaaggcactggaacgggatggtgggttttctgagctgcaaagcagactgatcaggtacgaaacccaaacgacctgcactagggagagctttccagtgcccaccgtcttgagtccactcccgtctcctgtggtctccagtgatccgggttccgtgccagacggtgaggtgctccagaacgagctgagaaccgaagtgagccgtttaaagcggaggtccaaggacctcaattgcctttacccaagaaagagactggtaaaatccgagtctagcgaatcactcctgagccagaccacaggtaattcaaatcactaccatcaccacgtgacaagtcgcaaaccgcagactgaaaggtccctccccgtcacctgccctcttgtgcctattcctagttgcgagactcctaagttagcaaccaaaacgtcctctggacagaagtctatgcacgagagcaaaacatctcggcagatcaaggagagccggtcccagaaacatacacgcattttgaaggaggtcgtgaccgagacgcttaaaaagcactccatcacagagactcacgaatgtttcacggcctgcagtcagcgactgtttgagatcagcaagttctatctcaaagacctgaaaacttcccgcggtttgtttgaagagatgaaaaagaccgcaaataataacgctgttcaagtgatagattgggtgttggagaagacttctaagaagtag

SEQ ID NO: 229781 - DNA, 1374 bp, Artificial Sequence
  Description of Artificial Sequence: Synthetic coding sequence
taaatggctgagacagtttggagtacagatactggagaggcagtgtacaggagtagggaccccgtgcggaacctgaggcttcgcgtacatctgcaacgaataacttcctctaattttctgcactatcagccagcagctgagttaggaaaagatcttattgatctcgctacatttcgaccacagcctactgcctccggccatcgccctgaggaggatgaggaggaagagattgtcattggctggcaggaaaagttgttctcccagttcgaagtggatctctaccagaacgagactgcatgtcagtcacctttggattatcagtatcggcaggagatactaaagctggagaactctgggggaaagaaaaacaggagaatattcacctacactgattccgacaggtataccaatctcgaagagcactgccagaggatgacgacagccgcatctgaagtgccttcctttttagtcgagaggatggcaaacgtgcgccgtcgcaggcaagacagaagaggtatggaggggggtattctaaagagtagaattgtgacctgggaaccatccgaagagttcgtgagaaataaccacgtgataaacacccccctgcagacaatgcatatcatggcggatctgggaccatataaaaagctcggatacaagaaatacgaacacgtcttatgcactctgaaggttgacagcaatggagtgatcactgttaaacccgatttcaccggcctgaagggaccatatcgcatcgaaactgagggcgaaaagcaggagctctggaagtatactattgacaatgtttctccgcacgctcagccagaagaggaggagcgggagagacgggtgtttaaagatctttatggcaggcacaaggagtatctgagctcgctggttgggaccgattttgaaatgacggtaccaggcgctctgcggttatttgtgaacggtgaggttgtcagtgcgcaaggatatgaatacgataacctatacgtgcatttttttgtggaactaccgacagcccactggtcatctcccgcttttcagcagctgagcggagtcacccagacatgcacgacaaaaagtttggcgatggataaagtggcccatttttcctatccttttaccttcgaggctttctttctgcacgaagacgagtcctccgatgctctgcctgaatggccagtgctatactgcgaagtactctctctggatttctggcagaggtacagggtcgaggggtacggagcagtcgtgctacccgctactcccggaccatcttggaaccgggcaccctttcggaagggctgtggcgtgtgctggacggtctggaaaggcagcgcttcacgcgttccattcacgatgtgttag

SEQ ID NO: 229782 - DNA, 1566 bp, Artificial Sequence
  Description of Artificial Sequence: Synthetic coding sequence
atggctgaaaccgtttggtctacagataccggagaggctgtgtaccggtcccgcgacccagtacggaatctgagactgagggtgcatctccaacggataacctcttcaaatttcctccattatcagccggcagctgaactgggcaaagacctcatcgatcttgctaccttccgacctcagcctacagctagcgggcatcgtcctgaggaagacgaggaagaggagatcgtgatcgggtggcaggaaaagctgttttctcagtttgaggtggacctttatcagaatgagaccgcttgtcagtccccactggattaccagtaccgccaggagatactgaaactcgagaacagtgggggaaaaaagaatcggagaatcttcacatatactgacagtgataggtacactaatctggaggagcactgccagcggatgaccaccgctgcctcggaggtccccagtttcctggtggaacggatggccaacgtgaggcgcagacgacaagatcgacggggtatggagggaggtatactcaagtcgaggatagtaacgtgggagccaagtgaggaatttgtgcgaaacaaccatgtaatcaatacaccactgcagaccatgcacatcatggccgacttgggtccgtataagaagctaggatacaagaaatacgaacatgttctttgtacccttaaagtcgactctaatggggtaataactgtgaagcctgattttacaggactgaaaggcccttaccgcatcgaaacggagggagagaagcaggaactgtggaagtacactatcgataacgtcagtccccatgctcagccagaggaagaggaacgggagcgcagagtgtttaaagatctctacggtcgacataaggaatatctctcttctctggtgggtacggactttgaaatgaccgttcccggtgctctcagacttttcgtgaatggcgaggtggtgtcagcccaaggctacgagtacgataatctgtacgtccacttcttcgtggagctgccgacagcacattggtcttctccagcctttcagcaattgagcggggtgacgcagacctgtacgacgaagtccctcgcgatggacaaagtagctcactttagctacccgttcacgtttgaggcattttttctgcacgaagacgagtcaagcgacgcacttcctgaatggccagtgttatactgtgaagtgctaagcctggacttttggcagaggtatcgcgtggaaggctatggggctgtggtcctgccggctacaccaggttctcacacgttaacagtgtcgacatggaggcctgtcgaattaggtacagtggcggaactgaggcgcttttttatcggtggtagtcttgaattagaggaccttagctacgtcagaataccgggaagtttcaaggcgttgctatcttcatcaaagacaaaagaaggccgaaaagttgatggcgagcgcgtgttgaacccacagcctgtttcactttctctctttcctggaaagcctcattctaccgcttggggtctgctgaggctgcgttacgaattgtttctcagcaaatag

SEQ ID NO: 229783 - DNA, 1680 bp, Artificial Sequence
  Description of Artificial Sequence: Synthetic coding sequence
atggcagagaccgtctggtctacagataccggagaggctgtgtatagaagtcgagatcctgtgcgtaacctaaggctaagagttcacctacaaagaataactagttcaaattttctgcattaccagcctgcagccgaattaggcaaagacttgatagatttggccactttccgtccccagcctacggcgtcaggccaccgaccggaagaagacgaagaagaggagatagttattggctggcaggaaaaacttttcagccaatttgaagtggatctgtaccagaatgagacggcttgccagtcccctctcgactaccagtacaggcaggagatacttaaattggaaaatagcgggggaaaaaagaatagaaggattttcacatataccgactctgaccgctacactaacttggaagagcactgtcaacgtatgactaccgctgccagcgaggtgccgtccttcctcgtggaacggatggccaacgtccggagacgacggcaagaccgcagggggatggaggggggaatccttaagagtagaattgtgacttgggagcctagcgaagaattcgtgcgcaataaccatgtcatcaacactcctctgcaaactatgcacatcatggctgacctcgggccttataaaaaactcggatacaaaaaatatgagcacgttctctgcactctcaaagttgattcaaatggcgttattacagtgaagccagacttcacgggacttaaaggtccttaccggatagaaaccgaaggcgaaaaacaggagttgtggaagtataccatcgataacgttagcccacatgctcagcccgaggaagaagagagagagcgacgcgtttttaaagatctctatggacgtcataaagaatacttaagcagcctggttggaactgattttgagatgacggtgccgggagctcttcggctcttcgttaacggagaagtggtgagcgctcaaggctacgaatatgataacctctacgttcatttcttcgttgagttaccaaccgcacattggagcagtcctgcatttcagcagctgtccggcgtgacacagacatgtacaacaaagagcctggccatggacaaggttgcccatttcagttacccttttactttcgaagctttctttctccatgaggatgagtctagtgacgccctacctgaatggcccgtcctctattgtgaggtgctgagcttggatttttggcagaggtatcgggtggaaggttatggagcagtagtgctacctgcaaccccagggtcgcacacactgaccgtctctacttggcgaccagttgagttgggtacagttgcggagctccggagattcttcattggcggaagcttggagctggaagatctgtcatatgtgcggatacccggaagtttcaagggagagcgactgtcccggttcggacttaggaccgagactaccggaaccgtgactttcagattgcactgcctgcaacagtcccgagcctttatggaatcgagctcgctgcagaagcgtatgcgtagcgtcttggatcgtctggaagggttctcccagcaaagttccatccacaacgtactggaggcttttcgtagagccagaaggcggatgcaagaggcgagggagtctctgcctcaggatctggtcagcccttcaggcacactggtctcatag

SEQ ID NO: 229784 - DNA, 1563 bp, Artificial Sequence
  Description of Artificial Sequence: Synthetic coding sequence
atggccgagactgtttggtcaacagacacgggggaggcagtgtatcgctcaagggaccctgtgcgtaatctgcgcctcagggtacaccttcagcgaattacgtcttcgaactttctgcactaccagcctgccgcagagctcggaaaggaccttatcgatctggctacctttaggccgcagccaaccgccagcggtcaccgtcccgaggaagacgaagaagaagagatcgtcatcgggtggcaggaaaagctgttcagtcagtttgaggtcgacctctatcagaatgagactgcctgccagagtcccctcgattatcagtacagacaggagattctgaagctcgaaaattccggcggaaagaaaaaccggagaatcttcacatatactgatagcgacaggtatacaaacttggaggagcactgtcagcgcatgaccacagctgcctcagaggtcccttcttttttggtggaacgtatggccaacgtgagacgtaggcgacaggacagaaggggcatggaggggggaattctgaaaagtagaatcgtaacgtgggagccatcagaagaatttgtgagaaacaaccacgtgattaataccccactgcaaactatgcacatcatggcagacctgggaccatataagaagttgggatataagaaatatgagcacgtcctctgcaccctgaaggtcgatagtaacggcgtaatcacagtgaaaccggactttacaggcttgaagggaccataccgaattgagacagagggcgaaaagcaagagctctggaaatataccattgataatgtttctccccacgctcagccggaagaagaggaacgggagcgccgagttttcaaagatctttatggcaggcacaaagaatacctgagctcattggttggaacagattttgagatgacagtgcctggtgccttacggctctttgtgaacggcgaggtagtgagtgcacagggatacgaatatgataacttatatgtccacttttttgttgagttacctacagcccactggtcttcccctgcgttccagcagctgtctggggtaacgcaaacttgcaccaccaagtctcttgctatggataaagtcgcgcacttctcctacccattcacctttgaggcattttttctccacgaagatgagtcctccgacgccttgccagagtggcctgtgctatactgcgaagttctctcactggacttttggcaaaggtacagggtcgaaggctatggggctgtggtactgccggctacgccgggaagccacactctgaccgtgagtacttggcggcctgtcgaactgggaacggtagcagaattaaggcgcttttttatcggcggatcgcttgaacttgaggacctgagctatgtgaggatccctggatcattcaaagggctaagcagctcaaaaacaaaggaaggtaggaaggttgatggagaacgcgtactaaatccccaacccgtgtcactaagcttgttccctggaaagccccacagcactgcctggggactgcttcgactgagatacgagctatttctgagcaagtag

SEQ ID NO: 229785 - DNA, 1650 bp, Artificial Sequence
  Description of Artificial Sequence: Synthetic coding sequence
atggctgtacccgtgagcagcttcgctcagaggaccaggtccagatttagggtccacttgcaaaggataacgtcatcaaatttcctccattaccagcccgcagctgagttgggcaaggacctgatagatctcgcaactttcagacctcagcccaccgcatcgggccaccgacctgaggaagacgaagaggaggagatcgtgattggctggcaagagaaactgttctcacaattcgaggttgatctctaccagaacgagacagcctgtcagtctcctttggattatcagtatcggcaggaaatccttaaattggaaaacagcggcggtaaaaagaatcggagaatcttcacatacacggactctgataggtatactaacctggaagaacattgccagaggatgaccacagctgcatcagaagtgccatccttcctggtggagcgaatggcaaatgttaggcgccgaaggcaggatcggagaggcatggaagggggtattctgaaatcacgaatcgtgacctgggagccttcagaagaatttgtgagaaacaatcacgttatcaacactcctctgcaaactatgcatattatggcagacctcggaccttacaaaaagctcggatataaaaagtatgaacacgtgctctgcactctgaaagtagacagtaacggggtgataacagtgaaacccgatttcacgggtctgaagggcccttatcgcattgaaacagaaggtgagaagcaggagctctggaaatataccattgacaacgtatcaccacatgcccagccggaagaggaggagagagaacgacgggtgtttaaggacctgtatggtaggcataaagaataccttagttcgctggtgggcaccgactttgagatgaccgtcccaggagcgttgaggttgttcgttaatggcgaggtcgtcagtgctcaagggtatgagtacgacaatctatatgtacatttttttgtggagcttcccaccgcccattggtcttctccagccttccagcagctgagcggagtgactcagacctgtactacaaaaagcctcgcaatggacaaagtggcccacttcagctatcctttcactttcgaagcgttttttctccacgaagacgaatccagtgatgcgctgcctgagtggcccgtgctgtactgtgaagtgttgtctctcgatttctggcagaggtaccgtgtggaaggatacggggctgtggtgctgcctgccacccctgggagccataccttgacagtttcaacttggcggccagtggagctcggtacagtggcggagctgcgtcgctttttcatcggtgggagtctggagctggaagacttaagttatgtgaggataccaggctctttcaagggggagagactgagtcgcttcgggctgcgcactgagaccaccggaaccgtgacattcaggctgcactgcctacagcagagccgtgcgtttatggaatcctccagtctgcagaagaggatgaggagcgtcctcgataggttagaagggttcagccaacagtcatctattcataacgtccttgaagcatttaggcgcgcacgaaggcgcatgcaggaagcacgcgaatctctgccacaggacctggtctcgccctccggcaccctggtatcctag

SEQ ID NO: 229786 - DNA, 1071 bp, Artificial Sequence
  Description of Artificial Sequence: Synthetic coding sequence
atgcacattatggctgacttgggtccctacaagaagttaggctacaagaaatatgaacatgttctgtgcaccctgaaggtggactcgaacggggtcataaccgtcaagccggattttacaggcctcaagggcccataccgcatcgagacagagggggagaagcaggagctgtggaaatacacaatcgataacgtgagtccgcatgctcaacccgaggaggaagaaagagagagacgagtgtttaaggatctttatgggagacataaagagtatctgagttcactggtcggaacagactttgaaatgacagtccctggcgctctcaggctgttcgttaatggcgaagtggttagcgcccaggggtacgagtacgacaacctgtacgttcatttttttgtagaactgcccaccgctcactggtcttcaccggctttccaacagttatctggcgtcacccagacctgcactacaaagagtttagctatggacaaggttgcccacttcagctaccctttcacctttgaagctttttttctgcatgaagacgagagctccgatgcacttcctgaatggcccgtcctgtattgtgaagtgctgagtctggacttctggcagagatatcgagtggaggggtacggtgctgtggtattaccagcgaccccagggagtcataccctgactgtgagtacatggcggcctgtggagctggggaccgtggctgaacttagacgattctttattggcggatctctggagctcgaggatctgtcctacgtgaggataccgggaagcttcaaaggcgaacgcctgtcccgctttggcctacgaactgaaaccacaggtaccgtaacattccggctccactgtctgcagcagtcacgggcattcatggagtcatcctccctgcaaaagcggatgaggagcgttctggacagactggaaggtttttcacaacagtcttccatccacaatgtgctcgaagcctttcggagggctcgcagacgcatgcaagaggctagagagtccctgccccaagatttagtgtccccctctggcactctcgtctcatag

SEQ ID NO: 229787 - DNA, 4746 bp, Artificial Sequence
  Description of Artificial Sequence: Synthetic coding sequence
atgaaagcccagggcgaaacagaggagtccgagaaactgagtaagatgtcctcgctcctggaacgcttacacgctaaattcaaccaaaatcgcccatggtcagagaccattaaactggtgcgccaggtgatggagaagcgagtcgtaatgtcgagtggcggtcaccagcacctggtctcatgtctggaaacactgcagaaagccctgaaagtcactagtctccccgctatgactgatcgtctggaaagcatcgcaagacaaaatggtctgggttcccatctgtccgccagcgggacggagtgctacattacctcagatatgttttacgttgaggtacagctggaccctgccggacaactgtgtgacgtgaaagtggctcatcatggcgagaacccagtgtcttgcccagagctggttcagcagctccgggaaaaaaatttcgacgaatttagcaagcaccttaaaggcctggtgaacctgtataacctccctggcgacaacaaactgaagactaagatgtaccttgcactccagtctttggaacaggatctctctaagatggcaattatgtactggaaggctacgaacgcgggacccctagataagattctccacggcagtgttggttacctgacccccaggtccggaggtcacctgatgaacttaaaatactatgtcagccccagcgacctgctggacgacaagacagcgtcaccaatcattcttcatgagaacaacgtctccaggtccctgggtatgaacgcttccgtcaccatcgaaggaacttcagctgtctataaactccccatcgccccactgatcatgggttcacatccagtggacaataagtggacgccatccttcagctcaatcacctcagcaaattcagtcgaccttcctgcatgctttttcttgaagttccctcaaccaatccctgtcagtcgagcttttgtccaaaagctccagaattgtactggaatccccttattcgaaacacagcccacgtacgctccactgtacgaactcatcacgcagttcgaactgtccaaggatccagacccgatccccctgaaccataatatgcgattctatgctgccctgcctggccaacagcactgctactttctgaataaggatgcacctctgccggacggacggagtctgcagggcaccctcgtgtccaagataacatttcagcacccaggacgtgtgccgctaatcctaaacctgattaggcatcaagtggcctataatactctgattggatcctgcgtgaaaaggaccatcctgaaagaggatagccccggactgcttcagttcgaagtctgtcctctgtccgagagcaggttctccgtctctttccagcatcctgtgaacgatagcttggtttgcgtcgtgatggatgtgcaggactctactcacgtctcttgtaagttgtataagggtctgtcagatgcactgatctgtaccgacgacttcattgccaaagtcgttcaacgctgcatgagcattcccgtcacaatgcgcgcaattaggcggaaagcggaaaccatccaggcagacacaccagctctgtcattgattgcagagaccgtcgaggacatggtcaaaaagaatctgcccccagcttctagcccagggtacggaatgaccactggtaacaaccccatgagcggaacaacaacccctaccaatacttttcctggcggtcctattactaccctgtttaacatgtcaatgtccatcaaggacaggcacgaaagcgttggacacggggaggacttcagcaaggtcagccagaacccaatcctgacatccctgcttcagattactggcaacggaggtagcaccatcggcagctcacctacccctcctcatcatacaccacctccagtgtcctcgatggctggaaatacaaagaaccacccaatgctgatgaatctcctgaaagataatccagcacaggatttttcgaccttatatggcagttcaccccttgaaaggcagaattccagcagtggcagcccgaggatggaaatttgctccggctcgaacaaaacaaagaagaagaaatctagcagactgccacccgagaaaccaaagcaccaaaccgaagatgactttcagcgagagctctttagcatggacgtggactcacagaaccccatctttgacgtgaacatgacagcagataccctagacacacctcacatcactccagctccttctcagtgctccactcctcctactacttaccctcagccagtgcctcaccctcagccctctatccagcggatggtaaggctctcttcttcagatagcataggacctgatgtaaccgacattctatcagatatcgccgaagaggcgagcaaacttccctcaacatctgatgactgtcccgcaattggcactccgctgagggacagtagttcctcgggacactcgcaaagtacattgttcgattctgacgtgttccagaccaataataacgagaatccttatactgaccctgccgacttgattgcggacgcagcaggctcccccagtagcgacagcccgaccaatcatttttttcacgacggggtggattttaatccagatcttttaaattcacagagccaatcgggtttcggagaggaatactttgatgagtcaagccagtccggtgataatgatgactttaaaggttttgcatctcaggccttgaacacccttggggtccccatgcttggaggcgacaacggggaaacaaaattcaaaggtaataaccaggctgatactgtcgatttcagcataatttccgtggctggcaaagcacttgcccctgcagacctgatggaacaccacagcggttcacaaggtccccttctgaccaccggcgacttaggtaaagagaagactcagaagcgcgtcaaggaaggaaacggaacatctaattctacccttagcgggccaggcctagactccaagcccggtaagaggtccaggacaccaagtaacgacggtaagagcaaagacaaacctccaaaaaggaaaaaggccgataccgagggaaagagcccaagccacagctctagtaaccgtccgtttaccccgcctacatccaccggcggatctaagagccctggctccgccggtaggtcacagactcctcctggggtggcaacacctccaatccctaaaattacaatccagattcctaagggaacagtaatggtgggaaaaccatcgtcccactcccaatacaccagcagtggctctgttagctcaagcggctcaaagtctcaccatagccacagtagctcgtccagtagcagtgccagcacaagcggcaaaatgaaaagcagtaagtccgagggcagctctagcagcaagctatctagctctatgtactcaagccaaggttcctctggctctagccagtctaagaacagcagccagtccgggggtaagcccggatcatcaccaataacgaaacacggcctgagtagcggctcaagttcaactaagatgaaaccccagggtaaaccaagctccctgatgaacccatcactgtccaaaccaaacatcagcccatcccacagccgacctccaggagggtccgacaagcttgcctctccaatgaagccagtgcctggaacacccccttctagcaaggcaaagagtcccatttccagcgggtccggcggttcccatatgagcgggaccagctcctccagcgggatgaagtcctcaagcgggctcggctctagtggatctctcagccagaagacccccccttcgtcgaattcctgtacagcatcgagctccagttttagttccagcggctcgagcatgtcctcaagtcaaaaccagcatggatcgtccaaggggaagagtccctcacgcaacaaaaagccttccctcaccgccgtaatagacaaactcaagcatggggtcgttacatctgggcctggcggagaagaccccttggatggccaaatgggagtgtcaacgaattcctctagtcatccaatgtctagcaaacataatatgagtggtggcgagttccagggcaaaagagagaagtctgataaggataaaagcaaagtttctacttcaggatcttctgtggactcgtccaaaaaaacttctgaaagcaaaaacgtcggctccacaggggtagccaaaatcatcatctctaagcatgacggaggatcgccaagcattaaggctaaagtaactttgcagaaacccggagagtcatctggagagggccttcgcccacaaatggcctcgagcaaaaattatgggagcccgttgatctctggtagcacaccgaagcatgagagaggttcgcccagtcattctaaaagccccgcatatacaccccagaatttggacagcgagagcgagtctgggtcctcaatcgccgaaaaaagttaccagaattccccctcaagcgacgatggcatcaggcctctcccagagtactccaccgaaaaacacaaaaaacataaaaaagagaaaaaaaaagttaaggataaggacagagaccgtgaccgcgataaagatcgtgacaaaaaaaaaagccactctatcaaaccagagagttggtccaaatcacccatctcatccgatcagagccttagcatgacctccaacaccatcttaagcgccgacaggccgagccgtctgtcaccggacttcatgatcggagaagaggatgatgacctgatggatgtcgcgctcatcgggaactag

SEQ ID NO: 229788 - DNA, 1671 bp, Artificial Sequence
  Description of Artificial Sequence: Synthetic coding sequence
atgaaggcccagggcgagaccgaggagtcggaaaaattgtcaaaaatgtcttcattacttgaacgactgcacgctaagtttaatcaaaatcggccatggagcgagactattaagctggtccgacaggtgatggagaaacgtgtagtgatgtctagcggcggacatcagcacttagtgtcatgcctcgaaaccttgcaaaaggcattaaaggtgaccagcttacctgccatgacagatcgactggaatctatcgctcgacaaaatggcttaggctcccatttaagtgcctcaggcacagagtgctatattacttccgatatgttttatgttgaggtccagctggatcctgcaggacagctgtgtgacgtgaaagtagcgcatcatggtgaaaaccccgttagttgccctgaattggttcagcagctgagagaaaagaattttgacgagtttagcaaacatctcaagggactagtgaacctgtacaatttgcccggtgataacaagctcaagacaaaaatgtacctggctctgcagagtctggagcaggaccttagcaagatggccattatgtattggaaagcaacgaacgcaggtcccttagataagatcctccatggctctgtcggctaccttacccctaggtcgggcggtcacctgatgaatcttaagtattacgtttctccaagcgatctcttagacgacaaaactgcctctcctattattctccatgagaataatgtgagtcgaagcctcggcatgaacgcatccgtgacaatcgaaggcacaagcgccgtgtacaaattaccaatagctcccttgattatggggagccatcctgtcgataacaaatggactccttctttcagtagcataacaagtgcaaactccgtggatttaccagcttgtttctttctgaagtttccacagcccattcccgtctcccgggcttttgtgcagaaactgcaaaactgcacagggattcctctttttgagacccagccgacatacgcaccactgtacgaactaattacccaatttgagctgtccaaggatcccgatcccatcccactgaaccacaatatgcgcttttatgcagctttacctggtcagcagcactgctacttcctgaataaggacgctcccctgcccgatgggaggtctttgcagggaacattggtaagcaagattacgtttcagcatccaggccgagtgcccctgatcctcaatctgatacgtcatcaggtggcttataacactttgataggctcctgtgtcaagcggacgattttgaaagaggacagcccgggacttctgcagtttgaagtttgtccacttagcgagtctagattttccgtgagtttccagcaccctgtgaacgactccctagtttgtgtggtgatggatgtccaggatagcacccacgtttcatgtaagctttacaaggggctctccgatgcgctcatttgtactgacgattttatcgccaaagtggttcagaggtgcatgagcattccggtcactatgagagcaattcggaggaaagccgagactattcaggcggacacccctgccctgagcctgatcgcagagaccgtggaggatatggtaaagaagaacctgccccctgctagtagcccgggaagcaagaaccctgagctgggatcgggctag

SEQ ID NO: 229789 - DNA, 408 bp, Artificial Sequence
  Description of Artificial Sequence: Synthetic coding sequence
atggctgaaaaatttgatcacctggaagaacatctggagaagttcgtggaaaacatacgccagttgggaattattgtgtccgatttccagccatcctcccaggccggacttaatcagaagctcaactttatagtcacaggcctgcaggacattgataaatgccgacagcaattgcacgacattaccgtaccgctcgaggtgttcgaatacatcgaccagggaagaaaccctcagctgtacaccaaggaatgcctcgaacgcgcactggcaaagaacgagcaagttaaaggcaagattgatacaatgaaaaaattcaagagtcttttaatccaggagctatccaaggtgttcccggaagatatggcaaagtaccggagtatacgcggtgaggatcatcccccatcatag

SEQ ID NO: 229790 - DNA, 354 bp, Artificial Sequence
  Description of Artificial Sequence: Synthetic coding sequence
atggctacgtattctttggccaatgagcggcttagagctcttgaggatattgagagagaaatcggggctatccttcaaaacgctggaaccgtgattctggagctttccaaggagaaaacaaatgagcgtctcctggatcggcaggcagccgcattcacagctagtgtgcagcacgtcgaggctgagttgagcgcacaaatacggtaccttacacaagtcgccacgggccagccgcacgaaggtagcagctactcctcaagaaaggactgtcagatggccctgaagagggttgactacgcacgattaaaactcagcgacgtcgccaggacttgcgaacaaatgttagagaactag

SEQ ID NO: 229791 - DNA, 6542 bp, Artificial Sequence
  Description of Artificial Sequence: Synthetic coding sequence
atggccgcattcggcattctgtcttacgaacaccgacctctaaagcggccacgtctcggcccacccgacgtttatccacaggatcctaaacaaaaggaggacgaactcacagctctgaatgtgaaacaggggtttaacaatcagcccgcagttagtggtgacgagcacgggagtgctaagaatgtgtccttcaatccggcaaaaattagttctaacttttcttcaattattgccgagaaactgcggtgcaacactctgccagacactgggcgtcgtaaaccacaagtcaaccagaaagataatttttggctggttacagccagatcacagtcagcaatcaatacctggtttactgacctcgcaggtactaagcccctaactcagttagcaaaaaaggtgccaatattttcaaaaaaagaggaagtttttggctacctggccaagtacacagtgcccgtaatgagagctgcctggttgataaagatgacatgcgcatattatgcggcaatctcggaaactaaagtgaagaagcggcacgtggacccattcatggaatggacgcagattatcactaaatacctatgggagcaactccaaaagatggcagagtattatagacctggaccagccggatctgggggatgcggcagcactattggcccacttccgcatgatgttgaggtcgctatacgccaatgggattatacagaaaaactggccatgtttatgtttcaggacggaatgctggacagacatgagtttctgacatgggttctcgagtgtttcgaaaaaatccggccaggggaagatgagctcctgaagctcttgctgccgttgctgttgagatactctggcgagttcgtccagtcagcctatctgagccgtcgactggcctacttctgcactcgcagactggccctgcagctagatggcgtatccagtcattcatcccatgtgattagtgcccaaagtacctccacgttgcccactaccccggctccccaacccccaacctcttccaccccttccacaccctttagcgacttgcttatgtgtcctcagcatcggcctctcgtattcggactctcgtgcatcctgcagacgattctcttgtgttgccccagtgccctcgtgtggcactatagtctgacggatagtaggatcaaaaccggaagccccttggatcacttgcccatcgccccttctaacctgcctatgcctgaaggaaattccgcattcacgcagcaagtgagggctaaactacgcgagattgagcagcaaattaaagagagagggcaggccgtggaggttaggtggtcttttgataagtgccaggaggcaacggccggatttactatcggcagggttctgcacacactagaggttctcgactcccactcctttgagagatccgacttctcaaactcgctcgactcgctgtgcaatcgtatctttgggttggggccttctaaagacggccatgagatctcaagtgacgacgacgcggtcgtgagcctcctctgtgaatgggctgtgtcctgcaagagatctgggcgtcacagagccatggttgtcgcgaagttactggaaaaacgacaggccgaaattgaagcggaaagatgtggcgaaagcgaggctgctgacgaaaaggggtcaatcgcgagcggcagcttgtctgcgccttctgctcccatctttcaggacgttctactccagtttctggatacacaggcacctatgctgacggatcctagatcagagtctgaaagggttgagtttttcaatctcgtccttttgttctgcgagctgattaggcacgacgtgtttagccacaatatgtatacatgtaccctaatctcacgtggtgatttggcttttggggctcctggtccacggccaccttccccatttgatgatcctgctgacgaccccgaacataaggaagctgaggggtcttccagttcaaaactagaggacccagggctcagcgaatctatggatatcgatccttcctcctcagtactgttcgaagacatggaaaagcctgattttagcctcttttccccgactatgccgtgtgaaggcaaaggaagtccctctcccgagaaacctgacgttgagaaggaggtgaagcctcctcccaaggagaagatcgagggaacactcggggtgctttatgatcagccgagacacgtacagtacgctacacattttcccattccccaggaggagtcttgctcacacgagtgcaatcagagattggtggtgctctttggggtggggaaacagagggacgatgccaggcacgctataaaaaagataacgaaggatattctgaaggtgctgaacaggaagggcaccgccgaaacagatcagctagcccctattgtccccctgaatcctggtgacttgacctttttaggaggtgaggatgggcagaagcgcagaaggaaccggccagaggcctttccgaccgctgaggacatattcgctaaattccaacatctgagccactatgaccagcatcaggtgacggcacaggtgtcccggaacgtcctagagcagattacgagttttgcgctaggaatgtcctaccacctgccactcgtgcagcacgtgcagtttattttcgaccttatggagtattccctcagcatcagcggattgatcgactttgcaattcagttgttaaacgagctctccgtggtcgaggcagaacttcttctaaagagcagcgacctggttggtagttataccacctcgctttgtctctgtatcgtcgccgtgcttagacactatcacgcttgtctcattttaaatcaggatcaaatggcccaggtatttgaaggactgtgcggcgtagttaagcatggtatgaatcggagtgacggatctagcgccgagcgatgtatccttgcctacctgtatgatttgtatacgagctgctcacacctgaagaataaattcggagagttatttagcgacttctgttctaaggtgaagaatactatctactgtaacgtggagcccagcgagtcaaacatgcggtgggctccagaatttatgattgacaccctggaaaatcccgctgcccacacgtttacatacacgggcctgggcaagtctctatccgagaaccctgctaatagatactcatttgtttgcaacgctctgatgcatgtgtgtgtgggtcatcatgacccggaccgggtgaacgacattgctatcctctgtgcggagctaactggatactgcaagtcactgtccgccgagtggcttggggttttgaaggctttgtgctgcagctctaacaacggcacttgtggtttcaatgacttgctgtgtaatgtggacgtctccgacctctcttttcatgacagcctcgcgacattcgtggctatcctgatcgccaggcagtgtctcctgctcgaagatttaatccgatgtgctgcaatcccctcactccttaatgccgcatgctctgaacaggacagcgagcctggagcacgactaacttgtcgaatcctcctgcacctgttcaagacccctcaacttaatccctgccagagtgatggcaataagcccacagttggtattagatccagctgcgatcgccatctcctggctgctagccagaacaggatcgtggatggggctgtctttgctgtgttaaaagcggtgtttgtgctgggagatgcggagctgaaaggctctggatttaccgttaccgggggaactgaagaactgccagaggaggaggggggaggtggttcagggggacggagacaaggaggccgtaatatctccgtggaaaccgcgtctttggacgtgtacgccaagtacgtcctgcgcagtatttgtcaacaggagtgggttggcgaaagatgtctcaaatctttgtgtgaagattccaacgatctccaggaccccgtgttatcaagcgcacaagcgcaaaggctaatgcagttgatatgttatccccatcgattactcgataatgaagacggggagaacccacagagacagagaattaaacgcatcctccaaaatttagaccagtggacaatgcgccaatctagccttgaacttcaactgatgatcaagcagaccccaaacaacgagatgaactctttgctcgagaatattgccaaggcaaccattgaggtttttcaacagtcggccgaaacagggagttcaagcgggagcaccgcatcaaatatgccaagctcgtctaagacaaagcccgtcctcagctctctggagcgtagcggtgtctggcttgtcgcacccctcattgccaagctgcctacgagcgttcaaggacacgttctgaaggctgccggagaagagctcgagaaggggcaacaccttggctctagctcacggaaggaaagagacagacagaagcagaagtccatgtctctgctgagtcagcagcctttcctgtccctcgtgctaacatgccttaagggtcaggatgagcagcgggaggggctcttgacttccctctacagtcaggttcaccaaattgtcaacaactggagagatgaccagtacttggatgattgtaagcccaagcagctgatgcatgaagccctcaagcttcgcttgaacctggtggggggaatgttcgataccgtccagaggtccacccagcagaccactgagtgggcaatgcttctccttgaaatcataatcagcgggactgtggatatgcagagtaataatgagttgtttaccaccgtcctcgatatgctgagcgtgctcattaacgggacattggctgccgatatgtcatctatttctcaagggagtatggaagagaacaagagagcatatatgaacctagcaaagaaattacaaaaggaactcggcgaacgccagagcgactccctggaaaaggtccgccagttgttgccgcttccgaaacagacccgcgatgttatcacctgtgagcctcagggttctctgatagatactaaaggcaacaaaatagcaggttttgactcaatttttaaaaaagaagggctgcaggtgtcaaccaaacagaaaatttcaccctgggatctgtttgagggccttaaaccttccgcccctctgagttgggggtggttcggcactgtgagggttgatcgacgcgttgcaaggggggaagaacagcagcggttactcctatatcatactcatctgcggcctcgaccgagagcatactacttagagcccctgccactccctcccgaggacgaggaacccccagccccaactctgctggaacccgaaaagaaggcacccgagccccctaagactgataaaccaggcgctgccccaccctcaaccgaagaaaggaaaaagaaaagcacaaagggaaagaagcgctctcagcccgctacgaagacagaggattatggcatgggccctggcagatccggaccatatggagtgacggtccccccagacctgctacatcacccgaaccctggaagcattacacacctcaattacagacagggctctataggcctgtatacacaaaaccagcccttgcccgctggaggccctagagttgacccctacagacctgtgaggctgccaatgcagaagttacccactaggcccacttatccaggcgtgctacccacgactatgacaggagttatggggctcgaaccttcctcctacaaaactagcgtctaccgccaacagcagcctgcggtaccccaggggcagaggctccgccagcagctgcaggccaaaattcagtctcaaggcatgctgggccaatctagcgtgcatcagatgactccttcctcatcatatggattacagaccagccaggggtacacgccttacgtttctcacgtggggcttcaacagcacactgggccagctggcactatggtgcctccttcttacagcagccaaccataccagagtacacaccccagtactaacccgactctggtggatccaacccggcatttacagcaacggccatccggctatgtccatcagcaagcccctacgtacggacacggacttacgtccacgcagcggtttagccaccagactctgcagcagaccccgatgatttctactatgacacccatgtctgctcagggtgtgcaggctggcgtgcgcagtacagctatactacctgaacagcaacaacagcagcagcaacagcagcagcagcagcagcagcaacagcagcaacagcagcagcagcaacagcaacaataccacatacgacagcaacagcagcaacagatactccgtcagcagcaacagcagcaacagcaacagcaacagcagcagcagcagcagcaacagcagcagcagcaacagcaacagcagcaccagcagcagcagcagcagcaggccgcacccccacagccccagcctcaatctcagccccaattccagcgacaaggtctgcaacagacacagcagcagcaacaaaccgcagctctggtgaggcaacttcaacaacaacttagtaatactcagccacaaccatcaacaaacatattcggcagatatta

SEQ ID NO: 229792 - DNA, 6533 bp, Artificial Sequence
  Description of Artificial Sequence: Synthetic coding sequence
atggccgcattcgggattctcagttacgaacacaggcctcttaaaagacctagactgggtcctcctgacgtctatcctcaggacccgaagcaaaaggaagacgaactgacagccctgaacgttaaacaaggctttaataatcaacctgccgtatctggagatgaacacggctccgccaagaacgtgtcttttaatcccgcaaaaatctcgtccaatttctcatctatcattgctgagaaactccgatgcaatacattacctgataccgggcgtcgcaaaccacaggtgaaccagaaggataatttctggctagtgaccgcacgaagccagagcgcaattaacacgtggtttaccgatttagccggtacaaagcccctgacccagctggccaagaaggtgccgatcttctcaaaaaaggaggaggttttcggatatctggcgaaatatacggtcccggtaatgagagcggcttggttgattaagatgacttgtgcctattatgccgcaatctccgagaccaaagtgaaaaagaggcacgttgatccattcatggagtggacccaaattattacaaaatacttgtgggagcaactacaaaagatggccgaatattaccgtcccggaccagcaggctccgggggttgcggatctaccattggcccactgccacatgacgtcgaggtggccataaggcagtgggactatacagaaaaactcgctatgttcatgtttcaagacggtatgttggaccgacatgaattcctgacttgggtcttggaatgcttcgagaaaataagaccaggtgaagatgaacttctcaagcttctcctgcctctgctgctgcgatacagcggtgagtttgtgcagagtgcatatctgtctcgcaggctcgcctacttctgcacacggaggttggctctgcagctggatggtgtgagtagccatagcagccacgtgattagtgcccagagcacctccacacttcctaccaccccagctccacaacctcccacaagcagcacgccatcaacccccttctccgacctgttgatgtgtcctcaacacaggcctctggtcttcgggctatcttgcatcctgcagacaatcttgctgtgttgtccttctgcccttgtgtggcactacagtttgaccgattcccgtattaagacaggatctccgctggaccatctgccgatcgcacccagcaaccttcccatgcctgagggcaactccgcatttacccagcaagtccgtgccaaactgcgggaaatcgaacagcagattaaggagcggggtcaagccgtcgaggttaggtggtcttttgacaaatgccaggaggccacagccggtttcaccatcgggagggtactgcacacactagaggtgcttgactcacactcatttgagcgctccgacttttcaaattctctagactccctgtgcaacaggatctttggtctgggacctagcaaggacggacacgagattagctccgatgatgacgccgtggtgtcgctgctctgcgaatgggccgtgtcatgtaagcgttccggccgacatagggccatggttgtcgctaagctcctggaaaaacgacaagccgagattgaggcagagcgctgcggggaatccgaggctgcagatgagaaggggagcatcgcaagcggttctcttagcgccccatcagcacctatttttcaagatgtcctcctgcaattcctggatacccaggctcccatgctcaccgatcctcggtccgagagtgagcgcgttgagttcttcaacctggtgctgttattttgtgagctcatcagacacgacgtcttctcgcacaatatgtatacttgcactctcatcagtcggggagaccttgcattcggtgcccctggacctcgcccaccaagtccatttgacgatccagcggacgatccagagcataaagaggcagaaggcagctcctcctccaaactcgaggatcctggcctgtctgagagcatggatattgatccttccagttccgtactctttgaggacatggaaaagcccgacttctcattattcagccctaccatgccttgcgaaggaaaggggtctccttccccagagaagcctgatgtagagaaagaggtgaaaccaccacctaaagagaaaatcgaagggactttgggcgttttgtacgaccaaccgagacacgttcaatatgccacacactttcccattcctcaggaagagagttgttcacacgaatgtaaccaaaggttggttgtgttgtttggagtgggtaaacagagggatgacgcacgacacgcgattaagaagattactaaagacatactcaaggtcctcaatcgtaaagggacagctgagactgaccagctggcaccgatcgttcccctgaacccaggcgacctcacctttctgggcggagaagatgggcagaaaagaaggaggaatcggcctgaggcgtttccaaccgccgaagacatttttgcaaaatttcagcatctgagtcattacgatcaacaccaggtcactgcacaagtctcccgaaatgtactggagcagattacaagttttgcattaggaatgtcctaccacctgcccctggtgcaacacgttcagttcattttcgatctgatggagtactcgctgagcattagtggccttattgatttcgccatccagctcttgaatgagttgagtgtggtggaagccgaattgctgttaaaaagttcagatttggtcgggtcttacactacctctctgtgcctttgcatcgtggccgtgctgcggcactaccatgcatgcctgatactgaatcaagaccagatggcccaggtgtttgagggactgtgtggggtagtcaaacatggcatgaaccgatccgatggcagcagcgctgagaggtgtatccttgcctacctgtacgatctctacacaagttgtagtcacctgaagaataagttcggagaactgttcagtgacttctgttctaaagtcaaaaatacaatatattgtaatgtggagccttccgaatcaaatatgcggtgggcaccagaatttatgatcgataccctggagaaccctgccgctcacacctttacttatactggactcgggaaatcactctctgagaaccctgctaaccggtattcatttgtgtgtaatgccctaatgcacgtttgcgtgggtcaccacgacccagaccgggtgaacgacattgctattctgtgtgccgagctcaccggatattgcaaatccctctccgctgaatggctcggggtgttgaaagccctttgttgttcctcgaataatggaacctgtggattcaatgatctcctctgcaatgtggatgtgtcagatctgagctttcatgattctttagccacattcgtcgcgattcttatcgccaggcagtgtttgctgctggaggacctcattaggtgcgccgctattccaagcctgcttaacgctgcctgcagcgagcaagacagcgagccgggtgcccgtctcacctgcaggatacttctacacctgtttaaaactccacagctgaatccctgtcagtccgacggaaataagcccacagtcggcattagaagttcttgtgataggcacctgctagctgccagtcaaaatcgcatcgtggacggagctgtcttcgcagttctgaaggcggttttcgtgctgggcgacgcggagctaaaagggagtggtttcaccgtaaccgggggtacagaggagctcccagaggaagaaggcggagggggatcaggaggcaggcgacaggggggtcgcaatattagtgtggagacagccagtttggatgtctacgctaagtacgtgcttaggtcaatctgtcagcaggagtgggttggggagcggtgcctgaaaagtctgtgcgaagactcaaacgaccttcaggacccagtcctgagttctgctcaagcgcaaagactgatgcagctcatttgctacccccaccggctgctggacaatgaagacggggagaatccacaaagacaaagaatcaaacgcatactccagaacctggatcagtggactatgcggcagtcttcacttgagcttcagctgatgattaagcagactcctaacaacgagatgaattcgctccttgagaatatcgccaaggcaacaatcgaggttttccagcagagtgccgaaactggtagctcttccggttccactgcttccaatatgccttcctcatcgaagactaagccggtgctgagtagccttgagaggtcaggcgtttggctcgtcgcaccgctgatagcaaaattaccaacctcagttcaaggacacgtattaaaagctgctggagaagagcttgaaaaggggcagcacctgggtagctcctccaggaaggagcgggaccgtcaaaagcagaagtcaatgtccctcttatcccagcagccctttcttagccttgtactcacttgtttaaaaggtcaggatgaacagcgcgaaggactgctcacatcattgtactcccaggttcatcagattgtcaataattggcgcgatgatcagtatcttgatgactgtaaacctaaacaactgatgcacgaggcacttaaattgaggttaaacctcgtgggcggtatgtttgataccgtacagagatccacacagcagaccaccgaatgggctatgctcctattggaaattataatcagcggcaccgtcgatatgcagtctaataacgaactgttcacaaccgtgctggatatgctgagcgtactgattaatggaacgctggccgctgacatgtcatccatatcccaaggcagtatggaagaaaataaacgtgcgtacatgaacttggccaaaaaattgcagaaggagctcggggagagacagtctgacagcttagagaaggtcagacagttactccctctgcccaaacaaacgcgagatgttattacctgcgagccacagggatcactgatcgacaccaagggaaataagattgcaggatttgactctatttttaaaaaggaaggtctgcaggtctcaacaaaacaaaagattagtccatgggacctgttcgagggcttaaaaccctccgctccgctttcatggggatggttcggaaccgtgagagtggaccgccgagtggcacgcggtgaggagcagcaacgattactcctgtatcacacccacctccgccctcggcctcgtgcctactatctcgaacctctgcctctgcccccagaggacgaagagcccccagccccaactctgttagaacccgagaaaaaggcccctgagcccccaaagacagataaacctggggctgctcccccttccaccgaggagcgaaagaagaagagtaccaagggtaagaaaaggagtcaaccagccaccaagactgaagactacggcatggggcctgggcgaagcgggccatacggcgtgacggttccccctgatctgctgcatcatcccaaccccggttccattactcatcttaattatcgccagggtagcattggactgtatactcagaatcagcctctgccagcgggtggcccaagggtcgacccctatagacccgtgagactgccaatgcaaaaacttccgaccaggcctacgtaccccggtgtattgccaacaactatgacgggggtgatgggtctcgagccgtcatcctataaaacttccgtctaccggcagcagcaaccggctgtcccgcagggtcagagactacggcagcagctacagcagtcacaaggaatgcttgggcagtcaagcgtgcaccagatgaccccttcatcctcatacgggctgcagacgagccagggatacaccccttatgtcagtcacgtcggcctccagcaacacactgggcctgcgggaaccatggtcccccctagctattcctctcagccctaccagagcactcatccaagtacaaacccaacccttgtcgaccctactcggcacctacagcaaaggcccagtgggtatgtgcaccagcaagccccaacctatggtcatggcctcacaagcacccagagatttagtcaccagaccctccaacaaacacctatgatttctaccatgaccccaatgtccgcccagggcgtgcaggctggcgttcgcagtacagcaatactccctgaacagcagcaacaacagcaacagcagcagcagcagcagcagcagcagcagcagcaacagcagcagcagcagcagcagcagtaccatatccgccagcagcagcagcagcagatcctgcgccagcagcagcagcagcagcagcagcagcagcaacaacagcaacagcaacagcagcagcaacagcagcagcagcagcaacatcagcagcagcagcagcagcaggcggcacctcctcaaccacagccgcaatctcagccacagttccagaggcagggcctgcagcagacccagcagcagcagcagacggcagctttagttaggcagctgcagcagcagctgagcaatactcagccgcagcccagcactaatatttttggcaggtacta

SEQ ID NO: 229793 - DNA, 6530 bp, Artificial Sequence
  Description of Artificial Sequence: Synthetic coding sequence
atggcggcttttgggattctttcctatgagcatcgcccactcaaaaggccacgcctgggaccacccgacgtgtatccccaagatcccaaacagaaggaggatgagctgaccgcccttaacgtgaaacagggattcaacaatcagcctgccgtcagcggtgatgagcatggtagcgccaaaaacgtatcatttaatcccgcaaagatctcctccaatttttcaagcattatcgcagagaagcttcgctgtaatacactgccggacaccggacggaggaagccacaggtcaatcagaaagacaatttctggttggtcactgccagatcccagtcggctataaatacctggtttacggacttggcaggaactaaacccctgacccagctggcgaagaaagtcccaattttcagcaaaaaagaagaggtgttcggatacctggccaagtacacagtgcccgttatgagagccgcatggttgattaagatgacttgcgcttactatgctgcaatctccgagaccaaagtgaagaagcgccatgtggacccgtttatggagtggacccagattataactaagtatctttgggagcagctccagaaaatggcggaatactataggcccggtcccgcagggagcgggggttgtggaagcacaatcgggcctctcccccatgatgtggaggtcgccataagacaatgggattacactgagaaactggcgatgtttatgttccaagacggtatgctggaccgccacgaattcctgacatgggtcctcgaatgtttcgagaaaatcaggcctggcgaggatgagctactcaagctcctgttgccccttttactaagatatagtggcgaattcgttcagagcgcttacctctctaggcgcctcgcatacttttgtactcgcagactggccctccagctcgatggagtaagcagccattcctcacatgtgatctccgcccagtccacctccactttgcccacaacccctgcccctcagccaccaacctcctctacccctagcacccccttcagtgacctgctgatgtgccctcagcatcggcctctggtctttgggctttcgtgtatcctccaaacgattctcctgtgctgcccaagcgcactagtgtggcactattctctcacagacagcagaataaaaacaggtagccctctggatcacttgccaatcgccccttcgaacctgccaatgcctgagggaaatagcgcattcacccaacaagtccgggctaaactgagagagattgaacagcagatcaaggaacgcggtcaggccgttgaggttagatggagcttcgacaagtgtcaagaagccactgcaggcttcactattgggcgtgtcctccacactctcgaggtcttggactctcatagcttcgaacgaagtgacttctccaattccctagattcgctgtgtaatcggattttcggactggggccatcgaaagacgggcatgaaattagttcagacgacgatgccgtggtgtccctgctgtgtgaatgggccgtgagctgtaagcggtccggaaggcatagggcaatggtggtggccaagctcctggagaagagacaggctgaaatcgaggccgagcggtgcggagagtctgaagccgctgatgaaaaaggaagtatcgctagcggttctctgagcgcaccttcagctcctattttccaggacgtgctcttacagttcctggacacccaggcacctatgttgacagacccccgatctgaatccgagcgcgtggaattttttaatcttgtgctgctgttctgtgagcttatccggcacgacgttttttcccataatatgtatacctgcaccctcatttctagaggggaccttgctttcggtgctccaggccctagacctccttccccattcgatgatcccgcagacgatccggaacacaaggaagcagaggggtcatcttcgtctaagctcgaggatcccggactgagtgagagtatggacattgacccctctagtagcgtgctgttcgaggacatggagaaaccagactttagcctgttctcacccacaatgccttgcgagggcaaaggttcaccttctcctgagaagcctgatgtagaaaaagaagtgaaacctcctcctaaagaaaaaatcgaaggtaccctcggtgtgctgtacgatcagcctcgccacgtgcagtacgctactcacttccccatccctcaggaagaaagctgtagtcacgagtgtaaccaaagactggtggttctttttggagtcggcaagcagagagacgacgcaagacacgcaattaaaaagattacaaaagacatcctgaaggtactaaatagaaaaggcactgctgagacagatcagctggctcccattgtgcctctgaacccgggtgacttaacattcctagggggagaggacggtcagaagcgacgtcgcaatagacctgaagcctttcccacggccgaagacatctttgccaaatttcagcacctctcacactacgaccagcaccaggtcactgctcaggtcagccggaatgtacttgagcagatcacgagtttcgccctgggaatgagttaccatctcccattagtccagcatgtgcagtttatctttgacctgatggagtattccctcagcatcagcggtttgatcgattttgccattcagctgcttaacgagttaagcgttgtggaagccgaacttctgctcaaatcatctgatctcgtaggtagttatacgacaagtctgtgtctctgcatcgtggccgtgctgaggcactaccatgcctgcctcatactcaaccaggaccagatggcacaagtattcgaggggctgtgcggcgtggttaagcatggaatgaaccgtagcgatggtagcagcgcagagcgctgcattctcgcctatctttatgatctatatacctcttgtagccacttaaaaaacaagtttggcgagctgttctctgacttctgttccaaagtcaagaacactatctattgtaatgttgaaccttccgagtctaatatgcggtgggctcccgaattcatgattgacacccttgaaaacccggcagctcatactttcacgtacactggtctcgggaagtctctcagcgagaaccccgctaatagatattcattcgtgtgtaacgcattaatgcacgtctgtgtcgggcaccacgatcccgaccgcgtaaacgacatcgctattctgtgtgcggagttgactggctattgcaagagtctgagcgccgagtggcttggcgtcctaaaggccctttgttgctctagcaacaatggtacgtgcggctttaatgatttgctctgtaatgtggacgtgtcagacttgagcttccatgacagcctggccacctttgtcgcaattttaatcgcacggcagtgcctgcttctggaggatctaattaggtgtgccgctataccttcacttctgaacgcagcatgctccgagcaagattccgagcctggagcccgactaacctgccgaatcctgctccatctattcaagactccacaattaaacccttgccagagtgatggaaacaagcctacagtcggaatacggtcttcttgtgaccgccatctgctggctgctagtcaaaaccggattgtggacggagctgtgttcgctgtcctaaaggctgttttcgtcctgggcgatgccgagttgaaaggcagcgggttcactgtaactggtggcacggaagagttgcccgaggaggaaggcggaggcggtagcggcggaaggcggcaggggggtcggaatatcagcgtcgaaactgctagcctcgatgtgtatgccaaatacgtgttaagatccatctgtcagcaggagtgggtcggcgaacgctgcttaaagagcctttgtgaggattccaatgatcttcaagatccggtcctgagtagcgcacaagctcagcgattaatgcagctgatatgctatccccatcggctcctggacaatgaggacggagagaaccctcagcggcagagaattaagaggatcctccagaacttggaccaatggactatgagacagagttcactcgaactgcagttgatgattaagcagactccgaataacgagatgaactccctgctggagaatattgccaaggccaccattgaagtctttcagcagtcagccgaaacaggctcgtctagtgggtcaaccgcctccaatatgcccagtagctctaagacaaaaccagtgctgagctctcttgaaaggagtggggtatggctcgtcgcacccctgatagcaaagctgccgacgagcgtgcaagggcatgtactgaaggcagcaggagaggaactggaaaaaggacagcacctcgggtcgtcctcacgtaaggaaagggaccgacagaagcaaaagagcatgagcctgctcagccagcagcccttcctatccctggtgctaacctgcctcaagggccaggatgaacagagagaaggtctcctaacttcactatactctcaggtgcaccagatagtgaataactggcgcgatgaccagtatctggacgattgtaaacctaagcagcttatgcacgaagccctgaagcttcgtcttaacctggtgggaggcatgtttgacactgtccagagaagcacacagcagacaactgaatgggcaatgctgttattggaaattataatctcaggaactgtagatatgcagtctaacaatgaactgttcaccaccgtcctggacatgctttctgtgcttattaatggaactctggcagctgacatgagttcaatctctcaggggtcaatggaagagaataagcgtgcttatatgaatctggctaagaaacttcagaaggaactgggtgagcgacagtcagattccctcgagaaggttcgccagctcctcccattaccaaagcaaactagagatgtgatcacctgtgaaccacaggggtccttgatcgatacaaagggtaacaagatcgccggttttgactcgatcttcaagaaggaaggcctccaggtatcaactaagcagaagatcagtccttgggacctcttcgaaggcttaaaacccagcgcccctctgtcttggggctggtttgggaccgtgagggttgatcggagggtagccagaggcgaagagcaacagcgacttcttctgtaccatacgcacctgagacccaggccgagagcatactacctggagccccttccactgccacccgaggacgaagagcctcctgctccgactctgctggaaccggaaaagaaagccccagagccgccaaagacggataaacctggcgctgcacctcccagcactgaagaacgaaagaagaaaagcaccaaagggaaaaagaggtcccagccagccacaaaaactgaggactacggcatggggcctggccgatctgggccatacggtgtcacagtaccaccagacctcctgcaccacccaaacccaggatctatcacccatcttaactaccgccagggcagtatcgggttatacacacagaatcagcctctaccagccggtgggcctagggtagatccgtacagacctgttcgtttgcccatgcagaaactgccgactcgcccaacctaccctggcgttctgcccacgaccatgaccggtgtgatgggacttgagccatcttcatacaagacaagcgtgtatcgtcagcagcagccagccgtcccgcagggtcagcgcctgcggcagcaattgcagagccaagggatgctgggacaaagcagcgtacatcagatgaccccctccagctcttacgggcttcaaacatctcagggctacaccccctatgtctcccacgtgggcctccagcaacacaccggacccgctggaacaatggtaccaccgtcatactcgtcccagccctatcagtccacccacccctcgaccaatcctacactggtggacccaacgcggcacctgcagcaaagaccttcaggttatgtgcaccagcaagctcctacgtacggccacggcctgacttctacacagcgattcagtcaccaaacactccagcaaactcccatgatctccacaatgacccctatgtccgcgcagggagtgcaagctggagtgagatccacggcgatcctccccgagcagcagcaacagcaacagcagcagcagcaacagcagcagcagcagcagcagcagcagcagcaacagcaacagcaacagtaccatatccggcagcagcagcagcagcaaattctgcgccagcaacaacagcaacaacagcagcagcagcagcaacaacagcagcagcagcagcagcagcagcagcagcagcagcaacaccagcagcagcaacagcaacaggccgcaccccctcagccgcagccccaatctcaaccacagttccaacggcaaggtctgcagcagacccaacaacagcagcagacagctgccttagtacggcagctgcagcagcagctcagcaacacccagccgcaaccctccaccaacatcttcggaaggtacta

SEQ ID NO: 229794 - DNA, 393 bp, Artificial Sequence
  Description of Artificial Sequence: Synthetic coding sequence
tgaaccccgaacaggagacgaaaaaaacagctaaatgctgccttcctgccccaagacgagctgacggccctgaacgtaaagcagggctttaacaaccaacccgcagtgtcaggcgacgaacacgggtcggcgaagaatgttagtttcaatccagccaaaatttcttctaacttttcctctataattgcagaaaagctccggtgtaacaccttaccagacaccggacgtagaaagccgcaggtgaatcagaaagacaacttctggcttgtcacggcacggtcccaatcggcgataaacacttggtttactgacctggctggtaccaagccattgactcaactggccaagaaggtgccgatttttagtaaaaaggaggaagttttcggttactag

SEQ ID NO: 229795 - DNA, 6383 bp, Artificial Sequence
  Description of Artificial Sequence: Synthetic coding sequence
gaagacgaattgactgccctgaatgttaaacagggcttcaacaatcagcccgcagttagtggcgacgagcacggttctgctaaaaatgtttctttcaatcccgcaaaaatcagcagcaacttttctagcattattgctgaaaaactgcgatgtaacacactgccagacactgggaggcgcaaaccccaggttaatcagaaggacaatttttggttggtcactgctcggtcccagtctgccattaatacgtggttcactgacctggcaggtacaaaaccattaacgcagcttgcgaaaaaggtgcctatttttagtaagaaagaggaggttttcggctacctagcaaaatataccgtccctgtgatgcgagctgcatggttgatcaaaatgacctgcgcctactatgccgcaatctcagaaactaaagtaaagaagcggcacgttgatccctttatggaatggacgcagattatcactaaatatctgtgggaacagctgcagaagatggctgaatactacaggccaggccctgccggtagtggagggtgcggctcgaccatcgggcctctcccccatgatgtggaagtcgcaatccgacagtgggactatactgaaaagctggccatgtttatgtttcaggacggcatgttggacaggcacgaatttcttacttgggttctggagtgcttcgagaaaattaggccaggggaagatgaactgctgaagctattgctgccattgctgctccgttactccggggaatttgttcagagtgcctacctctcaagacgcctggcgtatttctgcacacgcagattggctctccagctagacggcgtgtcatctcactcctcccacgtgatttcggctcagagcacttctacccttcccaccacacccgcaccacaaccccctacatcttccaccccgtcgacaccatttagcgatctgctgatgtgtcctcagcatcggcctctggtgtttggcctcagctgcatccttcaaacgatcttgttgtgttgcccctccgccctggtatggcattactctttaactgattcccggataaagaccggtagtcctcttgaccacctccctattgcccctagcaatctcccaatgcctgagggcaatagcgcctttacacagcaggttcgggcaaagcttagagaaatcgaacaacaaattaaggagagaggccaggcagttgaagttcggtggagctttgataagtgccaggaggcaacggccggattcaccattggtagagtcctgcacacactcgaggtcttggactctcattctttcgagaggagcgacttttccaattcactcgacagtctttgcaacagaatattcggtctcggaccgtctaaggatggccatgagatttcaagtgacgatgacgccgtggtttcacttctctgcgagtgggcagtgtcctgcaaacggtctggtcgccaccgggctatggtggtggcgaagctcctcgagaagcgccaagctgagattgaagctgaacggtgcggcgagtctgaagctgcagacgagaaaggcagcattgcctccgggtccctgagcgcaccttctgctcctattttccaggatgtcctgctccagtttttggatacccaggcacccatgttaacagatccacgctcggagtccgagagagtggaattttttaatctggtgcttttattttgtgaattgatccggcatgacgtgttcagtcacaacatgtacacttgtacacttattagcagaggagacctcgcttttggagcacccggtcccaggcccccttccccttttgacgaccccgctgatgaccctgagcacaaagaagccgaaggatcctcctccagcaagctggaggatccaggtctgtccgagagcatggacatcgatccctctagcagcgtgcttttcgaagatatggaaaagccagacttttccctgttcagtcctacaatgccctgtgagggaaagggcagcccctccccagaaaaacccgacgtggaaaaggaggtgaaaccaccccctaaagaaaagattgagggaacgctgggggtattgtatgaccaaccccgtcacgtacaatatgccacacactttccgatcccccaagaggagtcatgctcccacgagtgcaatcaacgcctggtagtactttttggtgttggtaagcagagagacgacgcacgtcacgccataaagaagataacgaaagacattctcaaagtgctgaaccggaagggaaccgccgagaccgatcagctggccccaatagtgccgttgaacccaggagatctgacctttttagggggtgaggatggacagaagcggcgtcggaatagaccagaagcattccccacagctgaagacatcttcgccaaatttcaacatctgagccactatgaccaacaccaggtgacggcgcaagtgtctcgcaatgttcttgaacagattacaagcttcgcactggggatgtcataccatcttcctctggttcagcatgttcagtttatcttcgatcttatggagtatagcctctcaatttctgggctgattgacttcgccatccagctacttaatgagctctccgtcgttgaggccgagcttctgcttaagagttccgacctcgtgggttcttacaccacatccctgtgcctatgcatcgtagcagtgctgaggcattaccacgcatgcttgattctgaatcaggaccagatggcccaagtttttgagggactctgcggagtggtcaaacacggaatgaacagatctgacggaagcagtgccgaaaggtgcatcctagcatacctgtatgacctgtacacctcctgcagtcatcttaagaacaaattcggtgagttgttttccgacttctgctccaaagtgaagaacactatttactgcaacgtcgagcccagtgaatctaacatgcggtgggccccagagttcatgatcgacacattggaaaatcctgcggctcatacctttacctacacgggcctgggtaagtcgctatcagagaatcccgcaaacaggtactcgtttgtgtgtaatgccctcatgcatgtttgcgttggacatcacgatcctgatcgggtcaatgacattgccattctgtgcgcagagctcaccgggtactgcaagagtctctcagccgagtggttaggcgtgcttaaagctttgtgctgttcttccaacaatggtacctgcggttttaatgatttgctgtgcaacgtggacgtgagcgatttgagctttcacgacagtcttgccacctttgtggctatcctgatcgcgagacagtgccttttgctggaggacttgatccggtgtgcagcgataccgtccttgttaaatgcagcgtgttcagaacaggactccgagcccggagctcgactgacctgtcgcattctgctgcacctgtttaagactccacaattgaatccatgccaatcggacggtaacaaaccaaccgtagggatcaggagcagctgcgaccgccacctcctggctgcatcacagaatagaattgtggacggcgcagtctttgccgtgctgaaggcagtatttgtcttgggagacgcggagttaaaaggaagtgggtttacagttacagggggtactgaggaactgcccgaggaagagggcggtggtggatcaggaggcagaaggcagggcggaagaaatataagcgtcgagactgcttcccttgacgtttacgctaaatatgtgctccgatcaatctgtcagcaggaatgggtgggggagaggtgtctgaaaagcctgtgcgaagattcaaatgatctccaggacccggtactgtcttccgcccaagctcagcggctgatgcaattaatctgctaccctcaccgactgctggacaatgaggacggagaaaatccacagcgccagaggattaaaagaatactacagaacctggaccagtggaccatgaggcagagctccctcgagctgcagctgatgattaagcagacccccaataacgagatgaatagtctgctggaaaacatcgcaaaagccaccattgaagtcttccagcagagtgctgagacaggaagctcatccggcagtactgccagtaacatgccctcctcttcaaaaacgaagcccgtcctctcatctctagagcgttcgggagtgtggttggtagctcccctgattgccaaactgcccacctctgtgcagggccacgtcctcaaggccgcaggggaggagctcgaaaaaggccagcacctggggtccagctcccggaaagagagggataggcagaagcagaaatcaatgtctttactctcccagcagccttttctcagcctggtgctgacatgtctgaaggggcaagacgagcaaagagagggccttctcacttctctctactctcaggtgcaccagatcgtcaacaattggcgcgatgaccagtacctggacgattgcaagccgaagcaacttatgcacgaagccttaaaacttcggctaaacctcgtgggaggtatgtttgacaccgtgcagcgctccacacaacagacgactgaatgggccatgctcctgctggaaattattatatccggcactgtggatatgcagtctaataatgaactctttaccactgttctggatatgttgtcagtgcttatcaacggtactcttgcggcagacatgagtagtatttcccagggaagcatggaagaaaacaaacgggcatatatgaatctggcgaagaagcttcagaaggagctcggggagcgccagtctgatagcctggaaaaggtgcggcagctgttgccattaccaaagcaaacacgggatgtcatcacctgtgagcctcagggttccttgatcgacactaaaggtaataaaatagcgggatttgattcaatttttaagaaagagggtctgcaggtctcgacaaagcagaagatcagtccatgggatctgtttgaaggcttgaagccatcagcccctttaagttgggggtggtttggtactgtccgagtagatcggcgagtcgccaggggggaagaacaacagcgactgctcttataccatacgcacttgcgccctcggcctcgcgcttactacctggagcctctgccactgccacctgaagatgaggagcccccagccccaacactgctcgaaccagagaaaaaggcgccagagcctcctaagacagataagccaggagccgctcctcccagcaccgaggaacgcaaaaagaagtccacgaaagggaagaagcgcagtcaaccagcaaccaagaccgaagattatggaatgggacctgggagatccgggccttatggcgtgactgttccgcctgatttacttcaccacccaaaccccggaagcataactcatctcaactaccgacagggaagcattggcttgtacacccagaaccagcccctgcctgctgggggtcctagggtggatccataccgtccagttcgccttcctatgcagaagctgcctacccggcctacatatcccggtgtgttgccgaccacaatgaccggcgtaatgggactggaaccttcttcctacaagacgtccgtgtatcgccagcagcaacccgctgtaccacagggacagcgcctacgccagcagctgcaacaaagtcagggaatgttagggcaatcctctgtgcaccagatgacaccctcgtctagctacgggctgcaaacttctcagctgtcccccagctccctgcagggctacacaccttatgtttcacacgtgggattgcagcagcataccggaccagcagatcctacccggcatctgcagcaacgcccttcgggttatgtacatcagcaggctccaacgtatggccacggactgacatcgacacaaaggttttcacatcagaccctgcaacaaacacccatgatctctacaatgacacctatgtcagcccagggggtgcaggccggtgtgcgatctactgctatcctgcccgagcagcagcagcagcagcagcagcagcaacagcaacagcagcaacagcaacagcaacaacagcagcagcagcagcaacagtatcacattcgacagcaacagcagcagcaaattctccgccagcagcaacagcagcagcagcagcagcagcagcagcagcaacagcagcagcagcagcagcaacagcagcagcaacagcaccagcagcagcaacaacagcaggctgcgccaccacagccccaacctcaatcccaaccgcagttccagagacagggcctgcaacagacacagcagcagcagcagaccgcagcattagttaggcagctgcagcagcagctctcaaatactcagccccaaccttcgacaaacatttttggccgatacta

SEQ ID NO: 229796 - DNA, 2778 bp, Artificial Sequence
  Description of Artificial Sequence: Synthetic coding sequence
ggtgggagtgggggaagaaggcagggcggacgcaacatatctgttgaaactgccagtttggacgtttacgctaagtacgtgctgagatctatatgccagcaggaatgggtgggcgagaggtgtctaaagagtctgtgcgaggattcaaacgatctacaggacccagtccttagttcagcccaagcccagcggttgatgcagctgatttgttatccacaccgcttactggacaacgaggacggggaaaatccacagcgccagagaatcaagaggatccttcagaatctcgaccagtggacgatgcgacaaagttcccttgaactgcagttgatgattaagcaaactcctaataacgagatgaactctcttctcgagaacatcgccaaggctaccattgaggttttccaacagagcgccgagactggctcaagctctggcagtacagcgtcaaacatgccgtcttcctctaagacaaagcccgtgcttagcagcctggaaaggagcggggtgtggctggttgctcctttaatcgccaagctgcccaccagcgtgcagggtcacgtgctgaaggctgcgggagaggaactggagaaaggacagcatctcggttcttcctctcgcaaagagcgggaccgccagaagcagaagtccatgtcgctgctatcgcaacagccttttctttcattggtgctcacctgcctgaagggccaagatgagcaacgggagggcctgctgacctcactttattcacaagtccatcagattgtcaataattggcgggatgaccagtaccttgacgattgtaagccaaagcagctcatgcacgaggctctgaaactccgactgaatctggtgggaggaatgttcgatactgtccagagatcgacccagcagaccaccgaatgggctatgttgttgctggagattatcatatccggcactgttgatatgcagtccaataatgaactcttcacaaccgtcctcgacatgctgagtgtcttgatcaatggaaccctggctgcagatatgtcttcaatctctcagggctctatggaggaaaataagagagcctatatgaacctggcaaagaaactccaaaaggaactgggggaacgccagagcgactccttggaaaaagtgaggcagttattgccactgcccaagcagacacgtgacgtcattacctgtgaacctcagggtagccttatcgatactaagggaaataaaattgccggtttcgacagtatcttcaagaaagaaggcttgcaggtgagtacaaaacaaaagatctctccatgggatctgttcgagggacttaagccatctgctcccctctcatggggctggttcggcaccgtaagggtagacagaagagtggcaagaggagaagagcagcagcggctgctcttgtaccacacacacctcagacccagaccacgcgcttattatctggagcctcttcctctgccaccagaggatgaagagcctcccgctcctacactactcgaacctgaaaaaaaggccccagaacccccaaagactgacaagcccggagcagccccaccctctaccgaggagaggaagaagaaatccaccaaaggcaagaagcgtagccagcctgcgactaagactgaggattatgggatggggcctggacgatccggcccatatggcgtgacagtgcctcccgacctgctgcatcatcccaaccccggttccatcacccacttaaattaccgacaaggtagcattgggctctatacacaaaatcaacctctgcccgcaggtggaccccgtgtagacccatatagaccagtgagactgcccatgcagaaattgcctactcggccaacttaccctggcgtattgcccacgacaatgaccggagttatgggccttgagccctcatcctacaaaacatcggtgtatcgacaacagcagccagccgtaccgcaagggcaacgcctgcgtcagcagttgcaggcgaagattcagtctcaagggatgctgggccagtcctccgtgcaccagatgacccccagcagctcttacggtcttcaaaccagccaggggtataccccttatgtatcccacgtgggcctgcagcagcacacaggacccgcaggcacgatggtgccaccaagctactccagccagccttaccagtcgactcacccatccacaaaccctactctcgtggatcccacacgacatctccagcagcggcctagcggctacgtgcaccaacaggctccgacttatggtcacggattgacaagtacacagcgattttcccatcaaacgctacagcaaacccctatgatcagcactatgacgccaatgagtgcccaaggggttcaagctggagtgagatcgaccgcgatcttacccgagcagcaacagcagcagcagcagcagcagcagcagcagcagcagcagcagcaacaacagcagcaacagcagcagcagcagtatcacatacgccagcagcaacagcagcagattttgagacaacagcagcagcagcagcaacagcagcagcagcaacagcagcagcagcagcaacagcagcagcagcagcagcaacagcatcagcaacagcagcaacagcaagcagctccgccacagccacagcctcaaagtcagccccagttccagcgccagggcctccaacaaacacaacagcagcaacagacggcagctcttgtgcgtcagctgcagcagcagctctctaatacacagcctcagccttccacaaacatatttggccgatattag

SEQ ID NO: 229797 - DNA, 756 bp, Artificial Sequence
  Description of Artificial Sequence: Synthetic coding sequence
taggaaagaaaaaagaaaagtacaaagggtaagaaacgtagccagccggcaactaaaactgaggattacggcatgggcccaggcagatctggtccttatggagtcaccgtgcccccagacttattgcaccatccaaatccaggatcaatcacccatctgaactatcgccagggcagtatcggcttgtacactcagaatcagcccctgcctgcaggtggccctcgggtggatccctaccgaccggtgaggttacccatgcagaaacttcctaccaggcctacctacccaggggtcctgcctactacaatgacaggagtcatgggcctggaaccgtcgtcttataagactagcgtctataggcaacaacaaccggctgtccctcagggacagagattgcgccaacagctacagcagagccaggggatgctggggcagagcagcgtacatcagatgacaccgtccagctcgtatggactgcagacgagtcagggctatactccctacgttagccatgtagggcttcagcagcacaccggaccagccgatcccacccggcacctccagcagaggccttctgggtatgtccatcagcaggcgcctacatatggacatggactgacaagtacccagcgcttttctcaccagacactgcagcaaaccccaatgattagtaccatgaccccgatgtccgcccagggcgtgcaagccggagtgcgatccacggccatcctgccagaacaacagcagcaacagtag

SEQ ID NO: 229798 - DNA, 6002 bp, Artificial Sequence
  Description of Artificial Sequence: Synthetic coding sequence
atggctgcattcggcatcctgagctacgaacataggcccctgaaacgccctaggcttggcccacccgatgtatacccacaggaccccaaacagaaggaggacgaactgacagccctcaatgtgaagcagggatttaacaatcaacccgcagtgagtggtgatgagcacggctctgcaaaaaatgtctcgttcaatcctgcaaagatctcatccaatttttcttctattatagcggaaaagctgaggtgcaacaccctgcctgacacaggacggagaaaacctcaggttaatcagaaggacaacttctggctggtaaccgcacgctcacagtccgccatcaatacatggttcaccgacctggcaggaaccaagcccctaacccaacttgccaaaaaagttccgatattcagtaagaaggaggaggtcttcggctatctggccaagtatactgtacctgtcatgagagcggcttggctaatcaagatgacatgtgcttactatgccgcaataagtgagactaaggtaaagaagcggcacgttgaccctttcatggaatggacccagattattaccaaatatctctgggagcagctgcagaaaatggccgagtattaccgccctggcccagcgggaagcggaggttgcggcagcacaataggacctctcccacatgacgtggaggttgcaatcagacagtgggattatacagaaaagttggcgatgtttatgttccaagacggaatgctggatcgtcacgaatttttgacctgggtcctcgagtgcttcgagaagatcagacccggtgaggacgagctcctgaagttactgctccctctgcttttgagatactctggcgagtttgttcagtccgcatatttgagcaggaggctggcttacttctgcacgcgcagactcgctctgcagctggatggcgtatcctcccactcatcacacgttatctccgcccagtcaacctcaactctccccacgacaccagcccctcagcctcccacgtcctcaacccctagcacaccttttagcgacctccttatgtgtccacagcatagacctctcgtgtttggtttatcttgcattctgcagaccatcctgctatgctgtccttcggccctggtatggcactacagcctcactgattctagaatcaagaccggtagtcctctggatcacctccctatcgctccgagcaacttgccaatgccagaaggcaatagcgcgtttacacagcaggtgagggcaaagttacgcgagatcgagcagcagatcaaagaacggggtcaagccgtggaggtgcgttggtcgtttgacaaatgccaggaggccacagctggtttcacaattgggagggtgctccacacactggaggtcttggactcacattcctttgagagaagtgacttctcaaattccttggattccttatgcaatcgtatctttgggcttggcccatccaaggacggccatgaaattagttctgacgacgacgccgtggtctccctgctctgtgagtgggctgtttcttgtaagcgaagtggcaggcacagggccatggtggtggctaagcttctcgaaaagcgtcaagccgaaatcgaggctgaaagatgtggagagtcagaagccgcagacgaaaaggggagtatagctagcggctccctgtctgccccatccgcaccaatctttcaggatgtcctgctgcagtttctggatacacaggcaccaatgcttacagatcctagatctgaatccgagagggtggaattcttcaacttggtgctcctcttctgtgagttgataaggcacgacgtttttagccacaatatgtatacttgtactctcatctctagaggcgatctcgctttcggcgcaccaggcccacgccctccctctccctttgatgacccggctgatgatcccgaacataaggaggcggaaggatcatcatccagcaaacttgaggatccaggtctctctgaaagtatggatattgacccaagcagcagcgttctgtttgaagatatggagaaacccgacttttctctttttagcccaactatgccttgtgaagggaaaggtagtccatcccccgaaaagccggacgtggagaaagaagtgaagcctcctcccaaagaaaagattgaaggtacccttggagtgctgtacgatcagccaaggcacgtgcaatacgcgacccacttcccaataccgcaggaagagtcttgttctcacgaatgtaatcagcgcctcgtggtgttattcggagtaggtaaacagagagacgatgcccgacatgctatcaaaaagataacaaaggatattctaaaggtgctgaacaggaagggcaccgccgaaactgaccagctggcaccgatcgtgccgttgaatcctggcgacctcacgttccttgggggagaagatgggcagaagcggagaagaaatcggccagaagccttcccaaccgccgaggatatatttgccaagttccagcacctgtctcactacgaccagcaccaggtgacagctcaggtgtccaggaatgtgctggaacagatcacatctttcgctctcggcatgtcttatcatctaccactggtgcaacacgtacagtttattttcgaccttatggagtatagtctatctatctccggcttgatagactttgctatccagctgcttaacgagctgagcgtggttgaggcagagctcctcctcaaaagctcagatctggttgggtcctatactaccagtttgtgtctgtgcatcgtggcagtgctcagacactaccatgcctgtctgatattaaatcaggaccagatggctcaggtctttgagggcctgtgcggggttgtgaagcacggaatgaacagaagtgacgggtcctccgccgaaagatgtatactagcttacttatacgacctctatacaagttgttctcacttgaagaacaaatttggcgaactcttctcagatttctgttccaaggttaagaatacgatatattgtaacgtggagcctagtgaatcgaatatgagatgggctccggagttcatgattgatacattggaaaacccagccgctcacaccttcacatatacaggcctcggcaaatcactttctgagaatccagccaataggtattcctttgtctgcaacgctctaatgcacgtctgcgtagggcaccacgatcctgaccgcgtgaacgacatcgcaatattatgcgccgaactgactgggtactgtaagagcctctctgccgagtggctaggggtcttgaaagccctatgctgtagctctaacaacggtacttgcggatttaatgacctcctttgtaatgttgatgtaagcgatttgtcattccatgatagtctggcaacctttgttgcgatcctgattgctagacaatgtctgctgctcgaagatctgatcagatgtgcggctataccgagcctgttgaacgccgcttgttcagagcaagattccgaacccggagcaagactgacctgtcgcatactgttacatcttttcaagaccccgcagttaaatccttgccagagtgacggaaacaaacccactgtgggaatcaggtcctcctgtgaccgacaccttctcgcggcaagccagaacaggatcgtggatggcgcagtattcgcagtgctaaaggctgtcttcgttctgggggacgcagagctgaagggctctggctttacagtgaccggaggcacggaggagttgcccgaagaagagggcggaggtggctcaggaggacgcaggcaggggggtagaaacatttccgtagagaccgccagtttggacgtctatgcaaaatatgtgttaagaagcatttgtcagcaagaatgggtaggggagaggtgccttaagtctctatgcgaagatagcaatgacttgcaggaccccgtgctatcttccgcccaagcacagcggctgatgcagctgatctgctatccccatagattgttggacaatgaggacggggaaaacccccaacggcagcgtattaaacgaatcctgcagaacctggaccagtggaccatgagacagtcttctctggaactgcagctgatgatcaagcagactcctaataacgagatgaattccttactcgaaaatatagcaaaggccaccatcgaggtgttccagcaatccgctgaaactggcagcagcagcggatccacggcaagcaacatgccttcatctagcaagaccaagcccgttctgagcagcctcgagcggtctggtgtctggctggtggctcctctgatagcgaagctgcccacaagcgtccaaggccacgtgcttaaggccgctggggaggaactggagaagggccagcaccttggatcctcaagtcggaaagaaagggaccggcaaaaacagaagtcaatgagccttttgagccagcagcccttcctgagcctcgtgctgacttgcctcaaggggcaggacgaacagagagaagggctgctgacatcactatacagtcaggtgcaccagatagttaataattggcgggatgatcagtatctggacgattgcaaacctaaacagctgatgcacgaagccctcaagttacgtctcaatttagtcggaggaatgttcgacactgtgcaacgcagcacccagcaaacgaccgaatgggctatgctccttcttgaaatcattatctctggcactgtggatatgcagtcaaataacgaactgttcaccaccgtgttggatatgctgagtgtcctgatcaatggcactctcgccgctgacatgtcctctatctctcagggatctatggaagaaaacaagcgcgcatacatgaacctggcaaaaaagctgcagaaggaactcggcgagcggcagtccgattctctggaaaaagtgcgacaactcctgccactacctaaacaaacaagggatgtgatcacttgcgagccccagggatccctcatcgacactaagggtaataaaatagcgggattcgattctatttttaagaaggaaggcctacaggtgagcaccaaacagaaaattagcccatgggacttatttgagggccttaagcctagcgccccactgtcatgggggtggtttggcacggtcagggttgataggcgtgtcgcacggggtgaggagcagcagaggttactgctataccacacccatcttaggccacggccacgcgcttattatctggagcccctgccccttcctcccgaggacgaagagccccctgccccaacactgctggagcctgagaaaaaggccccagagcccccaaaaacagacaaaccaggtgccgctcctcccagcaccgaagaaaggaaaaaaaagagcacaaaggggaagaagaggagccagcctgccactaagacagaggactacggaatgggtcccggacgttctggcccatacggagtgacagtccctccagacttactgcatcatccaaatcctgggagcattacgcacttaaactatagacaaggaagcatcgggttgtacacccagaatcaaccacttccggctggcggtccacgtgtggacccttaccggcctgttcgtctgccgatgcagaaattgcccactcgacccacttatccaggggtcctgcctacaaccatgactggtgtcatgggacttgaaccatcttcctacaagacaagcgtctacagacaacagcaacctgctgttccccaagggcagcgcctgcggcaacagttacagcagtctcagggaatgctgggtcaaagctccgtgcatcagatgacgccctcctcatcttacgggcttcaaacctcccagggatacaccccatacgtgagccacgttggtctgcagcagcacaccggcccagctgatcctacgcgccacctgcagcagcggccaagcggttatgtgcaccagcaggctccaacctatggtcacggcctcacaagcactcagtctttccacacccgccattgtagcagacaccccta

SEQ ID NO: 229799 - DNA, 2271 bp, Artificial Sequence
  Description of Artificial Sequence: Synthetic coding sequence
atggccgcttttggactattatcctatgaacagagacctcttaagcggccacgactgggccctccggatgtgtatccccaggatccaaaacagaaagaggatgagttgaccgctgtgaatgttaaacagggtttcaacaaccaacccgctttcacgggggatgagcatggcagcgcccgaaatatcgtgatcaaccctagtaaaataggagcctatttttcctcgatactggcagagaagctgaagctgaacacctttcaagatacaggaaagaaaaagccccaggtaaacgccaaagataactactggctggttaccgcgcgttcccaaagtgctattcactcatggtttagcgaccttgccggaaacaagcccctgtccattttagccaaaaaagtgcccatcttgtcaaagaaagaggacgtctttgcctacctggctaagtactccgtgcccatggtccgagcgacgtggctaattaagatgacctgcgcctactactcagctataagtgaggcgaagatcaagaagaggcaggccccagaccccaatctggaatggactcagatctctaccagatatctacgtgagcagctcgccaaaatctccgatttctaccatatggcgtccagcacaggcgatggtcccgtaccagtcccccctgaggtagaacaggcaatgaaacagtgggaatataacgagaaactggcctttcatatgttccaggagggtatgctggaaaaacatgagtatctgacatggattcttgacgtcctcgagaagatccgccctatggatgacgatttgttgaagttactactgcctcttatgctgcaatattccgacgagtttgttcagtctgcatacctcagtcggagattggcatatttttgtgctcgcaggctatctttactcctgagcgatagccctaacctgctggccgctcattctccgcacatgatgattggaccaaacaatagcagcatcggagcaccttccccaggcccacctggcccaggtatgtcaccagtgcaactagctttttccgactttctttcctgcgcccagcacggtcctctcgtgtacggtctttcttgtatgctccagaccgtgacattatgttgtccttccgctctggtctggaactatagtacgaacgaaaacaaaagtgccaaccccggaagccccctggacttgttacaggtcgcccctagttctcttccaatgcccggagggaataccgctttcaatcagcaggtgagggctcggatctacgaggtcgagcagcagattaaacagagaggtcgggcagtcgaagtgagatggagtttcgacaaatgtcaggagagcacagcgggtgtcactataagtcgtgtgctgcacacccttgaagtcctcgaccgacactgtttcgaccggacagactccagcaactccatggagaccctctaccataagattttttgggcaaatcaaaataaggataatcaggaggtggcccctaacgacgaagccgtggttacgcttctttgtgaatgggccgtcagctgtaagcgttccggtaaacaccgagccatggcagtggccaagttgctggagaagcgccaggcggaaatcgaagccgagagatgcggagaatcggaggtgcttgatgaaaaggaaagcatctcctccagttccttagcgggaagctcactgcctgttttccagaacgtcctgctgaggtttttagatacacaggcacctagtctgtcggatcctaacagcgaatgcgagaaagtcgagttcgtcaacttggtgctgttattctgtgaatttattagacacgacgttttctcccacgatgcttacatgtgcacactgatttcccggggtgatctgtccgtaactgcctcaaccagacctagatctccagtaggcgaaaatgccgacgaacactactctaaggaccatgatgttaagatggaagagcagagtatcatggctcacatgggcatagattctggaaccacgaacatcttcgacgaagtcgacaagtcagacttcaaaacagacttcgggagcgaattcccgattttttcccccatgcccggagaatcctgcgaaaatgcaaatacctcgctcggacgcaggatgtccgtcaactgcgaaaaactggtaaagagagaaaagccgcgagagctcatctttccatctaactacgacctgctaaggcacctccagtacgcaacacacttccccatccctctggtgtctcactgcttctcctag

SEQ ID NO: 229800 - DNA, 2166 bp, Artificial Sequence
  Description of Artificial Sequence: Synthetic coding sequence
atggcagcattcggtcttctgagttatgaacagaggcctttgaaacggcctagactcggtccccctgatgtgtacccccaggaccccaaacagaaggaagatgaactgaccgctgtgaatgtcaaacagggttttaacaaccagcccgcatttactggcgacgagcacgggtcagcgcgaaacattgtcatcaacccctcaaaaatcggcgcttacttcagctccatactggcggagaagctgaaattaaatacctttcaagacaccggcaaaaagaaacctcaagtaaacgcgaaggataactattggctggtaacagccagatctcagagtgccatccacagttggttctcagatctggccggaaacaaaccactctcaatactcgctaagaaagtgcctatcctgagcaaaaaggaggatgtcttcgcgtaccttgccaaatactctgtcccaatggttcgagccacctggctgattaagatgacttgcgcgtattactctgctataagtgaggcaaagatcaaaaagcgtcaagctcctgacccaaaccttgagtggacccagatttctacccgatatcttagagagcagctcgcaaagatctcggacttttaccacatggcttcctccacgggggacggtcccgtgcctgtgcctccagaggtggaacaggctatgaagcaatgggagtacaacgaaaaactggccttccacatgtttcaggaaggtatgctggaaaaacacgaatacctgacctggatcctggacgttcttgaaaaaattcgccctatggacgacgacctcctgaagctattactgccactaatgctgcagtactctgacgagtttgtccagtctgcctatttatcacgacgcctggcatacttttgtgcgcgtcgtctcagtctactcctcagcgacagccctaacctgcttgcggctcactcccctcatatgatgatcggcccaaataactcttcaattggggcaccctctcctggtcctcctggacctggcatgagtcccgtacagctagctttttcggatttcttgagctgcgcgcagcacggacccctggtgtacggcttgtcatgcatgttgcagaccgtcaccctgtgctgcccttccgctctggtgtggaattactcaacaaacgagaataagtctgcgaatccagggtctcccttggatctgctgcaggtcgctccttcatctttgccaatgccaggcggaaacacagccttcaaccagcaggtccgagcccgtatctacgaagtcgagcagcagatcaagcaacgcggacgggcagtggaagttaggtggtcttttgacaaatgccaggaaagcactgcgggtgtgacaatctctcgcgtgcttcatacactcgaggttttggacagacactgcttcgaccgcacggacagttcaaattcaatggaaactctgtatcataaaatattctgggccaaccagaataaggacaatcaggaggtggcgcctaatgacgaggcggttgttaccctcctgtgtgagtgggctgtgtcttgtaaacgcagcggcaagcacagagctatggccgtggcaaaacttttggaaaaaagacaggccgagattgaagccgaaagatgtggagagagcgaggttctggatgagaaagagtcaatttcctcttctagcctggctggatccagcttgcccgtgttccagaatgtactgttgcggttcctcgacacacaggcacccagtctgtctgatcccaactctgaatgtgagaaggtggagtttgtgaaccttgttctgcttttttgcgagtttattcggcacgatgtgttttcgcatgacgcctatatgtgcacactgatatccagaggggatctctccgtcaccgcaagcacaagaccacgcagtcctgtgggtgagaatgctgacgagcactactcaaaggaccacgacgtgaagatggagattttttcacccatgccgggtgaatcttgtgagaacgcaaacacctctctgggcaggagaatgtctgtgaattgcgaaaagctggttaagcgtgagaaacctcgcgagcttattttcccaagtaattatgatctactgaggcacctccagtacgctacccattttccgataccacttgtgagccactgcttttcatag

SEQ ID NO: 229801 - DNA, 6437 bp, Artificial Sequence
  Description of Artificial Sequence: Synthetic coding sequence
atggcggctttcggtctattgagttacgagcagaggcctctgaagcggcctagattaggccctcctgatgtttatccacaggatcctaagcagaaagaagacgagctgaccgccgtgaatgtcaagcagggcttcaataatcagcccgcattcacaggagatgagcacggctccgcgagaaacatcgttattaatccctcaaaaattggcgcatacttctccagtatcctagctgaaaaactcaaactgaacacattccaggacaccggcaagaagaaaccccaagtcaacgctaaggacaactactggctagtgaccgctcgttctcagtctgccatacactcctggttcagtgatcttgctggcaataagcccctctccattctggccaaaaaggtgccaatactgtctaagaaagaggacgtgtttgcttatctggccaaatatagtgtccccatggtgagagccacctggctgattaaaatgacttgtgcatactattccgcgatcagcgaggctaagatcaaaaaaaggcaagcgcctgacccgaatttggagtggactcagatatctactagatatctgagggaacagctggccaagatatcggatttttaccacatggcttcgtccactggagatggacccgttcccgtgccacccgaggttgagcaggccatgaaacagtgggagtataatgagaaactcgcctttcatatgtttcaggagggcatgctggagaagcatgagtaccttacctggattcttgatgtgctcgaaaagattcgacccatggatgacgatctcttgaagctgctgctaccactcatgctgcagtatagtgacgaatttgtccagagtgcataccttagcagaagactcgcatacttctgtgcaagacgactgtccctcttgctttccgatagtcctaatttactagctgctcacagcccacacatgatgattggacccaacaattcctctatcggggctcccagtcctggaccacctggcccaggaatgtctcctgtccagctagctttttcagacttcctttcttgtgcccagcacggccctctggtgtacggtctgagctgtatgctccagaccgtgactctatgctgtccctcggcgctagtgtggaattactctactaacgaaaacaagtcagccaatcccggatcccctctggacttactccaggtggcacctagtagcctccccatgcccggtggtaataccgccttcaaccagcaggtaagagccaggatctatgaggtggaacaacagatcaagcagagaggacgcgcagtggaggttcgctggtcctttgataagtgtcaggaatcaacagcaggcgtgacaatttcacgagtgctgcacacactcgaggtactggataggcactgttttgatagaacagatagctccaatagcatggaaacgctctaccacaagatcttctgggccaatcagaacaaagacaatcaggaagtggcccctaatgacgaggctgtggtgaccctcctttgtgaatgggccgtgagttgcaagcggtccggaaagcacagagccatggccgtagctaagctcttggaaaagcgtcaagctgagattgaggcagaacgctgcggggagagcgaagtgctcgatgagaaggagagcatctcgtctagctctctggccggttcaagtcttccggtcttccagaacgtccttctccggtttctcgatacgcaggctccatctctctccgacccaaatagtgagtgcgagaaggtggagtttgttaatctggtccttctcttctgcgaatttattcgccatgatgtgttttcccatgacgcttacatgtgtaccctgatcagtcgcggagatctgagtgttaccgcatctacccgcccaaggtctcctgtaggagagaacgccgatgagcactattctaaagaccatgacgttaaaatggaaattttctcaccaatgcctggcgagtcctgtgagaatgctaacacttcgttgggcaggcggatgtcggtgaattgtgaaaaacttgtgaagcgcgaaaagcccagggagctcatcttcccaagcaattacgaccttctgcgccaccttcagtacgctacgcacttccccattcctttagacgagtctagcagtcatgagtgcaaccaaagaaccatccttctctacggggtggggaaagaaagagatgaagcgcgacaccaactcaagaagatcacaaaagatatcctgaagatcctgaacaagaagtcaactactgagactggtgtgggcgacgagggacagaaagctcggaagaacaagcaggagacttttcccacccttgagaccgttttcaccaagctgcagttgctttcctacttcgatcagcaccaggtaactagccaaatttccaacaatgtgctcgaacagataacctcattcgccagtggcaccagctaccatcttcctctcgcgcaccacatccagctgatctttgatctcatggagccagcattaaacattaacgggttaattgactttgccatccagttactgaacgagctgtcagtcgtggaagccgagcttctcctgaagtcgtcctcgcttgctgggagctacactaccggcctgtgcgtatgtatcgtggcagtattgcgacgctatcactcatgtctgatcctgaaccccgatcagaccgcccaggtgtttgaaggactgtgcggagtcgtcaagcacgtcgtgaacccaagcgaatgttcatctccagagagatgcattctggcctatctatatgatctttatgtgtcctgctcccatctgaggtccaaattcggcgatctgttctcatcagcctgctccaaggtcaagcagacaatctacaacaacgtgatgccggctaactctaaccttcgctgggaccccgactttatgatggactttatagagaacccctccgctcgcagcatcaattactccatgctggggaaaatcctgagcgacaatgcagcaaatcggtattcatttgtgtgtaacacattgatgaatgtgtgtatggggcaccaagacgccggtcgtatcaacgacatcgccaatttttccagcgaactgactgcatgttgcacagtactgagcagcgagtggctcggcgtgcttaaagctctgtgctgcagtagtaatcatgtttggggcttcaatgacgtgctgtgcacagtggatgtgtccgatttatccttccacgattctctggctacctttattgccattcttatcgctcgtcaatgcttttcgcttgaagatgtggttcagcacgtagccctgccctccctgctcgcagcggcttgtggcgacgccgacgccgagccaggcgctaggatgacctgccgtctgctgcttcacctttttcgcgcaccacaggcctgcttcctgcctcaggcaaccggcaaaccttttcccggaatccgctctagctgtgatcgccacctgttggccgcagcacacaacagcatcgaggtgggcgctgtatttgctgttcttaaagctataatgatgctgggagatgctaagataggaaataactcagtgtcatccctgaagaacgacgattttaccatgagaggtttacgatgtgatggaaacgccgatgacatttggacagcctcccagaatccaaagagctgcggaaagtccatctcgatcgagaccgcaaacctccgagaatacgcacgttatgtgctgcggacgatctgccagcaggaatgggtgggcgagcactgcctaaaggaacccgagcggctctgtaccgacaaagagttgattctggaccccgttttgagtaatatgcaggcccagaaactgctgcaacttatttgttacccccatggaatcaaggagtgtactgagggggacaacctacagcggcaacatatcaagcgcatactccaaaatctagagcagtggaccctccggcagagctggttagaacttcagctgatgatcaaacagtgcctaaaagacccgggaagcggctccgtggcagagatgaacaatttgctcgacaacattgcgaaggcgacaatagaagtgttccaacagagcgccgaccttaataactcctccaactcaggtatgagcttgttcaaccctaacagtataggtagtgccgacacaagctcaacaagacaaaacggcattaagacttttttgtctagttcagagagaaggggcgtgtggctggtggcacctttaattgcccgattaccgactagtgtgcaggggagggtgcttaaagctgccggtgaggaactggagaagggtcagcacctggggtccagttctaagaaggagagggaccggcagaaacaaaagtcaatgtcacttctgtctcagcaaccattcctgagtctcgtcctcacctgccttaaaggtcaggacgaacagagagaaggcctattgactagcctccagaatcaagtcaaccaaatccttagtaactggagggaagaaagataccaagatgatatcaaagcacggcagatgatgcacgaggcactgcagttaagactgaacctggtgggagggatgttcgacacagtgcagaggtcaacacagtggactacagactgggctctcctgctattgcagatcataacaagtggcacagtagacatgcataccaataacgagttatttactacagttctcgacatgctgggagttttaattaatggtaccttggcatctgacctgtccaacgcctcacctggcggatccgaggagaataaacgcgcatatatgaatctcgttaagaagctcaaaaaggaacttggtgataaaaggtcagagtctatagacaaagtgagacagttgttgccactgccaaagcagacatgtgatgtgataacttgtgagccaatggggtccttgatcgataccaaaggaaataagatagctggctttgatagcattgataaaaagcagggattgcaagtatctaccaagcagaaggttagtccctgggatctgttcgaggggcagaaaaacccggcacccctgtcatgggcgtggttcggaaccgtgcgcgtcgatagacgggtaatcaagtatgaggagcaacaccatctgttgctgtatcatactcatcccatgccaaagcccaggtcttactatttgcagccactccctttacctccagaagaggaagaggaggaacctacgagtcctgtgtctcaggagcctgagaggaagagcgctgaattatcggaccaggggaagaccaccacagacgaagagaagaaaacaaaaggcagaaagaggaagaccaagagcagctctagagtcgacgaatacccgcagtccaacatatatagagtgcccccaaattattctcctattagttcccagatgatgcatcacccccaatccaccctctggggctacaacctcgtaggacagccccagcagcccggattttttctgcagaaccagtcactgactcccggtggatctcggctcgacccggctggatcttttgtaccaaccaatactaaacaagcactgtcaaacatgctccagcgacgcagtggtgctatgatgcagccaccaagcctgcacgctatcacttctcagcagcaactcatccagatgaagctgcttcagcagcagcaacagcagaggctactccgacaagctcaaactaggccgtttcagcaagggcagcctggtgaccaagccgctctgttcgcggctcaggcccgtccttccccacagttgccccaatatcccggtctccagcaggcacaaacaatgccccaaggatatacaatgtatggcacacaaatgcctctccagcaaacctctcagcagcaggcaggatctgtggtgttgtctccatcctacaattccagagcctatcctgccgctcactccaatcctgttctcatggagaggctgcggcagatccagcaacaaccttccggatatgttcagcaacaggctagtccatacctgcagccactgactggaagccaaaggttgaatcatcaggcccttcagcagagtccgttagtgggtggtggtattgatgcagttttaaccagcgcgcatccaaacttgccatcggtgcccctgcctcaagacccaatgcgacctaggcagcctcaagtccgccaacaacagagactcctccagatgcagcaaccgcagcagccccagcctcagcagccaccccagcctcagcagagctcacagagccagagccagacactgggacttcaggccatgcagccccagcagccactgtttccacgacaagggctgcagcagacccagcagcaacagcaaaccgcggctctggtgcggcagctgcagaaacagttgtcgtctaatcagccccagcaaggcgtgaccccatatggccacccctctcatttcta

SEQ ID NO: 229802 - DNA, 6521 bp, Artificial Sequence
  Description of Artificial Sequence: Synthetic coding sequence
atgtcagcttccttcgtcccaaatggggcatcgctcgaggactgccattgcaacctgttctgtcttgccgaccttacaggaattaaatggaagaagtatgtctggcaggggcctacttcggcgcctatactcttcccagtgactgaggaggaccctatactgtcatctttctcgcgctgtctcaaggcagacgtgttgggagtctggaggcgcgatcaaaggccgggacggagagaactgtggattttctggtggggtgaggacccggtcctgctgacccttttcacaatgacctatcagaagaaaaaaatggaatgcgggagaatggatttcccaatgaacgccgttctctgtttccaggctgtccacaatttgctagagagatgcctgatgaacaggaacttcgtgagaatcggaaaatggttcgtgaaaccctacgaaaaagatgaaaaaccaattaataaaagtgagcacctttcttgttcatttacattttttctgcatggcgactccaatgtgtgtacgagcgtggaaatcaaccagcaccagcctgtttacctgctcagcgaggagcacataactcttgcacagcagtctaattcccccttccaggttatcctgtgccctttcggtctaaatgggaccttgacaggccaagcctttaaaatgtccgattccgcgaccaagaaactgattggtgagtggaagcagttctaccctatttcttgttgtctaaaagagatgtctgaggagaaacaggaagatatggattgggaagacgacagccttgcagctgttgaggtactcgtcgccggtgtccgcatgatctaccctgcctgtttcgttcttgtcccacagagtgatatacccacgcccagcccagtgggatccacccactgcagttctagctgcctaggggtgcatcaagtcccagcatctaccagagatcccgctatgtcctccgttacactaactccccctacgtcccccgaagaagtccagactgtggatccccagagtgttcagaaatgggtgaaattctctagcgtgtccgacggcttcaactccgattcaacctcacatcatggtggaaaaatccctcgtaaattggcaaaccatgtcgttgaccgggtgtggcaagaatgtaatatgaacagggctcaaaacaagagaaagtattcagcaagttcgggcggtctctgtgaggaggccacggcagcgaaggtcgcctcctgggactttgttgaggccactcagagaacaaattgctcctgtttgaggcataagaatctaaagtcacgcaacgccggacagcaggggcaagcaccctctctaggccagcagcagcaaattttgccaaagcacaagactaacgagaagcaagagaagagcgaaaaaccacaaaagcggcctctgactcccttccatcatagggtcagcgtctccgacgatgttggaatggatgcagactccgcttctcagagacttgtgatcagcgcccctgacagtcaggtgcggttctctaatataaggacaaatgatgtcgcgaaaactccgcagatgcacggcactgagatggccaattccccccagccaccgcctcttagtcctcatccctgcgatgtagtggatgaaggagtcactaaaaccccttcaacgccacagtcgcagcacttctaccaaatgccaacaccagaccctttggtgccatcaaaacctatggaagacagaattgatagtctgtcccaaagctttcctccccagtaccaagaagctgtagagcctaccgtgtacgtggggacagctgtgaaccttgaggaagacgaagcaaatatcgcatggaagtactacaagtttccaaaaaagaaagatgttgaattcctgcctccacagctgccatctgacaagtttaaagacgatccagtaggaccgttcggacaggaaagtgtcacctcagtgacagaattgatggtgcaatgcaaaaagcctctgaaggtcagcgacgagctggttcagcagtaccaaatcaagaaccagtgtctcagcgccattgcctcagatgctgagcaggaaccgaagatcgacccctacgcttttgtggagggtgacgaggagtttctgttccccgataaaaaggaccgccagaattcagagagggaggcaggtaagaagcacaaagttgaggacggaacctctagtgtgacagttttgtcccacgaagaagacgctatgagtcttttttccccttcgattaaacaggacgcgccaagacccacctcgcacgccagaccacccagcactagcctgatttatgactcggacttagccgtgagttatacggacctcgataatctgtttaattcggacgaggacgagctgacccccggatccaagaagtccgcaaacgggagcgacgataaggcgagctgcaaagagtcgaagacgggaaacctcgatccactatcttgcatcagtactgcagacctgcacaaaatgtacccaacgccaccttccctagagcagcacattatgggtttctctccaatgaacatgaataataaggagtatggttctatggacaccaccccagggggaacagttctggaggggaacagctcatctattggtgctcagtttaaaatcgaagtagatgaagggttctgcagcccaaaacctagtgagattaaagatttcagttacgtatataaacctgagaattgtcagatcctggtagggtgcagcatgttcgcccctctgaaaacgcttcctagccagtatttacccccaattaaattacctgaagagtgtatttacagacagtcttggacggtggggaaacttgagctgctgtcttcgggcccttcaatgccatttattaaagagggcgatggcagtaacatggatcaggaatacgggaccgcgtataccccacagactcatacctcttttggtatgccaccgtcatctgcaccaccatccaacagcggggctggcatcctccccagtcctagcactcccagatttcctaccccacggacacccaggacaccacgcacaccccgtggagccggaggccctgcatctgcccagggtagcgtgaagtacgaaaattccgacttgtactcgccagctagcacccctagcacatgccgacccctaaactctgtggaaccagctacagtgccaagtataccagaagcccactccctctacgtgaacttgatactctccgagtcggtgatgaatctttttaaggactgtaacttcgacagttgctgcatctgcgtttgtaacatgaacatcaaaggcgctgacgtcggcgtctacatcccagatcccactcaagaggcacagtacaggtgcacttgtggattcagcgctgttatgaacaggaagttcggcaataactctggtctctttctggaagatgaactggacatcattggacgtaacacggattgcggcaaggaggccgagaagaggttcgaggctctccgcgctacaagtgccgaacacgtaaatggtggactaaaggaatcagaaaaacttagtgacgacctgatccttctattacaggatcagtgcaccaatctgttttccccgttcggtgcagccgaccaagacccattcccaaagagtggggtgatctcgaactgggtcagggtggaggagagagattgttgtaacgattgttatctcgcgttagagcacggcagacagttcatggataacatgagtgggggaaaagtggacgaagctctggttaagagttcatgcctgcatccctggagtaaacgtaacgatgtgtccatgcagtgttcccaggacatcctgaggatgctgctgagccttcagccggtattgcaggatgccatacagaaaaagcgaactgtgaggccttggggcgtgcagggtcccctcacctggcaacaattccataagatggcaggaagggggtcttatggaacagatgaatcgcctgagcctctgcccattccaacgttcctgcttggatatgactatgattacctggtgttatcccctttcgcacttccttactgggaaaggctgatgctcgaaccttacggctcacaacgggacattgcatacgtcgtgctatgccctgaaaatgaagctcttttaaacggcgctaagtccttttttcgcgacctgactgcaatatacgaaagctgtagattgggccagcatcgccctgtctctagacttctaactgacgggataatgcgggtcggatccactgcttctaagaagctctctgaaaagttagtggccgagtggttttcacaggcggctgacggcaataacgaagccttctctaagctaaaactgtacgcccaagtgtgtcgctacgacctaggaccctatctcgcgagccttcctcttgattcttctcttctctcacaaccgaacctggtggcaccgacaagccaaagtctgatcacccctcctcagatgactaacactgggaatgccaatacccctagcgcaacactggcttctgccgcttcgagcacaatgacagtgacaagcggggtggcaattagcacatccgtggcaacagcaaactcaactcttaccactgcatccacatcatctagttcatccagtaacctgaattctggggtcagctctaacaagcttccaagcttcccgccatttgggtccatgaattcgaacgccgcaggctcaatgagcacacaggcgaatactgtacagtccggccagctgggcggacagcagaccagcgcccttcagactgccggtattagcggcgaaagtagttcccttcccacccagcctcaccctgacgtgtctgagtctactatggatagggataaggtcggcatacctaccgatggggattctcatgctgtgacttaccctcctgctatcgtggtttacatcattgatcccttcacctacgagaacaccgatgaaagcacaaactctagctccgtatggacactgggtttgctgaggtgctttctggaaatggtgcagacacttcccccacatatcaagtcaacggtgagtgtgcagatcatcccctgtcagtacctcctgcagcctgttaaacatgaggaccgcgaaatctaccctcagcatcttaagtctcttgcattcagtgcgtttactcaatgccgtcggccactgccaacgtccaccaacgtgaagaccctgaccggatttggcccaggcctggcgatggagacagctcttcgctcgccagaccggccagagtgcattcgcctgtacgcaccccctttcatcttagctcccgtaaaggataagcagaccgagctaggtgagacattcggggaggctggtcagaagtataacgtcttattcgttgggtattgcttgtcacatgatcagagatggattctcgccagttgtaccgacttgtacggggaactgctcgaaacctgcattatcaatatagacgtgcccaacagagcacggagaaaaaagtcctccgctcgcaagttcggcctgcaaaagctgtgggagtggtgtctcggtctggtgcaaatgtccagcctgccctggcgcgtcgtcattgggaggctcggcaggatcgggcatggagagctgaaggactggtcctgcctcctgtctcggaggaacctccaaagtctttcaaagagattaaaggatatgtgtagaatgtgcggcattagcgccgcagattcccctagcatcctgtctgcgtgtctcgtggctatggagcctcagggctccttcgtgatcatgcccgacagtgtcagtaccggaagcgtatttgggcgatcaactactctgaacatgcagacaagccaactcaatactccacaggatacttcatgcactcacatcctggtcttccctactagtgcctcggtgcaggtagcatccgccacgtacacaaccgagaacctggaccttgcattcaatcccaacaacgacggagccgacggcatgggtatatttgatttacttgatactggggacgatcttgatccggacatcattaatatcttacctgcctctcctaccggctcacccgtgcactcccccggaagccattatccacatggtggggatgccggaaaaggccagtcgaccgacaggctgctgtccacagagcctcacgaggaggtgcccaacatcttacaacagccgctggctcttggctacttcgtcagcaccgcaaaggccggacctctcccagactggttctggagcgcatgcccacaagctcagtaccagtgccctctgtttctcaaagcctcactacacctgcacgtcccttccgtccagtctgacgaactgttgcactccaaacacagccatcccttagatagcaaccagacatctgacgtgctgcggttcgtcctggaacagtataacgctttatcctggctgacctgtgaccccgcaacccaggaccggagaagctgtttacccatacattttgtggtcctaaaccagttatataacttcatcatgaatatgctcta

SEQ ID NO: 229803 - DNA, 6524 bp, Artificial Sequence
  Description of Artificial Sequence: Synthetic coding sequence
atgtccgccagttttgtcccaaatggcgctagcctggaagattgccattgtaacctgttctgtcttgccgacctgactggtatcaaatggaaaaagtacgtgtggcagggaccgacatccgctcccatactctttcctgtcactgaagaagatcccattctgagcagtttctcaaggtgtttgaaggccgacgtgctgggggtatggagacgtgatcagaggcctggcagaagagagttgtggattttttggtggggagaagatccgagtttcgctgacctgattcaccacgacctgtccgaggaagaggatggagtttgggagaacggcttgagctatgagtgcagaactctactgtttaaggcggttcacaacctgctcgagcgttgtctcatgaatcgtaattttgtgcgtatcggtaagtggttcgtgaagccctacgagaaagacgagaaacctatcaacaagtcggaacacctttcctgcagcttcacattctttctgcacggtgattcaaatgtctgtacctctgtggaaattaatcaacaccagccagtttatctcctctcagaggagcacatcacactggcccagcaatctaactcaccttttcaggtcattttgtgcccctttggcttgaatggcactttgacggggcaggcattcaagatgtcagattctgctactaagaagctgatcggggagtggaaacagttctaccccatctcctgttgtctgaaagaaatgagcgaggagaagcaggaggacatggactgggaagatgactcccttgctgcagtggaggtgctggtggcaggcgtgcgcatgatctacccagcctgctttgtgctggtaccccagtctgacattcctaccccgagcccagtcggatccacacattgttccagttcttgcctcggagtgcaccaggtccccgctagcactagagaccccgctatgagttccgttaccttgaccccccctacctctccggaggaggtccagaccgtggatcctcagtctgttcagaagtgggtgaaattttctagcgtgtcagacggattcaatagcgatagtacttctcaccatggaggcaaaatccccaggaagctggccaatcatgttgtcgatcgcgtatggcaagagtgtaatatgaaccgcgcacagaataagcggaagtactcagctagctccgggggtctctgcgaggaggccacagctgcaaaagttgcctcatgggatttcgtggaggcgactcagcgcacaaactgcagttgtctgcgccacaaaaatcttaaaagccgcaatgctggacagcagggccaggcaccatccctgggtcaacagcaacagatcttacctaagcacaaaaccaatgagaagcaagaaaagtccgagaagccacagaagagacctctgacaccatttcaccaccgggtctctgtgtcagacgatgtgggcatggacgctgattctgccagccagagactcgtgatttcagcacccgatagccaagtgaggttttcaaacataagaacaaacgacgtagccaagaccccccagatgcacggaacagagatggcaaacagtccacagcctcccccacttagtccccatccttgcgacgtggtcgatgagggagtgacgaaaaccccatccactccacagtcccagcatttttaccagatgcctactccagatccactagtcccaagcaagcccatggaagatcggatagatagcctcagccagtctttcccacctcagtatcaggaagctgtggagccaaccgtttacgttggcacggcggttaatctggaggaggatgaagctaacatcgcctggaagtattataaattcccaaagaagaaagacgtggaatttctgcctccacaactgcccagcgacaaatttaaagacgacccagtgggaccatttggacaagagtcggttacgagcgtcaccgaactgatggttcagtgcaaaaaacccctgaaggtgtccgacgagctggtacaacagtatcagatcaagaatcagtgcctgtctgctatcgcttccgatgctgaacaagaacctaagattgatccatacgcattcgttgagggcgacgaagaatttcttttcccagacaagaaggatagacagaactcagaaagggaggccggtaaaaagcacaaggtggaggacggcactagctccgtcactgtgctcagccacgaagaagacgccatgtccctgttttccccgtcgatcaagcaggacgccccaaggccaacctctcacgcaagacctccaagcacaagtttgatttacgattccgatttagcagtgtcctacactgacctggacaatctctttaacagcgacgaagacgagctcacacctggtagcaaaaaaagtgcaaatggttcagacgacaaggcatcatgtaaggagagtaagaccggcaacctggacccgctgagttgcatcagcaccgccgaccttcataaaatgtatcctaccccaccatccttggagcagcacatcatgggtttctcacccatgaacatgaacaataaggaatacgggagcatggatactacaccaggaggcacagtgctggaaggaaatagctccagcattggggctcagttcaaaatcgaagtcgacgaaggcttttgttcccctaagccatcagagatcaaagattttagttacgtgtataaacctgaaaactgccagatccttgttggctgttctatgttcgctcccctaaagacccttcccagtcaatacctaccccctattaaactgcccgaagagtgcatttaccggcaatcttggactgtggggaaactggaattgctttcatctggtccgtcaatgcctttcatcaaagagggcgacgggagtaatatggatcaggagtacggaaccgcctacactccgcaaacacacacttccttcggtatgccccctagtagcgctcccccaagcaactcgggagccggtatcttaccatccccttctactccacgcttccctacaccgcgaacccctcgtactcctcggactccacgaggtgcgggtgggccagcgagtgcacagggatcggtgaaatacgaaaactcggacttgtactcgcctgctagtacccctagcacgtgccgaccattgaattccgttgagcccgctaccgtgccctccataccagaggcccattctctctacgtcaatctgatcctatctgagtcagttatgaatctcttcaaggattgcaacttcgactcctgctgcatttgtgtgtgcaacatgaatataaagggggcagatgtcggcgtctacattcctgaccctacacaggaggcacagtaccgatgcacctgcgggttctccgcagttatgaatcgaaaatttggcaacaacagtggactatttctggaggatgagcttgatatcatcggacggaatacagattgtgggaaggaggccgaaaaaagattcgaggcactgagggccacctcagctgagcacgtcaatggtggactcaaagagtctgagaagctatcagacgatctgatcctgctactacaggatcaatgcactaacttattcagcccttttggcgcagccgaccaggatccatttcccaaaagcggggtgatctccaactgggtgagagtcgaagagcgcgactgctgcaacgattgttatctggctctcgagcacggcagacagttcatggataacatgagtggcggaaaagtggatgaggcactggtcaaatcctcatgtctccatccctggagcaaaaggaatgacgtcagtatgcagtgcagccaagatatcttaagaatgctcttaagtctgcagcctgtactccaggatgctatccaaaaaaagcgaacggtccggccttggggcgtgcagggcccacttacttggcaacagttccacaagatggctggcagagggtcatacggcacggacgaatctccagagcccttaccaatccccacatttctcttggggtatgattacgactacctagtccttagccctttcgctttgccctactgggaacgtcttatgctggaaccctatgggtcacaacgcgatatagcctacgtggtgctctgccccgagaatgaagccttgttgaacggtgccaagagtttctttagagatttgaccgcaatctacgagtcttgccgcttgggacaacatcgtccagtgtcccgcttgctgacagatgggattatgcgagtcggaagcaccgcgtctaagaaactgtcggaaaaactggtggctgagtggttctctcaggcagctgatggcaacaatgaggccttctccaagttgaagctgtacgcccaggtttgtcggtatgatttagggccatacctggcttctcttccactggattctagtcttctttctcagccaaatctggtcgcacccacaagccagtcgctgataacgcctccccagatgaccaacaccggcaatgccaacactccatctgccactctcgcctctgctgcctcctccactatgactgtgacatcaggcgtggccatatctacatctgtagcgacagcgaactctactttgaccaccgcatccacaagttcgagcagctcctctaatctgaatagtggggttagcagtaacaaactgccgagctttcccccattcggctccatgaacagtaacgcagctgggagcatgtccacacaggcgaatacagtgcagagcggacagctgggcggtcaacaaacttcagcactacaaaccgctggcatctccggggagtcctcatctttgccgacacagccacaccccgacgtgtcagagtcaaccatggaccgggataaagtgggtattcctacagatggggatagccacgccgtcacttaccctcccgcaatcgtggtctacatcattgatccttttacatacgaaaacaccgatgaaagtaccaattcgtctagcgtgtggaccttgggcctgctacgatgctttttggagatggtgcagactctgccccctcatattaaatcaacagtgtcagtccagataattccttgtcagtacctgctgcagcccgtaaagcacgaggatcgtgaaatctacccacagcacctgaagtccctggctttcagcgcctttacgcagtgtagacgtcctcttcctacaagcacaaatgttaagacgcttaccgggtttgggcctggactcgcgatggaaactgccctccggagccctgaccggccagaatgcataaggctttacgcgccaccttttattctggcaccagtaaaggataagcagaccgagctaggggagacctttggtgaggcagggcagaagtataacgtgctcttcgtgggctactgcctgagtcacgaccagcgttggatcctggctagctgcacagatctgtacggcgagctgttggagacgtgcattatcaacatcgacgtgcccaacagagctcgtagaaaaaagtccagtgcaagaaaatttggcctacagaaactctgggagtggtgtctgggcctcgtgcagatgagcagtctgccctggagagtggtgataggtcgcttagggcgaattggacacggcgagctgaaagattggtcctgcttactctctaggaggaacttgcagtctctcagcaagcgcctgaaggacatgtgcaggatgtgtgggatctcagccgctgattcgccgtctatcttgagcgcttgcttagtagcaatggaaccccaaggatcgttcgttatcatgccagacagtgtgtccacaggaagcgtgttcgggagatccaccacccttaatatgcagaccagccaactgaacaccccacaggatactagctgcacccatattctggtgttccctacaagtgccagtgtccaggttgccagcgcaacctatacaacagagaatctggatctggcatttaatccgaacaacgacggggctgacggcatgggcatctttgacctcctggatactggcgacgatctcgacccagatatcattaacatcctgcccgcttcccccactgggagccccgtgcactccccaggaagccattatccccacggtggggacgctggcaagggacaaagtacagatagactgctatccacagagccccacgaggaggtgcccaatatcctgcagcagcccctggctctggggtactttgtgagcacagctaaggcaggcccactgccagattggttctggagtgcttgccctcaggcacagtatcaatgccctctgtttctgaaggcttccttgcacctgcacgtcccgtccgtacagtccgacgaactgttacattcaaaacatagccacccccttgattcaaatcagaccagtgacgtattgcgattcgtgcttgagcaatacaatgccttgtcatggcttacctgcgaccccgctacgcaggaccggcgatcctgtttgcctatccatttcgtagttcttaatcagctctacaactttattatgaacatgctata

SEQ ID NO: 229804 - DNA, 6633 bp, Artificial Sequence
  Description of Artificial Sequence: Synthetic coding sequence
atgaccgccgctgcgaactgggttgccaacggagcttcactggaagactgtcatagtaatctttttagtctggccgagttgacagggatcaaatggcgacgatacaattttggcggtcatggtgactgcggacccatcatcagcgctcctgcccaggacgaccctattctactctcttttattcggtgtttgcaggcaaacctgctatgtgtatggaggagagacgtcaagcctgactgcaaagagctgtggatcttctggtggggagatgaacctaacctggtaggcgtgattcatcatgaactccaagtcgtggaggagggtttgtgggagaacggtctctcatacgagtgtcgcaccctgctttttaaagctatccacaatctgctggaaaggtgtctaatggataagaacttcgtgcgtatcggaaagtggttcgttcggccatatgagaaggacgaaaaaccagtcaacaagtcagagcatctctcgtgcgcttttacctttttcctgcatggtgagtccaatgtttgcaccagcgtggaaatcgcgcagcatcagcctatctatctgatcaacgaggagcacatccatatggctcaaagttcacccgctcctttccaggtcctggtttccccctatggcctaaatggtactctgacaggtcaagcctataaaatgtcagaccctgccacacgcaagctgatcgaggagtggcagtacttttatcctatggtgcttaaaaagaaggaggaatccaaagaagaagacgagctggggtatgacgacgactttcctgtggctgtggaggtgatcgtgggtggagtgagaatggtctatccctccgcatttgtgctgatcagccaaaacgatattcctgtacctcaatctgtcgccagcgcgggaggtcacattgccgtgggacagcagggtctgggcagtgtgaaagacccttctaactgtggaatgcctttaaccccacccacaagcccggagcaggcgattcttggcgaatccggagggatgcagtccgctgccagtcatctagtttcccaggacggagggatgattaccatgcatagccccaagagatctggcaaaatcccaccaaaacttcacaaccacatggtccatcgagtgtggaaggaatgcatcttgaatcgaacacaatccaagagatcccagatgagcacccctacattggaggaggagcccgcaagcaacccagctacatgggactttgtcgaccctacgcagcgggttagttgctcttgttcccgacacaaactgcttaagcgctgtgctgtgggtcccaaccggccacccacagtcagtcagccgggattttctgcagggccatcatcttcctcttctttgcccccaccagcttctagtaagcacaagactgctgaaaggcaggagaagggagataagctccagaagagacctcttatcccttttcatcaccggccatctgtggccgaggaactgtgcatggagcaagacacaccaggccagaagctgggactcgccggtattgatagcagtctagaagtctcatcctcgaggaagtatgataaacaaatggccgtgccaagtcgcaacacttctaaacagatgaatctaaatcccatggactcaccgcactctcccattagcccgctgccgcctacactttcaccacagcccaggggtcaggaaacggagtctctcgacccaccatctgtgcctgtcaaccccgcactgtacggaaatgggctcgaattgcagcagttatcgaccttagacgaccgcactgtgcttgtgggacaacgactgccgcttatggctgaagtgtccgagaccgccctatattgcggaatccggccttccaaccccgaaagctctgagaagtggtggcactcctatcggttgccaccctccgacgatgcggaatttaggccacctgaactacaaggggagcggtgcgatgccaagatggaagtaaactcagaatcaacagcgcttcagaggctgcttgctcagcctaataaaaggtttaaaatctggcaggataagcagccccagcttcagcctctgcactttctggaccccctgcccctgtcccagcagcccggtgacagtctgggcgaagtcaacgatccctacacgtttgaggacggggatatcaagtacattttcaccgctaacaaaaagtgcaagcaaggaactgagaaagactctctgaaaaagaataagagcgaggacggctttgggacgaaagacgtcaccacgccagggcatagtactccagttccagatggaaagaatgccatgagcatcttttcgagcgcgacaaaaacggatgtacgacaggataacgccgcaggtcgagccggatcatcttccctgacccaggtgactgacttggcgccttccctgcacgacctcgataatattttcgacaatagcgacgatgacgaactgggggctgtctcccccgctcttagatcatccaagatgcccgctgttggcaccgaggatcgtcccctggggaaagatgggagagcagccgtaccgtacccccctactgttgccgatctccagagaatgtttcctaccccacctagtctggagcagcaccccgctttttctcctgtgatgaattacaaagacggcatcagttctgaaaccgtcacagctttgggaatgatggagagtcctatggtgagtatggtaagcacccagcttacagaattcaaaatggaggtggaagatggacttggtagtccaaagcctgaagagatcaaggacttcagctacgtccacaaggtccctagtttccagccattcgttggaagcagtatgttcgctccactcaaaatgctgccctctcactgcctcctccccctgaaaatccctgatgcatgtctgtttcgcccaagctgggccattcccccaaagatagaacaactaccaatgccaccagccgctaccttcataagggatggatacaataatgtgccttccgttggctcactggcagatcctgactacctgaatacccctcagatgaatacccccgtcacactgaattcagccgctcctgcctccaactctggcgcaggcgtgctgccttcgcccgctacacctcgctttagcgtgcctacccccaggacacctcgtacccctagaacaccacggggtggcggtacagcctccgggcagggctcggtcaaatacgattctactgaccagggctcgccggcatctacgccatcgactaccaggcctctcaattctgtggaacctgccaccatgcaaccgatcccagaagcccactcactgtacgtcaccctaatcctctcagacagtgttatgaatatctttaaagacagaaacttcgactcctgttgcatttgtgcatgcaacatgaacataaagggggcagacgtcggcctttacatccctgattccagtaatgaagaccagtacagatgcacgtgcgggtttagtgccatcatgaaccgtaagttgggttacaacagcggcctctttcttgaggacgagctggacatatttgggaaaaactcagacattggacaggccgctgaacgtagactgatgatgtgccaatctacatttctaccgcaggtcgaagggaccaagaagccgcaggagcctcccatttctctactgctgttgctccagaatcaacatacccaacccttcgcctccctgaactttctcgactatatcagtagtaataacagacaaacactgccgtgcgtgtcatggagctacgatcgcgtacaggctgacaacaatgactattggactgaatgctttaatgcactggagcagggacggcagtatgttgataaccccactggcggtaaagtcgacgaagccctcgtacgtagcgcaactgtacacagctggcctcattccaacgttttagacatcagcatgctgtcatcccaggacgtcgtgagaatgctcctgtcactgcagcctttcctgcaggatgccatccagaagaagaggaccggcaggacatgggagaatatacaacacgtacagggacccctgacatggcaacagtttcacaagatggccggacgagggacatacggatcggaagagagccctgagccgctcccaataccaactcttctggtgggttacgataaagatttcctgacaatttcccctttttcccttccattctgggaacgccttctgttagacccctacgggggacatagagatgtggcatacatcgtggtgtgccccgagaatgaggccttgctagaaggagccaagaccttttttcgagatctgagtgcagtgtatgagatgtgccgccttggacagcataaaccaatctgtaaagtgctccgggacggtattatgagagttggaaagaccgtagcccagaaattgacggacgaactggtgagcgaatggttcaatcagccctggagcggcgaagaaaatgacaaccactcccgtctgaaactctatgcgcaggtgtgccgccaccaccttgcaccctatctggccactctgcagcttgattcatccctacttatccccccaaaatatcagacccctcccgcagcagctcaagggcaggcaactcctgggaacgctgggccactcgctcctaatgggtcagccgcacccccagccggttcagcttttaatccaacctcaaattctagtagtacaaaccctgctgcaagctcaagtgcaagcggaagttctgtgccgccagtgtcctcctcagccagcgcccctggcatcagtcagatttccaccaccagtagctctggcttctcagggagcgtgggagggcagaacccgtcaacggggggaatcagtgcagaccgcacgcaaggcaatatcgggtgcggaggcgatacagaccccggacaatccagctcacagccctcacaggacggtcaggagtctgttacggaacgcgagaggattggcattccaacagaacctgactccgccgattcccacgcccatcctcccgctgttgtgatctatatggtagaccccttcacctatgccgcagaagaagacagcaccagcgggaacttctggctactgtcactgatgagatgttataccgaaatgctggataatctccccgagcacatgcgcaacagcttcattttgcaaatcgtgccttgtcagtacatgttgcagactatgaaagacgagcaggtgttttacattcaatacttgaagtccatggcgttttcggtttattgccaatgtcgaagacctctgccaacgcagatccatatcaaatctctgaccgggtttggacctgcagcttcaattgaaatgactttgaagaacccagaaagaccgtctcccatacagctttactcccccccattcattctggctccgatcaaggataaacagacggagctgggcgaaactttcggggaagcttcgcaaaagtataacgttctgtttgtgggatactgcttgtctcatgaccaacggtggttacttgccagctgtactgatttacacggtgaacttttggaaacctgcgttgtcaacatcgccctgcctaaccgatccagacggtctaaggtttcggctcgcaagatcggtcttcagaaactatgggagtggtgcattggcattgtgcagatgacttctctgccctggagggtggttatcggaagattgggaaggcttggccatggagagttaaaggactggagtatactcctgggggagtgttccttgcaaaccatttcaaaaaagctgaaggacgtgtgccgtatgtgtgggatcagcgcagcggacagcccctccatcttgagtgcctgccttgtcgctatggagccacaaggcagttttgttgtcatgccagacgccgtcactatgggcagcgtgtttggcaggtccacggcactcaacatgcagtcatcacagctgaacaccccacaggacgctagctgcacacacattctcgtctttcccacctcatctaccattcaagtcgcccctgccaactatccaaacgaggatgggttctcccccaacaacgatgatatgtttgttgacttgccgtttcccgatgatatggataacgacataggcatcctgatgacaggtaatctgcactcttcccctaatagtagccctgttccctctcccggaagccccagtggaatcggcgtcggatcacacttccagcacagtagaagccagggcgagcgactgctcagtagagaagctccggaggagctcaaacagcagccccttgccttgggatattttgtgagtactgccaaggcggagaatctgcctcagtggttttggtcctcatgtccacaggcacagaaccagtgcccattgttcctgaaggcttcgctgcatcaccatatctctgtcgcccaaacagatgagcttctgccagccaggaactctcagagagtccctcatcccctagattcgaaaaccacatctgacgtgttgcgatttgtcttggagcagtacaacgcattatcttggcttacatgcaacccagcaacgcaagacaggactagctgtctgccagtccatttcgtcgtgttaacacagctgtacaatgccattatgaacatcctgtac

SEQ ID NO: 229805 - DNA, 4365 bp, Artificial Sequence
  Description of Artificial Sequence: Synthetic coding sequence
atggcacctgtacagctcgagaatcaccaactggtgccgccagggggtggcggtggcggatcaggagggccaccaagcgcacctgcccctcccccaccaggcgcagcggtcgccgcagctgctgcggctgccgcatcacctggataccgcctatctaccctcattgagtttctcctgcatcgcgcatattctgagctcatggtgttaacagacctactcccacggaagagcgacgtggagcgaaagatcgagatagttcaattcgccagtagaaccagacagcttttcgtgcgtctattggcgcttgtcaaatgggccaacaatgcagggaaagtggaaaagtgtgctatgataagcagcttcctggatcaacaggccattctgttcgttgataccgctgatcgcttggcctcgctagccagggatgccctggtacacgctcggctgccatctttcgccataccctatgccatcgatgtgctgaccactggatcttatccccgactgcccacctgcatacgcgacaagatcattcctcccgatccgattaccaagatcgaaaaacaggccaccctccatcagttgaatcaaatcttacgtcacagactggttacgactgacctcccaccacaactagccaacctgaccgtggcaaatggacgagtgaaattccgcgtcgagggagagtttgaggccacccttaccgtcatgggggacgatcctgatgtgccatggagactgttgaagctggaaatcctggtcgaggacaaggagacaggcgacggcagagctctggtccatagtatgcaaataagttttatacatcagctcgtgcagagtcgactgtttgcagacgagaagcctctgcaggatatgtacaattgcctgcacagcttctgtctttcacttcaactcgaagtactccatagtcaaacactcatgctgatccgggagagatggggcgatttagtccaggtggaaagataccacgccggaaaatgtctttccctcagcgtatggaaccagcaggtgcttggcagaaaaaccgggaccgcctccgtgcataaagtcactatcaaaatcgacgaaaatgacgtgagcaagcctttgcaaatattccatgatccgcctctgccagctagcgactcaaagcttgttgaaagggctatgaagattgaccacctgtccatagaaaagctgctgatcgactccgttcacgctagagcgcaccagaaactgcaggagttgaaggctatcctgagaggatttaatgccaacgaaaactcctcaattgagactgccctgcccgcacttgtggtgcctatactcgagccgtgcggcaattcagaatgtctgcatatatttgttgatctccatagtggtatgtttcagctgatgctttacggacttgatcaggctaccctggatgatatggaaaagagcgtgaacgatgatatgaagcgcatcataccctggattcagcagctcaagttctggcttggacagcagagatgcaaacagagcattaaacacctgccaacaatttcctcagaaactctgcagctctccaactactccacgcaccctatcgggaacctgtctaaaaataagctgtttataaagttgactcgactgccacaatactacatcgtcgttgagatgctcgaggtgcctaacaaacctacgcagctgagctataagtactatttcatgtccgtaaacgctgcagacagagaggattcaccggcaatggccctcctgttacagcagtttaaagaaaatattcaggacctggtattcagaactaaaacaggcaagcagacaagaacgaatgccaaaagaaaactcagtgacgatccatgtcctgtggaatccaagaagaccaaacgtgcaggcgagatgtgtgcattcaataaagttctcgctcactttgtcgcaatgtgcgataccaatatgccgttcgtcggcctgaggttggaactgtctaatctggagattccccatcagggcgttcaagtggaaggtgatggttttagccacgccatccgcctattaaagattcccccatgcaaaggcatcactgaggaaacccagaaagcactagatcggtcacttctggattgtacatttcgtctgcagggtagaaataacagaacctgggtggccgaactggtcttcgctaactgtcccctgaacgggaccagcacaagagaacagggcccatctagacatgtctacctaacatatgagaacctgctctcggaaccggttggaggcagaaaagtggttgagatgttcctcaacgactggaactctatagccagactttatgaatgcgtgctggaatttgctcggagcctgcctgacatcccggcacatcttaacatcttttcagaagtgcgcgtgtataattatcggaaactcattttatgttatgggacaaccaaggggagttctatctcaatacagtggaacagtattcatcagaagttccatattagcctgggtactgtcgggccaaacagcggatgcagtaactgtcataacactatccttcatcaactgcaggagatgttcaacaaaactccgaacgtggtgcaactgctgcaggtcctgttcgatacgcaggccccactcaacgccatcaataagctgccaaccgtccccatgttagggctgactcagaggaccaatactgcataccagtgcttctcgattctcccgcagtcaagcacacatatacggttggcatttcgcaacatgtattgcatcgatatctattgtcgaagccgcggagtggtcgccatccgcgacggagcctactccctgttcgacaatagtaaactggtggaaggattttacccggctccgggtcttaagactttcttgaacatgtttgtcgattcaaatcaagacgctagacgaaggtcggtgaacgaggatgacaaccctcccagtcctatcggaggcgacatgatggacagcctcattagccagctccaaccccctccacagcagcagcccttccccaagcaaccgggtacaagcggggcttacccccttacatcaccacccacttcctaccatagcacagtcaatcagtccccaagcatgatgcacacccagtccccaggaaacttgcacgcggcaagcagcccttctggtgctcttagggctccctcccccgcatcttttgtcccgacccctccgccatcatctcacggtatcagtattggaccaggagcatcttttgcaagcccccacgggacactcgatccttcctccccttacaccatggtctcacctagtggcagagctgggaactggcccggatcacctcaagtgagcgggccatcacctgccgcacgaatgccaggcatgtcaccagcgaatcccagtttacatagtcctgtcccagatgcttcgcattcccctagggcaggtaccagctcccagaccatgccaaccaatatgccgcctcctcgcaaattgccacagcggagctgggccgcaagcatccctactattctcacccatagcgctctcaacatccttctgctgccttctcccacccccggtctcgttcccggtctggccggatcatacttgtgcagcccgttggagaggttcctgggtagcgtcattatgcgacgccatcttcagagaatcatccagcaggagacactgcagttgattaacagcaatgaacccggtgttatcatgttcaaaacagatgcccttaagtgccgggttgccctgtcccctaaaactaatcagaccttgcagttgaaggtcaccccggaaaacgcaggacagtggaaacccgatgaactccaggtcctcgagaagttcttcgaaaccagagtggctggacccccttttaaggccaacaccttgatcgcttttactaaactgctcggcgctccgacgcatatcctccgcgactgtgtacatattatgaagttggaactgttcccggatcaggccactcagttaaagtggaatgtgcagttttgcctgaccattcctcctagcgcaccccctatagcaccccctggcaccccggcagtggtgttgaagtctaagatgctgttcttcctgcagttgacacaaaagacatcggtgccccctcaggaacccgtgtccatcattgtgcctattatatatgacatggccagtgggactacccagcaagcagacatccccaggcaacagaattcatctgtggctgcgcctatgatggtatccaatatactaaaacggttcgcggaaatgaaccccccaaggcagggggagtgcaccatcttcgccgctgtgagggatctaatggctaacctcacactgccgcctggtggaaggccgtag

SEQ ID NO: 229806 - DNA, 468 bp, Artificial Sequence
  Description of Artificial Sequence: Synthetic coding sequence
gtggctggccctccctttaaagctaataccctgatcgcttttaccaagctgttgggagctccgacccacatcttgcgggactgtgtccacatcatgaagttggaactgttccccgaccaggcaacacagctgaagtggaacgtccagttttgcctcacaataccacctagtgctccgccaattgcccctccaggaactccagcagtggtcctgaagagcaagatgctgttcttcctccagctgacacaaaaaaccagtgtcccaccacaggagcccgtgagcattatagtaccaatcatttacgatatggcttccggaaccacccagcaagccgatataccaagacagcagaattcatctgttgcagctccaatgatggtgagcaatatcctgaaacggtttgcggaaatgaatccacccagacagggcagcattaaggggacgggctgcccaagtgactttctgtag

SEQ ID NO: 229807 - DNA, 996 bp, Artificial Sequence
  Description of Artificial Sequence: Synthetic coding sequence
ccaagcggaagggcgggaaactggccgggtagccctcaagtgtctggtccttcgcctgcagctaggatgccaggtatgagtccagccaatcccagcttgcattccccagtgcctgatgcttcccactctccacgcgctggaacttcatctcagacaatgcctaccaatatgccaccccctcgcaagttgccccagcgcagctgggcagccagcatcccaaccatcttgacgcattctgcactcaacatccttttgctgccctctcccaccccgggattagtgcctggattagctggatcctacctgtgttctcccctggaaaggtttttggggtccgttatcatgagacgtcatctgcagaggattatacagcaggagacactgcagctgatcaactccaacgaacctggtgtcatcatgtttaaaacagacgcactcaagtgtagggtggcgctttctcctaagacgaatcaaactctgcagctcaaagtgactccagaaaacgcgggtcaatggaaacctgacgagctgcaggtcctcgagaagttctttgaaacccgagtcgccggacccccatttaaggccaacacactgatcgcgtttaccaaacttctgggagccccaacacacatcctgcgcgactgtgtccacattatgaagctcgaactttttcccgaccaggcaacccagctgaaatggaatgtgcagttctgccttactattccaccttcagcacctcccattgccccacctggaactcccgctgtagtgcttaaatctaagatgctctttttcttacaacttacgcaaaaaaccagcgtcccacctcaggagcctgtgtccatcattgtccctatcatctatgatatggcctccgggacgacacagcaggccgatattcctcggcagcaaaactcgagcgtagctgctcccatgatggtgtctaatatcctgaagcgtttcgccgagatgaatcccccacgacagggaacatag

SEQ ID NO: 229808 - DNA, 2367 bp, Artificial Sequence
  Description of Artificial Sequence: Synthetic coding sequence
atggatgtgtccgggcaggaaaccgactggcgatctacagctttcaggcagaagctggtttcccagatagaagacgcgatgcgtaaagccggtgttgcacactcaaaaagttctaaggacatggaatcccacgtctttctgaaggctaaaacacgggatgaatatctgtctctggtggccaggctaattatccattttcgtgatatccacaacaagaaaagccaggcttccgtgtcagaccccatgaatgcactacagtctttaacaggcggtccagcagctggtgcggcaggcatcgggatgccgcctcggggaccgggacagtcacttggagggatgggttccctgggcgctatgggacaaccaatgtctctctcaggccagcctccacctggaacctccggcatggcaccccacagcatggccgtagtcagtactgccacccctcaaacacagctccaattgcagcaggtcgctttacagcagcagcagcagcagcaacaatttcagcagcagcaacaagctgcccttcagcagcagcagcagcagcagcagcagcagcagttccaagcacagcagagcgctatgcagcagcagtttcaggccgtagtgcagcagcagcagcagttgcagcaacagcagcagcagcagcagcatttgatcaagcttcaccaccagaatcagcagcagatccagcagcaacagcagcagttgcagcgcatcgcacagctgcagctacagcagcaacagcagcagcagcagcaacagcaacagcagcagcagcaagcactccaggcccaacctcctattcagcaacctcccatgcagcaaccacagccacccccaagccaggcattaccacaacagttgcagcagatgcaccacactcagcatcaccaacctcccccacagcctcagcagcctcctgtggctcaaaatcagccatcacagttacctcctcagagtcaaacgcaaccattggtctcacaagcacaggcactgccgggtcagatgctgtatactcagccaccattgaagttcgttcgagctcctatggtcgtgcaacagcccccagtacagccgcaagtgcagcagcagcagaccgccgtccagaccgcacaggccgcacagatggtcgccccaggagtgcagatgatcacggaggctctggcccagggcggaatgcacattagggcacgcttcccccctacaaccgcagtgtcggcaattcctagttccagcatacctctgggacgccagccgatggcccaggtttcccagagttccctgccaatgttaagttcaccatcccccggtcaacaggtgcagacgccacagtcaatgcccccacccccacagccctcgcctcagcccggacagccctcctcacagccgaatagtaatgtctccagtggccctgctccttcgccaagtagcttcctgccatccccttctccccagcccagccaatctcccgtgaccgcaagaaccccccagaacttcagtgtgccctcacctggccctctgaacacacctgtgaatccatccagcgtaatgtcaccagccggtagttcccaggccgaagagcagcagtatctcgacaaacttaaacagctgagtaaatatatagaaccactccggaggatgatcaataaaattgacaagaatgaggatcggaaaaaagacctcagcaaaatgaagtccctgctggacatcctgacagacccctcaaagcggtgtccactcaagacactgcagaagtgcgaaattgcgctcgagaaactgaaaaatgacatggcggtgcccaccccacccccaccacccgtccctcctaccaagcaacagtacctgtgccagccgctcctcgatgccgtgctggctaacattagaagcccagtgttcaatcattctctctacagaacgttcgtgccagctatgaccgccattcacggccctcctataaccgcaccagtcgtctgcaccagaaagcgaaggttggaggatgacgagagacagtcgatcccttctgttctgcaaggggaggttgctcgcttggacccaaagttcctggtgaatttagatccctctcactgtagtaacaacggaaccgtgcatctaatctgcaagctggatgacaaggatctccccagtgtgcctccccttgaactctcagtacccgcagattacccagctcaatctcccctgtggattgacaggcagtggcagtatgatgctaatcctttccttcagtccgtacacagatgcatgaccagtaggctgctgcagttgcccgataaacattccgtcactgccctgctgaatacctgggctcaatcggttcaccaggcttgtcttagcgccgcttag

SEQ ID NO: 229809 - DNA, 2247 bp, Artificial Sequence
  Description of Artificial Sequence: Synthetic coding sequence
atggatgtaagcggacaggagacagactggagaagcacggcctttagacagaagcttgtttctcaaattgaggatgcgatgaggaaagctggcgtggcccactcaaaaagctctaaagacatggaaagtcacgtctttctgaaagccaagacacgcgacgaatatctgtcccttgtggctcgcctgatcattcattttagggacattcataacaagaaaagtcaggcgagtgtctctgatcccatgaatgcgctccagtcgctgactggaggtcccgctgcgggtgccgcagggatcgggatgccacccagggggccagggcagtcattaggaggcatgggcagcctgggtgccatgggacaacctatgtctctttctggccagcctcccccagggacctccgggatggcccctcactctatggcggtggtttccaccgcaaccccacagacccagttgcagctccaacaagtcgctctgcagcaacagcagcagcagcagcagttccaacagcagcaacaggccgcattacagcagcagcagcagcagcagcagcaacagcagttccaagcgcaacagtctgctatgcagcagcaatttcaagcagtggtgcagcagcaacaacagctgcagcaacagcagcaacaacaacagcaccttattaagctgcaccaccagaaccagcagcagatacagcaacagcagcagcaactccaaagaattgcccagctccagcttcagcagcaacaacagcaacagcagcagcaacagcagcagcagcaacaggcactccaagcacagccgcctatacaacaaccccctatgcaacagccacagcctccaccctctcaagctctgcctcagcagttacagcagatgcatcatacacagcatcaccaacctcctccacagcctcagcagccacccgtggctcagaaccagccgagccagcttccaccccagtctcagacacaacctcttgtaagtcaggcacaagctctgcctggccaaatgctgtatactcagccgcctctgaagtttgtccgtgccccaatggtggtgcagcagccacctgtgcaaccccaggtgcagcagcagcagacagccgtccagaccgcacaagccgctcagatggtcgcccctggcgtccaggtgtcacaatcatctctaccaatgctctcatctcccagtcccggtcagcaggtacagacgcctcaatctatgcccccaccacctcagccctccccccaacctggtcagccatccagccaacccaattcaaatgtgagcagtggtccggctccatcaccatcctccttccttcctagtccgagtccccagccatctcagtctccagtgacggcaaggacccctcaaaatttctccgtaccatctcccggaccactcaatacaccagtgaacccaagttcagttatgagccctgctgggtctagtcaggcagaggaacagcagtatttggataagctgaagcagctgagtaagtatatagagcccttgcggaggatgattaacaagatagataagaacgaggaccgcaagaaagacctgtctaaaatgaagtccctcttagacatcttgacagaccctagtaagaggtgcccactgaaaactctccagaagtgtgaaatcgcccttgagaagctgaagaacgacatggccgtgccaaccccccctccacctcctgtgccacccaccaagcagcaatatctgtgccagccacttttggacgcagtcctggccaatataaggtccccggttttcaaccactccctttatagaacgttcgtgcctgctatgaccgccatccacggacccccaattactgcccctgtcgtttgtaccaggaaaaggagactagaggacgacgaacggcaaagcatcccatctgttcttcaaggagaagtggccagactcgatccaaaattcttagtgaacctcgacccgtcccattgttccaataatgggacagtacaccttatctgtaaattagatgacaaggaccttccttctgtgcctccactagaattgagtgttccggctgactatccagcccagtctcctctatggattgaccgtcaatggcagtacgacgccaatccttttttgcagtctgtccatcggtgcatgaccagccggcttctacagctgccggacaaacatagcgtaacagctctgctgaatacatgggcacaatctgtccatcaagcctgtctgtccgctgcctag

SEQ ID NO: 229810 - DNA, 2034 bp, Artificial Sequence
  Description of Artificial Sequence: Synthetic coding sequence
atggatgtttccggccaggagaccgattggcggagcactgctttcagacagaaactggtctctcagatagaagatgcaatgcgtaaagcaggtgtcgcgcactccaaatctagcaaggacatggagtctcacgttttcctaaaggctaagacacgggacgaatacttatcactcgtggcgagactcattatccacttccgcgacattcataataaaaaatcgcaggctagcgtctcggcccagcttcagctacaacaggtggccctgcagcaacagcagcagcagcaacagtttcagcagcagcagcaggccgctctgcaacagcagcagcaacagcagcaacagcagcaattccaggctcaacaatctgcaatgcagcaacaatttcaggcagtcgtccagcagcagcaacagctgcagcaacagcagcaacagcaacagcacctgataaaactacatcatcagaaccaacagcaaatccagcaacaacaacagcaactgcagagaatcgcccagctgcagctgcagcagcaacaacagcaacagcagcagcagcagcagcagcagcaacaggcgttacaggcccagccccctatccaacagccccctatgcagcagccccaaccaccaccatcccaggctctgccacagcagctccaacagatgcaccatacccagcatcatcagccacctcctcagccccagcaacctcccgtggcccaaaatcagccctctcaactgccccctcagagtcaaacacaaccgctggtctcccaggcccaagctctgccgggacaaatgctgtatacccagcctccgctgaaatttgtcagggcaccaatggtcgtgcaacagccgccagttcaaccccaagtccagcagcagcagactgcagtgcagactgcgcaagcagcgcagatggtcgcgccaggggtgcaggtttctcagtcctctcttccaatgctttcttctccgtcaccaggacagcaggttcaaacacctcagagcatgccgccacccccacagccctcccctcagcccggacagccctcgtcccagcctaattcaaacgttagttcaggacctgcacccagtccatcaagcttcctacctagtccttcgccccagccgtcccagagtcccgtgacagccaggactcctcaaaacttctcggtcccttcacctggaccactgaacactccagtgaatcccagctccgttatgagccccgctggcagcagccaggctgaagaacagcagtatctggacaaactcaaacaactctcaaagtatattgagccacttcgtcgaatgataaacaaaattgataagaatgaggaccgcaagaaggatttgtccaaaatgaaaagcctgctggatattctgaccgatcccagtaaacgatgtcctctgaagacactacagaaatgcgaaatagcacttgagaaactcaaaaacgacatggccgtgccaaccccacctcccccacctgttccgcctactaagcagcaatatctgtgtcaaccattgctggacgcagtgctggccaatatccggagtcccgtttttaatcactcgctctacaggactttcgtgcccgctatgactgccatccacggacccccaatcaccgccccagttgtttgcacaaggaagaggcgtctggaagatgacgaacggcagagtatcccttccgtgctgcagggggaagtggccaggctagatccaaagttccttgtcaacttggatccctcacactgttcgaacaatgggaccgtgcatctcatatgtaagctggatgacaaagatttgcccagtgtgcctcccctcgagctgtcggtgcccgcagactatccggcacagtctcctctgtggatcgaccggcagtggcagtacgacgctaaccccttccttcaatccgtgcatcgctgcatgacaagccggctgctgcagctgcccgacaagcacagtgttacagcgttgctgaacacctgggcacagtccgtgcaccaggcctgtttaagtgctgcctag

SEQ ID NO: 229811 - DNA, 2169 bp, Artificial Sequence
  Description of Artificial Sequence: Synthetic coding sequence
atgcgaaaagccggtgttgcacacagtaagtcttcgaaggacatggaaagccatgtttttttgaaggcaaagactagggacgagtacctctcactggtggccagactgatcattcattttcgggatatacacaataagaaatctcaggcaagcgtgtccgatcccatgaacgctttgcagtctttgacaggtggacccgcagccggagccgctggaatcgggatgccacccaggggacccggtcaaagtctgggtggaatgggcagtttaggagccatgggccagcctatgtccctctccggtcagccacctcccggtacatccggaatggctccccattctatggccgtggtgtctactgcgacgccccagactcaactgcagctgcaacaggtggcacttcagcagcagcagcaacagcaacagtttcagcagcaacagcaagccgctcttcagcaacagcaacaacaacagcaacaacaacagttccaggcacagcagagcgctatgcagcagcagtttcaagccgtagtccagcagcagcagcagttacagcagcaacagcaacagcaacagcacctaatcaagttgcaccaccagaaccagcaacagatccaacaacagcagcagcaactgcagcggattgcccagttacagctgcaacagcaacagcagcagcagcagcaacagcagcagcagcagcagcaagctcttcaggcccagcccccaatacagcaaccgcctatgcagcaaccacagcctcccccaagccaggcgctgccccagcagctgcagcagatgcaccatacacagcaccaccaacccccaccccagccacagcagccacccgtggcccaaaatcagcccagtcagctgcctcctcaaagtcagactcagccattggtatcccaggcacaggcacttcctggccaaatgttgtacacacaaccccctctcaaattcgtaagggcccctatggtagtgcagcagccccctgtacaacctcaggttcagcaacagcagactgctgtgcagacagcacaggccgctcaaatggtagcccctggagtgcaggttagccagtctagtctgcctatgctatctagcccatctcctgggcaacaggttcagaccccacagtccatgccaccaccccctcagccaagccctcagcctggacagcctagctcccaaccaaatagcaacgtgagttcaggaccagctccgtcacccagcagttttctgcccagtccaagcccccaaccctcacagtcacccgtaacggcgcgtacgccccagaatttctccgttcccagtccaggtcccctgaacacgcctgtgaacccttctagcgtgatgagccccgctggcagctcccaggcagaggagcaacagtacctcgacaaactaaaacaactgagcaaatatatcgagccactaaggcgaatgataaataagatcgacaaaaatgaggaccgtaagaaggacctcagcaaaatgaagagtcttctcgacatcttgaccgatcctagcaagaggtgccctctcaagaccttgcagaaatgtgaaattgcgttggagaagctgaagaatgacatggctgtccccacccccccacccccaccagtaccacccaccaaacagcaatatctctgtcagcccctcctggacgctgttcttgcaaacattcgtagcccagttttcaatcactcactgtacaggactttcgtgcccgctatgacagctattcatggccctccaattaccgcacctgtcgtctgcacaaggaaacgtaggcttgaggacgacgagcgacagtctattccatccgtcctgcaaggggaagttgctaggcttgaccccaagttcctcgtaaacttggacccttctcattgcagtaataatggtactgtacacctcatttgcaagctggatgacaaagatctaccctcagtgcccccactcgaactgagcgttccagccgactacccagctcagtctcccctgtggattgatcggcagtggcagtacgatgctaatccatttttgcagtcggtccatcgatgcatgacgtctcggttgctccagttacccgacaagcatagcgtaacagccctgcttaacacctgggcacagtctgtccatcaggcgtgtctgagtgccgcttag

SEQ ID NO: 229812 - DNA, 1914 bp, Artificial Sequence
  Description of Artificial Sequence: Synthetic coding sequence
atggagagccatgtttttttaaaggctaagaccagggatgagtatctgagtctcgtcgctcgcctgattatccatttccgggatatacacaataaaaaatcccaggcaagcgtctccgcccagcttcagcttcagcaggtcgctctgcagcagcaacaacagcagcaacagtttcaacagcagcagcaggcagctttacagcaacaacagcagcagcagcagcagcagcagtttcaggcccagcagtccgccatgcaacaacagttccaagcagtggtccaacagcagcaacagttgcaacagcagcagcagcaacagcagcatctgatcaagctgcatcaccaaaatcagcaacagattcagcaacagcagcagcagcttcagcgcatagcccaacttcagctgcagcagcaacagcagcagcagcagcagcaacaacaacaacaacagcaggccctgcaggcccagcctccaattcagcagccgcctatgcagcagccacaaccaccaccaagccaggccctgccacagcagctgcaacaaatgcatcacacacaacatcatcagcctcctccacaaccgcagcagcctcctgtggcccagaatcagccctcacagctaccgcctcagtcccaaacccagccactagtttcccaggctcaggctctgccaggacagatgctctatacgcagccacccttaaaatttgtaagggcaccaatggtggtccagcaaccacctgtgcagccccaagtccagcagcaacaaacagctgttcagaccgctcaggccgcacagatggtggctccgggagtgcaagtctcccagagctccctcccaatgctgagctccccctctccagggcagcaagtccaaactccccaatctatgcctccgcctccacagcctagcccacagcctgggcagccctcctctcagcctaacagtaatgtctcctctgggccagcgcctagcccaagctcttttctgccaagccccagtccccagcccagccagtcgccagtcaccgcacgcactccacaaaattttagcgtgccctctcccggaccgctgaatacccccgtgaacccatctagtgtgatgagcccagccggatcaagccaggccgaggagcagcaatacctggataagcttaagcagctttctaaatatattgagcctttgcggcgaatgattaataagatcgacaaaaacgaggatcggaagaaagacctgagcaagatgaagagcttgctggacatactcacagatcccagtaaaagatgtccacttaagacactacagaaatgcgagatcgctcttgagaaactcaagaatgacatggctgtgcctactccgccacccccacctgtacctccgaccaagcaacagtatctttgccagcctctgttggatgctgttctggccaatataagatcgcctgtgttcaatcactcactgtacagaacatttgtaccagcaatgaccgccatccatggaccaccgattactgccccagtggtctgtacccgcaagcggcgactcgaagacgatgagagacaaagtatccccagtgtacttcagggcgaggtcgcacggctggatcccaagttcctggtcaacttggacccatcgcactgctccaataacggcaccgtgcatctgatctgtaagctggacgacaaggacttgccatccgtcccgccactggagctcagtgttccagcagactaccctgcccagagtcccctgtggattgatagacagtggcaatatgacgcgaacccatttctccagtccgtacaccggtgcatgacttcccgcctcctgcagctgcccgacaagcacagcgttactgctctgctgaatacctgggcccagagtgtgcatcaggcttgtttaagcgccgcatag

SEQ ID NO: 229813 - DNA, 2169 bp, Artificial Sequence
  Description of Artificial Sequence: Synthetic coding sequence
atgaggaaagcgggtgtggcccacagtaagtcttctaaggatatggaatcccacgtgttcctcaaggcaaagactcgcgatgagtacctgtccttggtagctcggctcataatccacttcagagacatccacaataaaaaaagccaggcttctgtgtccgaccccatgaacgcccttcagtctcttaccgggggacccgctgcgggagccgctggcattggtatgccccctaggggccctggccagtccttgggcggtatggggagcttgggagcaatgggccagccaatgagcttatctggccagccacctccaggcacgagcggaatggcaccacattcaatggctgtagtgtcaacagctactccacagactcaactgcagctccagcaggtcgcgctgcagcagcagcagcagcaacagcaatttcaacagcaacaacaggctgcccttcagcaacagcagcagcaacaacagcagcagcagtttcaggctcagcagagcgccatgcagcagcaattccaagccgtagtacaacagcaacagcaattgcaacagcagcagcagcagcaacagcacctcataaagctccatcaccagaaccagcagcagatccagcagcagcagcaacaactgcagcgtattgctcagctacaacttcagcagcagcagcagcagcaacagcaacagcagcaacagcagcagcaggcactacaagcccagcccccaatccagcaaccccctatgcagcagccacagcccccaccctcacaggcactgcctcagcaactgcagcagatgcaccacacccagcaccatcagcccccacctcagccccagcaaccacctgttgcccagaatcagccctctcagctgccacctcagagccagacacagcctctggtttcacaggcccaggccttgcccggtcagatgctctatacccagcctcctcttaaattcgtccgggctcccatggtggtgcaacaacccccagtacaaccacaggtccagcagcagcaaacggcagtacagaccgctcaggcagcccaaatggttgcaccaggggtgcaggttagtcaatcgagcctgcctatgctgagtagcccatcccccggtcagcaggtccagaccccacagtccatgccacctcctccacagccatctccacagccagggcagccttctagccaacccaacagtaatgtctcaagtgggccagccccttccccctcgagctttctccccagtcccagcccccagccctctcagtcacccgtcacggccaggacacctcagaatttctctgtcccatctcctggtccgctgaacacgcccgtcaacccctccagcgtgatgtcaccagcgggttccagtcaggcagaagaacagcagtacctcgacaagttgaaacagctctccaagtatattgaacctcttcggaggatgatcaacaagatagataagaatgaggaccgcaagaaggacttaagcaaaatgaaatctctactagacatcctaacagacccgtctaaaagatgtcccctcaagacattacagaagtgtgaaatcgcgctcgagaagttgaaaaatgacatggccgtcccaacacccccaccaccacctgttcccccaacaaagcagcagtatttgtgccagccactcctggacgctgtgttggcaaacatccggagccctgtctttaaccattccctttaccgcacctttgttcccgcaatgactgccatacacggccctcccattactgctccagtggtgtgcactagaaaacggcgattggaagatgacgaacgacaatctatcccctcagttttgcaaggggaggtggctagactggatccaaagtttctcgtcaacctcgatccttcgcattgtagcaataacggtaccgtgcacttgatctgcaagttagacgacaaggacctgccctctgtgccgcctcttgagctgtctgtgccagcagattatcccgctcagagccccctctggattgataggcaatggcagtacgacgccaatccctttctgcagtccgtccatagatgtatgacatcacggttactgcagttaccagataagcattccgtgacagctctgcttaatacatgggcacagtctgtacaccaggcttgcctcagcgctgcctag

SEQ ID NO: 229814 - DNA, 2157 bp, Artificial Sequence
  Description of Artificial Sequence: Synthetic coding sequence
atgaggaaagctggcgtagctcactctaaatccagtaaggatatggaaagccacgttttcctgaaagcaaaaacccgggatgaatatctctccctggtcgccagactaataatccacttccgtgatatccacaataagaagtcccaagcaagtgtgtccgaccccatgaacgcactccagtcactgaccggaggtcctgcggcaggagcagctggaatcggcatgccgccaagaggcccaggccaaagtctcgggggaatgggctctctgggggcaatgggccaaccaatgtccctcagcggccagccgcctccaggaacgagcggtatggcgcctcacagtatggccgtagtatccacagccacgccccagacacaacttcaactgcagcaggtggcactgcagcagcagcagcagcagcagcaatttcagcagcagcagcaggcggcactgcagcagcagcagcagcagcagcagcagcagcagttccaggcacagcagtcagcaatgcagcaacagtttcaggccgtggtccagcagcaacagcagctgcaacagcaacagcagcagcagcagcacctgatcaagctgcatcaccagaaccagcagcagcagcagcaacaggccttgcaggctcaaccacccatccaacagcctcccatgcagcagcctcagccgccaccgagtcaggctctgcctcagcagttgcagcagatgcaccacactcagcatcaccagccaccaccccaaccacaacagcctccggttgcacaaaatcagccctcccagctgcccccacagtctcagactcagcccctcgtgtcacaggctcaagccctccctggacaaatgctgtacacgcagcctccactaaagtttgttagggccccaatggtggttcagcagcctcccgtacagccccaggtccagcagcagcagacagccgttcagacagcacaggctgcccagatggttgcccctggcgtccagatgattaccgaagctctagcccagggtgggatgcacatcagggcaagatttccccctacgaccgccgtgagcgccattccctcgtcatccattcccctcgggagacagcctatggcccaacaggtccaaaccccccagagtatgccaccgcctcctcagccgtcaccacagccaggacagccttcctcacaacccaactcgaatgtttcttctgggcctgctcctagtccgagttctttcctgccctccccgtctcctcagcccagccagagtccagttactgcacggactccccagaactttagcgtgccgagccctggtcccctcaacacgccagtgaacccctcttctgttatgtctcctgctgggtcttctcaagcggaagaacagcagtatctggacaagctgaagcaactctctaaatatattgaacccctccgtcgtatgatcaataaaatagacaagaatgaagacagaaagaaggacctcagcaaaatgaagtctttgttggatatcctcacagatccgtctaaaaggtgtccactcaaaaccctacagaagtgtgaaatcgccttggagaagctcaagaacgacatggcagtccccactccacccccaccaccggtgccacccacgaagcagcagtacttgtgccagcctctccttgatgccgtgctagctaatatacgtagtcctgtctttaaccactcgctctacagaaccttcgtgcccgcaatgacagcaatccatggaccacctatcaccgcgccagttgtctgtacccgaaagaggagattggaagatgatgaaaggcagagtatcccatcagttctgcaaggtgaagtggccaggctggacccaaagtttcttgtgaacttggatccctcccactgctctaataacggtaccgtccatttgatttgcaagctcgacgataaggaccttccatccgttccacctctagaattgagcgtccctgccgattatcccgcacagtcacctctgtggatcgacagacagtggcagtatgacgccaacccattcctgcagagcgtgcaccgatgcatgacctccaggttactgcagcttcccgacaaacacagtgtaacagcactcttaaacacatgggctcaaagtgtgcatcaggcctgcctgagtgccgcttag

SEQ ID NO: 229815 - DNA, 570 bp, Artificial Sequence
  Description of Artificial Sequence: Synthetic coding sequence
atgcagcagcaattccaagccgtagtgcagcagcaacagcagctgcaacagcagcagcaacagcagcagcacctgattaagctgcaccaccagaaccaacagcagatccagcaacagcagcagcagctgcagcgtatcgcacagctgcaactccaacagcaacaacagcaacaacagcagcagcagcagcagcagcagcaagccctccaggcgcagccccctattcagcagccacctatgcagcagcctcagccccctccatcacaggccctgccccagcagctacagcagatgcaccacacacaacatcatcagcctcctccgcagcctcagcagcccccagtggctcagaaccaaccttcgcagctccccccacaatctcagactcaacctcttgtttcccaggcacaggccttgccaggacagatgctgtacactcaaccaccattgaaattcgtgcgggcaccaatggttgttcagcagcctccagtgcagccgcaggtgcagcagcagcaaacagcagtacaaactgcccaggctgcacaaatggtggcgccaggagtgcagtag

SEQ ID NO: 229816 - DNA, 1956 bp, Artificial Sequence
  Description of Artificial Sequence: Synthetic coding sequence
atgagtggagtgagagcagtcaggatctctatcgagtcagcttgtgagaagcaggtgcacgaagttgggctggacggcaccgagacttacctgcctccattaagcatgtcacaaaatctcgctcgcttggcacagaggatcgatttttcacaaggcagcggttcggaagaggaggaggccgctggaaccgagggagacgcccaagaatggccgggtgccggatcttcagccgatcaggatgacgaagaaggagtggtcaaatttcaaccgagcctctggccgtgggattctgtcagaaacaatctgcgaagcgcccttactgagatgtgcgtgctgtatgatgtgttgtcaatcgttcgggacaagaagttcatgaccctcgaccctgtgagccaagacgcacttccccctaaacaaaacccccagactctgcagttgatctcaaaaaaaaagagcctggctggggctgctcagatcctgctgaaaggggctgagagactcacaaagtccgtgactgagaatcaggaaaacaaattgcagagggatttcaacagcgagctgcttcgcctccgacagcactggaaattgagaaaagtgggagacaagatactgggcgaccttagttatcgttcggcgggtagtctgtttccgcaccatggtacctttgaagtaatcaagaacactgatctcgacctagacaagaaaatcccggaagactattgcccactggatgtgcagatccccagtgacctggagggatcagcctacataaaagtgtccatccagaaacaagcacctgacatcggcgacctggggacggtaaatctgttcaaacgaccacttccaaagtctaaacccggttcccctcattggcagacaaaactggaggccgcacaaaatgtcttgctctgtaaagaaattttcgcccagctgtctagggaggccgtacaaataaaaagtcaagtgccacacatagtcgtaaaaaaccagatcatatcccagccattcccaagcctccagctgtcaatttcgttatgtcatagttctaatgataaaaagtcccagaagttcgccacagaaaagcaatgcccggaggatcacctgtatgtgcttgagcacaacctgcacttgctcataagggagtttcacaagcaaacactgagctcgatcatgatgcctcacccagccagcgcacccttcggccataagcgaatgagattgagtggccctcaggccttcgataaaaatgagatcaattcgttgcagtcatctgagggccttctggagaagattataaaacaggctaaacacatctttttgagaagccgcgctgccgctaccatagactctctggcatcacgaatagaggacccccagatccaagcccactggtccaacatcaacgacgtgtacgagtcctcagtgaaggtgctgatcacgtcccagggatatgagcaaatatgcaagtcaatccaactgcaacttaacattggggttgagcagatccgtgtggttcatcgagatggcagagtgattacactgtcgtaccaagagcaagaactccaggacttcctgctttcacagatgtctcagcaccaagtgcacgccgtccagcagttagccaaggtgatggggtggcaggtcctttccttctcaaatcacgtgggactggggccaattgagtctataggaaacgcctcagcaattacagtggccagcccaagcggggactacgcaatcagcgtacgcaacgggcctgagtctgggagcaagattatggtgcagtttccaagaaaccagtgtaaggacttaccaaaatctgatgtactgcaggacaacaaatggagtcatctgcgcggtccttttaaagaggtgcaatggaataagatggagggtaggaattttgtttacaaaatggagttgttgatgtcagcgctgtccccatgcctgctctag

SEQ ID NO: 229817 - DNA, 1866 bp, Artificial Sequence
  Description of Artificial Sequence: Synthetic coding sequence
atgtctggagtgcgggctgttagaatcagcattgaaagcgcctgcgagaaacaggtgcatgaagtgggcctggacggaacagaaacgtatctccctccgctgagtatgagccaggaatggcctggagccggttcgagtgcagaccaggacgacgaagaaggagtagtcaaattccagccttcactgtggccttgggactccgttcggaacaacctgagatccgccctcaccgagatgtgtgtcctgtacgatgttttatctattgtccgtgataagaagttcatgactttagacccagttagtcaggacgccctcccacctaagcaaaaccctcagaccctgcagcttatttctaaaaagaagagccttgcaggcgctgcacagattttacttaagggtgcagaacgtctgacaaagagcgtcacagagaaccaggaaaataagcttcaaagagacttcaactcagaactactaaggcttcgccagcattggaaactccgcaaagtcggtgataaaatattaggggacctttcttaccgttctgccggaagtctcttcccccaccacggaactttcgaggtaattaagaatactgacctggatctcgacaagaagattcccgaagactactgccctcttgacgtgcagattccatccgacctcgaggggagcgcttacattaaggtgtcaatccagaagcaagcgccagacattggggatctaggtacggtaaatctgtttaagaggccgctccccaaatctaaacctggttctccacattggcagactaagctcgaggctgcccaaaatgtgctattgtgcaaggagatctttgcccagctgagccgcgaagcagtccaaatcaagtcccaggttccccatatagtggtgaagaatcagattatatcacaaccattcccgtcgctgcagttgtctatctcactctgccactcttctaacgataaaaaatcccaaaaatttgccactgagaagcaatgccctgaggaccacttgtacgtcctcgaacataacttgcatttgctgattagagagtttcataagcagactctgtcatccatcatgatgcctcaccccgcatcagcacctttcggtcacaagcggatgcgcctgtcagggcctcaggcttttgacaagaatgagatcaattctctgcagtcctctgaggggctgttggagaagatcattaagcaggcaaagcacatctttctaaggtcacgggcagcagccacaatcgattccctagctagtcgaatcgaggaccctcaaattcaagctcactggtcaaatatcaacgatgtgtatgaaagctcagtgaaagtactgattaccagtcagggatatgagcagatatgcaagagtatccagctgcaattgaacattggggttgagcagattagggttgtacatcgggacggcagagtgatcacattgtcgtatcaggagcaagagcttcaggacttcctgctgtcccagatgtcccagcaccaagttcatgccgtgcagcagctggcgaaggtgatgggctggcaggtgttatctttcagcaatcacgtgggccttggaccgatcgagtccataggtaatgcctctgcaatcacggtggcatcccccagtggcgactacgctatatccgttaggaatggtccagaaagtggatcaaagataatggtccagtttccgagaaaccagtgtaaagatctgccaaagtcagatgtgctgcaggataataagtggagtcacctccgcggaccatttaaggaggtccagtggaataaaatggagggcaggaacttcgtttacaagatggagttacttatgagcgccctgagcccttgtctgctgtag

SEQ ID NO: 229818 - DNA, 438 bp, Artificial Sequence
  Description of Artificial Sequence: Synthetic coding sequence
atgtcgggggtgcgcgctgttaggattagcatcgagtctgcctgtgagaaacaggtgcacgaagttggtctcgatgggactgaaacttacctgccaccactgtctatgagccagaatctggcccgtctagcccagcgcattgattttagccagggttcgggctctgaggaggaggaagccgctggcacagaaggcgacgcccaggagtggcctggcgcaggctcatcagcagaccaagacgatgaggagggcgttgtcaagtttcagcccagcttgtggccttgggatagcgtgagaaacaacctgcggtcagcccttacggagatgtgcgtattgtacgacgtgctctctattgtaagggacaaaaaatttatgacgctggatccagtgtcccaggacgccctaccaccgaagcaggtgtttgtggacttcaattag

SEQ ID NO: 229819 - DNA, 627 bp, Artificial Sequence
  Description of Artificial Sequence: Synthetic coding sequence
atggaggcacctcctgttacgatgatgccagttactggaggtacgatcaatatgatggaatatctcctccagggtagcgtgctggatcactctctggagagcctgatccatcgtttaaggggactctgtgataatatggaacctgaaacattccttgatcatgagatggtttttctactgaaaggccagcaagcaagtcccttcgtgctgagagcccgtcgcagtatggaccgggctggagcaccatggcatctccgttacctgggccagcctgaaatgggggataaaaaccgtcacgcgctagttcgaaattgtgttgacatagcaactagtgagaacctcactgactttcttatggagatgggctttagaatggaccacgagtttgtggcaaagggtcatttatttcgcaaaggcatcatgaaaatcatggtttacaaaatctttcgtattctggtccctgggaatacagattctacagaggcactatcactttcctacctagtggagttgtccgtagtcgcccctgccggtcaggatatggttagcgacgacatgaagaatttcgctgaacagctgaaaccactcgtgcatctggaaaaaattgaccctaaaagactgatgtag

SEQ ID NO: 229820 - DNA, 627 bp, Artificial Sequence
  Description of Artificial Sequence: Synthetic coding sequence
atggaggctccccctgtgacgatgatgcctgtcacaggaggaaccatcaacatgatggagtatctgctgcaggggtccgtgcttgatcactcattggaatctttgatccatagactgagggggttgtgcgataacatggaacctgagacgtttctggatcacgaaatggtgttcctcctgaagggccagcaggcttcaccattcgtgctccgagctcgaaggtctatggaccgggctggagctccttggcacttaagatacctcggacagcccgagatgggagacaaaaaccgtcacgccttagtcaggaactgcgttgatatcgccacatccgagaatctcacggatttcctaatggagatgggttttcgaatggatcatgagttcgtggctaaagggcatctgttccggaaaggtatcatgaagatcatggtctataagatctttcgaatccttgtgcctgggaacactgattctacagaggcactaagtctcagttaccttgtcgagctctcggtggtagcccctgctgggcaggacatggtatccgacgacatgaagaacttcgcggagcagctgaaacctctagtccaccttgagaaaattgatcccaaaagactgatgtag

SEQ ID NO: 229821 - DNA, 585 bp, Artificial Sequence
  Description of Artificial Sequence: Synthetic coding sequence
atggaaaacttcacagcactgttcggagcccaggccgaccctcctccgcctccaacggcactcggttttggaccaggaaagccgccacctccccctcctcccccagctggtggaggtccaggaaccgcgccaccacccacagctgctaccgcgcctcctggagctgataagtctggagcagggtgtggtcccttttacttgatgagggagctccccggaagcactgagctaactgggtccacgaatctgattactcattataacctggagcaagcctataacaaattttgtgggaagaaggtgaaggagaagttatccaatttcctgccagatttaccaggcatgatcgatcttcccggaagccacgacaactccagtctcaggagtcttatcgagaaaccaccaatccttagctcttcttttaatccaatcactggtacgatgctggccggattccggttgcacacaggcccactgccagagcagtgtcgcctcatgcacatacagccgccaaaaaaaaagaacaagcacaaacacaaacagtctagaactcaggaccctgttccgccaggaaaaccttcatag

SEQ ID NO: 229822 - DNA, 735 bp, Artificial Sequence
  Description of Artificial Sequence: Synthetic coding sequence
atggagaactttaccgcactgtttggggctcaggctgacccccctcctccaccaaccgctttgggatttggacctggtaaaccaccaccacccccaccgcctccagcagggggtggacccggaacggcccctccccctaccgcggcaacagcccctcctggcgctgataaatccggcgctggctgcggtccattctacctgatgcgggagctccccggaagcacagagctgaccggttccacaaacctaataacccattacaacctcgaacaggcttacaataaattctgtggcaagaaggtgaaagagaaactgagcaactttctccccgacctcccaggtatgattgacctccccggatcccacgataatagcagcctgcgatccctcattgaaaaaccaccaatcctcagctctagttttaatcctatcactgggacgatgctcgcgggatttcggctgcacaccggccctttacccgagcagtgccgcctgatgcacattcaaccccctaagaagaaaaacaagcacaaacacaaacagtcccgcacccaggaccccgtcccaccagaaactccttcagactcggaccataaaaagaagaaaaagaagaaagaagaggatcctgagcgcaagcgcaagaagaaagagaaaaagaagaaaaagaatagacactcgccggatcaccccggaatggggtcaagtcaggcctcatcctcatctagtctccgctag

SEQ ID NO: 229823 - DNA, 639 bp, Artificial Sequence
  Description of Artificial Sequence: Synthetic coding sequence
atgggcgtgacctgtgtcagccagatgccagtggctgagggaaaatccgtccagcagaccgtggagctcttgacgaggaaactggagatgctgggggcagagaagcaggggaccttttgcgtcgattgcgagacttaccataccgccgctagcacccttgggagtcaagggcaaacaggcaagttaatgtacgtgatgcataactctgagtaccccctgagctgcttcgcattatttgagaacggcccttgcctgattgctgacaccaatttcgatgtcttgatggttaaactcaaagggtttttccagtctgctaaggctagtaaaatcgagacacgaggcactcgctatcagtactgcgatttcctggtcaaggttggtactgtgaccatggggccatccgccagaggcatctctgtcgaggtggagtacggcccttgcgtggtggcaagcgattgctggagtttgctgctcgagtttctgcaatctttccttggttcccacacacctggggcaccagcagttttcggcaataggcatgatgctgtctatggcccagccgacaccatggtccagtacatggaacttttcaacaagatcaggaaacagcagcaggtgccagtcgcagggatcagatag

SEQ ID NO: 229824 - DNA, 423 bp, Artificial Sequence
  Description of Artificial Sequence: Synthetic coding sequence
atgcctgtcgcagaagggaagtcggtgcagcagaccgtcgaactgctgacaagaaagctggagatgctcggcgcagaaaaacagggaaccttctgcgtcgattgtgagacctaccatacggctgcctccactttagggtctcagggtcagaccgggaagttaatgtatgtgatgcataactcagagtatcccttgtcttgcttcgcacttttcgagaacggcccatgtctcatcgcagatacaaatttcgacgtccttatggtgaagctgaagggctttttccagtcggccaaagccagtaagatagagactaggggtactcgctaccagtattgcgatttcctggtgaaggtgggcaccgtgaccatggggccaagcgctaggggaattagcgtcgaggtggagtatggcccatgtgtgtag

SEQ ID NO: 229825 - DNA, 438 bp, Artificial Sequence
  Description of Artificial Sequence: Synthetic coding sequence
atgggggttacatgcgtatcccagatgcccgtggcagaaggaaaatctgtccagcagacggttgaactcctaacccggaaattagaaatgctcggggcagagaaacaaggaacattctgtgtggattgcgaaacctatcacactgccgcatcaacactcggctcgcagggccaaaccggtaagctgatgtacgtcatgcacaattcggaatacccgttgtcatgttttgccctgtttgaaaatggcccttgcttgatcgccgacacaaattttgacgtgctgatggtgaagctgaagggtttttttcagtctgcaaaagcctctaaaatcgagactcgagggacccggtatcaatattgcgacttcctcgtaaaggttggcactgtcactatggggccaagtgcgcgagggatctccgtggaggttagaccctggtag

SEQ ID NO: 229826 - DNA, 372 bp, Artificial Sequence
  Description of Artificial Sequence: Synthetic coding sequence
atgggggtgacctgtgtgagccagatgcccgtggcagaaggcaagtcagttcagcaaaccgtggagctgctgacacggaaactggagatgttaggggctgaaaagcaggggaccttttgtgtcgattgtgagacatatcatactgcagccagcacactgggaagccagggccagacaggaaaactgatgtatgtgatgcacaattccgagtaccctctgtcttgctttgcgctgtttgaaaatgggccatgtcttattgccgatacgaatttcgatgtcctgatggtgaaactgaagggctttttccagagcgccaaggcgtccaagattgagacgcggggtacgcggtggagcatggccccagtctggtag

SEQ ID NO: 229827 - DNA, 435 bp, Artificial Sequence
  Description of Artificial Sequence: Synthetic coding sequence
atggccgaccggctaacacagctgcaggacgcggtgaacagtctggccgatcagttctgcaacgcaattggggtactgcaacaatgtggcccaccagccagtttcaacaatattcagaccgccatcaacaaggaccaacccgctaatccaactgaggaatatgcacagctatttgctgccttgatagcgaggaccgcgaaagatatcgacgtgctcatagattctctgccctctgaggaatccactgctgcgcttcaagccgcaagtctgtacaaactggaggaggaaaaccacgaggctgcgacatgtctggaggatgttgtctaccggggagatatgcttcttgagaagattcaatccgccttagccgatatcgcccagagccagctgaagaccaggtcagggacacactctcaatccctgccagattcttag

SEQ ID NO: 229828 - DNA, 4098 bp, Artificial Sequence
  Description of Artificial Sequence: Synthetic coding sequence
atggaaacgcaactgcagtctatattcgaggaagtcgtcaagacagaggtgatcgaggaggccttcccaggaatgtttatggatacgccggaggacgagaagaccaagttgattagctgcttaggagcattcagacagttctggggagggctgtctcaggagagccacgagcagtgcattcagtggatcgtcaaattcattcacggccagcattctccgaagcgaatcagcttcctgtatgactgccttgcgatggccgtggagactggattgctcccaccaaggcttgtttgcgagagtcttatcaacagtgatacccttgagtgggagagaacccagctatgggcgctgactttcaagctggttcgcaagattataggtggggtggactacaagggggtccgtgatctgctaaaggtgatcctagaaaagattctgacaatcccaaataccgtgtccagtgcagtcgtgcagcaactactcgcggctcgcgaagtcatcgcctatattctggagaggaacgcttgcctgctgcctgcatattttgctgtgacagaaattcgcaaactatatccagagggaaagcttccgcactggttgctgggaaaccttgtaagcgattttgtggacactttccgtcctacagccagaatcaactccatctgtggcagatgtagcttgctgccagttgtgaacaatagcggagctatttgcaactcgtggaagctagaccctgccactctgcggtttccactgaagggcctccttccctacgacaaggatctgtttgaacctcagaccgcacttctacgttacgtcctggaacagccctattctagagacatggtatgtaatatgctgggcctcaataaacagacccttaacattgcccagcataaacagcgctgcccagtgctggaagaccaactcgttgatctagtggtctacgctatggaacggtctgaaaccgaagagaaatttgacgatgggggtacatctcagctgttatggcagcatttatccagtcaattaattttcttcgtactgttccaatttgcaagctttccccacatggttcttagcctgcatcagaaactggcaggtcgtgggttgatcaaaggcagggatcacctgatgtgggtgctcctccagttcattagcggtagcattcagaaaaacgccctcgccgattttctgccggttatgaagctgtttgacttgctgtaccccgaaaaagaatatattcccgtccctgacatcaataagcctcaatccacgcatgcctttgctatgacttgtatctggatccatctgaaccgcaaggcccagaacgataattccaaactgcagattcccatccctcatagtctccgattgcaccatgagtttttacagcagagcttgcgaaacaagagcttacagatgaacgattacaagattgccctgctctgtaatgcttacagcactaattctgagtgtttcaccttacctatgggagctcttgtcgaaaccatctatggcaatggcataatgcgtatacccctgccagggaccaactgtatggcgtccgggtccattacaccactccctatgaatttactggattcactgacagtccacgcaaagatgagcctgatccattccatcgctacaagggtcatcaagctggctcacgcgaaaagttccgtagcgttagcaccagcgctggtagagacttacagtagactgctggtgtatatggaaattgagagcctcgggatcaaaggattcatttcccagctgctcccgacggttttcaaaagccacgcttggggcattttgcatacgttgctagagatgttcagctatcggatgcatcacattcaaccgcactatcgtgttcaactgctcagccatctgcataccctcgctgctgtggctcagacgaatcagaaccagcttcatttatgtgtagagagcactgccttaaggctgataacagcactgggcagctctgaggtgcaaccccagttcacaagattcttgtccgaccccaaaacggttttaagcgcagagagtgaggagctcaatagggccctgatcctgaccttagcaagagctacgcacgtcacagatttcttcacaggctcggacagtatccagggcacttggtgcaaggacatactgcagaccattatgagtttcacaccacataattgggctagccacacactcagctgcttcccaggcccattgcaggccttcttcaagcagaacaatgtcccacaagaatcccgttttaacctgaagaaaaatgtggaagaagaatataggaaatggaaaagtatgagcaacgagaacgatattatcacccactttagtatgcagggctcacccccactgttcctctgcctcctttggaagatgctattagaaacggaccatattaaccagatcggttacagagtactggagcggatcggagctcgtgcgctagtggctcacgtgagaactttcgccgatttcctggtgtacgagttcagtacctctgcaggtggccaacagctgaacaagtgtatagagattctgaatgatatggtttggaagtacaatatcgtcacccttgaccgcctcattctttgcttggccatgcggtctcacgagggtaacgaagcccaagtgtgttattttattattcagttgctcctcctcaagcctaacgattttagaaatcgagtttctgactttgtgaaggaaaactcccctgaacactggctccagaacgattggcatactaaacatatgaattaccataagaaatatccggaaaagttgtatttcgagggccttgctgaacaggtggacccacccgtgcagattcagtcaccctatcttcccatttacttcgggaacgtctgcctgaggtttctgccagtgttcgacatcgtcatccatagattcctggaactgctgccagtgagcaaatcactggaaacattactcgaccatctcggtggactgtataaatttcatgaccggccagttacttacctctacaataccctccattactatgaaatgcatctgcgcgacagggcttttcttaaaagaaaactggtgcatgctattatcggctctctgaaggacaatcgccctcagggctggtgtctgtccgatacttacttaaaatgcgccatgaatgcgagggaagagaacccttgggttcccgacgatacgtattactgccgtctgataggccgattagtagacaccatggcaggcaagagtccgggaccttttccaaattgtgattggaggtttaatgaattcccaaaccctgccgcacacgcccttcacgtcacctgcgtggaactgatggccctcgcagtctccggtaaggaggtgggaaacgcccttctcaatgtcgtcctcaaaagccagcctctggtaccccgagaaaatattaccgcctggatgaatgccataggcttgatcatcactgcactgcctgagccttactggatcgtgctccatgacaggatagtgagcgttatttcatccccgtcactcacctcagaaactgagtgggtgggatacccttttcggttattcgatttcaccgcttgccaccaatcctactcagagatgtcttgttcctataccctggctttagcccacgccgtgtggcaccactcctccataggacagttaagcctcattccaaagtttttgaccgaggtactcttgccgatcgtgaagactgagtttcaactgctgtacgtgtatcacttagttgggcctttcctgcaaagattccagcaggaaaggacacgctgcatgatcgagattggggtggctttctatgacatgctcctgaacgttgatcagtgcagcactcacctgaattacatggaccctatatgcgacttcctgtatcatatgaaatatatgtttacaggcgattccgtgaaggagcaggtcgaaaaaataatatgtaacctaaaacccgcactaaagctgcggcttcgctttattactcatatttcaaaaatggaacccgcagccgtgccccctcaggctatgaattctggaagcccggctcctcagtcaaaccaatag

SEQ ID NO: 229829 - DNA, 2661 bp, Artificial Sequence
  Description of Artificial Sequence: Synthetic coding sequence
atggagacacagttgcagagcattttcgaagaggtggtaaagacagaagtcattgaagaggccttccccggtatgtttatggacactccagaggacgaaaaaactaagctgatatcgtgcttaggcgcatttcgccagttctggggcggtctgagccaggaatctcacgagcagtgcatccagtggatcgttaagttcatccatggtcaacactccccaaagaggatttcctttctgtacgactgtttagcgatggccgttgagacaggcctcctgcctccaagactggtgtgtgagagtctcatcaactctgacacattagaatgggaaaggactcaactctgggccctgaccttcaaactggtgaggaagatcatcggcggagtcgattacaagggcgtaagagatcttcttaaagtgatcttggaaaagatcctgaccatccccaataccgtgagtagcgcggtggtgcagcagttactggccgcacgagaggtgatagcttatatcctagaaagaaatgcgtgcctgctgcccgcttactttgctgttacagagattcgaaaactgtaccccgagggaaagttgccccactggctgcttggaaatctggtgagtgactttgtagacaccttcagacctaccgccaggatcaactccatctgcggcaggtgtagtctgcttccggtggtcaacaactccggtgctatttgtaacagctggaaacttgaccccgcaacgctccgatttccacttaagggcctgctgccttacgataaagatctcttcgaaccacagacggccctcctcagatacgtgttggaacagccatacagtcgggacatggtttgtaacatgcttggtttgaacaagcagactcttaacatcgcccagcacaaacaaaggtgtccagtcttagaagatcaattagtagatttggtggtgtacgccatggagcggagcgagacagaggagaaattcgatgacggcggtacgagccagctgctctggcagcacctgtctagccaattgatcttctttgtactgtttcaattcgcgtcatttcctcatatggttctgagccttcatcagaaattagcgggacggggtctgatcaaagggcgtgaccacctcatgtgggtgctgctccagtttatcagcggatccatccagaagaatgctctggcggacttccttcctgtgatgaaactattcgacctattatacccagagaaagagtacattcctgttccggatatcaacaaaccgcagagcacccacgcctttgccatgacatgcatatggatccacctgaatcggaaggcgcagaatgataattccaagttgcagattcctataccccattccttgcggttgcaccatgagttcttgcaacagagtctacgtaataagtccctgcagatgaacgattataagatcgctttactctgcaacgcgtactccaccaactctgagtgtttcaccctgccaatgggagccttggtggagactatatacggcaacggtataatgaggatcccgctgccaggaacaaattgtatggctagtggatccattaccccccttccaatgaaccttctggacagtctaaccgttcatgctaagatgagcctgatccactccattgctacgcgagtcattaaattggcacatgccaagtcgagtgtcgctctggcccctgcgctggtggagacatattcacggctgcttgtgtacatggagattgagagcctggggatcaagggcttcatctctcagcttttgccgaccgtgttcaagtctcatgcatggggcattcttcacactctgcttgagatgttctcctaccgaatgcaccatatccaaccacactatcgggtgcagctactcagccacctgcatactctcgctgcagtggctcagacaaatcagaatcagttacacttatgcgtggaaagtaccgcattacgcctgataacggctctcggctcgtccgaggtgcaaccccaatttactaggtttttaagtgatccaaagaccgtgttgagtgctgaaagcgaagaacttaaccgtgccctgatcctcactcttgcgcgtgcgacacatgtcacagatttctttacgggtagcgattcaatccagggtacctggtgcaaggacatcctccaaacaatcatgtctttcactcctcacaattgggcttctcacactctctcttgcttccccggacccctgcaggctttcttcaagcagaataacgtacctcaggaatctagattcaatctgaagaagaatgtggaggaagagtatcgaaagtggaaatctatgtctaacgagaatgatattatcacacacttctccatgcagggctctccccctctttttttgtgcctcctgtggaagatgttattagaaacagaccacatcaaccagattggttatagagtactggaaagaatcggagctcgcgctttggtagcccacgtgcgaacatttgcagacttccttgtttacgaatttagcacttccgcaggcggacagcagcttaataaatgcattgaaatcctgaatgatatggtgtggaagtataatatagttactctggaccgtctgattctctgtctggtgagaatcaacacgttcctctcactgttctcctag

SEQ ID NO: 229830 - DNA, 4125 bp, Artificial Sequence
  Description of Artificial Sequence: Synthetic coding sequence
atggagacgcagctgcaaagcatctttgaagaggtggtgaagaccgaagtcatcgaagaagcgtttccaggaatgtttatggacactcccgaggacgagaaaacaaagctgattagttgtttgggggcttttaggcagttctggggcggactgagccaggaatcccacgagcagtgcattcagtggatagtaaagttcatacacggtcagcactcgccgaagcggatttcctttctctacgactgcttggcaatggccgtggagaccgggcttttgcctcccagactagtttgtgagtctttaatcaacagcgacactctggagtgggagagaacacaactgtgggctctcactttcaagctcgtcagaaaaataatcggcggagtggattacaagggggtaagggatctgctcaaagtgatcttagaaaaaattctgaccattccgaatacggtttcctctgcagtcgtgcagcagttgctcgcagctcgggaagtgattgcatacatcctcgagagaaacgcctgcctcctgcccgcttactttgccgtgaccgagatcaggaagttataccccgaaggaaagctgccacattggctccttggaaatttggtgtctgattttgtagacactttccggcctactgcaagaatcaattcgatctgcggaaggtgctcccttctgcccgttgtcaataacagcggcgctatttgcaacagttggaagctggatcctgcaacgcttcgattcccgctgaaaggccttctcccctacgacaaagatctgtttgagccccaaaccgcgctcctgcgatacgtgttggaacagccgtactcacgggacatggtttgcaacatgcttggattaaataaacagacgctgaatattgctcaacataagcaacggtgccccgtgctggaagaccagcttgtggacctcgtcgtgtatgccatggaacggagcgagaccgaagagaaattcgacgacgggggaactagccagcttctttggcagcacctcagttcacagctgatcttctttgtgctctttcagtttgcgtccttcccacacatggtgctatccctgcaccagaagttagccggaagaggtcttatcaaggggagggaccacctgatgtgggtcttactgcaattcatatccggatcaatccagaaaaacgcactagccgatttcttgcctgtgatgaaactctttgacctactgtatcctgagaaggagtacatcccagttccggacattaacaagcctcagtccacgcatgcctttgcgatgacttgcatttggatacatttaaacaggaaagcccagaatgacaatagcaagttacagattcccatcccacattccttgcggttacatcatgagtttctacagcagtcactgcgcaacaagtctttgcagatgaacgattacaaaatcgccctgctgtgcaacgcgtatagcactaattctgagtgcttcactctcccaatgggcgcattggtcgaaacaatttacggaaacggtataatgcgaattcctctgcccggtactaattgcatggcgtccggcagcatcacccctctaccaatgaacctcctcgatagcctgaccgtccacgccaagatgtctctgattcactcgatcgctacccgggtaatcaagctggcgcatgctaaatcctctgtagcattggcacctgctcttgtcgaaacttactcccggctcctcgtctacatggagatagaaagcctcggaattaagggattcatctcccagctgctccccaccgtcttcaaatcccatgcttggggcatactccatactcttcttgagatgttttcttataggatgcatcacatccagccccactacagagtgcagctgctcagtcatctgcatactctggctgccgtcgcacagaccaatcagaaccagttacacctttgcgttgagtcgaccgcactcaggttaatcacagctctcgggtctagtgaggtgcagccccagtttaccagatttctgagtgaccctaaaacagttctgagtgcagagagtgaagaactaaaccgagctctcatactaacgctggcaagggccacacatgtgacagacttctttactggctcggatagtatccagggaacttggtgcaaagacattctccagacaattatgtctttcactccgcacaattgggcctcacacaccttgtcctgtttccctggccctctccaggctttctttaagcagaacaatgtgccccaggagtcgagattcaatttaaagaaaaatgtggaggaagaataccgaaagtggaagagcatgtctaacgagaacgacattatcacccacttctcaatgcaggggtcacctccccttttcctgtgtctcctctggaagatgctgctggaaaccgaccacattaaccagattggctacagggtactggaacgaatcggcgcaagagccctggtagcgcatgtccggacatttgccgacttcctagtgtatgagttctctacttcagcaggaggacagcagctgaataagtgcattgagatacttaatgacatggtgtggaaatacaacattgtcaccctagaccggcttatcttatgcctggcaatgaggagccacgaaggtaacgaggcgcaggtttgttatttcatcatacagcttctgttacttaaacccaatgattttcggaatcgtgtgtccgactttgtcaaggagaactcacctgagcattggttacagaacgattggcacaccaagcacatgaactaccataaaaaataccccgagaaactgtactttgaaggactggcagaacaggtggatccacctgtacaaatccagtccccatacctgcccatctattttggcaacgtatgtttgcgcttcttacccgtgttcgatatcgtgatccatcgcttcctagagctgttacctgtcagtaaatcactcgagacactactcgatcatctggggggactgtataagtttcacgatcggccagtcacatatctctataacacacttcactattacgagatgcacttgagagaccgagcattcttgaagaggaaacttgtccatgccattatcgggtccttgaaagataatcggccacaggggtggtgtctgtcagacacatacctgaagtgcgccatgaacgctcgcgaagaaaacccctgggtcccggatgatacatactactgtcggttgatcggccgattggtagataccatggcgggaaagtcacccggacccttccccaactgcgattggagatttaacgagttcccaaatcctgccgctcacgctttacacgtgacatgcgtcgaactgatggccctggcagtgtcaggaaaggaggttggtaatgccctcctgaacgtcgtcctgaagtctcagccgttggtgcccagagagaacataaccgcgtggatgaacgccatcgggctaattataaccgccctcccagaaccatactggattgtgctgcatgacagaattgtgtcagtcatttccagcccttcactcacaagtgaaacagagtgggtggggtatccttttagactgttcgattttaccgcgtgtcaccaaagttattccgagatgtcttgttcctatacacttgccctggcacacgcagtgtggcatcacagctcaatcggacagctgagcctcattccaaagttcctaaccgaggtcctactgcccattgtgaagacagagttccagttactgtatgtatatcatctggtgggcccttttctgcagcggttccagcaggagcggaccaggtgcatgatcgagatcggagttgcgttttatgacatgctcctcaatgttgaccagtgttcaacccacctgaactatatggacccaatttgcgattttctgtatcacatgaagtacatgttcaccggggattccgtcaaggaacaggtcaagaaaattatttgcaatcttaagccagccctgaaattgagattaagatttataacccatattagcaaaatggagcctgccgctgtgccgccacaggcaatgaattcggggagcccggctcctcaatcaaaccaagtaccagtgagtctgcctgtaacgcagtag

SEQ ID NO: 229831 - DNA, 4095 bp, Artificial Sequence
  Description of Artificial Sequence: Synthetic coding sequence
atggagacccaactccagtccatttttgaagaagtggtcaaaactgaggtgattgaggaagcctttccagggatgttcatggatacccctgaggacgagaagacaaaactgattagctgtcttggagcattcagacaattctggggcggattgtcacaagagagccacgagcagtgtatccagtggatcgtgaagttcattcatggccagcactcaccaaaacgtatcagttttctctatgactgcttggccatggccgtggagacagggctgctcccgcctcgcttggtgtgcgagagccttatcaactcggacacattggaatgggagagaactcagctttgggcactcaccttcaagctcgttcgcaagattataggcggagtggactacaagggtgtaagggaccttttaaaagtaattctggagaagatcctcactataccaaatacagttagcagcgctgtggtacagcagctgttagcggcaagagaagtgatcgcctacatcctggagagaaatgcctgcctactgcccgcttactttgcagttaccgagattcggaaactgtacccggaggggaagttgccccattggttactggggaacctggtcagcgacttcgtggataccttcagaccaacggctcggattaacagcatatgcggtcggtgtagccttctccctgtcgtaaacaatagcggcgcaatctgtaatagctggaagctggatcctgctaccttacggttccctttaaaaggactgctgccttacgataaggatttgtttgaaccacagacggcccttctccgttacgtcctggagcagccgtacagccgcgatatggtatgcaacatgctgggcctgaataagcagcataaacagcgctgtcccgtgctggaagaccagctggtggatttggtggtctatgctatggaacgctccgagacagaggaaaagttcgacgacggcggaaccagtcagcttctgtggcagcatctttcctcgcagttaatctttttcgtgctgtttcagttcgcctcttttccacacatggtactatcacttcatcagaagctcgctggaaggggccttatcaaaggtagggaccacctaatgtgggtcctactgcagttcatcagtggtagtatccagaaaaatgccctggccgatttcttaccagtaatgaaactcttcgaccttctctatcccgaaaaggaatacatccccgtgccagacatcaacaaaccccagtctacccacgccttcgccatgacttgtatttggatccacttaaaccggaaagcccagaacgacaactccaaactgcaaatccccataccacatagcctgcggctgcaccatgagtttcttcaacagtctctgcggaataagtctctgcaaatgaacgattacaaaattgcactgctctgcaacgcctactctaccaactccgagtgcttcactctgcctatgggagcactggtcgaaaccatttacggcaatggaatcatgcggatcccattacccggaactaactgtatggcctcggggtcaatcacgccactgcccatgaacctgctggattctctgaccgtgcatgcaaagatgagccttattcattctatcgcgaccagggtcatcaagctggctcatgcgaagagctccgttgctctcgccccagctttggtcgagacctactctcggctccttgtctacatggagatagaatctttggggataaaaggatttatctctcaactccttccaacagtgttcaaatcgcacgcctgggggatacttcacaccctccttgaaatgttctcctaccgtatgcaccacatccagccccattatcgggtgcagctgttaagccaccttcataccctcgcagccgtggcacagactaaccagaatcaactgcatctgtgcgttgagtcaaccgccctgaggctcatcaccgcattgggttcaagtgaggtgcagccccagtttaccaggttcctttcagatcctaagacggtacttagcgccgaatccgaggaactgaatagagcactaattctcacgctagcacgggctacacacgtcaccgatttcttcactggcagcgacagcatccagggcacctggtgcaaggacatccttcagactattatgtcttttacacctcacaactgggcctcccacacactttcatgttttcctggacctctccaagccttcttcaaacaaaataacgtcccccaggagtctagattcaatctgaaaaagaacgtagaggaggaataccgtaagtggaaatctatgtccaacgagaacgatattatcactcatttctccatgcaggggtctccccctcttttcctgtgccttctctggaaaatgttacttgagactgaccacataaatcaaattggctacagggtgctagaacgtatcggggcacgtgctttggttgcccacgttaggaccttcgctgactttctggtgtatgaatttagtacttcagctggaggacagcagctgaataaatgtattgagatccttaatgacatggtctggaagtacaacattgtaactctcgaccgcctaattctttgccttgctatgagatcccatgaggggaatgaagcgcaggtgtgttattttatcattcaattgttgctgctcaaaccgaacgactttcgtaatcgagttagcgattttgttaaggagaattccccggaacattggctgcagaatgattggcatacgaagcacatgaattatcataagaagtaccctgaaaaactgtacttcgagggcttagccgaacaggtcgatcccccagtgcagatccagtccccctatctgccaatttacttcgggaatgtctgcctgcggttcctgccggtttttgacattgtcatccacagattcctcgagcttcttcccgtctctaaatccctcgaaaccttattggatcatctgggcggtctatataaatttcacgatagaccagtgacctatttgtacaacacactgcattactacgagatgcatctgagagatcgtgccttcctgaaacggaagctggtgcacgctataatcggcagcctcaaggataatcggccacagggctggtgcctctctgatacatatctcaagtgtgctatgaacgcccgtgaagaaaatccctgggtgccagatgacacgtattattgcaggctgatcggccgtctagtagatacgatggccggaaaatcacccggaccttttcctaactgtgactggagattcaacgagtttcctaatcctgcagcccatgccctgcatgtgacctgtgtcgagctaatggcactggcagtgagtgggaaggaggttggcaacgcacttctgaacgtggtattaaagagccaacccctcgtgcccagagagaatatcacagcttggatgaatgcaatcggtttgattatcaccgccttgcctgaaccatactggatcgtgctccacgatcggatcgtctcagtcatctcttctccatctctgacctccgagaccgaatgggttgggtacccctttcgactatttgacttcaccgcctgtcatcagtcttacagcgagatgagttgttcctatacgctggctcttgcacatgccgtgtggcaccattcctctattgggcagctttctctgattcccaagttcctcactgaggtgttgcttcccatagttaagacggagtttcaactcctctacgtgtatcatcttgtgggtcccttcctgcaaagattccagcaagagaggactcgctgtatgattgagattggggtagccttctatgacatgctgttaaacgtggatcaatgctccacacatctgaactacatggaccccatctgtgacttcctgtaccatatgaaatacatgttcacgggcgactcagtgaaggagcaagttgagaagataatttgcaaccttaagcctgccctgaagctgcgactgagattcatcacacatatcagtaaaatggagcccgcagcagtgcctccacaagccatgaattccgggtcacccgcacctcaatctaaccaagtggacacacttacgtag

SEQ ID NO: 229832 - DNA, 4107 bp, Artificial Sequence
  Description of Artificial Sequence: Synthetic coding sequence
atggagacccagctccagagcattttcgaggaagtggtgaagacagaggtgattgaggaagcattcccaggaatgtttatggacaccccagaagatgaaaaaaccaaattaatttcatgccttggggcttttcgccagttctggggtggcttgtctcaggagtctcacgagcaatgcatccagtggatcgtgaagttcatccatggccagcactcgccgaagaggatcagcttcctatatgattgtctagctatggcggttgagacgggtctgctgcctcctaggctggtctgtgagtctctgatcaattctgatacactggagtgggaaaggacacaactttgggcactcaccttcaaactggtgcggaaaattatcgggggagtagattataagggcgtgcgggacctcctgaaagttatcttagagaaaattcttactatccccaatactgtctcttcggctgtcgtgcagcagctgctggccgctcgagaggtgatcgcatacattctggagagaaatgcatgcctgctgccagcctacttcgcggtgacagagatccggaagctctatcccgaggggaaactcccgcactggttattaggcaatttggtcagcgattttgtggatacattccgccctacagctcgcattaactccatttgcgggaggtgctcactattacctgtcgtgaataactcaggcgcaatatgcaactcttggaagctggatccggctaccttaagatttcccctgaaagggctgctgccctatgacaaggacctgttcgagccgcagaccgcgctgctacgatacgtcttagaacaaccgtacagtagggacatggtgtgtaacatgctgggcctgaataagcagcataagcagcgctgtccggtgttagaggaccaacttgtggatctggtagtgtacgccatggagcgctctgaaactgaagagaagttcgatgacggaggaacatctcagcttctatggcagcacttatccagtcagctgatcttcttcgtgctcttccagttcgcatccttcccgcatatggttctgagtctgcaccagaagctagcaggccgaggattaattaaggggagagatcatctgatgtgggtgttgctgcaattcatttcaggcagtatccagaagaacgcactggcagatttcctccccgtcatgaaactattcgacttactgtacccggagaaggagtacatccccgttcctgatattaacaaaccccaatccacccacgcattcgctatgacctgcatctggatccacctcaatagaaaggcgcagaatgacaattcgaaactgcagatcccgatcccccacagtctccgtctgcaccacgagtttctccaacagtcattgaggaataaatcactgcagatgaatgattacaaaatcgccctactctgcaacgcttatagtaccaattctgaatgttttaccctgccaatgggagcattagttgagacgatttatggtaacggaattatgcgcatccccctgccaggcacaaactgtatggccagcggcagcattacgcccttgccaatgaatttacttgatagtttaaccgtgcatgctaagatgtctttgatacatagcattgccaccagggtaatcaagctcgcccacgctaaatcatccgttgcactggccccagcgctggttgagacctatagccgtcttctcgtttacatggaaattgaatccctgggtatcaaaggcttcatatcccagctgttacccacagtctttaagtctcatgcttggggcattcttcatactctgcttgaaatgttcagctatcgtatgcaccatattcagcctcattatagggttcagctgttgtcacatctgcacactctcgctgcggtggctcagactaaccagaatcagttgcacctttgtgtagaaagtacagctctgcggctgattaccgccctgggtagctcagaggtgcagccccagttcaccagattcctgtctgaccctaagacagtactgtccgccgagagtgaagaactgaaccgcgctcttattctgaccctggcacgggctacccatgtaaccgacttcttcacaggatctgactccatccaaggtacatggtgtaaggacattcttcaaacaattatgagcttcaccccccataattgggctagtcatacgctgtcctgtttccctgggccactgcaagccttttttaaacagaataacgttccccaagaaagccgctttaacctgaagaaaaacgtagaagaggagtaccggaaatggaagagtatgagcaatgaaaacgacatcattacgcatttttccatgcagggatctcccccactgtttctgtgccttctgtggaaaatgctgctggagacggatcacattaaccagataggctatcgggtcctggaacgcataggggcaagagcgttggtagctcacgtgagaacctttgccgattttctggtgtatgagttttctacaagtgctggtggccagcagctgaacaagtgcattgaaatactgaacgatatggtgtggaagtacaatattgtgacgttggaccggcttatcctgtgtctcgccatgcgcagtcacgagggcaacgaagcccaggtgtgttattttatcatacagttgctactcctgaagcccaacgacttccggaatagagtgtccgactttgtgaaagaaaattccccagagcattggttgcagaacgactggcataccaaacacatgaattatcataagaaatatccggagaaactgtacttcgaaggactggccgagcaggtcgacccacctgtgcagatccagagcccttatcttcctatttatttcggaaacgtgtgcttgaggttcctgcccgtattcgatatagtcattcatagattcctagaactcctgccagtgagtaagagcctggagacattgctcgaccacctgggtggcctgtataagtttcatgataggcccgtgacatacttgtacaacaccctgcattactatgagatgcacctgcgggacagagccttccttaaacggaagctagtgcacgctattatcggctccctgaaggacaatcgtcctcagggctggtgcctctcagatacgtacctgaagtgcgcaatgaacgccagggaggagaacccatgggtgcccgacgacacttattactgtcgtctcatcggcagactggtcgacaccatggcaggtaaaagcccaggcccatttcctaactgcgactggagatttaatgagttccccaaccccgctgcacacgcacttcatgtaacttgcgtggaactgatggccctggccgtctctgggaaagaggtgggcaatgcactacttaatgttgttttgaaatcgcagcctcttgtccctagagaaaacattaccgcatggatgaatgcgataggcttgattatcaccgcgctgcccgagccctattggattgttctccacgatagaatcgtaagtgttattagctctccatctcttacatccgagactgagtgggtcggctatcccttccgactgtttgatttcacagcctgccatcagagctactccgagatgtcttgctcctacaccctggctcttgcacacgcagtgtggcaccacagtagtattggtcagctgtccttaattcccaagtttctcaccgaagtcctcctgccaatcgtgaaaactgaatttcagctgttgtacgtttatcacctggtgggacctttcctgcaacggttccagcaagagaggacccgatgtatgattgagattggagtggcattctacgacatgttactcaatgtcgatcagtgttccactcaccttaattacatggacccgatatgtgacttcctctatcacatgaaatacatgttcacgggggactctgttaaggaacaggttgagaagattatttgtaacctgaaaccagcacttaaactccgtctgcggtttattacccatatatctaaaatggaacccgcagccgtccccccacaggccatgaactctggttcacccgcaccacaatctaaccaagtgccagtctctctgccagtcacccaatag

SEQ ID NO: 229833 - DNA, 4125 bp, Artificial Sequence
  Description of Artificial Sequence: Synthetic coding sequence
atggagacccagttgcagagtatctttgaggaagtggtgaaaacagaggtgattgaagaggcatttccaggcatgtttatggacactcccgaagatgaaaaaaccaaactgataagctgccttggagcattcagacagttttggggcggactgtcccaagaaagccacgagcagtgcattcaatggatcgtgaaatttatacacggtcagcactccccgaagcggattagctttctgtatgactgcctggcaatggctgtcgagacaggactgctgcctccacgcctggtgtgtgagtctctgatcaacagtgataccctcgagtgggagagaacccagttgtgggctcttacattcaagctggtgcggaagattataggcggagttgactacaaaggcgtgagggatctgttgaaggtcatcctcgaaaagattcttacaattcccaacaccgtgagttccgctgtggttcaacagttactagccgcaagggaagtgattgcctatatcctagagcgcaatgcctgtctactccccgcttatttcgccgttactgagattcgcaaattgtaccctgagggcaagctacctcattggctccttggaaatctagtgagcgattttgtcgataccttccgaccgactgctcgcattaatagcatctgtgggaggtgctccctcttacctgtcgtcaataactcaggtgccatctgcaactcttggaaactcgatcccgcaaccctccggttcccactgaagggcctcctgccctacgacaaagatctgttcgagcctcagacagccttgttacggtatgttttagaacagccatatagtagagacatggtgtgtaatatgctcggactgaacaaacagcttatttctgcccttcaacacaagcaacgttgtcctgtcttggaagaccaactggtcgacttggtggtgtacgctatggagcgcagcgaaacagaagagaagttcgacgatggcggaacaagtcaattactgtggcagcatttgtcatcccaactgatattcttcgtcctcttccagtttgcgtctttcccccacatggtgctctcattacaccagaagctcgctggcagaggcctgatcaaagggagggaccacttaatgtgggtcctgctccagttcatcagcggctctatccagaaaaatgcactcgccgacttcctgcctgttatgaagctgtttgatttgctttaccctgaaaaggagtatatccccgtacccgatataaacaagccacagagcacgcacgcattcgctatgacttgtatctggattcatttgaatcgcaaggcgcaaaatgacaacagtaaactacagattccaataccccacagcctccggctccaccacgagtttctgcagcaaagtctgcggaacaagagtctgcaaatgaatgactataagatagcattgctctgcaacgcctactccactaatagtgagtgcttcacgctccctatgggagctctcgtggagaccatttacggaaatggtatcatgcgcatccccctgcctggaaccaattgtatggcctctggctccatcactccattaccgatgaacttacttgatagccttacagtgcatgcaaagatgtcattgatccatagcatcgcaacccgggtgattaaactggcccatgcaaagagctcagtggctttagcgcctgccttggtggagacctacagtcgcctgctcgtgtatatggaaattgagagtctgggcatcaagggttttattagccagttgctgcccaccgttttcaaaagccacgcatggggcatcctccatacgctgcttgaaatgttctcttacaggatgcaccacatccagcctcactatcgcgtccaactgctgtcacacctccatacgctagcggctgttgcccagacaaaccagaaccagttgcatctgtgtgtagagtcaacagcactacggcttatcaccgccctcggatcctcagaggtccaaccccaattcacccgcttcttaagcgaccccaaaacggtcttatccgccgaaagtgaggaattgaatcgcgctctaatccttacgctcgcaagagccacgcatgtcacggatttcttcaccggcagcgattccattcaaggtacgtggtgcaaagatattcttcaaacaatcatgtcctttaccccacacaactgggcatcccacacactgagctgttttccaggccctctgcaagccttttttaagcaaaataatgtcccgcaggagtctcgattcaatcttaaaaaaaatgtcgaggaggaatatcggaagtggaagtcaatgtcgaatgaaaatgatatcatcacccacttctcaatgcaaggttcacctcccctgttcctgtgcctgctgtggaagatgttgctcgagaccgaccatataaatcagatcggatacagggtccttgagcgtatcggagctagagctttggtggcacatgtgcggacgtttgccgacttccttgtctacgaattctctacttctgccggagggcaacagctgaacaaatgtatagagatccttaatgatatggtgtggaaatacaatatcgtcacattagatcgactgattttgtgcctggctatgcgtagccatgagggaaatgaagctcaggtctgctactttatcattcaactgctgctgttgaaacctaatgactttagaaacagggtctcagatttcgtcaaggaaaacagccccgagcactggttacagaacgactggcataccaagcatatgaattatcacaagaagtatcccgaaaagctgtactttgagggtctagcagaacaggtggatcctcctgtgcagatccaatccccttatctgcctatctattttggaaacgtctgtctgagattccttcccgtctttgatattgtcatccatagattcctggagctgctgcccgtgagcaagagccttgagacgctgctcgatcatctaggtggcctgtataaatttcatgatagacccgtgacctacctatataacactctgcactattacgagatgcaccttcgggaccgcgcatttctcaaacgtaaactggtccatgccatcatcgggtcactgaaagacaatcgaccacaggggtggtgtctcagtgatacttatttgaaatgtgctatgaatgccagagaagagaatccctgggtgccagacgatacttattactgtagacttattgggaggttagtggacaccatggccggaaaaagtccaggacccttccctaattgcgactggcggttcaacgaatttccaaatcccgcagcacacgccctccatgttacatgcgtggagctcatggccttagccgttagcggcaaagaggtgggtaacgctctgttaaacgtggtgctgaaatcacagcccctcgttccaagagagaacattaccgcttggatgaatgccattgggctcattatcacagctctcccagagccctactggattgtgctgcacgaccgcatcgtgtcagtgatatcatctccctctttaacctcggaaactgaatgggttggctacccttttcggctgttcgactttaccgcatgccaccagtcttattccgagatgtcctgttcctatacgctcgctctggcgcacgctgtatggcaccactccagcattggacagctaagtttaataccaaaatttctgactgaggtccttctccccattgtaaagaccgaatttcagctcctatacgtctaccatctggtcggcccattcctccagcgcttccagcaagagcggacaaggtgtatgattgaaattggggtggccttctatgacatgctacttaatgtcgatcagtgctccacgcacttgaattatatggatccaatctgcgactttctctaccatatgaaatacatgtttactggagatagcgtgaaagaacaggtggaaaaaattatctgcaatctaaagccagctttgaaactgagactcaggttcatcacccacatttcaaagatggaaccagccgcagtgccaccccaggccatgaatagcgggtcccccgctcctcagagtaatcaggtgcccgtgtctctgcccgtgacgcagtag

SEQ ID NO: 229834 - DNA, 114 bp, Artificial Sequence
  Description of Artificial Sequence: Synthetic coding sequence
atggaaacccagcttcagtccatcttcgaggaggtagtaaagactgaagtgatagaggaggcttttcctggcatgtttatggacacgcctgaggacgaaaaaagtagcaagtag

SEQ ID NO: 229835 - DNA, 132 bp, Artificial Sequence
  Description of Artificial Sequence: Synthetic coding sequence
atggagacccagttgcagtccatttttgaagaggtggtgaaaaccgaggtgatagaagaggcattcccgggtatgtttatggatactcccgaagatgagaaaaccaaactttttatggaaatggagctgtag

SEQ ID NO: 229836 - DNA, 1428 bp, Artificial Sequence
  Description of Artificial Sequence: Synthetic coding sequence
atggagacgcagctgcagagcattttcgaagaggttgtcaagaccgaggtgattgaagaagcattccccggtatgttcatggacacgccagaagatgagaaaaccaagctcatttcgtgcctcggcgcatttagacagttctgggggggtttgtcacaggaatcacacgaacaatgcatccagtggatcgtgaaattcatccacggacagcacagcccaaagcgtatctctttcctgtacgactgtctggccatggctgtggagacggggctgctccctccgcgactggtctgcgaaagcttaatcaatagtgataccttagaatgggagagaacgcagttgtgggccctcacctttaagctggtgcgtaagataatcggcggtgtcgattataagggagtccgtgacctgttgaaggtcattctggaaaaaatcctgaccattccaaacactgtgtcctccgcagtcgtgcaacagctgttggccgctcgggaagttatcgcctatattctagagaggaacgcttgcctattgcccgcttattttgccgtgaccgaaataaggaagctctaccctgaaggaaagctgccccattggctgctcggcaacctggtctccgattttgtagacaccttcaggcccacggcgaggattaacagcatatgtggtaggtgctccttgctgcccgttgtcaacaattccggagcaatctgtaacagctggaagctggaccccgctactctcaggtttccgttgaaaggcctgctgccatatgacaaggacctgtttgagcctcagacagcacttctgcggtacgttctggagcaaccttactcgagagacatggtttgtaacatgctcggcttgaacaagcagcacaaacagcggtgtccggtactcgaggaccagcttgtggacctggtggtgtatgccatggagcgtagcgaaaccgaggaaaagtttgacgacgggggaacctctcaattgctgtggcaacacctgagctctcaattaattttctttgttctgttccagttcgcctcctttccacatatggttctgtcactccatcagaaattggccggaagagggctgatcaaggggagagaccacctgatgtgggttttgttgcagttcatatctgggagtatacaaaaaaatgccctcgcagatttcctccctgtgatgaaactttttgatcttctctatcccgagaaggaatacatcccagtgccagatatcaataaacctcaaagcactcacgctttcgccatgacctgtatctggatccatctgaatagaaaagcccaaaacgataacagcaagctacagatacccattcctcattctctgaggctgcaccacgaaagtgccttcgccaactgctttcaaatcacctgcatgggcgatctgacccacaccccctag

SEQ ID NO: 229837 - DNA, 429 bp, Artificial Sequence
  Description of Artificial Sequence: Synthetic coding sequence
atgcaccatatccaaccccactacagagtgcagttgctttctcacctgcacaccttggcggctgtcgcccaaaccaaccaaaatcagctgcacttgtgcgttgagtcgacagctctgcgactcattaccgccctaggcagctctgaggtgcagccccagttcacacggttcctatccgatccaaaaacagtgctctcagccgagagcgaggagctaaatcgagccctcatcctcactctagctagagcaacacacgtgacagacttcttcaccggatccgactctattcagggcacatggtgcaaagatatcctgcagacaattatgagctttacccctcacaactgggcttcccatactctgtcttgctttccaggccctctccagacactgcttatactgggagagctcgccttacggaagacctag

SEQ ID NO: 229838 - DNA, 2661 bp, Artificial Sequence
  Description of Artificial Sequence: Synthetic coding sequence
atggaaacacaactgcagagtatcttcgaagaggtggtgaagacggaggtgatcgaggaggcttttcctgggatgtttatggacacacccgaggacgagaaaaccaaactgattagctgcttaggcgctttcagacagttttggggtgggctgagccaggaatcgcacgaacaatgcatccagtggatcgtaaagttcatccatggccaacatagccccaagagaatttcatttttatatgactgcctggcgatggccgtcgagaccggcctgctccccccacgcctggtctgcgaatctctgattaactccgacactctggagtgggagcgcacccaactgtgggccctgacattcaagcttgtgcggaaaatcattggtggggtcgactataaaggagtcagggatttgctgaaagtgattttagagaaaatcctcacaattcctaatacggtgagttcagctgtcgtccagcagctgctggccgctcgcgaagtgatagcgtatattctggagagaaacgcctgtctcctgcctgcttacttcgcggtgacagaaatccgaaaattgtatccagagggtaagctgccccactggcttctgggcaacttggtttctgactttgtcgataccttccggccaaccgccaggatcaattccatttgcggcagatgctccttgctgcctgttgttaacaacagtggagcaatctgtaattcttggaagctggatccggcaactctccgattcccactgaagggcctcctgccatatgataaggatctgttcgagcctcagactgctttgctgcgctatgtactggagcagccgtattcccgcgatatggtttgtaacatgctgggcttaaacaaacaggtcctgaaaatcttcaaacacaagcagcgctgtcctgtgctggaggatcaacttgtcgatctcgttgtttacgcaatggagcggagcgaaacagaagagaagttcgacgatggcggtaccagccagctcctctggcagcaccttagttcccagctcattttttttgtgctgtttcagtttgcttcatttccccatatggtacttagcctgcaccaaaaactcgctggcagggggctcataaagggtcgagaccatttaatgtgggtgctgcttcagtttatctctgggtccatccagaagaatgcccttgctgacttcctgccggttatgaagctgttcgacttgttatacccagaaaaagaatacattccagttccagatatcaacaagccgcagtcaacccacgccttcgcaatgacctgcatttggattcaccttaaccgtaaagcccagaatgataattctaagttgcagatcccaatccctcatagcctgaggctgcaccacgaatttctgcagcagagcctcagaaacaaaagcctgcagatgaacgattacaagatcgccctcctgtgcaacgcctacagtacaaattctgaatgcttcaccctaccaatgggcgcactagtggagactatatacgggaatggtattatgagaattcccctaccaggaactaactgcatggccagcggatcaatcacccccctgccgatgaacctgctggactccctgaccgtgcatgctaaaatgtctctcattcacagtattgctacaagagttataaaactggcccatgcgaaaagctccgtcgccctggccccagcgctcgtggaaacgtactccagattgctggtatatatggagatcgagtcgcttggaatcaaagggttcatcagtcagcttctccctactgtttttaagtcgcacgcttggggtatcctgcataccctcctagaaatgttttcttatagaatgcaccacatacagccccattatcgggtacagcttttgtctcacctgcacacgctggcagctgtggcccagacaaaccagaaccagcttcacctctgtgttgagtcgacagcattaagacttatcaccgctctaggatccagtgaggtgcagcctcagttcactagatttctctccgatccaaagaccgtgctctcagccgaatccgaagagcttaacagggccctcattctcaccttagccagggcaacacacgtgacggatttctttacaggtagtgacagcattcaggggacatggtgtaaagacatcctccaaaccattatgagtttcacgccacacaactgggcttcccatacactgtcatgttttccagggcctcttcaggcctttttcaaacagaataatgtcccgcaggagtcaagattcaatctgaagaagaacgtagaagaggaatatagaaaatggaaatccatgagtaacgaaaatgatatcattacacacttctccatgcagggctcccctccactgtttctgtgcttgctctggaagatgctcctggaaactgatcatataaatcagatcgggtaccgagtcctcgagcgtattggtgctagggcactcgtagcccacgttcggacttttgccgactttcttgtctatgaattctcaacctctgctgggggacagcaactgaataagtgcatcgagattcttaatgatatggtgtggaagtacaatatagttactctggacagactgattctctgtttagtcagaattaataccttcctgtccctattctcatag

SEQ ID NO: 229839 - DNA, 3030 bp, Artificial Sequence
  Description of Artificial Sequence: Synthetic coding sequence
atggagcgcagcgaaacagaagagaagttcgatgatggtggaacctctcagttactgtggcagcacctgtcctctcaactgattttcttcgtgctattccagtttgcctcattcccacacatggtgctgtccctacatcagaaatacattcccgtccccgatattaataagccccagtccacccatgcatttgccatgacttgcatctggatccatcttaatcgtaaggcccagaacgacaattctaaattgcaaatcccaattccccatagtctaagactccatcacgagtttttgcagcaatctctccggaacaagagtctgcagatgaatgactacaaaattgccctgctgtgcaatgcatattctacaaatagcgagtgtttcacgctacctatgggggctctggtggaaaccatatacggcaacgggattatgaggatccctctcccaggcacaaactgcatggcaagcgggagcattactcccctgccaatgaatctcttggatagtctgaccgtgcatgccaaaatgtccctgatacattctatcgctacccgcgtaatcaaactggcgcacgccaaaagttctgttgcgctcgccccagctttggtcgagacttactcccgactacttgtatacatggaaatcgaaagcctgggaatcaaggggtttatttcccagttgcttccaaccgtgttcaaatctcacgcgtggggcatccttcacactctgctcgagatgttctcctatcggatgcaccatatccagccacactaccgagtgcaattattgtctcacctgcataccttagccgctgttgctcagaccaatcaaaatcagttgcatttgtgcgtggagtctacagctcttaggctgattaccgcccttggatctagcgaggtacaaccacagtttaccaggttcctgagcgatcccaagaccgtcctcagcgctgagtctgaggagctcaaccgcgcactcattttgacactggccagagcgacccacgtgacagatttcttcaccggctctgatagcattcagggaacctggtgtaaggatattctccagactattatgagctttacaccgcacaattgggcctcccacacacttagctgctttccaggcccactccaggctttctttaaacagaacaatgtgccgcaggagagcaggttcaacctcaagaaaaacgtggaagaggagtatcgaaagtggaaatccatgtccaacgagaacgacatcataacccatttctccatgcagggctctcctcctttgtttctgtgccttctttggaagatgctactcgagacagatcatatcaaccaaattggatacagggttctggagaggattggcgcacgagccttggtggcccatgtgaggacatttgccgactttctcgtgtatgaattttctactagtgctggcggtcagcaacttaataaatgtattgagattctgaacgacatggtgtggaagtacaacatcgtcacactcgacagactcatcctctgccttgccatgaggtcacacgaggggaatgaggcacaagtgtgttatttcattatccaactgctgcttttgaagccaaatgacttcaggaatcgcgtaagtgattttgtgaaagaaaattcccccgaacactggcttcaaaatgactggcacacgaaacacatgaattaccataaaaaatatcctgaaaaactttattttgagggcctcgccgagcaagtggaccccccagtgcagatccagtcgccctacctccctatttacttcggcaacgtgtgcctgaggttcctccccgtctttgacatcgtcatccatcgctttttagagctcttgcctgtgtctaagagtctcgaaactttgctggaccacctaggaggcctgtacaaattccatgacagaccagtgacctatctatacaacacattacactactacgagatgcacctccgcgaccgcgctttcctgaagagaaagctcgtacacgcaatcatcggatctctgaaggacaataggccccaaggatggtgcttgtctgacacttaccttaagtgtgctatgaacgcaagggaagaaaacccttgggttccagatgatacgtactactgtaggctgattggccgtctggtcgacacaatggccggaaaaagcccaggaccttttccaaattgcgactggagatttaatgaattccctaatccggcagcacatgcgctgcacgtgacatgtgttgagctgatggccctcgccgtgtctgggaaggaagtcgggaacgctctgctgaatgtggttctcaagtcacagcccctcgtgcctcgcgaaaacatcacagcttggatgaatgccatagggcttatcatcactgccctgccagaaccttactggattgtactgcacgataggatcgtctctgtaatctctagcccttcccttacttcagagactgagtgggttggatacccctttaggttgtttgattttaccgcgtgccaccaatcctattccgaaatgtcatgttcctatacactggcactggcccatgctgtatggcaccatagctcgattggccaactctccctgattcctaaatttctcacggaagttcttctgcccatcgtgaagaccgagttccagctcctttatgtgtaccacctggtgggcccatttctgcagcgattccagcaggagcggacccgctgcatgatcgaaatcggagtggctttctacgacatgctgctaaacgtcgaccaatgttccacccacctaaactacatggatccgatctgtgacttcctctatcatatgaagtacatgttcaccggggacagtgttaaagaacaggtcgagaaaattatctgtaatctgaaaccagcccttaagctgcggttgcgatttatcacccacatcagcaagatggagccggctgcagtgccgcctcaggcaatgaattcaggaagccccgctcctcaaagcaatcaagtacccgtgtccctgccagtgacccagtag

SEQ ID NO: 229840 - DNA, 2970 bp, Artificial Sequence
  Description of Artificial Sequence: Synthetic coding sequence
atgaaggtggtcaacctcaaacaggcaatcctccaggcttggaaggagaggtggtcagactatcaatgggctattaatatgaagaaattcttcccaaagggggctacatgggatatcctcaacttagccgacgctctgctggaacaagccatgattggaccctcacctaacccgctcatcttgtcttacctcaagtacgcaatctcgagccagatggtgagctactccagcgtactaacagccatcagcaaattcgatgacttctccagagacctctgcgtgcaggctctgttggacatcatggacatgttctgcgacaggctgtcatgccatggaaaagccgaagagtgcatcggtttgtgtcgcgctctgctgagtgctctccactggttgctgcggtgcacagcagcaagcgctgagcgactgagagagggcctggaggccggtacacccgctgccggagagaaacagcttgccatgtgtctgcagcgcctggaaaagacgctcagttcaacaaaaaatagagccctcctgcatatagccaaacttgaggaagcttcttcttggaccgcgatcgaacattcattgttaaagctcggggagatcctggctaacctttcgaatccccagctccggagccaggcagaacagtgtggtaccttgatccgatctatcccaacgatgctttccgtccacgcggaacaaatgcataagactggtttcccgaccgttcacgctgtgattctgctggaaggaacaatgaatctgaccggtgagacccagtccctggtcgaacaactgacaatggtgaagagaatgcagcacatcccaaccccactcttcgtcttggagatctggaaagcctgtttcgtaggtctgatcgagtctccagaagggacagaagagctcaaatggacagcgttcacttttctgaagatccctcaagttctggtgaagctgaagaaatacagccacggggacaaagattttacggaggatgtgaattgcgctttcgagtttcttctcaaattaacaccactcctggataaggccgaccaaaggtgcaattgcgattgtactaactttttactccaggagtgcggtaaacaggggctgctctccgaggcctcagtgaataaccttatggccaagcgcaaggccgacagagaacatgcaccccagcaaaagtctggagaaaacgcaaatatccaaccaaacatccagttaatcctgcgagccgaaccaacagtgactaacatcctgaagaccatggatgccgatcatagcaaatctcctgagggactgctcggcgtgctgggccacatgctgagtgggaagtctctagacctgctccttgccgcagctgctgctactggcaaactgaagagttttgccagaaagttcataaatctaaacgagttcaccacatacggctccgaagaatctaccaagccagcctctgtccgtgcactgctgttcgatatctcattcctgatgctttgtcacgtggcccaaacatatgggagcgaggtcatcctgtctgagtccaggaccggagctgaggtgcctttctttgaaacctggatgcagacctgcatgcccgaggaaggcaaaatcttaaacccagaccacccctgtttcaggccggactccaccaaagtggagtccttagtggccttgctaaataacagctccgagatgaaactcgtgcagatgaagtggcatgaggcatgcctatctatttcagccgctatcctggagatcctcaacgcttgggaaaatggagtgctggcttttgagtctatccagaagatcactgataacattaaaggcaaagtctgctccctagcggtctgcgcagtggcatggctggtggcccatgtccggatgctgggactagatgaacgggaaaaatctctgcagatgattagacagttggctggaccattattttctgagaacacactgcagttctacaatgaaagggtggttataatgaatagcatactcgaacggatgtgtgccgacgtactgcagcagacagctacacaaatcaaatttccctcaactggcgtcgacacaatgccgtactggaacctgctgccacctaagagaccgataaaagaagtccttactgatatctttgccaaagtccttgaaaagggatgggttgactcacggagtatccacatctttgatacgctcttgcatatgggtggggtttactggttttgcaataatctcatcaaggagcttcttaaagagactcgtaaggaacacacattgcgggctgtggagctgttatatagtatcttctgtttggatatgcagcaggtaactctcgtgctattgggtcacattctccccggactacttaccgactctagtaaatggcatagtctcatggatccgccaggcacggcacttgcaaagcttgccgtgtggtgcgccttgtcaagttactcgtcgcacaagggccaagcctccacaagacagaaaaagaggcaccgtgaggatattgaggattatatctctctgttccccctggatgacgtgcaaccgagcaagctgatgcggttactcagcagtaatgaggatgatgctaatattctgtctagccctacagaccgcagcatgagtagttcactgtctgcatcccagcttcacacagtgaatatgcgggatcccttaaatagagttctcgccaatctctttctgcttattagctcaattctgggcagtcgcaccgctggaccacatacccagtttgtgcaatggtttatggaagagtgtgtcgactgcctggagcagggagggaggggtagtgtgctgcaattcatgccattcactacagtttctgagctggtgaaagtctccgccatgagctctcctaaggtagtcctcgccattactgacctgagtctgcccctgggacgacaagtggcggctaaggctatcgctgctctctag

SEQ ID NO: 229841 - DNA, 2970 bp, Artificial Sequence
  Description of Artificial Sequence: Synthetic coding sequence
atgaaagtggtgaacctcaaacaggcgatactacaggcatggaaagagagatggagtgattatcagtgggccataaatatgaagaagttctttcccaaaggcgctacctgggacatcttgaatctggccgacgcccttctcgagcaggccatgatcggacctagcccgaatcctctgatcctctcgtacttaaaatacgcaatttcaagtcagatggtcagttactcaagcgtccttactgccataagcaagttcgacgatttctctagggatctttgtgtgcaggcactgcttgacattatggacatgttttgtgatcggctgtcatgtcacggaaaggcggaagagtgcatcgggctgtgccgcgcactactgtcagctctgcattggctgctgcgctgtaccgcggcttccgccgaacggctgcgtgagggcctcgaggcagggacccccgctgccggtgagaaacagcttgcaatgtgtctacagcgcctcgagaagacattgagctctactaagaaccgcgctttgttgcacatcgctaagctagaggaggcctctagttggactgcgatcgaacactctctcctaaagctgggcgagattctggccaaccttagcaaccctcagttgcggtcacaggccgagcaatgtggcaccctgattcgctcaatcccgactatgttgtcagtgcatgctgaacaaatgcacaaaacgggcttcccaaccgtgcatgctgtgattctgttggaaggcaccatgaatctcaccggtgagacccagagtctggttgagcagctcactatggtgaaacgcatgcagcacatccctacccccctcttcgtccttgagatctggaaggcctgttttgttggccttatcgagagccccgagggcactgaggagctcaaatggaccgccttcactttcctgaagattccacaggtcctggttaagctgaagaaatactcgcacggcgacaaggattttacagaagatgtcaattgcgcgttcgagtttttgcttaaacttactcctttattggataaggcagaccagcggtgcaattgcgactgtaccaacttcctgttgcaagagtgtggcaaacagggtctccttagtgaggctagtgtgaacaacctgatggccaagcgcaaagccgatcgggagcatgcgcctcaacagaagtctggggaaaacgcaaatatccaacccaacatccaactgatactccgggcagaacccactgtgaccaatattttgaagacaatggacgctgaccactctaaatctcctgagggacttctcggagtcctgggccatatgctctcaggcaaatccctggacctgttactggccgctgcagcggctacgggcaaactaaagagctttgccagaaagttcataaatctcaatgaattcaccacgtatggttcagaagagagtactaaaccagcatcagttagggccctgctgtttgatatatcttttctaatgttgtgccatgtggcacaaacctatggaagcgaggtgatcctgtcagaaagccggaccggtgccgaggtgcctttttttgagacatggatgcaaacttgtatgcccgaggaaggaaagatcttgaaccctgatcacccatgtttccgaccagacagtacaaaggttgagagcctcgtcgccttactgaacaattccagcgagatgaagttggtccaaatgaagtggcacgaggcttgtctttccatatccgccgcaatcctggaaattctcaacgcatgggagaacggcgtgctagcttttgagtccatccagaaaataaccgataatattaagggtaaagtttgtagtttggcagtgtgcgctgttgcatggcttgtggcccatgtgcggatgctgggcttggacgaaagagaaaagtcactgcagatgatccgtcagctagctggtcctttattttccgaaaacaccctgcagttttataacgagcgagtcgtcataatgaactcaattttggaacgcatgtgtgcagatgtgctccaacagaccgcaacacagattaaatttccatcaaccggcgtagatactatgccatactggaatctcctgcctccaaaaagacccataaaggaggtcttgacagatatctttgccaaggtgctggagaaggggtgggttgatagtcggagtatccacatattcgatacgctcttacatatgggcggagtatactggttctgtaacaatctgataaaagagctattgaaggaaacaagaaaggaacatacactcagagctgttgagctactttacagcatattctgtctagacatgcagcaggtgactcttgtgctactgggtcacattctcccagggttgctgaccgatagctctaagtggcattccttgatggaccccccaggaactgccctcgcgaagcttgctgtttggtgcgcactgtcctcttattctagccataaggggcaggcttcaacacggcagaagaaacggcatcgggaagacattgaagactatatttcactcttcccgctggatgatgtgcagccctctaagctcatgagacttctctctagcaatgaagatgacgccaacattctctcctccccaacagatagatcgatgtcatcttccctgagcgcatcacagcttcatactgtgaacatgagagatccacttaacagagtgttggcaaatctgttcttactcatttccagcatcctgggcagtagaactgccggtccccacacccagttcgtccagtggttcatggaggaatgtgtggattgcctggagcaagggggtagaggctcagtattgcagttcatgcccttcacgacagtatctgaacttgtgaaggtcagcgcaatgagttcgcccaaggtggtgctggcgatcaccgatctgtctctgcccttgggcagacaggtggcagctaaagccatcgcggcactttag

SEQ ID NO: 229842 - DNA, 2931 bp, Artificial Sequence
  Description of Artificial Sequence: Synthetic coding sequence
atgaaggtagttaacctgaaacaggcaattcttcaggcttggaaagagcgttggagcgactatcagtgggcgatcaacatgaaaaagtttttccccaaaggcgctacatgggacattttaaacctcgccgatgctctgctggaacaggccatgatcggccctagccccaatccactcattctgagctacttgaaatatgcaatcagctctcagttcgacgatttttccagagatctgtgtgtgcaagccctcctggacataatggatatgttctgtgacaggctgtcatgccacggtaaggctgaagaatgcatcggactctgccgagcgctgctgtctgctctgcactggttactgaggtgtactgcagcatcggccgaaagactgcgggagggactggaagctggcacaccagccgcaggtgaaaaacagctcgccatgtgtcttcagcgcctagagaaaaccctatcctctactaagaatagggctctgcttcacattgcaaaactcgaagaagcttcctcctggactgcgatcgagcacagcctgctgaaactgggcgagatcctcgccaatctctctaacccacagcttcgcagccaagccgagcaatgtggcactcttatacggtcaattcccactatgctctcagtgcatgctgaacagatgcacaaaacaggatttcctacagtgcatgccgtgatcttgctcgaggggacaatgaacttgactggcgaaacacagtccctagtcgagcagctgacaatggtcaagcgtatgcagcatatcccgaccccgctcttcgtgctcgaaatttggaaagcatgtttcgttggcctcattgagtcccccgagggcacagaggagctgaagtggactgccttcaccttcttgaagatccctcaggtcctggtcaagctgaagaagtacagtcacggggacaaagattttactgaagacgtgaattgtgcttttgagttcctgcttaagctgacccctctcctggataaggccgatcagaggtgcaactgcgactgcacaaactttctgctacaggagtgcggcaagcagggactgctgtctgaagctagtgtcaacaacttgatggctaaaagaaaggccgatcgcgaacacgcacctcaacagaagtcgggcgagaacgcgaatatccagcctaacattcagctgatcttgcgcgctgagcctaccgttactaacattcttaaaaccatggatgctgatcactcaaagagcccagagggcctgctgggcgtgctaggccacatgctgtccggaaagtccctcgacctcctgttagctgccgcagctgcaactggcaagctgaagagctttgcccgaaaattcataaacctgaacgagttcaccacatatggtagtgaggagagcactaaaccagcatccgtaagggccctattgttcgatatcagtttcctgatgctgtgtcacgtcgcccagacatacggcagtgaggttattttgtctgaatctagaacaggggctgaagtgcctttcttcgagacatggatgcaaacgtgcatgccagaggaaggcaagatcctcaatccagaccatccctgcttcagaccggattcgacaaaggtggagtctctggtggctctcctgaacaactcatcggagatgaagctggtgcaaatgaaatggcacgaagcttgcctgtccattagcgctgcaatactggagatacttaatgcttgggagaacggcgtgctcgccttcgagtctatacagaaaattacagataatatcaagggtaaggtgtgttctctggctgtgtgtgcagttgcctggcttgtggcccacgtgcggatgcttggacttgacgagagggagaagagtcttcaaatgatacgacagcttgcaggaccccttttttcagagaatactttacagttttataatgaacgggtggttatcatgaactccatactcgaaaggatgtgcgccgacgtgctgcaacagacggctactcagattaagtttccgagtactggcgtcgacacgatgccttactggaatctgttgccacctaaacgtcctattaaagaggtgctgaccgatatctttgctaaagttcttgaaaaaggctgggtggactcacgtagcatccatatattcgacactttactgcatatggggggagtgtactggttttgtaacaacttaatcaaggagctgttaaaagaaaccaggaaggagcataccttacgcgcagtagaattattgtattctatcttttgcttggatatgcagcaggttaccctggtgctcctgggtcatatcctgccgggactcctgacagattcgtctaagtggcacagtttaatggacccccctgggaccgccctcgcgaagttggcggtgtggtgtgccctttcttcgtacagctctcataaaggtcaggcctccactcgccaaaaaaaaagacaccgggaagacattgaagactatattagcctctttcctttagatgacgtgcagccgtccaaattaatgcgcctgttgagctccaacgaagatgatgcgaacattttgtcctcaccgaccgaccggtcaatgagcagctccctttctgcctctcagttgcacactgtaaatatgcgcgacccactgaatagggtgctcgccaatctattcttgctcatttcttccatcctggggagccgaacggcgggaccccacacacaatttgtccagtggtttatggaggagtgcgttgattgtctagaacagggaggtcggggatcagttcttcaattcatgccatttactactgtttcagaactcgtaaaggtgtccgccatgtcgagtcctaaggttgtgctggctataaccgatctgagccttcctctcggccgtcaggtggctgcaaaagccatcgcagctctgtag

SEQ ID NO: 229843 - DNA, 2970 bp, Artificial Sequence
  Description of Artificial Sequence: Synthetic coding sequence
atgaaggttgttaatctcaagcaggctatcttgcaggcctggaaagaaagatggagtgattaccagtgggccatcaatatgaagaaattcttcccaaagggggctacatgggatatcttaaatcttgccgatgcgctcttggaacaggcaatgatcggaccgtccccgaatcctctgatcctcagctacctgaagtatgccatttcctcgcagatggtctcttatagctctgtgctgacagctatctcaaaattcgatgacttctcaagagatctttgcgtgcaggctctactcgatatcatggacatgttctgtgaccggctgagctgccacggcaaggctgaagagtgtattgggttgtgtagagcattgctatccgcgcttcactggctgttacgatgtaccgccgcatctgccgaacgccttagggaaggcctcgaagccggaacaccagctgctggggaaaaacagctggccatgtgtttgcagcggctggagaagacattatcttcgacaaagaaccgagctctcttgcatatcgcaaaactcgaagaggctagctcctggactgccatagagcatagcttacttaaactcggcgagattctcgcgaacctgtcgaatccacagctgcggagtcaggcagaacagtgcggaaccctaataagatctataccaactatgttgagcgtgcacgctgaacagatgcacaaaacaggtttcccaaccgttcacgcagtgattctgttggaaggcacgatgaatttaaccggagagacccagtcactggtggagcagctcacgatggtcaagcggatgcaacacatacccaccccgttgtttgtattggaaatctggaaggcctgttttgtaggattgattgaaagtcctgagggaacagaggagttaaagtggactgcattcaccttcttgaagatcccacaggtactcgtcaaacttaagaagtactcacacggggataaggacttcacggaggatgtgaactgcgcattcgaattcttgttaaagctgacacctctgctcgataaagccgatcagcggtgtaattgcgattgtacaaatttcctccttcaggagtgcgggaagcaaggactgctttcagaggcctcagtaaacaacctgatggccaaacgaaaagcagaccgcgaacacgcacctcagcagaaaagcggcgagaatgccaacatccagccgaacattcagctgatcctacgtgcggaacctacagtgacaaatattttaaagaccatggacgctgatcatagcaaatcccccgagggactgctgggcgtactcggccatatgttgagcggcaagtctctcgatctgctcttggctgctgcagctgcgacagggaagcttaaaagcttcgccagaaaattcataaacctgaacgagtttaccacctacggctccgaagaaagtaccaagcctgcctctgttcgtgccctactgtttgacataagcttcttaatgttgtgtcacgtcgctcagacttacgggagcgaagtcatcctttcggagagtaggaccggagccgaggtgcccttctttgagacttggatgcaaacctgcatgcccgaggaaggcaaaatactgaaccctgatcacccttgcttccgcccagattccacaaaggtggagtctttggttgcccttttaaataactcaagcgagatgaaacttgtgcaaatgaagtggcacgaagcatgtttatcaatctccgctgcaatcttggagattctgaatgcctgggagaacggagttctggccttcgagtcaatccagaagatcaccgacaacatcaagggtaaggtgtgctctctagccgtctgcgccgtagcgtggctggttgctcacgtgcgtatgctgggcctcgatgaaagagaaaagtccctccagatgattcggcagctggccggacctcttttttcagagaatacgctccaattttacaacgagagggtggtgataatgaatagtattctggagaggatgtgcgccgatgtgctgcagcagaccgcgacccaaatcaagttccctagcaccggcgtggacacaatgccatactggaaccttctgccacctaaacgacccattaaggaagtgttgacagatatcttcgccaaggtgctcgagaaaggatgggtggattcacggtccattcatattttcgatacacttcttcatatgggcggagtgtattggttttgcaacaacctgattaaggaactgctcaaggagactaggaaagaacacacgctgagagccgtggagttactctatagcatattctgtctcgatatgcagcaagtgactctcgtgctgctaggacacatcttgccgggactgctcactgattcttccaagtggcactcactaatggacccgccaggtaccgccctggctaaactcgctgtctggtgtgctttaagcagttacagctctcataaaggccaagcctccactaggcaaaagaaaaggcaccgagaggatattgaagactacatttctttatttcccttagacgacgtccagccttcaaaattgatgagactcttgtccagcaatgaggatgacgccaacattctctctagccccaccgacagatccatgtctagctcgctgtccgcatcccaactgcacactgtcaacatgcgggatcctctcaacagggtgcttgcaaacttatttttgctgatcagctctattcttggttcgaggacagctggaccccatactcagttcgtgcaatggtttatggaggagtgcgtggactgcctggaacagggaggtagaggaagcgtgctccagtttatgccattcacaacagtcagtgagctggtgaaggtctccgcgatgagttcacccaaggtagtcctcgccattaccgacctgagcttaccgctcggccgtcaagtggctgccaaggcaattgctgcactgtag

SEQ ID NO: 229844 - DNA, 864 bp, Artificial Sequence
  Description of Artificial Sequence: Synthetic coding sequence
taaaatctcatcaaggaactcctcaaggaaacccggaaggagcataccttaagagccgtagagctgctgtatagtatattttgtcttgatatgcagcaggtcaccctagtcctcctcggacatatacttcctggcctgttgacggactcgagcaagtggcatagtctcatggacccccctgggacagcacttgccaagttagcggtgtggtgcgctctcagctcatattcatcccataaagggcaggccagtacaaggcagaaaaagcgccaccgcgaggacattgaggactacatcagtctcttccccctggacgatgtccagccttctaagctcatgcggctgctgtctagtaacgaagatgacgcaaacatcctatccagccccaggagctccctgggcagtccatgtactagctacctccgctgggttaaggtcggactcggtcatcccagaggcgcacccctcctgcatagtgctggctgtttccccgcattgcacctcttgcgcccaactgccgacaggtccatgtcaagcagcctgagtgccagccagctgcatacagtgaatatgcgtgacccccttaacagggtcttagccaatctattcctgctgatatcctcgattcttgggagccgcacagcgggtcctcatacccagtttgttcaatggtttatggaagagtgcgtcgactgtttagagcaggggggacgtggatctgtgctgcagttcatgccgttcacaactgtgagtgagctcgtcaaggtctcagcgatgtcctccccaaaggttgtgctggcaattaccgatctgtcactccctttagggagacaggttgctgccaaggctattgcagctctgtag

SEQ ID NO: 229845 - DNA, 906 bp, Artificial Sequence
  Description of Artificial Sequence: Synthetic coding sequence
atgaaggtggtgaaccttaagcaagcgattctgcaagcttggaaagagcgatggagtgactatcaatgggcaataaacatgaagaaattcttccccaagggcgcaacatgggacattttgaacctggccgacgctctcctggagcaggcgatgattggtccttcccctaatccgctcatccttagttacctgaaatacgcaatcagctcccagatggtttcctattctagtgtgttgaccgccatttctaaattcgacgattttagtcgcgacctgtgcgtacaggctctgctggacatcatggacatgttctgcgaccgactcagttgtcatgggaaagctgaagagtgtatcggactttgcagagctcttctgagtgccctgcactggcttttacggtgtacagccgcatccgcagaacgattgcgagaaggactcgaagcgggaaccccagctgccggtgaaaagcagctggctatgtgcctccaaaggctagaaaaaaccctgtccagcacgaagaatcgggctctgcttcatattgctaagttagaagaggcctccctgcacacaagccagggcctcggtcagggtgggactcgagctaatcagcctacggcctcttggacagcaattgagcacagcctgctgaaactgggggaaatcctcgcgaacctatctaatccccagctgagatcccaggctgagcagtgtggcaccctgataaggtcaatacctactatgctgagtgtgcacgccgagcaaatgcacaagaccggctttcccacagtccacgcagtgatcctcctggaggggaccatgaatctgactggggagactcagagtctggtggagcaactgactatggtgaagaggatgcagcacatccctaccccactcttcgtttag

SEQ ID NO: 229846 - DNA, 2700 bp, Artificial Sequence
  Description of Artificial Sequence: Synthetic coding sequence
atgcctctggtgccacgctggtgtccaaccctgttgtcgtcccagcccagcgtcagttgtcatgggaaggcagaggaatgcattggactgtgtagggctcttctgagcgccctgcattggctgctgcgctgtactgccgctagtgccgaaaggctgcgagagggattggaagccggaactccagccgcaggagaaaagcagctggccatgtgtctgcagcggctggagaagacactcagcagtaccaagaatcgggctctgctgcacattgctaagttagaagaggccagttcttggaccgccatcgagcattctctgctgaaactgggcgagatattagcaaatctcagcaacccacaactcaggtcacaagccgaacagtgtggaacgctgataagatccataccaacaatgctgagcgtgcatgctgagcagatgcataaaactgggttccctaccgttcatgctgttatcctgctggaaggaacgatgaacctcaccggcgaaacgcagtctctggttgagcagttaacaatggtcaagaggatgcagcacatacctactcctcttttcgtgttggaaatctggaaagcttgctttgtagggttgatagagtcccctgaaggtacagaggagctgaaatggacagcgtttacttttcttaagatcccccaggtcctggtgaagctcaagaagtatagtcacggcgacaaggatttcacagaggacgtcaattgtgctttcgagttcctgctcaagctgacccctctgcttgataaggctgaccagagatgcaactgcgattgcaccaacttcttgctgcaagagtgcgggaagcagggcctgctgtcagaggcgagcgtgaacaacctgatggctaagaggaaggccgaccgcgagcatgctccccaacagaagagtggagagaatgccaacatccagccaaacatccagttgatcttaagagccgagcctactgttactaacattctgaagacaatggacgccgatcattcaaagagtccagaaggactgctgggggtgctgggtcacatgctctcaggcaagtccctagacctactgctggcagctgctgctgcgacaggtaagctgaaatcctttgcacgaaagttcataaatttgaatgagttcaccacctacgggtcagaagagagcaccaaacctgcaagtgtacgcgcattgctgttcgatatcagctttctcatgctatgccacgtcgcgcaaacctacggtagcgaggtcatcctgtctgagtcacgcacaggcgctgaggtcccatttttcgagacatggatgcagacttgcatgccagaagagggaaaaattctgaatcccgatcacccttgcttccgtcccgactcaactaaggttgagagcttagtggcgctcttgaataatagtagtgaaatgaagctagtgcagatgaaatggcatgaagcttgtttatctattagcgcagcaatccttgaaatcttaaacgcgtgggagaatggggtcctcgcgtttgagtctatccaaaaaatcacagacaatatcaaggggaaggtatgttccctcgctgtatgtgcagtggcgtggctggtggctcatgtgcgcatgctcggattggatgagcgggagaaaagcttgcaaatgatacggcagctcgccggaccactgttctcagaaaatacactgcagttctacaatgaacgcgtagtgatcatgaattcaatcctcgagcgaatgtgcgcagacgttctgcagcagaccgctacccaaatcaagttccccagcaccggtgttgataccatgccgtactggaacctgcttcctcccaagcgacccatcaaagaagtgctgaccgatatcttcgctaaggtactggaaaagggctgggtagactcaagatcaatacatatcttcgatacactcctccacatgggcggtgtttactggttttgtaataatcttattaaggagttgctgaaggagactagaaaagaacacactctgcgcgcagtcgagcttttatactctatcttttgcctcgatatgcagcaggtcacactggttctactcggtcacattctccccggacttctaaccgatagttcaaagtggcacagcctgatggatcctccaggaaccgccctggctaagctggctgtgtggtgtgccctgtcttcctacagttcccacaaggggcaggcttctactcggcagaagaagcgccaccgggaggatattgaagactatatctctctgtttccactggatgacgtgcagcccagtaaactgatgcggcttctcagctccaatgaagatgacgcaaacatcctgagctcccccacagatcgttccatgagttcgtccttgtcagcctcacagctccacacagtgaatatgagagatcccctgaatcgtgtgttggcaaatctgtttctgctgatttcctctatccttggcagcagaaccgccggaccacacactcagttcgtacaatggttcatggaagaatgtgtcgattgcttagaacagggtgggcgaggatccgtacttcagttcatgcccttcacaacagtttccgaactggtgaaagtctctgcaatgtcttcccctaaggtggtcttggcaattactgacttaagcctgccactcggcagacaggtcgcagccaaggcaatcgctgcgctttag

SEQ ID NO: 229847 - DNA, 756 bp, Artificial Sequence
  Description of Artificial Sequence: Synthetic coding sequence
atgaaaaaattctttcctaagggcgctacctgggatatactcaatttagcggacgctctgctggaacaggcaatgatagggccttcccctaaccccctcatactgagctacctgaaatacgccattagctcacagatggtgagctatagcagcgttctcacagccatcatggaaatattgaatgcctgggaaaacggtgtgcttgccttcgaatcaatccagaagatcacagacaacattaaaggaaaggtctgcagtttggccgtctgtgcggtcgcctggttagttgcacacgtgagaatgctcgggctggacgaacgagagaaaagcctacagatgatcagacaactggctgggcctctattttccgaaaacacacttcagttctacaacgaacgggtggtcataatgaattcaatccttgaaagaatgtgcgcagacgtactacaacagacagcaacccagatcaaatttccctccaccggtgtcgataccatgccgtactggaacctgcttccacccaagagacccataaaagaagtattgactgatatctttgcaaaggtgttggaaaaaggatgggtagattctcgatcaatacatatcttcgacactctcctgcacatggggggagtgtattggttctgcaacaatctcataaaggaattactaaaggagacccggaaagaacatactctccgcgcagtggagctgctgtactctatattttgcctcgacatgcagcaggtaacctag

SEQ ID NO: 229848 - DNA, 2466 bp, Artificial Sequence
  Description of Artificial Sequence: Synthetic coding sequence
atgattggaccctccccaaacccgctgattttaagctacttaaagtatgcaatcagttcccaaatggtcagctactcttctgtgctaacagccattagcaagttcgacgactttagtcgcgacttgtgtgtgcaggccctgttggatattatggatatgttctgcgaccgcctctcttgtcacggcaaggcggaggaatgcattggactctgcagagccctcctgagtgccttacactggctgctccggtgcactgctgcatctgcggagcggctcagagagggtttggaagccggaactccggctgccggagaaaagcagctcgccatgtgtttacagcgcctggagaagacactaagctccacaaagaatagagctttactccacatcgccaagcttgaggaggcatctagctggacggctatagagcacagtctcctgaaactcggtgagattctcgccaacctgtcaaacccccagctaaggtcccaagctgagcagtgcgggactctcattcgatcgatacctaccatgctgtccgtgcacgcggagcagatgcacaaaactgggtttcccacagtgcacgccgtgatcctcctcgagggaactatgaatttaaccggagagactcagagtctggtagagcagctgactatggtaaagaggatgcagcatattcccaccccactcttcgtcttggagatttggaaggcttgttttgtgggactgattgaatctcccgagggaaccgaggaactcaaatggacagctttcacgtttctgaaaatcccccaggtcttggttaaactgaagaaatattcacacggagacaaggactttacagaagatgttaattgtgcctttgagtttcttttaaagttgacacccctattggataaggctgatcaaagatgcaactgtgattgtaccaattttctacttcaggagtgcggtaagcagggcctactgtctgaagcgagcgtgaacaatctcatggccaagcggaaagctgacagagagcatgcgcctcagcagaagtcgggcgagaatgccaacatccagcccaatatccaacttatcctgcgtgccgaaccgactgtgactaacatcctgaagactatggatgctgatcatagcaaatcccccgaggggctgctgggcgtgctggggcatatgctatcaggtaagtcgcttgaccttctgctcgccgcagctgccgcaaccggaaaactgaaatctttcgcccgaaaattcatcaacctcaacgagttcactacctacggatccgaagagtcgactaagcctgcaagcgtgcgcgcactactctttgatatctcattcctcatgctgtgccacgtcgcccagacgtatgggtctgaagtgattctttcagagagccgcactggggcagaggtgcccttttttgaaacatggatgcagacctgtatgccagaagagggaaaaatcctgaatcccgaccatccatgctttcgtcctgatagtacgaaggttgagtcactcgtcgccctgctgaacaattcatccgagatgaagctcgtccaaatgaaatggcacgaggcctgtctaagcatctcagcagcaattctggaaatactgaacgcctgggaaaacggggtccttgcttttgaatccattcagaagattaccgataatatcaaaggcaaagtttgcagcctcgctgtttgtgctgtggcatggctggtggcccacgtgcggatgcttggcctcgatgaacgcgagaaaagtctgcagatgatccggcaacttgccggacctttatttagtgaaaatactctccagttttataacgaaagggtcgttattatgaacagcattttggaacgtatgtgcgccgacgtgctgcagcagaccgcaacacagatcaaattcccttccaccggagtggatactatgccttattggaacctgctacccccaaaaagaccaatcaaggaggtacttacagatattttcgcaaaggtgctggagaagggctgggtcgacagccggtctatccatatcttcgatactcttttgcatatggggggtgtctactggttttgcaataacctgataaaagagttgctgaaggagacccgtaaagaacacacactgcgagcagtagaactgctctattctatcttttgccttgatatgcaacaagtaaccctcgtgttgctgggccacatcctgccgggattgctcacggattcatctaagtggcattcactgatggatccccctggaaccgcgttagctaagcttgcagtctggtgtgctctgagttcgtattcaagccataaggggcaggccagtacacgtcaaaagaagcggcacagagaagacatcgaggattatatttcaccaaaggtagtgctggccattacagacttaagtctgcctctgggccgtcaagtcgctgccaaggccattgcagctctgtag

SEQ ID NO: 229849 - DNA, 1026 bp, Artificial Sequence
  Description of Artificial Sequence: Synthetic coding sequence
atgaagaagttcttccctaagggcgcaacctgggatatcctgaatcttgccgacgccctgcttgagcaggcgatgataggtccctctcccaatcccctcatattgtcttacttaaagtacgccatcagttcccaaatggtgtcctacagctctgttctgacagccatcagcaaattcgacgatttcagcagggacctgtgtgtgcaggcactactcgatatcatggatatgttctgtgaccgcctgagctgtcatggcaaggcagaggagtgcattggtctgtgtcgtgcactgctgagcgctctccactggctgttgagatgtacagccgcaagtgccgagagattgcgagaaggcttagaggcaggcacgccagcagctggggaaaaacaacttgccatgtgcctccagcgactggaaaaaacactgtcatccactaaaaacagagcgctcctccacatcgctaaattagaggaggcatcctcatggaccgcaatcgaacatagtcttctcaaactcggagagattctggccaacttatccaacccacagcttcgtagccaggctgagcagtgcggtactctcatacgcagcatccccactatgctttcagtacacgctgagcagatgcacaagacaggttttcccacggtccatgctgtaatcttgctggaaggtaccatgaacctcaccggggagactcaaagcctcgttgagcagcagaccgctactcagataaaatttcctagcactggagtggacaccatgccttattggaatttacttcctcccaagaggccaatcaaggaggttctcacagacatattcgcaaaggtgctggaaaagggatgggtcgactctcgcagcattcatattttcgacaccctactgcacatgggtggagtgtactggttttgtaacaatctcattaaggagcttctgaaggagaccaggaaggagcacactcttcgagccgttgagcttctgtattcgatcttctgtcttgatatgcagcaggtcacctag

SEQ ID NO: 229850 - DNA, 2796 bp, Artificial Sequence
  Description of Artificial Sequence: Synthetic coding sequence
atgaaggtcgtgaaccttaaacaggcaatcctccaggcttggaaagagcggtggtcagattaccagtgggccattaacatgaagaaattctttccgaaaggggctacatgggatatcctgaacttagctgacgccttgttagagcaagctatgatcggccctagtcccaatccattgatcttaagctacctgaagtacgcaatcagtagccagatggtatcctactcttcagtcctcacggcaattatgtgtttgcagagactcgagaagaccctgtcatcgacgaagaacagggccttgctccacatcgccaagctggaggaagcaagcctgcatacgagccagggacttggacagggcggaacccgcgcaaatcaacctaccgcatcttggaccgcaatcgagcactccctcctgaagctgggagagatccttgccaatttgagcaacccacaactgaggtcccaggcggaacagtgtggtacgcttatacggtccatcccaacaatgctgagtgtgcatgcagaacagatgcataaaacaggtttccccaccgtgcatgccgttatcctcttggaagggacgatgaatttgactggggagacccagtcattagtagaacagctgacaatggtcaaaagaatgcagcatatcccaactcctctcttcgtgctggagatatggaaggcatgctttgtcgggttgatcgagagccccgaaggcactgaggagctgaaatggactgcctttaccttccttaagataccccaggtgctggtgaaattgaaaaaatacagccacggcgacaaagactttaccgaagacgtgaattgtgcgtttgagttcctgttgaagctcacaccactactggacaaggccgaccaaagatgcaactgtgactgcaccaactttctcttgcaggaatgcggtaagcagggattactgtcagaggccagtgtgaataatctaatggcaaaacgtaaggccgatcgcgagcatgccccacagcaaaagtcgggcgaaaacgccaacattcagcctaatatccagctgatactgagagccgaaccaaccgtaacaaatatcttgaagacaatggacgctgaccatagtaagagtcctgagggcctgttaggagtcctgggtcacatgctgtctggcaaaagtctagacctgctcctggccgcagccgctgccacaggcaagcttaaatccttcgctagaaaatttataaacctcaacgaattcactacttacggttctgaggaaagtacaaaacctgcttccgtacgagcactcttattcgatatatctttcctgatgctctgtcatgtggcacagacctatgggagcgaggtgattctgtcagaaagccgaacaggcgctgaggtaccattttttgagacatggatgcagacgtgcatgcctgaggagggtaaaatcctcaatcctgaccatccttgtttcagacccgacagtacgaaggtcgagagcctggtggcacttttaaataattcctccgagatgaaacttgttcagatgaagtggcacgaggcgtgcctgagtattagtgccgcaattctcgaaatcctgaacgcctgggaaaacggagtgctcgccttcgaaagtattcagaagatcactgacaatatcaaaggaaaagtttgttcattggcggtgtgcgctgtcgcgtggctcgtggcacacgtgcgcatgctgggcctggatgaacgcgagaagtctctccagatgatacgccagctcgcagggcctctattttcagagaacactttgcagttctataatgagcgcgtcgtgatcatgaatagcatcctcgagcggatgtgcgccgatgttcttcaacagaccgctacgcagattaaattcccttctaccggcgtggataccatgccttactggaacttactgcctcctaagcgaccaataaaagaggtactgactgacattttcgcgaaggttttagagaagggctgggtcgacagccgctctattcatatttttgatacactgctacatatggggggagtctactggttctgtaataacctaatcaaggagctccttaaagaaaccagaaaagaacataccttacgagctgtcgaattgttatactcgattttctgtctggatatgcagcaagtcaccctggtactgctgggccatattctccctgggttgctcaccgactcctctaagtggcacagtctgatggaccccccaggaacagctctggcaaaacttgctgtttggtgtgccctttcttcctatagcagtcataaaggccaggcgtcaacgagacagaagaaaagacaccgggaagacattgaagactacatttccttattccctttggacgacgtccagccgtctaagctgatgcgcctcctgagctcaaacgaagacgatgcaaatattcttagctcaccaactgatcggtccatgagctcttctctgagcgcctctcagctccacacggtgaacatgagggacccactgaaccgggtactggctaatctgtttctgctaatctcatctatcctagggagtcgaaccgccggaccccatacacagttcgttcagtggttcatggaggagtgtgtggattgcctcgaacagggagggcgaggtagcgtgctgcagttcatgccattcaccaccgtgtctgaactggtaaaggtctccgccatgtcttctccaaaagtagtgctcgccatcactgacttgagtctgccactcggcagacaagtggcagcaaaagcaatcgcagccctatag

SEQ ID NO: 229851 - DNA, 444 bp, Artificial Sequence
  Description of Artificial Sequence: Synthetic coding sequence
atgaagaagttcttccccaaaggagccacatgggacatccttaatttggccgacgcactcctagaacaggccatgattgggcctagccccaatcctctcatcctttcataccttaaatatgctatctccagccaaatggtgagttacagcagtgtgctcaccgccatctccaaattcgacgatttttcacgggacctatgcgtccaagcactcttagacatcatggacatgttttgcgaccgactgtcttgccacggcaaagctgaggaatgcatcggcttgtgccgggcattgctttccgctctgcactttatgccttttacaactgtgtcagagctggttaaagtgagcgccatgagctctccgaaggtcgtccttgctataaccgatctgtcgctccctctgggacggcaagtggcagccaaagcaatcgccgctctgtag

SEQ ID NO: 229852 - DNA, 921 bp, Artificial Sequence
  Description of Artificial Sequence: Synthetic coding sequence
atgaagaaatttttccctaaaggggctacgtgggatattttaaacctggccgatgctctcctcgagcaggccatgatcggcccttcaccaaaccctcttattctcagttacctgaagtacgccatatcttcacagatggtgtcctatagctcagtgttgactgccatttccaagttcgacgatttcagccgagatttatgcgtccaggccctgctcgacataatggatatgttttgtgatcgattgtcctgccacggcaaggctgaagagtgcatagggctctgtcgagctttactgtcggccctgcattggctgctgaggtgtactgctgcctccgcagaaagactccgggagggactcgaggctggcacccccgcagcgggagaaaaacagctggctatgtgcctgcagaggctggagaagactttgagcagtactaagaatagggctctgctccatatcgcaaagttggaagaagcgtcaagctggacagcgattgaacacagcctgttgaaattaggtgagatcttagctaacctgagtaatcctcaattgagatcccaggcggagcagtgtgggacgttaataaggtccattccgacaatgctctccgttcatgcggaacaaatgcacaaaactggctttcccaccgtgcatgctgtcatattgttggagggcacgatgaatttaaccggagaaacccagtccttagttgagcagctgactatggtgaaaaggatgcaacacattccaacaccactgtttggacggggaagcgtgctgcagttcatgcccttcaccacagtatcagaattggtcaaagtcagcgccatgagctctcctaaggtcgtcctggccatcactgatctctccctcccactgggcagacaggttgcagccaaggctatagccgcactatag

SEQ ID NO: 229853 - DNA, 2244 bp, Artificial Sequence
  Description of Artificial Sequence: Synthetic coding sequence
atggtgccaggctcggaggggccagctcgggcagggagcgtggttgctgatgtggtgttcgtaatcgagggcactgcaaatctgggcccttactttgaggggttaagaaagcattatctgctgcccgcaattgagtacttcaacgggggaccgcctgccgaaaccgacttcggcggtgattatggagggacccagtacagccttgtagtgttcaacactgtggactgtgcgccagagagctacgtccagtgccacgcccctacctcttcagcctacgaatttgtgacctggctcgatggcatcaagttcatggggggaggcggtgagtcttgtagtctgatagctgaaggactgtccaccgctctgcaacttttcgatgactttaagaagatgcgcgaacagataggccagacccatcgagtctgtcttctgatatgtaattcaccaccatatctgctcccagcggtcgaatctaccacttacagcggatgcacaaccgagaacctagttcaacaaattggcgagcgcggaattcacttcagtatagtgtcccccagaaagttaccggctttgcggctcttgtttgagaaagccgcacctcccgcactgctagagcccctgcagcccccaacagatgtgtctcaggacccccgacacatggtgcttgtgcgtggattagttctgcccgtggggggaggttcggccccaggacctctgcagtcaaaacagcccgttccactgccaccagccgctcctagcggggcaactctgtccgccgctccccagcagcctctcccaccagttccaccccagtatcaggtacccggtaacctctccgctgcacaagtggctgcacaaaatgccgtcgaagccgctaaaaaccagaaggctggattgggaccacgattctcacccatcactcccctccagcaggcagctcccggagtgggacctcccttcagccaagcccctgcccctcagttgccgcctgggcctcctggagccccaaagccccctcctgcctcacagcctagtctcgtcagtacggttgcacccggttctggactggcccctaccgcacagccaggcgcaccaagtatggctggtacagtggccccagggggagtgagtgggccatcccctgcccaattgggtgcacccgcacttggcggtcaacagagcgtatcaaacaagctcctggcttggagtggagtgttggagtggcaagagaagccgaaacccgcatccgtggacgcaaatacaaagctcacccggagtctcccttgccaggtttacgttaatcacggcgaaaacctcaaaaccgaacagtggccccagaaattgattatgcagcttattccgcagcagctattaacgaccctggggccactgtttcgaaattcaaggatggtgcagttccatttcaccaacaaagacctggagagcctcaaggggctgtaccgaatcatgggcaacgggttcgcaggctgcgtgcactttcctcacaccgccccatgtgaggtgcgagtcctgatgctgttgtactccagtaagaagaagatcttcatgggcctaatcccctacgatcagtcgggattcgtgaatggcattagacaggtgattaccaatcataagcaggtccagcagcagaaactcgaacaacagcagcggggtatgggcggacagcaggcccctcccggtttgggcccaattttggaggaccaagctagacccagccaaaatttattacagctgagaccaccacaacctcagccacaagggaccgtgggcgcaagcggagccaccggccaaccacagccccagggcacagcgcagccccctcccggtgctccacaggggcctccgggagctgctagcggtcctccaccaccaggacctatcttaaggccgcagaaccccggagccaacccccaactccgtagcttgctgcttaatcccccaccgcctcagaccggcgtgcccccaccgcaggcttcacttcaccatcttcagccacctggagctccggcactgctccccccacctcaccaggggctcggccagccacagctcggaccccctctgctccacccaccacccgcacagtcctggcccgcacaactccctccgcgtgcccctctgccaggccagatgttgctgagcggcggacctcgcggtcccgtaccacagcctgggctacaaccctctgtaatggaggacgatatcctgatggatctgatctag

SEQ ID NO: 229854 - DNA, 2268 bp, Artificial Sequence
  Description of Artificial Sequence: Synthetic coding sequence
atggtccccggatcagaggggcctgccagggcagggagtgttgtggccgacgtcgtgtttgttatcgagggcacggccaatctggggccatattttgaggggctgcggaaacactacttgctgcctgctatcgagtactttaacggtgggcctccagccgagactgacttcgggggagactacgggggaacgcagtactctctggtggtattcaatactgtggactgtgcacctgaaagttacgtccagtgccatgcacccacatccagcgcttatgagtttgtgacctggctggacgggatcaaatttatgggaggcggaggagaatcctgctctctcatcgctgaggggttgtccaccgccctgcaactgtttgacgatttcaaaaagatgcgggaacagattggtcagactcaccgtgtgtgtctgctgatttgtaatagtccaccctatctgttgcccgctgtggaatctacgacatacagcgggtgtaccacagaaaatctcgtccagcaaatcggggagcgcggaattcattttagtattgtatcccccagaaagctacctgcgctgcggctgctatttgaaaaggccgcacccccagccctgctggaaccattgcagcccccaaccgatgtgtcacaggatcctcgccacatggtgcttgtgcgcggactggtactgccagtgggaggcggatcagctccaggcccacttcagagcaaacagcctgtaccccttccacctgcggcaccttccggagctacactgagtgccgctccccagcagccgcttcccccagtgcccccacaatatcaggtgccaggtaatctcagcgcagcacaggtggcagcgcaaaatgcggttgaggcagccaaaaatcagaaagccggtttgggtccccgatttagccctatcacaccattgcagcaggccgcacctggcgtgggtcccccattctcccaagctcctgcccctcagcttccgcctggacctcccggagcccctaagccaccgccagcttcgcagccctcacttgtgagcacagtggccccagggtctggactggctccaaccgcccagcccggagccccttcaatggccggtacagtcgctcccggtggcgtttcgggtccctctccagcgcagttgggagctcctgccctaggaggccagcagtccgtgagcaacaagctgctagcttggtccggggtactcgagtggcaggaaaagccaaagccggcttcagttgatgcaaacacaaaattgacccggtctctcccatgccaggtgtacgtcaaccatggggagaacttgaaaactgaacagtggccccagaaactcattatgcaacttattccccaacagctgctgaccacccttggacctctttttagaaactccaggatggtgcagtttcacttcacgaacaaagacttggagtctctaaaagggctctacaggataatggggaacggatttgctggctgtgtgcatttcccccacacggccccttgcgaagtccgagtgctgatgctgctgtacagcagcaagaagaagatctttatgggtctgatcccttacgatcagtctggctttgttaacggcatcaggcaggtgatcacaaaccataagcaggtgcagcaacagaagcttgaacagcaacagagaggcatgggaggtcagcaggcacctcctgggttgggcccaattctcgaggatcaggcgagacccagccagaacctgcttcagttgcgtccacctcagccccagcctcagggcaccgttggagcgtctggggcaacaggccagccacaaccgcagggcactgcacagccccctccgggagcccctcagggtccccctggagccgcatccggacctcccccaccaggcccaatcctgaggccacagaatcctggcgctaatccccagctgcgttcactcttactgaatccaccgcctccacagaccggcgttccacctccgcaggcctcactccatcatcaccttccctccccgggaccacataacttcccactcggcctgcactgccaggtgcggggaccaggaggtgggcaaagaagcggactgagtgtcccagccgctccaggtctggagcaccaggacagggtcctgctaggatccaaggatatcgggtccaaaaacgagggctctcccatccgggcatgttcaccagcatcttggagaacaacatcctcctggatctccagcgaatcccccaccccgaataaggtcccattttag

SEQ ID NO: 229855 - DNA, 2349 bp, Artificial Sequence
  Description of Artificial Sequence: Synthetic coding sequence
atggtaccaggctcagaagggcctgccagagccggaagcgtggtcgccgatgtggttttcgttatcgaaggtaccgcgaatctggggccttactttgaaggattgagaaagcactacctgctgccagcaattgaatatttcaatggagggccacccgctgagacagattttggcggtgactatggcggaacacagtacagcctagttgtgttcaatacggtcgattgcgcccctgaatcatatgtacagtgtcacgcccctacatccagtgcgtacgagtttgttacatggttggacggcattaagtttatggggggtggcggagaatcctgtagcctcatagctgagggcctgtccaccgcccttcagttattcgacgatttcaaaaagatgcgagaacaaataggtcagactcaccgcgtgtgtttacttatctgtaatagtccaccatacctactgcctgccgtggagagcacaacctattccgggtgcaccaccgagaatctggtgcagcagatcggcgagcggggaattcatttttcaatcgtctcgccgagaaaattaccagctctcagactgttgttcgaaaaggctgctcctcccgcactgctggaacctcttcagcctccaacagacgtcagtcaggacccacgccacatggtactcgtaaggggacttgttctacctgtgggaggcggttctgcccctggcccacttcagtctaaacagcccgttcccctgccacccgctgcgcctagcggcgctacgttgtcagccgcaccgcagcagcccctccctcctgtacctccccagtatcaggtgcctggcaacctgtccgccgcacaggtagctgcacagaacgctgtggaggcagccaagaaccagaaagccggactaggtcccaggttctcacccattacccctttgcagcaggcagcccctggcgtgggccctccgttctcccaggcacccgctcctcagctcccgccaggaccacctggagcccctaaaccaccgcctgcctctcaacccagcctggtcagcactgtcgcgccaggttcagggctggcacctacagcacagcccggagctccctctatggctggtacagtggcgcctggcggtgtgagtggcccatctcccgctcaacttggggctcccgcacttggtggccagcagagtgtgtctaacaagctgctggcctggtccggcgtcctagaatggcaagaaaagcccaaaccagccagtgtggacgccaatactaagctgactcgctcacttccatgtcaagtatatgtgaaccacggcgagaatctaaagaccgaacagtggccgcagaaactaatcatgcagctgattccccagcagttgttgactacattgggtcccctcttccgaaattccagaatggtgcagttccactttacaaacaaagatctggagagtctgaaggggttataccggatcatgggtaacggatttgctggctgcgtgcatttccctcatacagcaccatgcgaggtccgggtgctgatgttgctgtattcaagcaagaaaaagatcttcatgggcttgataccctatgatcagtcgggcttcgtgaacggtataagacaagtcataacgaaccataagcaagtgcagcagcaaaaactggaacagcagcaaaggggcatgggtggccagcaggcacccccaggactcggccctatattagaggatcaggcacgaccaagccagaatctgctgcagctgcggcctccacagcctcagcctcaaggaacagtcggagccagcggtgcgactggccaacctcaaccccagggaaccgcccagcctcctcccggagcgccacagggtccccctggggctgcgtcaggtccacctcctcctggtcccatccttcggccacagaatcctggagcaaacccccagcttcggtcactactgcttaacccaccgcctccacaaactggtgtcccacctccacaggcctccctacatcacctgcagccccctggagctcccgcattgctgccacccccacatcaggggctgggacaacctcaactggggcctccactcctgcatcccccacccgctcagtcatggcccgcacagctacccccaagggctccattgccagctgctaagagaaagcgggaaggcgaaggacgtgtgttccgcgaaaagtgggagcgtgcctacttttttgttgaggttaagagcatgcccatgtgcctgatatgtaagcagatcgtgtccgtgctgaaagagtacaatctgaaacggcactatgaatccaagcattctaagtcatatgatcagtatactgaacagactcgatag

SEQ ID NO: 229856 - DNA, 1449 bp, Artificial Sequence
  Description of Artificial Sequence: Synthetic coding sequence
atggtcccgggtagcgaaggtcctgcaagggcaggctcagtggtggctgacgtggtttttgtcatcgaagggaccgccaatctgggtccttacttcgaagggttgcggaagcattacctgctgccagcaatcgaatacttcaatggagggcctcccgcaccattttctcaagctcccgcaccacaacttccccctggacctcctggagctccaaaaccgccaccagcctcacaaccaagcctggtgagtaccgtggcacccggatccggcttggcacctacagctcagcccggagccccttctatggccggtacagttgctccagggggtgtgagcgggccttcacctgcacaattaggagcacccgcactgggaggtcaacagtccgtctctaataagcttctggcctggtctggcgtgttggagtggcaagagaagccgaagcctgcatcagtggacgcgaatacaaagctaactcggagcctcccttgtcaagtctatgtaaaccatggcgaaaatctgaaaacggagcaatggccacagaaattaattatgcagctcatcccgcagcagcttctcacaacattaggacccctgtttagaaattctcggatggtgcagtttcatttcacgaacaaagatctggagtctctcaagggcctgtaccgaatcatgggcaatggctttgccggttgtgtgcactttccccacacggctccttgtgaggtgcgtgtccttatgttgttgtatagcagcaagaaaaaaatcttcatgggtctgattccttatgatcaatctgggttcgtaaatggtattcggcaggtcattactaatcacaagcaggtccagcagcagaagctcgagcagcagcagcgagggatggggggtcagcaggcacctccgggtctgggaccaatacttgaggatcaagccaggccttcccagaatcttctgcaacttaggcctccccagcctcagccccagggcacagtgggcgcatcaggagccacagggcagccccaacctcaggggactgctcagccacctcccggtgctcctcaggggccacctggagccgcaagcggcccaccccctccaggtcccatcctcaggccgcagaatccaggcgctaatccacagcttaggtctctattactcaaccccccaccacctcagacaggcgtccctccgcctcaggcgagcctacaccacctgcaaccacctggggcaccagctctgctgccacctcctcatcagggcctcggccagccacagctgggacctccgctcctgcacccaccccctgcacaaagttggcctgcccagctgccaccaagagcccctctgcccggtcagatgctgcttagtggcggaccccgaggcccagtccctcagcccggactccagcccagcgtaatggaagatgatatccttatggatctcatctag

SEQ ID NO: 229857 - DNA, 2385 bp, Artificial Sequence
  Description of Artificial Sequence: Synthetic coding sequence
atggtccccggttcagaagggccagccagggccggaagtgtggtggctgatgtagtgtttgtcatagaagggacagcaaaccttgggccatatttcgaaggcctgcgcaaacattatctgttgccggcaattgaatacttcaacggcggaccccctgccgaaacagattttggtggggactatggcggtacacagtacagtttagtggtgttcaatactgtggattgcgccccagagagttatgtacagtgtcacgctcccacctcatctgcatatgagttcgtgacctggctggatggcataaagtttatgggcggaggaggcgagagttgctcactgattgcagaaggactctctactgctctccagctgtttgacgacttcaaaaagatgcgagagcagatcggccagacacacagggtgtgtctgttgatttgtaattccccaccttaccttctccccgcagtggagtccacaacttacagcggctgtacaaccgagaatttggtacagcagatcggagagagggggatccatttttctatcgtgagcccacgaaaactgccggctctcaggctgctcttcgagaaagccgctcccccagccctcctagagccccttcagccacccacagatgtatcacaggatccacgccacatggttctcgtgagaggcctggtcctgccggtgggcggtgggtctgcacccggaccactgcagtccaagcagccagtccccctgcctccggctgccccttccggcgcaacgctgtcggctgctcctcagcaacccctgccacccgtccctccccagtaccaggtgcctggcaacttgagcgctgcacaagttgccgcacagaatgccgtcgaggcagcaaagaatcaaaaagccggactgggcccaaggtttagtcctattaccccgttacaacaggctgctcctggggtggggcctcctttctcccaagcaccggcaccccagctcccccctggaccgcctggggctccaaagcctcccccagcctcccagcctagcttagtctctacagtggcccctggatcaggacttgcgcctactgctcaacccggagctccttccatggccggtacagttgcgcctgggggagtgtcaggtccttcacctgcccagttgggggctcccgcacttggaggacagcagtcagtgtcaaataaacttctggcatggtccggagtgctcgagtggcaggagaagcccaagccagcttctgtcgacgctaacacaaaattgactagatcccttccttgccaggtctacgtgaatcatggtgaaaacctgaagaccgaacagtggccccaaaaattgataatgcaacttattcctcagcaacttctcacaactctgggtccccttttccgcaacagccgcatggtccagttccatttcaccaacaaggatctggagagcctgaaaggactgtaccgcatcatgggcaatggattcgccggatgcgtccacttcccccacaccgccccatgtgaggtgagagtgttgatgttactttattcttctaagaaaaagatattcatgggactcatcccatatgaccaatctgggtttgtgaacgggatacggcaggtgatcacaaatcacaagcaggtgcaacagcagaaactggagcagcaacagagggggatggggggacagcaagctccaccagggctgggcccaatactggaggatcaagcccgaccttctcagaatcttttgcagctgcggcctccccagccacaacctcagggaactgtgggcgcatccggcgctacgggccaaccccagccccagggcactgcccaacccccacctggggcacctcaagggccacctggagcagcgtccggacctccaccacccggtcccattctgagaccccagaaccctggcgctaatcctcagctccgcagcctgctcttaaatcccccacctccccagactggggtgccaccgcctcaggccagcctccatcatctacagccacctggtgctccagccctccttcctccgcctcaccagggactggggcagccccagctgggccctcccctgttacatccccctcccgacggagccaggcggagtgacgcggctgagagaggatcccctggccctggaaggagtccccagtcccctcccctgcccctcggatttccagtgaggcagagagtcacggccttccacgtgtccattactagcgggaaaactaaagagcgccgtcgtggaccttgcgtctctcggaagatgggtgcaagtcttttcctgtgcggaagtgaggagcatgcgtacgtcttcaatatgcagacaaatcgggtgtgcgtggagcgtatccaacctgaaacacccctctag

SEQ ID NO: 229858 - DNA, 2175 bp, Artificial Sequence
  Description of Artificial Sequence: Synthetic coding sequence
atggtgcccggatccgaggggcctgcacgcgcagggtcggttgtggcggacgtggtcttcgtgatcgaaggcaccgcgaatctcgggccttactttgaggggctgagaaagcactatctactgccggctattgagtatttcaatggtggccctcccgctgaaaccgatttcgggggtgactatgggggaacacagtactccctcgttgtctttaatactgtggactgtgcgcctgaatcctatgtgcaatgccatgccccaacatcttcagcctatgagtttgtaacttggctggacggaatcaaattcatggggggaggtggagaaagctgctccctgatcgccgagggactgtccacggctctgcagctgttcgatgacttcaaaaaaatgcgtgagcagatcggtcaaacacatagagtgtgtctacttatttgtaacagtcctccatacttattgcctgcggtggagagtacaacttattctggctgcaccacagagaatttggtgcagcagatcggggagagaggtatccatttctctattgtcagtccaaggaaattacccgctcttaggttgctgtttgagaaagcagctccgcctgccctcttggagcccctgcaaccccctacagacgtgagccaagaccccagacacatggtcctagtacggggactcgttctgcccgtgggtggcggatctgcaccaggccctctgcaatcaaagcagcccgtccccctgccccctgccgctccatcaggagccactctgtcggcagcccctcaacagccactgcctcctgtgcctccccagtaccaggtccccggtaacctgagtgccgcacaggttgcagcccagaatgccgtcgaggcggcaaagaaccagaaggccggtctcggacctcgcttcagtcctattactccactgcagcaggccgctcccggtgtgggccctcccttttcccaggctccagcaccacagttgccacctgggcctcctggtgcccctaaaccacctccagcctcacagccaagtctcgtgtcaacggtggctcctggctcgggcctggctccaacagctcagcccggagcaccaagcatggcgggaaccgtggccccaggaggcgtctctggccctagccctgctcagctgggagccccagccctggggggtcagcagtccgtgagtaacaagttgttagcatggagcggggtcctcgagtggcaggagaagcctaaacccgcatccgttgatgccaataccaaattgacccgcagtctgccttgccaggtgtacgtgaatcacggagagaacctcaagacggaacagtggcctcagaagttaataatgcagcttatcccccagcagttgctgaccacattgggcccactgtttaggaacagccgcatggtccagttccattttactaacaaggacttagaatccctgaaaggactgtataggatcatgggaaacggtttcgctggatgtgtgcactttccacatactgccccatgtgaggtgagggttctgatgctgctgtacagctccaagaaaaaaatcttcatggggcttattccatacgaccagagcggatttgtgaacggcataagacaggtgataaccaaccataagcaggtacagcagcagaagctcgagcagcagcagcggggaatgggagggcagcaagctccacccggactcggcccaatcctggaagaccaggcccgaccaagccagaatctgctccagctcagaccaccacagccccagcccccacccggagccccacaagggcctccgggagccgcatcaggccctcctcctcccggtcccattcttaggccacagaacccaggagcgaatcctcagcttaggtccctgctactaaacccccctcctcctcaaactggtgtgccgcctcctcaggcttctctgcatcacctgcaaccgcctggagcacccgctctgctccctccaccacaccagggcctgggtcagcctcaactgggtccaccgctgcttcacccacctcccgcacagagctggccagcccagctgccgccacgcgctcctctgcccggtaaaggcactcggggaagagcagaagtatggactgagtgtccatcctcaagttgggccagagccccaagacctagtgcgcctggcaagtag

SEQ ID NO: 229859 - DNA, 753 bp, Artificial Sequence
  Description of Artificial Sequence: Synthetic coding sequence
atgttactgtactcctctaagaagaagatatttatggggctcatcccatacgaccagtccggctttgtcaatggcatccgtcaagtcatcacgaatcacaaacaggtccagcagcagaagctggaacagcagcagaggggtatgggcggtcagcaggctccgccaggattaggcccaatccttgaggaccaggccagaccctcccagaacctgctgcagctcagaccgcctcaaccacagccccaggggacagtgggagcctcaggcgctacgggccagccacagccgcagggaaccgcccagcccccacccggagcacctcaaggcccacctggggcagccagtgggcctccaccaccagggccaatctttggacctcgtacgctcggacctacactgagttgtgaggcctcgagctcaacacaccatagacggcgtctaggatgcccacacccgcgaccccctagcactacttcttcacatcagggcctcctgcgatgctgccttcgcagacagggacttggccaaccacaattgggcccacactcttgtatacaccaccttcccagcccaggaccgcacaacttccccctagggctgcactgccaggtacgtggccctgggggaggacagagaagtggcctgtcagttcctgccgcacccggactggaacaccaagatcgcgtgctgctcggatccaaagacataggttcaaagaacgaaggctcacctatggcttttgccgagctgtag

SEQ ID NO: 229860 - DNA, 1605 bp, Artificial Sequence
  Description of Artificial Sequence: Synthetic coding sequence
atggttccaggatccgaaggccctgccagggctggttccgtcgtggccgatgtcgtgttcgtgatcgaaggtactgccaatttaggtccatatttcgagggcctccgcaagcattacctgctcccagccatcgaatattttaacggcggacctcctgccgagacggactttggcggagacgtgcctggcaatctgtccgccgctcaagttgccgctcaaaacgccgtggaggcagctaagaatcagaaggctggcctgggaccccgattctcacctatcaccccacttcaacaggccgctcctggcgttggcccaccctttagccaggcaccagcgcctcagctgccgccaggaccgccaggagcaccaaaaccccctcctgcgtctcaaccatcccttgtctcaaccgtggcccctggttctgggctggctcctacagcacagcctggggctccttccatggccggaactgtggccccaggcggagtcagtggaccatcccctgcccaattaggtgccccagcccttggcggacagcaatctgtatccaataagcttctggcctggtctggggttctggaatggcaggagaagcccaagcctgcgagcgtggacgccaataccaagctgactcgtagcttaccttgccaggtgtacgttaaccatggcgagaaccttaagactgaacagtggcctcagaagctaattatgcaactaattccacagcagctgcttacaacccttggccctttgtttcgtaatagtcgtatggtgcagttccacttcactaataaagacctcgagtccctgaaagggctgtacaggatcatggggaacggatttgcaggctgtgtgcactttccacataccgcaccgtgtgaagtgagggtgttaatgcttctttattctagcaaaaaaaagatctttatgggattaattccttacgatcagtctgggttcgtgaacggaatccggcaagtgatcacaaatcataagcaggtgcaacagcaaaagctcgaacaacagcaaagaggcatggggggacaacaggcccctccaggcctgggaccaatcctcgaggaccaggctagaccctcccaaaatttgcttcaactacggccaccccagccccaacctcaaggaaccgttggcgcatcgggcgcaaccggccaaccacagccccagggaacagcccagcctcctccaggcgctcctcaagggcctcccggagctgcttcgggccctcctcctcctggtccaatcctcagaccacaaaaccctggggctaaccctcaacttcggagcctcctgctgaaccctccaccccctcagacaggcgtcccccctccccaggcgagcctccatcacctccaaccgccaggagctcccgctctgctgccacctccacaccaaggactgggccagccacagctggggcctcctctcctccatccaccacccgctcagtcatggccagcacaacttcccccacgggcacctctgcccggtcagatgctcctcagcggtggacctaggggaccggtccctcaaccagggctccagccctcggtgatggaggatgacatccttatggaccttatttag

SEQ ID NO: 229861 - DNA, 1194 bp, Artificial Sequence
  Description of Artificial Sequence: Synthetic coding sequence
atggtccctggaagcgagggaccagcccgtgcaggctcagtagtagcagatgtagtgtttgttatcgaaggcacagcaaatttaggtccttatttcgaagggctacgtaaacactatcttttgccagctattgagtactttaacgggggaccaccagccgaaactgatttcggcggagactacggagggacacagtactccctcgtggttttcaacaccgtggattgcgcacccgagagctatgtccagtgtcatgcgccaacatctagcgcgtatgagtttgtgacctggcttgacggcatcaagtttatgggaggaggcggagagagctgttctcttatagccgagggcctttccacggccctgcagctgttcgatgacttcaagaagatgagagagcagattggacagactcaccgcgtgtgcttgctgatatgcaattcccctccttacctgctcccagcggtggagtccaccacctactctggctgcacaacagaaaatctggtgcagcaaatcggcgagagggggatccacttcagcattgtgagccctcgtaagcttcccgctctgaggctgctgtttgagaaagcagcaccaccagcgctcctcgaacccctgcagcctccaacggatgtcagccaggatcctaggcacatggtgctggtaagaggactggtgttgcccgtgggcggtggaagtgcacctggcccactgcaatccaagcagcccgtccctttaccacccgcagccccaagcggggcaactctgtccgccgcaccacagcagcctctccccccagtcccgccacagtatcaggtacctggcaatttgtcggccgcacaagttgccgctcagaacgctgtcgaggctgcaaaaaaccagaaggccggactcggacccaggttcagtcccatcactcccctacagcaagctgcgccaggagtgggccctccgtttagtcaggctccggcacccgcacttcttcctccccctcatcagggtctcggccaaccacaattgggtccccctctgttgcacccgcctcctgctcagtcctggcccgcacaactcccgccacgggctcctctgccaggccagatgcttttaagtggaggcccaaggggcccagtcccccagcctggcctacagccaagcgtgatggaggatgacattctgatggacctcatttag

SEQ ID NO: 229862 - DNA, 780 bp, Artificial Sequence
  Description of Artificial Sequence: Synthetic coding sequence
atggtcccgggatctgagggcccagccagagctgggtccgtcgtggccgacgtcgtgttcgtgattgagggaacagcgaacctcgggccatatttcgagggattgaggaaacactaccttctcccagctatcgagtactttaatggagggccaccagccgagaccgatttcggtggcgactacggaggtacgcagtactccctcgtggtctttaatacagtggactgcgccccagagtcctatgtacaatgccatgcgcctacctccagtgcttatgagttcgttacctggttagacggaatcaagtttatggggggaggtggcgagagctgttccctgatcgctgaaggcttgtccacagccctgcaactgtttgacgactttaagaagatgagagagcaaataggccagactcacagagtgtgtctgctgatctgcaattccccaccgtatttattgccggctgtcgaaagtacgacgtactccggatgtaccacagagaatctggtccaacagatcggcgaacgcggaatccatttttctattgtgagtcctcggaagctgcccgctctgcgcctactatttgagaaggcagcaccaggactcgctggcgctgccgctgcatctgatcgctgcgaacccggacccgaagcgcacggagcagggtctggcactcgggctgcctgctgggggtggttatctccaagacctcctcccgttaaagccgcaagtcctcctgcttcacggaggaccctgcgctgccaggttcgttgttgttag

SEQ ID NO: 229863 - DNA, 1803 bp, Artificial Sequence
  Description of Artificial Sequence: Synthetic coding sequence
atgaccgccgctcctgcgtccccccaacagattagggaccgcctcctccaggccattgaccctcagtccaacatcaggaatatggtggccgtcctggaggtgattagtagtctggaaaagtaccccatcacgaaggaagctctggaggagaccaggctgggaaaactgataaatgacgtccggaagaaaacaaagaatgaagagttggctaaacgcgctaaaaaactgctaaggtcctggcagaagctgatcgagcccgcacatcaacacgaagcagccctgagggggttagccggtgcgactggaagtgccaatggtggcgcacacaattgtcggccagaggtcggagccgctgggcctccgaggtctatacacgatctgaagagtcgcaatgatctccagagactgccgggtcagaggctggaccgactggggtcgagaaagaggcgcggagaccagagggacctgggccatcctggtccaccacctaaagtgagcaaagcttcccacgacccactggttcccaacagcagcccccttcctactaatgggatctccgggtcccccgaatcctttgcctcctccctcgacggatcaggtcatgcgggacccgagggctcaagattagagcgggatgaaaacgacaagcactcaggtaagattcctgtgaatgcagtgcggccacacacctcaagtccaggacttggcaagcctcctggaccttgcttgcagcctaaagcctcagttttgcagcagctcgacagagtcgatgagaccccaggaccgccacaccccaaaggtccgcctcgctgcagcttcagtccgcgaaactccaggcatgagggaagctttgcccgacaacagtcattgtatgcgcctaaaggaagtgttcctagtcccagtcccagacctcaggctctggacgctacgcaggtacctagtccccttccgctcgcccagcctagcaccccccctgtgcgaagactcgaactgcttcctagtgcggagagcccggtatgctggctggagcaacctgaaagtcaccagcggttagcgggtcctggttgcaaagctggcctctcccccgcagaaccgcttctgtctcgcgctggattctccccagattcatccaaggccgactcggacgcggcttcctcaggtggctctgactcaaaaaaaaagaagcggtaccgacccagggactataccgtgaacctggacggtcaggttgctgaggccggagttaaacctgtgagattaaaggagagaaaactcacatttgacccaatgaccaggcaaatcaagcccctgactcagaaggaacccgtcagggccgacagccccgtgcacatggagcagcagagtagaactgagctcgataagcaggaggccaaagcatccttgcagtcccccttcgaacagaccaattggaaggagctttcccgcaatgaaatcattcagtcctacttatctaggcagtccagcctgctgtcctccagcggcgctcagacacccggagctcaccatttcatgtccgaatatcttaaacaggaagaatccacccggcagggggctcgccaacttcacgtcctcgtcccacagtcaccgccaaccgacctgcctggcctgactcgagaggtaacccaggacgacctggatagaatccaagcttcgcagtggcccggtgtcaatggttgtcaggatactcaggggaattggtatgactggactcaatgtatctcgttggaccctcatggcgatgacgggcgactgaatatcctaccctatgtgtgcctggactag

SEQ ID NO: 229864 - DNA, 282 bp, Artificial Sequence
  Description of Artificial Sequence: Synthetic coding sequence
atgaccgcagcacctgcatcccctcagcaaatccgggatagacttctgcaggcaatcgaccctcaatcaaacatcaggaacatggtggccgtgctagaagtcatctctagcctggagaaatacccgatcactaaggaggcactcgaggagactcgtctcggcaagctgatcaacgatgtgcgcaagaaaacgaagaacgaagagctggctaagagggccaaaaagctgctccccggttggcagtgggcatgccgtccgcgtggccagcccccaggcgcttag

SEQ ID NO: 229865 - DNA, 936 bp, Artificial Sequence
  Description of Artificial Sequence: Synthetic coding sequence
atggcagacgttatcaatgtctccgtgaaccttgaagctttcagccaggcaatctctgcaattcaggctcttcgttcttcggtgagtcgggtcttcgactgcctgaaggacggcatgcgcaataaagagaccctcgaagggagggagaaggcctttatcgcacacttccaggacaacctccattcggtgaaccgcgatctgaatgaactggagcggctgagcaacctggtgggcaaaccttctgagaaccatcctctgcataattcgggcctgttatcacttgatcccgtgcaagacaagacccctttgtactctcagttactgcaagcttacaaatggtccaacaagctgcagtaccatgctggattggcttcaggcctgctcaaccagcaatcgctaaaacgttctgccaaccaaatgggggtgtctgccaagcgacggcctaaagcacagccaacaactctggtgttaccccctcaatacgtcgatgatgtgattagcaggattgaccggatgtttccggagatgtctattcacctgagtaggcctaacggcacaagtgcaatgctgctggtgacactggggaaggtgcttaaggttattgtagtgatgaggtccctttttatcgacaggaccatcgtcaaggggtataatgagaacgtatatactgaggacggtaagctggacatctggtctaagtctaactatcaggtgtttcagaaggtgaccgaccatgccactacggccctgcttcattaccagctgccacagatgcctgacgtcgtagttagaagctttatgacatggctgagatcttatataaagctatttcaagctccttgccagcggtgtgggaagttccttcaggatggcctgcctcccacatggcgcgattttaggacactggaggccttccatgatacgtgtcggcagtag

SEQ ID NO: 229866 - DNA, 714 bp, Artificial Sequence
  Description of Artificial Sequence: Synthetic coding sequence
atgaggaacaaggagaccctcgagggtagggagaaggctttcatcgcacacttccaggacaacttgcacagtgttaatcgggacctcaatgagctcgagcggctgtccaatctggtcgggaagccctctgaaaaccatcccctccacaattcaggattgctatcactggacccagttcaagataagactcctctgtacagtcagcttctacaggcctacaagtggagtaacaaactccagtatcatgccggtctggccagcggtctactgaaccagcagagcttaaagcggtcagccaatcaaatgggagtatccgccaagagaagacccaaagcccagccgaccacactagtcctgccgcctcagtacgtcgacgatgtgatctcgcgcatagatcgcatgttccccgaaatgtctattcatttgagccgacccaacggaaccagcgcgatgcttctcctggacatctggagcaaatcaaattatcaggtatttcagaaggtcacggaccacgcaacaacggctctgctgcattatcagctcccacagatgcctgacgtcgtggtgagaagctttatgacatggcttaggtcttatattaagctgtttcaggcaccatgtcagagatgtggcaaatttctacaggatgggttgcctccaacctggagggattttaggacccttgaagcattccacgatacttgtagacagtag

SEQ ID NO: 229867 - DNA, 828 bp, Artificial Sequence
  Description of Artificial Sequence: Synthetic coding sequence
atggccgacgttatcaatgtctcagtcaatctagaggccttttcccaagctatctcggctattcaggccttacgtagcagcgtgagtcgtgtgtttgactgcctcaaagacggcatgcgcaataaggaaactctcgagggacgtgagaaagcatttatcgcgcacttccaggataaccttcactccgtcaatagagatctgaacgagctcgaacgcctcagcaatctcgtcggtaaaccaagtgagaaccaccctctgcacaactccggtttattaagcctagatccggtacaggataagacccctttgtattcacaattactgcaggcctacaagtggtccaacaaacttcagtaccacgctggactcgccagcggtctacttaaccagcagtctctcaaacggtccgcgaatcagatgggagttagtgccaagcgacggccaaaggcccagcccactactcttgttctgccaccacaatacgtggacgacgtgatcagccggattgatcggatgttccctgaaatgtccatccatctatcaaggccaaatgggacaagcgccatgcttcttctggatatctggtccaagagcaactaccaggtgtttcaaaaggtgaccgaccacgccactactgcccttctgcactaccagctgccacagatgcccgatgtggtggtcagaagcttcatgacatggctgaggagttacattaagcttttccaggcaccctgccagcgctgcggcaaattccttcaggacgggcttccacctacctggagagatttcagaactctggaggcattccatgacacatgtcggcagtag

SEQ ID NO: 229868 - DNA, 666 bp, Artificial Sequence
  Description of Artificial Sequence: Synthetic coding sequence
atgcttaagtcaaatggcgagagacgcagccggaacgccctgcctgctgtttacgcaagaaagatggcagcctcccaacagcaagctagtgcggcatcgtccgctgccggtgtcagcggaccttcttccgccggaggcccagggcctcaacaacagccgcagccccctgcccagctggtggggcctgcccaaagcggcttgctccagcaacagcaacaggatttcgatccggtgcaacgttacaaaatgctcattcctcaactgaaagaatctttgcagactctgatgaaagtggctgcccaaaacctgatccaaaatacgaatatagacaatggccagaagtccagtgacgggcctattcaaaggtttgacaagtgcctggaagagttctatgccctctgcgatcagctggagctgtgcttacggttggcacatgaatgcctgtcccagtcttgtgatagcgctaaacatagtcccaccttggtacctacagctacgaagcccgatgcagtacagcccgatagtctgccatatccacagtatctcgcagtgatcaaggctcagatttcatgtgccaaggacattcacaccgctttgctcgactgcgctaataaggttaccggcaagacgcctgcccctcctgctgggccaggcggtactctgtag

SEQ ID NO: 229869 - DNA, 420 bp, Artificial Sequence
  Description of Artificial Sequence: Synthetic coding sequence
atgttaattccacaactgaaggaatctctgcagacgcttatgaaggttgcggcacagaacctgattcagaacacaaacatagataatgggcaaaaatcttccgacgggccaattcaacgattcgacaagtgccttgaagagttttatgccctgtgtgaccagttggagctttgtttgcgtctggcccatgagtgcttatcacagtcctgcgattccgctaagcactcacccaccctggtgcctactgcaactaagcccgacgccgtgcagcccgacagtctgccttaccctcagtatttggccgttatcaaggctcaaatcagctgtgcaaaggatatccacacagcgctcttggattgcgctaataaggtgaccggaaagacccctgcgcctcctgctggccctgggggtaccctttag

SEQ ID NO: 229870 - DNA, 537 bp, Artificial Sequence
  Description of Artificial Sequence: Synthetic coding sequence
atgagcacaccgcctttggccgcatcggggatggctccaggccctttcgctggaccacaggcccagcaggcagcacgtgaggtgaataccgcgtcactgtgtaggatcggccaggagacagtgcaggacatagtgtacaggaccatggaaatatttcagctcctacggaatatgcagctgcccaatggggtgacctaccacacaggcacttatcaggatcggctcaccaaactccaagacaatttgcgtcaactcagcgttctttttaggaaactgcggctcgtgtacgacaagtgcaatgaaaactgcggcggtatggacccaattcccgtcgagcagttgataccctacgtcgaggaggatggaagcaaaaacgacgatcgagctgggcctccacggttcgcctctgaagaacgcagagagatcgctgaggtgaataaaaaactgaagcagaagaatcagcagctgaagcagataatggaccagctgcgaaacctgatctgggacattaacgccatgttagctatgagaaattag

SEQ ID NO: 229871 - DNA, 813 bp, Artificial Sequence
  Description of Artificial Sequence: Synthetic coding sequence
atggctgcctccagttccggcgagaaggaaaaagagaggttaggaggtggccttggggtcgccggaggaaattccacccgagaaaggctgctgtcagcgctcgaggacctggaggtgttgtctagagagttgatcgagatgctggcaattagtcgcaaccagaaactgctacaagccggagaggaaaaccaggtactagaactattgatacatcgtgacggggaattccaggaactgatgaagctggctttgaatcagggaaagattcatcacgagatgcaggttctggagaaggaagtcgagaaaagggatagcgatatccagcagctccagaagcagcttaaagaggccgaacagatcctggccaccgccgtctaccaagccaaagagaaactgaagtccatcgagaaggccagaaaaggtgctatctcgagcgaggagatcataaaatatgctcatagaatatcagctagtaatgccgtgtgtgctcccctcacgtgggtgcctggcgatcctcggagaccctatcccaccgacctggagatgagatctgggctgttaggacagatgaataacccgtcaactaacggtgtgaatggacacctgcctggggatgcgttggctgccggacggctacctgatgtcttggcgccacaatacccatggcaatctaatgacatgtcaatgaatatgctgcccccaaaccacagctcagactttttgctggaaccccctgggcataataaagagaacgaggacgatgtggagatcatgtctaccgactcttcatcatcctctagtgaaagtgactag

SEQ ID NO: 229872 - DNA, 675 bp, Artificial Sequence
  Description of Artificial Sequence: Synthetic coding sequence
atgctagctatttcccgcaatcagaaacttttgcaggcgggtgaagaaaatcaggtcctggagttgttaatccatagagacggggaattccaagagctaatgaagctagctttgaaccaggggaaaattcaccacgagatgcaggtgctggaaaaagaagtggagaagagggactctgatatccaacagctacaaaaacaactcaaagaggccgagcagatccttgccacagctgtctaccaagccaaagagaaactcaaatcaatcgaaaaagctcggaagggcgctattagttcagaggagattatcaaatacgcccatcgtatatcagcgagtaacgctgtgtgcgccccacttacctgggttcctggagatcctcgacgcccttaccccacggacttggagatgcgcagcgggctgctgggtcagatgaataatccctctactaatggagtgaacggccacttgcctggcgacgcattggcagccggtagactgcctgacgttctggcccctcaatacccttggcaatccaatgatatgtcaatgaacatgctgccccctaaccactccagcgactttctgctcgaacctccgggacacaacaaagagaacgaggatgatgtggaaatcatgtctacagattcttcaagctcatcctctgagagtgattag

SEQ ID NO: 229873 - DNA, 747 bp, Artificial Sequence
  Description of Artificial Sequence: Synthetic coding sequence
atgaagctcttatggtggtgtgattggctgcccgagagatcacacgtgttcacacaaagggaactgatcgaaatgctcgctatatctaggaaccaaaagctgctccaagctggggaggagaaccaggttcttgagcttctgattcacagagatggggagttccaagagttaatgaagctcgctctgaaccagggtaaaattcatcatgagatgcaagtcctggaaaaggaggtggagaagagagactccgacattcagcagctccagaagcagctgaaggaggctgaacagatactcgccacagccgtataccaggccaaggagaagctgaaatccatagagaaggcccgtaaaggtgcgatttctagtgaagagattattaaatatgcccaccgcattagcgccagtaatgcagtttgcgctccgctaacgtgggtccccggagaccctcggaggccgtatcccactgatttagagatgcgctctggcttactgggacagatgaacaatcctagtacaaatggtgtgaacggtcatttaccaggcgacgccctggctgccggacgcctgccggatgtcttggcgcctcagtatccatggcagagcaacgacatgtctatgaacatgttgccccctaatcacagctcagacttcctgctggaaccccctgggcataacaaggagaatgaggatgacgttgagatcatgagtaccgattcctccagttccagctctgagtctgactag

SEQ ID NO: 229874 - DNA, 717 bp, Artificial Sequence
  Description of Artificial Sequence: Synthetic coding sequence
atgaagctgttgtggtggtgcgattggctgccagaacgctctcatgtgttcactcagagggagctcatagagatgcttgcaatatcaagaaaccaaaagcttctacaggctggcgaagaaaatcaggtgctggagctattaatccacagagatggtgaattccaagagcttatgaaattagctctgaaccaaggtaaaatccaccatgagatgcaagtactggagaaggaagttgagaagagagattccgacatacagcagttgcagaaacagctgaaagaagccgaacagattctggctaccgccgtctatcaggcaaaggaaaaattaaaatcaattgagaaggcccgtaaaggtgcgatcagcagtgaggagataatcaaatacgcacatcgcatttccgccagcaacgccgtctgcgccccactgacatgggtacccggtgacccaaggaggccatatccaacagatcttgaaatgaggagtggcctacttggacagatgaataatccttccactaatggcgtgaacggccatttgccaggggacgcgttggcggctggcaggttgcccgatgtgttggcccctcagtatccttggcagtctaacgacatgtccatgaatatgctgccccctaaccacagctcagactttttgctggagccaccagggcataataaagagaatgaggacgatgtcgagatcatgtcaacttag

SEQ ID NO: 229875 - DNA, 702 bp, Artificial Sequence
  Description of Artificial Sequence: Synthetic coding sequence
atgggggaaccccagcaggtgtctgctttgcccccacctccaatgcagtatattaaggagtataccgatgaaaacattcaagaggggttggcacccaaaccccctccgcctatcaaagattcttatatgatgtttggaaatcagtttcagtgtgacgatttgatcattcgccctctggagtcgcagggaatagagcggctccatcctatgcagtttgatcacaagaaagaactccgaaaactcaatatgagcattctgatcaacttcctagatctcctggacattcttatccgatcacccggaagtattaaaagggaagaaaaattggaagatctaaagcttctttttgtccatgtgcatcacctgataaacgaataccgtccacaccaggccagggagacccttcgggtcatgatggaagttcagaaaagacagcgcctggaaacagccgagaggttccagaagcacctcgagagggtgattgagatgatccaaaattgtcttgccagcctgcctgacgacctgccccactccgaggccggaatgagggttaagacggagccaatggacgctgacgactctaacaattgcacaggccagaatgagcatcagagagaaaactccgggcatcgcagagatcagatcatcgagaaggatgccgctctgtgtgtcctgattgatgagatgaacgaaagaccctag

SEQ ID NO: 229876 - DNA, 702 bp, Artificial Sequence
  Description of Artificial Sequence: Synthetic coding sequence
atgggggagcctcagcaggtgagtgctctgccaccccctccaatgcagtatatcaaggagtacacagatgagaacatccaagaaggactggccccaaagcccccaccacctattaaggattcatacatgatgtttgggaaccagttccagtgcgatgacctcatcattcgccctctggagagccaggggattgagcgactgcacccaatgcaattcgatcacaaaaaggagctgcggaaattgaacatgagcatcctgatcaattttctcgaccttcttgatatactgattaggtcaccaggctctattaagcgggaagagaagcttgaggatctgaagcttctgttcgttcacgtccaccatctgattaatgagtaccgtccacaccaagcacgagaaactcttcgagtaatgatggaggttcagaagagacagcgtctcgagacagccgaacgtttccagaaacacttggaaagggtgatagaaatgattcaaaactgtctggcaagcctccccgatgatctgccacactctgaggcaggtatgcgcgtgaagaccgaacccatggatgccgacgattcaaacaattgcaccggacagaacgagcaccaaagagagaattctgggcaccgccgagaccagattattgaaaaggatgccgcactgtgcgtgttgattgacgagatgaatgagcgaccgtag

SEQ ID NO: 229877 - DNA, 588 bp, Artificial Sequence
  Description of Artificial Sequence: Synthetic coding sequence
atgggcgaacctcagcaggtcagcgcgttgcccccaccgcctatgcaatacatcaaagaatacacggatgagaacattcaggaaggcctggccccaaaacctcccccacccatcaaggatagctacatgatgttcggtaatcagtttcagtgcgatgatctgatcatccgcccacttgaaagccaaggaattgaacggctgcacccaatgcagttcgatcacaaaaaagaactgagaaagctgaatatgtccatccttatcaactttttggatctgctggacatccttatccgctctcccggatcaattaagcgggaggagaaacttgaggatttgaagcttctttttgtccacgtgcatcatctgattaatgagtatcgccctcatcaggcaagagaaacattgcgcgtcatgatggaggtgcagaagcgccagagactcgagactgcagaaaggttccaaaagcatttggagcgcgtcattgagatgatccaaaattgccttgccagtctcccagacgatcttcctcattccgaggctggcatgagagtgaaaacagaacccatggacgctgacgactcaaactag

SEQ ID NO: 229878 - DNA, 441 bp, Artificial Sequence
  Description of Artificial Sequence: Synthetic coding sequence
atggcgtcagccggagtagcagccggaagacaggcggaagacgtgctgccgcctaccagtgaccagccactacccgacacgaagcccctgcccccaccacaaccgccacctgtgccggcacctcaaccacagcagtcacccgcaccccgtccccagagccccgcacgagcccgagaggaggaaaattactccttcctacctttggtgcacaatattattaagtgcatggataaggactcaccagaggttcaccaggatctcaatgcactcaaatctaaatttcaggaaatgagaaagctcatctctacgatgccagggatccatctgtctcctgagcagcaacagcagcaattacaatccctgagggagcaagtgcgtacaaagaacgaactactgcagaagtataaaagcctttgcatgttcgaaatccctaaggagtag

SEQ ID NO: 229879 - DNA, 894 bp, Artificial Sequence
  Description of Artificial Sequence: Synthetic coding sequence
atgtctaaccgggtggtttgtagggaagccagccatgccggatcatggtacactgcctctggcccacagttaaatgctcaactggaagggtggctgtctcaggtacagtctacaaagcgaccagcacgcgctattattgcccctcatgccggatacacatattgcggcagctgtgcagctcacgcatacaagcaggtggacccgtcaattacacggaggatcttcatcctgggtccgtctcatcacgtgccgctgagccgctgcgccttgtcgtcggtggacatctacagaaccccactttatgacctgcggatcgaccaaaagatctatggggaactttggaagaccggcatgtttgaacgcatgtcccttcagaccgatgaagatgaacacagcattgaaatgcacctgccatacaccgctaaggctatggagtctcataaggatgaattcaccatcattcccgtcctggtgggagcactctccgagtcgaaagaacaggagtttggcaagctcttttctaagtatctcgccgacccaagtaatttgttcgtggtgtcctctgacttctgtcattgggggcagagatttcgctacagctactatgatgagagccagggagaaatttaccggtctatcgagcatctcgataagatggggatgagcatcatcgagcagctggacccggttagtttcagtaactacctgaaaaagtatcataacaccatttgcggacgccaccccatcggtgtgcttcttaacgccattactgaactccaaaagaacggtatgaacatgtcattcagttttctgaattatgcccagagctctcagtgtaggaactggcaggactcatctgtgtcttacgctgccggtgcgttgacagtccattag

SEQ ID NO: 229880 - DNA, 903 bp, Artificial Sequence
  Description of Artificial Sequence: Synthetic coding sequence
atgcctctttggcgagccgataaatgtcaggacgtacagtctgcttcctggaggcctagaagggctgacggaccacagctgaacgcacagttggaggggtggcttagccaggtccaaagcaccaagcgccctgctagggcaattatagctccacacgctgggtacacatattgcgggtcctgcgcagcccacgcctacaaacaggttgacccatccatcacccggcgaattttcattctaggcccaagccaccatgtgccattgagtagatgcgctctgtcttcagttgatatctacagaactcctttatacgacttacggatcgaccagaagatttacggagagctttggaaaactgggatgtttgagagaatgtcgttacagacggacgaagatgagcacagtatcgaaatgcacttgccgtacacagcgaaggccatggaatcacataaagatgaattcaccataatccccgtgcttgtgggcgcactcagtgagagtaaagaacaggagttcggaaaactcttttcgaagtacctcgccgatcctagcaacctcttcgtagtaagctcagatttctgccattggggccagagatttagatattcctactacgatgaaagtcagggtgagatctatcggtctatcgaacacctggataagatgggcatgtcaatcatagagcagttggaccctgtttctttctcaaactacctcaagaagtaccacaacactatctgcggccgtcatcccataggcgttctgctgaacgctattaccgaattgcagaagaacggtatgaatatgtctttttcctttctcaattatgcccagtccagccagtgtaggaattggcaggattcttccgtttcttacgctgctggggcactaaccgtacattag

SEQ ID NO: 229881 - DNA, 894 bp, Artificial Sequence
  Description of Artificial Sequence: Synthetic coding sequence
atgtccaatcgggtggtctgtcgcgaagctagccacgccggatcctggtatacagccagcggccctcagctgaatgcacagctagaaggctggctctcccaagtccagtcaactaaacgtccagctcgtgctatcatagctccccacgctggttatacttattgcggctcatgtgcagctcacgcctataagcaggtcgatccatcgattactcgtcggatctttattctgggtccctctcatcacgtgcccctctcccggtgcgccttgtcaagcgttgatatttaccgcacccccctgtatgacctgcgaatcgaccagaaaatttacggcgaactgtggaagaccggtatgtttgaacgcatgtcactccagacagatgaagatgaacactctatagaaatgcatctgccgtacacagcaaaagctatggagagccataaagatgagtttacaatcatccctgtgctggtgggagctcttagcgaatcaaaagaacaagaattcggcaaattattctccaaatacctggcagatcccagcaacttgttcgttgtgtcctctgacttctgtcattggggacagcggttcagatattcctattacgacgaatcccaaggggaaatctaccgcagcatcgagcatctcgataagatggggatgagcattattgagcagctcgacccagtctcgttctccaattacctgaagaagtatcacaacaccatctgcggccgtcatcctattggtgttctacttaacgcaataactgagcttcagaaaaacggaatgaatatgagcttttcgtttctaaattatgcacagagttctcaatgtcggaactggcaggatagttcagtgtcttatgccgctggggcactcacagtgcactag

SEQ ID NO: 229882 - DNA, 825 bp, Artificial Sequence
  Description of Artificial Sequence: Synthetic coding sequence
atgtccaacagggtggtctgcagagaggcttcacatgcgggatcctggtacactgcaagcggtccccaactgaatgcacagttggaaggatggctgagtcaagtccagagtactaaaagacccgctagggcaatcattgcacccaggcgaattttcatcctggggcctagtcatcatgtccccctgagcagatgtgctctgtcttctgtggacatttaccggacccccctctatgatcttcggatcgaccagaaaatctatggggagctttggaagactgggatgttcgagcggatgagtctgcagaccgacgaggatgagcacagtattgagatgcaccttccatacaccgctaaggctatggaaagtcacaaggatgagtttacaattattcccgtgctggtcggtgctctgtcagaaagtaaggagcaggagtttgggaaactgttctcaaaatacctagctgatcctagcaaccttttcgtcgtgagttccgatttctgccattggggccagcggttcaggtacagctattacgatgaaagccaaggagagatctatcggtccatcgaacaccttgataaaatgggcatgagtattattgaacagctggacccagtcagcttctcgaactatctgaagaagtaccacaacacaatatgcggacgccatcccatcggggttctgctcaatgcgattaccgagcttcagaaaaatggcatgaacatgtcattttccttcctgaattatgcacagagctcccaatgtagaaattggcaggatagctccgtctcttatgccgcaggcgcactaaccgtgcactag

SEQ ID NO: 229883 - DNA, 63 bp, Artificial Sequence
  Description of Artificial Sequence: Synthetic coding sequence
atgtcaaaccgcgtagtgtgtagagaagcgtcgcacgccggtagctggtatacggcttcgtag

SEQ ID NO: 229884 - DNA, 5477 bp, Artificial Sequence
  Description of Artificial Sequence: Synthetic coding sequence
atggaagacacccaggctattgattgggacgtggaagaagaggaagagacagagcagtcctctgagtccctgcgctgtaacgtcgagcccgttggcagactgcacatctttagtggggcacatggacctgaaaaagattttcccctgcacctaggcaagaacgttgtgggtaggatgccagactgtagcgtggcccttccattccctagcatcagcaagcaacacgctgagatcgaaatcctggcgtgggacaaagctcctatcctgcgggactgtggatctctcaacggaacgcagatattaaggccccctaaagtgctgtcccctggagtttcccatcgcctccgcgaccaggaattaatactgtttgccgacctgttgtgccagtatcataggctggatgtttccctccccttcgtcagccgaggaccgcttaccgtggaagagacaccacgagtacaaggagaaactcagcctcagcgcctcctcctggcagaggatagcgaggaggaggttgactttctatctgaacgaaggatggtgaaaaaaagccgaacaaccagtagttccgttatcgtccctgagagcgatgaggaaggtcacagccctgtcctgggcggtctcggaccaccctttgcctttaacctgaattcagataccgatgtggaagaaggacagcagcccgcaactgaggaggctagctccgctgcacgccgtggcgcaaccgtggaagccaagcagagcgaagcagaggtggtgactgaaattcaactggaaaaagaccagcccctggtcaaagagcgcgataacgacaccaaggtgaaaaggggtgctggtaacggcgtagtgccggctggggtcatcctcgagcgaagccagccacctggcgaagacagtgacaccgatgtagacgatgattctcgtcccccaggaaggcccgcagaagtgcacttggagcgcgctcagcctttcggattcattgatagcgacactgatgccgaagaggagagaattcccgctacaccagttgtgatccctatgaaaaagaggaagatatttcacggcgtcggtacaaggggaccaggggcacccggactggcccatctacaggagtcccaggcaggaagtgatacagacgtggaagaagggaaagcaccccaggccgtcccactcgaaaaatcccaggcatcaatggtcattaatagtgacaccgacgacgaagaagaagttagtgcagcgctcacactggcccacctgaaggaaagccagcctgcaatttggaatcgggatgccgaagaagatatgccccagcgcgtggtgctgctgcagaggtctcaaacgacaacggagcgcgatagcgataccgacgtggaggaggaagagttgcccgtcgagaacagagaggcggttctcaaagaccacactaagatccgggcactagtacgggcacactcagaaaaggaccagccccctttcggcgatagcgacgactctgttgaagccgacaaatcttctcctggaattcacctagagcggtcccaggcatctacgacagtcgacattaatactcaggtcgagaaagaagtgccacccggaagtgccattatccatattaaaaagcatcaggtttcagtggaaggtactaaccagactgacgtgaaggcggtgggcggtccagctaagctgctcgtggtcagtcttgaggaggcctggccacttcacggtgactgcgaaaccgatgccgaggagggcacatctctcacagcaagcgtggtggctgatgtgcgaaaatcccagctcccagctgagggagacgctggggctgagtgggcagcagccgtgttaaaacaggagcgagcccatgaggtgggggcacagggcggtccacccgtggcacaagtagaacaggacttgccgatcagccgggaaaatttgacggacctcgttgtggataccgacacactaggtgaatctactcagcctcagagagaaggtgcgcaagtcccaaccgggcgagagcgcgagcagcacgtaggcggtaccaaagatagcgaagacaattatggcgactctgaggacctggatctccaagccacacagtgttttttagaaaatcagggcctcgaggctgtacagtcaatggaggacgagcccacccaggcattcatgttaacgccgccacaggaattaggcccttctcattgtagttttcagacaaccggacttttgaactgcaaaatgccccctgccgaaaaggcaagccgcattcgggcagccgagaaagtcagcaggggggaccaggagagtcctgatgcctgcctacctcctaccgtgcccgaagcccctgccccaccccagaagcccttaaatagtcagagccagaagcacctggccccacctccccttctcagtcctctattgccatctattaagccaacagtgcggaaaacccgccaggatggaagccaggaggccccagaagcccctctgtcctctgaactggagcctttccaccctaagcccaagatcaggacgcgtaagtcttcaaggatgacaccattcccagctacgtctgccgctccagagcctcaccctagtacttcaacagcccagccagtgacaccgaagcccacttcccaggcaactcgatcccgtacaaaccgatcttctgtgaagaccccagagcctgttgttcccaccgcaccagaactgcaacctagtacatcaactgatcaacctgtgaccagcgaaccaacatctcaagtgaccagggggaggaaaagtcggagctcagtaaaaactcccgaaacagttgtgcctacagcacttgaactgcagccctctacctccaccgaccgcccagtcacgagcgagcccacatcacaggcaacacggggtagaaaaaatcgcagcagcgtaaagactcccgaacctgtcgttcctactgcccctgagcttcagcccagcacttccacggaccaacctgtcacaagcgaacctacctaccaagccacgcgtggaaggaaaaatcgctccagcgtgaaaacccccgagcctgttgtccccacagcccctgaactccgaccaagcacgagcaccgatcgcccagttacccccaagccgacctctcggactactcgatctcggaccaacatgagcagcgtcaagaccccggaaacagtcgtgcctactgcacctgagcttcaaatctctacatcgaccgaccagcccgtcaccccaaaaccgacctccagaacaacaagatccaggaccaacatgtccagtgtcaaaaaccccgagagtacagtgccgattgccccagagctgcctccaagtaccagcacagagcagccagtcacgccggaacctacgagccgagccactcgtgggagaaagaaccgaagtagtgggaagactccagaaactttagtacctacggcacccaagttagagccgtccacaagtacagaccagcctgtgacgccagagccgacctcgcaggccacccgtggcagaaccaaccggtccagtgtgaagaccccggaaaccgtcgtgcctaccgctcctgaattacagccgtcaacgagcacagatcagcctgttactcctgagcctacatcccaggcaactagggggagaaccgacagatcttctgttaagactcctgagacagtcgtgcccacagccccagaactccaggcatctgcttcgacagaccaaccggttacctcagaacccactagtcgaacaacacgcggtcgtaagaacagatcctcagtgaagacacccgaaaccgtcgtgccggcagcacctgaactccagccctctacctcaacagaccagccggtcactcctgaacctactagtcgagccactagagggaggacaaacaggagcagtgtgaagacccccgagagcatagtcccaatcgcccctgagctgcagccgagtactagtcgcaaccagctcgtgactccagaacccacttcccgagccactcgctgccggaccaaccgttcctccgtcaaaacaccagaacctgtggttcccaccgcacccgagccacaccctacaactagtacagaccagccagtcacacccaagctgacttctcgggctactcggagaaaaacgaataggagctccgttaagactccaaagcccgtggagccggctgcctccgacctcgagccattcactccaacagatcaatctgtcacacccgaggcgattgctcagggtggacagtctaagacactcagatccagcacagtgagagccatgcctgttcccacaacaccagagttccagtcccccgtaacaaccgaccagcctatttcacccgagccaatcacccaaccttcctgcattaagagacagcgggcagctggtaaccccggtagtctcgccgcacccatcgaccacaagccttgctcagcccctctcgaacctaaaagtcaggcaagccggaatcaaagatggggtgctgttagggctgccgagagcctgaccgctatccccgagccggcaagcccacagctgctggaaactcctattcacgcgtcacagattcagaaggtggaacccgcaggaaggtcacgatttactccagagttgcagcctaaagcgtcccagtcacgtaaacggtccttggcaactatggattctcctccccatcagaagcagccacagcggggagaggtgtctcagaagacagttattatcaaggaggaagaagaggatactgccgagaaacctgggaaagaagaagacgtcgtaacccccaagccaggaaagcggaagcgcgatcaggccgaagaagagccaaacagaataccctctagatccctgcgcagaacaaaacttaatcaggagtcaacagccccaaaggttctgtttactggggtggtggacgccagaggcgagagggctgtcttggcccttgggggttccctcgcgggtagcgcagccgaagccagccacctggtgacggaccgaatcagacgcaccgtgaagttcctttgtgcactcggacgaggaatccccatcctttccctggattggctgcatcagtcaaggaaagcaggctttttcttgccaccagatgagtacgtcgtgaccgacccagagcaggagaagaatttcggcttcagcctgcaggatgccctaagcagggctcgagaacggagactccttgaggggtatgagatatacgttacgcccggtgtccaaccccctccgcctcaaatgggtgagatcataagctgctgcggcggtacttatctgccctcaatgcctaggtcctacaaaccccagcgagtcgtgatcacctgtcctcaggacttcccacactgcagcatccccctgagagtgggccttcccctgttatcaccggagtttctactgaccggtgtccttaagcaggaagccaaacctgaggcattcgtgttgtcccctctggagatgagtagtaccta

SEQ ID NO: 229885 - DNA, 6269 bp, Artificial Sequence
  Description of Artificial Sequence: Synthetic coding sequence
atggaggacacacaggctatcgattgggacgttgaagaggaggaagaaactgagcaatcctcggaatctctcaggtgcaatgtagagccagtgggccgactgcatatcttcagtggggctcacggtcccgaaaaagatttcccgctgcatcttggtaaaaacgttgtcggcaggatgcccgactgcagtgttgccctgcccttcccctcaattagtaaacagcatgcagaaattgaaattctggcttgggataaagcacccattctccgtgattgcggctcccttaacgggactcaaattctgagacctcccaaggtgctcagccccggagtcagccatcggcttcgcgaccaagaattgattcttttcgccgatctcctgtgccagtaccacagacttgatgtttcactcccttttgtttctcggggtcccctgaccgttgaagaaacaccacgcgtgcaaggcgaaacccagcctcagcggctccttcttgccgaggatagtgaggaggaagtagatttcctgtccgaacggagaatggtgaagaaatctagaacaacgtcctctagtgtcatcgttcccgaatcagatgaggagggccacagccctgtgctggggggacttggtccaccattcgcttttaatctgaacagcgacacggacgttgaggaaggtcagcagcctgccaccgaggaggcatcatccgctgccagaagaggagccactgtggaagcgaagcaatcagaagctgaggtagtgaccgaaattcagctcgaaaaagaccagccactggtcaaagaaagagataacgacacaaaggttaagagaggggcagggaatggagtggtccccgcaggcgttattctagaaaggagccagccacctggggaggactctgatacagacgttgacgacgattcccgccctcccggtcgaccggctgaagtgcatctggagagagctcagccatttggctttatagacagcgacacagatgcagaggaagaacgcatacctgctaccccggtggtgatcccaatgaagaagcggaaaatctttcacggcgtgggaacacggggtcctggcgctcccggtctggctcacttgcaggaaagtcaggccggatccgacactgacgtggaggaagggaaagcccctcaggccgtaccactggaaaaaagccaggcctcaatggtgatcaacagtgacactgatgatgaagaggaggttagtgccgctctcacccttgcacacttgaaggaatcccagccggcaatttggaaccgtgatgctgaagaagatatgcctcagagagttgtgcttctacagcgaagtcagaccacaaccgagagagactctgacaccgatgttgaggaggaggagttgccggttgagaaccgggaggccgtccttaaggaccacaccaagatcagggcactggtaagagctcatagcgagaaagaccaacccccttttggagatagcgacgattccgtggaagctgataaatcctccccaggcattcacctggaacgctctcaggcctcaaccactgtagacattaacacccaggtcgagaaagaagtaccaccgggtagtgccattatccatatcaagaagcaccaagtgagcgttgaaggaaccaaccaaacggatgtcaaagcggtgggtggacccgctaagctccttgttgtgagcctggaggaggcctggcctctgcatggggactgcgagacggatgcagaagaggggacttcgctgactgcgtcagtcgtagctgacgtacggaaatcacagctgcctgctgagggcgacgctggagccgaatgggccgctgctgtgttgaaacaagaacgcgcacatgaagtcggagcccagggcggtccaccagtggcccaagtagaacaagacctgccaatctcccgggagaatttgaccgacctggtcgtggacactgacacgctaggggagagtactcagcctcaacgagagggcgcacaggtgcctactgggcgtgagcgggaacagcacgttggcggaactaaagactctgaggacaactacggcgactcggaggacctggacctgcaggctacacaatgtttcctcgaaaaccagggcctggaggcagttcaatctatggaggatgagccaactcaggcctttatgctgacaccaccgcaggagctcggaccctcccattgctcttttcagaccaccggtactctggatgagccttgggaagtcttagctacgcagcccttctgtctaagagaaagcgaggatagcgaaacccagccattcgatactcatttagaggcatacgggccttgtctgtcaccacctagggctataccaggagaccagcatccggagtctccagttcacactgaacctatgggcatccaaggcagagggcgacagaccgtagataaagtgatgggaatacccaaggagaccgcagagagagtgggtccggagcgcggacctctggagcgtgagacagagaagctcctgccagaaagacagactgacgtaaccggcgaagaagaattaacaaagggtaaacaggatagagagcagaagcagctcctggctcgagacacccagaggcaggagtccgataaaaacggcgagtccgcctcgcctgaaagagaccgcgagagtcttaaggtggaaatagagactagtgaagaaattcaggaaaagcaagtccaaaaacaaactctgccatccaaggccttcgaaagagaagtagagcgaccggttgcaaacagagaatgcgatcctgccgagctggaagagaaggttcccaaagttattttggagcgggacacgcaacggggagagcctgagggtggatctcaggaccagaagggtcaagcaagttctcccacccctgaaccaggtgtaggtgccggtgatcttcccggacccacaagcgccccagtgccctccgggtctcagtccggcggtcgtggatccccagtctcgccgaggcggcaccagaaagggctactgaactgtaaaatgcccccagctgaaaaagcgtcccggatcagggctgccgagaaggtaagccgaggcgatcaggagagcccagacgcctgtctcccccctactgttccagaggcaccggcaccaccacaaaagcctcttaacagtcaatcccagaagcacctggcccctcccccactcctgagccctctgttgcctagcatcaagcccactgtgcgaaagaccagacaggatggctcacaggaggcaccggaggcacccctgagcagcgagctcgagcctttccatccaaaacctaagatacgcactagaaagagttctcgtatgacgcctttcccagccacctcagccgctcccgaaccacacccttcaacaagcaccgcccagcccgtgacgccgaagcccacttcgcaagctacccggtcgcgcaccaacagatcctctgtgaagacccctgaaccggtggtgcccactgctcccgagctgcaaccaagtaccagtacagatcagccagtcacgagcgagcccacaagccaagtgactcggggacggaagagccgctcatccgttaagactcccgaaaccgtcgtccctaccgctcttgagctgcaaccttccacgagcacagaccgcccagtcacatccgagcctacatctcaagcaacgcgcggtcgcaaaaacagaagctcagtgaaaaccccagagccagtggtgcccaccgccccagaactgcagccctccacgtctaccgaccagcccgtcaccagtgagcccacctatcaggccacacgcggaagaaagaaccgctcctcagtcaagactcctgaacccgtggtgccaacggcgcctgaactccgcccatcgacgagcacggataggccagtcactcccaaacctacgagtcggaccacacggtcaaggaccaacatgtcatcagtcaagacgcctgaaactgtcgtgcctactgctcccgagctccagatttctacctccacagatcagcctgtcactcccaagccaacctctcgcacaacacgctctcgaacaaatatgagcagcgttaagaatccagagagcactgtaccaattgcgccagagctacctccatctacttcaacagagcaaccggtgacgccagagcccaccagccgcgctacccgcggacgtaaaaacagaagtagtgggaagaccccagaaacactggtgcctactgccccaaaactggagccctccacgtcaactgatcaacccgtaacccctgaaccaacaagccaggctacccgcggtcggactaatcggagttccgtcaagacccccgaaaccgtggtcccaacggcccctgaattgcagccatcaactagcaccgatcagcctgtgacccctgaacctacttcccaagccacacgtggaaggaccgatagaagctctgtgaagaccccggagactgtggtgcctaccgctcccgagttgcaggcgtctgccagcacagaccagcccgtaacttccgaacctacttctcgaaccacgagaggaaggaagaatcgcagtagcgtcaagacaccggaaaccgtggtcccagccgctcccgagctgcagccatccacaagtactgaccagcccgtgacccctgagcctacttctcgggctacgcggggacgcacaaataggagttccgtgaaaacccccgaaagcatcgtaccaatcgcacccgagcttcagccgagcacctcacgcaatcaactagtgacaccagagccaacatccagagccacacgatgtcgtactaatcggagcagtgtcaagacaccagaaccagtagtgccgactgctccagaacctcaccctaccacaagtaccgaccagccggtcacgcctaaactgacttctagggctacacgacgcaagactaacaggtcaagtgttaagacccccaaacctgtcgaaccagccgcatccgatctcgaacccttcaccccaacggatcagagtgtgacccccgaagccatagcacaggggggacagagcaagaccctgcgttcgagcaccgtgcgggcaatgccggtgccaaccactcctgagttccaatcccccgtgacaaccgaccaacccatttctcccgagcccatcacccagccatcctgtataaagcgccagagggccgcaggaaaccctggaagcttagcagctccaatcgatcacaagccatgctcagcccctctggagcctaaatcccaagctagcaggaaccagcgctggggggcagtccgggcagccgaatcattgaccgccattcccgaaccggcaagtcctcagctgcttgaaactcctattcatgcgtcacaaatccaaaaggtggagcccgctggccgttcacgctttactccggaactacaacctaaggcttctcagtctaggaagaggtcattggccacaatggacagccctccacaccagaagcaaccccaacgcggagaggttagccaaaagaccgttattataaaagaggaagaagaggatactgccgagaagccaggtaaggaagaggatgtcgtgactccaaaacctggaaaacgaaaacgagatcaggccgaagaagagccaaacaggatcccttcgagatctctcagacggaccaaattaaatcaggagagcaccgcaccaaaagtattattcaccggtgtagtggacgctaggggggagcgggcagtgcttgcccttggcggaagtctcgcaggatctgctgccgaagcctcacatctggtgactgatcgaatcagaagaaccgtgaaatttttgtgcgctttgggcaggggtatccctatcctttccctggactggctgcatcagtcaagaaaagcaggattctttctgcccccagatgaatacgtggtcaccgatcccgaacaggagaagaatttcggattttccctgcaggacgctttatcaagagcacgcgagcggaggctactggaaggatatgagatctatgttacaccgggagtgcagccaccccctccgcagatgggagaaataatttcctgctgtgggggtacgtatcttcccagcatgccacgctcttacaaacctcagcgcgtcgtaattacgtgtccacaagattttccccactgttcgattccactgagggtaggtctacctctcctgagtccggaatttctgttgactggagttctgaaacaggaggccaagccagaggctttcgtgctaagtcccttggagatgagttccacata

SEQ ID NO: 229886 - DNA, 489 bp, Artificial Sequence
  Description of Artificial Sequence: Synthetic coding sequence
atggaagacactcaggcaatcgactgggacgttgaggaagaagaggagaccgagcaaagtagcgaaagcctgcgctgtaacgtggaaccggtcggtcgactccacatcttttctggcgctcatggtcctgagaaggatttcccacttcacctgggaaagaacgtcgtgggtcgcatgccagattgtagtgtcgcgctaccattcccatctataagcaaacagcacgccgaaattgagatcttggcttgggataaggcacctattcttcgggactgtggaagcctgaatggcactcaaatactgaggcctcccaaggtgctttctccgggagtctcacatagattacgggaccaggaactcatcctattcgccgacctcctctgccaataccacaggctcgacgtgtcccttccgttcgtatctcggggtcccttgactgtggaggaaacccccagggtacagggggaaacacagcctcagcgcctatag

SEQ ID NO: 229887 - DNA, 342 bp, Artificial Sequence
  Description of Artificial Sequence: Synthetic coding sequence
atggaagacacccaggccatcgattgggacgtcgaagaggaagaagaaactgaacagagcagcgagtcattaagatgtaatgttgaacccgtgggtcggctgcatatctttagcggtgcccacggtcccgagaaggattttccactccaccttggaaaaaacgtcgtgggtagaatgcctgactgcagcgtggccttgcccttccctagcattagcaaacaacacgcagagatcgaaatccttgcctgggataaggctcccattctcagagactgcgggagcctgaacggcacccagattcttaggcccccaaaagtattgagccctggtgtcagccattag

SEQ ID NO: 229888 - DNA, 384 bp, Artificial Sequence
  Description of Artificial Sequence: Synthetic coding sequence
atggaggacacccaagccatcgattgggatgtggaagaggaggaagagacagaacagtcctcggaaagtctgcgttgcaacgtcgagccggtaggcagactccacattttctcaggggctcatggcccagaaaaagacttccctcttcacctaggcaagaatgtggtgggaaggatgccagattgcagcgtcgctctgccgttcccctctatttctaagcaacacgccgagatcgagattctggcctgggacaaggcccctatcctgagagattgcgggagcctgaacggaactcaaatactgagaccacccaaagtgcttagcccaggagtgtctcacagactgcgcgaccaggagcttatactgtttgccgacctgttatag

SEQ ID NO: 229889 - DNA, 489 bp, Artificial Sequence
  Description of Artificial Sequence: Synthetic coding sequence
atggaggacacacaagccatcgattgggatgtcgaggaagaggaagagaccgagcagagttcagagagtctccgatgcaacgtagaacctgtaggcaggctgcatatttttagcggcgcacatggaccagaaaaggatttccccctgcacctgggcaaaaacgttgtgggtaggatgccagattgtagcgtggcattgcctttcccgagcattagtaagcagcacgccgaaatcgagattcttgcttgggataaagcacccatcctgagggattgcgggtctttgaacggtacacagatcctcagacctcctaaggttctaagtccgggtgtgagccaccggttgcgggaccaagaactaatcctttttgctgatctgctatgtcagtatcacaggctggatgtgagtttaccctttgtctccagaggcccactgaccgtggaagagaccccccgtgtacagggggaaacgcagccacaacggctatag

SEQ ID NO: 229890 - DNA, 921 bp, Artificial Sequence
  Description of Artificial Sequence: Synthetic coding sequence
tgacacgtggggggaacaaaggatagcgaggataactacggcgacagcgaggaccttgatctgcaagccactcagtgttttctcgaaaatcagggtctggaggccgtccagtcaatggaagatgagccaacccaggcctttatgctgaccccccctcaggagctggggccaagccactgttccttccagaccacagggctgctaaactgcaaaatgccccctgcagagaaggcttccagaatcagagctgcagagaaagtttcacgcggagatcaggagtcccctgacgcctgcctaccccctactgttcccgaagctccagcaccacctcagaagcctcttaactcccagtcacagaagcatcttgctcctccccctttgctgagtccattactcccatcaatcaagcctactgtgagaaaaacccgccaggacggttcacaagaggcaccagaggcccctctttcgtcagaactggagcctttccaccccaaacccaagataagaaccaggaaatcttcccggatgaccccgttcccggctaccagtgcggctcccgagccacatccatctacctcgactgcccaaccagtgacccctaagcccaccagccaggctaccaggtctcgcaccaacagatcatcagtcaagaccccagagcccgttgtccctaccgctccggagcttcagcccagcacttccacggaccagcccgttacttctgagccaacctcccaggtgactcgtggacgcaagtcacgatcaagcgtgaaaactcctgagactgtggtccccaccgcgttagagctgcagccaagcacttccactgaccgtcccgtgacttcagaacctacctcacaggctactcggggaaggaagaaccggtcctcagtcaaaacgccagagccagtagtcccatag

SEQ ID NO: 229891 - DNA, 384 bp, Artificial Sequence
  Description of Artificial Sequence: Synthetic coding sequence
atggaggacacccaggccatcgactgggacgttgaagaggaggaggaaacagaacagtccagtgagtccttacggtgcaatgtggagcccgtgggtcggttgcacattttctcaggtgctcacgggcctgagaaggatttcccactacatctgggcaagaacgtggtgggcagaatgcctgattgctctgtggcacttcctttccctagtatttcaaaacagcacgccgagatagagattctggcctgggacaaagcgcctatcctgcgagactgcggttcactgaatggtacacagattttgcggcctcccaaagtgctgtcacccggtgtttcacacagactgcgggaccaagaattgatattgtttgccgacctgctatag

SEQ ID NO: 229892 - DNA, 921 bp, Artificial Sequence
  Description of Artificial Sequence: Synthetic coding sequence
tgacatgtaggtggaacaaaggattccgaggataactacggggattccgaggacctggacttgcaagctacacagtgctttcttgagaaccagggtctggaagctgtgcagagcatggaagacgagcccacacaggccttcatgctcacaccaccacaggagctgggccctagccattgtagcttccagacgaccggcttattgaactgtaaaatgcctccagccgagaaagcctccagaattagggctgctgaaaaagtctccagaggagaccaggagtccccagatgcctgccttccccctaccgtgcccgaagcccctgctcctcctcagaaaccactgaatagtcagtctcagaaacacctggccccaccaccactgctctcaccattattgcccagcatcaaacctaccgtccgtaaaactcggcaggatgggtcccaggaagcccctgaggccccactctccagcgaactggaacctttccaccctaagcccaaaatccggacccggaaatctagccgcatgactccattcccagccaccagtgcagcccctgaaccccacccctccactagcacggctcagcccgtcacaccaaagccgactagccaagcgacacggtctaggactaataggtcctctgtcaagaccccagagccagtggttccgaccgcgccagaactccaacccagcacaagcaccgatcagcccgtgacaagtgagcccacttcacaggtcactaggggcagaaaatcgagatcgtccgtgaaaacaccagagaccgtggtgcctactgcattggaactacaaccctctacatcaactgaccgacccgtgacctcggagccaacctcgcaggcgacacgcggtcgcaagaaccggtctagtgtgaagaccccagagccggtagttccgtag

SEQ ID NO: 229893 - DNA, 921 bp, Artificial Sequence
  Description of Artificial Sequence: Synthetic coding sequence
taacacgttggcggtaccaaagactccgaagacaactatggcgactcagaggacttggatcttcaggccacacaatgcttcttagagaatcaggggttggaggcagttcagtcaatggaagacgaacctacacaggcctttatgctcacaccccctcaggaactgggcccatcccactgtagctttcaaacaacagggttactaaattgtaagatgccaccagctgaaaaggcctcccgtatcagggccgcagagaaggtcagcaggggtgatcaggaatctcccgacgcttgccttccccctaccgtgcccgaagccccagcccctccccagaaaccactgaacagccagtcccagaagcacttggcccctcccccactgttgtccccattactgccctctatcaagcctactgtgaggaaaacccggcaggacgggtctcaggaggccccagaggcacccctgtcttctgaactcgaaccctttcaccccaaacccaaaataagaactcgaaaaagctcgaggatgaccccattccccgcaaccagcgcggctccagagccccatccctctaccagtactgcccagcccgtaacccccaagcccacatcccaggccactcgttcaagaacaaataggtctagtgtcaagacaccggagccagttgttcccacagcaccagagctccagccctcaaccagtacggatcagcctgtgacgtctgaaccaacatcacaagtgacgcgcggacgtaagtcaagatcatctgtaaagacacctgaaactgtcgtgcctacagccctcgagttacagcccagcacttccacggatcgccctgtaacttcagagcccacttcacaggcgacccggggaaggaagaacagaagcagcgtcaaaacgccagagcctgtcgtcccatag

SEQ ID NO: 229894 - DNA, 6269 bp, Artificial Sequence
  Description of Artificial Sequence: Synthetic coding sequence
atggaggacacacaagcaattgactgggatgtggaagaagaggaggagactgaacagagcagtgaaagcctcaggtgtaacgtagaacctgttggccgtttgcacattttctctggggctcatgggccagagaaggatttccctttgcacctgggaaaaaatgtagttggtagaatgcctgactgtagcgttgcgctgccattcccttcaatctcgaaacagcatgcagagattgaaatactggcttgggataaggccccaatcctccgagactgcggttctcttaatggcacccagatattgcgccctcctaaggttctcagtcccggtgtatctcacaggctgagggatcaggaactaatactgttcgccgatctcttgtgtcaataccatagattagacgtttcactccctttcgtgagcagggggcctctaactgtcgaagaaacacccagagtgcagggagaaactcagccgcaacggctcctgctggcagaagactctgaggaggaagtcgatttcctgtctgagagaaggatggttaagaaatctcggacaactagctcttctgtcatagtgcccgagagtgatgaagagggtcactcccctgttctaggaggattaggaccaccgtttgccttcaacctcaactcagacacagatgtggaagagggacagcagcccgcaacagaagaggcgagctctgctgcacgacgaggtgcaaccgtggaagcgaaacagtcggaagccgaggtcgtgactgaaatccagctcgagaaggatcagccattggttaaggaaagggacaatgataccaaggtgaagcgaggggctgggaacggagtggtcccggctggggttattctggagagaagccaaccccctggggaagactcagacaccgatgtcgacgacgactcccggcctccaggcaggcctgcggaagtacacttagaacgcgcacagccctttggctttattgacagtgataccgacgccgaggaggaacggatacctgccactccagtggtgatccccatgaaaaagaggaaaatttttcacggcgtgggaacccgtggaccgggtgctcccggactggcacacttacaggagtcccaggcgggatcagatacggacgtcgaagagggcaaggcacctcaggcagtacctctggaaaaaagtcaagcctctatggtgattaattcggatacagacgacgaggaagaggtgagcgccgcactgaccctcgctcacctcaaagaaagtcagcctgcaatttggaaccgcgacgccgaggaggacatgccccagcgcgtggttcttctgcagcgatctcagactaccacagagcgagatagtgatactgatgtcgaagaggaagagttgccagtcgaaaaccgcgaggcggtgctcaaggatcataccaagatccgtgctctggtaagagcccacagcgaaaaagaccaacccccattcggagatagtgatgactcagtggaagccgacaagtcatcacctggaatccacctggagcgcagccaggctagcacgacagtggatatcaatacccaggtggaaaaggaggtcccacctggtagcgccatcatacacatcaagaaacatcaggtttctgtggaaggaacaaatcagaccgacgttaaggcagtaggaggccctgccaagcttctggtcgtttccctggaggaggcctggcctctgcacggggactgcgaaaccgacgcagaggagggtacttctttgacagccagtgtggtcgcagacgttcgtaagtcccagttacccgctgagggcgatgcaggcgctgaatgggctgctgcagtacttaaacaggaacgggcacacgaagtcggggcacagggtgggccacctgtggctcaggtggaacaggatctgcctatcagccgtgagaatctgacggacttggtggttgacaccgacaccctgggcgagtctacccagcctcaacgtgaaggcgcacaggtacctacaggacgcgaacgtgaacagcacgtggggggtaccaaagattctgaagataactacggtgactcagaggacctggatctgcaagcaactcagtgttttctggagaatcagggtctggaagcagtgcagtcaatggaagacgaacctactcaagcttttatgctaacacctccccaggagctcggaccctctcactgctcgtttcagaccactggcactctcgacgagccttgggaagtactggcgacccagccattctgtctgcgcgaatccgaagactccgaaactcagccctttgacacccacttagaagcatacggcccttgtctgtcacctcctagggcaattcccggtgaccaacatccagaatcacccgtgcacaccgaaccgatggggatccagggacgtggcaggcagaccgtcgacaaggtgatggggattcccaaagaaacagccgaacgcgtgggaccggaacggggtcctttggagagagaaaccgagaagttgcttccggaaagacagacagacgtaaccggtgaggaagaactcactaaagggaaacaggaccgggagcagaagcagctactggctagagatactcagagacaggaaagtgataagaatggagagtcagcgtcacccgagcgtgatagggaatccctcaaggtggaaatcgagacaagtgaggagatacaggaaaagcaggtccagaaacagactctccctagcaaagcttttgagcgcgaggttgaaagaccagtggcaaatcgcgaatgtgatcccgctgaactggaagaaaaagtgcctaaggtcatccttgaaagggacacacaacgaggcgagcccgagggtgggtcacaggatcagaaagggcaggcaagctcccccaccccagaacccggagttggagcgggagatctcccgggaccaacctcagcaccggtgcctagcggttcgcaatctgggggaagaggcagccctgtgagcccaaggaggcaccagaaggggctactgaattgcaagatgccccctgccgagaaagcctctcggatccgagcggcagagaaggtttcccgcggagaccaggagagtcctgacgcatgcctgcccccaactgtccccgaggcacctgcacccccacagaaaccgttgaactctcaatcccagaagcatttggccccacctcctctcctgagcccattactaccgagcatcaagcccactgttcggaagacaaggcaagatggcagccaggaagcccctgaggccccattgtccagcgaacttgagcccttccatcccaaacctaagatccggacaaggaaatcatcaagaatgactccctttcctgccacatcggcagccccagagccccatccctccaccagcaccgcgcaacccgtcacccccaagcccacctctcaggcaacccggagtaggacaaacagaagcagcgtgaagacacccgagccggtagtccccaccgcccctgagctccaaccctccaccagcactgaccagcccgtcacctccgagcccacctcacaagttactagaggtcgcaagtcccgatcatctgtgaagacccccgaaacagtggtaccaaccgctcttgagctgcagcccagcacctctaccgacaggcctgttacttccgagcccacctcgcaggctactaggggcagaaagaatcgtagtagcgtgaaaactcccgaacccgtagtgccgactgcgccagaactgcagccaagtacttctaccgaccagcctgttacttccgagccaacctaccaggcgaccagaggtcggaagaacagaagcagcgtgaagacccccgagcctgtcgtgcctaccgcacctgagctgagacccagcacatccacagaccggccagtgactcccaagcccaccagcagaactacaagaagccgaactaacatgtcaagcgttaaaacccccgagaccgttgtgccaactgccccagagctacagattagtacctccaccgatcagcctgtcacaccaaagccgacatcgcgtactacacgttcgcgaactaacatgagcagcgtcaaaaacccagaatccacagtgccaatcgcccctgagctgcccccatccacaagtactgagcagcccgttactccggagccaacttctcgcgctacaagaggacgtaaaaaccgctctagcggcaagacacctgaaacacttgtccctacagctcctaaattagagcctagcacttcaacagatcagccagttacccctgaaccgacctcccaggccacacggggacgcaccaatcgctcttctgtcaagacgcccgagaccgtggtgcctaccgccccagagctacagcctagcaccagtactgaccaaccggtcaccccggagcctacatctcaggctactagaggtagaactgatcggagttcagtgaagacacctgagaccgttgtgccgactgcacccgaactacaagccagcgcgagtacagatcaacctgtgactagcgagcctacgagtcggactactcgaggacggaagaatagatcctccgtgaagacacctgaaacggtagtgccagctgctcctgagctccagcccagcacgtccacagatcaacccgtaacccccgaacctacatccagagcaacacgtgggaggacaaatcgttcctctgtgaaaaccccagagtctatagtaccaattgccccagagctgcaaccctctacaagtcgcaaccaattagtcacccctgaacctacctccagagcgacacgatgccgtacgaaccgtagcagcgtgaaaaccccagagcccgtcgttcccaccgcaccagagcctcaccctacaacaagcactgatcagcccgtcacgccaaaattaacgagcagggccacacggaggaaaaccaataggtctagcgtcaagacccctaaacctgtggagccagccgcttcagatcttgagcccttcacaccaaccgatcagtcagtaacgccagaggccatagctcagggaggtcagtcaaagacgctccggtcctctaccgtccgtgctatgcctgtgcccaccacccccgagtttcagagtccagtcactacagatcaacccatttcccccgagcctatcacccagccttcatgtattaaacgccagcgagcagctggtaacccgggatcgctggcagcccctatcgatcacaagccctgtagcgcccctctcgagcccaagtcacaggctagccgcaatcaacgttggggcgcagtccgggctgctgaatcgttaaccgccattcccgaacccgcttccccccagctgcttgagactcctatacacgccagccaaatccagaaagttgaacccgcaggtcgttctcgattcacacctgagctccagcctaaggcctcgcagtccaggaaacggtccctggctaccatggactcccccccacaccagaaacagcctcaacgtggtgaagtcagtcagaagactgtgataataaaagaagaggaagaggataccgccgaaaagcccggaaaagaggaagatgtggtgacgcccaagcccggaaaaaggaaacgggaccaagcggaggaagagcccaatcggatacctagtagaagcttacgtcgcactaaacttaatcaggaatctactgctcctaaggtgctgttcacaggagtcgttgatgctcgaggcgagcgcgcagttcttgcactgggtggaagccttgcagggtcggccgcagaggccagccatctggttacagatcgcatcagacgcaccgtgaagtttctgtgcgccctgggaagggggattcccatcctgagcctcgattggctgcatcaaagcaggaaagcgggattcttcctgccaccagatgagtatgttgttactgaccctgagcaggaaaaaaatttcggctttagcctgcaagatgcgctcagtagagcccgagagaggcgcctcctcgaaggatatgaaatctacgttacacctggcgtgcagccaccccctccccagatgggtgaaatcattagctgctgtggcggtacgtatcttccgtcgatgcccagaagctacaagccacagagagtcgtgataacttgcccacaggattttcctcactgttctatccccctaagagtgggcctaccattgttgagccccgagttcctactgaccggcgtgctgaagcaggaggccaagccggaggcatttgtgctgtcacctctcgaaatgtcctctacata

SEQ ID NO: 229895 - DNA, 6269 bp, Artificial Sequence
  Description of Artificial Sequence: Synthetic coding sequence
atggaagacacccaggccattgactgggacgttgaagaggaagaggagactgaacagtcctctgaatcccttcgctgcaacgtggagcctgtgggccgactacacatcttctcaggagcacatggacccgagaaagattttcctctccacttgggtaagaatgtcgtaggcaggatgcctgactgtagcgttgcactgccatttccaagcattagcaaacagcacgccgagatcgagatcctagcatgggataaagcccctattttgcgcgattgtggcagtctcaatgggacccagatcctccggcctcctaaggtcctctcaccaggcgtgtcccaccggctccgggaccaggagttaattctgttcgccgatctactgtgccagtaccaccgcctggatgtgtccctcccatttgtgagccgcggtccacttaccgttgaggaaaccccacgggtccagggggagacccagccccagcgactgctgctcgccgaggacagcgaggaggaggtcgacttcctaagcgagaggcggatggtgaagaagtctcgcaccaccagctcctcagtgatcgtccccgagtcggacgaagagggacattcaccagtgctgggcggtttaggacccccattcgcatttaacctgaattctgatacagacgtggaagaagggcagcagcccgctacggaggaagcttcttctgccgcaaggagaggtgctaccgtggaagccaagcaatcagaagctgaggtggtgaccgagatccaattagaaaaagatcagcccctcgtaaaggagcgggataatgacaccaaagtgaaacggggtgccggtaacggagtcgttcccgctggcgtgatcctggagcgcagtcagcctcctggggaggacagcgatacagacgtagatgatgattcccgcccacccggaaggccagccgaagtgcaccttgagcgtgcgcagccattcgggtttatagattccgataccgacgccgaggaagaacgaattcccgcaacacccgtggtgatccccatgaaaaaaagaaagatcttccatggtgtgggaacgagaggacccggagccccagggcttgcgcacctccaagagagtcaggcagggtctgacacagacgtggaagaagggaaggctccacaagcagttcccctagaaaaatctcaggccagcatggtcattaacagcgatacggacgatgaggaggaggtgtccgcagcccttaccctggctcacctaaaagagtcgcaaccggctatctggaatcgggacgcagaggaggacatgccccaacgtgtggtgctactccagcgttctcagacaaccacagaacgggactcagacaccgacgtagaagaggaggaattacctgtcgaaaatagggaggcggttctcaaagaccataccaagatccgtgcgctggtgcgagcccactctgagaaggatcagccaccctttggcgattctgacgactccgttgaagccgataaatccagccccggtatacacctggaacgtagtcaggcctcaaccacggtcgacattaacacccaggttgagaaagaggtcccgcctggatcagccattatccacattaagaagcatcaggtgtccgtcgagggtacgaaccaaacagacgtgaaagccgtaggcggtcctgccaagctgctcgtggtgtctctggaagaagcgtggccgctccacggggactgtgaaacagatgccgaggagggcacatcactgaccgctagcgtcgtggctgatgttcgtaagtcccagctgcccgcagaaggtgacgcaggggcagagtgggccgctgccgtcctgaagcaggagagggctcacgaggtcggagcacagggcggaccacctgttgctcaggtggagcaggacttacctatatccagagagaacctgacagaccttgtcgttgataccgacaccttgggcgagtccacgcagcctcagcgtgaaggagcgcaggtccccaccggcagagagagagaacaacatgtcggcggtacgaaagacagcgaggataattatggcgactcagaggatctggacctgcaggccactcagtgctttttagaaaaccagggtttagaagctgtacagagcatggaagacgagccaactcaagccttcatgctgacaccccctcaggaactgggtccatcgcactgttccttccaaacaaccggcaccctggatgagccctgggaggttttagccacccagcctttctgcttaagagagagtgaagatagcgagactcagccattcgacactcacctggaggcctatgggccatgcctgtcacccccaagagccataccgggtgatcagcaccccgagtcacctgtgcataccgagccgatgggcatacaagggagggggagacagacagtggacaaggttatgggcattcctaaggaaaccgccgagcgcgtagggccagaacgtggcccattagagagggaaacagaaaaattgcttccagaacgtcagacagatgtaaccggggaggaggaactaacaaagggtaagcaagacagggaacaaaaacaactcctcgctagagacacccagaggcaggaaagcgataagaatggggagtccgcctcaccagaacgggatcgagagagtctcaaagtggagatcgagacatccgaggagattcaggaaaaacaggtacagaagcaaacattgccttcaaaggcttttgaaagagaggttgaaaggccagtggctaacagagaatgcgatcccgctgagttggaggagaaggtccccaaggtgattctggaacgggatactcagcggggagagcctgagggcggatcacaggaccagaagggacaggcctcctcacctacccctgaacccggagtgggagcaggagatctgcctgggcctaccagcgctccagtgccgtcggggagccaatcagggggtcgcggtagtcccgtgtccccacggagacaccagaaggggttattaaactgtaagatgccacccgctgagaaagcgagccgcatccgtgccgcagagaaagtgtccagaggtgatcaagagtcaccggacgcttgtctccctccgacagttcccgaagcccctgccccacctcagaagcctctgaactctcagagccagaaacacctcgctcctccgcctctcctgagccctctgctgccgagcatcaaaccaaccgtccgaaaaacccggcaagatggttctcaggaagccccagaggcgccattgtctagtgaactcgagccattccatcctaagcccaaaattagaacccggaagtcttctagaatgaccccattccctgccacatccgccgctcctgagccccaccctagtacctcgaccgcccagccagtgactcccaagcctacgtctcaggctacacggtcgagaaccaacaggagctccgttaagacaccggagcctgtcgtgccaacagcacccgagctgcagccctcaacttccactgatcaacctgtgacgagtgagccaacctctcaagtgactcgtggcagaaaaagccgcagctccgtcaaaacccctgagaccgtcgtacctaccgcactggagctgcagccttctacatcgaccgataggcccgtaacctcagagcccacatcacaggccacacgcggacgcaagaaccgttcatctgtgaaaactcccgagcccgtggtgcccaccgctcctgaattacagccgtccacatccaccgaccagccagtgacaagtgagcctacttatcaggccaccagaggcagaaaaaaccggtcgtcggtgaagacacccgaaccagtggtcccaacagcacctgagctgcgaccttcaacaagcactgatcgcccagtgaccccaaaacccacatcacgcacgacaaggagccgtaccaatatgagtagcgtgaaaacacctgagacagtagtcccgactgcgccagaactgcagatttcaaccagtaccgaccagccagtgacacctaaacccacgtctcggactacaagatctcgcaccaacatgagcagtgttaaaaaccccgaatcgacggtgcccatcgctcctgaactgccaccatctacgagcacagaacagcctgtgacacctgaacccacatcacgcgcaacccgtggacgcaagaatcgatctagcggcaagacccccgagacactggtgcctacggctccaaaattggagccgtctacgtccaccgatcaacccgtgactccggagcccacatcccaggctacccggggaaggacgaatagaagtagtgtgaagactcctgagactgttgtccctaccgctcccgagcttcaaccttcgacatcgacggaccagcccgtgacacctgagccaacgtcccaagctacaagagggcgaactgatcgtagtagcgtaaaaactccagagactgttgttcccaccgctcccgagttacaggcgtccgccagcaccgaccaaccagtgacgtctgagcccacaagtcgcaccacccgcggacgcaaaaatagatcgagcgtgaaaacccccgaaaccgttgttcctgctgctcccgagctacagccctctacctctactgaccagcccgtaacgcctgaacctaccagtcgcgctaccagaggaagaacaaataggtccagcgttaagactccagagtccatcgtaccgatcgcacctgaactgcaaccctctaccagtagaaaccagttggtgactccggagccaacctccagagcaactaggtgcaggacaaatcgctctagcgtaaagactccggagccagttgtccctaccgccccagagccacacccaactacatccactgaccaacccgtaaccccgaagttgacctcccgagctacacgacgaaaaacgaaccgatccagtgtgaagactccaaaacccgtcgagccagctgcttcagatctcgaacctttcaccccaaccgatcaatcagtgaccccagaggccatcgctcaaggcggacagtccaaaaccctgaggtccagcactgtccgggcaatgcctgttcctactactccagaatttcagagtcccgtcactacagaccaaccaattagccctgaaccgatcacacaaccatcatgcattaaacgtcagcgtgctgcaggaaacccgggatcccttgcagcccctatcgaccacaagccatgctcagcacctctggagcccaaaagccaggcgtcccggaaccagcgctggggagccgtgagggccgcagaatccctaacagcgatcccggaaccagcttccccacagctattagagacacctatccacgcgtcccaaatccagaaggtggaacctgcaggcaggtctcggtttacgcccgaactgcagccaaaggcgtcgcaatccaggaaaagaagcctggccacaatggatagcccaccacaccaaaagcaaccacaacgtggggaggtctctcagaagacagtgatcattaaagaggaggaggaggacacagccgagaagcccggaaaggaggaggatgtggtaacgccaaagcccggtaagaggaagcgcgaccaggctgaagaagaaccaaacagaattccttcccgctctctacgacggacaaagctgaatcaggagtcaacggccccaaaagtactgttcactggcgttgtggatgccagaggcgaacgcgctgttctggctctggggggttcacttgccggatctgctgccgaggccagtcacttagtcacagacagaattaggagaaccgttaagtttctgtgtgcattgggccgtggtatcccaatactgtcacttgattggttacatcagtcacggaaagccggattcttcctgccgcctgacgagtatgtcgtgacggacccggagcaggaaaaaaactttggcttttctcttcaggacgccctttctcgcgctagagagagaaggttgctggagggctatgagatctatgtgacccctggagtgcagccgccacctccccagatgggagagatcatctcctgctgtggcggtacctacctccccagtatgccacgcagttacaagcctcagcgcgtggtaattacttgcccccaggactttccacactgcagcattccactccgagtcggcctgcccttactctcccccgagttcttactgaccggagtgctgaagcaggaggcaaaaccagaggccttcgtacttagtccactagaaatgagcagcaccta

SEQ ID NO: 229896 - DNA, 4968 bp, Artificial Sequence
  Description of Artificial Sequence: Synthetic coding sequence
atgtatcataggctggatgtgtctctccctttcgtgtctcgtgggccattaacagtggaggagacccctcgtgtgcaaggggaaacccagccacaaaggttgctgctggctgaggattcagaagaggaagtcgactttctgtcggaaaggagaatggtgaaaaagtcccgtactacgtcatcctctgtcattgtgcctgagtccgatgaggagggccacagccccgtcctgggaggactgggccctccattcgctttcaatctgaatagcgatacggacgttgaggaaggccagcagccagcaactgaggaggcatccagtgctgccagaaggggagcgacagttgaggctaagcagtcagaagcagaggtagtgactgagatccagctagagaaagaccaacccttggttaaggaaagggacaacgacaccaaggttaaacgcggtgcaggcaacggggtggtgccggcaggggtcatcctggagcgctcgcagccacccggtgaagactccgacactgatgtcgatgacgattcgagacctcctggcagacctgccgaagtccatcttgagagagctcagcctttcgggtttattgattcagacaccgacgcagaggaggagagaatccctgctacccctgtggtgatccctatgaaaaagcggaaaatctttcacggggtggggacgagaggccctggagcccctggcctagctcatctccaggagtcccaggcaggaagtgacaccgatgtggaggaagggaaagcacctcaggccgttcccctcgagaagtcgcaagccagcatggtgattaacagcgatactgatgacgaagaggaggtgagcgcagcactcactctcgcacatctcaaagagtcacagcccgcaatatggaaccgcgacgctgaagaggatatgccacagagggtggtgctgctgcagcgcagccagacaacaaccgagcgggattccgatacagacgtcgaagaagaagaactgcccgtcgagaatcgggaggcagtgctaaaagatcatactaagatccgggctctcgtgcgcgctcactccgagaaggatcaacccccattcggcgactctgacgacagcgtggaagccgacaaatccagcccagggatacatctcgaaagatcccaggccagcaccactgtggacatcaacactcaggtcgaaaaagaggtgccgcctggctctgctatcatccacatcaaaaagcatcaggtctcagtggagggaacaaaccagacagatgtgaaagccgttggcggtcccgcaaagctcctggtcgtgtctctggaggaagcttggcctttgcacggcgattgtgaaactgacgctgaggaagggacctccctaactgcctccgtggttgcggacgtcagaaagtctcaattacccgctgaaggtgatgccggagccgaatgggccgcagcagtgctgaaacaggaacgcgctcacgaagtgggggctcaggggggtcccccagtcgcccaggtggaacaggacctgccgatatcgagggaaaaccttactgacctagtcgtagacaccgatactctaggcgaatctacccagccacagcgggagggggctcaggttcctactggacgggagagggagcaacatgtgggaggtacaaaggattccgaagacaactacggagattctgaggacctagacctgcaggctacccagtgctttcttgagaatcaaggactggaggtccagagtatggaggatgaacctacccaggccttcatgctgacaccccctcaagagctaggcccatcccattgttcctttcagactaccggcctcctgaattgcaagatgccaccagccgaaaaagcctctaggatacgcgctgcagagaaagtttcaaggggcgaccaagaatcacctgatgcatgtttgccccctaccgtaccggaggctccagccccaccccaaaagcctttgaactcacagagtcagaagcatttagcacccccaccactgctttcaccactcctaccatctatcaaacccacagtgcgtaaaaccagacaggacggctctcaggaagctccggaggcacccttgagtagtgaactggaacccttccatcccaagccaaagatccgaaccagaaagtcatcccgcatgacaccgttccccgctacaagcgccgcacccgagcctcacccatctaccagcactgctcagcctgtgacgcctaagccaacctctcaggcgactagatccagaaccaatagatctagcgtaaaaactccagaacccgtggttcctactgcccctgagctccagccttccacttcgaccgaccagccagtgactagcgagccaacttcacaggtcactagaggtcgcaaaagccgatccagtgtcaaaactcccgaaacagtcgtccccactgcactggaattacaacccagtaccagcaccgataggccagtcacttcagaaccaacctctcaggcaacgagggggcgaaaaaataggagctccgtgaaaacaccggaacccgtcgtgcccaccgctccggagctacaaccatcgaccagtacagaccagcccgtgacaagcgagcccacataccaggccactcgaggccgaaagaacaggtcttcggtgaagacccccgagcctgttgtccctactgcacctgagcttcgcccatccacctcgacggacaggccagtgaccccaaaaccaacatcccgtaccactagatcgcggacaaatatgtcgagtgtgaagaacccggaatcaactgtccccatcgctcctgaactccccccttctaccagcactgagcagcccgtgacacccgaaccgacttctagggccacccgcggtagaaagaaccgatcctcggggaaaactccagaaactcttgtgccaacagcgccaaagctggagccatcgacgtcgacagatcaacccgttacgccagaacctacatctcaagcaacccgcggacggaccaacaggagctctgtaaagacccccgaaaccgtagtgccaaccgccccagagctgcagcccagcacttctactgatcagcctgttacaccagagcctacctcacaggctactagagggaggacagacaggtcgagcgtgaaaactccagagacagtggtgcctacagcacctgagctgcaggctagcgccagcaccgatcaaccagtcacaagtgagccaaccagcaggaccacccggggtaggaagaaccgctcctccgtgaaaacccccgaaaccgtagtgcccgcagctccagaattacagccttctacatctaccgaccagcccgttacaccagagcctacttctagggcaacccgcggtcgcactaacagaagttcagtgaagactcctgagagtatagttccgatagcccctgagctgcagccatcgacctctagaaaccagttggtaacgcccgaacccaccagtagggctacacgctgccggacaaacagatctagtgtcaagactcctgaaccggtggttcctaccgcacctgaaccccaccccaccacatcaacagatcagccagtaacacctaagctcacctcacgcgctactcgacggaaaaccaatagaagcagcgtgaagaccccgaaacccgtcgagcccgcagcttccgacctggagccctttactcccacagatcagtctgtgactcctgaagcaatcgctcagggtggtcagagtaagaccctgcggagttcaacagtgcgggcaatgcccgtgcctacaactccagagttccagagtcctgtgactacagatcagcctatatccccagaacccatcacacaaccgtcatgtattaagagacagcgtgcagcgggaaacccaggcagcctggcagcacctatagaccataagccatgctccgcccctctggagcctaagagccaggcttcacgaaatcaacggtggggcgctgttcgcgctgccgagtcccttaccgctatcccggagcccgcttctccacaattgctagagaccccaatccacgctagtcagatccaaaaagttgagcctgcagggcgtagccgcttcacgcctgagcttcagcctaaagcttcccagtcgcgcaagagatcactggccacaatggatagcccacctcatcagaagcaacctcagagaggggaagtttcacagaagaccgtgatcatcaaagaggaagaggaagacacagcagagaagcctgggaaggaagaagacgtggttacccccaagcctggcaagaggaagcgggaccaggccgaagaggagcctaaccggatcccaagtcgaagtctgagaagaacaaaactgaaccaggagtcaaccgcccctaaagtgctcttcacaggcgttgtcgatgcccgtggggagagagcggtgctggcacttggcggttcgctggctggctcagctgctgaagcatctcacctcgtgacggacaggattaggcgcacggtgaagtttctctgcgccctgggtagagggatccccatcctcagcctggactggttgcaccaatctcgaaaagccggatttttcctgccccctgacgaatacgtggtcacagaccctgaacaggagaaaaactttggattcagcttgcaggacgccttgagtcgcgctcgggagaggaggctgcttgagggttatgagatctatgttacccccggtgtgcagccccctccgcctcagatgggtgaaatcatttcatgctgtggtgggacttatttgccttctatgcccagaagttacaagccccaacgagttgtcatcacctgtcctcaggacttcccacactgcagtattcccctcagagtgggcctgccactcctgagccccgaattcctattgacaggagttctgaagcaggaagccaaaccagaagctttcgtattgtctccacttgagatgtcaagcacgtag

SEQ ID NO: 229897 - DNA, 489 bp, Artificial Sequence
  Description of Artificial Sequence: Synthetic coding sequence
atggaggatactcaggcgattgattgggatgtagaagaagaggaagaaacggagcagtcatctgagtccctccggtgtaacgtggaaccagtgggcaggctgcacatattttctggagcgcatggacctgagaaggactttcccctgcatctcggaaaaaatgtggtgggcaggatgcccgactgcagcgtggccctgcctttcccttcaatctccaagcagcatgcagagatcgaaattctcgcttgggataaagcgcctatcctaagggactgtggcagcctgaacggtacccaaattctgcgtccgcctaaggtgctaagccctggggtctctcatcgtctgagagatcaagagttaatactttttgctgatcttctgtgccagtaccacaggctggacgtgtctctaccgttcgtctccaggggcccactaacagtagaggagactccacgcgtgcaaggggagactcaaccccagcgcctgtag

SEQ ID NO: 229898 - DNA, 342 bp, Artificial Sequence
  Description of Artificial Sequence: Synthetic coding sequence
atggaggatacccaggccattgattgggacgtcgaggaggaggaggagaccgagcaatcatcagagtccctgcggtgcaatgtggaaccagtgggaaggctacacatcttctccggagcacacggaccagaaaaggacttccctctgcacttgggaaaaaacgtggtgggcagaatgcctgattgttccgtggccctgccgtttccgtctatcagcaaacagcacgcggaaatagaaattttggcctgggacaaggcccctatcctgagggactgtggatcccttaatgggactcaaatcttacgcccaccgaaggtgctgtccccaggagtttctcactag

SEQ ID NO: 229899 - DNA, 342 bp, Artificial Sequence
  Description of Artificial Sequence: Synthetic coding sequence
atggaggatacacaagcaatcgactgggatgtagaggaagaggaggagactgagcagtccagcgaatcacttcgatgcaacgtggagcccgtgggccgattgcatatcttctcgggggcacacgggccagagaaggatttcccattacatctgggaaagaatgtagtgggcagaatgcctgattgttctgttgccctaccattcccaagtattagcaagcaacacgccgagatcgagattctggcctgggataaagcccctattttgcgtgactgcgggtcccttaatggaacccaaatcttaagaccgcctaaggtactatcgcctggcgtaagccattag

SEQ ID NO: 229900 - DNA, 384 bp, Artificial Sequence
  Description of Artificial Sequence: Synthetic coding sequence
atggaggatacccaggctatcgattgggatgtggaagaggaagaagaaacagagcagtctagcgagagtttgcgctgcaacgttgagccagtgggcaggctgcacatatttagtggcgctcacgggccagagaaggacttccctttgcatcttggcaaaaacgtggtgggcaggatgcccgattgttctgtggctctccctttcccatctataagcaagcagcatgcggagattgagatcctggcatgggacaaggctcccatccttcgcgattgcggttctctgaacggaacccaaattctgaggccccctaaagtgctctcccccggtgttagccatcgactcagggatcaggagctgatccttttcgcagacctgctctag

SEQ ID NO: 229901 - DNA, 489 bp, Artificial Sequence
  Description of Artificial Sequence: Synthetic coding sequence
atggaggatacgcaagccatagattgggatgtggaggaggaggaagaaactgaacagtcatccgaatctctccgctgtaacgtggagccggtcggcaggctacacattttttccggggctcacggtcctgagaaagactttccacttcatttggggaaaaatgtggtcgggcgtatgcctgattgctccgttgccctgccgtttccatccatctcaaaacagcatgccgaaatcgagattctggcctgggacaaggctcccattttgagagattgcggctccctcaatggcacccaaatactcaggccaccaaaagtcctcagtcctggggtatctcataggctccgcgatcaggaacttatactgttcgcggacctcctctgccagtatcaccgactggacgttagtttaccctttgtctcgcgaggtccactcacagtggaggaaacacccagggtgcaaggagaaacccaaccacagcgcctttag

SEQ ID NO: 229902 - DNA, 342 bp, Artificial Sequence
  Description of Artificial Sequence: Synthetic coding sequence
atggaggatacccaggcaatcgactgggatgtcgaggaggaggaggagacagaacagtcatccgaatccttgagatgtaacgtggagcctgttggcagattgcacatcttttccggggcacacggcccagagaaggactttcccctgcatctgggaaagaacgtcgttggtcgaatgccggactgcagcgtcgctttgccatttccttccatatcaaaacagcatgctgagatcgagattttggcctgggataaggccccaatccttcgcgactgcggatctctcaacgggacacaaatcctcaggcctcccaaggtgctcagccccggtgttagccactag

SEQ ID NO: 229903 - DNA, 489 bp, Artificial Sequence
  Description of Artificial Sequence: Synthetic coding sequence
atggaagacacgcaggccattgattgggacgtggaggaggaagaggaaacagagcagagctcagaatctctccgctgtaatgtggagcccgtcggaagactgcacatctttagtggcgcacacgggccagaaaaagacttcccgctccaccttggaaagaacgtggtcggaaggatgcctgattgcagtgtggcgctgcccttcccctcaatcagcaagcaacatgccgagatcgagattcttgcctgggataaagcccctatcctacgtgactgcggtagcctgaatgggacgcaaatcctgcgacctcctaaagtactgagcccgggagtttctcacagactacgagatcaggagctgattctgttcgcggatctgctttgtcagtaccaccgtctcgacgtgagcttgccattcgtgtccagaggaccactcacagtggaggagaccccacgcgtacagggagaaacacaaccacaacgactctag

SEQ ID NO: 229904 - DNA, 384 bp, Artificial Sequence
  Description of Artificial Sequence: Synthetic coding sequence
atggaggatacccaggccattgactgggacgtggaggaagaggaggaaaccgagcagagtagcgaatcactgcggtgcaacgtagagcccgtgggaaggctccatattttttctggcgcacatggccctgagaaagattttcctctacatctgggcaaaaatgtggttggacgcatgccagactgttctgtcgcgcttccattcccctccatcagtaaacagcatgccgaaatagagatcctggcttgggacaaggcaccgatcctccgtgattgcggaagcttgaatggaacccagatcttgcgaccacctaaagtactttcccctggagtttcacacagactgcgagaccaagagttgattctgttcgccgacctcctttag

SEQ ID NO: 229905 - DNA, 921 bp, Artificial Sequence
  Description of Artificial Sequence: Synthetic coding sequence
tagcatgtcggaggaacgaaggacagtgaggacaattacggtgatagcgaggatctcgatcttcaagcgacccagtgtttccttgagaaccagggcctggaggcagttcagtctatggaagacgaaccgactcaagctttcatgttaaccccaccccaggaattaggaccaagccattgttcgttccagactacaggacttctgaactgcaaaatgccccctgccgaaaaagcaagtcgtattcgcgcagccgaaaaggtaagccgtggggatcaagagtcacccgacgcctgcctgcctccaaccgtacctgaagcccctgcacctccccagaagccacttaacagtcagtcacagaagcatctcgcaccccctcctctgttgagtcctctgctgcctagcattaagcctaccgtacggaaaacaaggcaggacggctcacaagaggcacctgaggcgccattaagctccgaactggagccattccacccaaagccaaagatcaggacacggaagtcaagccgcatgacccccttcccggctacaagcgcagctccagaaccacacccctccacatccactgctcagccagtaactcctaagcccacatcacaggcaacccggtcccgcaccaaccgctcaagcgttaaaactcctgagcctgtggttcctacagcccctgaacttcagcctagcacaagtaccgaccaacccgtgacctctgagccaacaagccaagtcacccgcggtcgcaagtcgcgaagttccgtaaagacacccgagaccgttgtgcccaccgctctcgaactccagccgtccaccagcaccgatagacccgttacaagtgagcctacttcccaggctacccgcggtcggaagaaccgcagctcagtgaaaacgcctgagcccgttgtgccttag

SEQ ID NO: 229906 - DNA, 6269 bp, Artificial Sequence
  Description of Artificial Sequence: Synthetic coding sequence
atggaagacactcaggccatagattgggacgttgaggaggaggaagaaactgaacagagctcagagtccttacggtgtaatgtagaacctgttgggaggctgcacattttctcaggtgcccacgggcctgaaaaagatttcccactccacttaggcaagaacgtcgtcgggcgaatgcctgactgcagcgtggcactccccttccccagtatctcaaagcagcatgccgagattgagattttggcttgggataaggcccctatactgagggactgtggttcattgaacgggacccagatactcagacctcccaaagtcctctcacctggcgtgagccatcggctgcgagaccaggaactgattctattcgccgatctgctgtgtcaataccacagactggacgttagccttcctttcgtgagcagaggacctctgaccgtagaagagacgccaagagttcagggcgaaacacaacctcaacggcttttactggctgaagactccgaagaagaagtggacttcttaagcgagagacgtatggttaagaaatctcgtaccaccagcagcagtgtcatcgttcctgagtctgatgaggaaggccattcaccagtactgggcggactaggaccaccctttgctttcaacctgaactccgataccgatgtcgaggagggccagcagccggcaaccgaggaagcgagttctgcagctcgcaggggtgcaaccgtagaggcgaaacaatctgaggctgaggtagttacagagattcaacttgagaaggaccagccgctggtcaaagaacgggacaacgatacaaaggtcaagagaggcgctggcaacggggtagtgcctgccggagtcattctggagagaagccaacctcctggagaagatagtgacactgacgttgatgatgattccagacctcccggaaggccggcagaggtgcacttagaacgcgctcagccattcggattcattgatagcgacacagacgcggaggaagagcgtatccccgctacgcctgtagtgatccccatgaagaaacgtaaaattttccacggcgtggggacgcgcggaccaggagccccagggttggctcatctgcaggagagccaggccggttccgataccgacgtcgaggaggggaaggctccccaagccgtgccgctggaaaagtctcaggcttccatggtgattaactctgataccgatgatgaggaggaggtttccgcggctttaacgctcgcgcatctgaaggagagccaaccggctatctggaatagagacgcagaagaagacatgccccagagagttgttttgctccaacggtcacagactaccactgagcgtgattcggacacagacgtcgaagaggaggaattacctgttgagaacagggaagctgttctgaaagaccacacaaagatccgcgcactcgtgagagcacactccgagaaggatcagcccccattcggcgactccgacgactcagtggaagcagataaaagttctccgggtatccacctggagagatcacaggcttcgacaaccgttgatataaatactcaggtggaaaaagaggtgcctcctggcagcgctattatccacataaaaaagcatcaggtgtccgttgaggggaccaaccagaccgacgtcaaagctgtgggcggacctgcaaaactactggtcgtcagtcttgaggaggcctggcccctgcatggagactgtgaaaccgacgctgaggaaggaaccagtctcaccgcttcagtggtggccgacgtgagaaagtctcaactccctgccgagggtgacgcaggcgctgagtgggcagcagcagttcttaaacaagagagggctcatgaagtcggcgctcagggagggcctcctgtggcacaggttgagcaggacctgcccattagtagggaaaatctgactgaccttgtggtggataccgatactcttggagaatctacacagcctcagcgggaaggcgcacaagtgcctacagggcgagaaagagagcaacacgtgggcggaaccaaggacagtgaggataattacggggatagcgaggatctggatctgcaagccacccaatgttttcttgagaaccagggactagaggcagtgcagagcatggaagatgagcccacacaggcttttatgttgactcctcctcaggagctggggccatctcactgctcctttcaaactaccggtacactcgacgagccttgggaggttctggcaacacagccattttgcctgcgggagtcagaggattccgagacacagccttttgacacccacctggaggcctatggcccatgcctgtcccccccacgtgcgattcctggggaccagcatccagagtctcccgtgcacacagagcctatgggaattcagggacggggacggcaaacggtagacaaggtgatgggcattccgaaagagacggccgagagagttggacccgaacgcggaccgcttgaacgagagacagagaagctcctgcccgagcgtcagactgatgtgactggcgaggaagagttgaccaaaggcaagcaagatcgggagcaaaaacaactgctggccagggatacacagagacaggaaagcgacaagaatggagagtccgcctcgcctgaacgagacagggagagcctgaaggtggagattgagaccagtgaagagatacaggagaagcaggtgcagaagcagactctgcccagcaaggcttttgagcgggaggttgaacgacctgttgcaaacagggagtgcgatcccgcagaactggaagagaaagtcccaaaagtgattctggagcgcgacacccagcggggtgaacccgagggaggttctcaggatcaaaaagggcaggctagcagtccaacgcctgagccaggcgtgggcgctggcgacctcccgggtccgacctccgctcctgtgccatcagggagtcaaagtggcggaagaggcagccccgtttctccccgtaggcatcagaagggcctgttgaattgtaaaatgcctcctgcagagaaagccagcagaataagagccgcagagaaggtatcccggggtgatcaggagtcgccagatgcatgcctgccccctacagtgcccgaagctcctgcgcctcctcaaaaaccgctgaactcccagtcccagaagcacttagctcctccacctctgctctctccgttgctgccatccatcaagcctaccgtcagaaagacccggcaggacgggtcgcaggaggccccagaggctccgctgtccagtgagttggaaccctttcatcccaaaccaaagattaggacgcgcaaatctagccggatgacaccctttccggctacaagtgcggctcccgagccccatccatcaacgagcacggctcaaccagtcaccccaaaacccacatctcaggcaacccggtcacgcactaacagaagcagcgtaaaaactcccgaacccgtcgtcccgaccgcacctgaactgcaaccatccacttcaacagatcagcccgtgacctctgagccgacaagccaagtgacaaggggaagaaagagtcgttctagcgtcaagacacccgaaacggtggtgcccaccgccttagagttgcagccaagtacatccacagaccggcctgtgacttctgaacccacctcacaagccaccaggggacggaaaaatcgctctagtgtaaagactcccgaacctgtggtcccaaccgcccctgaactccagcctagcaccagtacagaccagcccgtaacgtccgaacccacatatcaggcaaccaggggccgtaaaaacagaagtagcgtgaaaactccagagcctgttgtaccgactgcccctgaacttagaccttccacaagcaccgacagacctgtcaccccaaaaccaacaagtcggacgacgcggagccgaactaacatgtcctccgttaagactccagaaaccgttgtgccgacagccccagagctgcagatttctacctctactgaccagcctgtgactcctaagccaacatcccgcacaacccggagccggactaacatgtcttcggtgaaaaatcccgagagcacagttccaatcgcacccgaactgcccccttctacttcgaccgagcagccggttactcccgaacctactagtcgggcaacccgagggaggaagaacagatcctcgggtaaaacaccagaaacacttgtccccactgcaccaaagctggaaccgagcaccagtaccgatcaacctgtgaccccagagcccaccagtcaagccactagagggaggaccaatcggtcaagcgtcaagacccctgagaccgtggtaccaactgcgcctgaactccaaccctctacaagcaccgaccagcctgtgactcctgaacctaccagccaggcaacacggggacgcacggaccggtcaagtgttaagactcctgaaacagtcgtgccgaccgcgcctgagctacaggcgagcgccagcacggatcagcctgtgacttctgaacccacctcgcgtaccacacggggaagaaaaaatagaagctcagtcaagactcctgaaacagttgttccagccgcaccagaacttcagccgagtacaagcaccgatcagccagtgactcccgagcctacctctcgtgccactcggggaaggacaaatagaagttccgtcaagactcctgaaagcatcgtgcccatcgcgcctgagctgcaacctagcacgtcccggaaccagcttgtaacgccggagcctacatcccgagccaccagatgcaggaccaacagaagctccgtaaagacacccgagcccgtcgtgcctactgcaccagagccgcacccaacaaccagcactgatcagccggtgacacctaaactgacttcaagggcaacccggagaaaaacgaatagaagctcagtaaagacccctaagcctgttgagccagccgctagcgacttagagccgtttactcccaccgatcaatcagttacaccagaggcgatcgctcagggtggccagtctaaaaccttgaggagttccactgttcgggctatgcccgtccctactactccagagttccaatccccagttacaaccgaccagcctatttctcccgaacctatcacccaaccaagttgtatcaagaggcaaagggcagccggaaaccccggatctctcgcagcccctatagatcacaagccttgtagcgcacctctggaacctaagtctcaggcatcccggaatcaacgttggggtgccgtgcgcgcagctgaatcactcacagccattccggagcccgcaagtccacagttgctggaaacccccatacacgcatctcagatccagaaagtggagcccgctgggagaagtcgcttcactccggaactacaacccaaggcctcccagtcccggaagcgcagcctcgccacaatggacagccccccacaccagaagcagccgcagcgcggtgaggtctctcagaaaaccgttattatcaaggaagaagaagaggatacggccgagaagcccggtaaagaagaagatgtggtgacgcctaaacccggtaagcgtaaaagggaccaggccgaggaagaacccaatagaatcccaagtcgcagtcttcggagaacaaagcttaaccaggagtctacagctcctaaggtgctgttcacaggagttgtggacgcacgcggagaaagagccgtcttagctctcggtgggtctctggcagggtcagctgccgaggcatcacacctcgtgacagaccgcatcagacgtacagtcaaattcctgtgtgctctaggaagaggcatccctatccttagtctggactggctgcaccagagcagaaaggcaggattctttcttccacccgacgaatacgtggttactgatccagaacaggaaaaaaacttcggcttttctcttcaagatgctcttagtcgggctagagagagaagactgctggagggctacgagatttacgtgaccccaggagtgcagccaccacccccacagatgggcgaaattatttcctgctgtggagggacatatcttccttcaatgccaaggtcttacaaaccacagcgtgtcgtaatcacctgcccgcaggacttccctcattgctcaatccccctgcgggtggggcttccccttctgagcccggagttcctgctaacaggagttctgaagcaggaagccaagcctgaggcttttgttctgagtcccctagaaatgagctccacgta

SEQ ID NO: 229907 - DNA, 5408 bp, Artificial Sequence
  Description of Artificial Sequence: Synthetic coding sequence
atggaagacacacaggccatcgactgggacgtagaagaagaggaggagactgagcagtcatctgagtccctgcggtgcaatgtcgagcccgtgggacgattacatatcttctcgggcgctcacggacccgaaaaagattttccactgcatctgggcaaaaatgtggtgggcagaatgccagactgctcggtcgccctaccctttccaagcatctccaagcagcacgcagagatcgagattctggcttgggataaagctcctatactgagagactgcggctcactgaacggcacgcagatccttcggccacccaaggtcctttctcctggagtttcgcatagacttagagaccaggagctgattctgtttgccgacctgttatgtcagtaccatcggctcgacgtgagcctccctttcgttagtcggggtccactcacggtggaggaaacgcccagagtgcagggtgagactcagcctcagcgcttgctcctggcagaagattctgaggaggaagtggatttcctcagcgaacgccgtatggttaagaagtcgcgcaccacctctagctctgttatcgtcccagagtctgacgaagaggggcacagtcctgtccttggcggtctggggcctccctttgccttcaacctgaacagcgatacggatgtggaggagggccagcagccagcaactgaggaagccagttctgcagcaagacggggagctactgttgaggccaagcaatccgaagcagaggtagttacagagattcagctggaaaaggaccagcctctggtgaaggaaagggataacgacacgaaagtaaaaaggggggcaggcaatggcgttgtgccagccggagtgatcttggaaaggtctcagccccctggggaagattccgataccgatgtggatgacgactctcgcccacctggaagacccgcagaggttcacttggaaagagcgcagccctttggcttcatcgactccgacacagatgccgaggaggaaaggataccagccacccccgttgttataccaatgaaaaagcgaaaaattttccacggcgtgggcacaaggggtcccggagccccaggtctggcccacctacaggaaagccaagcgggtagcgacacagacgtggaggaagggaaggccccacaggctgtgcccctcgagaagtcacaggcttccatggtgatcaactctgacaccgacgatgaggaggaagtgagcgcagccctgactctggcgcatctgaaagagagccaaccagccatttggaatcgagatgccgaagaggacatgcctcaaagagtggttctgttgcagaggtctcaaaccacaacagagcgggactcagacaccgacgtggaagaagaagagctgccagttgaaaaccgggaagccgttctcaaagatcacacaaaaatccgcgctctggtgcgcgctcatagcgaaaaggatcaaccgccattcggggactctgacgattccgtcgaagcggataagagctccccaggaatccacctggagaggtcacaggcttccacgacagttgatataaacactcaggtagagaaggaagtgccgccaggctctgccatcatccacattaaaaagcaccaggtgagcgtagagggtacgaatcagactgatgtcaaggcggtgggagggcctgctaaactgttagtggtgtccctggaagaagcctggcctctgcatggcgattgcgagaccgacgcagaggaaggcacatctctgaccgctagcgttgtggcggatgtgaggaagtctcagctccctgccgagggcgacgccggagcagaatgggcagctgctgtattgaagcaagagagggcacatgaagtcggagcccagggaggccctccggtggcacaagtggaacaggacctgcctattagccgagagaacctgaccgacttggtggttgacacggatacactgggggagagtacacagcctcagagggagggcgcacaggtccctactggtagagagcgggaacagcacgttggaggcacgaaggatagcgaagataactatggcgacagtgaggatctggacctgcaggccactcagtgtttccttgagaaccagggccttgaggcggtgcaaagtatggaagatgagcctactcaggcctttatgcttactccccctcaggagctcggcccatcccattgcagcttccagacaaccggcacactcgacgaaccttgggaggtgctggccacacagcctttctgccttagggagagcgaagatagcgaaacccagccttttgacacgcacctggaagcttatggaccttgtctcagcccgcctagagcaatcccaggtgaccagcacccggagagtcctgtgcacacagagcctatgggcattcaggggcgtggtcgccaaacggtggacaaagtgatgggtatccctaaagagactgccgaacgagtgggtcccgaaagaggtcctctcgagagggagacagagaagctgctgcccgaaaggcagaccgacgtcactggagaggaggaactgactaaaggaaaacaggaccgggagcagaagcagctgctagcacgggatacacagaggcaggagagcgataaaaatggtgagtccgcgtcccccgagcgtgatcgagaaagcctgaaggtggaaattgaaaccagtgaggagatccaagaaaagcaagtgcagaaacagaccctacccagcaaagccttcgagcgggaagtggagaggccagttgccaaccgggagtgcgatccagcggaactggaggagaaagtgcccaaggttatactggagagagacacacaacgcggagaacccgagggtggcagtcaggaccagaagggtcaggccagcagcccgactcccgaacccggtgtcggtgccggagatctaccgggaccaactagcgccccagtgccctccgggtcccaatccggcggtcgcggttcaccggtaagtccccgacggcatcaaaagggcctgctcaattgcaagatgccccctgcagagaaggctagcaggattagggcggcagagaaggtgtcaaggggcgatcaggagtcacccgacgcctgcctgccacctacggtccctgaagcgcctgcaccaccacagaagccattaaatagtcagagccagaaacatctggccccacctccactcttatctccgctgctgcctagtattaagcccaccgttcggaagaccagacaggacggctcccaggaggctcctgaagcccctctgagcagtgagctagagcctttccatcccaaacctaaaatcagaaccaggaagtcgagcagaatgactccttttcctgcgacctcagcggctccaaagctggagccttccacatctaccgatcagccagttacccctgaacccacatctcaggctacgcgagggcgtacaaaccggagttcagtgaaaactcccgagactgtggtgccaaccgcccctgaactccagccaagcacgagtactgaccagccagtaaccccagaaccgacttctcaggcaacacggggtagaacggatcggagctctgtgaaaacccctgagacggtggttcctacggctcccgaattacaggcctcagcttctactgaccagcctgtcacgtccgaaccgacatccagaactacacgcggacgtaaaaatcggtcaagcgtaaaaactcccgaaactgtagttcctgcagccccagagctccaaccttcaacatccacggatcagcccgtgacgcctgaaccaacctcacgagcaactcggggaagaaccaacagatcatcagtcaagactcccgaatctattgtgcccattgcccctgagcttcagccctccacctcacgcaatcagctggtgacccctgagccgacctctcgtgctacaagatgcaggactaacagaagcagtgttaaaacccccgagcccgtagtgcctaccgctcctgagccgcaccccacaacttcgactgaccaaccagttacacccaaattgacctcccgggctacgagaagaaaaacaaatcggagctcagtgaaaacccccaaacctgtggagcctgcagcctcagacttggaaccttttacgccgactgaccaatctgttacccctgaagcaattgcacaggggggacagtccaagaccttaaggagttccactgtccgggctatgcccgtacctaccactccagaatttcagtcccctgtgaccacagaccaaccaatcagtccagagcctatcacacagccttcttgcatcaagagacagcgagctgccggaaatccgggttcgttagcagctcccatagatcacaaaccatgctccgcccctcttgaacccaagagtcaggcgtcacgcaatcaacgctggggagctgtgcgcgctgccgagtctctgacagcaatccctgaaccagcctcccctcagctccttgagaccccaatccacgcctcccagattcagaaggtggagcctgcgggaaggagccggtttaccccggagctgcagcccaaagcaagtcaaagtcgtaagcgcagtctggctactatggattcccctccacatcagaaacaaccccaacggggagaggtctctcagaaaactgtgataatcaaggaggaggaggaggataccgccgagaagcccggaaaagaggaagatgttgtgacacccaaaccaggcaagaggaaacgcgatcaagcagaggaggagcctaaccggatcccatccaggagccttaggcgcactaaactcaaccaagagagcacagcacccaaggttttatttaccggtgttgtggacgcaagaggagagcgggcagtgctggcgctggggggaagtctagccggatccgccgctgaggcaagccaccttgttaccgatcgaattagacgcactgtgaagtttctttgcgcactgggacggggtatccccatactgtccctggattggttgcatcagtcccgcaaagcgggattctttttgccaccagacgaatacgtggtcaccgatcctgagcaagagaaaaactttggcttttcactgcaagatgccctcagcagggccagggaaaggcgactgctggaaggatatgaaatctacgttacacctggggtgcagcctcccccaccacaaatgggcgagatcattagttgttgtggcggaacatatctccctagcatgcccaggtcttataagcctcagagagtggtgattacctgccctcaagatttccctcactgcagtattcctctacgcgtcggcctgccgcttctgtcccctgaattccttctcaccggggtgctcaaacaggaggctaagccagaagccttcgtgctttcccctctggaaatgtcctcaaccta

SEQ ID NO: 229908 - DNA, 342 bp, Artificial Sequence
  Description of Artificial Sequence: Synthetic coding sequence
atggaagatactcaggccattgactgggacgtcgaagaagaagaagagactgaacaatcatcggagtctttacgatgcaatgttgagcctgtgggtagacttcacatcttttcaggggctcatggtccggagaaagattttcccctgcacttgggaaaaaatgtggtcggccgtatgcctgactgtagtgttgcattaccttttccctctatttctaagcagcatgccgagatcgagattctcgcatgggataaggcgccaattctgcgagattgtgggtcattgaatggaacccaaatcctccgcccaccgaaggtgctctcacctggcgtatcccattag

SEQ ID NO: 229909 - DNA, 6269 bp, Artificial Sequence
  Description of Artificial Sequence: Synthetic coding sequence
atggaagatactcaggccatagactgggacgttgaagaagaggaagagactgagcagtctagcgaatccctacgttgtaacgtcgagcctgtgggtcggctgcacatcttcagtggtgcccatggtcctgagaaggattttccgctccacctgggaaagaatgtcgttggccgaatgcctgactgctctgtggctctgccatttccctcgatcagcaaacaacatgcggagatcgaaatcctagcatgggacaaagcccctatactgcgggattgcggctctttgaacggaacccagatactgcggccacctaaagttttgagccctggcgtctcccaccgactgcgggatcaagagctcatcctgtttgcagacctcctgtgtcagtaccaccggctggacgtaagtttgccctttgttagtagaggacccctgactgtggaggaaacgcctcgcgtccagggggaaacccaacctcaacgactcctattagcagaggattcggaggaagaggtcgattttctttcagaacgccgtatggtgaagaagtcccgaacgaccagcagttccgttattgttccggaatctgatgaggagggccattcacctgtgcttgggggactggggccaccgttcgcatttaatctgaactccgataccgatgtcgaagaaggtcagcagcccgctactgaggaggcgtccagcgcagcacggcgtggcgcaactgtggaggccaaacaatccgaggctgaggttgtaaccgagatccagctggagaaggaccagccactggtgaaagaacgggacaacgataccaaggtaaagcgcggtgccggtaatggagtggtgcccgcaggggtcatcctggagcggtctcagcctcccggtgaggattctgataccgatgtcgatgacgattcccgcccacccggacggcctgcagaagtgcacctggagagagcccagcccttcgggtttattgacagcgatacagacgccgaggaagagaggatcccagcaacaccagtcgtaatacccatgaagaagcggaagatctttcacggcgtcggcaccagaggacctggagctcccggactcgcccacctgcaggaatcacaggcaggatctgataccgatgttgaggaagggaaagctccacaggcggtgccgctggaaaagagtcaggctagtatggtcatcaactctgacaccgacgatgaagaagaagtgagcgcagctctaacccttgcccacctcaaggaatcgcagcccgcaatttggaacagggatgccgaagaagatatgccgcaacgcgtcgtgttactacaacgttcacagaccaccacagagagagattctgacacagatgtggaggaagaggaacttcctgtggaaaatcgcgaggccgtgttaaaggaccacaccaagataagagcactagtccgcgctcattcagagaaggaccagccaccatttggtgattctgatgactcagtcgaggccgataaaagtagccccggaatccatctcgagaggtcacaggctagcaccacagtggacataaacacacaggtagaaaaggaagtgccgccaggatcggccatcatccacatcaaaaagcaccaggtgtcagttgagggaacaaatcaaaccgacgtgaaggctgtcggaggccctgcgaaactcctggtggtgtccttagaggaggcatggccccttcacggtgactgtgaaactgatgcggaagagggcacatctctcacagccagcgtcgtggctgacgtccggaaatcccagttgcctgcagaaggagacgcaggggctgaatgggctgcagctgtcctgaaacaggaaagagctcatgaagtgggagcccaggggggaccaccagtggcccaagtggagcaggatctccctatttccagagagaacctgactgatctggtggtagatacagatacgcttggcgaatctactcagcctcaaagggagggggcacaggtgcccacaggtagagagagagagcaacacgtgggcggtaccaaggatagtgaggataactacggggacagcgaagatttggatctgcaggcgactcaatgctttctggaaaaccagggattagaagcagtgcagagtatggaagacgagccgacacaggcctttatgctcacccctccacaggagctcggtcctagccactgctcctttcagaccactgggacgctcgacgagccttgggaggtgttggccacacagccattttgcctacgcgagagtgaggactctgagactcagccttttgacactcatcttgaggcttatggtccctgcctgtcccccccacgggctatcccaggggaccagcatccggaaagtcctgtacacactgaacccatgggtattcaagggagaggcaggcagacagtcgacaaagttatgggcatcccaaaagaaaccgctgagcgcgtcggacctgaaaggggacccctcgaacgtgaaacagaaaagttgctaccggaacgccagacggacgttacaggtgaagaggagttaacaaagggtaaacaagaccgcgagcagaagcaactattggcccgtgatacccaacggcaagaaagcgacaagaacggcgagagcgcaagccctgaaagggaccgcgagagtctaaaggtcgagatagaaactagtgaggagattcaggagaagcaggttcaaaaacagaccttaccttctaaagcctttgaacgggaagtggaacgaccggtggctaaccgagagtgtgaccctgccgaacttgaagagaaggtgcctaaggtgatattggagcgggacacgcagaggggagagcctgagggcggatcccaggatcagaaggggcaggctagcagcccgacccctgaaccgggagtcggagccggtgatctgcccggaccaacttccgcccctgtgccgtccggtagtcagtcagggggacgtgggagtcccgtctcgccacggaggcaccaaaaggggctgttaaattgcaagatgccgccagcggaaaaagcctctaggattagggctgctgagaaagtgtctcgcggagaccaggaaagtcctgacgcttgcctcccaccaactgtgcctgaggctcctgctccacctcagaagcctcttaattcccagagtcagaagcatctcgccccacctccccttctttctcctctcctgccttccatcaagcccaccgtcaggaagacccggcaggatggctcccaggaagctcctgaagctccactgagttcggaactcgaacctttccaccccaagcctaaaatcagaacccggaagtcgagcaggatgactccgtttccagccacgtcagctgcgcctgagccgcacccttccacaagcaccgcccagcctgtgacgccgaagccaactagccaggcaacaaggtctcgaacaaacagatcttctgtgaagacgcccgaaccagtggtccccactgccccagagctgcaaccaagtacttctaccgatcagccggtgacgtccgagcctacctcacaggtgactagaggcagaaaatcaagatcttcagtaaaaacccccgaaactgtggtgcctactgccctcgaactccagccatctacctctactgacagacccgtcactagcgagccaacctcccaggctaccaggggcagaaaaaatcgaagttccgttaagacacccgaacccgtggtgcccactgcacccgaactacagccgtctacttcgactgatcagcccgtgactagtgagcccacctatcaggctacgcgcggacgtaaaaataggtctagtgtaaagacccccgagcctgttgtccccactgctcctgagcttaggccttctacctcaaccgatagacctgtcacgcccaagccgacctcacgaaccaccagatctcggaccaacatgtcatccgtgaagaccccagagactgtagtgcctaccgctccggagctgcagatttctacgtccacagaccagccagtgaccccaaaacctacctcccgaaccacgagatcccggacaaatatgagttccgtaaagaatccagaaagtactgtccccatcgcacccgagcttccgccaagcacaagcacagagcagccagtgaccccggaaccaaccagtcgagcgacacggggaaggaaaaacagaagctcaggcaagaccccggaaaccctcgtgcctaccgcgcctaaactggagccaagcacctccactgaccagcccgtaactccggagcctacttctcaagcaactcgaggaagaacaaacaggagtagcgtgaaaacccccgagacggttgttcctacggcacccgaacttcaaccttcaacctcaacggaccagcccgtcacacccgagccgacaagccaggcgactaggggacgcacggaccgctccagcgtaaagaccccggaaacagtcgttcctacagccccagaactgcaggcttcagcctctaccgaccagccagtcacctcagagcccacttcaaggaccacacgaggcagaaagaaccgtagctctgtcaagacccctgagacggtcgtgcccgcagccccagccctacagcccagcacctccacagatcagccagtaacgcccgaacctacatctagagccacccgcggaaggacgaacagaagctccgtgaagactccagagagtatcgtccctattgctcctgaactgcagccttccacaagcaggaatcaactggtgacaccggaacctacttccagggcaacaagatgcagaactaatagaagctccgtaaagacaccagagcccgtggttccaactgcaccagaacctcatccaactacatcgacggatcaaccagtgactcctaagctcacatcccgggctaccagacggaagacaaacaggtcttccgtcaagaccccgaagccagtggaacccgcagcctcagaccttgagccctttacaccaacggatcagtctgtcaccccagaggcgatagcccaggggggacagagcaagacccttcggtcctccacagttagagcgatgcctgttcccactacccccgagtttcaaagcccggtaacgacagaccagccaattagccccgagcctatcacccagcctagttgcatcaagcggcagagggcagccggaaacccaggttcccttgctgccccaatcgaccataagccttgctcagcccctttagagcccaaatcacaagcatccagaaaccagaggtggggcgctgtgagagctgccgaatccctaaccgcaattcctgagcctgcatcaccccagttgctggaaacccctatccatgcttctcagattcagaaagtggaacctgccggaaggtcaaggttcaccccagagcttcagcccaaggcctcacagagtagaaaaagaagtctggcaactatggactctccgcctcaccagaaacagccccagagaggcgaagtgtcgcagaaaaccgtgataatcaaggaagaagaggaagacacagctgaaaaaccaggtaaagaagaggatgtggtcactcctaaacccggtaagaggaagcgggatcaagccgaagaagagccgaatagaatcccgtccaggtctctccggcgtacaaaactgaatcaggagtctaccgccccaaaggtactgtttaccggggtggtggacgcacgtggcgagcgcgctgtccttgctctgggagggtctttggctggatctgcagccgaagcatctcacttggtcacggaccgcattcggagaactgtgaaatttctgtgcgccctgggcagaggcatcccgatcctctctcttgattggctgcatcagtcacgcaaagccggtttttttctgcccccagacgagtacgtggtgaccgatcctgagcaggaaaaaaattttgggttctctctgcaggatgcgttatccagggctcgtgaaaggaggctactggaaggctatgagatatacgttacccctggggttcagcccccaccccctcagatgggagagataatctcttgttgcggcggaacctacctcccatccatgcccagatcatataagcctcagagagtggtgatcacttgtccacaggatttccctcactgctccatccccctgagggtcggtctccctttactttcccccgagttccttctgaccggcgtcctcaaacaggaagctaagcctgaggcctttgttctatcccctttggaaatgtcctcaacata

SEQ ID NO: 229910 - DNA, 738 bp, Artificial Sequence
  Description of Artificial Sequence: Synthetic coding sequence
atggaggacactcaggcgatagactgggacgtggaagaggaggaggaaactgagcagagtagtgagagcctacgatgcaacgttgagcctgtggggaggctgcatattttttcaggagctcacggtcccgaaaaggactttcccctgcatctcggcaagaatgtggtcggcagaatgccagactgctcagtcgctctgccgttcccgtcaatttccaaacagcacgctgaaatcgagatcctggcttgggataaggctccgattctacgggactgcggctcacttaatggcactcagatcctaaggccaccaaaggtgctgtcacccggagttagccataggctacgtgaccaggagctgatcctcttcgccgacttactatgtcagtatcaccgactcgatgtgtctttgccatttgtcagccggggacccttaactgtcgaggaaacaccaagagtccagggagaaacgcagccacaaaggctcctccttgccgaagactcagaggaggaggtcgactttctgagtgagcggagaatggtgaagaagagtcgtaccacaagctcctccgtcattgttcccgagtccgacgaggagggccattccccagttctcggtggactcggcccaccattcgcctttaatctcaattccgacacagatgttgaagagggccagcagccagccaccgaggaggctagtagcgctgctcgcaggggagccaccgtagaggcttag

SEQ ID NO: 229911 - DNA, 342 bp, Artificial Sequence
  Description of Artificial Sequence: Synthetic coding sequence
atggaggacactcaagctatagactgggatgtggaggaggaggaagaaacagaacagtctagcgaatccctccggtgtaacgtggagcccgtggggagactccacatattcagtggggctcatggcccagaaaaggatttccctctgcacctgggcaaaaacgtcgttgggcgtatgccagactgctctgttgctctgccgttcccctccatttcaaagcagcatgctgaaatcgagattctcgcttgggacaaggccccaatcctgcgtgattgtggcagtctgaacggtacccaaatcctcagaccaccaaaggtcctgtcgcctggtgtgtctcactag

SEQ ID NO: 229912 - DNA, 384 bp, Artificial Sequence
  Description of Artificial Sequence: Synthetic coding sequence
atggaagacacccaggccattgattgggatgttgaagaggaagaggaaacagaacaaagctccgagtctttgaggtgcaacgtggaaccggtcggcaggctccatattttttcaggggcacatggaccggagaaagactttccgctacacctgggcaagaacgtcgtaggcaggatgcctgattgctcagtagctctgcctttcccaagcatttccaaacagcacgcagagattgaaatattggcttgggacaaagcccctatcttaagagactgcggttcccttaatggaacgcagattctgaggcctccaaaagtgctctccccaggcgtttctcaccggcttcgagatcaggaactgatcctgttcgccgaccttctctag

SEQ ID NO: 229913 - DNA, 6269 bp, Artificial Sequence
  Description of Artificial Sequence: Synthetic coding sequence
atggaggatacccaggcaatagattgggatgtggaggaggaagaggaaacagagcaatctagcgaaagtctgcgatgcaatgtagaaccggtcggccgtcttcatattttctcaggagcccatggacctgagaaagatttccctttacatctggggaagaacgtggtgggtagaatgccagattgttctgtggccctgccatttccatcaatttccaaacagcacgccgagattgagatccttgcttgggataaagcacccatcctccgagattgcggctccctcaacggaacacagattctgcgccctcctaaggtgctgagccccggtgtgagccacaggctgcgagaccaggaactgatcttatttgcggatctgttatgtcagtaccacagactcgacgtgtccttacctttcgttagccgtggccctttgaccgttgaggagaccccacgggtacagggagaaacccagcctcaacgactgctcctggctgaggactcagaggaagaggtcgacttcctcagtgagaggagaatggttaaaaagtcgaggacaacttcatcctcagttatcgtgcctgagagcgatgaggagggccactcccctgtactgggaggtcttggtcctcctttcgctttcaacctgaactccgacaccgacgtcgaggaagggcagcagcctgcaactgaggaggcatcttccgcggcacgccgtggggctaccgttgaagccaagcagagtgaagcagaggttgtgacggaaatacagctcgagaaggaccagcccctggttaaggagcgggataacgacacaaaagtcaaacggggagcgggaaacggcgtcgtcccagctggtgtgatactggagcgcagccagccacccggtgaagattcagacaccgatgtggacgacgattcccgccctccaggcaggcccgctgaagtgcatctggagagagctcagccatttggctttatcgactccgacactgacgccgaagaggaaaggatccctgccaccccagtggtgattcccatgaagaagcgcaagatcttccacggcgttgggactcgcggacctggagccccaggactggcccaccttcaagaatcccaggcaggatcagatacagacgtcgaggaggggaaggcgccacaggctgtgccgcttgaaaaatcccaggcctctatggtcataaattctgacacggacgacgaggaagaggtgagcgcggctctcaccctggcccacctcaaggagtctcagccagccatttggaacagagacgcagaagaggatatgcctcagagggtcgttctgctgcaacgcagtcaaacaacaacagagcgtgatagcgacacggacgttgaagaggaggagttgcccgtggagaatagagaggccgtcctcaaggaccatacgaaaataagagcactggttcgggctcactctgagaaagatcaaccccctttcggcgattcagatgattctgtggaggccgataagtcaagcccgggaatccacctggagaggtcccaagcatcaacgacagttgatatcaatacccaagtggagaaggaggtgcccccaggtagcgcgatcatccacattaagaagcatcaagtgtctgtggagggaactaatcaaaccgatgttaaggcagtagggggtccagccaagctattagtcgtgtccctggaggaggcctggcctctgcacggagactgcgaaaccgacgcagaggagggaacctcattaacggcctccgtggttgcagatgtaaggaagtcccagctccccgcagagggcgacgctggggcagagtgggccgcagctgtgctgaagcaggaacgggctcatgaagtcggcgctcagggcggaccacctgtagcccaagtggagcaggatctgccaatctcaagagagaacctgaccgaccttgttgtggatacagatacccttggtgagagtacccagcctcaaagagagggggcacaggtgcccacaggcagggaacgggagcaacatgtcggaggcactaaagatagcgaagacaattatggcgactcagaagacttagacctacaggccacccagtgcttcctggagaaccagggactggaagccgtgcaatccatggaggacgagccgacccaggcattcatgctcacccctcctcaggaattaggaccttctcactgctctttccagaccacagggactctcgacgaaccctgggaggtgcttgctacccaaccattttgtctccgcgaatctgaggatagcgagacacagccctttgatacacacttggaggcgtatgggccttgcttgtcgccaccaagggcaatacccggagaccaacatcctgagtctcccgttcatactgagcctatggggattcagggcagagggcgtcaaaccgtggacaaagtcatgggcatcccaaaagagactgctgaacgcgtgggccctgaaagagggccactcgagagggagactgagaagctgttgcctgagaggcaaactgacgtgaccggggaagaagagttgaccaagggaaagcaagaccgggagcagaagcagcttctggctcgggatacccagcgtcaagaatcagacaaaaatggcgagtcagccagcccagaacgtgacagggagagcctgaaagtggaaattgaaacatccgaagaaattcaggagaagcaggttcagaaacagaccctcccatctaaggcctttgagcgagaagtcgaacggccagtggccaatagggagtgtgaccccgctgagctggaagagaaggtgcccaaagtaatcttggaaagagacacccagcggggtgagccggaaggtggctcacaggatcaaaagggtcaagcgtcctccccaacccctgagccaggagttggagctggtgacctacccggacccacgagcgcacctgtgccctcaggctctcagagtgggggaaggggctctcctgtttccccccgaaggcaccagaaaggactgctcaattgtaagatgcctccagccgaaaaggcctcccgtatacgcgcagcggagaaggtatctcgaggggaccaggagagtcccgacgcatgtctgcctccgacagttccagaggccccagcgccaccgcagaaacctcttaattctcaatctcagaagcaccttgcaccaccacctttattgtccccacttctgcccagtatcaagcctaccgtcaggaagacaagacaggatggctcgcaggaagcccctgaagcaccgttgagcagtgagctggagcctttccacccgaagcccaaaattcggacccggaaatcttccaggatgacaccatttcctgcgacctccgcagcccctgaaccacatcccagcaccagcaccgctcagcctgtgaccccgaagcccacatctcaggcaacacgttccaggactaaccggtcctctgtaaagacacccgaacccgtcgttccgaccgcccctgagctccagccaagcacttccactgatcaacctgttaccagcgaaccaacctctcaggtcaccagaggccgaaagagccggtcatctgtcaagactcctgaaactgttgtgccaacggcactcgaactccagcccagcacgtcgactgaccggccagtgaccagtgaacctacctcacaggccacacgcggacgaaaaaatcggtccagcgtgaaaacacccgagcccgtagtgccgacagccccagagctgcaacctagcacttcaaccgaccagccagtgacatctgaacccacgtatcaggcaactaggggcaggaaaaacagatcctccgttaagacaccagaaccagtggttcccactgctcctgagctgcgcccatccacctccaccgatcgccctgtcacccctaagcctacttccagaacgacaagaagccgcaccaacatgtcctcagtgaagacccccgagactgtagtgcctactgcgccagagctgcagatcagcaccagtactgaccaacctgtgacgccgaaaccgacctctcggaccacaagaagcaggaccaatatgagttctgtgaagaatcctgagagtactgttcccattgctccggagttaccccctagcaccagcaccgaacagcctgtcacgcccgagccaacgagcagagcaacccggggtcgaaagaacagatcttctggcaagacccctgaaacccttgtgcctactgccccaaagcttgaaccctccacatctaccgaccagccagtcacacccgaacccacaagccaagcaacccggggacgaacaaacagatcctcagtgaagacacccgagaccgtggtgccaaccgctccagaactgcagccttccacatctaccgaccagcccgtcacccctgagccaacctctcaggcgactcgcggtcgaacagacaggagcagtgtgaagacccccgagactgttgttcctacggcaccagaattacaggccagcgcctccaccgatcagcctgtcacctccgagccaacatccagaacaacgcgcggtcggaaaaatcgctcttctgtgaaaacacctgaaacagtagtcccagccgcacctgagttacagccttctacctccactgatcagcctgttactcccgagccaacatctcgggctacacggggtcggaccaacagatcatctgtgaagactcctgagtcaattgtgcccattgcgcctgagttgcaacctagcaccagtcgaaaccagctcgtgacaccagaaccaacctcccgggcaactagatgccggacaaatcggagttcagtgaagacaccagaacccgtcgttcccactgcacctgagccccaccctacgacttctacagatcagccagtgactcccaagcttacttcccgtgctacacgcagaaagaccaataggtcatccgtgaaaactccgaagccagtggagcctgccgcttctgacttggagccttttacgcctactgatcaatcggtgacccccgaggcaatcgcccagggtggccagtctaaaacattgaggtcctccacggtgagggccatgcctgttcctactacgccagagtttcaatcgccggttactaccgaccagccaatttcgcccgaacccataacacagccgtcctgcatcaagcgccagcgggctgcgggtaacccaggcagccttgccgctccaattgatcacaagccctgttcagcaccgctcgagcctaagagtcaggcctctagaaaccagcggtggggtgccgtgagggcagcagagagcctgacagccattcctgagcctgcctccccccaactcctggaaacacctatccacgccagccaaatccaaaaggttgagccggctggaagaagcaggttcacaccagaactgcagccaaaagcctcacagtccagaaagcgctccctggccaccatggatagcccgccacatcagaagcaacctcaacgaggagaagtgtcccaaaaaaccgtgatcatcaaggaggaggaagaggatactgcagaaaaacctggaaaagaggaagacgtcgtcactccgaaaccaggcaaaaggaaaagagaccaagccgaggaggagccaaaccggatcccgtccagatcactgcggcgtactaagctgaaccaggagtctaccgccccaaaagttttgttcacaggcgtggttgacgctcggggtgagagggctgtgctcgcgttggggggtagcctcgccggttcggccgcagaggcaagccatcttgtgaccgacagaatcagaaggaccgtgaagtttctctgtgcactgggacggggaattcccatattatccttagattggcttcatcagtctagaaaggctggtttctttctcccacccgatgagtatgtggtgaccgacccagagcaggagaagaatttcgggtttagcttgcaggacgcactatctcgcgcaagagaacgaagactgctggagggctacgagatctacgttactcctggcgtccagcctcccccacctcagatgggtgaaatcatatcttgctgcggtggcacctacctgccctcgatgccacggtcatataagcctcagagggtggtaatcacttgtccccaggattttcctcactgctcgatcccactcagggtgggccttcctctgctgagccctgaattcctgctaacaggcgtgctgaagcaggaagccaaaccggaagcattcgtgctttcaccactggagatgagcagcaccta

SEQ ID NO: 229914 - DNA, 489 bp, Artificial Sequence
  Description of Artificial Sequence: Synthetic coding sequence
atggaagacactcaggcgatcgactgggacgtggaggaggaagaggaaacagaacagagcagtgaatctttacgatgcaacgttgaacccgtggggagactgcacatctttagcggagcacatggccctgagaaggattttcccttgcatttgggaaagaacgttgtgggtcgaatgcccgattgcagtgtcgccttaccctttccgtcaatttccaaacagcatgcagaaatcgaaattcttgcttgggataaggcacctatccttcgagactgtggatctttaaacgggacacaaattctccgtccacctaaggtactatcacccggagtgagccaccggctccgggatcaagagcttatactgtttgccgacctgttgtgtcagtatcaccggcttgacgtgtcccttccttttgtatcaagaggacccctgaccgtggaagagacaccacgtgttcaaggcgaaacccaaccccagagactgtag

SEQ ID NO: 229915 - DNA, 921 bp, Artificial Sequence
  Description of Artificial Sequence: Synthetic coding sequence
tgacatgtagggggaaccaaggactccgaagataattacggagactccgaggatctggatctgcaagctacacagtgcttcctggaaaatcaggggcttgaggctgtgcagagtatggaggacgaacccacccaagctttcatgctgactcctccgcaggagctgggtccctctcattgcagtttccaaaccactggtctgctgaattgtaagatgccacccgctgagaaggctagcaggattcgggcagcagaaaaggtttcaagaggagaccaggagtcaccagacgcctgcctacctccaaccgttccagaggcccctgcccctccgcaaaaaccactgaattcacagagtcaaaaacacttggcccctccgcctctgctatcacctctgctccccagtatcaaacctacagtgagaaaaacacggcaagacggttctcaggaggctccagaggccccattgtcctcggagctggaacctttccatcctaaaccaaagattagaacccgcaagtcctctaggatgacccctttcccagccacctctgccgctccagagcctcacccatcgaccagcaccgcacagccggtaactcctaagccaactagccaggctacccgaagccggacgaaccggagcagtgtaaaaactcctgagcccgtcgttccaaccgctcccgagcttcaaccgagcacatctactgaccagcctgtcacgagcgagccaaccagccaagtcactagaggacgcaagtcacggtcatccgtaaaaacccccgagacagtagttcccacagcactggagctgcagcccagtactagcacagatcggccagtgacaagtgagccaacctcacaagccacccgcggtaggaaaaataggtcatcagtaaaaactcccgagcctgtggttccatag

SEQ ID NO: 229916 - DNA, 921 bp, Artificial Sequence
  Description of Artificial Sequence: Synthetic coding sequence
taacatgtgggcggtaccaaggactccgaagataattacggcgattctgaggacctggacctgcaagcaactcagtgctttttggagaaccagggtctcgaggccgtacagtcaatggaggatgaacccactcaggctttcatgttaacacctccccaggaactcggaccctcccactgcagtttccaaacaaccgggctgcttaactgtaaaatgccgcctgcggaaaaagcatcaagaattagagccgctgagaaagtgtcccgaggagatcaggagtctcctgatgcttgccttccacctacagtcccggaggctccagccccaccacagaaaccgcttaactcgcaatcacagaaacacctggccccaccacctctcctctcacctctgctgccatctattaagccaactgtccgaaaaactagacaggatgggtcccaggaggctcccgaggcgccacttagctctgagttggagcctttccacccaaagcccaagatacgaacgcggaagtcctctcgtatgactccatttcccgcaacttcagccgcacccgagccccatccatctactagcactgcacaacctgtcacccctaagcctacctctcaagccacaaggagccggaccaaccgctcgtcagtgaagaccccagagcccgtcgtgcccaccgctcccgagcttcagccctccacctctaccgaccaaccggtgacgtctgagcccaccagccaggtgactaggggcagaaagtcccgcagcagtgtcaaaacccctgagactgtggtgcctacagcattagaactccaaccatctacttccacggataggcccgttacctctgagcctacctcacaagcgacaagaggccgtaagaatcgctcttccgtcaagacaccagagcctgtcgtgccttag

SEQ ID NO: 229917 - DNA, 384 bp, Artificial Sequence
  Description of Artificial Sequence: Synthetic coding sequence
atggaggacacccaagcaatcgactgggatgttgaggaggaggaggaaacagaacagtccagcgagtccctccggtgcaacgttgaacctgtgggacgattacatatcttctccggcgcacacggaccagaaaaagacttccccctgcatctgggcaagaacgttgtgggacgtatgcctgactgcagcgtggcgcttccttttccttccatcagcaagcagcacgctgaaatcgagattctcgcctgggacaaagcgccaattttgagagactgtggctcactgaatggcactcaaattctcaggccacctaaagttctcagcccaggcgtgagccaccgtttgagggaccaggaactcattctgttcgcggatctgctgtag

SEQ ID NO: 229918 - DNA, 921 bp, Artificial Sequence
  Description of Artificial Sequence: Synthetic coding sequence
tgacatgtgggtggcaccaaggattccgaagacaactacggggactccgaggatctggatctgcaggctactcagtgtttcctagaaaaccagggactggaggcagtgcagagtatggaagacgaacccacgcaggcttttatgctcaccccacctcaggagttgggcccatcacattgcagtttccaaacaacagggctgcttaattgcaagatgcctccagcggaaaaggcttctcggatcagggccgctgaaaaggttagtaggggggatcaagagtctcccgacgcgtgcttgccccctacagttccagaggccccagcccctcctcagaagcccttaaactcacaaagccagaagcacttagctccaccgcctctgctgagtcctttactgccgagtatcaaacccactgtgcggaaaactcggcaggatgggtcccaggaagccccagaggcccctctcagcagcgaactcgaaccctttcaccccaagcccaagattagaacacggaaaagctcgaggatgactcctttccccgcaacttccgccgcaccggaacctcatccctccaccagcaccgctcagcctgttaccccaaaacccacctctcaggcaacccgttcccggacgaatcggtcgagcgtcaagacccctgagccggttgtgccaaccgctcctgagctccagccatcaacgagcactgaccagccagtgacaagcgagccgacgtctcaggtcaccagaggacggaagagccggagtagtgtgaaaacccctgaaaccgtggtgcctacagcgttagagctccagccctccacctcaacagacaggcctgttaccagtgaacccacaagtcaggccaccaggggaaggaagaatcggtcaagtgttaagacaccagaaccagtagtcccgtag

SEQ ID NO: 229919 - DNA, 489 bp, Artificial Sequence
  Description of Artificial Sequence: Synthetic coding sequence
atggaggacacccaagctattgactgggacgtcgaggaagaagaggagactgaacagagctcagaaagcttgagatgcaacgtggagccggtgggccgtctccacatttttagcggagcccatgggccagagaaggactttccccttcatctcggcaaaaatgtggtaggcaggatgcccgattgcagtgtcgccctcccgtttccctccatatctaagcaacacgcagagatcgagatcctggcttgggataaggcaccaatcctccgcgattgcggcagccttaatggtactcagattctgaggcccccaaaggtcctctcccccggagtcagtcacaggctccgggaccaggagctgatcttgtttgctgacctgttgtgccagtaccacaggctcgacgtcagtctccctttcgtgtctcggggacccttaactgtggaggagaccccccgtgtgcagggggaaacccagcctcagcgactgtag

SEQ ID NO: 229920 - DNA, 6269 bp, Artificial Sequence
  Description of Artificial Sequence: Synthetic coding sequence
atggaagacacccaggcgatcgactgggacgtggaggaggaagaggagaccgaacagtcatccgaatcgctccgctgcaatgtcgaacctgtcggcaggcttcatattttctccggagcccacggccctgagaaggactttcctctccacttgggaaaaaacgtggttggcagaatgccagattgcagcgtcgctctcccatttccgagtatttctaaacagcatgctgagatcgaaattctggcatgggacaaggcaccaatcctgagggattgcggcagcctcaacggcacccagatcttacggcctcctaaggttctctctccgggagtgtcccatcgcttaagggaccaagagctcatattgttcgcagacctgctttgccagtatcaccggctcgatgtgtcattaccgttcgtgtcaaggggaccattgacagtcgaggaaacaccaagagttcagggggaaacccagccgcagcgtttgcttttagctgaggacagcgaggaggaggtggatttcctctctgagaggcgcatggtgaagaagtctaggacgactagctcctccgtgatcgtccccgagtcggatgaagaggggcactcccccgtgctcggcggactcggtcccccatttgcctttaatctaaacagcgatactgatgtagaagagggacagcagccggcaacagaggaagcatcaagtgccgctaggagaggcgcaactgttgaggccaaacagagcgaagcggaggtcgtgactgaaattcaacttgagaaggaccagccactcgtgaaagaacgagataatgataccaaagtgaaacgtggggctggaaatggcgtggtgcccgcaggcgtgattctggaaaggtcacagcctcccggagaggatagcgataccgatgtggacgacgactcccggcctccaggaaggcctgcggaagtgcatctggagagggctcagccttttggatttattgatagtgatactgacgctgaggaagagcgcatccccgctactccagtggtgattcccatgaaaaagcgaaagatattccatggcgttggaacgcggggacctggtgcacccggtcttgcacacctgcaggagagccaggcaggatcagacaccgacgtagaggagggcaaagccccacaagccgttccactggagaagtctcaggcttccatggtgataaatagcgataccgatgatgaggaggaagtatcagccgctctcacactggcccacttaaaggaaagccagcctgctatctggaaccgggatgcggaagaggacatgcctcagcgggttgtcctcctccaaaggtctcagaccaccactgagcgggattctgataccgacgtggaggaggaagagcttcccgtagagaaccgagaagctgttcttaaagaccatactaaaatccgggctctggtccgggctcactccgagaaggaccagcctccgttcggtgatagcgatgactctgtcgaggccgacaagtccagccccggtatacaccttgagcgcagtcaagctagcacaacagtagacataaacactcaggtggaaaaggaagtccctccaggatccgcaattatccatatcaaaaagcatcaagttagtgtggaagggaccaaccagaccgacgtgaaagcggtgggcggaccagcaaaactgcttgtcgtgtcacttgaagaggcttggcctctacacggtgattgcgagaccgacgccgaggaaggcacgtcgctgaccgctagtgttgtggcagacgtgaggaaatcacaactgccggctgagggagatgctggcgcagagtgggccgctgccgtgttaaagcaagaaagagctcacgaggtaggcgcacagggcggtccccctgtcgcccaggtggagcaggatttgcctataagtagggagaacctgactgacctcgtcgtggacaccgatacattaggtgagtccacgcagcctcaacgcgaaggggctcaggtacccactggaagagagcgcgaacagcacgtcggcggaaccaaggactccgaagacaactatggagattctgaggacctggacctgcaggcaacacagtgctttctcgagaatcagggcttagaggccgtacagagcatggaagacgagccaacgcaggcctttatgctaactccgccacaggaactgggtcctagccattgctcgtttcaaactacagggacactggatgagccgtgggaggtgctggctacccagccattctgcctgcgagaatccgaggacagtgagacgcagccttttgacacacacctcgaagcctatgggccttgtctctcccctccgcgagccattcctggagaccaacacccagaatccccggtccataccgagcccatgggtatccaaggcagaggacgacagacagtcgataaggtcatggggatccccaaggagaccgcagagcgcgtcggcccagaacgaggcccactggagcgggaaacagaaaagctgctgcccgagcgacagacagatgtgacaggagaggaggagctcaccaaaggcaagcaggatagggaacagaaacagctgctcgccagagacacgcaacgacaagagagtgataagaacggggaatctgcctctcctgaacgtgatagagaaagtctcaaggtggagatagagacctcagaggagattcaagaaaaacaagtacagaaacagacacttccaagcaaggcttttgaaagggaagtggaacgaccagtcgccaatcgggaatgcgacccagccgagctggaagagaaggtgcctaaggtcatcctcgagagggacactcaacgaggggaacctgaagggggtagccaagaccagaaaggccaagctagctccccaactccggaaccaggagtgggtgctggagatctgccgggacccactagcgcccctgtgccttcagggagccagtctggagggaggggatcaccagttagcccgcgtaggcaccagaaaggcctgttgaactgcaaaatgcccccagctgagaaggcttccagaatcagggcggcagaaaaggtctctcggggagatcaagaatccccagatgcttgcctgccaccaacggtccccgaagcaccggctccacctcagaagccccttaattcccaaagtcagaagcacttggccccacccccattgttgagtccgctgctgccttctattaaacctactgtccggaagacccgacaggacggatctcaggaagctccggaagccccattgtcctccgagctggagcccttccatcctaagcccaaaatccgcacaaggaaaagcagcagaatgaccccattcccagccactagcgctgcgccagaaccccatccctcaacgagcacagcgcagcctgtgacaccgaagccgaccagtcaggccacccgatccaggacaaaccgaagctcagtaaagactcctgagcctgtcgtgcccaccgcaccagagctccagccttctacttctacagaccagccagttaccagtgaaccaaccagccaagtgacacgcggacggaaaagccggtctagcgtgaagacaccagaaacagtagtgccaacggctttggagctccagccttccacttcaacggacagaccggtgacctccgaaccaacttcacaggccactagaggcaggaaaaatcggtccagcgtgaagactcccgaaccagtcgtgcctactgcacccgaactgcagccatccacatccaccgatcaacctgtaacttccgagccgacctatcaggcgacgcgcggacgtaagaaccgctcctcggtgaagactcctgagccagttgtccccaccgcacccgagctgcgcccatccacctcgacggataggccagtgacccctaaacctacgagtaggacaacacggagcagaactaacatgagtagcgttaagacacctgagaccgttgtgccgaccgctccagagttgcagatctccacctccactgatcagcctgtcacccctaaacccaccagcagaacaactagatccagaaccaacatgagtagcgttaagaatccagagtcaacagtgcctattgcaccggagcttccaccttcgacatccaccgaacagcccgtgactccagaacccacatctcgggctaccaggggacgcaaaaaccgctcatcggggaaaaccccagagaccttagtgcctaccgctcctaaactggagcccagtacaagcaccgatcagcctgtgaccccggaacctacgtcacaggctaccagaggccgaaccaaccgtagcagtgtaaagacccccgagaccgtggtccctaccgccccagagttgcaaccatccaccagcaccgaccagcctgtgacgccagaacctacgagtcaagccacgcggggacggacggaccggagtagtgtcaaaacaccagaaaccgtagtgccgacagctccagaactgcaggcctctgctagcaccgaccagccagttacgtcggaacccacatcgcgtacaaccagaggacgaaaaaacaggagctccgtcaagacccccgaaaccgttgtcccagctgcccctgagctgcagccatctacttccacagatcaacctgtaactcccgagccaacaagcagggcgacccgtggccgaaccaacagatcctctgttaaaacacctgagagcattgtgccgatcgcccctgagttgcaaccatctacgagtcgtaatcaactggtcacgcctgagcccaccagccgcgctacccgctgtagaacgaataggtctagcgtcaagacccctgagccggtcgttccaaccgcaccagagccccacccaactactagtacagaccagcccgtgacccctaagttaacatcccgtgccactcggaggaagacgaacagatcgagtgtgaagaccccaaaaccggttgaacccgctgcctccgatctcgagcccttcactccgacagatcagtcggtgacccccgaggccatcgcgcaaggaggtcagagtaaaacccttcgttccagcactgtcagagctatgccagtgccaacgactccagagttccaatctcctgtgacaacagatcaacccatctcccctgagccgattacacagccctcatgcatcaagaggcagcgtgccgctggtaatccgggtagtctcgctgcacccattgaccacaaaccctgctctgccccactggagcccaaatcacaagcgtcaagaaatcagcgctggggagccgtcagggccgcagagtcactaaccgccattccggagcccgcatccccacaacttctggagactccaatccacgcgtctcagatccaaaaggtcgagcccgctggaagatcccgcttcacaccagaattacaaccaaaagcttcacagtcacggaagagaagtctcgcaacgatggatagccctcctcatcaaaaacagccacaacgcggtgaggtttcccaaaagaccgtgattatcaaggaagaggaagaggataccgccgagaagcccggaaaagaagaagatgttgtcactcccaagcctgggaaacggaagagagatcaggcggaggaagagccaaaccgtatccctagccgctctctccgacgtactaaactgaatcaagagtccactgcccctaaggtcctgtttaccggtgttgtggatgccaggggggagagggcagtcctcgctctaggaggcagcctcgctggttccgccgcagaagccagccacctggtcactgatcgcatcagaaggactgtaaagtttctgtgtgccctcgggagaggcatccctatcttgtcgttggactggttacaccagtcccgcaaagctggattctttctgccccctgatgagtatgtggtgaccgaccctgagcaagaaaagaattttggattttcactgcaggatgctctgtctcgcgctagagagagacggctgctcgaaggatacgaaatttacgtaacacccggtgtacaaccaccccctcctcagatgggcgagatcatcagctgctgcgggggaacatacctgcctagcatgcctcgatcatataaaccccagcgggtagtgatcacttgtcctcaggattttccacattgctccatccctttgagagtcggactgccactgttgtccccagaattcctgctgaccggggttctcaaacaggaggccaaacccgaagcattcgtgctgtcacccctcgagatgagttcaaccta

SEQ ID NO: 229921 - DNA, 735 bp, Artificial Sequence
  Description of Artificial Sequence: Synthetic coding sequence
atggaggacacccaagctattgattgggacgtcgaagaggaggaggagacggaacagtcctccgagtctctccgctgcaatgtagagcccgtgggcagactgcacattttctctggcgctcatggtcccgagaaagacttcccactccacttgggcaaaaatgttgtcggtaggatgccagattgttccgtcgcactacctttcccatcaatttctaaacagcatgccgaaatagagatactggcttgggacaaggcacccatcctgcgggattgtggctccctgaatggcacgcaaatcttgagacccccaaaggttctttctccgggagtatcccatcggctcagggaccaggagctgatcctttttgctgatctgctgtgtcagtatcatcgcctggacgtgagtctgccctttgtgtcccgaggacccttgaccgttgaagaaacaccccgtgtgcagggtgagactcaaccccaaagacttctgctagcagaggactcagaagaagaagtagatttcctgtccgaacgccgaatggtaaagaaaagcagaaccacttcatcgtctgtgatcgttccagaaagcgacgaggagggccactctcctgtcttggggggactggggcctccttttgcctttaacttgaacagcgacaccgacgtggaggagggacagcaaccacatcggggagggctattatcatgtcaaaagcgatgtcactgccgaggctag

SEQ ID NO: 229922 - DNA, 384 bp, Artificial Sequence
  Description of Artificial Sequence: Synthetic coding sequence
atggaggacacccaggcgatcgattgggatgtagaggaggaggaggagactgagcaatcttcagagagcctgcggtgtaatgtggaacccgttggacggctccacattttcagtggggctcacggccctgaaaaggacttccctcttcacctcggaaaaaatgttgtgggacgcatgccagattgttctgtggcactgccatttccctctatttccaaacaacacgccgaaatcgagatcctcgcttgggataaggctcctattttgcgggactgcggctccctgaatgggactcagatcctcagacccccaaaggtactgtcaccgggagttagtcatcgcctgcgagatcaggagttgatccttttcgcagatctgctttag

SEQ ID NO: 229923 - DNA, 342 bp, Artificial Sequence
  Description of Artificial Sequence: Synthetic coding sequence
atggaggacacacaagctatcgactgggacgtggaagaggaagaagaaactgaacagagttcagaaagcttgaggtgcaatgtggagccagtcggacgtctgcacatcttctccggtgcacacggaccagagaaagactttcccttgcatctaggcaaaaatgtagttggcaggatgcccgattgttctgttgctttgcccttcccatctatcagcaagcagcatgcggagatcgagatcctcgcatgggataaagctccaattctgcgagattgtggatcgcttaacgggacccaaatcctgaggcctcccaaagtgctatcccctggtgtttcgcactag

SEQ ID NO: 229924 - DNA, 5408 bp, Artificial Sequence
  Description of Artificial Sequence: Synthetic coding sequence
atggaggacacccaggccatagactgggacgttgaggaggaagaggaaaccgagcagagctcagagagcctgcgctgcaacgtagagcccgtggggaggcttcacattttttccggcgctcacggcccagagaaggacttcccactccatctggggaaaaatgttgtcggtcggatgcccgattgcagtgtggctctgccattccctagtattagtaaacagcacgctgagattgagattctggcttgggacaaggcccctatcctcagggactgcggatcattgaacggcactcagatcttaaggccccctaaggtgttaagtcccggtgtgagtcaccgcttgcgggaccaggaactgattctgttcgcagatctgctgtgccaataccatagactggatgtcagtctccccttcgtatcacggggaccattaactgtagaggagactccacgagtgcagggcgagacccagcctcagagacttctgttggccgaggactccgaggaggaagtcgacttcctgtccgagcgcaggatggtcaaaaagagcaggaccacatcctcttctgttattgttcccgagagtgatgaggaggggcacagccccgtgctggggggactgggtcccccatttgcctttaatctgaactctgatacagacgttgaggagggtcagcagccagctacggaagaggcctcatccgctgcccgacgcggtgccaccgtggaggcaaagcagagtgaggctgaggtcgttaccgaaatccagcttgagaaggatcagccactggttaaagaacgggataacgatacaaaggtcaaacgcggtgccggtaacggcgttgtacctgcgggagtaatcctggagcggagccaacctccgggagaggatagtgacacagatgtggacgatgattctagacccccaggtaggcctgcagaggttcatttagagagggcgcaacccttcggtttcatagatagtgacactgatgccgaggaagaacgaatccccgctacgcccgtcgtgatacctatgaagaaaaggaagatctttcacggcgtaggcacacgtggccctggagcaccaggcctggctcatcttcaggagagtcaggcgggttcagacactgacgtcgaggagggaaaggcaccccaggcagtaccactggaaaagtcacaggcgtccatggtgatcaacagcgataccgacgacgaagaggaagtgagcgcggcactgaccttagctcacctgaaggaatctcagccggctatttggaatagagacgccgaagaggatatgcctcagcgggtagtgctcttgcagcggagtcagaccactactgagagagattccgacacagacgtcgaagaggaggagttgccagtggagaatcgggaagcagtgctgaaagatcacactaaaatccgagcgcttgtccgtgctcactcagagaaggaccagcccccatttggcgacagtgatgattcggtcgaggccgacaagagttcccctggcattcacctcgaacgcagtcaggccagcactaccgtggacatcaacacacaggtagagaaggaggtccctccagggtcagccatcatccatattaaaaagcaccaggtatcagtagaaggcaccaatcagactgacgtgaaagctgtgggcggtccagctaaactcctcgtggtgtcactcgaggaggcctggcccctgcacggagattgcgagactgacgcggaagaagggacaagtctaaccgcaagcgtggtggccgacgtgagaaaatcccagctgccagcggagggggatgccggagcggaatgggcagctgcggttctgaaacaggaaagggcgcacgaggtaggcgctcagggcggaccacccgtcgctcaggttgagcaggatctgcccatttcccgtgaaaatcttacagacctggtggtagacacagacacattgggcgagtctacgcagccacagagagagggtgctcaggtgcctacaggcagggaacgggagcagcacgtgggagggaccaaggactcagaggataattatggcgattctgaagatttggatctgcaagccacacagtgctttctagagaaccagggcctcgaggctgttcaatccatggaagatgagcctacgcaggccttcatgctgactcctcctcaggaactgggaccgagtcattgctcattccagaccactgggacactggacgaaccgtgggaggtcttggcgacccagccattctgcctgcgggagagcgaagattccgaaactcagcccttcgatacccatctcgaagcttatgggccatgtctgtcgcctccacgagccatccctggcgaccagcaccccgagtcaccagtgcatactgagccgatgggaatccagggacggggtcgccaaaccgtggataaagtgatggggatccccaaggaaacagctgaaagagtgggtcctgagcggggtcctctggaaagagaaaccgagaagctgctcccagaacgccagaccgatgtcactggggaagaagagctcaccaaaggaaagcaggaccgcgaacaaaagcagctgctggcaagggatacccaaaggcaagaatcagataagaacggagagtcagcatctccggagagggatcgtgaatcgctgaaagtcgaaatcgagaccagcgaagagatccaggaaaaacaagtgcagaagcaaactctcccatcaaaggccttcgaacgcgaggtggagcgacctgtggccaatagagagtgcgatccagccgaactggaggagaaggtgcccaaggtcatcctggaacgcgatacccagcgcggagagcctgaaggaggctcacaggatcagaagggccaagcctcctctcccacaccagaaccaggtgttggagctggggatctccctggcccaacttcagctcccgtcccctcgggctcccaatccggcggaaggggctcacctgttagtccacggcgacaccagaaggggctgctcaactgcaaaatgccacctgctgaaaaagcatcccgcataagggcagctgagaaggtatcacgaggggatcaggaatcgcctgacgcatgtctcccaccgactgtgcccgaggcaccagctcccccacagaagccccttaacagtcagtctcagaagcacctcgctccaccaccactgctatcacctctgcttccttcaatcaagcctaccgtaaggaagacccgacaggacggctcccaggaagcccctgaggcaccattgtcctctgagctggagcctttccatcctaagccgaaaattcggactaggaagagtagcagaatgacccccttccccgcaacatccgccgcacctaagttagagccaagtacatccaccgatcagcccgtcaccccagagccgacatcacaagccacacgcggaaggaccaaccggtcttctgttaaaacaccagaaaccgttgtgccgactgccccagagcttcagccaagcactagtactgatcaacccgtgacccccgaacccactagccaggcaactaggggccgaactgaccgcagtagcgtgaagacacctgaaacagtggtgcctacggcccctgagctgcaggcatctgccagcaccgatcagccagtcacatcagagcccacttctagaacaacccggggtagaaaaaacaggtcttccgtgaagactcctgagaccgtagtcccagccgctccagagctccagccctcaacaagcactgaccagcccgtcacacctgaaccaacatctcgtgcaacgcgcggaaggactaatcgaagttctgtgaaaacacccgaatcaatcgtcccaatcgcacccgagctgcagccatccacgagtcggaaccaattggtgacaccagagcccacaagtagagcgacccggtgccgcactaaccgctccagcgtcaagacgccagaaccagtggtacccactgcccctgagccgcatcctaccacatcaacggatcagcccgtcacacctaaactgacatccagggctacacgaagaaagactaatcgttccagtgtgaagacccctaagccagtggagcctgccgcttccgacctcgaaccgttcacaccgacagaccagtccgtaactcctgaagctatcgcccagggcggacagagcaaaacccttagatcctccactgtgcgggcaatgcctgtacccaccacgccagaattccagtccccggttactaccgaccagcccatctcacccgagcccattacacagccttcatgtatcaaacgccagcgagccgcagggaaccccggatctctcgcggctcctatcgaccacaagccctgttctgcccctctggagccaaaaagccaggcttcgaggaatcaacgatggggtgccgtgcgggctgccgaatccctcacagccatccccgaacccgctagcccacaactgctggaaacaccaatccacgccagtcaaatccagaaagttgagcctgctggacgatccagattcactcctgagctccagcctaaagcgtcacagtccaggaaacgaagcctggcaacaatggatagccctcctcaccagaagcagcctcagaggggcgaggtcagccagaagactgtgatcataaaagaggaagaagaagatacggccgaaaagcccggtaaggaagaagacgtggttacgccaaagcccggaaaacgaaaacgggaccaagctgaggaggagccaaatagaatcccttcccgctctctgagacggactaagctgaatcaagagtcaactgcccctaaggtgctcttcacaggcgtcgtggacgctagaggtgaacgcgcagtgctcgcactggggggatctctggccggttccgcggctgaagcgtcacacctggtgacagacaggatacggaggactgtgaagtttctctgtgccctaggtcgcggaattccgatattgtccttggactggctccatcagtctaggaaagccggatttttcctcccacctgacgagtatgttgttacagacccagagcaggagaaaaatttcggcttctctctgcaagatgctctgtcacgagccagagagagacgactgctcgaaggatacgaaatctacgtgactccaggagtgcagcctccacctccccagatgggggaaattatatcctgctgcggcggaacttacctgcccagtatgcctcgctcctataaaccgcaacgagtggttatcacctgccctcaggacttccctcactgttcaattcccctgagagtggggctacccctgctttcgccagagtttctgttgacaggggtgttgaagcaggaggccaaaccggaggccttcgtcctgtccccactggaaatgagctcgacata

SEQ ID NO: 229925 - DNA, 735 bp, Artificial Sequence
  Description of Artificial Sequence: Synthetic coding sequence
atggaagacactcaggccatagattgggacgtggaagaggaagaagagacggaacagtcaagcgagagcctgcggtgcaacgtggaaccagtggggcgtctgcatattttcagcggggctcatggacctgagaaggacttccccttacacctcggtaaaaatgtggtgggacgaatgcctgactgcagcgtcgccctaccatttccctccatttcaaaacagcacgccgaaatcgagatcctggcctgggacaaggcaccaatcctgcgcgattgtgggagcctgaatggcacgcagattcttagaccgccaaaggtcctgagccccggtgtcagtcaccgactccgggaccaggaactgattctttttgccgacctgctgtgccagtatcacaggcttgacgtgtcactacctttcgtgagtcgagggcctttgacagtggaggaaacgccccgagtacaaggagagactcagccgcagcgccttttactggccgaagacagtgaggaggaggtggactttctttccgagcggagaatggtaaaaaaatccagaactacaagctccagcgtcattgtacctgaaagcgacgaagaaggtcactcccctgtcctaggagggctgggacccccttttgcctttaacttgaactctgataccgatgtcgaagaaggtcagcagccacacaggggaggcttactgtcctgccagaaaaggtgtcattgtcgaggctag

SEQ ID NO: 229926 - DNA, 5408 bp, Artificial Sequence
  Description of Artificial Sequence: Synthetic coding sequence
atggaagacacacaggcaattgattgggatgtcgaagaggaggaggagacagagcagagcagcgagtcactgcgatgcaacgtggagcctgtaggcagactgcatatattcagtggtgctcacggccctgagaaggacttcccactgcacctgggaaaaaatgttgtgggcaggatgcccgactgcagcgtggccctccctttccccagcatctcgaagcagcatgctgagatcgaaattctagcttgggacaaggcgcctatcctaagggattgcggcagcctgaatggcacccaaattctacgtcccccaaaagttctatccccaggcgtcagccacaggctgagagaccaagaactcatattgttcgctgacctcttgtgccagtatcacagactcgatgtgagtttaccttttgtctcgaggggacctctcacagtggaggagacccctagggtgcagggcgagacccagccgcagaggctgctgttagccgaggactccgaggaggaagtcgactttctctccgaacggcgtatggtcaagaaatcccgtactacaagtagctctgtgattgttcctgagagtgatgaggagggacatagtcccgtgctcggaggtctgggacctcccttcgctttcaacctcaacagtgacactgacgtcgaggaggggcagcaacctgccacagaggaagccagcagtgctgcaagacggggagccaccgtcgaggccaagcagtcagaggccgaggtggtcaccgagatccagctggagaaggaccagcctctggtaaaggagagggataacgatacgaaggtgaagcggggagccggtaatggagtggtgccggcaggcgtgatcctcgaacggagccagccacccggagaggactcggatacagacgttgacgacgattcgaggcccccaggtcgacccgctgaggtccacctcgagcgcgctcagcccttcgggtttattgactctgatacagacgcggaagaggagaggataccagcaaccccggtcgtgattcctatgaagaagcgcaagattttccacggtgtgggaacaaggggacccggtgctccagggttagcccatttgcaggagtcccaggcaggatccgataccgacgtggaagaaggaaaagcaccgcaagccgttccgcttgagaagagtcaagcaagcatggtcattaactccgatacagacgatgaggaagaagtgtctgcggctctgacgcttgctcatttgaaagagtcacagcccgctatctggaatagagacgccgaggaagacatgccccaacgagtcgtcctcctgcaaagaagccagaccactacagagcgagactctgacaccgacgtggaggaggaggagcttcccgttgagaatagggaggcagtcctgaaagaccacaccaagatcagggctctggtccgtgctcacagtgaaaaggatcagccccctttcggtgattcagacgacagcgttgaggctgataaaagttcaccgggaatacatctcgagcgatcacaggctagcactacagtcgacatcaacacacaggtggaaaaagaggttcctcctggctccgccatcatacatataaaaaagcaccaagtgagtgtcgagggaacaaaccaaaccgacgtgaaggccgtgggcggaccggctaagctcctagtggtgtctctcgaagaggcctggcccctgcacggtgattgcgagacagatgccgaggaggggacctccctgacagcatctgttgtcgctgatgtgcgtaagtcccagctgcctgccgagggtgatgccggtgctgaatgggccgcagcggtcctgaagcaggagcgggcacacgaggtcggggcacagggaggtccccctgtggctcaggtggagcaggatctgccaatctccagggaaaatctgactgacctggtagtggacacagatacactgggcgagagcacccagcctcagcgcgaaggggctcaggtgcccacaggaagggaaagagaacagcacgtcggcggaactaaggactcagaagataactacggggactccgaggacctggatcttcaagcaactcaatgttttctcgagaatcaggggcttgaggccgtgcagtccatggaagacgagccaacccaggcgttcatgctgactcccccacaggaactgggcccaagccactgttctttccagactaccggaacgctggacgagccatgggaggttcttgcgacccagcccttctgcctccgcgaatcagaagattctgagacccagccctttgacacccacctcgaggcctatggcccatgccttagtccaccccgtgccatcccgggagaccagcaccccgagtcgcccgtgcataccgagccaatgggcatacagggccgaggtaggcaaactgtggacaaggtgatgggtattcccaaggagactgcagagcgagtcgggcctgaaagggggccacttgaacgagaaaccgaaaagcttctcccagaacggcagacagatgtgaccggggaagaggagctaacgaagggcaagcaagaccgggaacaaaaacaattactcgctagagatacgcagaggcaagagtcagacaaaaacggggaatctgcttctcccgaacgggatagggaatctctgaaagtcgagatcgagactagcgaggagatacaggaaaagcaagtgcagaagcaaaccttacctagcaaggcattcgagagggaagtggaacgtccggtggcaaaccgcgaatgtgacccggctgaactggaggagaaagtgcccaaagtcatccttgagagggacacacaaaggggagagcccgaaggcggaagtcaagaccagaaggggcaggcctctagtcccacccccgaaccaggtgtcggagctggcgacctgcccggtcccacaagcgctcctgtccccagcgggagccagtccggcggaagaggatcacccgtgtcccctcgaaggcaccaaaaggggctgttaaattgtaaaatgcctcccgctgagaaggcttccagaattagggctgcagagaaggtgtccagaggcgatcaggagtctcccgacgcgtgtctccctccaactgtgcctgaagccccagcgccacctcagaaacctctaaacagccaatcccagaaacacctagcacctccccctttattgagccccctgctgccaagtataaaaccaaccgtccgcaagacgaggcaagatggctctcaggaggcccctgaggcccctctctctagtgagttagagccattccatccgaagccgaagattcggactcgaaagagttccagaatgacaccgtttccagctacatctgctgccccaaagctcgaacccagcacatctaccgaccagccagtcaccccggagccgactagtcaggccacccgtggtcggacgaaccgaagttccgtaaagactccagaaacggtagtgccaaccgctcccgagcttcagccaagtacatctaccgaccagcccgtgacacccgaacctacatcgcaagcaaccagagggagaactgataggtcaagcgttaaaacaccagaaactgtagtccctacagcacccgagctgcaagccagtgcaagcaccgatcaacccgtgacgagcgagcccacctcaaggacgacccggggtagaaaaaaccggtcatctgtgaaaaccccagaaaccgtggtgcctgcggctccggagctgcagccgagcacttccacagaccagcctgtaacgcccgagcccacttcacgggctactagagggaggaccaataggagctcggtcaagacgcccgagtccatcgtgccgatcgctccagagcttcagcctagtactagtcgcaaccaactggtcacaccagaacctacttcccgggctacaagatgtcgcacgaaccgcagctcagtcaaaacacccgaacccgtggtgcccacagccccagagccacatcctacgacctcaaccgatcagcctgtaacacccaagctcaccagccgggcaacaaggcgcaagactaaccggtccagtgttaagactccaaagcccgtggagccagccgctagtgatctggagcctttcacgcctacggatcagtccgttaccccggaggccatcgcccaggggggtcagtccaagactttgaggtcctccaccgttagagcaatgcctgtgcctaccacccctgaattccaatcccccgtcaccacggatcagcctattagtcccgagcctattacacagccatcctgtatcaagcgtcaaagagcggcaggaaacccaggctccctggctgcacccatagatcacaagccgtgtagcgcacccttggagccaaaatcccaggccagtcggaatcagcgctggggcgctgtaagagccgctgaaagtctgaccgccataccagagccagcttcccctcagctgctagagacacctatccacgccagtcaaatacagaaagtagagcctgctggaaggtcacgcttcactccagagcttcagcccaaagcaagccaatccaggaagcgttccctggctaccatggacagtccccctcaccagaaacaaccccagagaggagaagtgtcacagaaaactgtgatcatcaaggaagaggaagaggacaccgccgaaaaacccggtaaggaggaagatgtagtcactcctaagccgggtaagcggaagcgtgatcaggccgaggaagagcccaatagaatacccagcaggtcccttcggcgaacgaagcttaaccaggagtctacagcccctaaagtgctctttacgggtgttgttgatgcccgtggggaacgggctgtgcttgccctaggcggtagcctagcaggatcagccgctgaagcctcccatttggtcactgacaggatccggagaacagtgaaatttttatgtgcactgggacgaggcattccaatcctcagcttggactggctgcaccaatccagaaaagctggcttcttcctcccccctgacgagtacgtcgtaaccgatccagagcaggagaaaaattttgggtttagtctacaggatgcactgagtcgcgcaagggagaggcggttgttggagggctatgagatttacgtcaccccaggagttcagcccccaccgcctcagatgggtgaaatcatatcttgttgcgggggaacctatctcccaagcatgcccaggagctataagcctcaacgggtggtgatcacctgcccccaggacttcccccattgctctatccctctccgcgtgggcttgccgctcttaagtcctgaatttctgcttacaggggtgctgaagcaagaggccaagccagaggcttttgttctgagccccctggaaatgagctctaccta

SEQ ID NO: 229927 - DNA, 735 bp, Artificial Sequence
  Description of Artificial Sequence: Synthetic coding sequence
atggaagacactcaggcaattgactgggacgtggaggaagaggaggaaactgagcagtcttctgagagccttcgctgcaatgtcgagcctgtcgggcgacttcatatcttcagtggcgctcatgggccagagaaggacttccccctccacttgggtaagaatgtggtcggcagaatgcccgactgcagcgttgcccttccatttccctcgatcagcaagcagcatgctgagattgagattctagcttgggacaaggctccaatcttaagggattgcgggagcctaaacgggacacagatcctccgtcctccgaaggtgttgagcccgggtgtgtcgcacaggctccgcgatcaggaattgatcttgttcgcggatttactttgtcaataccatagacttgatgtatctctaccattcgtctcacgtggtcctctcaccgtggaagagacacccagagtgcagggggaaacccaaccacagagactcctgctagcggaggactccgaagaagaagtcgacttcctctcagagcgccgaatggtgaaaaagagtcgtacgacttcatcgtcagtgatagtacccgaatctgacgaggaaggccatagcccagtgctgggaggcctaggtccgcctttcgcctttaatttgaactccgacacggacgtggaggagggacagcagcctcacagaggaggactcttatcttgccagaagaggtgtcactgtcgcggatag

SEQ ID NO: 229928 - DNA, 735 bp, Artificial Sequence
  Description of Artificial Sequence: Synthetic coding sequence
atggaggacacacaggccatcgactgggatgttgaagaagaagaagagaccgaacagagcagcgagagtctccgctgcaacgtggagcctgtgggtagactacatattttttcgggggctcatggccctgaaaaagacttccctctgcacttgggaaagaatgtcgttggccgaatgcccgactgtagcgtggctctgcccttcccatctatttcaaaacaacatgccgagatcgagattctcgcatgggacaaagcacctatcttaagagactgcggatccttaaacggcactcagatcttgaggccccctaaagtgctgtcaccaggcgtttcccacaggctccgggatcaggaactgattctgtttgcagatctactttgtcaatatcacaggctggatgtgtccttgccattcgtctctcggggtccactgaccgtggaggagactccgagagtacagggggaaactcagccccagcggctgctgctggcagaggacagtgaggaagaggtggactttctctcggaacgccgtatggtgaagaagtctagaaccactagctcaagtgtgatcgttccagaaagcgatgaggaaggccactcccccgttctgggaggactcggaccaccattcgctttcaacctgaatagtgataccgatgtagaggagggacagcaaccacaccgcggaggtctgctctcgtgccagaagagatgccactgtagggggtag

SEQ ID NO: 229929 - DNA, 738 bp, Artificial Sequence
  Description of Artificial Sequence: Synthetic coding sequence
atggaggacacacaagctatcgactgggacgtcgaagaagaagaagagactgaacagtcgagtgagagtctgagatgcaatgtagagccggtaggtcggctccatattttttcaggcgctcatgggccagagaaggactttccgcttcatttagggaaaaacgtggtgggcagaatgcccgactgcagtgtggctctacctttcccttctattagcaagcagcatgccgaaatcgagattctcgcatgggacaaagcaccaatcctcagggactgcggatccttaaacgggacccagattctgcggccacccaaggtgttgagccctggtgtgtcacaccgccttcgcgatcaggagctcattctgttcgctgatctgctttgccagtaccatcggttggacgtgtcattacctttcgtgtctagaggacccctaactgtggaggagactcccagggtgcagggtgaaacacagccccagcggctactcctcgccgaggatagcgaggaggaggttgatttcctgtccgaaaggcgtatggtcaaaaagtctaggactaccagttccagtgtgatcgtgccggagtctgatgaagaggggcatagtcccgttctgggcggtctgggtccaccatttgccttcaatttgaactcggatacagacgtcgaggagggccagcagccagccaccgaggaggcatcctctgccgctaggaggggggctacagtagaggcatag

SEQ ID NO: 229930 - DNA, 5477 bp, Artificial Sequence
  Description of Artificial Sequence: Synthetic coding sequence
atggaggacacccaggctatcgactgggacgtggaagaggaagaagagacagagcagtcttccgaaagtctgcggtgtaatgtggaacccgtggggagactgcacattttctctggagcccatggacctgagaaggacttcccccttcacctcggcaagaatgttgtcggacggatgcctgattgtagtgtggcactccccttcccgagcattagcaaacaacatgctgagattgaaatcctcgcatgggacaaagctccgatactccgagattgcggatccctgaatggtactcagatattgagaccaccaaaagtgttgtcgccgggtgtgtcccatagattacgcgaccaggagctcatactctttgccgatcttctgtgccagtatcaccgtctggacgtctccctgcccttcgtctccaggggtcctctcactgtagaagagaccccccgagtccagggagagacccagccccagaggcttctccttgcagaggatagtgaggaggaagtggattttctgtccgagcggaggatggttaaaaagagtcgcaccaccagttcatccgtcatcgttcccgagtccgacgaggagggccacagccccgtgctgggaggcctcgggccaccttttgcctttaacctaaacagtgatacagatgtcgaagagggccagcaaccagccacagaagaagcgagcagcgcggcacgtcgcggagccacagtggaggcaaagcaaagcgaagcggaagtggtgacggagatccagctcgagaaggatcaaccactggtgaaagagcgtgacaatgatactaaggttaagcgcggagcgggaaacggggtggtgccagctggggtgatcctggaaagatcccagcctcctggggaggactccgacactgacgttgatgacgactctaggcctcccggtcggccagcagaggtgcacttggagcgagcccagcccttcggatttattgacagcgatacagatgctgaagaggagcggattcccgctacacccgtggtcattcccatgaaaaaaagaaagatatttcacggagtgggtacccggggtcctggcgcaccaggccttgcgcatctgcaagagtcgcaggcaggctcggacactgacgtggaggagggcaaggccccacaggcagtgcctctggagaagtcccaggcttctatggtgattaactccgacacagatgatgaagaagaggttagtgccgcacttactctggcacacttgaaagagtcccaaccagcaatatggaacagggatgcggaagaagacatgcctcaaagggttgttctgctgcagcggagccagaccacaacggaacgagatagtgacaccgatgtggaggaagaagagctgccggtggagaaccgggaggctgttctgaaggatcatacaaaaatccgggctctggtgcgggcacactcagaaaaggaccagcctcctttcggcgatagtgacgactcagtggaagcagacaagtcgtctccaggcatacatctggagagatctcaggccagcaccacagttgacatcaacacccaggtcgaaaaagaggttcccccagggtccgcaatcattcatataaaaaagcatcaggtaagcgtcgaaggcacaaaccagacggacgtgaaggctgtcggaggaccagccaagctcctggtggtcagtcttgaggaagcctggccactccacggagactgtgaaacagatgcagaagagggtacttcattaacagcttcagtcgtggcagacgttcgtaaatctcagttacctgccgagggagatgccggagcagagtgggcagctgccgtgctaaagcaggagagggcccatgaagtgggagcacaggggggtccacccgtggcacaagtcgagcaggacttgccaatctctcgtgagaaccttactgatctcgtggtcgacactgatacactgggcgaatcaacgcagccacaaagagagggagcccaggtccccacggggagggagagggagcagcacgtcggaggaactaaagatagcgaagataattatggtgactcagaggatctcgatctgcaggcaactcagtgcttcctcgagaaccaaggactggaggctgtccaaagtatggaggatgagccaacacaggcgttcatgttgacgccccctcaggaactcggacccagtcattgttcatttcagaccaccggattgctcaactgtaagatgccccctgctgagaaggcatcacgcatcagagctgctgagaaggtgtcgagaggtgatcaggagtccccagatgcatgcctgccacccactgtgccggaggcccctgcaccaccccagaagcccttgaattctcaatcacaaaagcatctagccccaccacccctgctgtcccctctacttcctagcataaagccgaccgttcgcaagactcgacaggacggatcccaggaggctccagaggcacccttaagtagcgaactggagcccttccacccaaaacccaaaatcaggacaagaaagagctctaggatgaccccctttccggcaacaagcgcagcacctgagccacacccttctacttcaaccgcccagcctgtgactcctaagcctacatctcaagctaccaggagcaggactaataggtcatctgtcaaaacccccgagccagtagtgccaacggctccagaactgcagccatcaacaagcactgaccagcctgtcacttctgaaccaacctcacaagttacacgaggacggaaatcgagaagctcagtcaaaacccccgagactgtggttccaactgcccttgaactacagcccagcaccagcactgaccgtcccgttacctcggaacccacctcgcaggcaactcgcggacgtaagaaccggtcgtcagtgaaaaccccggagcccgtggtaccgaccgcccctgaactccagccaagcacatctactgaccagccagtcacctcagagccgacataccaggctacccgagggagaaagaaccggtctagcgtgaaaactccggagcccgtagtgcctacggcaccagaattgagaccgtccacgagtacagatagacccgtaaccccaaaaccgacttcccgaacgactaggagtagaacaaacatgagctctgtgaaaacacccgaaacagtggtgccaacagctccggaactccagatctccacaagtacagaccagcccgtcaccccaaagccaacaagtagaacgacacgttctcggacaaacatgtcgtctgtcaaaaatcccgagagcaccgtgcctatcgcacccgagctgcccccatctacttctaccgagcagcctgtgactccggaaccaactagccgagccacccgagggcgaaaaaatagatcatctggaaaaactcctgaaacactcgtgccaacagccccaaagttggaacccagtacatctacagatcaacctgttactcccgagccaacgtcccaggcaactaggggacgcacaaacagatcttcagtaaagactccagagaccgtcgtccctactgctccagaactgcaaccctcgacatccaccgaccaacctgttactcccgaacccacctcacaggccaccagggggaggacggacaggagcagtgtgaagaccccagagaccgtcgtccccacagcccctgaactccaagctagtgccagtacagatcagccagtgacaagtgagcctacaagtcggacaacccggggtagaaagaacagatcgtcagtgaagactcctgaaaccgtggtacccgcagccccagaactgcagccttcaacctcaaccgatcagccagttacccctgaacccacatctcgcgctacccggggaagaactaatcggtccagtgttaagaccccagagtccatcgtgcccatcgctcctgagctgcagccaagcacctctcgaaatcagctggtgactcctgaaccaacttccagagccacacgatgccgaaccaaccgtagtagcgttaaaacccctgagcccgttgttcctactgcgcctgaacctcaccccaccaccagtaccgatcagcccgttacgccaaaactgactagccgcgctacccggagaaagacaaatcgctcttctgtgaaaacacctaagcccgttgagccagccgcttcggatctggagccatttactccaacagatcagtccgtgactcccgaggccatcgctcaaggcggtcagtctaaaaccctccgtagttcgaccgtgcgcgctatgcctgtacccacaactcctgaatttcaaagcccggttacaaccgatcagcccatatctcccgaacccattacccaaccgtcctgtatcaagagacaaagggccgctggcaaccctggcagccttgccgcacccatagaccataagccatgctccgcccctctcgaacctaagagccaagctagccggaaccagcggtggggcgcagtgcgcgcagccgagtctttgaccgccatccccgaaccagcctcccctcagcttcttgagacccctattcacgcttcacagatccagaaagttgagcccgctggcaggtcgaggtttacacccgagcttcagcctaaggcatctcagtctcgaaagcgctccttggctacaatggactctccacctcaccagaaacagccgcagcggggagaagtgtcccagaaaaccgttattatcaaagaggaagaggaagataccgccgaaaagcctggcaaggaagaggatgtagtgacccccaaacccggaaagaggaaacgagaccaagcagaggaggagccaaatcgtataccctctcgttccctgagacgcactaaattaaaccaggagtccacagcccctaaggtcctgtttacaggcgtggttgacgcgcgtggcgagagggccgtgctggcacttggtgggtcactcgcgggatcagccgctgaggcatctcaccttgttacagacaggatccggcgaacagttaagtttctgtgcgccctgggtaggggaatccctatcctcagcctggattggctgcatcagagtaggaaggccggattcttcctgcctccagatgagtacgtagtgaccgaccctgagcaggaaaaaaacttcggcttctctcttcaagatgcactgagcagggctcgcgaacgtcgtctgctggaaggctatgagatttatgtaacgcccggagtgcagcccccacccccacaaatgggagaaatcatttcttgctgtggcggaacttatctgccctccatgccacgttcctataagccacagagagtggtgattacctgtccgcaagacttccctcactgctcgatacctctacgggtgggtcttccattgctatcacctgagtttctgctaacaggcgtcctgaaacaggaggcgaaacctgaggctttcgttttaagccccttggaaatgtcttctacata

SEQ ID NO: 229931 - DNA, 738 bp, Artificial Sequence
  Description of Artificial Sequence: Synthetic coding sequence
atggaagacacccaggctattgactgggatgtcgaggaggaagaggagacagagcagtcctctgaatctttacgatgcaatgtggagcccgtcgggaggctgcacattttctcaggtgcacatggcccagaaaaagactttcccctgcacctgggaaaaaatgtggttggtaggatgccagactgctctgttgcattgccgttcccaagcatatccaagcagcacgctgaaattgaaatccttgcctgggataaggcaccaatattgagggactgcgggtcccttaacggaacacagatactgagacccccaaaagtactgtcaccaggtgtcagtcatcggttgcgggaccaggagcttatattgttcgccgacctcttatgtcaataccaccgcctagacgtctcactcccctttgtcagcagaggccctcttaccgtcgaagagaccccccgtgtgcagggtgagactcagccacaaaggcttctgctagcggaagattctgaggaggaggtcgactttctttccgaaagacggatggttaagaagtcaaggaccacatcgtcaagtgtaattgtacccgaaagtgacgaggagggacactcccccgttctgggcggactaggacccccatttgcttttaacctgaatagtgatacagacgtcgaggagggacagcagccagccacagaagaagcatcttccgctgccagacgaggcgcaactgtggaagcctag

SEQ ID NO: 229932 - DNA, 5408 bp, Artificial Sequence
  Description of Artificial Sequence: Synthetic coding sequence
atggaggacacacaagccatcgattgggacgtggaggaagaggaggaaactgaacagtctagcgagtctttgcggtgcaacgtggagcccgttggccgtcttcatatttttagcggtgcccacggcccagaaaaggacttccctctgcacctgggcaaaaacgtggtggggaggatgcccgattgttcagttgctcttcctttcccttcaataagcaagcagcatgccgagattgagatccttgcctgggacaaagcaccaatcctgcgagattgtgggtctctgaacgggacgcagattttgcggccaccaaaggtcctttcaccaggcgtgtctcatcgactgagggaccaggaacttattctgtttgcagatttgctttgccagtatcatagactggatgtgtcactgccatttgtcagcagggggccactgaccgttgaggagaccccaagggtccaaggggaaacacaaccacagagactgctgctcgccgaggattcagaggaagaggtagattttttgtccgagcggaggatggtcaaaaaaagccggaccacctctagctctgtgattgtccctgaatccgacgaggaagggcactcacccgtgctgggaggtttggggcctccctttgcctttaatctaaattcagacaccgatgtggaagaaggacagcaacccgctactgaggaagcctctagtgctgcccgacggggagcgacagtggaagctaaacagagtgaggctgaagtggtaacagagattcagctggagaaagaccagcccctggtcaaagaacgcgacaacgatacgaaggtgaaaagaggcgctggtaatggggtggtgcctgccggagtgatactggaacggtcacaaccgccaggcgaggacagcgataccgatgttgacgatgactctcgccctcccggtcggccagcagaagtccatctagagcgagcccagccattcggatttatcgattcagatactgatgccgaagaggagcgcatacctgcaaccccagtcgtgatccccatgaagaaacggaagatctttcatggagtcggtaccagggggccaggagcccctggcctcgctcacctccaagaatctcaggccggaagtgacaccgatgtagaagagggtaaggccccacaggctgtgcccctggaaaagtcacaggcatcaatggtcattaactcagataccgacgatgaggaagaagtcagtgccgctttgaccctcgcacatctcaaggagtcccaacctgctatatggaatcgggatgcggaagaggatatgcctcagagggttgttctcctccagcgctcccagacgacaaccgaacgcgactcggataccgatgtcgaagaggaggaactgccagtggaaaaccgcgaagccgtgctcaaagaccacacaaagatcagagctctcgtgcgtgcacatagtgagaaggaccagccaccttttggggattctgatgactctgtcgaagcagataagtcttcccccggtattcatctggaacgaagccaagcctctacaacagttgacataaatacccaggtggagaaggaggtgcctccaggatccgccattatccatatcaagaaacaccaggtgtcagtcgagggaactaatcaaaccgacgtcaaggcggtggggggaccggcaaagctactcgtggtgagtcttgaagaggcttggcctcttcacggagactgcgaaaccgacgccgaggagggaacgtcccttaccgccagcgtggtcgccgacgttcggaaaagtcagctccctgccgagggagacgcaggcgcagagtgggccgctgctgtacttaagcaggaacgggcacacgaggtaggcgctcaggggggtccacccgtcgcccaggtggagcaggatcttcctattagcagggagaatctcaccgatttagtggtggatacagacactctcggcgaaagcactcagccccaacgcgagggagcccaggtgccaacagggagagagcgcgaacagcacgtgggaggtacaaaggactcagaggacaactatggcgattcagaggacctcgatcttcaggccacccagtgctttttggagaatcaaggattggaggctgtccagtccatggaagacgagccaacgcaagcctttatgctgactccccctcaggagctgggcccaagccattgctcgtttcagaccactgggaccttagatgagccatgggaagttctggcaacccagccattttgcctacgcgagtctgaagacagtgagacccagccatttgacacccatcttgaggcctatggaccttgcctttcaccgccacgtgccatacccggagatcagcaccccgaatctccagtccacacagaacctatgggtatccaaggaagaggacggcaaactgtggataaggtaatgggaatccctaaagaaacagctgaaagagttggacctgaaaggggcccactcgagcgcgagaccgagaagctgctgccagagcggcagactgacgtgaccggagaggaggaattaactaaagggaagcaggatagggagcagaaacaactgcttgccagagatactcagcggcaggagagtgacaaaaatggtgaaagtgcctcccccgagagggaccgggagagtctcaaggtggaaattgaaaccagcgaggagattcaggagaaacaggtgcaaaagcaaacactgcccagcaaggcttttgagagggaggtcgagcggccagtggcgaacagggagtgcgatcctgctgagctggaggagaaggtccctaaagtgattctggaacgcgacacccagcgcggagagcccgagggcggatcccaagatcagaaaggacaggccagctcccctacccccgagccgggtgtaggtgctggggaccttccaggcccaacatcagccccagttccatcagggagccaatctggagggagaggctcacctgtgagtccacgtcggcaccagaaaggtctgcttaattgcaagatgccccctgcagagaaggcctcccggatcagggctgcagaaaaagtgtcgcgcggagatcaggagtcgccagatgcatgcctgcccccaacggttccagaggcccctgcaccaccccagaaacccctgaactcccagagccagaagcacttagctccgccacccctgctttcaccactgttacccagcatcaagcccacagtacgcaagactcgccaggatggttctcaggaagccccagaggcacccctgagctcagaactggaaccgtttcaccccaaaccgaaaattcggaccagaaagagttccaggatgacccctttccctgcaacttcggccgcaccaaagctagagccatccactagtacagaccagcccgtcactcctgagcctacctcccaggcaacccggggacggactaataggtcttctgtgaagaccccagagacagtggtaccaaccgcccctgagctgcagccaagcacgagcacagaccaacccgttacacccgaacccacctcacaggctacaagaggtcggacggacaggtccagtgtgaagaccccagaaacggtggttcctaccgccccagagctccaggccagtgccagtacagaccaacctgtgacaagcgagcctactagccgaactactcggggtagaaaaaacagatcctccgtgaagacacccgagactgttgtacctgcggcaccggagctccagccgagtacttcaactgaccagccagtcacgcccgagccaacctctagagcgactagaggccgaaccaacagatccagcgtgaagacccctgaaagtattgttcctattgctcctgagttacaacccagtacttcaagaaaccagctggttacacccgaacccacctctagagccacacgatgccgaacaaacaggtcatcagtgaagactcccgaacccgtcgttcctacagcccctgagccacaccctaccacctccacagatcagcccgtcaccccaaagttgacttcaagagcgacaagaaggaaaaccaacagatccagcgtgaagacccctaaacccgtcgagcccgctgcgtctgacctggaaccatttacccctaccgaccagtctgtgacccctgaagcaatagcacagggtggccagtcaaaaaccctacggagctccaccgtccgagccatgcccgtacccactacccctgaatttcagtctcccgtcacgaccgaccagccaattagcccagaacctatcacacagccttcgtgcataaagcgacagcgagcagcagggaaccctggatccctggctgccccaattgaccacaagccctgctcagctcctctggagcccaagtcccaggcgtccaggaatcagaggtggggagctgtaagagccgctgaatcgttgaccgctatccctgagccagcctccccccagctgctggagacaccaatacatgcgtcccagatccagaaggtggagcccgcaggacgctcacgcttcaccccagagctgcagcccaaggcatctcagagccgcaaaaggtcattggcaactatggattctcctccccatcagaagcagccacagcgcggagaggtctcacagaaaacggtgatcatcaaggaggaagaggaggacacagccgaaaagccgggaaaggaagaagacgtggtgacccctaaacccggaaagcggaagcgcgatcaggccgaagaagaaccgaaccgaataccgagtagatccctacgccgaacaaaactgaaccaggagtccactgcacctaaggtcctcttcacaggagttgtcgatgctcgcggtgagcgcgctgtgctggcacttggaggcagccttgccggaagcgcggctgaggccagccacctggtgactgaccgcattaggagaaccgttaaattcttatgcgccttgggcagaggcatccccatcctgagcctggactggctgcaccagagccgcaaagcaggttttttccttcctcccgacgagtacgtcgttactgatcccgagcaggagaagaacttcgggttctcactgcaggacgcattaagccgcgctcgagaacggaggcttctggagggatatgagatctacgtgactcctggcgtgcagccacccccacctcagatgggggagatcatctcctgttgtggcggaacataccttccttcaatgcccaggagttacaagccccaaagagtcgtaataacctgtcctcaggactttccccattgttcaatcccgcttcgggtgggtttgcctctgctgtctcccgaattcctgctgacaggcgtcctgaagcaagaagccaagcccgaagcttttgtactgtccccactggaaatgtccagcacgta

SEQ ID NO: 229933 - DNA, 738 bp, Artificial Sequence
  Description of Artificial Sequence: Synthetic coding sequence
atggaagatacccaggccatagattgggacgtggaagaggaggaagaaacagagcaatcatccgagtctctgcgctgcaacgtggaacctgtcggacgcttgcacattttcagtggcgcacacggcccagagaaggacttcccactgcacctgggaaagaacgtggtaggtagaatgcctgattgcagcgttgcgcttccattcccttccatctcaaaacaacatgccgagatcgagattcttgcctgggataaggcccctattcttagagactgcggcagtttgaatggcactcagattctcagaccacctaaggtgctgagcccaggcgtatcgcaccgattgcgagatcaggagctgatcttatttgccgatctcctttgccagtaccaccgactggatgtctcactgccatttgtcagcagaggcccactgactgtggaggaaactccacgggttcagggagagacgcagccacaaaggctgctcctagccgaggactctgaggaggaggtcgacttcttatctgaaaggcgcatggtgaagaaaagccgaacaacgtctagttctgtgatcgtgcctgaaagcgacgaggaggggcactcccccgtgctcggcggactgggtcccccatttgcttttaacttgaattcagatacagatgtggaggagggccagcagcccgcaactgaggaggcgtcctccgccgctcgtagaggcgctaccgttgaggcttag

SEQ ID NO: 229934 - DNA, 5408 bp, Artificial Sequence
  Description of Artificial Sequence: Synthetic coding sequence
atggaggatacccaggccattgactgggatgtcgaggaagaagaagagacagagcagtcttccgaatctctgaggtgtaatgtcgagcctgtaggacggctgcatatcttttctggggctcacggcccagaaaaggatttcccgctccatttggggaagaatgtggtgggtaggatgccggattgcagcgtggcactgccattccctagtatatcaaaacagcacgcagagatcgaaatcctggcttgggacaaagcaccaatcttaagggattgcggatcactcaacggtacacaaatactgagacctccaaaggtgctcagtcctggcgtttcccataggctccgcgatcaggaactcattctgtttgccgatctcttatgccaataccatcggttggacgtatctcttccatttgtaagcagaggtccactgacagtcgaagagacacccagagtccaaggagaaactcaaccccagaggttgctgcttgccgaagacagcgaagaggaggtagactttctaagcgagagaaggatggtaaagaagagtcggacgactagcagctctgtgatcgtgccagagtccgacgaggaaggccactcccccgttctgggcggattgggcccaccttttgcgttcaacctgaatagcgacacagacgtagaggagggccagcaacctgcaacagaggaggccagcagcgcagcccgaagaggggcaaccgtggaggcaaagcagtccgaggcagaggtcgtgactgagattcagttggaaaaggaccagccccttgtgaaggagagagataacgataccaaggtgaagcgcggtgccggaaacggggtggtcccggctggagtgatccttgaaagaagccagcctcccggagaggattcagatacagatgtggacgacgactcgcgccctcctgggcgtcctgctgaggtccacctggaacgcgcacaaccttttggttttatagactcagatacagatgccgaagaagagcgcattcctgcaactcctgtcgtgattcccatgaaaaagcgcaagatctttcacggggtcggaacaagaggccctggggcacctggtctggctcacttacaagaatcccaggccggttccgacacagatgtggaagaaggtaaggcccctcaggccgtgcctttagagaagtctcaggcttcaatggttattaatagtgatactgatgacgaggaagaggttagtgccgctctaaccctggctcatcttaaagaatcacagcctgccatttggaaccgagatgcagaggaggatatgcctcaaagggtggtgctcctccaaaggtctcagaccacgacagagcgcgatagtgacacggacgttgaagaagaggagctgccggtggagaaccgggaggcagtgcttaaagatcacactaagatccgggcactagtgagggcgcattcagaaaaggaccaaccacctttcggcgatagcgatgattccgttgaagcagacaaaagttcacccggaatacacctggaacggagtcaggcttctactacggtcgacataaacacacaagtagaaaaggaggtccctcctggctctgcaattattcatattaaaaagcaccaggtgtctgtcgagggaacaaaccagaccgacgtcaaggccgtcgggggaccagccaaattgctggtggtctcattggaggaggcttggcccctgcacggtgattgtgagaccgatgctgaggagggcactagtctgactgcatccgtcgtggccgacgtccgcaagagccagctgcctgctgagggtgacgctggagctgaatgggcagctgctgtgctgaagcaggaacgtgcgcatgaggtgggcgcacagggagggcctccggtggcacaagtggagcaggatctccctatttccagagagaatctgaccgacctagtcgtggatacagacacccttggcgaatccacccagccacaaagagaaggagctcaggtgccaacgggtcgggagcgcgaacagcatgtggggggtaccaaagacagtgaggacaattatggcgactctgaagatttggatctacaggccactcagtgctttctcgaaaaccagggactcgaggcggtgcagtcaatggaggacgaaccaacccaggcctttatgcttactcctcctcaggaactggggcctagccattgtagtttccaaacgacaggaaccctagacgaaccttgggaggtcctagctactcagcctttttgtttacgcgagtctgaggatagcgagactcagccttttgacacacatctagaggcctacggcccttgcctgtcgccccctagagccattcctggcgaccagcaccccgagtcaccagtgcacaccgaacctatgggtatccaaggcagagggcgtcagacagtcgataaggtgatgggaatccccaaagagactgcagagcgggtgggccctgagcgtgggccactggagagagaaaccgaaaaactattacccgaaaggcagactgatgtgacaggggaggaagaacttaccaaaggtaagcaggaccgggaacaaaaacagttgttggctcgtgatactcagagacaggagagtgacaagaacggagagagtgcgtcccctgaacgggacagagaatccctgaaagtggaaatcgaaacttccgaggagattcaagaaaagcaagtccaaaagcaaacgttaccttctaaggcatttgagcgggaggtcgaaagacctgtcgccaatagagagtgcgacccagccgagctggaggagaaggttcctaaggtaatacttgagcgcgacacccagagaggggaaccagaggggggatcacaggatcagaaaggccaggcttcatctccgactccggaacctggcgtgggcgctggcgacctgccgggacccacctccgcacccgttccatctggcagccaaagtgggggaagaggctcccccgtgtcccctcggcgtcatcagaaaggcctcttgaattgcaagatgccccctgcagaaaaagcctcccgaattcgggctgcggaaaaagtgagtcgaggggatcaggagtcgcctgatgcctgtttaccaccaacagtccccgaagcgccagcccctccacagaagcccctgaatagccaaagtcaaaagcatctggcgccaccgcctctactcagccctctactcccatcaattaagcccactgtcaggaagacccggcaagatggcagccaggaggcccctgaggctcccctgagtagtgagcttgaacctttccaccccaaacccaagatccgtacacggaagtcctccagaatgacccccttcccagctacctccgcagcaccaaagctggaaccttctacatccaccgaccagcccgtcaccccagaaccgacatcccaagccacaaggggacgaaccaatagaagctctgttaagacaccggagactgtggttcccaccgctccagagttgcaaccttccaccagtactgaccagcctgtcacacccgaaccaacctcacaggccaccagaggtaggacagaccgttcctcagtgaagaccccagagacagtggtccctactgctccagaactccaggcatctgcctctacggaccaaccggtaactagtgagccaactagcagaacaacacgcggtcggaagaatcggagcagtgtcaagacccctgagaccgtagtcccagccgctcctgcgctgcaacccagcacgagtaccgaccagcctgttaccccagaacctaccagcagggcgaccagggggagaactaaccgaagtagcgttaagactcccgagagcatcgtgcccattgcgcctgagcttcaaccatcaaccagtcgaaatcagttggtaacgcctgagcctacgagcagagccactcggtgccggactaaccgcagctcagttaagacaccagaaccggtggtgcccactgcccctgagccacaccccactacctctaccgaccagcccgttacacctaaactcacctcacgagccacaaggcgcaaaaccaatcgatcgtctgtaaagacccccaagcctgtcgagccagctgcctcagatctcgaaccatttactcccaccgatcagagcgtgacaccagaagccatcgcccaagggggtcagagcaaaactctcagaagtagcaccgtgagagcaatgccagttcccaccactccagaatttcagagtcctgttaccacggaccagcctatttctcccgagccgataactcagccttcgtgtattaaacgtcagcgcgctgcaggcaaccccggatcgcttgccgctccaattgaccacaagccgtgcagcgccccactagaacccaagtctcaagcgagccgtaatcaacgatggggagccgtccgggctgcagaatctctgactgccatccctgagcccgcatcgcctcaattactggaaactcctattcatgccagccagattcaaaaggtggaaccagcaggcaggtcacggttcacaccagagctgcagcccaaagcaagccagagcaggaagcgtagtttagcaacaatggattcccctccccaccaaaaacagcctcagcgcggagaagtgtcacagaagacagtcattattaaggaggaggaggaagatactgctgagaaacccggaaaggaggaggatgtagtgacccccaaacctggcaagcggaaacgggatcaggccgaagaggaacccaacagaatcccttcccggtcccttagacgcaccaagctgaaccaagaatccactgcgcctaaagttctcttcacaggcgtcgtggatgcacgaggggagagggccgtgctcgccctgggcggttctttagcaggtagtgccgcagaagcgagccatctggtgacagatcggatccgtagaactgtaaagtttctgtgcgccttgggcagaggcataccaattctcagcctggattggctgcaccagtcccgaaaggcgggattttttctgcctccagatgagtatgtggtaactgatcccgagcaggagaaaaacttcggattcagccttcaagatgctctgtctagggcccgagaaaggcgcctgctcgagggctacgagatctacgtcacccccggagtccagcctcccccaccacagatgggtgaaattataagctgttgcgggggaacctatcttcctagcatgccacgcagttataaaccccaacgggtggtgattacctgccctcaggactttccccactgcagcatcccactcagagttggcctcccactactcagccccgagtttttgttgacaggagtgctgaagcaggaagctaagccagaagcgtttgttttgagcccactcgagatgtccagcacata

SEQ ID NO: 229935 - DNA, 5477 bp, Artificial Sequence
  Description of Artificial Sequence: Synthetic coding sequence
atggaggatacacaggctatagattgggatgtagaggaggaggaggaaacggagcagagtagtgaatctctacgctgcaatgtggagccagtgggtcgcctacatatcttctctggggctcacgggcctgagaaggactttcccttacatctgggcaagaacgtcgtgggtcgcatgccggattgtagcgtcgcactgccttttccttccatttctaaacagcacgcagaaatcgagattctcgcctgggacaaagcgcctatactgcgagactgcggaagtctaaatggaacacaaatcctgaggccgcctaaggtgctgtctcctggtgtttcgcatcggctacgcgaccaggagcttatcctgttcgctgacctcctgtgtcagtatcaccggctggacgtcagcctgccttttgtgagccgaggacccttaaccgttgaagaaacgccgcgagttcagggtgagacgcagccgcaaagactgctgttggcagaagattctgaggaggaggtcgatttcctgtccgaacgcaggatggtgaaaaagtccagaacaacgagcagctccgttattgtgcctgagtcagacgaggaaggtcattctcctgtgctagggggactgggccctccgttcgccttcaatctgaactccgacacagatgtggaggaggggcaacaacccgcaacagaggaggcatcttctgcagctagaaggggagctaccgtagaagctaaacagtcagaggctgaggtggttactgagattcagctggagaaagatcagcccctggtcaaggaacgggataacgatacaaaagttaaacggggagccggtaatggtgtcgttcccgctggggtcattttagagcgcagtcagccccctggtgaagattctgacaccgatgtagatgacgattctcgcccaccaggtaggccagctgaggtacatctggagagggcccaaccattcgggttcattgattccgacaccgacgccgaggaggaacgtattccagccactccagttgtcatcccaatgaaaaagaggaagatattccacggcgtgggcacccggggaccaggcgctcccggtttagcacatctacaggagagccaggctgggagcgacacagatgtggaggaaggaaaggcccctcaggctgtgcctctggagaaatctcaggcttccatggtcatcaattcggataccgatgacgaggaagaagtgagcgccgcactcacgctggcgcatttgaaagagagtcagccggctatctggaatagggatgcagaggaagacatgccccaacgcgtggtgctgttgcaacgcagtcaaacaaccacggagcgcgattccgacaccgatgtagaagaagaagagcttcccgtagagaaccgggaggctgtactgaaggaccacacaaagatccgggcactggtaagagcccacagtgaaaaggatcagccgccattcggcgatagcgacgacagtgtggaagccgacaagagttctcctggcatccatcttgagagaagccaggcttccactacagtggacatcaatacgcaagtcgaaaaagaggtgcctcctggatccgccatcattcacattaagaagcaccaagtgtctgtcgaagggaccaatcagacagatgtcaaggccgtgggaggaccggctaagctgctggttgttagtctcgaagaggcttggccattacatggcgactgcgagaccgacgccgaggagggaacaagcctgactgcatcagtggtcgcggacgtgagaaagagtcagctgcctgccgagggggacgctggcgcagaatgggcggcagccgtcctgaagcaagagcgggcacatgaggttggggctcagggcggtccacccgtagcccaggtcgaacaagatctgccaataagccgtgagaacttgactgacctggtggttgataccgacacacttggggagtccacacaaccccagagagaaggcgctcaggttccaacaggcagagagcgcgaacaacacgtgggcggaactaaggacagtgaggacaactacggtgattccgaggaccttgatctacaggccacacagtgttttctggaaaatcagggccttgaggccgtccagagtatggaggacgaacccacccaagcttttatgctcacgcctccacaagaattgggcccatcccattgctctttccagaccactggactcctgaactgcaagatgccccctgcggagaaggctagtcgaattcgtgccgcagagaaagtgtcaagaggtgaccaagagtcacctgacgcatgcctgccccctactgtgcctgaagcccctgccccaccccagaaacccctcaactcacagagccagaagcatctggccccaccgcctcttctgtcccctctgttaccatccatcaaaccaaccgtcaggaagaccaggcaggacggatcacaagaagcacctgaggcccctctcagctccgagctcgagccgttccacccaaaaccaaaaatcagaacccgcaaatctagcagaatgacaccttttcctgccactagcgcagccccagaacctcatccatcgacctccacggctcaacctgtgactcccaagcccactagtcaggccactcggtcacggaccaatcgctcttcagtaaaaacccctgaacccgtggtcccaacagcccctgagcttcagccctcaacctctaccgatcaaccagttacatccgagcccacctcacaggtgaccaggggtagaaagtctcgctcctccgttaaaactcccgagaccgtagtacctactgccctggagttacagcctagtacgtccactgaccgaccagtcacctctgagcctaccagccaagccacacgtgggaggaaaaaccgttctagtgtgaaaactccagaacctgtggtgcccactgcaccagagctgcagccttctaccagcaccgaccaacctgtgacctccgagcccacttatcaggctacgagagggaggaaaaatagatccagcgtcaaaacgcccgaaccagttgtccctaccgcaccagaactccgtccatcaactagcactgatcggccagtgacgcccaagccaacatctagaaccacacgcagccggaccaacatgtcgtccgtgaagacgccggagactgtggtgccgaccgcaccagaactccagatctctacttccacggatcagcctgttacccctaagccgaccagccggacaacaagaagtcgcactaacatgtcttccgtcaaaaatcccgaatctacggtgccaatcgcgccagagctgccccctagcaccagcacagagcagcctgtaaccccagaacccacttctcgcgctacccggggtcggaaaaatcgctcatcgggaaagactcctgaaactctggtccccaccgctcctaagctggaacctagtacaagcaccgaccaacccgtgacaccagagcctacgtcacaggcgacacgtgggaggactaacagatctagcgtgaagacgccagagacggttgtaccaacagcccctgagctgcagcccagtacatccacggatcagcctgtaacacccgaaccgacgtcccaggccactcgaggacgcaccgatcgtagctccgtgaaaacccccgaaactgtggttcctacggccccagaactccaggccagcgcctccactgaccaacccgtcacctcagaacccaccagccggactacacgaggaaggaaaaataggtcatcagtgaaaacccctgagacagtggtccctgcggcacccgaacttcagccttctactagcacagaccagcccgtgactcccgagcctacatccagagccactaggggaagaactaacagatcttccgtaaaaacccccgaaagcatcgtccccatcgctcctgagcttcaaccttcaacctcccggaaccagctggtaacgcctgagccaacctcacgagccacgcggtgccgaacaaatcggtcgtcagttaaaacacccgagcctgtggtgccaaccgccccagagccccatccaactacgtcgacggatcaaccagtcaccccgaaacttactagcagagctacaaggcgcaaaaccaatcgctctagcgttaaaacacctaagccggtcgagccagccgcaagcgacctggagccttttactccaactgatcagtccgtaacaccagaggccatagctcagggaggtcaaagcaagacgttgcggtcaagtacggtgagagctatgccagtcccgaccacccctgaatttcagagcccagtcactaccgatcagcccatttctcctgagcccatcacacaacctagctgcattaagcggcagagagcagctgggaacccgggatctttagctgcgccaatagaccataaaccttgctcagctcccctcgagccaaagtctcaggcttcacgaaatcagcggtggggagccgtgcgcgctgcagagtctttgaccgcgattcccgaacccgctagcccccagctgctcgagacccccatccacgccagtcagattcagaaggtggaacccgcaggcaggagccgttttactccggagctgcagcctaaggccagccagagcaggaaaaggagcctggccactatggatagtccaccacatcaaaagcagccccagcgaggggaggtgtcacagaaaactgttattatcaaagaagaagaggaagatacagcagagaaaccgggtaaagaagaggatgttgtcacccctaaacccggaaagcgaaagcgagatcaggcagaggaggaacccaaccggatcccttctcggagcctccgtcgtactaaacttaatcaggagagtacagcaccaaaagtcctttttaccggggttgtcgatgctcggggtgagagggctgtccttgccctgggtggcagtctcgctggctctgcggctgaggcttctcacctggtgactgaccggatccgcaggacagtaaaatttttgtgtgcgctggggagggggatacccatactctcactggattggttacaccagtcccgtaaagcagggttttttctcccccctgacgagtacgtggtcacagaccctgaacaggaaaaaaatttcggctttagtcttcaggatgccttaagtcgcgctagagagaggcgtctactggagggctacgaaatttacgtcacaccgggagtgcagccacctccacctcagatgggagaaattatcagttgctgcggaggcacttatctccccagtatgcctagatcatataaaccacaacgcgtggtcataacgtgccctcaggactttccacactgcagcattcctcttagagtgggcctgcccctgctatctcctgaatttttactcacaggcgtcctgaagcaggaagcaaagcctgaggcttttgtgctgtctcctttggagatgtcctccaccta

SEQ ID NO: 229936 - DNA, 4968 bp, Artificial Sequence
  Description of Artificial Sequence: Synthetic coding sequence
atgtaccatcgcctcgatgtgtctctcccatttgtcagccgcggacccctgacagtggaagaaacccccagagtgcagggtgagacacagccccagcggcttctccttgccgaagattccgaagaggaagtcgacttcttatccgagaggcggatggtgaaaaagtccaggacaacgagcagcagtgttattgtccctgagtccgacgaagaggggcattccccagtgctgggcggtctggggcctcccttcgcatttaacctcaattcggatacagacgtggaggagggacagcagccagctaccgaggaggcgtcttctgccgctagaagaggggcaactgttgaagccaagcagagcgaagccgaggtggtgaccgaaatccagctcgagaaagaccagcctctcgtcaaagagcgcgacaatgacactaaagtcaagcggggagctggaaatggagtcgtgcccgctggggtgatattagagcggtcgcaaccaccaggcgaagattctgataccgatgtggatgacgactccagacccccaggccgtcccgcagaagtccatcttgagcgggctcagccatttggcttcattgattctgataccgatgcagaagaagagaggattccggctacgcccgtcgtaatccccatgaaaaagaggaagatattccatggggtaggcacaagaggcccaggagctcccggattggcccacctacaggagtcacaagctggcagcgataccgacgtagaagaaggaaaggctccacaggctgtgcccttggaaaaatctcaggcgagcatggtgattaattcagatacggatgacgaagaggaggtctccgctgcattgaccttggcccatcttaaagagtctcagcctgctatctggaaccgcgatgcagaggaggatatgccacaacgcgtggtgctactacagaggagccagactaccaccgaaagggattctgacacagatgtcgaggaggaggagctgccagtcgaaaaccgcgaggccgtcctgaaggaccatacaaaaatccgagctctagtccgagcccactccgagaaggatcagcctccctttggcgatagcgatgactcagtagaagccgataagagctcgcctgggattcacctggagcggtctcaggcgagtactaccgtagacataaacacgcaggtcgagaaagaagtgccgcctggctcagctatcattcacatcaagaaacatcaggtgagcgtggagggaaccaaccagaccgacgtgaaggccgtggggggtccggcaaagctcctggtcgtgagtttagaggaggcttggccacttcacggcgactgcgagacagatgccgaagagggtaccagtctcacagcctccgttgtggccgatgtgcggaaatcacagctgcccgctgaaggggacgccggtgccgaatgggccgctgcggtgctgaagcaggagcgcgctcatgaggtgggcgcacaagggggaccccctgtggctcaggtcgaacaggatttgccaatttcccgtgaaaacctgaccgacctcgtggtcgataccgacacactgggagaaagtacacagccccaaagagaaggtgcccaggtgccaacggggagggaacgagaacagcatgtcggtggtacgaaggattcagaggataattacggtgacagcgaagacctggacctccaagctacccagtgcttccttgagaatcaaggtttagaagtacagtccatggaagacgagcctacccaggcattcatgctgacccctccccaggaactggggccaagccactgttctttccaaacaacagggctgctgaactgtaagatgccacccgcagagaaagcaagtaggatcagggcagcagagaaagtctccagaggcgatcaggaaagcccagacgcttgtctgcctcccacggttcctgaagccccagcacctcctcagaaaccactgaacagccaaagccagaagcacctggcgcctccaccccttctttcacccctgttgcccagcatcaaaccaaccgtccgcaagacccgtcaggacggatcccaagaggctccggaagcccctctctcatctgagttggagcctttccaccccaagcctaagattcggacaagaaagtctagccggatgacaccttttccagctacatctgctgcgcctgaaccacatccctctacgtcaaccgctcagccggtgacacccaaaccgactagccaggctactcgttctcggactaaccgatcatctgtcaaaactccagaaccagtggtgccgaccgctccggaattgcagccctccaccagcaccgatcagcccgtaactagcgaaccaacctctcaggtgacccgcggacgtaagagccgctcatcagttaaaaccccggagacagtcgtcccaacagcccttgagctgcagccttctacatcgacggaccgcccagtgacctcggaaccaacatctcaggcgacacggggtcgtaaaaacagatcttcagtgaaaacacccgaacccgtggttccaacagccccagaactccaaccatctacttcgacagatcaacctgttacaagcgagcccacctaccaggccactagaggccgaaagaatcgatctagtgtgaagacacctgagcctgtggtgcccacagcacctgagctgaggccttcgacctctaccgataggccggttacccccaagccgacctcccggacaactaggagtagaactaacatgagctccgttaagaatccggagtctaccgtcccaatcgcacccgagctgccgccaagcaccagtacggaacagccagtcaccccagaaccaacctcaagggccactagagggagaaaaaataggagtagcggaaagacgcctgaaactctggtccctacagccccaaaattggagccatccactagtactgaccagcccgtcacaccggagccaacatctcaagcaaccagaggtcgaaccaacaggtcgagcgttaaaactcctgaaaccgtggtgcccacggccccagaactccagccttctaccagcaccgaccaacctgttaccccggaaccaacctctcaagcaacccgcggacgtaccgacaggtcttctgtgaaaaccccggagactgtggttcctacggccccagagctccaggccagcgcaagcaccgaccagccagttactagcgagccaaccagcagaactacaagagggagaaagaaccgatcctccgtaaaaacacccgaaaccgttgttccagccgcaccagagcttcagccctcaacttccaccgaccagcctgtaaccccagagccaacctctcgcgcaacacgcggtaggaccaatagaagcagcgttaaaacgccagaaagtatcgtgcctatagccccagaactgcaacctagcactagcagaaatcaattagtcactccggaaccgacgtctcgggcaacaaggtgtcggaccaataggtcatcagtgaaaactccagaacccgtcgtgccaacagctccggagccacaccccacaacgtcaacggaccagccagtgacaccgaaactcacttcgcgggctacccgacggaaaaccaatagaagttccgttaagacaccaaagcctgtcgagcccgctgcctctgacctcgaaccattcacacctacagatcagagtgtgaccccagaagccattgctcagggcggtcagtccaaaactctgaggtcatcaaccgtgcgggcaatgccagtgcctacgacaccagagttccaaagtcctgtcacgaccgatcagccaataagccctgaacctatcacacagcctagttgtatcaagcgccagagggctgctggaaatcccggttcattagcagcacctatcgaccacaagccctgcagtgcacctctggaaccgaaaagccaggcctcccggaaccagcgatggggagctgttcgggcagctgaatctcttacggctataccggaaccagcttcccctcaattactagagacccccattcatgcttcgcagatccagaaagtggagccagcgggaaggtcacggttcaccccagagttgcagccaaaggcctctcagtcacgcaagcgctccctggcaacgatggactctccccctcaccaaaagcagcctcagagaggggaagtctctcagaagaccgtgattataaaggaagaagaggaggacaccgcggaaaagccgggtaaggaagaggatgtggtgactcctaagcctggaaaacgaaaaagggatcaggccgaggaggaacccaaccggatcccctcacgctctctccgtcgcactaagttaaaccaagagtcgaccgccccaaaagtccttttcaccggggttgttgacgccaggggcgagcgggctgtgctggctcttggtggctcactggccggttctgccgcagaagcttctcacttggtcacagaccggataaggcgtactgtgaagttcctttgcgcactcgggaggggtatcccaatcctgtcgcttgactggcttcaccagtcccggaaggcgggattttttttgccacctgatgagtacgtcgttactgaccctgaacaggagaagaactttggtttcagcctacaggatgctctctctcgggcaagggaacgccgtctcctcgaggggtatgagatatatgtgacccccggtgtgcagccccctccaccgcagatgggtgaaatcatctcatgctgtggaggtacttatctgccaagtatgccaagaagttataagcctcaacgtgtggtaataacctgcccacaggacttcccgcattgtagcattcccctaagggtggggctcccccttctgtcccctgaattcttgctcactggcgtgctgaagcaggaagccaagcctgaggcctttgttctgtctcccttggaaatgtcatcaacttag

SEQ ID NO: 229937 - DNA, 4968 bp, Artificial Sequence
  Description of Artificial Sequence: Synthetic coding sequence
atgtatcatcgactggatgtgagccttccattcgtgtcccgcggaccgctgactgtcgaagagactccaagagtgcaaggtgagactcagccgcagaggcttcttcttgcggaggacagcgaggaagaggtcgactttctgtcagagaggcggatggtgaaaaagtcccggacaacatcctcatcagtcatcgtccccgaaagtgatgaggaagggcactcacctgtccttggtgggctaggacctcccttcgcttttaatctgaattcggacactgatgtggaggagggccagcagcctgcaacggaagaagcaagcagcgccgctaggcggggagctacggtggaggccaagcagtcagaggccgaggtggtgactgaaatacaattggagaaagaccagcctctggttaaggagagagacaacgacactaaagtgaaacgcggagctggaaacggagttgtccccgctggcgtgattctggaacgttcacagccacccggagaagatagcgacaccgacgttgatgatgacagtagacctcccggacgtccggcagaggtgcatctggaaagagcgcagcctttcggcttcatcgatagtgacactgacgcagaggaggaacggattccagctacgcccgtagtcatccctatgaagaagcgcaaaatttttcacggggtaggtacacgaggcccaggcgcaccaggattagcccatctccaggagtcccaggccggttccgatacagatgtggaagaaggcaaagccccacaggctgtgccactggaaaagagccaggcttccatggtgatcaactctgacacggacgatgaggaggaagtgtctgcagcattaaccctagcccatctgaaggagtcacagccagctatttggaaccgggatgccgaggaagacatgccccaacgggttgtgttgctccagcggtctcagacaacaaccgaacgggattccgacactgacgtagaagaggaagagctgccggtggagaatagggaagccgttctgaaggatcatactaaaattcgcgctctggtgcgggctcactccgaaaaagaccagcccccttttggggattctgatgattctgtggaagctgataagtccagcccaggcattcaccttgagagaagccaggcaagtaccactgtggatatcaacacacaagtggaaaaggaagtgccccctgggtccgctattatacatattaaaaaacaccaagtgtctgtagagggaactaatcaaaccgacgtcaaggcggtcggtggcccagccaaactcctcgttgtcagcctcgaggaagcctggcctttgcacggcgattgcgagacggacgccgaggaggggacgagtctgacagcatccgtggtcgcagacgtgcgaaagtctcagcttcctgccgaaggcgatgcgggagccgagtgggcggctgctgttttaaaacaagaaagagctcatgaggtgggcgctcaggggggaccaccagtggcccaggtggaacaggatctgccgatcagccgtgagaaccttaccgacctggtggttgacaccgatacactaggagaatcaacccagccacagcgtgagggggcacaggtacccactggtagggagcgggaacagcacgtgggaggaactaaagactcagaagataattacggtgacagcgaggacttggaccttcaggcaactcagtgcttcttagaaaaccaggggctggaggtccaatcgatggaagacgagcctacgcaggccttcatgctcactccccctcaggagctgggacccagtcattgttccttccagactactggcctattgaattgtaagatgcctcccgctgagaaggcgagtaggatccgggctgctgagaaggtgagtcgcggtgatcaggaaagcccggatgcctgcctgccaccgactgtcccagaagctccggctcccccacagaaaccactcaattctcagtcccagaagcatctcgctcccccaccccttctgagcccactcctgccctccattaaaccaacagtacgtaaaacaagacaggacggctcacaagaagcccctgaggcgccactgtcctccgagctagaaccttttcatccaaaacctaagattcgtacgagaaagtcttccagaatgaccccatttccagccaccagcgcagctcctgagccccatcccagtacctctacggcccagcctgtgacacccaagccgaccagccaagccacccgctctcgcaccaaccggtcatcagtgaaaaccccggagcccgtcgtgcccactgctcctgagctccagccctctacttccacagatcagccagtaacttctgagcctaccagtcaggtcacacggggacgcaaatccagaagctcagtcaagactccagagaccgtggtcccgacggctcttgaactccaaccatcaacttcaaccgataggccagttacatctgagcccacgtcacaagccacacggggtaggaagaaccggagctcagtcaaaacgcccgagccagtggtacctaccgctcctgagctccagcctagtacgtcgaccgatcagcctgtgacttctgaaccaacataccaggccacccgcggaagaaaaaatcgaagcagcgttaagaccccagagcctgtggtgcctactgccccagagctgagaccctccacttcaaccgatcggccagtgacccctaaaccaactagcagaacaaccaggagcaggaccaatatgagttcggtgaaaaaccctgaatccaccgtacctatcgcacccgagctccccccttcaacgtcaacagagcaaccagtgacccccgaacctaccagccgggctacaagggggagaaagaatagaagctcgggaaagacccccgagaccctggtaccaaccgcgcctaagctggagcctagtacaagcactgatcagcccgtcacaccagaacctaccagccaagccactagaggccgaacaaatcgcagctccgtgaagacccccgagaccgtggtcccaactgctccagagttgcagccctccactagcaccgatcagccagttacccccgaacctacttcccaggccacccgagggcgaacagaccggtctagtgtaaaaacaccagaaacagtagtgcctaccgctccggaattacaggcctctgcttccacagatcagccagtgacctccgagccaaccagccgtactacaaggggacgaaagaaccggtctagtgtgaagactccggagacagtggtgcctgcagcgccagctctccaaccatctacatccaccgaccagccggtgacgcccgaaccgacctcaagggccacacggggaagaacaaacaggagctccgtcaaaactccagaaagcatcgtacccattgctcctgagctacagccctctacgtcaagaaaccagcttgtgactcctgagccaacctcccgcgcaacaaggtgcagaacaaatcgatcaagtgtgaagacgcccgaaccagtggtgcctactgctcctgagccccatcccacaacatctaccgaccagccggttactcctaagctgacttcacgcgcaaccaggcggaagacgaatcggtcaagcgtaaaaacccctaaacctgtggaaccagcagcgagtgacctggagcccttcacccctaccgatcagtccgtgacaccagaagccattgctcagggtggccagtctaaaaccttgagatcttccaccgtccgggctatgccggtgccgactaccccggaatttcaatcccctgtcacaacagatcaaccgatttcacccgaacctataactcagccctcctgcatcaagaggcagagggctgcaggcaatcccggtagccttgctgcacccatcgatcataaaccatgctctgctccgctggaaccgaaatctcaggcctctcggaaccagcggtggggcgctgtgcgcgcagctgagtctctgactgctattccagagccggcttcaccgcagctcctggagacaccaatccacgcctcccagattcagaaggtcgaaccggctggacgctccaggttcacccctgagctgcagcctaaggcctcacaaagtcggaagaggagcctggccactatggacagccctcctcatcagaagcagcctcagaggggcgaagtgtctcagaagaccgtgattatcaaagaggaggaagaggatacggccgagaaacccggaaaggaagaggatgtcgtcacacccaagcctgggaaacggaagcgcgaccaggccgaagaggagcccaataggattcccagccgatcacttcgcaggacgaagctgaatcaggagagtactgctccgaaagtgttgttcacgggcgtggtcgatgcgcgaggcgaacgggctgtcctggcactcgggggtagtctggccggtagtgctgccgaggcctctcacctggtgaccgatcgaatacggagaaccgttaaatttctgtgtgccctgggcagaggaattcccatactatctctcgactggttgcaccagagccgcaaagccggtttcttcctgcctcccgacgagtatgtcgtcacagatcccgaacaggaaaagaattttgggttcagcttgcaggacgcactcagcagggccagggagagacggctgctggagggctatgagatttatgtgactcccggagtccagcccccaccgccacagatgggcgaaatcatttcctgttgcggtggtacatatttacccagcatgcctcggtcttataaacctcaacgagtggttataacctgcccccaggattttccccactgcagcatccccctgcgggtcggcctcccactcctgtccccggaattcctgctcaccggcgttcttaagcaggaggcaaagccagaggccttcgtgctttctcctctggagatgagctcaacatag

SEQ ID NO: 229938 - DNA, 666 bp, Artificial Sequence
  Description of Artificial Sequence: Synthetic coding sequence
atggaagacacccaggctatagattgggatgtcgaagaggaagaagagacagagcagagtagcgaaagcctgcggtgcaacgtcgagccagtcggtcggctgcacatcttctccggtgcccacgggcctgagaaggattttccactccatcttggcaaaaatgtggtaggaaggatgcctgattgcagtgtggccctgcctttccccagcatctctaagcaacatgccgagatcgagatcctggcctgggataaagcacccattctgagagattgcgggtccctcaacggcactcagattctgagctcatcgctgccgcctccccagaccagcttactcccactgtctcttaggcttaggttgctgggcgaggaacaaatcgatcctctgagccggctgctcaagcagcttagccctcagccactgtcataccgcctgcctcctccccaaaccagcctgagtccactgtccccgcatcttggcccactgggtgaagaaaaaatcggccctttgtctcggcctttgaagcaactgtgcccacagcccctcagctcgagtctacctccaccccagacaaacctgtcccctctgagcccacacctcggacctctgggcgctgggcaaataggtccgttgtctaggcctttgaaccaattgtcactgtag

SEQ ID NO: 229939 - DNA, 666 bp, Artificial Sequence
  Description of Artificial Sequence: Synthetic coding sequence
atggaggacacgcaggccatcgactgggatgtggaggaggaggaagagactgaacagagcagtgaaagcctgcgctgcaacgtagagccggttgggagactacacattttcagtggggcacacgggccagaaaaagactttcccttacatctgggaaagaacgtcgtggggaggatgcctgactgtagtgtagctctgcccttcccatccatcagcaagcagcacgctgagatcgaaatcctggcatgggacaaagccccaatattgcgagattgcggatctctgaatgggacgcaaatcctgagtagctcactcccaccaccacagacatccctgctgccattgtccctgcgtctgagactgctgggcgaggaacaaattgatcccctcagcagactcctgaaacagctcagtccacagcccctaagctaccgcctcccgccacctcagacaagcctgtcccctctgtcacctcatctcggccctctgggtgaggagaaaatagggcctctgagccggcctcttaaacagctttgcccccaacccttaagtagtagtctcccaccaccacagaccaacctgagtccgctcagcccacacctcggccctttaggggcaggtcagataggtccactgagtcgacctctgaaccaactcagcctctag

SEQ ID NO: 229940 - DNA, 738 bp, Artificial Sequence
  Description of Artificial Sequence: Synthetic coding sequence
atggaagacacacaagcaatcgattgggacgtcgaggaagaagaagagaccgagcagtcctctgagagtctcaggtgcaacgtcgagccggttgggagactgcacattttctctggcgctcacgggccagaaaaagacttccccttgcatcttggtaagaacgtcgttggacggatgcccgactgtagcgtcgccctcccttttccatccatatctaaacagcacgctgaaatcgaaatactggcctgggacaaagcccctatcctccgcgattgtgggagcctgaacggaacccaaatcctaaggcctccaaaagtgctgtcacccggagtgagccatagactacgcgatcaggagctgattctatttgctgacttgctctgtcagtaccaccgccttgacgtgagccttccatttgtgtcgagagggccattgacagtcgaggaaacaccaagagtgcaaggggagacgcagccccagcggctgctgttagcagaggatagcgaggaagaagtcgatttcttatctgagcgaagaatggtgaagaaaagcaggacgaccagctcgagtgttatcgtaccggaatcagacgaggagggacatagtccggtactcgggggtctggggcctccttttgcttttaacttgaactccgataccgatgtcgaggaggggcagcagcccgctacagaagaagcttcctccgccgctcggcgtggggcaaccgttgaagcctag

SEQ ID NO: 229941 - DNA, 4968 bp, Artificial Sequence
  Description of Artificial Sequence: Synthetic coding sequence
atgtaccaccggctagatgtctcactgcccttcgtttccaggggtccactgaccgttgaagaaacacccagggttcaaggcgaaactcagccccagcggctccttctggctgaagactccgaagaggaggtggacttcctaagcgagagacggatggtgaaaaaatcacgaactacttcttctagcgttatcgtaccagaatccgacgaggaggggcacagccccgtactggggggactaggtccacccttcgcctttaacttgaatagcgatacagatgtagaagaggggcaacagcctgccacagaggaagcttcttccgcagctaggcgtggtgcaacagtagaggctaagcagtctgaggccgaggtggtgacagaaattcaactggagaaagaccaacccttagttaaagaaagagacaacgacactaaagtgaagagaggcgctggaaatggtgtggtgcctgctggggtcatactggaaagatctcagcccccaggtgaggacagtgacaccgatgttgacgatgatagtaggccccctggccgaccagccgaggttcacctggaacgtgcccaaccttttgggttcattgattccgacacagatgctgaggaggaacgcattcctgccactccggttgttatcccgatgaagaagcgtaagatcttccatggtgtgggaactcgcggaccaggcgcacccggactcgcccacctgcaggagagtcaagcaggatcagacaccgacgttgaagaagggaaggcaccgcaggcagttccactggaaaaatcccaggcatcaatggttatcaattctgacacagacgatgaggaagaagtgagcgccgctctcacactggcccatcttaaggagagccagcctgcaatttggaaccgcgacgcggaggaagacatgcctcagcgcgtggttttgctgcagcggtcccaaacaaccacagagagagattcagatactgacgttgaagaagaagagctgccagtggagaacagggaagcagtgctgaaagatcacaccaaaatacgggctctggtaagggctcactccgagaaagaccaacccccattcggagacagtgatgactccgtggaagcagacaaatcaagtcccggtatccacctcgaaaggagccaagctagcacaacagtggacatcaacacacaagtggagaaagaggtgccacccggatcggccatcattcacataaaaaaacatcaagtatcggtggaagggacaaaccagacagacgtgaaagcagtgggtggtcctgccaaactccttgtggtgtccctagaagaggcctggccactccatggggactgtgagaccgatgccgaggaaggtacaagtctgacagcctctgtggtcgcggatgttaggaaatcacagctacccgctgaaggagatgctggtgcagaatgggccgctgcagtcttaaagcaagagagggcacatgaagtcggcgcacaaggcggaccaccggtagcccaggtggagcaggaccttcctatttccagagaaaatctaaccgatctcgtggtggatacggacaccctgggggagtccacacagcctcagcgcgagggggctcaagtaccaactggcagggaacgggagcagcacgtgggcggaaccaaagattcagaggacaactacggtgatagcgaggatctcgatctccaagctacgcaatgttttttggagaatcagggtcttgaggtccagagtatggaagacgagcctactcaggcctttatgctgacccctccccaagagctcggcccttcgcactgcagcttccagacaactgggctcctcaattgcaagatgccacccgctgaaaaagcttccaggataagggctgccgaaaaggtgagcaggggagaccaagagtctcctgacgcatgcctccctcctaccgtgcccgaagcccctgctccaccccagaaaccattgaactcgcaatcacagaaacatcttgctccgccacctttgctgtccccactgcttccatctatcaagccaactgtgaggaagacccggcaagacggatctcaggaggcaccagaggctcccctcagtagtgagctggaaccatttcaccccaagccgaaaattaggactaggaagtcctctcggatgacaccatttccagccacatcagccgctccggaaccccatccatcgaccagcacagcacagcccgtcacccccaagccaaccagtcaggcaacccgttcgcgaacaaatcggagttcagttaaaacaccagagcctgtcgtgcctactgcccctgagctgcagccgtcaacaagcactgatcagcccgtgacaagtgaacctacaagtcaggtcacacggggacggaaaagccgcagcagcgttaagacacctgagaccgtggtgcccaccgccctcgagctgcagccgtccacgtccactgacaggcctgtgaccagtgagcccacgtcccaggctacaaggggacgtaaaaacagaagctctgtgaaaacccccgaaccagttgtgcctacagcccctgaactgcagccttcaacgagcactgaccagcctgtaacatctgaaccaacataccaggctactaggggccgaaagaatcggtccagtgtcaaaacccctgagccagtcgtccctaccgctcctgagttgagaccaagcacttccactgaccggcctgttaccccaaagcccaccagcagaaccacacgcagcaggacaaatatgtcctcagtaaagaatcccgagtccactgtaccgatcgctcccgagttgcccccaagcacttccacagaacagcctgtcacgccggaaccgacttctcgcgctaccagagggcgaaagaaccggagctccggaaaaacacccgaaacattggtgcctaccgcgcctaagctggagccatcgactagcaccgaccagcctgtgacacccgaacctacctcccaggccacccgcggacgtacaaaccgatcctccgtgaaaactcccgagacagtggtacctactgctccagagctgcaacctagcacaagcactgaccagcccgtgacccctgaacctaccagccaggccacaaggggcagaaccgaccgctcttccgtgaaaactccagagactgtggtgcccaccgctcctgaattgcaggcttccgcttctaccgatcaaccagtgacctccgagcccacatcccggactacgcggggacgcaaaaataggtcatcggttaagacacccgagacagtggtgcctgctgcccctgagctccagccctccacgtctaccgatcagcccgtcacccccgagcctaccagtcgggctacccggggaaggacaaaccgctctagcgtcaaaacaccagagagtatagtccctattgctccagagttgcagccctcaacctcgcgcaaccagctcgtgacaccagagcctacatctcgcgcaacaaggtgtaggaccaacaggagttccgtcaaaacaccagagcctgtggttcctacagcccctgaaccgcaccccaccacttccacagatcagccggtgacaccaaagctgacaagccgcgctacccgcagaaaaaccaatcggtcaagtgtcaaaacaccaaaacctgttgagccagcggctagcgacctggagccttttacccccacagatcagtcagtcacgcctgaagctatcgctcaggggggtcagtctaaaactttgcgctcttccactgtgagagctatgcctgtgccgactacaccagagtttcaatcccctgtcaccaccgaccagcccatttccccggaacctattacccaaccatcatgcattaaaagacagagggcggctggcaaccccggttccctcgctgcccctattgaccataaaccctgcagtgcacccctggagccgaaaagtcaagctagccggaaccagagatggggggctgtacgtgccgcagagagtctgacagctataccggagccagcttctcctcagctcctagagacgccaattcatgcttcacagatccagaaggttgagcccgctggcagaagccgctttacgcccgagttgcagcccaaggcctcacaaagccgcaagcgcagcttagctacaatggatagcccaccgcaccagaagcagccacagcgaggggaggtcagtcaaaaaactgtcataattaaggaggaagaggaggacaccgcagaaaaacctgggaaggaggaggacgtggtgacccccaaacccggtaaacgcaagcgtgaccaggcggaggaggaacccaatcgcattcctagcaggtctctgcgccgaaccaagctgaaccaagaatctaccgcccctaaagtgctgttcaccggcgtggtggatgctcggggagagagagccgtcctggccctgggcggtagccttgccggttcagcagccgaagcctcccacctggtgaccgacaggattcgaaggaccgtgaagtttctgtgcgccctcggcagggggatccccatcctaagcttggactggttacaccagtccaggaaagccggttttttcttgccgccagacgagtacgtggtcacggaccccgagcaggagaaaaatttcggattcagtctgcaggacgccctctcccgggcacgggagcgacgcctgctcgaggggtacgaaatatatgtcaccccaggtgtgcagcctccacctccacagatgggggagataatttcctgttgtggcggaacctacctgccttcaatgccccgatcttacaaaccgcagcgtgtggtcataacttgcccccaggactttcctcactgctccatcccactcagggtggggctgcccctgttgtcccccgaattcctcctgacaggcgtgctgaaacaggaggccaagcctgaagcatttgtattatctcctctagagatgagcagcacttag

SEQ ID NO: 229942 - DNA, 5477 bp, Artificial Sequence
  Description of Artificial Sequence: Synthetic coding sequence
atggaagacacacaagccatcgattgggatgtcgaagaggaagaggagacagagcagtcgtccgaatctttgaggtgcaacgttgagcccgtgggtcgtctccatatattctctggggcacatggacccgaaaaagatttcccattgcatctgggaaagaacgtcgtcgggagaatgcctgattgttccgttgcactgcccttcccatctatttccaaacagcatgctgaaatcgagattctggcctgggacaaagcacccattctccgtgattgcggctcactcaacggcacacaaattctccgacctcctaaggtgctgagccccggtgttagtcaccgtctgcgcgaccaggagctcatattgtttgccgacctattgtgtcaatatcatagattggatgtgtctttaccattcgtctcccgcggacctctcactgtagaagagacccctagggtccaaggcgagactcagcctcagcgtctgctcctggcagaggattccgaggaagaggtggatttcctcagtgagaggcggatggtgaagaagagcagaacaacaagttctagtgtcatagtccctgaaagcgatgaggagggccattctcccgtactggggggattgggtccccctttcgcattcaatctgaactctgataccgacgtagaggagggacagcaacctgcaactgaagaagcgtcatccgcggcacgccgaggcgctactgtggaggccaagcagtctgaagctgaggtggtcactgagattcaacttgaaaaggaccagcccctagtgaaggagagggacaatgacaccaaggtgaagcggggtgcgggaaacggagtagtcccggctggagtgatactggagcggagtcaaccaccgggtgaggactctgataccgatgtcgatgatgattctagacccccaggaagacccgctgaagtgcatctagagcgggctcagccctttggcttcatcgacagtgataccgacgcggaggaggagagaattcccgcaacccctgtggtcatccccatgaaaaaacgcaagatcttccatggcgtgggaacccgcggaccaggtgctcccggtctggcgcacctgcaggaaagccaggccggaagcgacaccgacgtcgaagagggcaaagcccctcaagctgtgccattagaaaagtcgcaggcgtccatggtgatcaattcagatactgatgacgaggaggaagtttcagccgctctcacattggcacatctcaaagaatcgcagccagctatatggaacagagatgctgaagaggatatgccgcagagggtcgtgctcctccaacgtagccaaacaaccaccgagagagacagcgataccgacgtagaagaggaagagctgcccgtcgaaaacagagaggccgtcctaaaggaccacaccaagatcagagcgttggtgcgcgctcactccgaaaaagaccagccgccttttggggattctgacgactctgttgaggctgacaaaagttcacccggaatccacctggagcggtctcaggccagcactactgtggatattaatactcaagttgaaaaagaggtccctcccggatctgctatcattcatattaaaaagcaccaggtcagcgtggagggcacgaatcagactgatgtgaaagcagtgggtgggccagccaagttgcttgttgtttccctcgaggaggcatggcctttgcacggtgattgcgagactgatgccgaggagggtacttcactgacagcttcagtggtggccgacgtccgtaagtcacagctgcccgctgaaggtgatgctggcgctgaatgggcagccgcagtactgaaacaggagcgggcacatgaggtaggcgctcaggggggtcccccagttgcccaggtcgaacaggatctccccatcagtcgtgagaatctgaccgaccttgtcgtggatacagatactctgggcgagagcacccagccccagcgcgaaggcgcacaagtgccgacaggcagggaaagggagcaacatgtcggaggcaccaaggactccgaggacaactatggagactctgaggacttggacctacaggctactcagtgcttcctggagaaccagggattagaggctgttcagagcatggaggatgagcccacccaagcgtttatgttgacaccgcctcaggaactgggcccatctcactgtagctttcagacaacgggcttgcttaactgcaaaatgccacctgctgagaaggcatccagaatacgggctgctgaaaaggtgagtcggggagatcaggagtccccagatgcctgtctcccacctaccgtccctgaggcgccagcccctccacagaaacccctaaattctcagtcccagaaacaccttgctccgcctcctcttctgagccccctgctgccgagcattaagcctacagtgcggaagactcggcaggatgggtcacaggaggctcccgaggcccctctgtcttctgaactggaacccttccatcccaaacctaaaatccggactaggaagtcatcacgtatgacacctttccccgctacgtcagccgcacctgagccccacccatccactagcacagctcaaccagtgacgcctaagcctacctctcaggccacccgtagcagaactaaccgctccagcgtgaaaacccctgaacccgtggtgcccaccgccccagaactccaaccgagtacttccaccgatcagcctgtcacaagtgaacccacttcacaggtaacaagaggaagaaaaagcaggtcctctgttaagactccagagacagtggtccccaccgctctggaattgcaacccagcacatccactgacagacccgtcacgtcagagccaacaagccaagcaacacgcggtaggaagaatcgatccagcgttaagactcccgaaccagtggtgcccacagccccagagcttcagccttctacctctactgaccagccagtgacttcagagccaacatatcaagccacaagaggacgcaaaaaccggagctcggtgaagaccccagaacccgtggtgcccactgccccagaactgaggccatccacctcaacagatcggcctgttaccccaaagccaacatcacggactacgcggtctcgcacaaatatgtcctcggtcaaaacacctgagacggtggtccctacagctccagagcttcagattagtacctctacggatcaaccagtgactcccaagccaacgtctagaacaactcgttctagaacaaatatgagctccgttaaaaacccagaatcaaccgtgcctatagctccagagttaccaccttccactagtacggagcagcctgttacacccgagcctactagccgcgctacaagggggcgtaagaatcgctcctccggaaagacccccgagacgctggtcccaacagctcccaaactggaaccaagcacttctactgatcagccagtgacccctgagccaacctctcaggcgacccgcggtagaaccaacaggtcgtctgtgaagacacccgagaccgttgtgccaactgcaccagagttgcagccaagcacgagcaccgaccaacccgtgacccccgaaccaacctcccaggcgacaaggggcaggactgacaggtcgagcgtgaaaactcctgagacagtggttcctacggcaccggaacttcaagcatccgcctccactgaccagcctgtcactagtgagccaacaagtagaactacacgcggtcgcaaaaaccggagctccgttaagaccccggaaaccgtggtcccggcagccccagagcttcagccgagcacctctacagatcagccggtcaccccggaacctacatccagggcaacaagggggaggacaaaccgctctagtgttaaaacaccagagtcaattgttcccatcgcaccagaactgcagcccagtactagccgaaaccagctggtcacccccgagcctacttcccgggcaacaaggtgcagaaccaatcgctctagcgtcaagacccctgaacccgttgtgccgaccgccccagaaccacaccccaccactagtactgatcagcccgtgactcctaagctgacaagtcgtgcaactaggcgtaagactaacaggtcttccgtgaagacccctaagcctgttgagcctgccgcttccgatcttgagcctttcacacctacagaccagagtgtgacccctgaggccattgcacagggagggcagtcaaagaccctgagatcttcaacggtccgcgcaatgccagtccccaccacccctgagttccagagccccgtgaccactgatcaaccgataagtccggagcctataacgcagccctcgtgcattaagcgacagcgcgcagccggaaaccccggttcactagcagcccctattgaccataaaccttgttcagccccattggagcccaagagtcaggcatctcgtaaccaacgatggggtgcggtgcgtgccgcagaatcgttgaccgccattcctgagcccgcatctccccaactgttagagacacctattcacgcctctcagatacagaaggtcgaacctgcaggtcgctctaggttcacacccgagctccaacctaaagcttcccagtcacgcaagcggagccttgccactatggactcaccaccccaccagaaacagccacaaagaggcgaagtgtcccagaagaccgtcatcataaaggaggaggaagaggacactgctgaaaaacccggaaaggaggaggatgtagtgactcccaagcctggcaagcggaaaagagaccaagctgaagaggaacccaaccgtattcctagtcggtctttgaggaggacaaaattaaaccaggagagcaccgctccaaaagtgctattcactggtgtagtcgacgcccgtggagaacgagccgttctggctcttggcggaagcttggctggaagtgcagccgaggccagccatctggtgaccgacaggattaggagaaccgtcaagttcttgtgcgccctgggcagggggatccccatcctgtcattggattggctccatcagtccagaaaagccggattcttcttgccacccgacgagtacgttgtcactgaccccgagcaggaaaagaattttggcttctctctgcaagacgctttgtctagagcaagagagaggcgcctgctcgagggatacgaaatatatgtgaccccgggagtgcagccccctcctccccagatgggggagattatctcatgctgtggaggcacgtacctgcccagtatgccacgcagctacaagcctcagagggtagttattacttgccctcaggacttccctcactgcagcataccgctaagggtcggcttgcctctgttaagcccagagtttctattgacaggcgtgttgaaacaagaggcgaagccggaagcgtttgtgctgtctcccctggagatgtcatcaacgta

SEQ ID NO: 229943 - DNA, 4968 bp, Artificial Sequence
  Description of Artificial Sequence: Synthetic coding sequence
atgtaccacaggctggacgtctctctcccatttgtgtcaaggggaccgctcaccgtggaggagaccccacgggtgcagggagaaactcagccccagcgactgctgcttgccgaagattcggaggaggaagtggactttttaagcgagcgacgaatggtaaaaaagtcacgcacaacctccagctcagtaatcgttcccgaaagcgacgaagaaggccattctcccgtgttaggcggactcggcccaccattcgcgttcaacctgaattcagatacagacgtggaagaaggacagcagcctgctactgaagaggctagcagcgcagctagaaggggagctactgtggaggccaagcagagcgaagcagaagtggtgacagaaatacagctggagaaggaccagccgctagtgaaggagcgtgataatgacacaaaagtcaagcggggagcaggaaatggggtggtccccgctggtgtgattctggaaaggtcgcaaccacccggagaggattcagatactgatgtcgacgacgactcccggcctcccggacggcctgcagaagtgcacttagagcgggctcagcccttcggttttattgattcagacactgacgccgaggaagaaaggataccagccacccccgtagtcatcccgatgaaaaaaaggaaaatctttcatggcgtggggaccagaggcccaggcgcacccggattagctcatcttcaggagtctcaagccggttcggacaccgatgtggaggaggggaaggcccctcaggccgttccgctggaaaaaagccaggcgagcatggtgatcaacagcgacactgacgatgaggaggaagtgagcgccgctctgaccctggcacatctgaaggaatctcagcccgcaatttggaatcgcgacgcggaagaggacatgcctcaaagagtcgtgttactccagagatcccagacaaccactgagcgagacagtgatacggacgtggaagaggaggaattaccagtcgagaaccgggaggccgttctgaaggaccataccaagatcagggccctggttcgcgcacattctgagaaggatcaacctccttttggagatagcgacgatagcgtggaggccgacaagtctagtccaggcatccacttggaaaggagccaggcgagtaccactgtagacataaacacacaggtggagaaagaggtaccccctggatctgcaatcattcacattaagaagcatcaggtgtctgtggagggaactaatcagaccgatgtgaaggccgttggaggccctgccaagttgttggtggtctcgctggaggaagcttggccgcttcacggcgactgcgagacagatgcagaggaggggacctcactgacagcaagcgtcgtcgctgacgtgcgcaaatctcagctgccggctgagggagacgctggggcagaatgggctgccgctgtgctgaagcaggagcgagcccacgaggtcggagcccaggggggacccccagtggcgcaggttgagcaggacctacccatcagcagagaaaacctgaccgatttagtggtggatacagacaccttgggcgaatctacccaaccccagagagagggcgcacaggttcctacaggcagggaaagagagcaacacgtggggggtacaaaagactccgaagataactacggggactctgaggatctcgatctccaggccacccagtgctttctcgagaatcaggggctggaggtccagagtatggaagacgagcccacacaagcgtttatgcttacaccacctcaggaacttggacctagccattgtagcttccagaccaccggactgttgaattgcaagatgccccctgcagaaaaagcgagccgaatccgcgctgccgagaaagttagccgcggagatcaggagtctccggatgcctgtctgcccccaacggtaccagaggctccagctccccctcagaaaccattaaactcacagtcgcaaaagcatctcgccccacctcccctactcagccccctgctgccctccatcaagcccacggtgcggaaaacccggcaagacggctcacaggaggcaccagaagcgcctctgtcttctgagctggaacccttccaccccaaacccaagatccgaactcgaaagtcaagccggatgaccccctttccggctactagtgctgctcccgaaccccacccctccacttctacagcccagcctgtgactccgaagcctacgtcccaagctaccaggtctaggactaaccgaagctcagtgaagacccctgaaccagtggtacccactgcccctgagctgcaaccatccacttctactgaccaaccagtaacaagtgagccaacatctcaggtgacacgagggaggaagtccaggtccagcgtgaagactcccgagacagtggttcctactgcactggaactgcaacccagcaccagcaccgatcgccctgttacttcagagccaacgtctcaggcgacccggggacgtaagaataggagtagcgttaagactccagagccagtcgtgccaactgcacctgagctgcagccctcaacttccactgaccagccagtgactagcgagccgacctaccaggcgactcggggaaggaagaataggtcctctgtgaagactcccgagccagttgtgccaaccgcccctgagctgagaccatctaccagcacagatcgcccagtcactcccaagcccaccagtagaaccacccgaagcaggacaaacatgagcagtgtcaaaaatcccgagtcaacggtaccgatagccccagaactcccccctagtaccagcaccgaacagcccgtgaccccagagcctacctcccgtgcgacaaggggtcggaagaacaggtctagtgggaaaacgcccgaaaccttggttcccacagctccaaagctagagccgtccacatccacagatcagccagtgacacctgaaccgaccagccaggcaaccagggggcgaaccaataggagctcagtaaaaactcctgaaactgtcgtgcccaccgcgccagaactgcagccatccacgtcaactgatcagccggtgactcccgaaccaactagtcaggctactcgtggcagaacagacagaagcagcgtgaaaacacccgaaaccgtggtccccacagcacccgagctccaagcttcagcatcaaccgaccaacccgtgacctcggagcctaccagcagaaccactaggggcagaaagaatcgctcctccgttaagacgccggaaacggtcgttccggctgccccagagctacagccatccacttcaaccgatcagccggtcacacctgagcctacctcgagagcaacccggggacgcacaaataggtccagcgtgaaaacaccagagtctatcgtacccatcgcaccagaactgcagccttccacaagtaggaatcaactcgtaaccccagaacctacatcacgcgcaactcgatgccggaccaataggtcttccgtcaagactcccgagcccgtggtacccaccgccccagagcctcacccgacaactagcaccgatcagcctgttacaccgaagttgacgtcccgcgctacccgccgaaagacgaatcggtcaagcgtgaagacacctaaacccgtcgagccggcagcttcggacctagagccctttacgcccaccgatcagtccgtgactcctgaggcaattgcccaaggcggtcagagcaaaacgctgagatctagcacagttagagccatgccggttcccaccacccctgagtttcagtctcccgtgacaacagatcagccaataagtccagagccaattacgcagccatcttgcataaagcggcagcgggcagccggtaatccaggaagcctcgcagcgcctattgaccacaagccgtgctcagcaccactcgagccaaagtcacaagcctctaggaatcaacggtggggggcagtgcgggcagccgaatctctcacagccatcccggagcccgcttctccccagctcctggagaccccaattcacgcctcacagattcagaaggtggagcctgccggtaggtccagattcacccctgaactgcaacccaaggcctcccagtcacgaaagcgctctttagctacaatggattcccccccacatcagaagcagccacaaagaggggaagtgtctcaaaagacagtgatcattaaagaggaagaagaagacaccgccgagaagccaggaaaagaagaggacgtggttacccctaagcccggaaagagaaagagagaccaggctgaggaagagcccaataggataccgtcccgttcattgagacgcaccaaacttaatcaggaatccaccgctcccaaggtcctattcactggggtggtcgatgccaggggcgagagagctgtgctagcactggggggttctttggccggttccgccgcagaagcttcacatctggtcactgaccgaattcgccgtactgtgaaatttctgtgtgcactggggcgagggattcccatcctctcccttgactggctgcaccagtcccgaaaggctggattcttcctgcctcctgatgaatacgtcgtgacagaccctgagcaagagaaaaacttcggtttctctctgcaggacgcactgtcgcgggcacgcgaacgccgacttctggaagggtatgaaatatatgtgacccctggtgttcagccccctcctccacagatgggagaaattatctcctgttgcggtggcacctacctccccagtatgccacgcagctataaaccacagcgtgtggtgatcacttgtccgcaggattttccccattgttcaatacctttacgcgtgggtctgcctcttctgagtcccgaattcttgctgacaggagtcctgaaacaggaggctaaacctgaggcttttgtgcttagtcccctggaaatgagcagtacttag

SEQ ID NO: 229944 - DNA, 4968 bp, Artificial Sequence
  Description of Artificial Sequence: Synthetic coding sequence
atgtatcaccggcttgacgtgtcgctgccctttgtcagcagaggccctttgaccgtggaagaaactccccgagtgcagggggagactcaaccgcagagactgttgcttgcagaggacagcgaagaggaagtagacttcctctctgaacggcgaatggtgaagaagtcccggacaacgtcatcatcagtgatagtccccgaaagtgatgaagaaggccattccccggtgctgggaggcttaggccctccctttgccttcaatttgaattccgacaccgacgtggaagaggggcaacagcctgctaccgaggaggctagcagcgccgcaaggagaggtgcgactgtagaagctaaacagtccgaagccgaggtcgtcacagaaatccaactcgagaaagaccagcctctggtaaaagaaagggacaatgataccaaggtcaaaaggggagcagggaatggagttgttccagcaggggtgatccttgagcgttcgcagccccctggcgaggactccgacaccgacgtcgacgatgatagtagacccccagggcgacccgcagaggtccacctagagcgcgctcagccttttgggttcatagactctgacacagacgccgaggaagagaggatcccagccactcccgtcgtgattcccatgaagaaaagaaagatattccacggagtgggcacaaggggacctggcgctcccggactcgcacaccttcaggagtctcaggctggcagtgatacagacgtcgaggaaggcaaagcaccccaggccgtgcctttggagaagtcccaggcaagtatggtgatcaactccgatacggacgacgaggaggaagtgagtgctgccctgactctggcgcatctgaaggagtctcagcctgccatctggaaccgggatgccgaggaagatatgcctcagagagtggtgctgctgcaacgttcacaaacgaccacagagagagatagcgatacagatgtcgaggaagaagagctgcctgtcgagaatagagaggctgtcctgaaggaccatacaaagatcagagctcttgtgcgggctcactccgagaaggaccagccaccctttggcgactcggacgattccgttgaggctgacaagagttcaccgggaattcatctggagagatcacaggcttcaaccactgtagatattaatacgcaggttgagaaggaggtcccaccagggagtgccatcattcacattaaaaaacaccaagtgtcagttgaaggcacgaatcagacagacgtgaaagcagtcgggggaccggcaaagctgctggtggtgagcctagaagaggcctggcccctccatggcgattgcgaaactgacgctgaggagggcacgagcctgactgcatcagttgtggccgacgttcgcaagagccagctccctgctgaaggcgatgctggtgctgaatgggccgctgcagtgctcaagcaggaaagagctcacgaagtcggcgcacagggcggtcccccagtggcacaggtggagcaggatctaccaatctcccgggaaaacttaacagacctggtggtcgacacagatacactgggtgagtccacccagcctcagcgcgaaggagctcaggtgccaaccggaagagaacgtgagcaacacgttggcggtaccaaggatagcgaggacaactatggcgattcagaagatcttgatcttcaggccacacagtgcttcttagagaaccagggcctcgaagtccaatccatggaagacgaacccacccaggctttcatgctgacaccgccacaggagttaggtcctagccactgtagcttccaaacaactggcctgctcaattgcaagatgcccccagcggagaaggcaagtaggatacgagccgcagaaaaggtgtctcgcggtgatcaagaaagtcccgacgcttgcctcccccctacagtacctgaagcccctgcccctcctcaaaagcctctaaatagccagtcccagaagcacctcgcccctccccctctgctctcccccctactgcccagcatcaaaccaaccgtgcgaaagacgagacaggatggaagccaggaggcacctgaagccccactctctagtgagctcgagcccttccatcctaagcccaaaatcaggacacgtaaatctagtcggatgactcccttccccgctacaagcgctgcacccgagccacatccatcaacttctactgcccagcctgtcactcctaagccgacgtctcaggctactcgttctcgtacaaaccgcagcagcgtgaaaacaccagaacctgtggtgcctacagcgccagaactccaaccctcaacatctactgaccagcctgttacaagtgaaccgacctcacaggtgacaagggggagaaagtcacgttctagcgttaagaccccggaaaccgtggtccctacagcacttgagctgcagccttccactagtacagataggcccgtgacctcagagccgacctctcaggctacccggggaagaaaaaatcgatcctcagttaaaacccccgaacctgtggtaccaacagcacctgagctgcaaccatccacttcaaccgatcagcccgtcacctctgagcccacctaccaggctaccagaggtaggaaaaaccggtcgagcgtgaagactcctgaaccagtcgtgcccaccgctcctgaattgaggccttcaacttccaccgaccgacccgtcacaccaaagccaacatcccggacaacccgttccaggaccaatatgagcagcgtgaaaaaccccgaaagcacagtgccaattgccccagaactgcccccatccacttccaccgaacagcctgtgacacccgaacctacttcaagggctacccggggtaggaagaatcgatcctcaggcaaaactccagaaaccctggttcctacagctccaaagctcgagccttccaccagcactgaccagcccgttacacccgaaccgacttcacaggccactaggggcagaacaaaccggtcaagcgttaagactcctgagaccgtcgtgcctaccgccccagaacttcagccatcaacttccacagaccaacccgtgactcctgaacccacctcgcaggcgactcgagggcgtactgatcgttcttcagtgaagacgccagagactgttgttccgacggcacccgagctccaggcatccgcttccacggaccagcctgtcacatcagaaccaactagccgcacgactcgcggtagaaaaaacaggtcctctgtgaagacacctgaaacagttgtgcctgctgcccctgagttgcagcctagtacttcgaccgatcagcctgtgacacccgagcccactagtagggccacccgcggaaggactaacagaagcagcgtaaaaactcctgagagcattgtgccaatagctcctgagctccagccttccacgagcaggaaccagctggtcacccctgagccaacttccagggccacgagatgccgcacgaatcgctcctctgtgaagacacccgagcctgtcgtgcccacagccccagagccacatccaaccactagcacggatcagccagtgacgccaaagctaacgagcagagccacacgccgtaagacaaataggagctccgttaagaccccaaagccggttgagccggcagcaagcgacttagagccattcacacctaccgaccagagcgtcacaccagaagcgatcgctcaagggggacagtctaagacactccgctctagtacagtgagggcaatgcccgtgccgaccactcctgagtttcaatctcccgttactaccgatcagccgatttcacccgaaccaataacacagccctcctgcattaagcgccagagggctgccggaaatccgggaagtttggcagccccaattgaccacaagccctgttccgcgcctttggagcccaaaagccaggcaagcaggaaccagcggtggggtgcggtgcgagcagccgaaagcctcaccgctatcccagagccggctagcccccagcttctggagactccaatacacgcttcccagatacagaaggtagaacctgccggaagaagtagattcaccccagaacttcaaccaaaggctagccagagtcgaaagcgtagtctggctacaatggactccccccctcaccagaagcagccgcagagaggggaagtgtcccagaagactgtcatcataaaggaagaggaagaggacacagcggagaagccgggaaaggaagaagacgttgtgacacccaagcctggtaagcggaagagagaccaagctgaagaggagcccaatcgcatcccgtctcgctctttgaggagaactaagctgaaccaggaatcaacagcgccaaaagtgttgttcacaggggttgtcgacgctaggggagaacgtgccgtgcttgctctggggggaagcctggcaggaagcgccgctgaagcaagccacctcgtgacagatagaatccgccgtacagtgaagttcctgtgtgccttaggcaggggcattccaatcctatccctggattggctgcatcagtctaggaaggccggattcttcctgccacccgacgaatacgtcgttactgaccccgaacaggagaagaactttgggttttcccttcaagacgcgctgtcccgagccagggaacgaaggctgctcgagggttacgagatttacgttacacctggtgtgcaacccccaccacctcagatgggcgaaatcatatcttgttgtggaggaacctatctgccatccatgccacgctcatacaaaccacagcgagtcgttatcacttgcccccaggacttcccacattgctcgatcccacttagggttggtctcccactcctgtctcccgagttccttctgaccggcgtacttaagcaggaggccaaacctgaggcttttgtattatcgccccttgaaatgagctccacctag

SEQ ID NO: 229945 - DNA, 735 bp, Artificial Sequence
  Description of Artificial Sequence: Synthetic coding sequence
atggaagacacccaggccatcgattgggatgtggaagaggaggaagaaaccgaacaatcgagcgaatctcttcgatgcaatgttgagcccgttggccgactgcatatttttagcggagctcacggcccagagaaggacttcccacttcacctgggcaagaatgtggtgggtcgcatgcctgattgcagcgttgcgctcccctttccttccatctccaagcagcacgccgagattgagatactggcctgggataaggccccaattctgcgtgattgcggctcactgaacggtacacaaatattgcgtccgccaaaagttttatccccgggtgtgagtcacagactgagggaccaggaactgatcctttttgcggacctgttatgtcagtatcataggcttgatgtatctctgccattcgtgtccaggggaccattaaccgtggaggagactccaagagtgcagggtgagacccaaccccagaggctgttactcgccgaggactccgaagaagaggtagatttcctttctgaaaggcggatggtgaagaaatcaagaaccactagtagttctgtgattgtgcccgagtccgacgaggaaggccactcgccagtgctgggaggcctaggaccaccctttgcatttaacttgaactccgatactgatgtcgaggagggtcagcagccacaccggggagggctattgtcatgtcaaaagaggtgtcactgccgagggtag

SEQ ID NO: 229946 - DNA, 5408 bp, Artificial Sequence
  Description of Artificial Sequence: Synthetic coding sequence
atggaagatacacaagccatcgactgggacgtcgaggaggaggaggaaaccgagcagtcttccgagtcactaagatgcaatgtcgaacccgtggggcgattacacatcttctccggtgctcatggccctgaaaaggacttccctctccacttgggcaaaaacgtcgtcggtagaatgcctgactgtagtgttgcgctgccatttccttcaatttccaagcagcacgctgagatagagatcctcgcctgggacaaagccccaattctcagggattgtgggagtctgaacggaacccagatcctgcggcctcccaaggtgctcagccccggagtgtcacacaggctccgtgaccaggagctcattctgttcgccgatctgttgtgtcagtatcacagattagacgttagtcttcccttcgtttctagaggaccactgacagtggaagagactccccgagtgcaaggagaaacacaaccacagcggcttctgctagctgaagattccgaggaggaagtagacttcctgtcggaaaggcgaatggtgaagaaaagtcgcactaccagcagcagcgtgattgtacccgagtcagatgaggagggccactctcctgtactgggaggacttggccctccgtttgccttcaatttgaacagtgatacagacgtggaagagggtcagcagcccgcaactgaggaggccagcagcgctgccagaaggggcgcaacagtggaggcaaaacaatctgaagccgaggtggtgaccgagatccagttggagaaggatcagcctcttgtgaaagagcgcgacaatgacaccaaagtgaagcgcggagctggaaacggtgtggtgcctgcaggggttatcctcgaaaggagtcagccaccaggcgaggatagcgatacggatgtcgatgacgatagccgcccacccggacggcctgctgaagtgcatctagagcgggcacagcccttcgggttcattgacagtgatactgacgctgaagaggagcgcataccagccactcccgtggtgattcccatgaagaagagaaagatttttcacggggtgggaactcgtggcccaggggcaccagggctcgcccacctgcaggagtcacaggcaggttctgataccgacgttgaggagggtaaagcccctcaagccgtgcctctggagaaatcccaggcatctatggtcatcaatagtgacaccgacgacgaggaggaggtcagcgcggctcttaccctcgcccacttgaaggaatcccaacctgccatttggaaccgcgatgctgaggaggatatgccccaaagagtggtgttgctgcagagatcgcagacaactactgagagggactcggacacggatgttgaagaagaagagctcccagtcgagaatagggaggctgttttgaaggatcataccaagatcagagccctggtgcgggcacattccgagaaggaccagcccccattcggggactctgacgacagtgtggaagccgacaagtccagtccagggatccatttagagagatcacaggcatcgactactgttgacattaacacccaagtcgagaaagaagtgccaccagggtctgctatcatacatatcaagaagcatcaggtgtctgtcgagggaactaatcagaccgacgttaaagcagttggcggacctgcgaaactactcgtggtgtctctggaggaagcgtggccccttcacggagattgcgagacagacgcagaggaaggcaccagcctgaccgctagcgtggtggctgatgtgcgcaagtctcagctgcctgcagagggggacgccggtgccgaatgggcggcagcggtccttaagcaggaacgcgctcatgaagttggtgcccagggcggtccacctgtggcgcaggtcgaacaggacctgcctattagccgcgagaatctgaccgacctggttgtggacaccgatacgctcggcgaatctacccagccccagcgagagggcgctcaggtgcctacgggcagggagcgagagcaacatgtagggggtactaaggactcagaagacaactacggtgattccgaagacctagatttacaggccacccagtgttttctggaaaaccaaggcttggaagccgtgcagagcatggaggacgagcctacacaagcatttatgcttaccccccctcaggaactggggccatcccactgcagctttcagacgaccggaaccctagatgagccttgggaggtgcttgccacccaaccattctgcctacgtgagtccgaggattccgagacacaacccttcgacactcacttggaggcatatggcccttgcctctccccgcctcgcgcaatccctggagaccaacaccccgagtcacctgttcacaccgagccaatgggtattcaggggagaggaaggcagactgttgacaaggtcatgggcatccctaaggagactgccgaaagggtgggccctgagagggggcctctcgagcgggaaacagagaaacttctgccagaacggcaaactgatgtgactggagaagaggaactcaccaagggtaaacaggaccgggaacagaagcagcttctggctagggacacccaacgacaggaaagcgataagaacggtgagtcagctagcccggaaagagaccgcgaatcactaaaagttgaaatcgaaacttccgaagaaattcaggagaaacaggttcagaagcaaacactgccttccaaggcattcgaacgggaggttgagcgccctgtggcgaatcgagaatgtgatccggcagagttggaggaaaaggtgccaaaagtcatccttgaacgggatacccagcggggtgagccagaaggagggagtcaagaccaaaaggggcaggcctccagcccaacccctgaacctggagtgggagccggtgatctgcctgggccaacatctgctccggtaccaagcggaagccagtcaggaggcaggggttctcctgtatcacccagacggcaccagaagggtctcctgaactgcaagatgccaccagccgagaaagcgtcgcggattagggcagcagaaaaagtatctagaggtgatcaagagtcaccagacgcgtgcttacctcccaccgtgcctgaagctccagctcctccccagaagccactgaacagtcaatcccaaaaacacctagcccctcctcctttgctatccccactcctaccatcaattaagccaaccgtccgcaagacacgacaagacggatcccaggaggcacctgaggcgcctctctcctccgaactggagcctttccatcccaaaccaaagatccggaccaggaagtcctccaggatgacaccgtttcctgccacctcggcagcccctaaacttgaaccgagcacctcaaccgatcagccagttaccccagagcccacctctcaggccaccagaggcaggacgaatcgctctagcgtcaaaacccccgagacagtcgttccgacggcacccgaactgcagccatcaacaagcaccgatcagcccgtgacacccgaacccacgagccaggcaacacgagggaggaccgacagatcctctgtcaagacaccagaaactgttgtgcctaccgccccagagctgcaggcatcagcatctactgatcagcccgtcaccagcgaacccactagcaggaccacaaggggcagaaagaaccgaagttcagtgaaaactccagaaacagtggtccctgcggctcctgaactgcagccgagtacctctactgatcagcccgtgacccccgagccgacgtctagggcaaccagaggacggactaatagatcctcagtcaagactcccgagagcatcgtccctatcgccccagaactgcagccgtcaacttccagaaaccagctggtcactcctgagccaactagcagagctacccgttgccgaaccaaccgctctagtgtgaaaactcctgaacccgtggtaccaaccgcgccagaaccccacccaacaacatccaccgaccagccagtgacccccaaattgacctccagagcgaccaggaggaaaaccaacaggtcttccgttaaaactcctaaacccgtggaaccagcagcatccgatctcgagcctttcactcccaccgaccaatcagtcactccggaagccatcgcgcagggagggcagtccaaaaccctgcgctcaagcactgtaagagccatgcctgtccccacgacacctgagtttcagtccccagtgacaacggatcagcctatctctcctgaaccaatcacccagccttcatgtataaagaggcagagggcagctggaaatccgggaagcttggccgcaccgattgatcacaagccctgttcagccccactagagccaaaaagtcaggccagcagaaatcagagatggggggctgtgcgggctgctgaatctctcaccgcaataccagagcctgccagtcctcagctgctagaaaccccaatccatgccagtcagatccagaaagtggagcccgctggccgtagtagattcacccccgaactacagccaaaagcttctcagtctcgaaaacgcagtctggccacaatggactctcccccacaccagaagcagccccagaggggcgaggtgtcacagaaaacagtaatcattaaggaagaagaggaggacaccgcagaaaagccgggtaaagaagaggacgtcgtgaccccaaagccgggtaagagaaagagagatcaggctgaggaagagcccaatagaatcccaagccggtcccttcgcagaactaagctgaaccaggagtccactgctccgaaggtcctcttcacgggtgtagttgacgcacggggagagcgcgcagtcctagccctgggagggtcccttgctggcagcgccgctgaggcgagccatttagttacagacagaataagacgcaccgtcaaattcctctgtgccctggggcgtggtatcccaattttgagcctcgactggctgcaccagtcccggaaagctggcttcttcctgccacctgacgaatacgttgttaccgaccccgaacaagaaaagaactttggatttagtctccaggatgctctgagccgcgctcgcgagcgacgtctcctggagggctatgagatttacgtgacacctggagttcagcccccacccccacagatgggcgagattatttcgtgctgcggtggcacgtatcttcccagcatgccgcgttcttacaagccacagagggtggtcatcacatgcccacaggacttcccacattgtagtattcctcttcgggtagggttacccctgctgtcccctgaattccttttgacaggcgttctcaaacaagaagccaaacccgaggcatttgtgcttagtccactggagatgtccagtacata

SEQ ID NO: 229947 - DNA, 4968 bp, Artificial Sequence
  Description of Artificial Sequence: Synthetic coding sequence
atgtatcatagattggatgtaagcctccccttcgtatcacgcggtccactaacagtcgaggaaacccccagagtgcagggtgagacccagccccagcgactccttctcgctgaggacagcgaggaagaagtggacttcctctctgagagacgtatggtgaaaaagagccgaaccacatccagttccgtgatcgtgcctgagtccgacgaggaggggcatagcccagttttggggggattgggacccccattcgcctttaacttaaacagtgatacagatgtcgaggaaggacagcagcccgcaaccgaagaagccagctctgccgcacgcagaggcgcaacagtcgaggccaagcagtcagaagccgaagtcgttactgagatccagttagagaaagatcagccactggtcaaagagagagacaatgacacaaaggtgaaaagaggagcaggcaatggtgtcgtacccgctggtgtcatcctcgaacgaagccaaccccctggtgaggattcagacacagacgttgatgacgatagccgacctcccggaagacctgctgaggtgcacctggaacgtgcccagccctttgggttcatcgattcagacactgacgctgaggaagaaaggatcccagctacaccagtcgtcatcccaatgaagaaaaggaagatttttcatggcgtcggcacaagaggacccggagcacctgggctggcgcacctgcaggaatctcaggcgggatcagataccgacgtcgaagaaggcaaggccccacaggcggtgcctctggagaagagtcaggccagtatggtcatcaatagcgacacggatgatgaggaagaggtgtcagctgctctgaccctggcccacctaaaagaatcacagccagctatctggaaccgagacgcagaagaggacatgccccagagggttgttctgcttcagcgctcccagacaaccacagaacgcgatagcgatactgacgtggaagaggaagagttgcctgtggaaaaccgcgaggcggtgttgaaagatcatactaaaatcagagcgttagtacgcgctcactctgagaaggaccagcctccattcggcgacagcgatgactccgtcgaggcggataaaagtagccccggaattcacttggagagatcacaggctagcactacagtcgatatcaatactcaggtagagaaggaagtgccgcctgggtccgccattatccacataaaaaagcatcaggtgagtgtggaggggactaatcagaccgacgtgaaggcagtgggtggcccagcgaaactgctggtggtcagcctggaggaggcatggcctctccacggcgattgtgagacggacgccgaagaggggacatcacttaccgcaagtgtggtggcagatgtgagaaaaagtcagctgccagcggagggcgatgccggtgcggagtgggccgctgccgtcttaaaacaggagcgggcacatgaggtgggggcacagggtggacctccagtcgcacaggtggaacaggacctaccaatttctagagaaaatctcacagatctggtagtcgacactgatacactcggtgaaagcactcagccccagagggaaggtgcacaggttccaaccgggagagaacgtgaacagcatgtagggggaacaaaggactcagaggataattatggcgatagcgaggacctcgacctccaggcaacccagtgcttcctggaaaatcaggggctggaagtgcagagcatggaagatgaacctacccaggcattcatgctgactccgccacaagaactggggccttcccactgcagcttccaaacaaccggcctgctgaactgtaaaatgccccctgcagagaaagcttcaagaatccgggctgcagagaaggtgagcagaggtgatcaggaaagcccagacgcctgtcttccccctaccgtccccgaggcccctgcaccaccccagaaacctctgaattctcagtcccagaagcacttagcaccaccacctctgcttagccctctactgccctcaatcaagcctacagtgcggaaaacccggcaggacgggagtcaagaggcccctgaagcaccactctctagtgaactcgagccgttccaccctaaaccgaaaatccgtacacggaaaagtagccgcatgacacccttcccggctacttccgcagctcccgaacctcacccctctacttcaacagctcagcccgtgacgcctaagcccacctcccaagccactaggagccgaacgaatcgctcctctgtaaagacacctgaacctgtcgttcctacggcgccagaactgcagccatcaacctctacggaccagcctgtcactagtgaacccaccagtcaggtaacgaggggacgaaaatcacgcagcagtgtgaagacacctgaaaccgtggtcccaacggcacttgaactacagccgtccacctccactgatcgcccagtaacaagtgagcctacaagccaagccactcggggaaggaagaaccggtcttccgttaagacacctgaacctgtggtgccgactgcaccagagctccaacctagcacaagcactgatcaacccgtgactagcgagcccacttatcaggctacgcgcggacggaagaatagatcctcagtgaagacgccggagccggtggttccgacagctcccgagctgagaccaagcacatcaacagatagacccgtcactccgaagcccacatcgcgcaccactcgcagcagaacaaacatgtcttcggtcaaaaaccccgaatctaccgtgcccatagctcctgaactccccccttccacctccacagaacagccggtaactcctgagcccacaagtagggctacacgcggacggaagaatcggtcatctgggaaaacccccgagacactcgtgccaaccgcacctaaactggagcctagtacctcaaccgaccagccagtgaccccggaaccaacatctcaagcaacacgcggtagaaccaaccgatccagtgtgaagacccccgaaaccgtggttcccacagctcctgaattgcaaccctcaacgagcacagaccaacctgtgactcccgagcccacctcccaggcaacacgagggagaacagaccggtcaagtgtgaagacacccgagacagtggtgccaaccgccccagagttacaagcatctgcttcaactgaccaacctgtcacttccgaacccactagtaggaccacccgcggtaggaagaaccgcagcagcgtcaaaacacctgaaaccgtggtgcctgctgcgcctgagctccagccatctacatctacagatcaaccggttacaccagaaccaacctctcgggcaacaaggggtcggactaacaggagcagcgtgaagacccccgaaagcatcgttcccattgctcccgagttgcagccatccacaagcaggaatcagctcgtgacacctgaaccgacaagtcgcgctacaagatgtagaaccaacaggtccagcgttaagacacctgaacctgtcgtcccgacagcgccagagcctcatcctacaacctctaccgaccaacctgtaacacctaagctaacaagccgggcaactaggagaaagacaaaccgaagctcagtgaagacacctaagcccgttgaaccagccgctagcgatctggaaccgtttacgcctactgatcagtccgtgacccccgaagctattgctcaaggtgggcagagcaagactctgcgttcgtctaccgtcagggctatgcctgtgcccacaactcctgagtttcagagtcctgttaccaccgatcagcccatcagtcctgaaccgatcactcagcccagttgcattaaacggcagagggctgcaggcaaccccggatccctagccgctcccatcgaccacaagccatgttccgccccactggagcctaaaagccaggctagcagaaaccaacgctggggtgcagtacgcgcagccgagtccctgacggcaattcccgagcccgcaagtcctcagctgctggagacccctatccatgcctctcagatacagaaggtggaacccgctgggcgttccagattcacaccagagctccaaccaaaggctagccaaagcagaaaaaggtccctcgccactatggatagccctccacaccagaaacaaccgcagcggggagaggtgtcacagaagacggtgatcattaaagaagaggaagaggacactgccgaaaagccaggtaaagaagaagatgtggtcacccctaagccgggaaagagaaaacgggatcaggccgaggaggagcctaatcggatccctagcagaagtttgagacgaacaaaattgaaccaggagtccacagcccctaaggtgctgttcaccggggtggtagacgccagaggggaaagggccgtgctggccctaggaggctcgttggccggatccgcagctgaggccagccacttggtgactgatcgcattagacgaactgtaaagtttctttgcgccctcgggagaggaatacccatcttaagcttggactggctccaccagagtcggaaggccggttttttcttgccacctgacgagtacgtcgtgaccgacccagagcaggagaagaatttcggattctcacttcaggatgccctgagccgcgctcgtgaacgcaggctgttagagggatacgaaatctacgttacacctggagtgcaacctccccctcctcagatgggggaaattatatcctgctgtgggggtacttacctcccatccatgcctagaagctacaagccgcaaagggtcgtgatcacctgcccacaggattttcctcattgttcaatacccttacgggtcggcttaccccttcttagccctgagtttttgctgactggagtgcttaaacaagaggccaaaccggaagcgttcgtcttgtcacccttggaaatgagttcaacatag

SEQ ID NO: 229948 - DNA, 5408 bp, Artificial Sequence
  Description of Artificial Sequence: Synthetic coding sequence
atggaggacacccaagccattgattgggacgttgaggaagaagaggaaaccgaacagagttccgaatcccttcggtgtaacgtggaaccagtgggccgactgcatatattctcaggcgcacacggtcccgagaaagatttccctctgcacctggggaaaaatgtggtcggtcgaatgccagactgcagtgtcgccctacccttcccatcaattagtaagcaacatgcagaaatagagatcctggcgtgggacaaagctccaatccttagagattgtggtagcctgaacggtacccaaatcctgagaccaccaaaggtcctgtctcccggtgtcagccataggctgcgtgatcaggagctcatcctgttcgccgacctgctctgccagtatcatcgcttggacgtttctcttccgtttgtgagtaggggcccactgacagtggaggagacgccaagagtccagggcgaaactcagccacaacggctcctgctggccgaagatagtgaggaagaagttgactttctcagtgaaaggagaatggtcaaaaagagtcgaaccacatcatctagcgtcatcgttccagagtctgacgaagaggggcattctcccgtgcttggtgggctgggacctccgttcgcttttaatttgaactccgatacagatgtagaggaaggacagcagccagctacagaggaagcttccagcgccgcaagacggggagcaacagtggaagccaagcagtcagaagctgaggttgtaaccgagatccagctggagaaggatcagcccctggtgaaagaaagggacaacgacacgaaagttaaaagaggtgccggaaacggggtggtgcccgctggcgtgattctcgaacggtcgcagccacctggtgaggatagcgacaccgacgttgatgacgatagtcgtcctccaggcagaccagcagaggtgcacttggaaagggctcagccatttggctttatcgattcagatacggacgccgaggaggagagaatacccgctaccccggttgtgattcctatgaaaaaaagaaagatttttcatggagtgggcactaggggaccgggagccccaggcctggctcacctgcaggaatcacaggcagggagcgacacagatgttgaagagggcaaggcccctcaagcagtccccctggaaaagagccaagcctctatggtgattaactctgatacagatgatgaggaggaagtcagcgcggcattaactttggcacacttaaaggagagccagcctgcgatttggaatcgggatgccgaagaagatatgccgcagagggtggtgctactgcagaggagtcagaccaccaccgagcgagactcagatacggacgtagaggaggaagaactcccagtggaaaatcgagaggcggtactgaaagatcatactaaaatccgcgctttagtgcgggcacatagcgagaaagaccaacctcctttcggggacagcgacgactctgtagaggctgataagagctctccgggtatccatttagaaaggagccaggccagcactacagtggatataaatacacaggttgaaaaagaagtgccaccgggatctgcaatcatacatattaagaaacatcaggtgtcagtggagggaactaatcagaccgacgttaaagccgtcggaggaccggctaaattgctggtcgtgagcctcgaagaggcctggcctctacatggggactgtgagactgacgctgaagaaggcacctcccttaccgctagcgtagtagccgacgttcggaagagtcaactgccagccgagggagacgccggagcagaatgggctgccgcagtactgaaacaagagagagcccacgaggtgggcgctcagggcggacccccagtggctcaggttgagcaggacctgcccatttcaagagagaacctgactgaccttgtcgtggacacggatacgctaggtgagagtacccagcctcagcgggaaggagcacaggttcctactggacgggaaagagaacagcatgttgggggaacgaaagatagcgaggataattatggtgattccgaggacttagacctgcaagccacccaatgttttctggagaatcaaggcctcgaggcagtacagagtatggaggatgagcccacacaggcattcatgctcacgcccccacaggagttaggaccttcccattgttccttccaaactaccgggacccttgacgagccttgggaggtgttggccacccagcccttctgcctgagagagtccgaggactccgaaacacagccattcgacacacacctcgaagcatacggtccgtgcctctctccaccccgtgctatacctggggatcagcatcctgaaagccctgttcatacagaacccatggggattcagggcagggggagacagacagttgataaagttatgggtattcctaaagagactgcagagagagtggggccagaacgaggacccctagagcgcgaaactgagaagctactccctgaaaggcagaccgatgtgaccggcgaagaggagctcacaaaaggcaaacaggacagggaacagaaacagttgcttgcccgagatactcaacggcaggagtccgataaaaacggtgagtccgcctcaccggaacgggaccgagagtccctgaaggttgagatcgaaacaagcgaagagatccaggaaaagcaggtacaaaaacagactttgcctagcaaagccttcgagcgcgaggttgagcggcctgtggctaatagggagtgcgaccctgcggaactggaggagaaggttcctaaagtcatcttagagcgggacactcagaggggcgaacccgagggaggaagccaagatcagaaaggccaggcttcctcgcccacaccagaaccaggtgtcggtgccggagacctacccggacctacctcggccccagttcctagcggcagccagtccggcggtagagggagcccggtgtcgcctcgacgtcaccagaagggcctgctgaactgcaagatgcctccagccgagaaagcaagccgaatccgggcagccgagaaggtttcaagaggcgaccaggagtcacctgacgcctgtctcccacccaccgttcccgaggcacccgctccacctcaaaaaccgttgaattcccagtcacaaaagcacctcgctccacctcctctcctgtcgccactccttccctccatcaagcccaccgtcagaaagactagacaagatggatcccaagaggcgccagaggcccctctgagtagcgagctagaacctttccaccccaagcctaagatacgtacgcgcaaaagttcccgcatgaccccattcccggctactagcgctgcccctaaacttgaaccttctacatccacagatcagcctgtcactcccgagcccacatcacaggccactcggggaagaactaatcggagcagtgtcaaaactccagagaccgttgtccctacggccccagagctccagccatctacaagtaccgaccagcctgtgacccctgagcccaccagtcaggcaacacgcggtagaactgatcgctcatcagtcaagaccccagaaacggtggtgcccactgcaccagagctgcaggctagcgcgtccactgaccagccggtaacaagcgagcccacctctagaactactcgaggtaggaagaaccgaagtagtgtgaaaacaccagagactgtcgtcccggctgccccagaactacagccaagcacatctacagatcagcccgtgacacccgagccaacatctagggccacgcggggacgtactaaccgttcctccgtgaagacgcccgagagcattgtcccaatcgcccctgagctgcagcctagcaccagccgcaaccaactcgttactcctgaacctaccagccgcgctacaaggtgcaggactaaccggtctagcgtgaagacacctgagcctgtcgtgccaactgccccagaacctcacccgaccacctctactgaccagccagtgactcctaaattgacatcaagagccaccaggaggaagaccaataggagcagcgttaaaacccccaagccagtcgaacctgccgcttccgacctagaaccttttacacctacggatcaatcggtaacccccgaagcaatcgctcaggggggacagagtaagaccctcagatcttcaacagtgagagccatgccagttcctactaccccggagttccagagccctgtgaccactgatcagccgatttcgcccgagcccataacccagccatcttgcatcaaacgacagcgggcagctggcaaccctgggagccttgcagccccaatcgatcacaaaccctgctcagctccccttgagcctaagagtcaggcgtccaggaaccaaaggtggggcgctgtgcgggcagctgagtccttgacagccatcccagagccagcttctccacagctgctggaaacaccgatccatgcgagccaaatccagaaggtggagcccgcaggccgttctcggttcacccctgaactgcagccgaaagccagtcagtcaagaaagaggtccctcgctaccatggatagccctccgcatcagaaacagccgcaaaggggggaggtctcacagaagacagtgataatcaaggaagaggaggaggacaccgctgagaagcccggtaaggaggaagatgtagtgacccccaagccgggaaagcgaaagcgcgatcaggctgaggaggagcctaatcggattcccagccgatccctcagacgcaccaaactgaatcaagaaagtaccgctccaaaagtgttgttcaccggcgtggtcgatgctaggggtgaaagagcggtgctggccctgggaggcagtcttgccggttcagccgctgaagcctcacacttggttaccgatcgcatccggagaaccgtgaagtttttatgcgcgcttggcaggggcattcctattttgtccttagactggctacaccagtcgaggaaggctggtttcttccttcctcccgatgagtatgtcgtgactgacccagagcaagagaaaaattttggattttctctgcaggacgcgcttagcagggccagagaacgacgcctgttggaggggtacgaaatctacgtgacccccggagtgcagcctcctcccccacaaatgggggagatcattagttgttgtggcggtacctatttaccttccatgccacgcagctataagcctcagagggttgttattacctgcccccaggacttccctcattgttccataccgttgagagtcgggttgccattgctctcccccgagtttttgctcaccggcgtacttaaacaggaggcaaaaccggaagcttttgttctgtcgccgctcgaaatgagcagcactta

SEQ ID NO: 229949 - DNA, 666 bp, Artificial Sequence
  Description of Artificial Sequence: Synthetic coding sequence
atggaagacacccaggcaattgattgggatgtcgaggaggaagaagaaacagagcagtcgtccgaatctttgcgttgtaatgtggagccggtgggaaggctccatatcttcagtggtgcccatgggcctgaaaaagattttcctttgcacctggggaagaatgtggtgggcaggatgcctgactgctctgttgcgttaccctttccctccatatctaagcagcacgccgagatagagattcttgcatgggacaaagcgccaatactgagggactgcggtagcctgaatggtacccaaatcctctccagcagcttgcctccacctcagacctccctgctgccactctctttgagacttaggcttcttggcgaggagcaaatagaccccctgagcagattgcttaaacaactgagtccacagcctctcagctacagactgccaccccctcaaacaagtctgtcaccactgtctccgcacctgggtccgttgggtgaggagaaaatcggcccactgtcacggcctctgaaacagctgtgcccccagccgctcagatcaagtctcccgccacctcagacaaacctgtccccacttagcccccacctggggccactgggagctggtcaaatcggccctttaagccgccctctgaaccaactgtctctgtag

SEQ ID NO: 229950 - DNA, 666 bp, Artificial Sequence
  Description of Artificial Sequence: Synthetic coding sequence
atggaagatactcaagccattgattgggacgttgaggaggaagaggagacggagcagagcagtgagtctctgaggtgcaatgtcgagcctgtggggaggctgcatatcttctccggcgcacacggtccggagaaggacttccctctgcatctgggcaaaaacgtggtaggtcgcatgcccgattgctccgtggccttaccatttcctagcatctctaagcaacacgcagaaattgagatcctcgcatgggacaaagcgcctattctcagagactgtggctcactcaacggcacccaaattctgagctcgtcgttaccgcctcctcagacttctttgttgccactctctctccgcctgcgcctgctgggcgaggagcagattgatccattgtcccggctgcttaagcaactgagtcctcagcctcttagctaccggctccctccaccccaaacgtctctcagtcctttgagcccacacctgggccctttgggcgaggagaaaatcgggccactgtcacgccctttaaagcaactgtgccctcagcctctgagcagcagcctgccaccaccacagacaaatttatcaccactgagcccccacttaggaccactgggggcaggacagattggtcccctatcacgccctttgaaccaattaagcctgtag

SEQ ID NO: 229951 - DNA, 738 bp, Artificial Sequence
  Description of Artificial Sequence: Synthetic coding sequence
atggaagacacccaggcaatagattgggacgtcgaggaagaggaagaaactgagcaatcttcagagagtctccgttgtaatgtggagcctgtgggtagactgcatatcttcagcggtgcacacggcccagagaaagatttccctctgcaccttggtaaaaacgtggtcgggaggatgccagactgcagcgtggctctgccatttccatcaatcagtaaacagcatgccgagatcgaaattctcgcctgggataaggccccaattcttagagattgtggttcactcaatggcacgcagatactcagacctcccaaggttctgagccctggggtgtcccatagactacgcgaccaggagctgatactgtttgccgacctcctgtgccagtatcatcgcctggatgtgtctttaccgtttgtatcccgcggaccattgactgttgaggagacacccagagtccagggtgagacgcagccccagcgactgctgctggccgaggattccgaggaagaggtggactttctcagcgagcggcgaatggttaagaagagccgtactacatcttcttccgtgattgtccctgagtcagatgaggagggacactctcccgtcctgggaggactgggcccaccctttgcctttaatcttaatagcgatactgacgtggaagagggccagcagcccgcaacagaggaggccagcagcgccgctcgacgcggtgccacagtggaagcttag

SEQ ID NO: 229952 - DNA, 5477 bp, Artificial Sequence
  Description of Artificial Sequence: Synthetic coding sequence
atggaggatacacaggctatcgattgggatgtggaggaagaggaggaaacagaacaatcctcagagtcactgcgatgtaacgtggagcccgtcgggagactgcatattttcagtggcgcacacggaccagagaaggattttccactgcatttggggaagaatgtagttggcaggatgcctgattgttcagtggcacttccctttccttcaatctcaaagcagcatgcagaaatagaaattctcgcctgggataaggcacctatcttgagagactgtggctcattgaacggcactcagatcctacgccctcctaaagtgctgtctcccggtgtgagtcacaggctacgcgatcaggagctgatcttgttcgccgatttgctgtgccaatatcacaggcttgacgtaagcctgccattcgtgagcagaggaccactgaccgtcgaggaaacacctcgcgtgcaaggcgagacccagcctcagaggcttctactagccgaagactcagaagaagaggtcgattttttatctgagcgcagaatggtgaaaaaaagccgaactacatcaagcagcgtgatcgtgccagaatcagacgaggagggccactctccagtgctggggggtttgggcccacctttcgccttcaacctcaatagcgacactgacgtggaggagggacagcagccagctacggaagaggccagctctgcagcccgtagaggggcaaccgtggaggcaaaacaatccgaagccgaggtcgtgactgagatacagctagagaaggatcaacccctagtcaaagagagggataacgacacgaaagtaaagaggggagccggtaacggcgtggtccccgcaggagtcattctcgaaagatctcagccacctggagaagactctgataccgatgttgatgatgattcccggccacctggcagaccagcagaggtgcacttggagcgggctcagccattcggcttcattgatagcgacaccgatgccgaggaagagagaatcccggctactcctgtggtgatacccatgaaaaagcgcaaaattttccacggtgtgggcacccggggaccaggtgcaccgggactggcacatctccaagagagtcaagcaggctcagataccgacgtggaggaggggaaggctccccaggctgtgccgcttgagaagtcacaggcctcaatggtcatcaactccgatactgacgacgaggaagaggtgagtgccgctctgacactggcacacctcaaagaaagtcaacctgccatctggaacagggacgccgaagaagacatgcctcaaagagtcgtcctactccaaaggtcacaaactacaaccgagagagatagtgacactgacgtcgaagaggaagaactgccggtggaaaaccgggaggctgtgttgaaagatcacaccaagatacgcgctctcgtgagggctcactccgagaaggaccagccgcctttcggcgatagtgacgattccgtagaggcagataagtcttctcccggaatacatttagagcgatcgcaggctagtacaaccgtggacatcaacacccaggtcgagaaagaagtccccccaggcagcgccattatccatatcaagaaacaccaggtgagcgtagaggggacaaaccagacagacgtcaaggccgtcggagggccagccaaactgctcgtagtgagccttgaagaagcatggcctctgcatggggactgtgagacggatgcggaggagggaacctctttgaccgctagtgtggtagccgacgtgagaaaaagccagctgccggcagagggagacgccggtgctgaatgggccgctgctgtgctgaagcaggagcgggctcacgaagtgggtgctcagggaggaccgccagtagcccaggtcgaacaagatctgcccatttcaagggagaacttgacagatctagtcgtcgacacagataccttgggcgaatctacgcagccacagcgcgagggagcccaggtaccaacaggcagagagcgagaacagcacgtcgggggaacaaaagactccgaagacaactatggggacagtgaggacctcgaccttcaggcaactcagtgtttcctcgagaaccaaggactggaggccgttcagtcaatggaagacgagcccacccaagccttcatgcttaccccaccacaagagctagggcctagtcactgtagtttccagacaaccgggctcttgaattgtaaaatgcctcctgccgaaaaggccagtcgaatcagggctgccgaaaaggttagtcggggagatcaggaaagcccagatgcttgcctgcctccaaccgtgccagaggcgccagcccctcctcagaagccactgaattcccagtctcaaaaacacctggccccacctcctttactgagtccactgctgccttcaatcaagcctaccgtgagaaagacacgtcaggatggcagccaggaagcccctgaggcgccactgagcagcgaactggagcctttccatcccaagcctaaaatccgtactaggaagagttcaagaatgactcccttccccgctactagcgccgctccagagcctcatcccagcactagcacagcacaacccgtgacaccaaagcccactagccaggctacaaggagccggaccaatagaagttcggtgaaaacgccagagcctgtggttcctacagccccagagctgcagccttctacgtctaccgatcagcctgtcacatctgagcctacctcacaggtcacacgagggaggaaatcaagatcatcggtgaagacgccagagacagtggttccaacagccctggaattgcaaccctccacgtcaacggatagacccgtgacgagcgagcctaccagtcaggctactcgcggtcgtaaaaatagaagctccgtgaaaactcctgaacccgtggtcccaaccgcccctgaactccagccttccacttctaccgaccagcccgtaacctccgagcctacatatcaggccactaggggcaggaaaaataggagcagcgtcaagacccccgagccagtcgtccctactgcccctgaacttcggccttccacgagcaccgacagacccgtgacacctaaaccaacatctcggaccaccagatcccggaccaatatgagttctgtgaagacaccggaaacagttgttcctactgcaccagagttgcaaatctcaacttcaacagaccaacccgtcacacctaaaccaacttccagaaccactcgttcaagaacgaacatgtcaagtgtgaagaaccccgaaagtaccgtgcctatcgcgccagaactgccccctagtacgagtaccgaacaacctgtgactccagaacctacaagccgggctacccggggacggaagaataggtcctccggtaaaacaccagaaacactggtgccaaccgcgccaaagctggaaccgtcgacatccactgaccagcccgtgacacccgaaccgaccagccaggctacccgtggaagaacaaaccggagcagcgtcaaaaccccagagaccgtcgtgccgaccgctccagaattacagccctctacctccactgaccaacctgttacacccgagcctacaagccaggcgacgaggggccgaaccgacaggagtagcgtgaagacaccagagacagttgtgccaacagcacccgaactccaggcgagtgcgagcaccgaccagcccgtgaccagcgaacctacctctagaaccacacgtggtcggaaaaaccgctcctccgtcaagactcctgagactgtggtccctgccgcaccagagctgcagccttccacctcgactgaccagccagttacccctgagccgacctccagggccactaggggcaggactaatcgctcatccgttaagaccccggaaagtattgtaccaattgcccctgaacttcagccctccacatctcggaatcagctggtgacgcctgagcctacatccagggccacaagatgccgcacaaatcggtcctccgtgaaaactcctgaaccagtggtgccaactgctccagagcctcacccaaccaccagcaccgaccagccggtgaccccaaagctgacttctcgcgctactcgcagaaagaccaacagatcttctgtgaagacacctaaacccgtggagcccgcagccagcgaccttgagccctttacccccactgaccaaagcgtgacaccggaggcaattgcccagggcggacagtcaaagacactgcgctcttctaccgtccgcgctatgcctgtccccaccacacccgaatttcaatctcctgtcaccaccgatcagcccattagccccgaacccattacccagccgtcctgcattaaacgccaacgggcagccggtaaccctgggtctttggcggctccaatcgaccacaagccgtgtagcgccccactagagcctaaaagtcaagcctcccgtaaccagcgatggggtgccgtcagggccgctgaaagcttgacagctatcccagaacccgcttcccctcaactccttgaaacgccaatccatgccagccaaattcagaaggtggagccggcagggaggagcagatttactccggagctgcagccaaaagcttcccagagcagaaagaggtccctggctacaatggacagcccaccacaccaaaagcaaccccaaaggggagaagtatcacaaaagacagtgatcataaaggaagaagaggaagacaccgccgagaagccaggtaaagaggaggacgtggtgactcccaaaccgggtaagaggaaaagggatcaagcagaggaggaacccaatagaattccatcccgtagcctgcgacggacgaagttaaaccaggaatctaccgctcctaaagtgctgttcactggggtggtggatgcaaggggggagcgtgcagtactggctctgggcggatccctggctggatctgctgccgaagcgtctcaccttgtgacagacagaatcaggcggaccgtcaaatttttgtgtgccttgggcagaggcatccccatcctgtctttagattggctgcatcaaagccggaaggcaggattctttctgccgccagacgaatacgttgtaaccgacccggagcaggaaaagaactttggtttcagccttcaggatgccctatcacgggctcgtgaacggagactgctggaggggtatgagatctacgtgactcctggggtgcagcctcccccaccacaaatgggcgagataattagctgctgtggcggaacatacttaccctctatgcccagatcttataagccccagcgggtagtgatcacatgtccgcaggattttcctcactgcagcattcccctcagggttggactgccactgctctccccagaatttcttcttacaggggtgcttaagcaggaggccaaacccgaggccttcgtgttgtcacccctagagatgtccagcacata

SEQ ID NO: 229953 - DNA, 735 bp, Artificial Sequence
  Description of Artificial Sequence: Synthetic coding sequence
atggaagatacacaagctatcgattgggacgttgaggaggaggaggagaccgagcagtctagcgaatctcttcgctgtaacgttgagccagtggggagacttcacattttttccggcgctcacggtcccgaaaaagattttcctctacatctgggcaaaaatgttgtgggcaggatgccggactgctccgtagcccttccctttccgagcatcagtaaacaacacgccgagatcgaaatcctcgcttgggacaaggctcccatcctccgggattgtgggtccctgaacggcacacagattttgcggcctccgaaagtcctaagtccgggagtcagccatagattgagagaccaagaactaatcctttttgctgacctgctctgtcaatatcataggctcgacgtatctctccctttcgtgagccgagggccactgacagttgaagaaacaccaagagtgcaaggtgagacgcagccacagaggctcctactagcagaagatagcgaggaagaagttgattttctgtcagagcgtaggatggttaagaagagccgcaccacttccagctcagtaatcgttcctgaatcagatgaggaggggcacagccctgtcctgggcggactcggcccacccttcgccttcaatctcaacagtgacactgatgttgaggaaggacagcaacctcaccgcggtggcctcctgtcctgccagaaacgttgccactgccggggttag

SEQ ID NO: 229954 - DNA, 735 bp, Artificial Sequence
  Description of Artificial Sequence: Synthetic coding sequence
atggaggacacccaggctatcgactgggatgtcgaagaagaagaggaaacagaacaaagctccgagagcttgcggtgtaatgttgaacctgtcggtaggctgcacatcttctccggtgcacatggaccagagaaggactttccgttgcatctgggaaagaacgtagttgggcgtatgcctgactgcagtgtggctctgcccttcccaagcatctcaaaacagcacgcagaaatcgagattctggcatgggataaagcacccatcctgcgggattgcggctctctgaacggcacacagatcctgcgcccaccaaaagtcctcagccccggtgtttctcacaggctgcgggaccaggaattgatcctattcgcagatcttttatgccagtatcaccgtctggatgtttccctcccattcgtgtcaagaggtccattgaccgttgaggagacaccacgagtccagggagaaactcaacctcagagactgctcttggcggaggatagtgaagaggaagtggacttcctgagcgagcggcgtatggtcaaaaagagccggaccacatctagttctgtcatcgtgcccgagagcgatgaggagggacactcccctgtgctcgggggactcggcccacccttcgctttcaacttgaatagtgacacagacgtcgaagagggacaacaacctcaccgcggagggctcctttcctgccaaaagcgctgccactgtaggggatag

SEQ ID NO: 229955 - DNA, 666 bp, Artificial Sequence
  Description of Artificial Sequence: Synthetic coding sequence
atggaggatacgcaagccatcgattgggacgtggaagaggaagaggaaacggaacagagcagtgagtctctccgctgtaacgtcgagcccgtcggcaggctgcatattttcagcggtgctcacgggcctgaaaaagatttccctctgcatttaggtaagaacgtggtgggaagaatgcctgactgcagtgtggccttgccattcccgtctatctccaaacagcatgctgaaatcgaaattctggcctgggacaaagcgcctatactcagggattgcggtagtttgaacggaacacagatcctttcatcgtctctgcccccacctcaaaccagcttgctccctttaagcttgaggctccgccttcttggtgaggaacaaattgaccctctcagccgacttctcaagcagctgtcgcctcagcccctcagctaccgattaccacccccacagaccagcttatcaccactgtctccccatctgggccctttgggcgaagaaaagatcggccctctgtctcgcccactcaagcagctctgcccccagccactttccagttccctgccccctcctcagacaaacttatcacctctgtcacctcacttgggccctctgggtgccggacagataggacctctttcgagacctctcaaccaactcagcctgtag

SEQ ID NO: 229956 - DNA, 666 bp, Artificial Sequence
  Description of Artificial Sequence: Synthetic coding sequence
atggaggatactcaggctattgattgggatgtggaagaggaggaggaaacagagcagagctctgaatccctgcgatgcaatgtcgagcccgtgggacggctccatatcttttcaggagcacacggccctgaaaaggactttcccttgcatctgggaaaaaacgtggtgggacggatgcccgattgctccgtggccttaccatttccgtctatctccaagcagcatgccgagattgaaatccttgcctgggataaggctcccatcttgagagactgcgggtcactgaatggaacccaaattctgtccagcagcttaccacctccacagaccagtctgcttcctctgtccctgcgcttaagattgctgggggaggaacagatcgacccgctcagcaggctcctgaagcagctgagcccccagcccttgtcctatcggctgcccccaccacaaacctcgttgagccccctgtcgccgcatctcggcccactgggagaagaaaagataggtcctctctctagacctcttaagcagttgtgtcctcagcccctctcttctagcctccctcctccacagacaaacctgtctccactgagtcctcacctcggcccactgggcgcaggtcagattggaccgctctccagacctctcaaccaactgagtttgtag

SEQ ID NO: 229957 - DNA, 5477 bp, Artificial Sequence
  Description of Artificial Sequence: Synthetic coding sequence
atggaggacacccaggctatcgactgggatgtggaagaagaggaggaaactgagcagtctagcgagagcctgaggtgtaacgtagaacctgtgggcaggctgcacatcttttcgggggcacacgggcctgagaaagacttcccgctgcacctcggaaaaaacgtagtcggtcgaatgccagactgtagcgtggcgttgccctttccatcgatctctaagcagcacgccgagatcgaaatacttgcctgggataaggcccctatcctgagggactgcggtagcctcaatggaactcagatcctgaggcccccaaaagtgttgtccccaggagtgtctcatagacttcgggaccaagaactgatcctttttgcagatttgttgtgccagtaccatagactggatgtgtctttgccttttgtcagcagagggccactcacagtggaggagacgcccagagtgcagggggagacacagccccagcggctcctcttggccgaggacagcgaagaggaggtggatttcctttccgaacgtcgaatggtaaaaaagtctaggactaccagctcctccgtcatcgtacccgagagcgacgaggaggggcacagcccagtcctcggtggcctagggccaccctttgctttcaacctgaatagtgacacagatgttgaggaggggcagcaacctgctaccgaagaggcatccagtgcggctagaagaggtgcaacggtagaagcgaagcaaagcgaggccgaagtcgtcacggagatacagttggagaaggatcagccccttgtcaaggagcgggacaatgacaccaaagtgaagagaggcgcagggaacggcgtggtccctgcaggcgtaatacttgagcgcagtcaacctcctggcgaagattccgacacagatgtcgatgacgatagcaggccacccggacgccctgctgaagtgcacctagagagggcacagccattcgggttcattgacagcgacactgacgccgaggaggagcgcattccagcaacacctgtcgttattccaatgaagaagaggaagatcttccacggtgtgggcaccagggggcctggcgctccgggtctggcccatctgcaggaaagccaggcgggtagtgataccgatgtggaggaggggaaagcccctcaggccgtaccactggagaagtcccaggcaagcatggtaattaatagcgatactgacgacgaagaagaggtgagtgctgccctgaccctggcccacctgaaggaatctcagcccgcaatttggaacagagacgccgaggaagacatgccccagcgcgtggtcctgcttcagcggtcgcaaactactacagagcgcgactccgatactgacgtagaggaagaggagctccctgtagaaaatcgagaagcagtgctgaaagaccacaccaagatccgggcattggtcagggctcattccgagaaagaccagcccccatttggcgatagtgatgactccgtggaggccgataagtcttctccgggaatccatctggagcggtctcaagccagcactacagtcgatatcaatactcaggtggaaaaggaggttccccctggcagcgctattatccatatcaagaagcaccaggtgagcgtcgaggggacaaaccagacggacgtgaaggctgtaggtggccctgccaagctactcgtggtatccctggaagaggcctggccccttcacggggactgcgagacagatgcagaagagggtacatctctcaccgccagtgtagtggccgacgttcgaaagagccagttgccagcggaaggggatgctggagctgaatgggcggcagccgtgctgaaacaggagcgcgcacatgaagttggagcccagggcggtcccccagtggcacaggtggagcaggatctgcctatttctagggaaaatttaaccgacctcgtagtcgataccgacaccctgggggaaagcacgcagccacagcgggaaggtgcccaagtccccaccggaagagaaagggaacagcatgtgggcggaactaaggatagcgaggataactatggtgactccgaagacttagatctgcaggcaacccaatgttttctggaaaaccagggtcttgaggctgttcaatctatggaggatgaaccaactcaagcattcatgttgacacctccccaagaattgggtccttctcactgcagctttcaaaccaccggcctccttaattgcaaaatgcctccagctgagaaagcaagtcggataagggcggcagaaaaagtgtcgcggggtgatcaggagtcacccgacgcgtgtctaccaccaaccgtgcccgaggccccagccccaccacagaaaccattaaattcccagagtcagaaacatctcgcaccgccacccctcctatctccgcttctacctagcatcaagcccaccgtgcgcaagactcgacaggatggatcacaggaggcccctgaggcacctctctcaagcgagctcgagcccttccaccctaagcccaagattcggacccgaaagagctccagaatgacacccttcccagccacttcagcggctcccgagcctcatccctccacaagtactgcccaacctgtaacccctaaaccgactagccaagctactcggtcaagaacaaaccggtcttccgttaaaaccccagagccggttgtgcccacagctcccgaactccaaccctcaaccagtacagaccagccagtgacaagcgaaccgacctcgcaggtgacacgtggaaggaagtcgcggagtagcgttaagacccctgagactgtggtccctaccgctctggagctgcagcccagtacatccactgacagacccgtcacaagcgagccaacctcacaggccaccagaggccgtaagaacaggagctcggtgaagacgccagagcctgtggtgccaacagccccagagctccaaccctcgacatccaccgatcagccagtgactagtgaaccgacgtatcaggctaccagaggacgaaaaaaccgaagttctgtgaaaacaccagaaccagtagtcccaaccgctcccgaactgcgaccatctacaagtacagacagacccgttacgccaaagccaacctcccggacaacgagatcacgcaccaatatgtctagcgtgaagacacctgagacagtcgtgcccaccgcacctgaattacaaatctctacatccaccgatcagcccgtgacccccaaacctacctcccggactacacgttcccgcactaatatgagctcggtaaagaatcctgagtcaaccgtgccaattgcacctgaattacctccgtctacatcgacagagcagcctgtgactcccgaaccaacttctcgcgcaacaaggggccgaaagaatcgttcttccggaaagaccccggagactctggtacctactgcacccaagctagagccaagcactagcacagatcagccagtcactcctgaacctactagccaagccacccgtggcagaaccaacagatcttcggtgaagactcctgagaccgttgttcccacggctcctgaactgcagccctcaacaagtacggatcagcccgttacaccagagcctacttcacaggccacaagaggtcgaacagataggagttctgtaaagaccccagaaacggtcgtgcccaccgcacccgaactgcaggcatccgctagcacggaccagccggtaacaagtgagcccacgtcacggactacgagggggagaaagaataggtcaagtgtgaagacccccgagactgtcgtgcccgctgcacccgaactgcagcctagcactagcaccgaccaacctgtgactcctgaacctacgtcaagggctactcgtggacgcaccaataggtccagtgtgaagaccccagagtcaatcgtccctattgctccagaactccagccctctacctcaaggaaccagcttgtgacgcctgaacccacaagccgcgctactcggtgccggaccaaccggtctagcgtgaagactcctgagccggttgtgcccaccgcccctgagcctcacccaaccacaagcacagaccagcctgtcacacccaagctgacatccagagctacacggaggaagacgaaccgcagctctgtgaaaacacctaaaccagtggagccagcggcttcagatttggaaccttttacaccaactgaccagtctgttacgccagaagccatcgcccagggaggacagtctaagacattgcgtagtagcactgtccgcgcaatgcccgtgcccactacccccgaattccagtctcccgtgaccacagaccagccaatttctccagagcccatcacccaaccttcctgtataaagaggcagcgagctgccggtaatccgggatccctggccgcaccgatcgaccataaaccttgtagcgccccattggagcccaaaagtcaggctagtcgcaatcagcgatggggggctgtgcgtgcagcagagtctctcactgccattccagaacctgcctcacctcagctcctggaaaccccaattcatgccagccaaatccagaaggtggaacctgccggacggtctagatttacccctgagctgcagccaaaagcaagtcaaagccggaagcgtagcctcgctactatggactcaccgcctcaccagaagcaaccgcagcgcggagaagtttcccaaaaaacagtcattattaaggaagaggaggaagacacagccgaaaagccagggaaggaggaagatgttgtgacgcccaagccaggcaaacgcaagagggaccaggcagaggaggagcccaatcggatcccttctcgcagcttaagaaggaccaaactaaatcaggagtcgaccgctccaaaagttctttttactggagtggtcgacgcccgaggggagcgggcagtgctcgctctgggagggagccttgccggttccgctgcggaagcgtcccaccttgtcacagaccgaattcgcagaaccgtgaagttcctgtgcgcgctcggcagaggaattcctatactgtcactcgactggctccaccagtcacgcaaagcgggttttttcctcccaccagatgagtacgttgtgaccgatccagagcaggagaaaaattttggtttcagtctacaagatgcattgagccgcgctcgagagcggagactgctggagggatatgaaatttacgtcactcccggtgtccagccacctcctccgcaaatgggggaaatcatcagttgttgtgggggtacctatctgcctagcatgcccaggtcctacaagccccagagagtagtgataacctgtccccaggatttcccccattgttcaatacccctgcgcgtggggctcccattgttatcacctgagtttttgttaaccggggtgcttaaacaggaagctaagcctgaagccttcgtactctctccactcgaaatgtcttccaccta

SEQ ID NO: 229958 - DNA, 738 bp, Artificial Sequence
  Description of Artificial Sequence: Synthetic coding sequence
atggaggacactcaagccatagattgggacgtggaagaggaggaggagacagagcaaagtagtgagtcacttagatgcaacgtggagcctgtgggcaggctccacatcttcagcggggctcatggccctgagaaggacttccctctccacctcgggaaaaatgtggtaggcaggatgcccgattgctcagtggctcttccatttccttcaatctcaaagcagcacgcagaaatcgaaattctggcttgggacaaggctcctatattgcgggactgcggcagccttaatggaacccaaatcctgcgccctccaaaggtactcagccccggtgtgtcccaccgcttgagagatcaggagctcattctgtttgccgacctgctttgccagtaccataggctggacgtgtcactgccatttgtgagcaggggccctctcaccgtagaggaaacccctagggtgcagggagagactcagccccagcggctgttgctagccgaggacagcgaagaagaggtggactttttgagtgagaggcgtatggtaaagaaatcaagaacaacttcaagtagcgtaatcgttccggagtctgatgaagagggacacagtccagttcttgggggattaggtccccctttcgcttttaaccttaacagtgacaccgacgtcgaggaggggcagcagcctgcaacagaggaagcctctagtgctgccaggcggggagctactgtggaggcatag

SEQ ID NO: 229959 - DNA, 2238 bp, Artificial Sequence
  Description of Artificial Sequence: Synthetic coding sequence
atggcttgtcgacagagagggggatcctggtccccgagcgggtggttcaacgctggatggtcaacatatcgaagcatctcattgtttttcgcccttgtcacctcgggcaatagcattgacgtgtcacagcttgtgaaccccgcattccctggcaccgtcacctgcgacgaaagggaaataaccgtcgagttcccaagcagtcctgggacgaagaagtggcatgcttctgtcgtagatcccctgggtctcgatatgcctaactgtacatatatcctggacccagagaaactgacgctgcgtgccacctacgacaattgtacgcggcgtgttcatgggggtcaccaaatgactatccgcgtcatgaataactccgcggcattgcgacatggcgcagtgatgtaccaatttttctgccccgctatgcaggttgaggagacccaagggctctcagcctcaaccatctgtcagaaagacttcatgagtttttccctaccgagggtgttctctggcctcgccgacgactctaaggggacaaaggtccagatgggttggtccattgaagttggggacggggctcgggcaaaaacccttacattgccagaagctatgaaagagggtttcagtcttttgattgataaccaccgcatgacgttccacgttccgttcaatgccacaggtgtcacccactacgtacagggcaattctcacctatacatggtgtccctaaagcttacatttatctctcctggacaaaaagtcattttctcttcccaggctatctgtgccccagatccagtaacgtgcaatgctacacatatgactctgaccattcccgagttccccggaaaactcaagagcgtttcattcgagaatcaaaacattgatgtgtcccagctgcacgataacggaatcgatctggaagcaacaaacggcatgaaattacacttcagcaagaccctcttgaagacgaagttgagcgaaaagtgtttgttacaccagttctacttggcctccttgaaactgacattcctgctacgtccggagaccgtgtccatggtcatttacccagagtgcctgtgcgagagtcctgtcagtattgtaactggcgagttatgcacccaggatggatttatggatgttgaagtctatagctaccagacacagcctgctctcgatctgggtacgctgcgagttggcaacagctcatgccagccggtgtttgaggcccagagccagggtctggtacggttccatatccctctcaatggttgcggaacacgctataaatttgaggacgataaagtggtgtacgagaacgagatccacgctttgtggaccgacttccccccatccaagatatcacgtgactcagaatttcggatgacagtgaagtgcagctatagccgcaacgatatgctcttaaacattaatgtcgaatcattgacccctcctgtcgcgtctgttaagttagggccttttaccctgatcctgcaatcataccctgacaattcctaccagcagccttacggagaaaacgagtatccactggttagatttttgaggcagcctatatacatggaggtgcgggtgctgaacagagatgaccccaatattaagctcgtgctggacgactgttgggccacttcaacaatggatcccgactcatttccacaatggaatgtcgtcgtggatggttgcgcgtacgatctggataattaccaaactactttccacccagtggggagcagtgtcacacaccccgatcattatcagcgattcgatatgaaagcctttgcatttgtgagcgaggcccacgtgctgtcctccctggtctatttccactgttctgccctgatctgtaatagattgtctcctgattccccactgtgcagcgtcacgtgccctgtgagtagcaggcacagaagggccactggcgctactgaggctgagaagatgacagtctccctcccaggtcccattctgctgttgtcagacgacagctccttccgcggagtcggatcaagtgatctgaaagcctctggtagctcgggggagaaatcccggagcgagacaggggaggaagtcggctctcgaggcgctatggatactaaaggacataaaacggccggtgatgtgggatcgaaggctgtggccgctgtagctgccttcgctggtgtcgtggctacactcggttttatctactacctgtacgaaaagcggaccgtttccaaccactag

SEQ ID NO: 229960 - DNA, 1806 bp, Artificial Sequence
  Description of Artificial Sequence: Synthetic coding sequence
atggctaagacaccctccgatcacctattgtctactctggaagagcttgttccctatgattttgagaaatttaaatttaagctccaaaataccagcgtgcagaaagaacacagccgcatcccacgaagtcagattcagcgggctcgccctgttaaaatggcgactctactggttacctactacggggaagaatacgccgtgcagctcaccctccaggtgctgagagccataaatcagcggcttctcgctgaagagctgcacagagccgcaatccaggacatgggttcttgttacgtagctcaggtagggcttgaactcctgatctctaacaatccacccattttcgcctccgagacggcgggtatcactggtcgccctccagacaccgcggcttccccaagatgccatgcccaggagggtgatccggtggacgggacatgcgtgagagactcttgctcattccctgaggctgtgtctgggcatcctcaggcgagtggttcacgttctccgggttgtccaaggtgtcaggacagccacgagagaaaaagcccaggctcactctcaccccaaccgcttccacagtgcaaacgacatttgaagcaggtccaactgctgttctgtgaggaccacgatgagccgatttgcttgatttgctctctatcccaggagcaccagggacaccgtgtgcgtccaatcgaggaggtggcactcgaacacaaaaagaaaatccaaaaacaactcgaacacttgaagaaactgagaaagagcggagaagagcaacggagttatggcgaggagaaggcggtgagtttcctgaagcagacggaggcactaaaacagcgtgttcagagaaaactggagcaggtctactacttcctggaacaacaggagcacttcttcgtggctagcctggaagatgttggtcagatggtgggccagattcgcaaagcctacgataccagagtgagtcaggacatcgccttgcttgatgccctgatcggggagctcgaggctaaagaatgtcagagtgagtgggagctgctccaggacatcggcgatattctccatagagcgaaaacagttccagtccctgaaaaatggactacccctcaagagattaagcagaagattcagctactacatcagaagtcagaattcgtcgagaagtccaccaaatatttctccgagacgctgaggagtgagatggaaatgtttaacgtaccggagctgatcggggctcaggcccacgcagtcaacgtcattctcgatgctgagacagcctaccccaatctgattttttccgacgacttaaagagcgtcaggctaggtaacaaatgggagcgccttcccgacggtccccagcgcttcgactcatgtattattgtcctgggcagccccagtttcctgtccggaaggcggtattgggaagtggaagttggcgataagaccgcctggatcctaggcgcttgcaaaactagcatcagtaggaaggggaatatgacgctgagtcccgaaaatggctactgggtggtgattatgatgaaagagaatgagtaccaagccagctcagtgcccccaacacggttactgattaaggagcctcccaaacgcgtggggatttttgtggattatcgcgtgggaagcatctccttctacaatgtgactgcgaggagccacatatataccttcgcatcttgctctttttccggtccattgcagcccattttttcaccagggactcgggacggaggcaagaacactgcgcctctcactatttgcccagtgggcggtcagggacccgattag

SEQ ID NO: 229961 - DNA, 1239 bp, Artificial Sequence
  Description of Artificial Sequence: Synthetic coding sequence
atggccaagacccctagtgaccatctcctttctacactggaggaactggtcccctacgatttcgaaaagtttaaatttaaacttcaaaacacgagcgtccagaaggaacatagcaggattccccgatcacaaatccagcgggctaggcctgttaagatggccaccctccttgttacctattatggcgaggagtacgcagtgcaactaacactacaggtcctgcgggcaatcaaccagcggttgctcgctgaggagttgcatagagccgctatccagggtcgccctcctgacactgctgcttcaccacggtgccacgcacaggaaggcgaccccgtcgacggaacatgcgtcagagatagctgttcctttccagaggccgtttccgggcacccgcaagcctcaggtagtaggagtccaggatgccctaggtgccaagattcccacgaacgaaagtctcccggatctttgtctccacagcccctaccacagtgtaagagacacctgaagcaggtgcaacttcttttctgcgaagaccatgatgagcccatctgcttgatctgtagcctcagccaagagcatcagggtcaccgggtgcggccaattgaggaggtagccctcgaacacaagaagaagatacaaaagcagctcgagcacctgaagaagttacgaaaaagcggagaagagcagcgctcctacggcgaggaaaaagccgtgtcctttttaaagcagacagaagcgctcaaacagcgcgtgcaacggaagctcgaacaggtgtactactttctcgaacagcaggagcacttctttgtcgctagtctcgaggacgtgggccagatggtcggacagatcagaaaagcctacgacaccagagtgtcccaggacattgcacttctcgatgcactgattggggaactggaagcaaaggagtgtcaatccgagtgggagctcctgcaagatatcggggacattttgcatagggctaaaacagtgcctgtcccagaaaagtggacgacccctcaggagattaaacagaagatccagttactgcaccagaaaagcgaatttgtagaaaaaagcacaaagtacttctccgagaccctccgcagtgagatggagatgtttaacgatcacagcccgcaacacggcctgggttcctgggaagagcgagattatacccagcacagcatgcaggggccaaagcagggtgtcccttgttttttggttgttaggacagtttag

SEQ ID NO: 229962 - DNA, 1713 bp, Artificial Sequence
  Description of Artificial Sequence: Synthetic coding sequence
atggctaagaccccttccgaccatctgctttctactttagaagagttagtgccatacgatttcgagaagttcaagttcaaacttcaaaatacatcggtccagaaggaacatagtcgcattccacgcagccagattcaaagagccagacccgtcaagatggctacattgctcgtcacatactatggcgaggagtatgcagtgcaattgactctccaagtcctccgtgccatcaaccagaggttgttagctgaggaactgcacagggccgctattcagggacggcctccagatactgccgcttccccccgttgccacgcgcaggagggcgatcccgtggacggaacatgtgtcagagattcttgttctttccctgaagcagtttccggtcacccccaagcgtccggcagccgctcaccaggctgtccacggtgtcaagactctcatgagcgcaagagtcctgggagtctttcccctcagcccctcccccaatgtaagcgtcacctgaaacaggttcagctcctcttctgcgaagaccacgatgaacctatttgtttgatctgctctctgtctcaggagcaccagggccatagggtcagacctattgaagaagtggctctggaacacaaaaagaaaatccagaaacagctggagcacctgaagaagctgagaaagtcaggtgaggagcaacgcagctacggggaggaaaaagctgtcagctttcttaaacagaccgaggcgctgaagcagcgcgtccagagaaagctggaacaggtgtactatttcctggagcaacaggagcacttctttgtcgcgagcctggaggacgttggacagatggtgggtcaaatcaggaaggcctatgatacacgagtatcacaagacattgcactgcttgacgcactgattggtgagctggaggctaaagagtgtcaaagtgagtgggagctcctccaagacatcggagatattttgcaccgcgcaaagactgtacccgtacccgagaagtggaccaccccacaagagattaagcagaagattcagttactgcatcagaaatccgagttcgtggagaaatccacgaaatacttctccgaaacccttcggtctgagatggagatgttcaacgtgcctgagctcatcggtgcccaggcccatgccgtcaacgtgatacttgacgcagaaacggcttatcccaatctaatttttagtgatgacctgaaatccgtgaggttggggaacaagtgggagagacttcctgatggcccacagaggtttgactcctgcatcatcgtgcttggttctccctccttcctgtccggcagaaggtactgggaggtcgaggtcggagacaaaaccgcctggatattgggcgcatgtaaaacgtccatttcaaggaagggcaatatgacactatctcctgaaaacggttattgggtggtcattatgatgaaagagaacgagtaccaggcgtcttcagtcccgccaacaaggttgctgatcaaggaaccccctaagcgtgtcggcattttcgtcgattaccgcgttggctcgattagcttctacaacgtgactgccaggtctcatatctatacctttgcttcttgttcatttagcggtcctctgcaaccaatcttctctccaggaacacgagacggtggcaaaaacacagctccgctgacaatttgtcccgtgggcggacagggccctgactag

SEQ ID NO: 229963 - DNA, 1209 bp, Artificial Sequence
  Description of Artificial Sequence: Synthetic coding sequence
atggctaagacgccgtcagatcacctgctcagtacattagaagagctggttccgtatgatttcgagaagttcaagttcaagctgcagaacacctccgttcaaaaagagcacagtcgaatcccgcgatcacagattcagcgtgcccgtcctgtaaaaatggcaactctgttagttacatattacggcgaagaatatgccgtgcagctaaccctacaggtgcttcgcgcaattaatcagagacttttggctgaggaactgcaccgtgccgcaatccaaggacgtcctcctgacacggctgcgagcccgaggtgtcatgcccaggaaggtgaccccgttgacggcacgtgtgtgcgcgacagctgttctttccccgaagccgtgagcgggcacccccaggctagtggatctcggtctccaggatgccccagatgtcaggatagtcacgaaaggaagagtcccggatccttgtcaccacagcctcttccccaatgcaagcgacatttaaagcaggttcaactgctgttttgcgaggatcacgacgagcccatctgcctgatttgcagtctctctcaggagcaccagggacacagggtccgcccaattgaagaggttgcactggaacacaaaaaaaaaatacagaagcagctcgaacatctcaaaaaattgcgcaagagtggagaagagcagcgcagttatggcgaggaaaaggccgttagctttttgaaacagactgaggcactgaagcagcgggtgcagcgaaaactggaacaggtatactactttctggagcagcaagagcactttttcgtagctagtttggaagacgtcggccaaatggtggggcagattcggaaggcgtatgatactcgagtctcgcaggacatagcactgctggatgcactaatcggcgaactcgaagctaaagagtgccagtctgagtgggagctgctccaagacattggcgatatcttgcaccgggcaaaaactgtcccagtgccggaaaagtggaccaccccccaagagattaagcagaaaatccaattactgcatcagaagtccgaatttgtggaaaaaagtaccaagtatttttcagaaaccttaaggagtgagatggaaatgtttaacggcgagtcctctggcaacggggtctgttggcctggtgtggtggccgtcttcccgtgtgctgtcgacctaaggggcccaatttag

SEQ ID NO: 229964 - DNA, 1338 bp, Artificial Sequence
  Description of Artificial Sequence: Synthetic coding sequence
atggccaagacaccaagtgatcatctgctgagcacgctcgaagaactcgttccttatgatttcgaaaaattcaaatttaagctgcaaaacacttcagtgcagaaggaacatagtaggattccacggagccaaatacaaagggctaggcccgttaagatggccacgctgctggtaacatattatggggaggagtatgccgtacagcttactctgcaggtgttgagagccattaatcagaggttattggcagaggagctgcatcgggctgctattcagggcaggcctcccgatactgcagcatcccctcgctgccatgctcaagaaggagaccccgtggacggtacatgcgtgcgggattcttgtagcttccccgaagcagtgagcggccacccccaggccagcggcagccgctctcccggttgtccccgatgtcaggatagccatgagaggaaatctccagggagcctgtccccccagccactgccacaatgcaagcgccacctgaagcaggtacagttgctgttttgtgaggaccatgatgagcctatttgcttaatctgcagcctttctcaggaacatcaggggcatcgtgtccgccctatcgaggaagttgcactggaacataaaaaaaagatccaaaaacaattggaacatttaaaaaaactgcgcaaatcgggcgaggaacagaggagctacggggaagaaaaggccgttagctttctcaagcagaccgaggcattgaaacagcgcgtccaacggaagctggagcaggtctattacttccttgagcagcaggaacacttttttgtcgccagtttggaagatgtgggccagatggttggtcagatcagaaaggcctacgatacacgtgtaagtcaggatatcgccctcctcgatgcgctgatcggcgagctcgaagccaaggagtgtcagtccgagtgggaactgctgcaagacatcggcgacatcttacacagagccaagactgtacccgtgcctgaaaaatggactactcctcaggaaataaagcagaagatacagttgttgcatcaaaaatccgagttcgtggagaagagtaccaaatatttttccgaaacgctgagaagcgagatggagatgtttaatgatcattccccacagcacggactgggctcttgggaggagcgagactatactcagcacagcatgcagggccctaagcagggcgtgccttgtctgtctttgctgtcaggtcagtgtaaccttgcacccctgaacgcaaacgcccaagatttctttccctacctgatatttttgagatcaagcggggcagattggcgttctggcacctgttgttag

SEQ ID NO: 229965 - DNA, 2067 bp, Artificial Sequence
  Description of Artificial Sequence: Synthetic coding sequence
atggccaagacgcctagcgatcaccttctatccacattggaggagctggttccatatgattttgagaaattcaaattcaaactgcagaatactagtgttcagaaggagcatagccgcattccccgaagccagatccagcgagcaagacccgttaaaatggccactctgttggtcacttactacggcgaggagtacgcggtgcagctgacactgcaagtactaagagctataaaccagaggttgcttgccgaggagctccaccgcgctgctatccaggagtattcgactcaagagaacgggactgatgatagtgccgctagtagctcactgggagagaacaaacctaggagccttaagactccggaccatccagagggcaacgaaggaaacggccctcgcccttacggagggggtgccgcatccctccgctgcagccagccagaggccggtagggggctttcacgcaaaccattgtccaagcggagggaaaaagcgtcagaaggcctggatgcccagggcaagcccaggacacgctctccagcgttgccgggaggcagatctcctggcccatgccgtgcccttgagggaggacaggcagaggtaagactgaggcggaacgctagtagcgctggtcgcttgcaaggcttagctgggggagctccgggtcagaaggagtgtagacccttcgaggtctacttgcctagcggtaagatgcgcccaagatctttagaggtgacaatctctaccggcgaaaaggctcccgcaaacccagaaattctcctgacacttgaggagaagactgcagcgaatctggattcagccactgagcctagagcccgtccaacccctgacggaggggcttctgcggatctgaaagagggacccggtaaccctgaacactccgtgacaggaagaccaccagacacggccgcaagcccacgctgccacgctcaggaaggggaccctgtcgacggtacttgcgtacgggactcgtgtagctttcctgaagctgtgtctggtcaccctcaggcttctggcagcagatctcccggatgtccacgttgccaggacagccacgagcggaagtctcctggatctctgagcccgcagccactcccccagtgtaaaaggcacctcaagcaggtacagctgctgttctgcgaagatcacgacgaaccaatttgcctgatctgctccctctctcaggagcatcaggggcaccgcgtgagacctatcgaggaggtcgctctcgagcacaaaaagaagatccagaagcagctcgagcacctgaagaagctcagaaagtctggagaggaacagaggagttatggggaggagaaagcagtttcctttttgaagcagaccgaggctctgaagcaacgcgtgcagcgcaaactcgaacaagtctactactttttagagcaacaggaacatttctttgtggcctctcttgaagatgtcggacagatggttgggcagatcaggaaagcttatgacacaagggtgtcccaagacatcgccctactagacgcgctgatcggcgaactggaagcaaaggagtgccaatccgaatgggagcttctgcaagatattggcgacatactccatagagccaagactgtgcctgtccccgaaaagtggacaacaccccaggaaatcaaacagaaaatccagctgctccaccagaaatctgagttcgtcgaaaagtcaacaaaatacttcagtgaaacactgagatccgagatggaaatgtttaatgtgcccgagcttatcggggcacaagcccacgcagtaaatgtgatactggacgctgaaacagcctatccgaacctgatttttagcgacgatctcaagtccgtgaggctaggcaacaagtgggaaaggctccctgatggtcctcaacgcttcgacagctgtattatcgtgctcggaagcccaagttttctgtcaggcagaagatattgggaggtcgaggtgggtgacaaacgcttcagctgtctgtcacttcggtcgtcatgggattacagaagaccacctccctgcccagcaaattttctccatttttag

SEQ ID NO: 229966 - DNA, 2796 bp, Artificial Sequence
  Description of Artificial Sequence: Synthetic coding sequence
atgcctcctttgaagtcaccagccgcattccatgaacaacgcaggagcctcgaaagagcccgtacggaagactacttgaagcgaaaaataagaagccgccctgaacggagtgagctggtccggatgcatattctagaagaaacctcggccgaaccaagtcttcaggctaagcagctgaagctcaagagagccagactggccgatgacttgaacgaaaaaattgctcagcgcccaggacccatggagctggtcgaaaaaaacatcctgccagtagagtcatcacttaaggaggcgattatcgtggggcaggtaaactatcccaaggtcgccgatagctcttccttcgacgaggattcctcagatgctcttagcccagaacagcctgccagccacgaatctcagggcagtgtgcccagccccctagaagccagagtgtccgagcccctgctctccgccacgtcagcatctcccactcaggtcgtttcccagctgcctatggggagagactccagggagatgctctttttggccgaacagccaccactgccaccacctccattactgcctccttcattgacgaatgggaccacaattcctactgccaagagtacacccacgctgatcaaacaatcgcagcccaaatccgcttccgagaaatcccaacgcagcaaaaaggctaaagaactgaagcctaaggtcaagaagctgaagtaccatcagtacataccccctgaccagaagcaggatcggggtgccccaccgatggactccagctacgccaagattttgcaacagcagcaactcttcctccagctgcagatactgaatcagcaacagcagcagcaccataactaccaggcaatactcccagccccaccaaagtctgctggcgaagctctgggctcttctggaacacccccagttcggtcactgagcacaactaactcgtcttctagttcaggagcacccggtccgtgtgggctcgctaggcaaaattcgacctctctaaccggtaagcccggtgcactgccggcaaacctggatgacatgaaggtggcggagctcaagcaggagctgaagctgcggtcactgccagtatccggcacgaaaactgaattaatcgaacgcctgagggcgtaccaggaccagattagccctgtacctggcgctccaaaggcaccagccgcaacctctattttacataaagctggcgaagtggtggtggccttccctgctgcgagactctccactggacctgctttagtagcggctggactggccccagcggaagtcgtggtggcaaccgtcgcaagttccggcgtggtgaaatttgggtctacaggctctacacctcccgtgagcccaacccctagcgagcgatcattactgtccacgggcgatgagaacagcacacccggagatacctttggggagatggtcacttccccacttacccaacttaccctgcaggcctccccgctgcagatattggtgaaggaggagggacctagagcaggaagctgttgcttgtctccaggaggccgagcagagctggagggtcgagacaaagaccagatgctacaggagaaagataagcagattgaggcactgactcggatgctgcggcagaagcagcagctcgtggagcggctgaagttgcaacttgaacaggagaaacgtgcacagcagcctgctcctgcacctgccccactagggacgccagtcaaacaggagaattcattctccagctgtcagctctcccagcagccactcggacccgctcatccttttaatccatccctggccgctcctgccacgaaccacatcgatccatgcgccgtcgccccagggcctccgagcgtggttgttaagcaggaagccttacaacctgaacctgagcccgtgcccgctccacaactgctgttggggcctcagggcccatccctgattaagggtgtggcacctcccacactgatcaccgattccacaggcactcacctcgttctgacagtcaccaataaaaatgctgattctccgggtctctctagcgggtctccccaacagccaagctcgcagccagggagccctgcccctgcgccaagcgcacagatggaccttgagcaccctttacaaccgttatttggcacgcccacatcattgctcaaaaaagagcccccaggttatgaggaggctatgagccagcagccaaaacaacaggagaatggatcatccagccagcagatggatgatctttttgacatcctaatccaatccggagaaatctccgctgacttcaaggagcctcccagtctgccgggtaaggagaaaccgtcccctaaaacggtatgcgggtctcctctagctgcccagccctcacccagcgcagaactgccccaggccgcaccaccccctcctggctcacctagtctgccaggcagattggaggacttccttgaaagttctactggcctgcccctcctcactagcgggcatgacgggccagaaccccttagcctgatcgatgaccttcactcgcagatgctgtcctctaccgcaattctggatcatcctccttcccccatggacactagcgagctgcactttgtgcccgaaccttcctcgacaatgggcctggacttggcggatgggcacttagactctatggattggttggagttgagctccggaggaccagtgctgtcactggctcctctgtcaaccaccgcgccttctcttttttcaactgactttctggacggtcacgacctgcaactccattgggattcatgtttgtag

SEQ ID NO: 229967 - DNA, 2397 bp, Artificial Sequence
  Description of Artificial Sequence: Synthetic coding sequence
atgcctccgctgaagagcccagctgctttccacgaacagagacgatctctcgaacgcgcaagaacagaggactacctaaagaggaagattcgttcccggccagaacgctcagaactcgttcggatgcacatactcgaagaaacttcagctgagccatccctgcaagcaaagcaactcaaattaaagagggcacgcttggccgacgacctaaatgagaagatagctcaacggccaggcccaatggagttggtggaaaagaacatcctcccggtagagagcagcttgaaagaagccatcattgtgggacaggtgaattatccaaaagtagcagacagcagctcgttcgacgaggactctagcgacgccttgagccccgagcagcctgcgtcacatgaaagtcaaggatccgtccccagtccattagaagcgagggtctcagaaccgctgctctcagctaccagcgccagccccacccaggtggtgtctcagctaccaatgggacgggacagccgcgaaatgctttttctggcagaacagccgccactgcctccaccccctctgctgcccccttccctgacaaacggcaccactatccccactgccaaaagcacgcccactcttatcaaacagtcacagccgaaatcggcgagtgagaagtcccagcggagcaagaaggccaaagaattaaagccaaaagttaagaagcttaaataccaccaatacatcccacccgaccagaagcaggatagaggggctcctccgatggactcctcttatgctaaaattcttcagcagcagcagcttttcctgcagctgcagatccttaaccagcaacaacaacagcaccataactatcaggccattcttcccgcaccaccaaaaagcgctggggaagctctgggatccagtggcaccccccctgtgcgcagtctaagtaccacaaatagttcctcaagctctggggcacccggaccctgcggtttagccaggcaaaattcaacatcactgaccgggaagccaggagcactgccagcgaatctcgacgatatgaaagtggctgagctgaagcaggagctgaaacttcggagtctgcccgtgagcggtacaaaaactgaattgattgaacgactgagggcctaccaagatcagatttctcccgtgccaggggctcctaaggctcctgcggcaactagcattcttcacaaagccggagaggtggtcgtagcattcccagccgcaagactgagtaccggcccagccttagttgccgcaggcctcgccccagctgaggtggtggtggccaccgtggccagctcaggtgtggtaaaattcgggtctacagggagtacccccccagtcagcccaacgccctcagagcgaagcttactgagcaccggcgatgagaacagcacgccgggtgatactttcggcgaaatggttacctcacccctgacacagctgaccctgcaggctagccccctgcaaatcctggtaaaggaggagggacctcgtgcagggagttgctgtctctcacctgggggtcgggctgagctggagggacgcgacaaggaccagatgctccaagaaaaggacaagcagattgaagcactcactcggatgcttcggcaaaagcagcagttggtggagcggctaaaactgcagttggaacaggagaagagggcccagcaacccgctcccgctcccgctcctctgggcacacccgtgaaacaggagaactccttcagctcatgccaactgagccagcaacccctgggacccgctcatccctttaacccctccttggcagccccagccaccaaccacattgacccctgcgcagtagcacctgggcctccatctgtcgttgtgaagcaggaagctcttcaaccagagcccgagcccgtgcctgcgccacagctccttttggggccacagggaccatctcttattaagggcgtagccccaccaactctgataacagatagcacaggcacacacttagtcttgaccgtgaccaacaagaacgcggattccccgggactatccagtggtagcccacagcaaccaagcagccagcccggaagccctgctccagccccttctgcccagatggatctggagcacccactgcagccactgttcggcacacccacaagcctgcttaagaaagagcccccagggtatgaggaagctatgagccagcagcccaagcagcaagaaaacggatcttcttcacagcaaatggatgacctgttcgatatcctcattcagagtggagggaatcctaggaatttcagccggtttcagggggcagcgattccggctcgcgagggagaggctatccccgaagactcactttgggttccaccgggatccactgctattactttttgctag

SEQ ID NO: 229968 - DNA, 2646 bp, Artificial Sequence
  Description of Artificial Sequence: Synthetic coding sequence
atgcctcccctgaaatcacccgcagccttccacgagcagcggagaagcttagagagggcacgcacagaggactatctgaaacggaagattcgcagcagacctgaacgctcggaactcgtgagaatgcacatcctggaagaaacttctgccgaaccatctctgcaagcgaaacagcttaagctcaagcgcgcaagactggctgacgacctcaacgagaaaattgcccagaggcctggaccaatggagctcgtagaaaagaatatcttgcctgttgaatctagtctgaaagaggcaattatcgtcggacaggtgaattacccaaaggttgccgatagcagttccttcgatgaggacagcagcgacgccctgtcaccggaacaacccgcatctcatgagagtcaaggatctgtgccctcacccctcgaagctagggtcagtgaacccctgctgtccgcgacatctgcgtcgccgacacagcagtcccagcctaaatcagctagcgagaagagtcaacgctccaagaaagcaaaagaattgaagccaaaggtgaagaaactgaaatatcatcagtatattccccctgatcagaagcaagatagaggagcgccacccatggactcctcctatgcgaaaattctgcagcagcagcagttgttcttgcagctgcaaatcctgaatcagcagcaacagcaacaccacaactatcaagccatcctgccagccccaccgaaatctgcaggggaggcgttgggctccagtggaacaccccctgtgcgaagcctgtccaccacaaacagcagctcttcatccggcgcacctgggccatgcgggttggcgaggcagaactcgacctccctcacaggaaaaccgggagctttgccagctaatcttgatgacatgaaagttgccgaactgaagcaagagttaaagcttcgttctctccccgtctccggaactaagacagagctaattgagaggctgagagcgtatcaggatcagatatctcccgtgccaggcgcaccaaaggctcccgctgccacatctattctgcacaaggccggagaagtggtcgtcgcttttccggctgctcgattgtccacagggccagcgctggtggcagctggcctcgctcctgccgaggtagttgtagctacagtggcctcctccggggtggtaaaatttggctctaccggttctaccccacctgttagtcctactccttcagagagatcactgctcagcaccggggacgaaaatagtaccccgggtgacaccttcggagagatggtgaccagtccactaacccagctcaccctgcaagcctcaccattgcagattttggtcaaagaggagggccctcgcgctggttcttgctgtctttctccgggaggacgcgctgaactcgagggcagggacaaggatcagatgctgcaggagaaggacaaacaaattgaagcccttacacgtatgctccggcagaagcagcagctagttgagagattaaaactccagctggagcaggagaaaagggcacagcagcctgcacctgcgcctgcacccctcggaacacctgtaaagcaggaaaactctttctcaagctgccagttgtctcaacaacccttaggtccagctcacccattcaacccatccctggcggcacctgccacaaatcacattgatccttgtgccgtcgcaccaggtcctccatctgttgtggtcaagcaggaagcgcttcagccggagcctgagcccgtgcctgctccccagctactgctggggccacagggaccctcgctcatcaaaggagtggccccaccgactttaattacagacagtacaggcacccatctagtgctcacggtcaccaataaaaacgctgactctcctggtttaagcagcggttcaccacagcaaccgagctcacagcccggatctccagccccagccccatccgcacagatggatctggaacaccctctccagcccctattcggaaccccaaccagcctgctcaagaaggaaccccctggatatgaggaggcaatgagccagcagcctaagcagcaggagaacggctcttcttctcagcagatggacgacctgtttgatatactgatccagagcggcgagataagcgccgactttaaggagccaccaagcttgccaggcaaggaaaaaccaagccccaagaccgtgtgtgggtctcccctggccgcacagccaagcccaagcgcagaactgccccaggctgctccacctcccccaggtagcccaagtctgcctggacggctcgaggatttcctggaatcctccacggggttgcctctgctaactagtggacacgatggacctgagcctctgtccttgatcgatgacctacattctcagatgctcagcagtaccgctattcttgaccaccctccgagcccgatggacaccagcgagttgcattttgttcctgaaccttcatcaaccatgggtctagatctggctgatggccatctagatagcatggactggctggagctctcttcaggtggacctgttttgtctctggccccactatctaccacggcaccatcgctgttcagtaccgactttttggacggccacgacctccagctccactgggatagttgcctgtag

SEQ ID NO: 229969 - DNA, 2796 bp, Artificial Sequence
  Description of Artificial Sequence: Synthetic coding sequence
atgccacccctgaaaagccctgcagcattccatgagcagcggaggagcctcgaacgagctaggaccgaagattatcttaagcgcaagataagaagtagacctgaacggtcagagctggtaagaatgcatatcttagaggaaactagtgcggagccatcactgcaggccaagcaacttaaacttaagagggctcgcctcgccgatgacctgaatgagaaaatcgctcaaaggcccggaccgatggagttggtggagaaaaatatcctccctgtggagtcctccttaaaggaggccatcatcgtgggacaggtgaattaccccaaggtggcggattccagcagcttcgacgaggattcttctgacgctctgtctccagaacagcctgcttcacatgaatcccagggttctgtgccaagccccctggaggcacgcgtatctgagccgttgctcagcgccacatccgcctcccctactcaagtggttagccaactgcctatgggtagagacagtagggaaatgctgtttctcgctgaacagcccccactgcccccaccccctttgctccctccgagcctaaccaatggaactacaattcccaccgcaaagagcaccccgaccctgatcaaacaatcccagcccaaatccgcaagtgaaaaaagtcagcgaagtaagaaggctaaagaactcaaacctaaggttaaaaaactaaagtaccaccagtatattcctcccgatcagaagcaagaccggggagccccacccatggatagctcttatgctaagatccttcagcagcaacagcttttcctgcaattacaaatactgaaccagcagcagcagcagcatcacaattatcaggccatcctgcccgctcctcctaaaagtgctggtgaggctctggggagcagcggaactcccccagttagatctttatctaccacgaacagcagttccagctctggagctcctgggccttgcggattggcacggcagaactcaacctccctcacgggaaagccaggcgcactgccagccaatttggacgatatgaaggtagccgagttaaagcaagaattgaagctgcgctccctgccagtctctggtacgaaaacagaactgatagaacgcctgagagcctatcaagaccaaatctcccctgtacccggagccccaaaggcccctgcagcaacctctattctgcacaaagccggagaggtggttgtggcatttcccgcagccagattgtctacgggcccagccctggttgctgcaggactcgcgccagcagaggtggtggtagctaccgtggcgtcttctggagttgtcaagttcgggtccaccgggagtactcccccagtctcccctaccccatcagaaagatctttgctgagcactggtgatgagaactctacccccggtgatacattcggcgagatggtaacttcgccacttacgcagctgaccttacaagccagccctctgcagattttggtgaaggaagaggggccacgggctggaagctgctgcttgagtccgggaggccgtgccgaactggaaggaagagacaaggatcagatgctgcaagaaaaagataagcaaatcgaagcactaaccaggatgcttcgacagaagcagcaactagttgaaagactgaagctgcagctggagcaggagaagcgagcccagcagccagctcccgctcctgccccactcggcacccccgtcaagcaagaaaatagcttctccagctgtcaactgagccaacagcccctggggccagctcatcccttcaatcctagcctggcagctcccgctaccaaccatatagatccttgcgcggtggcgcctggcccaccctctgtcgtggtcaaacaggaagctctgcagcccgaaccagaacccgtgcccgctccccagctcctacttggaccgcagggcccaagtttgataaagggggtcgccccacccactctgattactgactccacaggaactcatctggtactcaccgtaacaaataagaatgccgactctcctggtctcagctccggatccccccaacagcctagctcgcagcctgggagtccagcgccagctccctccgcccagatggaccttgagcatccgctgcagcctctttttggcacccccaccagcctcctcaaaaaagagccgcctgggtacgaagaggccatgtctcaacagccaaagcagcaggagaatggctccagcagccaacaaatggatgatctatttgatattctcatccagagcggggaaataagtgcagatttcaaggaaccgccttctctgcccggaaaagagaagccctccccaaagacagtctgtggcagccctcttgccgcacagccaagtccttcggctgaactcccgcaggccgctccccctccgccaggaagcccctcgttaccagggagattagaggactttctggagtcgtcaactggactgccactcctgacctccggtcatgacggaccggaacccctatctctcatcgacgatttgcacagccagatgctgtccagcactgctattctagaccacccgcctagtcctatggatactagcgagcttcattttgtccctgagccctcaagcaccatgggactggacctggcagatgggcacctagatagcatggattggcttgagctatcaagtggcggtcctgtgcttagtttagccccactgtcgaccactgccccttccctgtttagcactgatttcctcgatggccacgatttgcaactgcactgggactcttgcctttag

SEQ ID NO: 229970 - DNA, 258 bp, Artificial Sequence
  Description of Artificial Sequence: Synthetic coding sequence
atgcttagctccaccgccatcctggaccacccacctagccccatggacaccagtgagcttcactttgtacccgaaccaagcagcaccatgggcctggacctggctgacgggcatcttgactctatggattggctggaactcagttctggcggtcctgtgctgtccctcgctcccctctcaactaccgcgccttccctgttttccaccgattttctggacggacatgacttgcagctgcattgggacagttgtttgtag

SEQ ID NO: 229971 - DNA, 1524 bp, Artificial Sequence
  Description of Artificial Sequence: Synthetic coding sequence
atggctggaaggggttctttagttagctggagagcattccatggttgcgacagtgccgaagagttaccgagagttagccctaggtttctccgagcttggcaccctccacccgtgagcgctcgaatgcctacaagaagatgggccccagggacacagtgcatcaccaagtgcgaacacacccgcccaaagccgggagagctagcttttagaaagggggatgtagtgaccatcctcgaggcctgcgaaaataagtcttggtatcgcgtgaaacaccataccagcggccaagaggggcttttggccgctggcgctctgagggagcgggaggccttgtcagcggatcccaagctcagcctcatgccctggttccatgggaaaattagcgggcaggaagcagtccaacagcttcagccacccgaggatggattgtttttggtcagggagtccgcacggcacccgggtgattatgtgctatgcgtctccttcgggagagacgtcattcactacagagtgctgcacagagacggccatctcacaatcgatgaggccgttttcttctgtaatctcatggatatggtagagcactattccaaagataagggagcgatctgtacaaaactggtcagaccaaagcgtaagcatggcaccaagtctgctgaggaggaactcgccagagcgggatggctcctgaacttacagcatctgactctgggggcacagatcggggagggtgagttcggagcggtcctgcagggtgagtacttgggccagaaggttgctgtgaagaatattaagtgtgatgtgactgcccaggcatttctcgacgaaaccgccgtcatgacaaaaatgcagcacgaaaatctggtccgtctgctaggagtgattcttcatcagggcctgtatatagtgatggagcatgtgtcaaagggcaacctggtcaattttctgcgaactcgcggtcgtgcgttagtgaacaccgctcaactgctccagtttagtcttcatgtcgccgaaggaatggagtatctggaatcgaagaaactggtgcatcgggaccttgcagccagaaacattctggtttcggaggatctggtggccaaagtgtcggatttcggcctggccaaggctgaaaggaagggattggatagctcacgtctcccggtgaagtggaccgctcctgaagctcttaagcatggtaagtttaccagtaagtctgacgtctggtcctttggagtgctactctgggaagtcttctcctatggcagagccccttacccaaagatgtctctgaaagaagtgtccgaagctgttgaaaagggctacaggatggagccacctgaaggctgcccaggccctgtacatgtgctcatgagttcatgctgggaagctgaaccagcacgacggccaccttttcggaaattggcagagaaactagctagagaattgcggagcgccggagcccctgcctcagttagcggccaggacgccgacggatccacaagcccacgaagtcaggagccttag

SEQ ID NO: 229972 - DNA, 1401 bp, Artificial Sequence
  Description of Artificial Sequence: Synthetic coding sequence
atgcctacccggaggtgggccccaggcacacagtgcatcacaaagtgcgagcatacaaggccaaaaccgggtgaactcgccttccgcaaaggggacgtagtgactatcttggaggcttgcgagaataaaagttggtatcgagtcaagcatcacacaagcgggcaggagggcttgttggcagccggagcgctaagggagcgcgaggcgctgtcggctgacccgaaactatctcttatgccgtggtttcacggaaagatctcaggacaagaggccgtacagcagctgcagcccccagaagacggactcttcctcgtacgtgagagcgccaggcacccaggcgattatgtcctttgtgtgagcttcgggcgtgacgtgatccactatcgagttctgcacagggacgggcatttgacgattgatgaggcggtgtttttttgcaatctcatggacatggtagagcactattccaaggacaaaggagctatctgtactaaactcgtgagaccaaagcgcaaacacggaacaaagtctgcagaggaagagctggccagggcaggttggctactgaatctgcagcacttgactcttggtgcccagattggggaaggcgagttcggcgcagttctgcaaggggagtatttaggacagaaagtcgctgtcaagaacatcaagtgtgacgtgacagcacaggcattcctggacgagacagcagtgatgaccaagatgcagcacgagaatttggtgcggcttctcggggttatcctacatcaaggactgtacatcgtgatggaacatgtatccaagggaaacttagtgaatttcttgcggaccaggggaagagcgcttgtgaataccgcccagctgcttcagtttagcctacacgtcgcagagggaatggaatatttggagtcgaaaaagctggttcatcgagacctggctgcacgtaatattctcgtgtcggaagatctggtagcgaaagtctctgacttcgggctcgctaaggccgagcgaaaaggcctggacagcagccgccttcctgttaagtggacagcccctgaagcactgaaacacggaaagtttactagcaagtcggatgtgtggtcttttggagtcctcctgtgggaggtcttttcttatggcagggctccttaccctaaaatgagtcttaaggaggtctcggaggccgtggagaaagggtatagaatggaaccccctgaaggatgcccgggtcccgtgcacgttctcatgtcttcatgttgggaagcagagcccgctaggagaccaccttttagaaagctcgctgagaaactggccagagaattgcgaagtgcgggtgcccctgcatccgtctccgggcaggacgcagatggcagtacctccccgagaagccaggagccctag

SEQ ID NO: 229973 - DNA, 1527 bp, Artificial Sequence
  Description of Artificial Sequence: Synthetic coding sequence
atgcaaggacattttcccgctgaacggagggaggggaggcctcgaagggggactaggggacagcagcagctattggtgtcaccccgtttcctgcgggcatggcacccccctcctgtgtccgctagaatgcccaccagaagatgggcacccggaactcagtgcattaccaaatgtgagcacacacgcccaaaacctggcgaactcgcttttaggaagggggacgtagtgaccatccttgaggcatgcgaaaataaatcatggtaccgagtcaaacaccatacttcaggacaagaaggccttctagctgccggtgccctccgcgagcgggaagctttgtccgcagatcccaaattaagcctgatgccttggtttcacggcaagataagtgggcaagaggcagtccagcaattgcaaccccctgaagatggactctttctggtgcgcgaatctgctcgtcatcccggtgactacgtactatgtgtcagcttcgggagggatgtgatccactatagggtactacatcgggacggccaccttacgattgacgaggccgtctttttctgcaatctcatggatatggtcgaacattattctaaggacaagggagcaatttgtacaaagctcgtgcgtccgaagcgcaagcacggaacaaaatctgccgaggaggagttggctagggctggttggctgctgaatctgcagcatctcactttaggcgcacagatcggggaaggcgagttcggcgcagtgctgcagggggagtatctgggacagaaggtggctgtgaagaatattaagtgtgacgtgacggcacaggcatttttggatgagacagcagtgatgaccaagatgcaacacgaaaacctggttcgccttttgggggtaattctgcaccaggggttatacatagtgatggagcatgtcagtaagggtaatttagtgaacttcctacgtacccgcggtcgggcattagtgaatacggctcagcttctccagttttccctccatgtggccgaaggcatggaataccttgaatcgaagaagctagtgcacagagacctggctgctcgaaatatcctagtgtctgaggatttggtcgcaaaggtctctgatttcggcctggcgaaagccgaacggaagggcctcgacagctcgaggttgccagtgaagtggactgctcccgaggctctgaagcacggtaagtttaccagtaagagtgacgtgtggtcctttggagtcctgctttgggaagtattcagttatggaagggccccttatccaaagatgtcactgaaagaagtgtcagaagcagtggagaagggctatcggatggagcccccagaggggtgccccggtcccgtacatgtgttgatgtcttcctgttgggaagccgaaccagccagacgtcccccttttagaaaactcgcagagaaactggctagagagttgcggtctgcaggcgctcctgctagcgtcagtgggcaagacgccgatggcagcacctctccgcgatctcaggaaccatag

SEQ ID NO: 229974 - DNA, 1134 bp, Artificial Sequence
  Description of Artificial Sequence: Synthetic coding sequence
atgacccaggagccatttcgtgaggaactggcttatgatagaatgccgaccttggaacgtggcaggcaagatccagcgagctacgctcccgatgctaaaccttccgatctgcagctgtctaagaggttgccaccgtgtttttcccacaaaacgtgggtgtttagcgtcctgatgggttcctgtctgctcgtaaccagcggtttctctctgtatttagggaacgtgtttcccgctgagatggactatctgcgctgcgcggctggaagctgtattccctcagctatcgtgagtttcactgtgtctcgacgcaatgcaaacgtcattccaaacttccagatcttattcgtgtcaacatttgcagtcacaacaacttgtctcatctggtttggatgcaaactggtgctcaacccatctgcaataaacattaatttcaacctgatcctgctgctgttgctcgagctcctgatggctgcaacagtgattatcgccgcaaggtcttccgaagaggactgtaagaaaaagaaaggaagtatgtctgactcggcaaatattctggacgaagtgccgttccctgctcgcgttttaaaaagctatagcgtggtagaagtgatcgccggaattagtgctgtccttgggggtataatagctctgaatgtagacgatagcgtaagtggtccccacctgtctgtgaccttcttttggattcttgtggcatgcttcccaagcgccatcgccagtcatgtggccgctgaatgcccatccaaatgtctggtggaagtgctgattgcaatttcgtcactcacatcacctctcctgttcaccgcttccggatacctgtcattcagcatcatgcgtatcgtggagatgtttaaagattatccgcctgccatcaagccaagctacgatgtgcttctcttgctgctcctgctggttcttctcctgcaagccggattgaataccggaacggccatccagtgtgtcaggttcaaggtttcagccaggctgcaaggggcttcatgggacactcagaacggaccccaggagcggctggccggagaggtcgccagatctcccctaaaagaatttgataaggagaaggcctggagggctgtggtggtccagatggcacagtag

SEQ ID NO: 229975 - DNA, 1134 bp, Artificial Sequence
  Description of Artificial Sequence: Synthetic coding sequence
atgacacaggaacctttccgtgaagaactcgcttatgacagaatgcctactctcgaacggggtagacaggacccggcatcttacgcacctgatgccaagccttctgatctgcaactctccaaaagactgcccccatgtttctctcataagacatgggtctttagcgttctgatgggctcctgcctgctggtaacctccggctttagcctctaccttggcaacgtgtttcccgcagagatggactacctgagatgcgcggctgggtcatgcattcccagcgcaattgtatcattcaccgtttctcgcagaaatgcaaacgtaattccgaattttcagatcctgttcgtcagcaccttcgccgtcaccacaacttgcctgatttggtttggctgtaagctcgtgctgaacccctcagccataaatatcaacttcaatctcattttgctgttactgctggagctgctgatggcagctacagtgattatcgccgctaggtcttctgaagaggactgcaagaaaaagaaaggatcgatgtctgattcagcaaacattctcgacgaagtgcctttccctgctcgggtgctgaaaagttatagtgtggtggaagtgatcgctggaataagtgccgtgctggggggaataatcgcacttaatgtagatgattctgtctcagggcctcatttaagcgtgacctttttctggatcctcgtcgcgtgcttccctagcgctatcgcctctcatgtggcagccgaatgccctagtaaatgtctcgtggaggttttaatagcaatttctagtctcacctctccccttctttttaccgcctctggttacctctctttttccattatgagaattgtcgaaatgtttaaagattatcctcccgctattaaaccttcttacgacgtcctgctgcttctgctgctgctggttctgctcctgcaagcaggcctcaacaccggcactgcaatacagtgtgtgaggtttaaggtgtcggctcgcctccagggagccagttgggatacccagaacggcccacaggagcgactcgccggagaagtcgcccgaagtccattgaaggagtttgacaaagagaaagcatggcgcgctgtagttgttcagatggcacaatag

SEQ ID NO: 229976 - DNA, 1044 bp, Artificial Sequence
  Description of Artificial Sequence: Synthetic coding sequence
atgacacaggagccattcagggaggaacttgcctatgatcggatgcctacactggagcgaggtcgtcaggatcccgcatcatacgcacccgacgcaaagccttcagatctgcagctgtccaagcggctccccccatgcttttctcacaagacatgggtatttagtgttttgatgggctgtatcccaagtgcgatcgtttcttttacagtgagccggagaaacgcaaatgtcataccaaacttccagattctgtttgtgagcaccttcgcagtgactaccacttgtctgatatggtttggatgcaaactagtgctgaacccaagtgcaattaacatcaactttaacctgatactgctgcttctactcgagctcctgatggccgctaccgtgataattgcagcccgatcatctgaagaagactgtaagaagaaaaagggtagcatgtccgactccgctaacatccttgatgaagtcccattccctgcgcgagttctcaaatcttacagtgtagtcgaggtgatcgccggtatctcagcggtcctcggaggcatcatcgcacttaatgtggatgactccgtgtcaggtccgcatttgtcagttaccttcttctggatactggtcgcttgcttcccttccgctattgcgtcacacgttgccgctgagtgtcccagtaagtgcttggtggaggttcttatcgctatttctagccttacctcacccttgctgttcactgcttctgggtacctaagtttcagtattatgaggattgtagagatgtttaaggattatccaccggctataaaaccctcgtacgatgtcctactactgctccttctgcttgtgctgctcctgcaagccggtctgaacaccggaactgctatacaatgtgttcgattcaaggtttcagcaagattgcaaggggcttcctgggacacacagaatggcccacaggaacgtttagcaggtgaggtggccagatcccccctgaaagagttcgataaggagaaagcttggcgagccgtagtggttcagatggcgcagtag

SEQ ID NO: 229977 - DNA, 672 bp, Artificial Sequence
  Description of Artificial Sequence: Synthetic coding sequence
atgactcaagaacccttccgggaagagctcgcgtacgaccggatgccgacactcgagcgaggccgtcaggaccccgcttcttatgctcccgacgccaaaccaagcgacttacagctctccaagaggctgccaccctgtttttcccataagacatgggtgtttagcgtccttatggggtgcatcccttctgctatcgtgagctttaccgtgtcaaggagaaatgctaatgtgattccaaactttcagatcctttttgtgtctaccttcgcagtgacgacaacttgcctaatatggtttggatgtaagctcgtactgaatcccagtgctatcaatataaattttaacctgatactgttgctgcttctggaattgctgatggcagccacagtcataattgcagcgaggtcttcggaggaggattgcaagaaaaagaagggtagtatgagcgattccgcaaatatccttgacgaagtcccctttccagcgcgtgtgcttaagtcctatagtgtggtggaggtgatcgccggtatctccgccgtgctaggcggaattatcgccctaaacgtggacgactccgtctctggaccgcatctctctgttacctttttctggatcctggtagcctgctttcccagcgccatcgcctcccatgtcgccgctgaatgtccttag

SEQ ID NO: 229978 - DNA, 978 bp, Artificial Sequence
  Description of Artificial Sequence: Synthetic coding sequence
atgacacaagagcccttccgagaggagcttgcatacgacagaatgcccacgctagagcggggaagacaggaccccgcttcctacgcgccagacgctaaaccttccgacttgcaactgtcaaaacggctgcccccttgcttcagtcacaaaacctgggtcttttcagttctgatgggctcgtgtctgctggtgacgtcaggattttccttatatctcggcaacgttttcccagctgagatggattatctgcggtgcgctgctggttctattaatttcaacctgatcctccttctactccttgagctattaatggctgcaacagtgatcatcgccgctcgatcctccgaggaagactgtaagaaaaaaaaggggtcaatgtcagattccgccaacatcctggacgaggtacccttcccggcacgcgtgctgaagtcctattctgtggtagaggtcatcgctggcatcagtgctgtcctcggcggaatcatcgcactgaacgtcgacgattccgtgtccgggccacacctgtccgtgacatttttctggatcctagtagcctgtttcccatccgccattgcttctcatgtggctgcggagtgcccatctaagtgcttagtggaggtcttgatcgctatctctagcctgacttcaccactgctgtttactgcgagcgggtatttgtcgttctcaattatgcggatcgtggaaatgtttaaggactacccaccagccattaaaccaagttacgacgttttactgctgctccttctactggtgctgctcctccaggcaggcctgaatacgggcacagccatccagtgtgtgaggtttaaagtctctgcacgactgcagggtgccagctgggacacccaaaatggaccccaggaaagactggctggggaggttgctagaagtcccctcaaggaatttgataaggagaaggcatggagagctgtggtcgtgcagatggcccaatag

SEQ ID NO: 229979 - DNA, 897 bp, Artificial Sequence
  Description of Artificial Sequence: Synthetic coding sequence
atggattatctgcgctgtgccgctggttcatgcattccttccgcaatcgtgtcattcaccgtgtcaagaaggaatgccaatgtcattcccaattttcaaatccttttcgtgtcgaccttcgcagttaccactacttgcctgatttggttcggctgcaaactggtgctgaaccccagcgctatcaatattaatttcaacctgatactcttgctgctcttggagttgttgatggccgctaccgtgattatagccgcacgctccagcgaggaagattgtaagaagaagaaggggagcatgtctgacagcgccaatattctggatgaggtcccttttccagctagggtcttgaagagctacagcgttgtggaggttatcgctgggatttcggcggtcctcggcggtattatagcgcttaacgtggatgatagcgtgtccggccctcacctgtcagtgaccttcttttggatcctagtggcgtgcttcccctccgccattgcttctcacgttgcagccgaatgcccgagcaagtgtctcgtagaagtactgatcgccattagtagtctaacttcgccactgctctttactgcctctggctatctgtccttctctattatgcgcattgtagaaatgtttaaggattacccacctgccatcaagccctcatatgacgttttgctgctgttgctgctccttgtgctgctgctacaggcaggcctaaacaccgggaccgcaatccagtgcgtgagatttaaggtttccgcccgtcttcaaggagcctcctgggatacccagaatgggccacaagagcgtctggccggtgaggtggccaggtccccgctgaaggagtttgataaagagaaagcctggcgagccgttgttgtgcagatggctcagtag

SEQ ID NO: 229980 - DNA, 1032 bp, Artificial Sequence
  Description of Artificial Sequence: Synthetic coding sequence
atgacccaagaaccgttccgggaagaactagcttacgataggatgcctacccttgaacggggacggcaggatcccgcatcatacgccccagatgctaagccaagcgacctacagctatctaaacgactccccccttgctttagccacaaaacttgggtcttttcggtgttaatggggtcttgtctgcttgtcacctctggtttctccctgtatcttggtaatgtgtttcccgctgagatggattatctccgctgtgctgcaggatcctgcattccttcagctatcgtttctttcacagttagtaggaggaatgccaatgttatcaacttcaacctcattctcctgctgttgctcgaattacttatggctgcaaccgttatcattgcagcacgatctagcgaggaggattgtaagaagaaaaaggggtccatgtccgactccgccaatatacttgacgaggttccattccctgcccgtgttctgaaaagttacagcgtggttgaggtcatcgccggtatctctgccgtgttgggagggatcatagcacttaacgtggatgacagcgtgagcggcccacatctctccgtcacatttttctggattcttgtagcatgctttcctagcgcaatagcgtcccacgttgctgccgagtgcccaagtaagtgtctagttgaggtgctgatcgctatttcctctctaacatctcccctcttgtttaccgcgtctggctatctgagcttcagcattatgaggattgtcgagatgtttaaggattatcctcctgctataaaacccagctatgacgtgctgcttctattactgctgctcgtcctgctacttcaggccggactgaacaccgggaccgccattcagtgtgtgagatttaaagtaagcgctcgactgcaaggggcttcctgggacactcagaacggcccacaggaaaggttggcaggcgaagtggcacggagtcctctgaaggaattcgataaggagaaggcatggcgggcagtggtagtgcagatggcccagtag

SEQ ID NO: 229981 - DNA, 267 bp, Artificial Sequence
  Description of Artificial Sequence: Synthetic coding sequence
atggcatcaagcgacgtcaagcccaagagtgttagccatgcgaagaaatggagcgaggagatcgaaaatctgtatcggttccagcaagcgggttatcgtgacgagacagagtatcggcaggtcaagcaggtgtcaatggttgacaggtggccagagacagggtacgttaagaagctccagaggagagacaatacattctactactataacaagcagagagagtgcgatgataaagaggttcataaggtcaaaatatacgcatactag

SEQ ID NO: 229982 - DNA, 267 bp, Artificial Sequence
  Description of Artificial Sequence: Synthetic coding sequence
atggcaagttcagacgtgaaacccaaaagtgtgtcacatgctaagaagtggagcgaggaaattgaaaatctgtaccgtttccaacaagcaggctatcgggacgaaacagaatataggcaggttaaacaggtcagcatggtggataggtggccggaaaccgggtatgtgaaaaagctccagcgacgcgacaacactttctactactacaataagcagcgggagtgtgatgacaaggaggtgcataaagtgaaaatatacgcctattag

SEQ ID NO: 229983 - DNA, 1488 bp, Artificial Sequence
  Description of Artificial Sequence: Synthetic coding sequence
atgggatctaaaagaaggaacctgagttgctctgaaaggcatcagaagctagttgacgagaactattgtaagaaactccacgtgcaagcactgaagaatgtgaattctcagatccggaatcaaatggtccagaatgagaatgacaatcgggtgcagcgcaaacagtttttacgtctgcttcagaatgaacagttcgaattggatatggaagaggcgatacagaaggctgaggaaaacaaaaggctcaaggagctccagttgaagcaagaggagaagttggctatggaacttgccaagctgaaacacgagagtctgaaggacgagaagatgaggcaacaggtgcgggaaaatagtatcgaactgagggagttggagaagaaactcaaagccgcttacatgaacaaggaacgggcagcacaaattgcagagaaggatgccattaaatatgaacagatgaagagggatgccgagattgcaaagacgatgatggaggaacataaacggataattaaggaggagaatgcagccgaggacaagcggaacaaggctaaggcccaatattatctggacctggaaaagcaactagaagagcaggagaagaagaaacaggaggcctacgaacagctcctcaaggagaaactcatgatagacgagatcgttcggaagatttacgaggaggaccaactggagaaacaacagaagctagaaaaaatgaacgccatgcggagatacatcgaagaattccaaaaggagcaagccttgtggagaaagaagaaacgagaagaaatggaggaggagaaccgaaaaatcattgaattcgccaatatgcagcagcaacgggaagaagaccgcatggccaaggtacaggaaaatgaagagaagcgactgcagctgcaaaacgcccttacacagaaactcgaggaaatgctccggcagagagaggacctggaacaagttaggcaggaactgtaccaggaggagcaggcagagatatataaatccaagctgaaggaagaagccgagaagaaattgcgaaagcagaaagaaatgaaacaagactttgaagagcagatggccttgaaggaacttgtcctgcaggcagctaaagaggaagaagagaacttccgcaaaactatgctggccaagttcgctgaggacgacagaattgagttaatgaatgcacagaaacagcgcatgaagcaacttgagcatcggagagcagtcgagaagttgattgaagaacgtagacagcagttcctcgctgacaagcagagagagctcgaagaatggcagcttcagcagcggcgacagggcttcataaatgccataattgaggaagagaggctcaagctgcttaaagaacatgctacgaacctgctgggctatctccctaagggagtgttcaagaaagaggacgatatcgacctcctgggtgaagaatttcggaaggtgtaccagcagaggtccgagatctgtgaagagaagtag

SEQ ID NO: 229984 - DNA, 1173 bp, Artificial Sequence
  Description of Artificial Sequence: Synthetic coding sequence
atggcacagcgctatgacgacctgccccattacggaggcatggatggtgtcgggattcccagtactatgtacggagatcctcatgctgcacgttcaatgcagcctgtgcatcatctgaatcacggtccgcctctgcattcccatcagtacccacataccgctcataccaatgccatggccccttctatgggatcatcggtcaatgatgctttgaagcgtgacaaggacgccatatatgggcaccctctgttccccctcctggccttaatcttcgagaagtgtgaacttgccacctgcactcctcgggagcccggagtcgccggtggcgacgtgtgctctagcgaatctttcaacgaggacattgcggttttcgcgaagcaaattcgcgctgaaaaacctttatttagcagcaacccggagctcgacaatctcatgatccaggcaattcaagtcctgagattccacttacttgaacttgaaaaggtgcatgagctttgcgataatttttgccacaggtatattagctgcctgaaagggaaaatgccaatcgacctggtcattgatgaccgcgagggagggagcaaatcagatagtgaagatattacacgatcagcgaacctcactgaccagccaagttggaacagggatcacgatgatactgccagtactcgaagcggaggaactccgggacctagttccggcggtcacacatcgcacagtggagataactcttctgaacagggcgacgggctggataattcagtggccagtcccagtaccggagatgacgatgaccctgataaagataagaaaaggcacaagaagaggggaatctttcccaaggttgcaaccaacattatgagagcttggctcttccagcacttgacacatccctatccttctgaagaacagaagaagcaactagcccaggacactggcttaactattctgcaggtgaataactggttcattaatgcgcgtcggaggatcgttcaacctatgatcgatcaaagtaacagagctgtgtcccagggtacaccctataaccccgacgggcagcctatgggcggattcgtgatggacggacaacagcatatgggcatccgagcccctgggccaatgagtggaatggggatgaacatgggcatggaaggccagtggcactacatgtag

SEQ ID NO: 229985 - DNA, 1392 bp, Artificial Sequence
  Description of Artificial Sequence: Synthetic coding sequence
atgcagtacgatgacctgccccattatggcggaatggatggtgtgggaatcccaagtaccatgtacggtgatcctcatgcggctcgttccatgcaacccgtgcaccacctcaaccacggacctcctctgcacagtcaccagtacccccatactgcccatactaacgccatggccccttcaatgggctcttctgttaatgacgcattgaaaagggacaaagatgccatttacggacaccccctgttcccgctcctggctttgatttttgagaaatgcgagctcgctacatgtacaccacgtgaaccgggtgtggcagggggagatgtatgttcgagcgagagttttaacgaggatatcgctgtgtttgccaaacaaattcgcgctgagaagcccttattctctagcaaccccgagctcgataacctaatgatacaggccatccaggtgctgagattccacttactggagctggagaaggtgcatgagctgtgcgataacttttgccacagatacatcagctgtctgaaaggcaagatgcctatcgatctggtgatcgacgacagggaaggaggcagtaagtccgattcagaggacatcacacgatccgccaatcttacagaccagcctagttggaaccgggatcatgatgatacagcaagcaccagatccggaggcactcccggaccttcgtccggtggtcacacctctcactccggtgacaattcatccgaacagggtgacgggctggataactcagtcgcctcgccatctactggcgatgacgacgaccctgacaaggacaagaaacgccataagaaaagaggaattttccccaaggtagcgactaatattatgagggcgtggttatttcagcatttaacgcacccttaccccagcgaagagcaaaaaaaacagctggcccaagacacaggtctcaccatattgcaagtcaataactggtttataaacgcccgtcgcagaattgtgcagcctatgattgatcagtctaatcgggcagtcagccagggcacgccttacaatccagacggacaaccgatgggcggttttgtgatggacgggcagcagcacatgggaatcagggcccctggtttgcagtctatgcctggcgaatatgtggctcgaggtggtcctatgggcgtgagtatgggtcagccatcatacacacagcctcagatgcctccccaccctgcccagctcaggcacggaccaccgatgcacacgtatatcccagggcatccgcaccatcctaccgtcatgatgcacggagggccacctcaccctggcatgccgatgtctgcctccagtccaaccgttctgaataccggcgatccgacaatgagcggccaggtaatggatatccatgcacagtag

SEQ ID NO: 229986 - DNA, 762 bp, Artificial Sequence
  Description of Artificial Sequence: Synthetic coding sequence
atgattcaagcgatccaagtgttgagattccatctgctcgaactggagaaagtacacgaactgtgcgacaacttttgccaccgatacatttcctgtctgaaaggaaagatgccgatcgacctggtcattgacgacagggaggggggatctaaatcagactcagaagacattactaggagcgccaatctcacggaccagcccagttggaatcgggaccacgacgatactgcaagtactcggtcaggcggaacacccggaccttcttcgggagggcacacatctcacagtggagacaacagctccgaacagggcgacggattagataatagtgtggcctccccttccactggggacgacgacgatcccgataaagacaaaaagagacacaagaagcgcggaatattccccaaggtggctactaatattatgcgtgcttggctcttccaacacctaactcacccctacccaagtgaggaacagaaaaaacagttggcgcaagacaccggcctcaccatcctccaggttaataattggtttatcaatgcaaggcgccgtatcgtccagcctatgatcgatcagtctaaccgcgcagtatctcaggggaccccttataatcctgatgggcagcctatggggggattcgttatggatgggcagcagcacatggggatacgggcaccgggtccaatgagtggtatgggtatgaatatgggcccaccatgtatcagaacgttcctggataccctgacgacgcaacaatag

SEQ ID NO: 229987 - DNA, 1398 bp, Artificial Sequence
  Description of Artificial Sequence: Synthetic coding sequence
atggcccagcggtatgatgacttaccgcactatggtggaatggatggtgttggcattccatcgacgatgtacggggacccgcatgctgcacgctctatgcagcctgtgcaccacctgaaccacggcccaccattacacagtcaccagtatccccatactgcacataccaatgctatggccccttccatggggtcctccgttaatgacgctctgaaaagagacaaagacgcaatctatggccatcctctgtttcccttgttggctttaatcttcgaaaagtgtgaactggccacctgcacaccacgcgaaccaggcgtggcgggaggagacgtgtgcagcagcgaaagcttcaacgaggacattgctgttttcgccaagcagatcagagctgaaaagccattattttcgagcaaccctgagttagataacttgatgatacaggccattcaggtactgaggtttcacctcctcgaactggaaaaggtgcatgagctgtgcgacaatttttgtcacaggtacattagctgtcttaaagggaaaatgcccatagatctcgttatagacgaccgagagggcggttccaaatctgacagcgaggacataactcggtccgcaaatctcactgatcagccatcctggaaccgagatcatgatgacaccgctagcactcggtccgggggaactcctgggccaagttctggcggacacaccagccacagtggcgataatagttccgagcagggtgatgggctggacaactccgtcgcatcaccctccactggcgatgacgacgacccagacaaagacaaaaaaagacataaaaaacggggtatcttcccgaaggtcgcaacgaatatcatgagggcgtggctgtttcagcacctgacccacccttatccaagcgaagaacagaagaagcagttggcccaggacactggactgaccatactacaggtgaataactggttcatcaacgctcgacgcaggatcgtgcagcctatgatcgaccaaagcaatagagctgttagtcaggggaccccctacaatccagatggacaacccatggggggttttgtgatggacggacaacaacacatgggaattagggctcccggactccagtcaatgccaggagagtacgttgcccgtggcggtccgatgggcgtgagcatgggtcagccctcatacacccagccccaaatgcctccccaccctgcacagctgcgacacggaccgcctatgcatacttatattcctggacaccctcatcaccctacagtaatgatgcacggcggacctccccatcccggtatgcccatgtcagccagtagccccacagtgctgaacacaggggaccccacaatgtctggccaagtgatggatattcatgctcagtag

SEQ ID NO: 229988 - DNA, 423 bp, Artificial Sequence
  Description of Artificial Sequence: Synthetic coding sequence
atgaagaagaacggtgacgagaagtcacctctggggacagagatcatgatgactaggcacctcttggttcaagaagaacctcaggctcttcctgctgtggccacccggcacaccgtgggtaccacagcggtatctaagcacccttatccatctgaggagcagaagaagcaacttgcccaggacaccggactcaccatccttcaggtgaacaattggttcataaacgctcgacggaggattgtccagcccatgatagaccagtccaatcgggcagtctctcaaggcacaccttataatccagacggtcaaccaatgggaggctttgtgatggacgggcaacagcacatgggcattcgtgcaccaggccctatgagtggcatgggaatgaatatgggtatggaaggccagtggcattacatgtag

SEQ ID NO: 229989 - DNA, 663 bp, Artificial Sequence
  Description of Artificial Sequence: Synthetic coding sequence
atgcaaccggtgcaccacttgaatcacggacccccactgcacagtcaccagtacccccacaccgcacacacaaatgccatggcccctagcatgggcagttcggtcaatgatgcactaaagagagacaaggatgccatttatggccacccgctctttccattgctcgcacttatctttgagaagtgcgaattggccacatgcaccccacgtgaacccggtgtcgcaggaggtgatgtctgctctagcgaatcatttaatgaggacatcgctgtctttgcaaagcagattcgagctgagaagcctctgttttcatccaatccagaacttgataacctcatgattcaagccatacaggtgttacgctttcacctcttggagctggagaaggtgcacgaactctgcgataatttttgccacaggtacatatcttgtttaaaaggcaagatgccgatagaccttgtcatcgacgaccgcgagggcggatcgaagtccgactcagaggatatcacaaggtctgcaaatctgacggaccagccctcatggaatagagaccatgatgacaccgcctccaccagaagtggcggaacacccggacccagttccggagggcacacatcccattccggtgacaacagcagcgaacaggcaccactaccgttctag

SEQ ID NO: 229990 - DNA, 540 bp, Artificial Sequence
  Description of Artificial Sequence: Synthetic coding sequence
atgaagtcactcctgactttctacaagtgtggatccgagctcctccctgcagctgtgtggagtgctggtgggtctccatcactgttcagcgacctgaagtccaagaagggaaagaaattctctagagatcacatcgaagtcaccatcagcaactgcggcgtaaatggcaacgcgaagggcgatggactcgataatagcgtagcatccccttctaccggtgatgacgacgatccggataaagataagaagcggcataaaaagcgtggcattttcccgaaagttgctaccaatattatgcgcgcatggctctttcagcatctcacccacccgtacccctcggaggagcagaagaaacagctagctcaggatacaggattgaccatattgcaggtgaacaactggtttataaacgccagacggaggatcgtgcaaccaatgattgatcagagtaaccgagcggtgagccagggaactccttataatcccgatggacagccgatgggcggtttcgtcatggacggtcagcagcacatggggtag

SEQ ID NO: 229991 - DNA, 978 bp, Artificial Sequence
  Description of Artificial Sequence: Synthetic coding sequence
atggcccaaggactccgtctacaaggtagccgtcggaaaggtagacaccctttatttccactgctggccctgatctttgagaaatgtgaactagccacgtgtactcctagggaaccaggagtggccggtggagatgtatgctctagcgagtccttcaatgaggacatcgccgtcttcgctaaacagatcagagcagagaaacccctattttcatccaacccggagttggacaatttaatgattcaggcaatccaggtgctccgatttcatcttcttgagctcgaaaaagttcacgagttgtgtgacaatttttgtcaccgctacatttcctgtctgaaaggtaagatgccgattgatcttgtaatcgacgaccgagaaggaggatcaaagtccgattccgaggacatcactcggagtgctaacctgaccgaccaaccttcctggaatagggaccatgacgacacagcatctacacgctcggggggaacaccaggaccctcttcagggggtcacacttctcattccggtgacaattcaagcgagcagggcgatggcctcgacaactcagtcgctagcccctctacaggcgacgatgatgaccctgataaggataagaagcgccataaaaagcgtggaatttttccaaaggtggcgaccaacattatgcgcgcatggctgttccagcacctgacacatccctatcctagcgaagagcagaagaagcaactggctcaggataccggtctgactatcctccaagtgaacaactggtttattaatgcccgacgacgcatcgtgcagccgatgattgatcagtctaaccgagcagtttcgcagggaacaccctacaacccggatgggcagccaatgggcggattcgtcatggacgggcagcagcacatgggaatcagagcccctggccctatgtctgggatggggatgaatatgggaatggaggggcagtggcactatatgtag

SEQ ID NO: 229992 - DNA, 1113 bp, Artificial Sequence
  Description of Artificial Sequence: Synthetic coding sequence
atggcccagcggtacgatgacctccctcattacgggggaatggacggcgtcgggatccctagcacaatgtacggcgatccgcatgcagcaagaagcatgcagccggtgcaccacttgaaccacgggccaccactccactctcatcagtacccccatacagctcatactaacgctatggctccttccatggggagttctgttaacgatgcgttaaagcgtgacaaagatgcgatttatggtcatccactctttccacttctcgccttgatcttcgagaaatgtgagttggcgacttgtacacccagggaaccaggagtggcaggcggtgatgtgtgctctagcgaatcttttaacgaggatattgctgtgtttgcgaaacagatccgggcagagaagcccctgttcagctctaaccccgagctggacaatctgatgattcaggcaatccaagtgctgcgttttcatctgctggagctcgagaaggtccacgaactctgcgataacttttgccatcgctatatatcttgtctgaaggggaagatgccaatagatctcgtaatcgatgatcgggaaggaggttcgaaatccgattccgaggacattacccggtctgcaaatcttactgatcagccgagctggaatagggatcacgatgacacagcctcgacccgcagcggagggactcccggaccatcatcgggtggacatacgtcccattcaggcgataacagttccgagcaaggcgacggtttagacaacagcgtggctagtcctagcaccggggatgatgatgacccagacaaagacaagaagcgccacaaaaaacgcggaatctttcctaaggtggccaccaacatcatgcgtgcgtggttgttccagcatcttactcacccctacccctcagaggagcagaaaaaacagctcgcacaggacacgggcctgacgatcctgcaagtaaataattggttcattaacgccaggcgcagaattgtgcagccaatgatcgaccagagcaatcgcgcagggaaatctcctattgttacagtgttcaaatcccggaagcggaagccaagctcatcgcattccccagggggtccgcttcccggaaagtag

SEQ ID NO: 229993 - DNA, 2259 bp, Artificial Sequence
  Description of Artificial Sequence: Synthetic coding sequence
acaacggccatggctcacaggaagcttgaatcggtgggaagtgggatgctggaccacagggtgaggcccggtcctgtgccacacagtcaggagcccgagagcgaggacatggagctccccttagagggatacgtccccgaaggcttagagctggccgcactgagacctgaatctccagccccagaggagcaagaatgccacaatcatagccctgacggcgactcatcttctgattacgtaaataacacctctgaagaagaggattatgacgaggggctacctgaggaggaggagggaataacctactacataaggtattgccctgaggatgattcctacctcgaggggatggattgtaatggagaggagtacctggcccatagcgcgcaccccgtcgacacagacgaatgccaagaggccgtagaagagtggaccgacagtgcagggcctcacccccatgggcatgaggctgagggatcgcaggattaccccgacgggcagctgcctattcccgaagacgagccgtcagttctcgaggcccacgatcaggaggaggacggccactactgcgcttctaaggaaggctaccaggattactacccggaagaggcaaatgggaacacaggcgcaagcccttataggctacgcagaggggacggcgatctggaagaccaggaagaggatatagatcagatcgtggctgagattaagatgagcctgagtatgacatctatcacctcggcgagtgaggcttcccccgagcacggacccgagcctgggccagaggacagtgtggaagcctgtcctcccatcaaggcaagttgctccccatcaaggcatgaagccaggcccaaaagcctgaatctgctacccgaggcaaagcaccctggggatcctcaacgcggtttcaagccaaaaacccggaccccagaagaacgactgaagtggccacacgagcaggtttgcaacggcctggaacagcccagaaagcagcaacgctcagacttaaatggcccagtagataataataatattcctgagacaaagaaggtggccagctttcccagctttgtggcagtgccaggcccttgtgaacccgaagatttgattgacggtattatcttcgcagctaactacctcgggagcacccaactcctctccgaaagaaacccttccaagaacatccgtatgatgcaagcccaggaagccgtctctcgtgtcaaaaggatgcagaaggccgctaagattaagaagaaagctaatagtgagggcgacgcgcagacgttgaccgaagtggatctgttcatctctacacaacgcatcaaagtgctaaacgcagacacgcaagagacgatgatggaccacgccttaaggactatatcttacatcgccgacataggcaacatcgttgtgttaatggccaggaggcggatgcccaggtccgcgtcacaagactgtatcgagacaaccccgggagcgcaggaaggtaagaagcagtataaaatgatttgccacgtctttgagtccgaggacgcccaacttatcgcccagtccattggacaagccttctctgtcgcataccaagagttcttacgggcaaacggaattaaccctgaggacctctctcagaaagagtattccgacattattaacacccaagaaatgtacaatgatgacttaattcacttcagcaattccgagaactgtaaagagctacagctggaaaagcacaaaggtgagattctgggcgttgtggttgtcgagtccgggtgggggtcaatcctcccaactgttattctggccaacatgatgaacggaggaccagctgccagatccgggaaattgtctattggagaccaaatcatgtctatcaacggtaccagtctggtgggcctccccttagctacctgtcagggaatcatcaaaggtttaaagaaccagacacaggtgaagctgaatatcgtctcttgcccccctgtcacaacagtgctcatcaagagaccagacctgaagtatcaactgggattcagcgtccagaatgggatcatctgttcgctcatgagaggaggcatagcagagcgaggaggcgtcagggtcggccatcgcataatagaaataaatggacagtctgtggtcgcaactgcacatgagaagatagttcaggctttgagtaattccgtgggtgagatacacatgaagactatgcctgctgccatgtttcggctcctcactggtcaggagacgccgctgtatatctag

SEQ ID NO: 229994 - DNA, 1413 bp, Artificial Sequence
  Description of Artificial Sequence: Synthetic coding sequence
atggctcagcggtacgacgagctgcctcattatgggggtatggatggtgttggtgtccccgcatctatgtatggagacccccatgcaccacgcccaattcccccagtgcaccacctaaaccatggaccccctctccatgcaacccagcactacggcgctcatgccccacaccccaatgttatgccagcttccatgggatctgcagtaaatgatgcattaaaaagggacaaagatgccatctatgggcatcctctgtttcccctcctcgcacttgttttcgagaagtgcgaattggctacctgcaccccccgagaacctggcgtcgccggtggcgacgtgtgcagcagcgattccttcaacgaggacatcgccgtgtttgctaagcaagtgcgagccgagaaaccacttttctccagcaatcctgagcttgacaacctaatgattcaggcgattcaagtcctccgctttcacctattggaactcgagaaggtgcacgagctgtgtgataacttctgtcaccgatatataagctgtttgaagggaaaaatgccaatcgatctggtaatagacgaaagggatgggagtagcaagagcgatcatgaggagctcagcggcagttccacgaaccttgctgatcacaatccgtctagttggcgtgaccacgatgatgcgacatccactcactcggccggtacccctggaccttcttcggggggtcacgcaagccagagtggcgataattcttccgagcagggcgacgggctggacaatagcgtggcctccccgggaaccggggatgatgacgaccctgataaggataaaaagcggcagaagaagcgtggcattttcccaaaggtggcaactaatattatgagggcgtggctgtttcaacatcttactcatccatatccatcggaagaacagaagaaacagctcgcccaagatacagggctgaccatactccaggtgaacaactggttcatcaatgccaggcggcgaatcgtgcagcctatgattgaccagagtaaccgcgcagtgagtcagggcgcagcgtattctcccgagggacagcccatggggtcctttgtgctcgacggtcagcagcatatgggtattaggcctgccggactgcagtcaatgcccggtgactacgtgtcccaaggtggcccaatggggatgtctatggctcagcccagctataccccgccacagatgacgcctcaccctacccagctgcgtcacgggccaccaatgcactcgtatctgcctagtcaccctcaccacccagcaatgatgatgcacgggggaccaccgacacatcccggaatgacgatgtcagctcagagccccaccatgttgaactccgtggaccccaatgtgggcggacaagtgatggatatccacgcccagtag

SEQ ID NO: 229995 - DNA, 1146 bp, Artificial Sequence
  Description of Artificial Sequence: Synthetic coding sequence
atggacggtgttggagtgcccgctagcatgtatggggaccctcatgcaccgaggcccattccaccagtgcaccacctaaatcatggcccaccattgcacgcaacccagcactacggtgcacacgcaccacatcccaacgttatgccggcatccatgggatcagctgtgaacgacgcattaaaaagggacaaggacgctatatatggccaccccctctttcccctcctcgcattagtcttcgagaaatgtgagcttgctacctgcactcccagagagcccggtgtggctggaggcgacgtctgcagtagtgattccttcaatgaggacattgctgtgttcgccaaacaagtacgtgcagaaaagccgctcttctcaagcaatccggagctggacaacttaatgatccaggcgatccaggtgctccgctttcatctcttggaactcgaaaaagtccatgaactgtgcgataacttttgccaccgctatatctcatgtttgaagggcaagatgcccatcgatctggtgatcgacgaacgggacggttcatctaagagcgaccacgaagagctgtctggcagcagtacgaatctggctgaccacaaccccagctcttggcgcgatcacgacgacgctacatctacacattcagcaggaacccccggaccttcaagtggtggacacgcatcacagagcggggacaattcctccgagcaaggtgacgggctggataattcagttgcctctcccggaactggagatgacgatgatcctgacaaagataaaaaaaggcagaaaaaacgtggtatcttcccaaaagttgcgacgaacattatgcgggcttggctatttcagcatttgacccacccatatcccagcgaagagcagaagaagcagctagcacaggataccggcctgactattctgcaggttaacaactggtttatcaatgcaaggagacgcattgttcagcctatgatcgatcagagcaaccgcgcagtatctcagggagccgcatacagcccggaaggccagcccatgggcagcttcgtgttggacggtcagcaacatatgggaatacgccctgccggtccaatgtccgggatgggtatgaacatggggatggatggtcaatggcactacatgtag

SEQ ID NO: 229996 - DNA, 1413 bp, Artificial Sequence
  Description of Artificial Sequence: Synthetic coding sequence
atggcccagcgctatgatgagctgccgcattatggtggtatggacggagtgggcgtgcccgcatctatgtacggcgatccacatgctccacgccctattccccctgtccatcacctcaatcatggtcctccactacacgcaacacagcattatggcgcacacgccccacatcccaacgttatgcctgctagtatggggtcagcagtcaatgacgcactgaaaagagacaaagacgctatctatggccaccctctcttccctctgctagccttggtgttcgaaaagtgcgagttagccacctgtactcctagggaacccggtgttgctggcggagatgtgtgctcaagtgactctttcaacgaggacatagccgtctttgcgaagcaggttagagccgaaaagcctctgttctcaagtaatccggagttggataacctgatgattcaggctatccaggttttaagattccatctcttagagctggaaaaggtgcacgaactgtgcgacaacttctgtcaccgctacatcagttgtttgaagggtaaaatgcccattgatttagtaattgatgagcgcgatgggtcgtccaagtctgaccatgaagagctatccggttcttctacaaacttggccgatcacaatccctcttcatggcgggaccatgacgatgccacatccacgcacagcgctggcacacccggtccaagcagcggcggacacgcttcccagagcggtgacaacagttccgaacaaggcgacggcttggataacagtgtggctagcccaggcaccggcgatgatgacgatccagataaagacaaaaagagacaaaagaagcggggtatcttcccaaaggtcgcgaccaacataatgcgagcttggctttttcaacacttgacccatccatacccttccgaagagcagaagaaacaactggcacaggacaccggcctgacgatattgcaggtaaataattggtttatcaatgcccgacgtcggatcgtacaaccaatgatcgatcagagcaaccgagccgtgtcccagggcgctgcttattcacccgagggtcaaccaatggggtccttcgtgctggacggacagcagcatatggggatacggcctgcgggtctgcagtccatgccaggcgactacgttagccagggaggccctatgggcatgagtatggcacagccatcttatacccctcctcagatgacacctcaccctacccagttaaggcacggaccacctatgcattcctacctcccatcccacccacaccaccccgcaatgatgatgcatgggggacctcccactcatccagggatgaccatgagcgcgcagagcccaaccatgttaaacagtgtggatcctaatgtcggtggacaggtgatggatattcacgcccagtag

SEQ ID NO: 229997 - DNA, 921 bp, Artificial Sequence
  Description of Artificial Sequence: Synthetic coding sequence
atggctttggtatttgagaaatgcgaactggctacttgcacacctcgggagcctggcgtcgccggaggagatgtttgcagcagtgattctttcaacgaggatatcgccgtcttcgctaagcaggtgcgcgcagagaaacctctgttttctagcaatccagagctggacaatctgatgatccaagccattcaggttctccggtttcacctcttggagctggaaaaggtgcacgaactgtgtgataacttttgccaccgctacatctcctgcctcaaaggcaaaatgcccatcgatttggttatcgatgagcgagacggatcaagtaaatctgatcacgaagagctgagtggctcctcaaccaatctggctgaccataacccatcttcttggagagatcatgacgatgcgacatcaacccacagcgccggtactcccggaccttctagtggtggtcacgcctcccaatccggcgacaattcatctgagcaaggagatgggctcgacaattccgtggcatcacccggaacaggcgacgatgacgatccagataaagataagaaacgccagaaaaagcgaggtatctttccaaaggtcgcaactaatataatgagagcttggttgttccagcacctgactcatccatacccttcagaagagcaaaagaagcagctggctcaggataccggccttacaatcctgcaggtaaacaactggtttataaatgctcggaggcggatagttcagcctatgattgaccaaagcaaccgcgcagtaagccagggtgccgcatacagtcctgagggccaaccaatgggttcttttgtgctggacgggcagcagcacatgggcattaggccagccggacctatgtctgggatgggaatgaatatgggaatggatggacagtggcactacatgtag

SEQ ID NO: 229998 - DNA, 921 bp, Artificial Sequence
  Description of Artificial Sequence: Synthetic coding sequence
atggctctcgttttcgaaaagtgtgaactggcaacctgcactcctagagagccaggagtagctgggggtgacgtgtgctcaagtgactcttttaacgaggatatagcggttttcgctaagcaggtacgcgctgagaaaccacttttcagttcaaaccccgaactggacaatctcatgatacaggcgattcaggttctcagatttcaccttctagaactcgaaaaggtccacgaactctgtgataacttctgtcacagatacatatcatgtctaaaagggaagatgcctatcgatctggtgattgatgaacgggacggcagctccaagagcgatcacgaggagctgtcgggctcatccacgaacctcgcagaccacaacccttcttcatggagagatcacgacgatgcaacctccacccacagtgccggaactcccggtccttccagcggcggacacgcgtcccagtcaggagataactctagcgaacagggagacgggctcgataattcagttgccagcccgggtacaggagatgacgacgatcctgataaagataaaaagcggcagaagaagcgtggcattttccctaaagttgcaacaaacattatgcgggcttggctttttcagcacctgacccacccctatcctagcgaggagcaaaaaaagcagctcgctcaggacacagggctgacaatcctgcaggtgaataattggtttattaatgcccgacggagaatcgtccagccaatgattgaccagtcaaatcgggctgtttcccagggggcagcttacagccccgaggggcagccaatgggttcctttgtgctggacgggcaacagcatatgggcatccgacccgctggaccaatgagcggaatgggcatgaatatggggatggacggacagtggcactacatgtag

SEQ ID NO: 229999 - DNA, 1206 bp, Artificial Sequence
  Description of Artificial Sequence: Synthetic coding sequence
atggcacagcggtacgacgaactaccccattatgggggaatggatggcgtgggggttcctgccagcatgtatggcgacccgcatgcgccacgccctatcccccctgtgcaccatttaaaccacggcccacccctacatgcaacccagcattatggtgctcacgccccacaccctaacgtcatgccggcttccatgggaagtgcggttaatgacgccctgaaaagagataaggacgccatttacggacaccctttgtttcctctgctcgctctggtttttgagaagtgtgaactcgccacttgcaccccaagagaaccgggagttgcaggtggcgacgtttgctccagtgattcgttcaatgaagacattgccgtcttcgctaagcaggtgcgcgcagaaaaacctcttttctcctctaaccctgagttagataacctgatgatccaggctattcaagtgcttcgcttccatctgttggagctggagaaggtgcatgaactgtgtgacaatttctgccaccgatatatttcctgcctgaaaggcaagatgcctatcgatttagttatcgacgagagggacggaagtagtaagagtgatcatgaggaactttctggttcatccactaatttggcagatcataatccctcctcttggagagatcatgatgatgccacctcaactcattccgctgggacacccggtccatcaagtgggggacacgctagtcagtctggggacaattcttcggagcagggcgatgggttggacaatagcgtggcatctcctggcactggagacgatgacgaccccgacaaagacaagaaacgacaaaagaaaaggggaattttccccaaagtggctactaacattatgcgggcttggctctttcagcacctgacgcacccttatccgagtgaagaacaaaagaaacagctggctcaagataccggactcaccatcctgcaagttaacaactggttcatcaatgctcgaagacgcatagtacaacctatgatcgatcagtctaaccgtgccggtttcctgctggacccatcagtgtcgcagggcgctgcctactctcctgaggggcaacccatgggctcctttgtgctggacgggcagcagcacatggggattcgcccagcaggtcctatgagcgggatgggtatgaacatgggaatggacggccaatggcactacatgtag

SEQ ID NO: 230000 - DNA, 1185 bp, Artificial Sequence
  Description of Artificial Sequence: Synthetic coding sequence
atggcgcagagatacgacgaacttcctcattatggagggatggacggcgttggggtacccgcttccatgtatggggatccccacgctccccgacccatcccccctgttcaccaccttaatcatgggcctccccttcacgcaacgcagcattacggcgcacacgcaccccaccccaacgtgatgccagccagcatgggatccgccgtaaacgacgctctgaaacgtgacaaggatgccatttacgggcaccctctgtttcccctgctggcactcgttttcgaaaagtgtgaactcgccacgtgcacaccaagggagcccggagtggcgggaggagacgtttgctctagcgactccttcaacgaagatatcgcagtctttgccaagcaggtccgtgccgaaaaacccctgttttcctcaaacccggaactggataatctaatgatccaggctatccaggtcctacgtttccatttactggagttggagaaggtacacgagttgtgtgacaacttttgtcatcgttatatctcatgcctgaagggaaagatgcccattgatctcgtgatcgatgaacgcgacgggtctagtaagagtgaccacgaagagctgtccgggtcttccacaaatctggccgaccataatccatcttcctggagagatcatgatgacgccacctccacccatagcgcaggcacacccggaccatcgagtggcggtcacgcatctcagtcaggcgacaactcttctgaacagggcgacggccttgacaatagcgttgcttctcccggaaccggtgacgacgatgaccccgacaaagacaaaaaacgccaaaagaagagaggcatttttcccaaggttgccactaatataatgagagcctggctgtttcagcaccttacccacccctacccctctgaggagcaaaaaaagcaactagcccaagatactggtttgacaattctgcaagttaacaattggtttattaatgcacggagacgtatcgttcagcccatgattgaccagtctaaccgcgcagtctcacaaggcgcagcctattcacctgagggacagccaatgggttcattcgtcctggacggacagcagcacatgggaattcgccctgctgggcctatgtccggcatggggatgaatatggggatggatgggcaatggcattacatgtag

SEQ ID NO: 230001 - DNA, 717 bp, Artificial Sequence
  Description of Artificial Sequence: Synthetic coding sequence
atggatggtgtgggtgtccccgctagtatgtatggcgacccccacgcacccaggcccattccccctgtccaccatctaaaccatggaccccctctccatgccacgcagcattatggggcacacgccccacacccaaacgttatgcctgcctcaatgggctccgccgtgaacgatgccctgaagcgggacaaggacgctatctatggccaccccttatttccattgcttgcattggtctttgagaagtgtgaactggccacatgtacaccaagggagccaggcgtggccggaggggatgtatgctcatcagatagctttaacgaggacattgccgtgttcgctaagcaggtgcgagcagaaaaacccttgttctctagtaacccagagttggataacctgatgatacaggccatccaggtcctaaggttccacctgctggagctcgagaaagtccatgagctttgtgacaacttttgccatcggtacatcagctgcctgaaggggaaaatgcccatcgacttggttatcgacgaacgcgacggctcttccaagtccgatcacgaagagctgagtggatccagcacgaacctcgccgaccataacccttcctcctggcgtgatcacgacgacgccacttccacacatagcgcaggtacccccggaccatcctccggcggtcacgcatcacagtcaggtgataattcctccgagcagtag

SEQ ID NO: 230002 - DNA, 240 bp, Artificial Sequence
  Description of Artificial Sequence: Synthetic coding sequence
atggctctagtctttgagaaatgcgaactggctacatgtacccccagggaacctggagtggctggcggagatgtgtgttcttccgatagctttaacgaggacatcgccgtctttgcgaaacaggtgcgcgctgagaagcccctattttcaagtaacccagaactagataatcttatgatacaggccattcaggtgctccgcttccacttactcgaacttgagaaagtctcaaggaagtag

SEQ ID NO: 230003 - DNA, 1167 bp, Artificial Sequence
  Description of Artificial Sequence: Synthetic coding sequence
atggatggagtaggagtcccggcaagcatgtacggagaccctcacgcgcctaggccgataccccctgtccaccatctaaatcatgggcctccactgcatgcgacccaacactatggggcacatgcccctcatccaaacgtaatgccagcaagtatgggttccgctgtgaacgatgccctgaaacgtgacaaagatgcgatttacggtcaccctctgtttccactattggccctggtcttcgaaaagtgcgaactagccacttgcactcctcgtgaacctggggtagctggcggagatgtctgctccagcgacagcttcaacgaagatatcgccgtgtttgcaaaacaagtaagagcggagaagcccttgttcagctctaaccctgaactcgataatctaatgattcaggccattcaggtgctgaggttccacctcctcgaactggaaaaggttcacgaactctgtgataacttctgccatcgctatattagctgcctgaaaggcaagatgccaatagatctggtgatcgacgaacgcgatggatcttctaagtctgaccatgaggaactgagtggaagctcaaccaacttggccgatcataacccctcaagctggagagatcatgatgatgccactagcacacactcagccggaacacctggcccaagttccggcggacacgcctctcagagtggagataactcctctgaacagggtgacggactggataactctgtcgcctcaccagggacaggagacgacgacgaccccgataaagataagaagagacaaaaaaagcggggtatctttccaaaagtggcaaccaatatcatgagagcttggctgttccagcatctaacacatccttatccatccgaggaacagaaaaaacagttagctcaggataccgggctcaccatacttcaggttaataattggtttatcaatgcccgtcgcaggatcgtgcaaccaatgatcgatcagtcaaatcgggcagggttcttactggacccatcagtctcacagggtgctgcttacagccccgagggccagccaatgggcagtttcgtgctggatgggcagcagcacatgggtattcgccctgccggacccatgtcaggcatgggaatgaacatgggaatggatggacagtggcactatatgtag

SEQ ID NO: 230004 - DNA, 1185 bp, Artificial Sequence
  Description of Artificial Sequence: Synthetic coding sequence
atggcccagaggtacgacgaacttcctcactacggaggcatggacggtgtgggggtccctgcatctatgtacggtgacccccacgctcctaggcctatcccccctgtccaccacctcaatcatggtcccccacttcacgccactcagcattacggtgctcacgccccacaccctaacgtgatgcccgcatcaatgggaagcgccgtgaatgacgctttgaagagagacaaagatgcaatttacggccaccccctgtttcccctattggctctagtgtttgaaaagtgcgagcttgcaacctgtactcctagggaacccggtgtggctggtggtgacgtgtgttcttccgactcattcaacgaggatatcgcggtttttgccaagcaggtgagggccgaaaagcccctattttcttccaaccccgagttggacaacctcatgattcaagccatccaggtgcttcgcttccatctgctcgagttagagaaagtgcacgagctgtgtgacaacttctgccataggtatatatcctgcctgaagggcaagatgccaattgacctcgtgatcgacgagcgggacgggagcagcaagagcgatcatgaagagctgtctggatctagcacaaatctggctgaccataatcctagcagctggagagatcatgacgacgcgaccagtacacacagtgccggtaccccagggccaagttctggtgggcatgcctctcagtccggcgacaattcctctgagcagggggacggtctggataattctgtggccagtccaggcacaggagacgatgatgatccagataaagacaaaaagaggcagaagaagcgcggtatattcccaaaagtagccaccaacatcatgagggcctggctgttccagcacctgacgcacccctaccccagtgaggagcagaagaaacaattagcgcaggacacggggctgacaatcctgcaggtcaataattggttcatcaacgctcgcaggcgcatcgtgcaaccaatgatagaccagagcaatcgcgcagtctctcagggggctgcctactcacctgaggggcaacctatgggtagctttgtccttgatggtcagcaacacatgggaatcaggccagcaggcccaatgtctggtatgggcatgaacatgggcatggacgggcagtggcactacatgtag

SEQ ID NO: 230005 - DNA, 1434 bp, Artificial Sequence
  Description of Artificial Sequence: Synthetic coding sequence
atggcccagagatacgatgaactcccacattatggtgggatggacggggtcggggtccctgccagcatgtatggggacccccatgccccacgccctatccctccagtgcaccaccttaaccatgggcctccactgcatgccacgcagcactacggggcacacgcaccacacccaaatgtgatgcccgcttcaatgggaagcgctgtaaacgacgccctcaagagggacaaggacgccatttacggccaccccctgttcccattgcttgccttggtcttcgagaagtgcgagctggcgacctgtacgcctagagagcctggggtagctggaggggacgtttgtagctcagactcctttaacgaggacatcgccgtgtttgctaaacaagtcagggcggagaaaccactgttttccagcaaccccgagctggataaccttatgatccaggctatacaagtgctgagattccatctgctcgaactggagaaggtgcacgagctttgcgacaacttttgccaccgctacatatcctgcttgaagggaaaaatgcccattgatctagttatcgatgaaagggacggttcatctaaatccgaccacgaggagctctctggatccagcaccaacctcgcagaccataacccttcttcttggagagaccacgacgatgctacctccacccactccgccggaactcctggtccaagctcagggggacatgcgagtcagtccggcgataattcttctgagcagggcgatgggctcgataactcagtcgccagtcctggtaccggagatgatgacgatcctgacaaggataaaaagagacaaaagaagcgcggaatttttcctaaggtcgccactaatattatgagggcgtggctgttccaacacttgacgcatccatacccatcagaggagcagaaaaaacagctcgcccaagacacgggcttgacgattcttcaggtcaataactggtttatcaacgcgcgacgtaggatagttcagcctatgatcgaccagtccaatcgggcaggcttccttcttgatccaagtgtgtctcagggagctgcctattcacctgaaggacaacctatgggttcattcgtgctggacgggcagcagcacatggggataaggcccgcaggcctgcagtctatgcccggtgattacgtcagtcagggcggtcccatgggaatgtccatggcccagcccagttatactccccctcagatgacaccgcatcctacccaactaagacacgggccaccaatgcatagctacctgcctagtcacccgcaccaccccgcaatgatgatgcatggcggtccccctacacatccaggaatgacaatgtcagctcagtctccgactatgctcaactccgttgatccaaacgtgggcggacaggtcatggacatccatgcccaatag

SEQ ID NO: 230006 - DNA, 1434 bp, Artificial Sequence
  Description of Artificial Sequence: Synthetic coding sequence
atggcacagcggtacgatgagctccctcattacgggggtatggacggtgtgggcgtaccagcaagcatgtacggcgacccacacgcccctagaccaatcccaccggtacaccatctgaaccatggcccacccttgcacgctacccagcactatggagcccacgctcctcatcctaacgtgatgccagcctccatgggcagtgccgtgaatgatgctcttaagagggacaaagatgcaatctatggtcacccgctgttcccacttttggccctggtgtttgagaaatgcgaacttgctacctgcacacctcgggagcccggagtggcgggtggagacgtctgtagctctgacagcttcaacgaagatatagctgtgtttgctaagcaggtgagagccgagaaaccattgttcagctccaacccagaactagacaacttgatgatccaagccatccaggtgctgaggttccaccttctggagctggagaaggtgcatgagctatgcgacaacttctgccaccgttacataagttgcctgaagggcaaaatgcctatcgatctggttatcgacgagcgggacggaagttccaaatcagatcacgaggaactctcaggttcaagtacaaatcttgcagatcataaccccagcagttggcgagaccacgacgatgctacatctacacacagcgccggaacacccggtccctctagtgggggacatgcctctcagtctggcgataatagctcagaacagggggatggacttgacaattccgtagcctcgcctggtacgggagacgacgacgaccccgacaaggataaaaaacggcagaaaaagcgcggtattttccccaaggtagcgaccaatataatgagagcttggctgtttcaacacttgacccacccttatccaagcgaggaacaaaaaaagcagcttgcacaagacacagggctaaccattctccaagtgaataactggttcattaatgcaagaaggcgtattgtgcaacctatgattgatcaatcgaacagagccggatttcttctggacccttcagtctctcagggcgctgcgtatagccccgagggacaaccaatgggcagttttgtgctcgacggccaacagcacatgggcatccgcccagctgggctgcaaagcatgccgggagattatgtaagtcagggcggaccaatgggaatgtccatggcccagccctcatataccccaccccaaatgaccccccaccctactcagctgcggcatgggcctcccatgcatagttacctccccagtcatcctcaccaccctgctatgatgatgcatggtgggcctccaactcatccaggcatgaccatgtcagcccagtcacccacaatgcttaactcagtcgatcctaatgtggggggtcaagttatggacatccatgcgcaatag

SEQ ID NO: 230007 - DNA, 357 bp, Artificial Sequence
  Description of Artificial Sequence: Synthetic coding sequence
atgccccgagaggatgcacactttatttatggatatcccaagaaggggcacggacacagttacacaaccgcggaggaagcagccggtatcggaatcttgactgtgatcctgggagtactcttacttattgggtgttggtactgtcgcaggagaaacggttacagagccttaatggacaaatctctgcatgtaggcacacagtgtgccttaacccggagatgtccccaggaggggttcgatcatcgagactctaaggtctccctgcaggaaaaaaattgcgagcccgtcgtacccaacgcaccccctgcttatgagaaactctcagcagaacagtctcctccaccctattccccctag

SEQ ID NO: 230008 - DNA, 357 bp, Artificial Sequence
  Description of Artificial Sequence: Synthetic coding sequence
atgccacgcgaggatgcacattttatttacggataccctaaaaaaggccacgggcattcctacacaacagcagaggaggccgctgggatcggcatccttacggtgattcttggcgtgctacttctgatcggatgttggtattgtaggcgacgcaatggctaccgtgctttaatggataaaagcctgcacgtgggaactcagtgtgccttgacgaggcggtgtccccaggaggggtttgatcatagagatagtaaagtgtccttacaggaaaagaattgtgagcccgtggttccaaacgcccctcctgcctacgagaaactttccgctgagcagtcaccccctccctacagcccatag

SEQ ID NO: 230009 - DNA, 357 bp, Artificial Sequence
  Description of Artificial Sequence: Synthetic coding sequence
atgccacgagaggatgcccactttatttatggatatccaaaaaaagggcacggccacagctatacgaccgctgaggaggccgctgggattggcatcctgactgtcattttgggcgtcctcttactgattgggtgctggtactgtcggaggcgcaacggatacagagccctgatggataaaagtctccacgtggggacacagtgcgcactgacccggcgttgtccgcaagaaggctttgaccatcgagactccaaggtgagtcttcaggaaaagaattgcgaacccgtcgtccctaatgcacccccagcttacgaaaaactctctgcagagcagtctccacccccatacagcccctag

SEQ ID NO: 230010 - DNA, 1269 bp, Artificial Sequence
  Description of Artificial Sequence: Synthetic coding sequence
atgtccgtgggcgctatgaaaaagggtgttggcagagcagttggactgggaggcggatccggatgccaggcgacagaggaagaccccctcccaaactgtggagcatgcgccccaggtcaagggggaagacggtggaggctcccacaacctgcatgggtggaagggtcaagcgctcgcctctgggagcaggcaacaggcacaggctggatggacctggaggcaagcctgctgcccacggggcctaatgctagtaatacttccgatggacccgataacctaacatctgccggatctcccccacggacaggctctatttcctatattaacattataatgccttctgtgttcggcacaatatgcctactaggtattataggcaattcgacagtcatcttcgccgtcgtgaaaaagtccaaactgcactggtgtaacaacgtgccagacatctttatcattaacctgagtgtggtggatctgctatttctcctgggcatgccatttatgatacatcagctcatgggaaatggtgtctggcatttcggcgaaactatgtgtacactcatcaccgccatggatgctaactcacagtttacatccacatatatactgacggccatggcgatcgaccgctatctggccaccgtgcaccctatctcttccaccaagtttcgtaagccttccgttgctacactcgtgatctgcctgctgtgggcgctctcttttattagcattacacccgtttggctgtatgcacgtctcattcctttccccggaggagctgtcggctgtggcatcagattaccgaatcctgacacagacctatattggtttaccctatatcagttctttttagccttcgccctccctttcgtggtgattaccgctgcatacgtcaggatcctccagaggatgacatcctccgttgctcctgcatcccagcggtctatccgtctcaggactaagcgggtgacccgaactgctatcgctatctgtctggtcttctttgtgtgctgggccccatactatgttctacagctcactcagctcagtatctctagaccaacgctgacttttgtctatctttataacgctgctattagcctggggtacgccaacagctgcctgaaccctttcgtgtacatcgtgctgtgcgaaacatttagaaagcgcctcgtactatcagttaagcccgcagcccagggccagcttcgggcagtgagcaatgcacagacagctgacgaagaaaggacagaatctaaaggaacctag

SEQ ID NO: 230011 - DNA, 891 bp, Artificial Sequence
  Description of Artificial Sequence: Synthetic coding sequence
atgagtgttggggctatgaagaagggggttggacgcgcagtgggcttgggaggcggttctgggtgccaggcaaccgaggaagatcccctgcccaattgcggcgcatgtgccccaggacagggcggacggcgatggcggctgccccagccagcttgggtggagggcagctccgcaagactctgggagcaggccaccgggaccggatggatggaccttgaggcaagcctgcttccgacgggccctaatgctagcaacacgagtgacggtcccgacaatctgacctccgcaggatctccacctcgcacgggctccatcagctatattaacatcatcatgccctccgtgtttggaaccatttgcttgctgggaattattggaaatagcaccgtgatctttgccgtggtgaaaaagtctaagctccactggtgcaataacgtgcctgacatcttcatcataaatctgtccttcttcctggcttttgcattacccttcgtggtcataacagctgcctatgttcggatcctacagagaatgacctccagcgtggcccctgcttcgcagaggtcaatccggctccggactaagagggtcacacgcaccgctatcgcaatttgcctcgtcttttttgtgtgctgggctccttactacgtgcttcagcttacccagttgtcgattagtaggcctacattgaccttcgtctacttgtataacgccgctatttccctgggatacgccaactcgtgccttaatcctttcgtctacattgtgctatgtgaaacttttaggaaaagacttgtactctctgttaaaccagcagcccaagggcagctgagagccgtgagcaatgcacagacggccgacgaagagcggaccgagtctaagggtacctag

SEQ ID NO: 230012 - DNA, 1023 bp, Artificial Sequence
  Description of Artificial Sequence: Synthetic coding sequence
atgaaccccttccacgccagctgctggaacacctccgcagagctgcttaacaaaagctggaacaaggagttcgcttatcaaacagcttccgtcgttgatacggtcattctgccatctatgatcgggataatatgctccaccggtctggtgggcaatatcctgattgtatttactattatccgatcacgaaagaaaaccgtgcccgacatatacatatgtaatttggccgtcgctgacctggtacacattgttggaatgcccttcctcatccaccagtgggcccgaggaggcgaatgggttttcggaggccctctgtgcacaataataacttccctggacacttgcaaccagtttgcctgcagcgcaatcatgaccgtgatgtctgtcgacagatactttgccctcgtgcagcccttcaggctgactagatggcgcactcgctacaaaacgataagaattaatctggggctttgggccgcatctttcatacttgccctgccagtgtgggtgtattcaaaggtcattaaattcaaggacggcgtcgagagttgtgcttttgacctaaccagccccgatgacgtcctttggtacacgctgtacctgaccatcacaacatttttctttcccctccccttgatcctagtttgttatatccttatcctgtgttacacttgggaaatgtatcagcagaataaagatgcacgttgctgtaatccatctgttccaaagcagagagtgatgaagctgacaaagatggttcttgtcctggtggtggttttcatcttgagtgccgctccataccacgtgatacaacttgtcaatctgcagatggaacagcccaccttggcattttacgtgggttattatctatcgatttgcctatcatacgctagcagcagtattaaccccttcctgtacatccttctgtcagggaacttccagaaaaggcttcctcagatccagcggagagccacagaaaaggaaatcaataatatgggaaatactctaaaaagtcacttttag

SEQ ID NO: 230013 - DNA, 1023 bp, Artificial Sequence
  Description of Artificial Sequence: Synthetic coding sequence
atgaacccatttcacgctagctgctggaacacgtccgccgaattgttgaacaagtcatggaacaaagagtttgcctaccagacagcctcagtggtggatacagtgattctgccatcaatgatcggcatcatatgcagcactggtctagttggtaatattcttatagtcttcacgatcatccggtctcggaagaagactgtgcctgatatctacatttgcaacctggcagtcgcggaccttgtacatatagtaggtatgccttttttaatccatcaatgggctcgtgggggagagtgggtcttcggaggacccttatgtacgattatcacttcactcgacacctgcaaccagttcgcgtgctcagccattatgacggtgatgagcgtggacaggtacttcgctctggtccagccatttagactgactaggtggcgaacccgctacaaaacaatccgaattaatctgggcctctgggctgcatcattcatcctcgctcttccagtttgggtctattctaaggtcataaagttcaaggatggtgtagagtcctgcgccttcgatctgacatcccctgacgacgtcctgtggtatacattgtatttgaccattactaccttcttcttccccttaccactcattctggtgtgttatattctgatactgtgctatacatgggaaatgtatcaacaaaataaggatgctcgctgctgtaacccttcagtaccaaagcagcgcgtgatgaagcttactaagatggttctggtactcgtagtcgtatttatcctctcagctgcaccatatcacgtgatacagctagtgaacttgcagatggaacagcccaccctggcattttacgtgggctattacctcagcatctgcttatcatatgcgtcatcctcgatcaacccattcctgtatatcctgttgtccggaaactttcagaaaagactgccacagattcagcggcgagccactgaaaaggaaattaacaacatgggtaacacactcaaaagtcatttctag

SEQ ID NO: 230014 - DNA, 1023 bp, Artificial Sequence
  Description of Artificial Sequence: Synthetic coding sequence
atgaatcctttccacgcctcatgctggaacacttctgcagagttactgaataaaagttggaataaggaattcgcttatcagactgccagtgtcgtagacaccgttatcctcccatcaatgatcgggataatctgttcaaccggcttagtgggaaacatactgattgttttcaccatcatccgtagtcgaaagaagaccgtgcccgacatttatatttgtaatctagccgtcgcggacttggtgcatatcgtgggaatgccgtttttgatacatcagtgggctcgcggtggtgagtgggtgtttggaggaccgctctgcactatcattactagtttagatacctgtaatcagtttgcctgctctgcaataatgacagtgatgtcagtagacaggtactttgctctagttcagccgttccggctcacccggtggaggacaaggtataagaccatccgcattaacttgggactttgggcggcaagctttattctagcactgcctgtgtgggtttactcaaaggtgataaagtttaaggacggcgtggaatcatgcgcttttgacttgacttcccctgacgatgtgctttggtataccctgtatctgaccattaccacattcttcttccctctccctctaatacttgtgtgctacattctgatactttgttacacttgggaaatgtatcagcagaataaagacgccaggtgctgtaatccttcggtccccaagcaacgggtgatgaaactgaccaaaatggtcctcgtgctggtggttgtctttatcctatctgccgctccgtaccacgtgatacaactggtgaatctacagatggagcagcccaccctcgctttttatgtgggatactacttatctatctgcctgagctacgcgtccagctccattaaccccttcctttatattttgttgtctggcaacttccagaagaggctgccacagatacagaggcgggctacagaaaaagagatcaataatatggggaacacactgaagtcacatttctag

SEQ ID NO: 230015 - DNA, 519 bp, Artificial Sequence
  Description of Artificial Sequence: Synthetic coding sequence
atggccaacggcaccaatgcctctgccccttattatagctacgaatactatctggattatctagacctgatcccagtggacgaaaaaaagctgaaagcacataagcactcgatcgtaatcgcattttgggtgagtctcgccgcttttgtggtgctccttttcctgatccttctgtacatgagctggtctgccagcccgcaaatgcgaaattcaccaaagcaccatcaaacatgcccttggtcacatggtctgaacctgcatctctgtatccagaagtgcttgccatgtcacagagagccattggctacttcccaggcacaagcatctagtgtggagcctggatcccggaccggtccagatcagcccctgcggcaagagagctcttctactctacccctcggcggtttccaaacccatcctacccttttatgggaattgactttgaacggtggtcccttggtgcgctcgaagccttcagagcctccaccgggagaccggaccagccagctccagtcttag

SEQ ID NO: 230016 - DNA, 309 bp, Artificial Sequence
  Description of Artificial Sequence: Synthetic coding sequence
atggcaaacggcacaaatgcatcagcaccctactactcgtatgagtactatctggactatctggacctcattccagtggatgaaaagaaattgaaagcccacaagcactccattgtaatagctttttgggtgagtttggctgcattcgttgtgctgctatttctgatcttgctgtacatgtcgtggagcgcttccccccagatgagctttaacaccgatgagagtttgctgcattcggaagtcctgccacagactcgtgccattagctgcgacgagcttcaggctccgagggaggagggtgctgcctag

SEQ ID NO: 230017 - DNA, 519 bp, Artificial Sequence
  Description of Artificial Sequence: Synthetic coding sequence
atggcaaacggcacaaacgccagtgctccttattattcctacgaatattaccttgactacttggacctgatccccgtcgatgagaagaagctcaaagcacataagcattctatcgtcatcgcattctgggtttctctggccgcttttgtcgtacttctgtttctcattctgttgtatatgtcatggtcagccagcccccagatgcggaatagccctaaacaccatcagacttgcccttggtcacatggcctgaacctccacctgtgtatccaaaagtgcctaccctgtcatcgtgagcccttggctacttcccaggcgcaagcatccagcgtagagcctggatcaagaacgggacctgatcaacccttacgtcaggagagctcttcaacactgccattaggaggcttccagacccaccctacattattgtgggaattaactcttaacggagggcctctggtacggagcaagccctccgaaccccctcccggagacagaaccagccagctccagagctag

SEQ ID NO: 230018 - DNA, 309 bp, Artificial Sequence
  Description of Artificial Sequence: Synthetic coding sequence
atggccaacggaaccaacgcttccgcaccgtattactcctacgagtactacttggattatctggacctgattcccgtggacgaaaagaagttgaaggcgcacaagcactccatcgtgatcgccttctgggtgtctctggccgcatttgtcgtcctgcttttcctcattcttctctacatgtcctggagcgcctctccccaaatgtcctttaatacagatgagtccttattacattccgaggtgttgccccagacccgggctatctcttgcgatgagctccaagcccctcgagaggaaggagctgcttag

SEQ ID NO: 230019 - DNA, 1110 bp, Artificial Sequence
  Description of Artificial Sequence: Synthetic coding sequence
atgcctcgggctccaaagcggcagaggtgtatgcctgaggaagatcttcaatcacagtccgagactcagggactcgaaggagctcaagcccctctggcagtagaggaagatgcctcatcatccactagcacaagctcaagtttccctagctcttttccaagcagctcctccagtagctcctccagctgttatccactgatccctagtacacccgaggaggttagtgcggacgacgagacacctaacccgccacagtctgctcagatagcctgtagcagtccctctgtagtggcctcactgccgctcgatcaaagcgatgagggatcatcatcacagaaagaagagtcgccatctactttacaggtcctccccgactctgagtccctccccagaagtgagattgatgagaaagtcacggacctcgtgcagttcctcctgttcaagtatcagatgaaggaaccgatcactaaggccgagattctcgagagcgtcattagaaactacgaggatcacttccccctgctgttttccgaggcaagcgagtgtatgttgttggtgttcgggattgatgtgaaggaggtagaccccactggccattccttcgtgttagtgactagcctgggcctgacctacgacggaatgctgagtgacgtccagtccatgccaaaaaccggcatcttgatcctcattctgagcattgtcttcatcgaagggtattgcactccagaggaggtgatttgggaggccttaaacatgatgggtctctacgatgggatggagcacctcatatacggcgagccgaggaagttactcacacaggattgggtgcaggaaaattacctcgagtacaggcaggtgcctggaagcgatcccgctcgatacgagtttctctggggaccacgggctcacgccgagataaggaaaatgagtctgttgaagtttcttgctaaggtcaatggcagcgatcccagaagctttcctctttggtacgaggaagccctgaaggatgaggaagagagagcacaggataggatcgctactacagacgatacgacagctatggctagtgccagctctagtgctaccgggagctttagttaccccgagtag

SEQ ID NO: 230020 - DNA, 1110 bp, Artificial Sequence
  Description of Artificial Sequence: Synthetic coding sequence
atgccacgagcaccaaagagacaacgatgcatgcccgaagaagacctacaatctcagtcggagactcagggcttggagggagcacaggcacccctcgccgtggaagaggacgcatcaagctcaacctcgacgtcttcctcctttcctagtagctttccaagctcttctagcagctccagcagcagctgctacccgctcattccatcaacccctgaggaggtgtctgccgacgacgaaaccccaaatccaccccagagtgcccagatcgcatgttctagtccctctgtggtggcctcactgcccctggaccagtctgacgaggggagctccagccaaaaggaagagtctccttctacattacaggttttgccagacagtgagtcactgcccagatcggagatcgacgagaaggtcacagacctggtacagttcctcttgtttaaataccaaatgaaagaacccatcactaaggcggaaatcctcgaaagtgttatccgcaattatgaagaccattttcccctcctgttctcagaggcctccgaatgcatgctgctggttttcggcatcgatgtcaaggaagttgatcctacagggcattctttcgtcctcgtgacctctctaggactcacttatgatggcatgctgtccgatgtacagagtatgcccaaaactggaattctgattcttatattaagcatcgtatttatcgagggctactgcactccagaagaagttatctgggaggcgctcaatatgatggggctttacgacggaatggagcatctgatttacggcgaacctcgcaagctattgactcaagactgggtgcaggagaattacctggaatatcgacaagttcctgggtccgatcctgctcggtatgaattcttgtggggcccacgggcacacgctgagatccgaaagatgtctttgctgaaattcctcgcaaaggtcaacggaagcgacccaaggtccttccctctttggtatgaagaggccctgaaagatgaagaggaaagggcgcaggataggattgcgaccaccgatgacaccacagctatggccagcgcgtcctcatccgctacagggtcattcagctaccctgagtag

SEQ ID NO: 230021 - DNA, 486 bp, Artificial Sequence
  Description of Artificial Sequence: Synthetic coding sequence
atgccacgcgctcctaagcggcagaggtgtatgccagaggaggatctgcagtcacagagtgagacccagggtctcgagggggcacaggccccactggccgtcgaagaggacgctagttcctctacctctactagcagctcatttccttccagcttcccctcttcatccagtagctcatcatcttcatgctatccactaattccatcaacccctgaagaggttagtgccgatgacgagacacccaaccccccacaatctgcacagattgcctgctcttcaccgtcagtggtggctagcttacccctggatcaatcagacgagggatcctcttcccagaaggaggagtctccttccacgctgcaggtcctacccgattctgaatcgctccctcgaagtgaaatcgatgaaaaagtcacggacctggtgcagtttctgctgttcaagtaccagatgaaggagccaattactaaggccgaaattctgtag

SEQ ID NO: 230022 - DNA, 573 bp, Artificial Sequence
  Description of Artificial Sequence: Synthetic coding sequence
atgccacgagctccaaagcgtcaacggtgtatgccagaagaagacttgcagagtcagtcagagacacaagggctagaaggggcacaagcgcctttagcagttgaggaagacgcctcaagctcgacaagcacctcatcgagtttcccctcgagcttccccagcagcagcagttcatcctcatcatcttgttatcccctgattccttcgacgccagaagaggttagtgccgacgacgagaccccgaatcctccacagagcgcacagatcgcttgtagtagccctagcgtcgtcgcatccctccccttagatcagtcagatgagggatcctcctcccagaaggaggagtcaccttctacccttcaggttcttcctgacagcgaatcgcttcccagatctgaaatcgacgaaaaggtcaccgatctagtgcaattcctgttgtttaagtatcagatgaaggagcctatcaccaaagctgagatcctggaaagtgtgattagaaattatgaggaccacttccccctcctgttctctgaggcttccgagtgtatgctcctggtgttcgggattgactag

SEQ ID NO: 230023 - DNA, 1203 bp, Artificial Sequence
  Description of Artificial Sequence: Synthetic coding sequence
atgagtaaagtctcaaccatgtttagtgaagacgatttccagtcaactgagcgagccccatacggaccacaacttcaatggagccaggacctgcctcgcgtgcaagtgtttagggagcaagccaatttggaagataggagtccccgacgcacacaaagaattactggaggcgaacaggtgttatggggtcccattactcagatcttccctacagtgaggccagctgacctgacgagggtgattatgcccctcgagcagcggagccagcattgtaagcctgaagagggactgcaagcccaggaagaggacttgggtttggtcggggcacaggccctccaggctgaggaacaagaggcagctttctttagcagcacactcaacgtcggtacgctggaagagctgcctgccgctgaaagccctagcccgcctcagagcccccaggaggagtctttctcacctacagccatggacgccatttttggttccttatcagatgagggttccggtagccaggagaaagaaggcccttctacaagccccgatcttattgatccagagtcattctcacaggacatcttacacgataaaatcatcgacctggtccacctgctcctaagaaaatatcgagtgaagggcttgataaccaaagcagagatgttaggtagtgtgattaaaaactatgaggactacttcccggagatctttagggaagcgtcagtttgcatgcaattactgtttggtattgacgttaaggaggttgacccgaccagtcactcttacgtattggtgactagcctaaatctaagttacgacggaatccaatgtaatgagcagagcatgccaaaaagtgggctgctgattatagtgctgggggtcatcttcatggagggtaattgcattcccgaagaagtgatgtgggaggtgctgtccatcatgggcgtttatgctggacgggagcacttcctatttggagaacccaaacggcttctcacgcagaattgggtccaggaaaagtacctcgtctataggcaggtgccaggcactgatcctgcatgctacgaatttttatgggggcctagagctcatgccgagacatccaaaatgaaggtcctcgagtacatagccaacgcgaacggccgagatccaacctcctatcctagcctctacgaggatgcgctgagagaggaaggggagggagtctag

SEQ ID NO: 230024 - DNA, 1290 bp, Artificial Sequence
  Description of Artificial Sequence: Synthetic coding sequence
atggaaacccagttcaggcggggaggattaggctgttcaccggcatccatcaaacgtaaaaagaagcgcgaggacagtggggattttggactgcaggtttcaacaatgttctccgaagatgattttcagtccactgaacgggctccttacgggccacagcttcagtggagccaggacctgccacgggtgcaggttttcagagaacaggccaatctggaagatcgctcccctaggcgtacacagaggataactggtggagagcaggtcctttggggcccaattacccaaatctttcctactgtccgccctgctgatctgacacgcgtaatcatgcccctcgaacaacgaagccagcactgcaagccggaagaaggcttgcaagcacaggaggaggatctgggactcgtgggcgctcaggcattgcaggcagaggagcaggaagcagcttttttcagttccactctgaatgtcggcacactcgaggaacttcccgcagccgaatccccttcaccccctcagtcccctcaagaagagtcattctcccctaccgcgatggacgctatattcgggtccctctctgacgaaggttccggatcacaagaaaaggaaggtccaagtacctctccagacttgatcgatcctgagagtttttcccaagatattcttcatgacaagatcatcgacttagtccatctgcttctgcggaaataccgggtgaagggcctgattaccaaggcggagatgctgggctctgtgatcaaaaattacgaggattacttcccggagatattccgtgaggcatccgtgtgcatgcagctactgtttggaattgacgtgaaggaggttgatcctacttcccatagttatgtgctggtgacctccctaaatctaagctatgacggcattcaatgtaacgagcagagtatgccaaagagtggcctgctgatcatagtgctgggtgtcattttcatggaagggaattgcattcctgaagaggttatgtgggaggtcctcagcattatgggggtgtacgcaggcagggaacattttctatttggcgagccaaaaagactcttgacccaaaattgggtgcaggagaagtatttggtatacagacaggtgccaggtacagacccagcttgctacgagtttctgtggggaccgagggctcatgccgaaaccagtaagatgaaagtgcttgaatacatagctaacgcaaatggcagggatccaacctcatacccgtccctctacgaggatgcacttagggaagaaggagaaggagtgtag

SEQ ID NO: 230025 - DNA, 945 bp, Artificial Sequence
  Description of Artificial Sequence: Synthetic coding sequence
atgcctctggaacaacgtagtcagcactgcaagccggaggagggtttggaggcacagggcgaagctctcggtctcgttggggcacaggccccagctacggaagagcaggagacagcctcctcaagctctacgctggttgaggtgaccctgcgcgaggtgcccgctgcagagtcaccatctcctccacatagccctcagggcgctagcacactgccaacgactatcaactatactctgtggagccaatctgacgagggctcttcgaatgaggaacaggaagggccttcaacattcccggatctcgagaccagcttccaggtagccctgtcccgcaagatggcagagcttgtgcactttctgttactgaaataccgtgccagggaaccatttacaaaggccgagatgctgggcagtgttatacgtaactttcaggatttttttccagtcatctttagtaaagcctctgagtatctgcagctggtgttcgggatcgaagtggtggaggtcgtgagaattggtcatctttacatactagttacgtgcttaggactgtcttacgacggactactgggggataatcagattgttcctaagacgggcctgctgataatcgtgctcgcgatcattgctaaagagggtgactgtgcgccagaggagaagatctgggaagagttatctgtattagaagcctccgatggacgcgaggacagcgttttcgcacatccacgtaagctgcttactcaggacctcgtccaagaaaattatctggaataccgccaggtgccgggttcggatcctgcctgctatgaattcctatggggaccccgtgccctcgttgagacaagctatgtaaaggttctacaccacctgcttaagatctccggaggcccacatatctcgtaccccccacttcatgagtgggccttccgggagggagaggaatag

SEQ ID NO: 230026 - DNA, 945 bp, Artificial Sequence
  Description of Artificial Sequence: Synthetic coding sequence
atgccactggaacagaggtcccagcactgtaagccagaggagggcctcgaagctcaaggagaggctctcgggctggtgggggctcaggccccagcaacggaagagcaagagaccgcctcttcctctagcacattagtagaggtaacactccgagaggtgcccgctgcagagtccccatccccccctcattcccctcagggcgcatctacattaccaaccaccatcaattacactctgtggtcccagagcgacgaaggtagttccaacgaggaacaggagggacccagcacgttccctgatctggaaacaagcttccaggtcgctctctcaaggaagatggcagaactggtgcactttcttttactcaaatatcgggctagggagcctttcaccaaagccgaaatgctaggaagcgtcatcagaaactttcaggatttctttccagtgatattttccaaagctagtgaatacctacagcttgtgtttggaatcgaggtggttgaggtagtgcgcattggacatctttacattttggtgacatgccttgggctgagttatgatggacttctcggagacaaccagattgttcctaagacagggctgctcatcattgtgctagcaattattgccaaagagggagattgcgcccctgaagaaaagatttgggaggagcttagcgttctggaggcttctgatggcagggaggattctgtgtttgcacaccctcggaagcttctgacacaagacttggtccaggaaaattatctggagtacagacaggtacccggttctgacccagcctgctacgagtttttatgggggcctagagccctcgtggaaacgagctatgttaaagtgctccaccatttgctcaagataagtggtgggcctcatatctcctatcctcctctccatgagtgggcctttcgggagggagaagagtag

SEQ ID NO: 230027 - DNA, 945 bp, Artificial Sequence
  Description of Artificial Sequence: Synthetic coding sequence
atgcccctggagcaaaggagccaacactgtaagcctgaagaggggcttgaggcccaaggcgaagccctcggcctggttggtgcccaagcccctgcgaccgaagagcaagagacagcatcctctagcagtacgctggtcgaggtcaccctgcgagaggtcccggctgccgagtcaccttcccctccccacagccctcagggagcctcaactctgcccacaaccattaattacacactgtggagccagtccgatgagggctcctctaatgaggagcaagagggcccttccacctttcccgatttggagacaagcttccaagtcgcactcagccgaaagatggctgaactggttcactttctcctcctcaagtatagagcccgtgaaccttttactaaggccgagatgctcggtagtgttattaggaattttcaggacttcttccccgttatttttagtaaagcctctgagtacctccagctggttttcgggatcgaggttgtcgaagttgttcgcatcggacacctttacattctggtgacttgcctcggactgtcgtacgacgggctcctcggcgacaaccagatcgtccccaagactggactcttaataatcgtccttgcaatcatagccaaagagggcgactgcgctccagaagagaagatttgggaagagctctctgtcctggaggccagtgatggaagggaggattctgtgttcgctcacccccgaaaactactgacacaggatctggtacaggaaaattatctggagtaccgtcaggtgccgggatccgatcccgcatgctacgaatttctctgggggcctagagctctcgtagagacaagctatgtgaaggtgctccatcatcttcttaagatttccggcggacctcatatctcctatccccctctgcatgagtgggcatttcgggagggggaggaatag

SEQ ID NO: 230028 - DNA, 945 bp, Artificial Sequence
  Description of Artificial Sequence: Synthetic coding sequence
atgccccttgaacagagatctcagcactgcaagcccgaggaaggattggaagcccgaggcgaagcactaggcttagtaggtgcacaggctccagccactgaggaacagcagactgctagctcatcctcgaccctggtagaagtaacactcggggaagtacctgcagccgatagcccatcccctcctcattctcctcagggcgcaagctcattcagtaccaccattaactacaccctgtggcgtcaaagtgatgaaggttcctcaaaccaagaggaggagggcccacgaatgttcccggatctggagtcagaatttcaggcggctatctcaagaaagatggtcgaactcgttcacttcttattactgaaataccgggctcgcgaaccagtgactaaagccgagatgctcgaaagtgtgctgagaaactgtcaggactttttcccagtgatcttctccaaggcgagcgagtacctgcaattggtgttcgggattgaagtagtagaggtggtgccgattagtcatctttatatattagtcacttgtcttggactgtcttatgatggcctgttgggagataaccaggtgatgcctaagaccgggctgttgatcattgtgctggccattatagccatagagggagattgcgcacccgaggagaagatatgggaagaactgagcatgctggaagtctttgaaggccgagaggattcagtgttcgcacacccacgcaagctgttgatgcaggatctcgtgcaggagaactacctggagtacaggcaagtacccggatctgatcctgcttgctacgaattcctgtggggacctagagctcttatcgaaacttcatacgtgaaagtcctgcaccatacactcaaaatcggtggagagccccatatttcctatccacctctgcacgagagggcactcagagagggcgaggagtag

SEQ ID NO: 230029 - DNA, 945 bp, Artificial Sequence
  Description of Artificial Sequence: Synthetic coding sequence
atgccgctggagcaacgaagtcagcattgcaagcccgaggaggggctagaagcccgtggtgaggctcttggacttgtcggcgctcaggcaccagccacagaagaacagcagactgcgagttccagttctactctggttgaggttactctgggtgaggtgcccgcagcggattctccatcgccgccacactctcctcaaggagcatccagcttcagcactacaatcaattacaccctgtggcggcagtccgacgaaggatctagcaaccaggaggaagaagggcctaggatgtttcctgatctggaaagcgagttccaggcagccatctcccgcaagatggtcgagctggtgcactttctgcttctgaagtatcgggcacgcgaaccggttacgaaagccgagatgctggagtccgttctccgcaactgccaggacttcttcccagtcatattttccaaagcttctgaatatctacaactggtcttcggcatcgaggtggtggaggtggtgccgattagccatctgtacattctagttacttgtttaggcctgagctacgacggactcctgggagacaaccaggtcatgccgaagacaggcttactaattatcgtgttggccatcatcgccatcgaaggtgattgcgccccagaggagaagatctgggaggaactgagtatgctggaggtcttcgaaggcagagaagacagtgtgtttgcccatccacgaaagctgctcatgcaagatctcgtccaggaaaattaccttgagtaccggcaggtgcctgggtctgatcccgcttgctacgaattcctttggggaccgagggctcttatagagaccagctacgtcaaagtgctgcaccatacccttaagatcggtggcgaaccccacattagttaccctcccctgcatgaacgagcactgcgcgagggcgaggagtag

SEQ ID NO: 230030 - DNA, 945 bp, Artificial Sequence
  Description of Artificial Sequence: Synthetic coding sequence
atgcctctcgagcagcgcagtcagcactgtaaaccggaggaaggcctggaggcccgaggcgaagctctcgggctggttggagctcaggccccagctactgaagagcagcagaccgcctcttcttcatcgactctggtcgaggtgactctgggagaagtgcctgccgctgattcaccttcaccccctcattcccctcagggagccagtagcttctccaccaccattaattacactctttggcgacagtcagatgaaggcagttccaatcaggaggaggaagggccacggatgttccctgatctggagtcagagttccaggccgctataagcaggaagatggtggaattagtccacttcctgctacttaagtaccgtgcgagggagcctgttacgaaagccgaaatgctcgagagtgtgctgcggaactgccaggatttctttccagtcatcttcagtaaagcttccgagtacttgcagctggttttcggcattgaggtagtggaggtagtcccgatctcccacctctatatacttgttacatgcttgggactgtcttatgacggactgctgggcgacaatcaagtcatgcctaagacaggattgctcatcatcgtcttggcaatcatcgccatcgaaggcgactgcgcacctgaagaaaaaatctgggaggagctcagcatgttagaggtttttgaggggcgtgaggacagcgtgttcgctcacccgagaaaactgttaatgcaggatctcgttcaggagaactacctggaataccgacaggttccaggttctgatcccgcttgttacgagttcctgtggggaccgcgagccctgatcgaaacatcctacgtcaaggttctgcatcatacgctgaaaattgggggagaaccccatatctcatatccccctctacatgaacgagccttacgggagggagaagagtag

SEQ ID NO: 230031 - DNA, 945 bp, Artificial Sequence
  Description of Artificial Sequence: Synthetic coding sequence
atgcccctggagcagaggtcacagcactgtaagccggaggaaggccttgaggcaagaggagaggccttggggctggtcggtgctcaagcacctgctacagaggagcaacagactgcttcatcttcctccactctggttgaagtgacattaggcgaggtccccgctgcagatagtcccagcccaccccattcccctcagggagcttcttcgttctctacgacgatcaattacaccctgtggagacagagcgacgagggcagcagtaatcaggaggaggaaggcccacgcatgttccccgatctcgaaagcgaatttcaagccgctataagtcgcaagatggtggaattggtacatttcttgctgctgaagtatcgtgctcgtgaacctgttacaaaagccgaaatgctcgagtctgttttgcgtaactgtcaggacttttttccagtgatattttccaaggccagtgaatatttgcagcttgtgtttggcatagaggtcgtggaggtggtaccgatcagtcacttgtacatcctggtgacttgccttgggctgagctatgatgggctgttgggtgacaaccaagtgatgccgaagactggtctgctgataatcgttctagctatcattgcgattgaaggagattgcgcccctgaggaaaagatttgggaggaactcagcatgctggaagtgttcgaggggcgagaggactcagtctttgcacatccgcgaaagttgttaatgcaagatttggtgcaagaaaactatctcgagtataggcaggtgccaggatcggaccctgcctgctacgagtttctgtgggggccacgcgcactgatagagacatcctatgtaaaggtgcttcaccacacactgaaaatcggtggtgagccccatataagttacccacccctccacgaacgtgccctgcgggagggagaggaatag

SEQ ID NO: 230032 - DNA, 945 bp, Artificial Sequence
  Description of Artificial Sequence: Synthetic coding sequence
atgccactcgaacagcggtctcagcattgcaagcccgaagaaggcttggaagcacgcggagaagcgttaggcttggtcggggctcaagctccagcgaccgaagaacaggaggccgcttcatcctcctccacattggtcgaggtgacgttaggcgaagtgcctgctgccgaatcccccgacccacctcagtccccccaaggagcgagctcattgcccaccactatgaactaccccctgtggtcccaatcgtacgaagactcctcaaatcaggaagaagagggtcctagtacattcccagacttagaaagcgagttccaggctgcactcagtcggaaagttgccgagctcgtgcactttctgctgctgaaatacagggcaagggagccggtcactaaggccgaaatgttggggtcagtggtcggcaattggcagtacttctttccagttatcttcagcaaggccagctcctctttgcaactggtgtttgggatagagctgatggaagtcgatccgattgggcacctgtacatttttgctacatgtttaggactttcttacgatgggttactgggggacaaccagatcatgccgaaggcaggtctcctgattatcgtgcttgcaattattgccagagaaggagactgtgcccctgaggagaaaatctgggaagaactgagtgtgttagaggtgtttgaaggacgggaggatagtatcctaggtgatcctaaaaagttactaacccaacactttgttcaagagaactacctggaatacagacaagttcccggttcggacccagcctgctacgaattcctttggggacccagggcactggtcgagacatcatatgtcaaagtgctccaccacatggtcaagatctcaggtggtccacatataagctacccccctctgcatgaatgggtcctgcgggagggagaggagtag

SEQ ID NO: 230033 - DNA, 945 bp, Artificial Sequence
  Description of Artificial Sequence: Synthetic coding sequence
atgcccctcgaacagcggagccagcattgtaaacctgaggagggcctcgaagcccgaggcgaagcgttaggtctggtgggagcccaagctcccgcaaccgaggaacaagaggcggcatcttcttctagcaccctggtagaagtaactctgggcgaagtgcccgctgcagagtctcctgaccctccacagtccccccagggagcatcaagcctgcctaccacaatgaattatccactttggtcacaaagctatgaggattcctcaaatcaggaggaggagggaccttccactttccccgatctggagtccgaattccaggcagccttgtcaagaaaggtggccgagctagtgcatttcctcctgctcaagtacagggcgagggagcctgtgaccaaagcggagatgctcgggagtgtcgtcggaaactggcagtacttcttccctgtgatcttctcaaaggcatcttccagcctgcagctggtgtttggcattgagctgatggaggtggatccaattggccacctgtatatctttgcaacctgtctgggcctcagctatgatggtctcctgggcgataatcagatcatgcccaaagctggcctgctcattattgtcctcgcgatcattgccagggagggtgactgtgcaccagaagaaaagatctgggaagaattaagcgtcctggaagtctttgaggggagagaggattcaattctgggagaccctaagaagttgctgactcagcatttcgtgcaggaaaattacctcgagtaccgccaggtgccaggatcggacccagcgtgctatgagtttctttgggggcctcgggcactcgtggagaccagctacgtgaaagtgctgcaccacatggttaagattagtgggggtcctcatatttcttacccccctctgcatgagtgggtgctcagggaaggagaagagtag

SEQ ID NO: 230034 - DNA, 597 bp, Artificial Sequence
  Description of Artificial Sequence: Synthetic coding sequence
atgccgctggaacaaaggtctcagcactgcaagcctgaggaaggcctagaggctcggggtgaggccctcggactcgtcggagcccaggctccagcgacggaagagcaggaggccgcttcatcgagtagcaccctagtcgaagttacgcttggcgaggtgcccgctgcagaatccccggaccccccacagagcccgcaaggtgcatcaagtttgccaactaccatgaactacccactgtggtcccagagctatgaagatagctcaaaccaggaggaagagggcccaagcacctttccagatctggagagtgagttccaggctgcactcagccggaaagtcgccgagctggttcacttcctcctgctgaaatatcgcgcacgggagccggtaactaaagctgaaatgctcggatctgtggtgggaaattggcagtacttttttccggtcattttttcgaaagcctcctcctcactacagctcgtatttggcatagaactcatggaagtggacccaatcggccacctatacatctttgccacttgtttaggactgtcttacgacggcctactgggcgataaccagatcatgcctaaatag

SEQ ID NO: 230035 - DNA, 954 bp, Artificial Sequence
  Description of Artificial Sequence: Synthetic coding sequence
atgtcctctgaacagaagagccagcattgcaagcccgaagaaggcgttgaggcacaagaggaagcactcggtctggtgggagcacaggcgcctacaaccgaagagcaggaggctgcagtatccagctcctcaccactggtcccaggcactctcgaagaggtgcccgctgctgaaagcgccggaccccctcagagtccccagggcgctagcgcattgccaacgactatctcctttacctgctggagacagccaaacgaaggtagttcctcacaggaggaggaaggaccctcaaccagccccgacgccgaaagcctgttcagggaagcactatctaacaaagtggatgagctggcccatttcctgctgcggaaatatcgcgctaaagagttagttacgaaggccgagatgttggagcgggtcataaaaaattacaagagatgcttccccgtgatctttggaaaggccagtgagtcacttaagatgatcttcggcatagacgtaaaggaagtggatcccgcatcgaatacatacacgctggtgacctgtctcggattgtcttatgatggccttctaggtaacaaccagatctttccaaaaaccggccttctcattatcgttcttggcactattgctatggaaggcgattcagcgtcagaggaagaaatttgggaggagctgggggtgatgggtgtgtacgatggcagggaacatactgtatatggggagccaagaaagttgcttacgcaggactgggtgcaggaaaattatttggaataccgacaggtcccaggctcaaatcctgcccgatacgaatttctgtgggggcctcgtgctctggcggaaaccagttacgtcaaggtgctggaacatgtggtaagagtcaacgcacgcgtgcggatcgcttaccctagtctgcgggaggccgcactgttggaggaggaggaaggtgtgtag

SEQ ID NO: 230036 - DNA, 954 bp, Artificial Sequence
  Description of Artificial Sequence: Synthetic coding sequence
atgtcaagtgagcagaaatcgcaacactgcaaacctgaagagggagtggaggcccaggaagaagcactcgggctcgttggtgcccaggccccaaccacagaggagcaggaggctgctgtttcctcttcctccccgctcgtgcctggtactctcgaagaagtccccgctgcagagagcgctggcccacctcaaagtcctcagggagcttctgccctgcctaccactatatctttcacgtgctggagacagccaaacgagggtagctccagtcaggaggaggaaggtccaagcacctccccggacgctgagtcattatttagagaggccttgtcaaataaggtggacgagcttgctcactttctactccggaaatacagagcaaaggaattggtgacaaaagcagagatgctagaaagggtgattaagaactacaagaggtgttttcccgtaatttttggtaaagcaagcgagtctctaaaaatgatttttggtatcgacgtcaaggaggtggaccctgcttcaaacacttatacgctcgtgacctgtctaggcctgagttacgatggacttttaggaaataatcaaatttttcctaaaaccggtctactaatcatcgtattaggcacaatcgccatggagggcgacagcgctagtgaggaggaaatttgggaagagttgggagttatgggtgtgtacgatggcagggaacatactgtttatggtgaaccacgcaaacttttaacacaggattgggtacaggagaattacctcgaatacagacaggtccctggcagcaaccctgctcggtacgagttcctgtggggacccagggccctcgccgagactagttacgtaaaggtactggaacatgttgtgagggttaatgccagagtgaggatcgcctatccgagcttacgagaggccgcacttttggaagaggaggagggcgtgtag

SEQ ID NO: 230037 - DNA, 954 bp, Artificial Sequence
  Description of Artificial Sequence: Synthetic coding sequence
atgtcatccgagcagaagagtcagcactgtaagccagaggaaggagtcgaagctcaggaagaagctctggggttggtcggggctcaagcacctactaccgaggaacaggaagcggcagtgagttcctcctcccccttagtccctggcaccctggaggaggtgccagccgcagaatcagcgggaccacctcagtctccgcagggcgctagcgctcttcctactaccatcagttttacctgttggcgccaaccgaacgagggctcctcatcacaggaagaggaaggtccttctaccagtcccgacgcagaatcactgtttagggaagctcttagcaataaggtggacgagctggctcactttttgctccgaaagtatagggctaaggaactggtcaccaaagcagagatgcttgaacgcgtgatcaagaactataagcgctgcttcccagttatttttggcaaagccagtgaatcactgaagatgatctttggaatcgacgtgaaggaagtggatccagcttctaatacctatactctcgtcacatgtctcggcttgtcttatgacggccttctgggtaacaaccaaatttttcctaagaccggtctcctgatcatcgtactgggcaccattgcaatggagggagactcagctagcgaggaagaaatctgggaagaattgggagtaatgggagtgtacgatggccgagaacacacagtgtacggcgaacccagaaagctcctgacgcaggactgggtgcaggaaaactacctggagtacaggcaggtacctgggagcaacccagcacgttacgagtttctatggggtcctagggcactcgccgagacgtcctatgtgaaagtgcttgagcacgtcgttcgtgtcaatgccagagtgaggattgcctacccctccttgcgggaggcagccctgttggaggaagaggagggcgtgtag

SEQ ID NO: 230038 - DNA, 954 bp, Artificial Sequence
  Description of Artificial Sequence: Synthetic coding sequence
atgtcaagtgaacagaagagtcagcactgcaaacctgaggaaggagtcgaggcgcaagaggaggctctgggcctggttggtgcccaggcgccaactactgaagagcaggaagccgctgtctcttcatcatctccccttgtgccagggacgctggaggaggtccccgctgctgaatcggccggtcctcctcagtcaccacagggggcttctgccttacccactaccatctccttcacttgctggagacagccaaatgagggaagtagttctcaagaggaagaggggcctagcacatcaccagatgcagaaagccttttccgcgaggccctgagtaacaaggtggatgaactggcacattttctgctgcgtaaatacagggccaaagagcttgtgacgaaggccgaaatgctagaacgtgttattaagaactataaacgatgttttcctgtaattttcggcaaggcgtccgagtccctcaagatgatctttggaatcgatgtgaaggaggttgatcctgcctcaaacacatacaccctggtgacttgcctaggtttatcttacgatgggctgcttggaaacaaccagatctttccaaaaacaggactgcttatcatcgtgctgggtaccatcgcaatggaaggcgattccgcttcagaagaggaaatctgggaggagctcggagtaatgggggtgtacgatgggagggagcatactgtgtatggcgaaccgcgaaaactgcttactcaagattgggtgcaggaaaattaccttgaatacaggcaagtccccggaagtaatccggcacgctacgaattcctatggggacccagggcgctggccgaaactagctatgttaaggtcctggagcacgtggtccgggtgaacgcccgagtaaggatagcttacccatcgctacgcgaggctgcactgctggaggaggaagagggggtgtag

SEQ ID NO: 230039 - DNA, 954 bp, Artificial Sequence
  Description of Artificial Sequence: Synthetic coding sequence
atgagctccgaacagaagagtcagcattgcaaacccgaagagggagttgaggcccaggaggaggccctggggctggttggcgcacaagcccctaccacagaggaacaagaagctgccgtgagcagctcttcacccctcgttcctggaactctggaggaggttccagctgcggagtcagcgggtccgcctcagtccccacagggtgcctcagcattgcccacaaccatcagctttacctgttggagacagcccaacgaaggatcatcttcccaagaggaggaaggaccctccacttctcccgacgccgaatcgctgttccgagaagctctcagcaacaaggtcgatgaactagcacattttctgctgaggaaatatagagccaaagagctcgtgaccaaggccgagatgcttgagcgcgtgataaaaaattataagaggtgcttcccggtcatcttcggcaaggcttctgaaagtctgaagatgatttttgggattgatgtgaaggaagttgatcccgcaagcaatacctacaccctcgtaacatgtctcggcctcagctatgacggccttctgggtaataatcaaatttttcccaagactggtctcctgattatagtgctcggaacaatcgccatggagggcgactctgcttctgaggaagagatttgggaggagctaggtgtgatgggagtgtacgatggcagagaacacacagtgtatggtgaaccccgaaagctcctcacccaggattgggtgcaggagaattacttggaatacaggcaagtccccggtagcaaccccgctcgctacgagtttctgtggggccctcgcgcactcgctgagacctcatacgttaaagtgctcgagcacgttgtaagagtaaatgcaagggttcgcatcgcatatccaagtctgcgtgaggctgctctcttggaggaagaagaaggtgtgtag

SEQ ID NO: 230040 - DNA, 954 bp, Artificial Sequence
  Description of Artificial Sequence: Synthetic coding sequence
atgtcgagtgagcagaagtcccagcactgcaaaccagaggagggtgtcgaagcccaggaggaggcactcggcctggtgggcgctcaggcgcctacaaccgaggagcaggaagccgctgtctcttcttcctctcccctggtccccggtaccttggaagaggtgcccgctgccgagagcgctggacctcctcagagcccccagggggcatccgccctgccgactacaatatccttcacttgttggagacagccaaacgaaggctcctcctcccaagaggaagaaggaccctcgacctcaccagacgccgagagtttatttcgagaggcgctgagtaacaaggtggatgagttagcccatttcctgctgcgcaagtaccgcgcaaaagagctagtgactaaggccgaaatgctggagcgagtgattaagaactataaaagatgtttcccagtgatttttggaaaggcttcagagagcctgaagatgattttcggtatagatgttaaagaggtggacccggctagcaacacttatacgcttgtgacatgcctgggactcagctacgacgggctcctgggtaataatcaaatcttcccgaagacaggactcttaattattgtactggggacaatcgcaatggaaggagattcggctagcgaagaagaaatttgggaagagctcggagtgatgggcgtgtatgacggacgagagcacaccgtgtacggtgaacctcgtaaactcctaacccaggattgggtgcaagaaaactatctggagtaccgacaggtgcccggatccaaccccgctcgatacgaattcctgtggggtcctcgcgcattggcagaaacaagttatgtcaaagttctggagcacgtggtgcgcgtgaacgctagagtgaggatagcctacccttcattgagagaggccgctcttctggaggaggaggagggcgtatag

SEQ ID NO: 230041 - DNA, 954 bp, Artificial Sequence
  Description of Artificial Sequence: Synthetic coding sequence
atgtcttcagagcagaagtcacagcactgtaaacctgaagagggagtcgaggcccaggaggaggctctggggttagtaggggcacaagccccaacaaccgaggaacaggaggcagctgtctcatcaagttccccgctggtcccgggaacactggaagaggtcccagcggctgaaagtgctggtccacctcagtctcctcagggtgccagtgctttgcccaccactatttcctttacttgctggcgccagcctaacgagggatccagttcacaggaagaggaaggtccttcaacaagccctgacgcagagtcgctgttcagagaggctctcagtaacaaagtcgacgagctggcccattttttattgcgcaagtaccgggctaaagaacttgtcacaaaggccgagatgttagagagagtcattaagaactacaaaagatgtttccctgtgatctttgggaaagcttctgaatccctgaaaatgattttcgggatcgatgtcaaggaggtggaccctgcctctaatacttacacgctggtcacatgtctcggcttatcttacgacggccttctgggaaataatcagatcttcccaaaaacaggcctgttgattatagttctggggacgatcgccatggagggggactccgcaagcgaggaggagatttgggaggagctgggtgtcatgggggtatacgatggacgggaacacacagtgtatggcgagccacgcaagctgctcacacaggattgggtgcaggagaactatctagagtaccggcaagtacctgggtccaatcccgcaaggtacgagttcctgtggggccctcgcgctttggcagagacctcttacgttaaagttctagaacacgtcgtcagggtgaacgcccgagtgaggatagcttacccgagtttgcgagaggctgccctcctggaagaagaggagggcgtatag

SEQ ID NO: 230042 - DNA, 693 bp, Artificial Sequence
  Description of Artificial Sequence: Synthetic coding sequence
atgtcaagcgagcagaaaagccaacactgtaaaccggaggaaggagtagaggcacaggaggaggccctgggccttgtgggcgctcaggctcctacaaccgaggagcaagaggccgctgtatcatcctctagtcccctggtaccgggaacactggaggaggtgccagccgctgaatcagcagggccaccacagtcccctcagggggcatcggcgttacctacaactatttcctttacttgttggaggcaacctaatgaagggagcagttcacaagaagaggagggcccatctacatcgcccgatgctgagtccttattccgggaagctctgtctaacaaggtagatgaactggcccattttttgcttcggaagtacagggcgaaagagcttgtaacaaaggccgagatgctggaacgcgtgatcaagaactataagcgatgctttccggtcatttttggtaaggccagtgagtcactgaaaatgatctttgggattgatgtgaaggaggtggacccagcttctaacacatacacactggtgacttgccttggcctcagttacgacggcctcttgggtaacaatcaaattttccccaagacagggcttcttattatcgtgctcggcacaatcgcaatggagggggactctgcgtccgaagaggagatttgggaggaactgggagtcatgggttag

SEQ ID NO: 230043 - DNA, 654 bp, Artificial Sequence
  Description of Artificial Sequence: Synthetic coding sequence
atgagcagcgaacagaaatcacagcactgcaaacccgaagaaggcgtggaggctcaggaagaagctcttgggcttgtcggagcgcaggcgcctacaacggaagaacaggaggccgctgtaagttccagttccccccttgtcccgggtacgctcgaggaagtaccagctgcagagagtgccggtcctccccagtcgccgcagggcgcatcggcccttcccacaaccatttctttcacgtgttggaggcagcccaatgaagggtcatcctctcaggaagaggagggacccagtaccagcccggatgccgagtcccttttccgcgaggccttgagcaacaaagtggatgaactggcccatttcctgctgcgaaaatacagagcgaaggaactcgtcaccaaagctgagatgctggaaagagtgataaagaactataagcgatgctttcctgttattttcggtaaggccagcgaaagtctgaaaatgatcttcggaattgacgtcaaggaagtggatcctgcctcgaatacgtacaccctcgttacttgtttgggcctgtcctacgacgggcttctgggcaataatcagatctttcctaagactggcctgttaatcattgtgctcgggactattgccatggagggcgattcagcctag

SEQ ID NO: 230044 - DNA, 726 bp, Artificial Sequence
  Description of Artificial Sequence: Synthetic coding sequence
atgtcttctgaacagaagagtcagcactgcaaaccagaggaaggagtggaagcacaggaagaggcactgggactggtgggtgctcaggcgccaaccactgaggagcaggaagccgcagtctcctccagctccccacttgtgccaggcacactcgaggaggtccccgctgcagagtctgcaggaccaccacagagcccacagggggcatcagctctcccgacaaccatcagtttcacgtgttggaggcaacctaacgagggatccagcagccaggaagaggagggcccttccacgagccctgacgctgagtctttgtttcgcgaggccctttctaacaaggttgatgagctcgcacacttcctgttgaggaagtatagggccaaagaactggtgactaaggccgaaatgctcgaaagggtcattaaaaactacaagaggtgttttcccgtaatcttcggtaaggcatcagaatctctgaagatgattttcggcattgatgtgaaggaggtcgacccagccagcaatacctacaccctcgtcacttgtctaggtctctcttacgacgggctcctcggcaataaccagatattcccaaagaccggattattgattatcgtgctgggaacgattgcaatggaaggggacagcgctagcgaggaggagatctgggaagagctgggagtgatgggtgtgtatgatggcagggagcacactgtttatggctag

SEQ ID NO: 230045 - DNA, 519 bp, Artificial Sequence
  Description of Artificial Sequence: Synthetic coding sequence
atgtcttccgagcagaagtctcagcactgcaagccagaagaaggggtggaagcccaagaggaagctctgggactcgtaggcgcacaagccccaaccacagaagagcaggaggcagctgtttcctcatcgagccccctggtcccaggaactctcgaggaagtacccgctgcggaatctgcaggtcctccacagtcacctcagggcgcttcagccctaccgactaccatttcttttacttgttggagacagccaaatgagggcagttcttcccaggaggaagaaggtcctagtactagtcctgatgccgagtcactgtttagggaagcgctctccaacaaggttgacgaactcgcccatttcctgctgaggaagtaccgcgctaaggagttggtcaccaaggccgagatgcttgagcgggttatcaagaattacaaacggtgcttccccgtaatttttggtaaagccagtgagtccttaaaaatgattttcggaatcgacgtcaaagaggttgatccgtag

SEQ ID NO: 230046 - DNA, 726 bp, Artificial Sequence
  Description of Artificial Sequence: Synthetic coding sequence
atgagttccgagcagaagagccagcactgtaaacctgaagaaggtgtcgaggcgcaggaggaagccctcgggctggtgggcgcacaggctccaaccacagaggaacaggaagccgctgtctcgtctagttcaccactggttcccggaacgctggaagaggttccagcagccgagagtgctggtccaccacagtccccccagggggcatccgctttacctaccacaatttcattcacttgttggagacagccgaacgaagggtctagcagccaggaggaggagggaccatcaacgtccccagatgccgaaagcttgtttagggaagcgctctccaataaggtggacgagctagcccactttctgctccgaaagtaccgggctaaggagctggttaccaaagccgaaatgctcgagcgggtgattaaaaattataagcgttgcttccctgtgattttcgggaaggcctctgaaagtctcaagatgattttcggtatcgacgtcaaggaggttgaccccgctagtaatacctatacgctcgttacctgcctggggctctcctacgacggcctcttgggcaataaccaaatcttcccaaagacaggcttgcttatcattgttctggggacaatcgcgatggaaggtgactcggcctccgaggaggagatctgggaagagttaggtgtcatgggcgtttatgatgggcgagaacacaccgtgtacggatag

SEQ ID NO: 230047 - DNA, 726 bp, Artificial Sequence
  Description of Artificial Sequence: Synthetic coding sequence
atgtctagtgagcagaaatcccagcattgcaagcccgaggagggtgtcgaagcgcaggaggaggccctgggcctggtcggggctcaagccccaactaccgaggaacaggaggctgcagtgagttcctcctctccacttgtacctggtacactggaagaggtgcctgcagccgagtcagcgggaccccctcagagcccacagggcgcatctgccctgcctacgaccattagctttacttgctggaggcagcccaatgaagggagttcgagccaggaggaggagggacccagtacctcccctgatgcagagtctttgttccgcgaagctttgagtaacaaagtggacgagctcgcccattttttactgcggaagtacagagccaaggaactcgtgacgaaggccgagatgctggagcgggtgattaagaactacaagaggtgtttccctgttatctttgggaaagcatctgagtcactcaagatgatctttggtattgacgtcaaggaggtggatcctgcctcaaacacttacaccttagttacctgtctgggcttgagctacgatggactcttaggtaataatcaaatttttcctaaaacaggccttcttattatcgtactcggcaccattgccatggagggcgatagtgcctctgaggaggagatctgggaggagctgggcgtcatgggggtctacgacggcagagaacacacagtgtacggttag

SEQ ID NO: 230048 - DNA, 654 bp, Artificial Sequence
  Description of Artificial Sequence: Synthetic coding sequence
atgagttcagagcaaaagagccaacactgtaaacctgaggagggagtcgaggcccaggaggaggctttgggccttgttggagcacaggccccaaccaccgaagagcaggaagctgctgtgagtagctcatcgccgctagttccagggaccctagaggaggtacccgctgctgaaagcgccggtcctccacagtctcctcagggcgcaagcgctcttccaactacgataagcttcacatgctggaggcagcccaacgagggctcctctagtcaggaagaagaagggccatcaacatccccagatgcggaaagcctattccgtgaggccctcagcaataaggtagatgaattggctcacttcctgttaaggaagtaccgcgcaaaggagctggtgacaaaggctgaaatgttggagagggttatcaagaattacaaacgatgtttcccagtgatcttcggaaaggcatcagagtcgttaaagatgattttcggcatcgacgttaaagaggtggaccccgctagcaacacgtacactctagtgacctgcctgggcttgtcttacgacggcttactgggcaacaatcagatctttcctaaaacgggactgcttatcattgttctcggaaccatagccatggaaggggactctgcgtag

SEQ ID NO: 230049 - DNA, 726 bp, Artificial Sequence
  Description of Artificial Sequence: Synthetic coding sequence
atgagcagtgagcagaagagtcagcattgcaaaccggaagagggcgtggaagcgcaggaggaggctctgggcttagttggcgcacaggctccgacaacagaggagcaggaggcagctgttagttcatctagtccacttgtgcccggtacgttggaggaagtgcctgccgctgagtcggctggaccaccacagtctccgcagggagcttccgcattacctaccacgatttcattcacatgctggagacagccaaatgagggttctagttcgcaagaagaggagggtccttcgacgagtccagacgccgagtcactgtttcgcgaggctctttcaaacaaagtcgatgaactcgcgcattttcttttgcgaaaataccgggctaaggaactcgtaacgaaagcagagatgttagagcgcgttattaagaactataaaagatgttttccagtaatctttggaaaggcttcagagtctcttaaaatgatttttgggattgacgtgaaggaggtggatccagcttcaaacacatacacccttgtcacctgcctgggcctgtcctacgatggactgctggggaataatcagatttttccaaagactggtttgcttattatcgttctcggaacaattgctatggagggggatagcgccagtgaggaagaaatttgggaggaactgggggttatgggggtgtatgatgggagggagcacacggtttatggatag

SEQ ID NO: 230050 - DNA, 945 bp, Artificial Sequence
  Description of Artificial Sequence: Synthetic coding sequence
atgcctctggagcagcgatctcagcactgcaagccggaggaggggctcgaagcacgcggtgaagctctgggactcgttggagcccaggccccagctaccgaggagcaggaggctgcctccagctcttccacgctggttgaagtcacactcggcgaagtgccagctgctgaatcgccagacccccctcagtctccacagggggcaagctctctgccgaccacaatgaactaccctctgtggagccagtcgtacgaagacagttccaatcaggaggaagaggggccaagtacctttcccgatctggaaagcgaatttcaggccgcactaagcaggaaggtggctaaattggtgcatttcttacttctgaagtacagagcaagagaacctgtcaccaaagccgagatgcttgggtctgtggtggggaattggcagtacttttttcccgtgatcttcagtaaggcctctgatagcctgcaattggtgttcggcattgaactcatggaagttgaccccatcggtcatgtctacatcttcgctacatgcctggggttgagttacgacggactgcttggggacaaccagatcatgcctaagacaggattcctcatcattatcctagctataattgctaaagagggtgactgcgcccctgaagaaaaaatctgggaagaattgtctgtgctagaggtgttcgagggcagagaggattctatctttggtgatccgaagaagttactaacccagtacttcgtacaggagaactatctcgagtatagacaggtcccaggttccgacccggcatgttatgagttcctctggggccctcgcgctttgatagagacctcgtacgtgaaagtcctacaccatatggtgaagatcagtggaggacccaggataagttatcccctgttacacgaatgggcactcagagagggtgaggagtag

SEQ ID NO: 230051 - DNA, 606 bp, Artificial Sequence
  Description of Artificial Sequence: Synthetic coding sequence
atgccgttggaacagaggagtcagcactgcaagcctgaggagggcctggaggccagaggagaggcactgggcctcgtgggcgctcaggcacccgcaacagaagagcaggaggctgcctcatcttcttctacgttggttgaggtcaccttgggggaggtccccgcagcggagagtcccgatcctccacaaagtccccaaggggcttcctctcttcctaccacgatgaactatcccctctggtctcagagctacgaagactcttccaatcaagaagaagaaggccctagcacattcccagatttagagagtgaattccaggctgcactgagtagaaaggtggccaagctcgtgcattttttacttttaaaatatcgggcaagggaacccgtcacaaaagctgagatgttgggcagcgtggtagggaactggcagtacttttttcccgtcatcttttctaaagcctctgatagcctccagctggtgtttggaatcgagctgatggaggtggaccctatagggcacgtgtacattttcgccacatgtctgggactgagctacgacggcctgctgggcgacaatcaaattatgccgaagactggcttctag

SEQ ID NO: 230052 - DNA, 708 bp, Artificial Sequence
  Description of Artificial Sequence: Synthetic coding sequence
atgcccctagagcagaggagccagcattgtaagcctgaagaaggccttgaggctaggggcgaggcattaggcctggtcggcgcacaggccccagcgacagaagagcaagaggcagcctcttctagctcaacattagtagaagtgaccctcggcgaggtccctgctgcagagagtcccgatcctccccaatccccgcagggcgcatcctcactacctactaccatgaattatcctctctggtcccagtcctatgaggatagctctaaccaggaggaggaaggaccatctactttccccgatctcgagagcgaattccaggcggctctgtcccgcaaggtagctaaactggttcatttcctgctcctgaagtaccgcgcacgggagccagtcacaaaagcagagatgctcggctcagtggtgggtaactggcaatactttttccctgtcattttctcaaaggcatctgatagcctccagctggttttcggaatcgaactaatggaggtggatccaatcggtcatgtgtacattttcgcaacttgcttgggcctgtcttacgatggcctgctcggagacaatcagatcatgcctaagaccgggttcctgattatcatcctggcaattattgcgaaagagggcgattgtgctccggaggagaagatttgggaggagctttcggtgctggaggtgttcgagggaagggagtag

SEQ ID NO: 230053 - DNA, 957 bp, Artificial Sequence
  Description of Artificial Sequence: Synthetic coding sequence
atgcttttaggtcagaagtcccaacgctacaaggccgaggaagggctgcaagcacagggtgaggcccctggccttatggacgtgcagatcccgactgccgaagagcagaaagccgctagtagctcctccacactgatcatgggtaccttggaggaggtaaccgactccggcagcccaagcccaccacagtcgcccgaaggtgcttcttcatccttgacagtcactgactccacactgtggagccagagcgacgaaggatccagcagcaacgaagaagagggcccttccacgagcccagaccctgcccatctcgagagcctgttccgcgaggcacttgatgaaaaggtagccgagctggtccgttttctgcttcgcaagtaccagatcaaagagccagttactaaagccgagatgttagaatcggtgatcaaaaattacaaaaatcatttccccgatatcttctccaaggcatcagagtgcatgcaggtcatattcggtatcgatgtcaaggaggttgaccccgcagggcacagttatatcctcgtgacttgcctgggactttcgtatgacggtctgttaggcgacgatcagagcaccccaaaaacaggcctgctgatcattgtgttgggaatgattctgatggagggttcaagggccccagaagaggccatttgggaagcactgagcgtcatgggactttacgacgggagagaacactctgtgtactggaaactgcggaaactgctcacgcaggagtgggttcaggaaaactacctggagtaccggcaagccccaggtagcgatcctgtgaggtatgagtttctgtggggtccaagagctttggccgaaaccagctacgttaaagtactcgagcacgtggtccgggtgaatgccagagtgcgcatttcatacccaagcctgcacgaggaggcactgggagaggagaaaggggtgtag

SEQ ID NO: 230054 - DNA, 957 bp, Artificial Sequence
  Description of Artificial Sequence: Synthetic coding sequence
atgctgttgggccagaaaagccagcgctacaaggcagaagagggactgcaggcgcagggagaagccccaggcctgatggacgtccagatcccaacagctgaagaacagaaagcggcatcctcctcttccaccttgatcatgggcaccctcgaggaggtgactgacagtggcagccccagcccaccacagagcccagagggggctagtagtagcctcacagtgactgactcaactctgtggtctcagtccgacgagggtagcagcagcaacgaggaggaaggtccctcaacttcgcctgaccccgcacacctggagtccctgttcagagaagcactagatgagaaagtcgcagagctcgtgcgcttcttgctgaggaagtatcagattaaggagcccgtaaccaaggcagagatgctggagagcgtgatcaagaattataaaaatcatttcccagacatattctctaaggcctccgagtgtatgcaagtcatttttgggatcgatgttaaagaggtcgacccggctggtcactcttacattctggtaacctgcctgggcctgagctatgatggactcttaggggacgatcagtctactccgaaaaccggactgctcatcatcgtcctgggcatgattttaatggaaggctcgagagccccagaagaggctatatgggaagctctctccgttatggggttgtatgacggtcgcgagcacagcgtatactggaagctgcgcaaactgttgacccaggaatgggtccaggagaattatctggagtaccgccaggcacccggatctgaccccgtgcgctatgaattcctgtggggccctcgagccttagccgagacttcttatgtgaaagtgctcgaacacgtggtaagggtgaatgctcgggtaagaattagctacccctccttacatgaagaagccctcggggaagagaaaggagtgtag

SEQ ID NO: 230055 - DNA, 957 bp, Artificial Sequence
  Description of Artificial Sequence: Synthetic coding sequence
atgcttcttggccaaaaaagtcagcggtacaaagccgaggagggcttgcaagcccagggggaggccccaggactaatggacgtgcaaatcccgactgcagaggagcagaaggcagcttcctcaagttccaccttgatcatgggaacgctggaggaggttaccgactcgggcagcccatccccccctcagtcccccgagggagcatcctctagccttaccgtcacggacagtacactgtggtcgcaatctgacgaaggtagttcctccaatgaagaggagggcccaagcacgtctccagaccctgcccatctcgaatctctgttcagggaggcccttgatgaaaaggtggccgaattagtgcgctttctactcagaaaatatcagatcaaagaaccagtaacaaaagctgaaatgcttgagtctgtgattaaaaattataaaaaccatttccccgacatcttttctaaagcttctgagtgcatgcaggttatcttcggcatcgatgttaaagaggttgatcccgctggccatagctatatcctcgtgacatgtctcggattgagctatgacgggcttctgggcgacgaccagtcaaccccgaaaaccgggcttctcattattgtcctggggatgatcctaatggagggaagccgggcaccagaggaagctatttgggaagccttgtctgttatgggcctttacgacggaagagagcactccgtttactggaaattacggaagttgctgactcaggagtgggtgcaggaaaactaccttgaatataggcaggccccaggaagtgaccctgttcgctacgagtttctgtggggtcccagggccctggctgaaacgtcatacgtgaaggtgcttgagcatgtggtgcgggtcaacgcaagagtgagaatcagttatccttcactgcatgaggaagcccttggagaagaaaagggcgtgtag

SEQ ID NO: 230056 - DNA, 948 bp, Artificial Sequence
  Description of Artificial Sequence: Synthetic coding sequence
atgtccctcgaacagagatccccacattgcaagcccgatgaagaccttgaagcccaaggtgaggaccttgggttaatgggcgcacaggagcccaccggcgaggaggaagaaacaactagctccagtgactccaaggaagaagaggtttccgcagccggttctagcagccctcctcagtcaccacaggggggtgcatcatcatcaataagtgtgtactacaccctctggtcccagtttgatgaaggttccagctctcaagaggaagaagaaccaagcagcagcgtggaccctgcgcagctggagttcatgtttcaggaggctcttaaactaaaagtcgctgagttggtacactttctactgcataaataccgggtgaaagagccagtgacaaaggccgagatgcttgagtcagttatcaaaaactataaacgctatttcccggtgatttttgggaaagccagcgagtttatgcaagtgattttcggtacggacgttaaagaggtagatcctgccggacacagctacattctggtgaccgctcttggcttgagctgtgacagtatgcttggcgacggtcactcaatgccgaaagcagcccttctgattatagtcctgggcgtcatcctgactaaggataactgtgccccagaggaagtcatctgggaggctctgtctgttatgggggtgtacgttgggaaagaacacatgttctatggtgagcctaggaaattgctgacacaggattgggtgcaggagaattacctggagtaccgccaggttccagggtctgatccagcacattacgagttcctgtggggatcaaaggctcatgccgagacatcctacgagaaagtcattaactacctcgtaatgctcaacgcaagagaaccaatatgctacccatcactgtacgaggaggttctgggtgaggaacaggagggggtgtag

SEQ ID NO: 230057 - DNA, 345 bp, Artificial Sequence
  Description of Artificial Sequence: Synthetic coding sequence
atgagcctagagcaacgctctccgcattgtaagcctgacgaggacctcgaggctcaaggggaggacctggggctcatgggagcgcaggagccaacgggggaggaggaagaaacaacatcaagttcggactcaaaggaagaagaagtctctgcagctggatcaagttcaccaccccagtcccctcagggaggggcatcctctagtataagcgtatactacacactctggtcgcagttcgacgagggatcatctagccaagaggaagaagaaccgagttcatccgtcgaccctgctcaactcgaatttatgtttcaggaggctctcaaactgaaggtagccgaatag

SEQ ID NO: 230058 - DNA, 930 bp, Artificial Sequence
  Description of Artificial Sequence: Synthetic coding sequence
atgagtctcgaacaaaggtccccacactgtaaaccggacgaagatcttgaagcacagggagaggatctgggactcatgggcgctcaggaaccaactggtgaggaggaggaaacaacctcaagctctgacagcaaagaggaggaagtgtcagctgcaggttcaagcagtcccccacagtctccacaaggaggggcttcatcctcaattagcgtctattatactctgtggtcccagtttgatgaggggtcttcatctcaggaagaggaggaacccagcagcagcgtggatccagcccagctggaattcatgttccaggaggccctgaagctgaaagttgccgagctcgttcactttctgctgcataagtatcgagtaaaggagcctgtgacgaaagccgaaatgcttgaaagcgtaattaagaactacaagcgctatttcccagtcatatttggaaaagctagcgagtttatgcaggttatcttcgggacagatgtcaaggaggtggacccagctggccattcatacattttagtgactgccctgggtttgtcatgtgactccatgttgggcgacgggcactccatgccgaaggccgctctgttgatcatcgtgctcggtgtcatcctgacaaaggacaactgcgctccagaagaggtgatatgggaggctctctccgtcatgggcgtgtacgtgggcaaagagcacatgttttacggtgagcctcggaaactcttaactcaagactgggtccaggagaactatctcgagtacagacaggtacctgggtccgatccagcccactatgagtttctctggggaagcaaggcccacgctgagacgtcctatgaaaaagttatcaactaccttgttatgcttaacgcaagggaacccatttgttatccgtctctctatgaagaagtcctcggatag

SEQ ID NO: 230059 - DNA, 591 bp, Artificial Sequence
  Description of Artificial Sequence: Synthetic coding sequence
atgtccttggagcagagaagtccacactgtaagcccgatgaggacctggaagctcagggagaggacctgggtttaatgggagcacaagaacctacaggtgaggaagaagagacgacctcgtcctcggacagtaaggaggaggaagtctctgcagccggatccagcagccctccccagtccccacagggtggcgcaagctcatccatatctgtgtattatacactctggtcacagtttgacgaaggcagctcgagccaggaggaggaggaacccagtagttcagtggatcccgctcaactcgagttcatgtttcaggaggccttaaaattaaaagtggctgagctcgttcacttcctcctacacaaatatagggtcaaggaacctgtcacaaaggccgagatgctggagtcagtgattaaaaactataagcgatattttcctgtgatcttcggcaaagccagcgaatttatgcaagtgattttcgggaccgacgtgaaagaggttgaccctgcagggcactcctatatcctagtcacggcactagggctgagctgcgatagcatgctgggcgacggtcattcaatgccttag

SEQ ID NO: 230060 - DNA, 294 bp, Artificial Sequence
  Description of Artificial Sequence: Synthetic coding sequence
atgagcctcgagcaacggtctccccactgcaagccggatgaggacctcgaagctcaaggagaggacctgggactgatgggcgctcaagagcctaccggggaggaagaggagacaacgtcttcttcggatagcaaggaagaagaggtaagcgccgctggaagctcctctccccctcagtccccacagggcggagcttcttcgtccatatccgtctactacacactgtggtcgcaatttgatgagggatccagcagtcaggaggaagaggagccctcgagctccgtcgacccgtag

SEQ ID NO: 230061 - DNA, 948 bp, Artificial Sequence
  Description of Artificial Sequence: Synthetic coding sequence
atgagccttgagcagagatctcctcactgtaagcccgacgaagacttagaggctcagggcgaggacttgggactcatgggcgcacaagagcctaccggggaggaagaggaaaccacttcctcgagtgacagtaaagaagaagaggttagtgccgcaggcagttctagtccccctcagtcgccacaggggggagccagctcctccatttcagtgtattatactctgtggagccagtttgacgagggttcaagtagccaggaagaggaagagccatctagcagtgtggaccctgcccagctcgagttcatgtttcaggaggccctcaaactcaaggtggcagaactggtgcactttttgctacacaagtaccgtgtcaaagagccagtgacaaaggctgaaatgctggaatcagtaataaagaactataagaggtattttccagtcatttttggcaaggcctccgagttcatgcaagttatcttcggcacagacgtgaaagaggttgaccccgcagggcatagctatatactcgtgacagccttgggactgagctgcgatagcatgctgggagacggacatagcatgcccaaggcagctctgctgattatcgtcctgggcgtcattctgactaaagacaactgtgcaccagaggaggtgatttgggaagcattgagtgttatgggcgtgtatgtaggcaaggagcatatgttctatggagagcctcgcaagctcctaacacaggattgggtgcaggagaactacctcgagtaccgtcaagtcccaggcagcgacccagcccactatgagttcctgtgggggtccaaggcacacgcagagactagttatgagaaagttatcaattatttggtgatgcttaacgccagggagccaatttgctaccccagtttgtacgaggaggttcttggggaggaacaagagggtgtctag

SEQ ID NO: 230062 - DNA, 1044 bp, Artificial Sequence
  Description of Artificial Sequence: Synthetic coding sequence
atgccccgtggccagaagagcaagctccgagctagagagaaaagaagaaaagcaagagaagagacgcagggcctgaaagtcgcccatgctacagcagccgaaaaagaggaatgcccatcgtcctctccggtgctaggcgacactcccaccagttcgccagcggcaggaattccccagaaaccgcagggcgcaccacccactactaccgcggctgccgctgtaagctgtacagagagcgatgaaggtgctaagtgccagggggaggagaacgcctccttcagccaagcaacaacctcaaccgagtcctctgtgaaggatcccgtggcatgggaggcaggcatgctcatgcactttatcctgagaaagtataaaatgcgggagccaattatgaaagccgatatgcttaaggtggttgatgagaaatacaaagatcactttaccgagattctgaacggcgcaagtcggcgtctggagttggtgttcggcctcgacctgaaggaggataatccctctggtcacacatacacactggtgtccaaactgaatcttaccaacgacggcaatctgtccaatgattgggattttccgcgtaatggacttttgatgcccttgctgggtgtcattttcctgaaaggtaattctgccactgaggaagaaatctggaagttcatgaacgtgctgggcgcttatgacggagaggagcatttaatttatggtgagccacgtaaatttatcacacaagacctggtgcaggagaagtatctgaagtatgaacaagtcccaaactctgatcctccaagataccaattcctttgggggccacgcgcttacgctgagacaactaagatgaaggtcctcgagtttctggccaaaatgaacggcgctacacctagagacttcccaagccattacgaagaggctctgcgagatgaggaggagcgagcacaagtcagatcttcggtgcgggcacgacgcagaacaacagcgactacttttcgcgcacgcagtcgcgcaccattctctcgctcctcccatcctatgtag

SEQ ID NO: 230063 - DNA, 1044 bp, Artificial Sequence
  Description of Artificial Sequence: Synthetic coding sequence
atgccacggggtcagaaaagcaagctgcgagccagggagaagagacgcaaagctagggaagaaacccaaggcctcaaagtcgcccacgctaccgccgcagaaaaggaagagtgcccaagctcgagtccagttctgggagacacccctaccagtagcccagccgcaggaattcctcaaaaacctcagggcgctccaccaaccaccaccgccgctgccgctgtgagctgtacggagagcgacgaaggcgcaaagtgccaaggtgaagagaacgcgtccttctcccaggccactacgagcaccgaaagtagcgtgaaagatccagtcgcctgggaagctggaatgctgatgcatttcatcctacggaagtacaagatgcgtgaacctatcatgaaggctgacatgctcaaggttgtcgatgaaaaatacaaagatcattttacagaaatcctgaatggagccagtaggcggctggagttggttttcgggctggatctgaaggaggataatccttcaggacatacctataccctggtatccaaactgaacttgacgaatgatgggaacctgtctaatgattgggattttcctagaaatggtctgctcatgccactcctcggtgttatcttcctgaaggggaactcggctactgaggaagaaatatggaaattcatgaacgtactgggcgcttacgatggcgaggagcaccttatatatggggagccaagaaaatttatcacacaagacctggtgcaggaaaaatacttgaagtacgaacaggtgcctaactctgatccaccccgatatcagtttctgtggggaccacgggcttacgcggagacaaccaagatgaaggtgctggaattcctggccaaaatgaacggcgcaacgcctcgggacttcccctcccattacgaggaagctctccgagacgaggaggagcgggctcaggtgcggtcctcagtgcgcgcaaggaggcgtaccacagccaccactttcagagctaggagccgggctccattttcaaggtcatcccacccaatgtag

SEQ ID NO: 230064 - DNA, 1044 bp, Artificial Sequence
  Description of Artificial Sequence: Synthetic coding sequence
atgccacgaggacagaagagcaaattgagagcaagggagaaaaggagaaaagcgagggaggaaacccagggtctgaaagtggctcatgctaccgccgctgagaaagaagagtgcccgagctcttcccccgtccttggagatacacccacaagctcgccagccgcaggcattccacagaaaccccaaggcgcacctcccaccaccacagcagctgcagcggtctcttgcacggagtcggatgagggcgctaagtgtcagggcgaagaaaatgcctctttcagtcaggccacaacctcgacagaaagctcggtgaaagaccctgtggcttgggaagccggaatgctcatgcactttattcttagaaagtacaaaatgagggagcctatcatgaaggcagatatgttaaaggtcgtagacgagaagtacaaggatcactttactgaaatcctgaacggagccagtcggaggctcgagctcgtcttcggcctggacctgaaagaagacaacccctccggacatacctacacgctggtgtctaagctaaatctcactaacgacgggaatctgagtaatgactgggacttccctcggaatggccttctcatgcccctgctgggggtgatttttctcaagggtaactcagcaaccgaagaggaaatttggaagttcatgaacgtcctcggagcctacgatggagaggaacatctgatttatggggagccaagaaagtttatcactcaagacttggtgcaggaaaagtatctgaagtacgaacaggtgccaaactcagaccctcccagataccagtttttgtggggccctcgcgcatacgccgagactacaaagatgaaggtgttggagtttctagccaaaatgaacggcgctaccccgagggattttccaagtcactatgaagaagctctacgtgacgaggaggaaagggctcaggtcaggagttcagtgagggcaagacgccgaaccaccgcaaccacttttagagccagatcccgggctccatttagccggtcttcacaccctatgtag

SEQ ID NO: 230065 - DNA, 1044 bp, Artificial Sequence
  Description of Artificial Sequence: Synthetic coding sequence
atgcctaggggacagaagtccaagttgcgcgctcgggagaaacggaggcaggcccgaggaggcctagaggacttaatcgacgccttggacatattagaggaggaagaagaaagtcccccatccgcatctgcatgtctgaaagacgtgtttcaatccagccttgatggtgcctcaaacaatccccacggactgagagaggcacagtcgacctccacaagtgccacagctgccagccacactcggcaccccgagggcgtgaacgatcaaatggaagagaggccaatatgtacacaagatctcgaggcaacagattcatttccaagaggcccagttgatgaaaaggtgatcatcctggtgcattacctgctgtacaaataccagatgaaggaacctatcactaaggctgacatgctgaggaacgtaactcagatgagtaagtctcagttccctgtgattcttagcagggcatccgaacacctggagctgatttttgggctggatttgaaagaggtggaacctaataagcacatctacgttcttgtaaataagctggacctgggttgtgatgccaaactttctgacgagactggtgtgcccaaaactggcctacttatgacagtccttggcattatcttcacgaatggaaactgtgtggccgaggaggaggtgtggaaggtgttcaacacgatgggtctctacgacgggatagagcatttcatgtttggggagccgagaaaactcctgacaaaggacttggtgaaagaaaactatctggaataccagcaggttcccaatagtgatcctccgcgatatcagttcttgtgggggcctcgggcacatgcagagaccagcaagatgaaagtcctggaattcctggcgaaagtcaatgatactgccccatctgaattttccaattggtatacggaggctctgcaggacgaggaagaacgggctagggctcgagtggcagccaaagccagggtgtcagccaccgccggagctagatccaaggtgaaaagctccaaaagctcccaactccagtag

SEQ ID NO: 230066 - DNA, 975 bp, Artificial Sequence
  Description of Artificial Sequence: Synthetic coding sequence
atgtcccaggaccaggagtccccaagatgcacgcatgaccagcacctgcagactttctctgaaacgcagtctctggaggttgcccaagtgagcaaggccctggaaaagacactactgagctcgtctcatcctcttgttcccggtaaactaaaggaagcacccgctgccaaggccgagtcaccattagaagtaccacagtccttttgttcctcctccatagctgtgaccaccaccagcagtagcgaaagcgacgaggcctcatcaaatcaggaggaggaggatagtccgtcaagcagtgaagacacatccgatccaagaaacgtccccgcagatgcccttgaccaaaaagtcgcatttttggtaaattttatgctgcataaatgccagatgaagaaacccatcaccaaggccgacatgttgaagatcattatcaaggacgatgaatcccatttctcagagattctgttgcgggctagcgagcaccttgaaatgatttttggcctagacgtcgtcgaagtggaccctaccacacattgttatggcctcttcattaagctgggcctaacttacgacggcatgctcagcggagagaaaggtgttcctaaaacaggacttttgattatagttctcggcgttatattcatgaaaggaaacagagctacggaggaagaagtttgggaggtgttgaacctgacaggagtgtatagcggaaagaaacactttattttcggtgagcccaggatgctgatcacgaaggacttcgttaaagaaaaatacctggagtaccagcaggtagccaacagcgatcccgctcggtacgaattcctctgggggccaagggctaaggctgaaacaagcaaaatgaaagtgttggagttcgtggccaaggtgcatggcagctacccccattccttccccagtcagtacgccgaagccctgaaagaggaggaagagagagcacgcgcacgaatttag

SEQ ID NO: 230067 - DNA, 975 bp, Artificial Sequence
  Description of Artificial Sequence: Synthetic coding sequence
atgagccaagatcaagagtcacccagatgtacccatgaccagcacctacagaccttcagtgaaacccagtccttggaagtggctcaggtcagcaaagcactggaaaaaactctgttgagctcttctcatccacttgtgcccggaaagctgaaggaggcacccgcagcaaaagcggaatcgccactcgaggttcctcagagcttctgctcctcatccatagctgtgaccaccacttccagctccgagtcagatgaagcctcctcaaatcaggaagaggaagatagtccatcgagtagcgaagatacttccgacccgcgaaatgtccctgccgatgcactagaccaaaaggtcgcatttctggtcaactttatgctgcacaaatgccaaatgaaaaagcccatcacaaaggccgacatgctcaaaataatcatcaaggacgatgagtctcatttctctgagatcctcttaagggcatcagagcaccttgagatgatatttggcttggatgtcgtggaagtggaccccaccactcattgttatggcttattcatcaagctcggtctgacgtatgacggtatgctgagcggagaaaagggggtgcctaaaactgggctgctcataattgtgctgggtgtcatcttcatgaaggggaatcgggctaccgaggaggaagtatgggaggtgcttaatttgacaggagtatattcagggaagaagcattttatctttggtgagcctagaatgctgatcacaaaggactttgtaaaggagaaatatctggagtatcagcaggtagcaaatagcgatcccgctagatacgaattcttgtggggaccaagggccaaggccgagacctccaagatgaaagtcctggaatttgtcgccaaggtgcacgggagttacccgcactcctttcccagccaatacgccgaggcattgaaagaagaggaagaaagggctagggctcgcatatag

SEQ ID NO: 230068 - DNA, 975 bp, Artificial Sequence
  Description of Artificial Sequence: Synthetic coding sequence
atgtcccaggaccaagagtctcccagatgtacccacgaccagcatcttcagacgtttagcgaaacgcaaagtcttgaggtcgctcaagtctctaaggccctggagaaaaccctgctgtctagctcccatccactggttccgggtaaactgaaagaggcaccagccgcaaaggccgagtctcctctggaagtgccacagtcattctgcagttccagtattgctgtcacaaccacgtcaagcagcgaatctgacgaggcttcttctaaccaggaggaagaagatagcccctcctcctctgaggacactagcgatccacggaacgtccccgcagacgccctggaccagaaggtagcttttcttgtgaactttatgctacacaagtgtcagatgaaaaagcctatcacaaaggctgacatgttaaagatcattataaaggatgacgaaagtcacttctccgagatcctgctccgagccagtgaacaccttgaaatgatattcgggctggatgtggttgaggtggacccaacaacccactgttacggtctgtttattaagcttgggctcacctatgacggaatgttgagcggcgagaagggcgtaccaaagacaggcctgcttatcatcgttttgggagttatcttcatgaagggtaacagagcaactgaggaggaggtgtgggaagtattgaacctaactggtgtgtactcaggcaaaaaacacttcatatttggggaaccccgtatgttaatcacgaaagactttgtgaaagagaaatatctagaatatcagcaagtcgctaattccgacccagcccgttacgaatttctgtgggggccacgcgcaaaggctgagacttccaaaatgaaggtgctggagtttgtggcgaaggtgcacggaagctacccacattcttttcccagccagtacgccgaagcactcaaagaagaggaagaacgtgcacgtgcaaggatctag

SEQ ID NO: 230069 - DNA, 975 bp, Artificial Sequence
  Description of Artificial Sequence: Synthetic coding sequence
atgtctcaagatcaggagtctccacgttgtacccatgaccagcatctccaaacattctctgaaacccagtctttggaggtagcccaggtttcaaaggccctagagaagaccctgctgtctagctcccaccccttggtcccgggaaagctgaaagaggcacctgccgcaaaagcagagagccccctagaggtgccccaatcattctgcagtagcagtattgccgtgacgactacgagcagttccgaaagcgacgaagcttccagcaatcaggaggaagaagactctcccagctcaagtgaagacacaagtgatccaaggaacgtgcccgcagacgccttggaccagaaagtcgcatttctagtgaactttatgctccacaagtgccagatgaagaaacctatcactaaagcagacatgctgaaaatcataataaaggatgacgagtcccatttctcagagattttactgcgcgcttccgagcatctggagatgattttcgggctggacgtggtggaggttgacccaactacccattgctatggcctgtttatcaaactcggccttacctacgacggaatgttgtcaggcgaaaaaggcgtcccaaagactggcctgctgattatcgttctgggggttatcttcatgaaaggaaaccgcgctacggaggaggaggtgtgggaagttcttaatctgacaggagtttacagtgggaagaagcacttcatcttcggggagcccagaatgctgataacgaaagattttgtgaaagaaaagtatttggagtatcaacaggtggcaaattctgatccagcacggtacgagttcctgtggggcccacgcgctaaggccgagacgtcaaagatgaaggtcctcgagttcgtggccaaggtgcacggcagctacccacattcatttcccagtcagtatgcagaggccctgaaagaggaggaggaaagggcacgcgctagaatctag

SEQ ID NO: 230070 - DNA, 1071 bp, Artificial Sequence
  Description of Artificial Sequence: Synthetic coding sequence
atggggactgaggcacagcccgtagttaaggccgtgatcttacattgcctcccatcttgccctcactcctgcctgttgccgcctacccgcgtgatcatgtctcaggatcaggagagtcctcggtgtactcatgatcagcatttgcagacattcagcgagacacagagccttgaagtggctcaggtgagtaaggcattagagaagaccttactcagctcatcacaccccctggtccccggaaagctgaaggaggctccagcagccaaggccgagtctcctctggaggttccgcagagcttttgttcttccagtattgctgttactacaacatcctcttcagagtctgatgaggcttcgagcaatcaggaagaggaggattcaccatccagctccgaggacacctccgatcctcgaaacgtccctgctgacgccctggatcagaaagtggcatttctggttaattttatgctgcacaagtgccagatgaagaagccaatcaccaaggcggatatgctaaagattatcattaaagacgacgagtctcactttagcgaaatactcctcagagcgagcgagcatctggagatgatctttggcctcgacgtggttgaagtggaccctacgacacattgttatggattatttataaaactcggcctcacttatgatggcatgctttctggcgaaaaaggggtccccaagactggccttctcattatcgttctgggcgtgatatttatgaagggcaaccgtgcaactgaggaggaagtttgggaggtgctgaatctgacaggggtttatagtggcaagaaacactttatattcggagagccccgtatgctgattaccaaagattttgtcaaggaaaaatacctggaatatcagcaagtggctaattcggaccccgcacggtacgaattcttatgggggccaagagctaaggctgagaccagcaaaatgaaggttttagagtttgtggccaaggtgcacggcagctacccgcacagttttccaagtcagtatgcggaggccctgaaggaagaagaggagagggctcgcgctcggatttag

SEQ ID NO: 230071 - DNA, 996 bp, Artificial Sequence
  Description of Artificial Sequence: Synthetic coding sequence
atgcccagaggtcaagcttccaagagacgggctcgcgaaaagagacgtcaagcgcgtggggaggaccaatgtcttggcggtgcacaagccactgctgccgaaaaggagaaattgccctctagctcctccccagcttgtcagtcccctcctcaatcatttcccaatgccggaatcccacaggagagtcagagagcgtcatacccatcttcccccgcaagcgcagtgtccttaacctccagtgatgaaggcgctaagggccaaaaaggagaatctccaaacagcttccacggcccttcatcatccgagagcactggcagagatcttctgaataccaaaacaggggagctcgttcagtttcttctcaataaatacattaggaaagaaccaatcaccagggaagccatgctcaaggtgattaaccggaagtacaagcagcacttccccgagatcctccggaggtccaccgaaaatgtcgaggtagtgttcggcctgtatctgaaagagatggatccatcccgccagtcctacgtgctggtgggtaagctcgactttcctaatcaaggctccctgtctgatggcggtggtttccccctgagcggcctcctgatggtgctcctgagtacaatcttcatgcacggaaatcgggctactgaggaggagatgtgggaatgcctgaacgcacttggcatgtacaaggggaggaaacacttcatatacggtgagccacaggaattagtgaccaaggatctggtcagggagggctacctggaataccaacaggttccctctagcgaccccccacggtatgagttcctgtggggcccacgcgctcgagctgaaacaagtaagatgaaggttctcgagttcgtggctaagcttaatgacactgtggctagtacttataaatcacgttatgaggaagccctgagggaagaagaggagcaagccagagcacgagctgttgcaagggacagcgccagggcacgggcatcttag

SEQ ID NO: 230072 - DNA, 1011 bp, Artificial Sequence
  Description of Artificial Sequence: Synthetic coding sequence
atgccaaggggacaggcgtccaagagacgcgcacgggaaaagcgccgtcaggctcgcggagaagatcagtgcctgggcggtgctcaagcgaccgccgcagaaaaagaaaaactgccttccagctcctcccccgcttgtcaatcccccccacaatccttcccaaacgcagggattcctcaagagagtcagagagccagctatccctcctctcctgctagcgccgtcagcctgacttcatcagacgagggagctaagggccaaaagggcgagtcacccaactccttccacgggccttcttcatcagaaagtacaggaagagacctcctcaatacaaagacgggtgagttggtacagttcctgctgaataagtacatccgcaaagagcccattacccgagaagctatgctgaaggtcattaaccggaagtacaagcagcatttcccagagattcttaggagaagtactgagaacgtggaagtggtgtttggcctatatctcaaagagatggatccaagtcggcagagctatgtgctggtggggaagctggatttccctaaccagggctcactgtctgacggcggagggttccctctgagcggattgctgatggtgctgctatctactatctttatgcatggaaacagggccacagaagaggaaatgtgggaatgcctcaatgcattgggaatgtacaagggccgaaaacatttcatatacggggagccgcaggagctggtgaccaaagatctggtcagagaaggctacttagagtatcaacaggttccaagctcggacccgccacgctacgaattcctgtggggccctagggcgagagctgagacatccaagatgaaggtcctcgagttcgttgcgaaactgaacgacacagtggcttccacatataaatctcgctacgaagaagctctaagagaagaggaggagcaggctcgggctagagccgttgcccgagacagcgctcgtgctcgtgcttctcggtccttccagccgtag

SEQ ID NO: 230073 - DNA, 1011 bp, Artificial Sequence
  Description of Artificial Sequence: Synthetic coding sequence
atgcctcgaggccaggcctctaaacgcagagccagggagaaaaggagacaagcccgaggagaagaccagtgtcttggtggcgctcaggcaacagctgctgaaaaagagaagctgcctagttcctccagtccagcatgccagtcccctcctcagagcttccccaatgctgggatcccacaggaatctcagcgcgcatcttacccaagctcgcctgcgagtgctgtgtcacttacctctagcgatgaaggcgcaaaggggcagaaaggcgagtcccccaatagcttccacgggccttcctcatctgagtccacaggcagggatcttttaaacacaaagacaggcgagctggtgcagttcctgctcaacaagtatattcggaaggagcccataaccagggaggctatgcttaaggtgatcaatcgtaaatataaacagcatttccctgagattctccgtcgttctactgaaaacgtcgaggtggtatttggactgtacctgaaagagatggaccctagtcggcagtcttatgttttagtggggaaactggatttcccaaatcaaggttctttgtccgacggcggtgggtttcctctttctggactgctgatggttttgttaagtactatctttatgcatgggaatcgcgctaccgaggaggagatgtgggagtgcctcaacgcacttggaatgtataaggggagaaaacacttcatttacggagaaccccaggaactagttaccaaggatttagtgagagaggggtatctggagtatcagcaggtgccaagttccgaccctccgagatatgagtttctgtgggggccaagagcaagagccgaaacctctaagatgaaagtcttggaattcgtggccaagctgaacgacaccgtagcgtcaacctacaaatctaggtatgaggaggccttgagggaggaggaagagcaggcacgggcacgagcagtggcaagggacagtgcgcgagcacgggcttccagaagcttccagccatag

SEQ ID NO: 230074 - DNA, 960 bp, Artificial Sequence
  Description of Artificial Sequence: Synthetic coding sequence
atgcccagaggacagaaatctaagctccgtgccagagagaagcgccgaaaagcacgagatgagacgcgtggattgaacgtccctcaggttaccgaagccgaggaggaggaagcaccgtgctgttcatcgagcgtgtctgggggagcagcttcctcatctccagccgctggaattccccaggaaccccaaagagccccaaccacagcagccgcagcagccgctggagtgagcagcaccaaatccaagaagggcgctaaaagccaccaaggagaaaaaaatgcaagcagcagccaagcctccactagcacgaagtccccctctgaggacccgttgacaaggaaaagcggaagcctagtacaatttttgctgtataagtacaaaatcaaaaagtccgtgaccaagggagaaatgttaaagattgttgggaaacgcttccgggaacatttccctgagatcctgaagaaagcctcagagggcctgagcgttgttttcggtttggaattgaacaaagtgaatcctaatgggcacacgtatacatttatcgacaaagtagatctgacagatgaagaaagtctcctgtcgtcttgggactttccacggagaaagctgctcatgccattattgggcgtgatatttcttaatgggaattctgcgactgaggaggaaatttgggagttcttgaacatgctgggcgtgtacgacggcgaagaacattcggtgttcggcgaaccctggaagttgattactaaggacctggttcaggagaaatacctggaatacaagcaggtgccctcttcggacccgccacggttccagtttttatgggggccacgtgcctacgccgagaccagcaaaatgaaggtactggaatttcttgctaaggtgaatggcactaccccatgcgcatttccaacacactatgaggaggctctcaaagatgaggagaaggccggtgtgtag

SEQ ID NO: 230075 - DNA, 1041 bp, Artificial Sequence
  Description of Artificial Sequence: Synthetic coding sequence
atgccgaggggtcagaagtctacactgcacgcacgcgagaagcggcagcagactcgcggacagactcaggatcaccagggagcccaaatcaccgcaacaaacaaaaagaaggtaagcttctcctctcctctgatccttggcgctaccatccaaaagaagagtgctggacggagtcggtcggcgttaaagaagccccaaagagccctttctactactacctcagtggatgtgagttacaaaaaatcctacaaaggagccaattccaagatcgagaagaagcagtccttctcccaaggcttgagcagcactgtccaatcacgcacggatccactgatcatgaagacaaatatgttagtgcaatttttgatggagatgtacaagatgaaaaaaccaataatgaaggcagatatgctgaaaatagtccaaaagtcacacaagaattgcttccccgaaattttaaagaaagcctcttttaatatggaagtagtgtttggcgttgacctcaagaaagtagactctaccaaagactcttacgtcctggtgtctaagatggatttaccaaacaatgggaccgtcacacgcggacgaggcttccccaagaccggcctgctactcaacctgcttggggttatatttatgaaaggaaactgtgcgaccgaggagaagatctgggaattcctaaataaaatgcgcatttacgacgggaagaagcacttcatcttcggagagcccagaaaacttatcacacaggacctcgtgaaacttaagtatttggagtacaggcaggtgcccaactccaatccagctcggtacgagtttctatggggtcccagggcacacgccgagacttcaaaaatgaaggtactggaattctgggctaaagttaataagacagtgccctctgcattccagttctggtatgaggaggccttacgggatgaagaggagagggtgcaggcagccgctatgttaaacgatgggagttctgctatggggagaaaatgtagcaaggcaaaagcgagtagtagttctcacgcctag

SEQ ID NO: 230076 - DNA, 1041 bp, Artificial Sequence
  Description of Artificial Sequence: Synthetic coding sequence
atgcccaggggccagaagtcaaccctccatgcacgggaaaagagacagcaaacccgtgggcagacccaggatcatcagggcgcacagattaccgcgaccaacaagaaaaaggtgtccttctccagccccctcatcttgggcgcaactattcagaagaaatcagctggcaggtcaagaagtgcactcaaaaagccgcaaagggccctctctactacaacttctgtggatgtctcctacaaaaagagttacaaaggcgctaactctaaaattgaaaaaaaacaatctttctctcagggcctgtcttctacagtgcaaagcaggacggatcctctgattatgaagactaatatgctggtacaatttcttatggagatgtacaaaatgaagaaacccataatgaaagccgacatgctgaagattgtccagaagtcccataaaaattgtttccccgagatccttaaaaaggccagttttaatatggaggtagtttttggtgtagaccttaaaaaggtggactcgaccaaggatagttatgtactggtgtcaaaaatggacttgcccaacaacggcaccgtaaccaggggacgcggatttcccaagaccggcctcctgctgaatttgctaggggtgatcttcatgaaaggaaattgcgcgacagaggagaagatttgggaattcctgaacaagatgcgtatttacgacggaaaaaagcattttatcttcggggaaccacgaaaattgataactcaggacctggtgaaattaaagtaccttgaatacaggcaggtgcctaattccaatccagccaggtatgagttcctgtgggggccaagggctcacgccgaaacatccaagatgaaggtgcttgagttctgggccaaagttaacaaaaccgtaccaagtgccttccagttttggtacgaggaagctttaagagatgaagaggagcgggtgcaggctgctgcaatgctgaatgacggaagctcagcaatgggcagaaaatgtagcaaggctaaggcctcttcttccagccatgcgtag

SEQ ID NO: 230077 - DNA, 1041 bp, Artificial Sequence
  Description of Artificial Sequence: Synthetic coding sequence
atgcccagagggcagaagtccaagctgcgcgctcgcgagaagagacagcgtactagaggccagacccaagatcttaaagtcggccagcccacagccgctgaaaaagaggagtctcctagcagtagctcctcagtgctccgggacaccgctagctcgtcactggcctttgggatcccccaggaaccacagagagagcctccgacaacctccgccgcagctgcaatgagctgcactggttctgacaagggtgatgagagccaggatgaagagaacgcttcctcctctcaggccagtacatctaccgaacgctcgctgaaggatagcctgacccggaagacaaagatgctcgtgcagttccttctgtacaagtataaaatgaaggagcccaccacaaaagctgaaatgctgaagattatcagtaagaagtacaaagaacacttccctgagatcttcagaaaagttagccagcgcacagagcttgtatttgggctcgccctgaaggaggttaatccaacaacacacagttatattttagtatccatgctggggccaaatgacgggaatcagtcttctgcctggactctcccaagaaatggcctcctcatgcccctgttatcagtcatcttcctgaatggtaattgcgcaagagaagaagagatctgggaattccttaatatgctgggcatttacgatggtaagagacaccttattttcggcgagccgcgaaaacttatcacccaggatctggtgcaagaaaagtaccttgagtatcagcaagttccgaactcggacccacctcggtaccagttcctgtggggcccacgggctcacgcagagaccagcaagatgaaggtattggagttccttgctaaagtaaacgacaccacccctaataacttcccgctgctctatgaggaggccctccgggatgaggaggaaagagccggagccagaccgagagtggctgctcgcagggggacaacggctatgacctcagcatactcccgagctactagcagtagttcgagccagccaatgtag

SEQ ID NO: 230078 - DNA, 828 bp, Artificial Sequence
  Description of Artificial Sequence: Synthetic coding sequence
atgacttcagctggtgtgttcaacgcgggtagcgatgagagggcaaactccagggatgaggagtatccctgttcatcagaggtgtccccgtccacagagtcgtcttgcagcaattttatcaacataaaggttggtctccttgagcagtttctgctgtataagtttaagatgaagcagcgcattctgaaggaggacatgctgaagatcgtcaatcctcggtaccagaatcaattcgccgaaattcataggagagcaagtgagcatattgaagtcgtcttcgccgtggacttgaaggaagtcaatcccacttgccatctttatgacttggttagcaaactaaagcttccgaacaacggcagaatccacgtcggcaaggtgctgccaaaaacagggctcctcatgacctttctggttgtcattttcctgaaaggaaactgcgctaataaagaggatacatggaaatttctggatatgatgcagatttatgatggaaaaaaatattacatttacggtgagccaagaaaactgatcactcaggatttcgtgagactcacgtacttagaatatcatcaggtcccgtgttcctaccctgcacactatcaatttctgtggggcccacgggcttacaccgagacctctaagatgaaggtccttgaatacctagcaaaggtcaacgacattgctccgggagctttttcaagccagtacgaagaagctctgcaggacgaagaggaatccccaagccagcgctgctctaggaactggcattactgctccggacaggactgtctccgcgctaagttctcttcattctcgcagccatactag

SEQ ID NO: 230079 - DNA, 1224 bp, Artificial Sequence
  Description of Artificial Sequence: Synthetic coding sequence
atgccccgaggacacaagtctaaactcagaacctgtgagaagagacaagagacaaatgggcagccccaaggacttacagggcctcaggcgactgcagagaaacaggaggaatcccacagctctagcagtagttctcgagcctgcttgggcgactgtaggcgcagctcagacgcttctataccccaggagtcccagggagtctccccaaccgggagccctgacgccgtcgtgtcatactctaagtctgatgtcgccgctaatggacaggatgagaaatcgccgtctacatccagagatgcttccgtgccacaggagagccagggcgcttcgcctaccggcagtccagacgccggtgtgagtgggtccaagtatgatgtagctgcaaacgggcaggacgagaagagcccgtccactagccacgacgtctcagtcccccaggagagccaaggggcaagcccaactggctccccggacgctggcgtgtccggtagcaagtacgacgtggcggcagaaggcgaagatgaagaaagtgtgagcgcctcacaaaaagcaatcatctttaagagactttctaaggacgctgtcaagaaaaaggcttgtaccttagcccagtttttgcagaagaagtttgagaaaaaggagtctatccttaaggcagacatgctgaagtgcgttcgcagagagtataagccctactttccccagatcctcaacagaacttcccagcatctggtggtggccttcggagtggagttgaaggagatggactctagtggagagtcttatactctcgtctctaagctggggcttccatccgaggggatcctgagtggcgacaatgctctgccaaagagtgggctgctgatgagcttacttgtcgtgattttcatgaatggaaattgcgctacagaggaagaggtctgggagtttctgggcttgttgggcatttacgatggaatcctgcactctatttacggtgatgcgaggaagataatcaccgaggatctggtgcaagacaaatatgtggtctatcggcaggtgtgcaactccgatcctccctgctacgaattcctgtggggtccacgggcttatgcggagactacaaaaatgcgtgttttgagagttctggctgattcatccaatacttctcccggtctgtatccacatctgtatgaggacgctttaattgacgaggtcgagagagccctccgtctccgtgcttag

SEQ ID NO: 230080 - DNA, 3429 bp, Artificial Sequence
  Description of Artificial Sequence: Synthetic coding sequence
atgggcgacaaagatatgccaacagcagggatgccctccctgctccagagctcctctgaatctcctcagtcctgtcctgagggagaagactcacagtctcccctgcaaataccccagagttccccagaaagcgacgacacattatatcctctccaatccccacagtcgagatccgagggagaggactccagtgaccctcttcagcgcccaccagaagggaaggactctcagtccccactccaaatccctcagagctctcctgagggagatgatacacagagccccctccagaactcacagtcttcgcccgagggcaaggactccctctcccctctggaaatttcccaaagccctccagagggcgaggacgtgcaatctcctctccagaaccccgcatcctctttcttttcttccgccctgttgagcatttttcagagttcccctgagtccacccagtccccgtttgaggggtttcctcagagcgtcctgcagattccagtttcggccgctagcagttcaactctcgtatccatctttcagtcttctccagaatccacacaatcaccctttgagggcttcccccagagtcccttacagatccccgtttccagatcttttagctccacccttctgagcatcttccagtcttccccggaacgcacccagtctacgtttgaaggattcgcccaatcacccctccagatccccgtgtctccaagtagcagctccactctactgtctctttttcaatccttcagtgagcggacgcaatccacttttgagggatttgcacagtcatccctccagattcctgtgagtccttcgtttagctcaaccctagtgtcattattccagtccagcccagagagaacacaaagtacattcgagggcttcccccagtccccattgcagataccagtcagctcttcaagcagctccactcttcttagcttatttcaatccagtccagagcgtacccacagtaccttcgagggattcccccagtcgttgttgcagattcccatgacgagctctttttctagtaccttactcagcatattccagtcttctccagaaagcgcccagtctacattcgaaggtttccctcagtccccgttgcagatacctgggtcccctagtttctctagtaccctgctgtcgttattccagtcgagcccagaacggacccacagcactttcgagggcttccctcagagccctttgcagatacctatgacttccagtttctccagcaccttacttagcattctccaatcttctcccgagagtgcccagtctgcctttgaaggctttcctcagagtcccctgcagatcccagtgagcagttcattttcctacacattgttgtcgctgttccagtcgagccctgaacgcacacacagcacctttgaaggctttccgcagtctcccctgcagattcccgtctctagcagcagctcttcctcaaccctcctgagcctcttccagtcaagtcccgagtgcacgcagtccacgtttgagggcttcccccaaagtccactgcagatccctcagtctccacctgaaggtgagaacacgcacagtcctctgcagatcgtgccttcgttaccagagtgggaggacagcctgtcaccacactattttccacagtcccctccccagggcgaggattccctcagccctcattactttccccagtccccaccccagggcgaggactcgctgtctccccattatttccctcaaagtcctcaaggcgaggactctctttccccacattacttcccacagtctccaccacagggcgaagattcaatgtctcccttatactttccacaatccccattgcaaggtgaggagttccagagctcactacagtcccctgtgtcaatttgctcctcaagcaccccctcaagcctcccacaaagtttccctgagagctcccagtccccgcctgagggcccagtgcaatcaccacttcatagtccacagagtcctcccgaaggtatgcacagccaaagccccttgcagtctcccgagagcgcacccgagggtgaggactcattaagtcctctccagattccacagtctccccttgaaggcgaagatagcctgagtagcctgcacttccctcagagtcctcctgaatgggaagacagcttatccccacttcattttccccagtttcccccacagggagaggactttcagtccagtctgcagtcccctgtctccatttgctctagttcaactagcctgtcactacctcagagttttcccgagtctcctcagagcccccctgagggccctgctcagagcccgctgcagcggccagtctcctcctttttttcttatacgcttgcctcgcttctccagtcttcacatgagagcccgcagtctccgcctgaagggcctgcacagtcccccttgcagtcccccgtgtctagctttcctagcagtacatcttcgtcgctttcacagtctagccccgtgtcttcattcccgtcatctaccagcagctctctgtcaaaaagctcaccagagagcccacttcagtcacccgtaatctcattcagctccagcacttccctgagtccattttctgaggaaagctcctctccggttgatgagtacacttccagctccgacacgctgctggagagtgactccctcaccgacagtgagtcactcattgaaagcgaacccctctttacctatactcttgacgagaaggtcgatgagctcgcccgatttcttctcctcaagtaccaggtcaagcagcctattacaaaagctgagatgttaacgaacgtgatctcccggtacaccgggtattttccagtgatcttcaggaaagctcgcgaatttattgagattctcttcggcatttccctgcgggaggtggacccagatgattcatacgtgttcgtcaacaccctcgacctgacctccgagggctgcctgagcgacgagcagggcatgtcccagaatcgactgctcattctcattcttagcatcatcttcattaaaggtacttacgcctcagaagaggtcatttgggatgtgttatccggcatcggggtccgagctggaagagagcattttgctttcggggagccacgagagctgcttacaaaagtgtgggtgcaggagcactatcttgaatatagggaagtgcccaactcctcccctcctagatacgagtttctctgggggccacgagcccacagcgaggtgattaaaaggaaagttgtcgaattcctggctatgttgaagaacaccgtgcctataacattcccttcatcctataaggatgctctgaaggatgtcgaagagcgggctcaggccattattgacactacggacgactccacagcaacagagtcagccagttcaagtgtgatgtcccctagttttagcagcgagtag

SEQ ID NO: 230081 - DNA, 354 bp, Artificial Sequence
  Description of Artificial Sequence: Synthetic coding sequence
ggcgacaaagacatgcccacagctgggatgccctctcttctccagtctagcagcgagagtccacaatcgtgtcccgaaggtgaagacagccagtctccccttcaaattccagtaagtccctcaagcagctcgacactgctcagcctttttcaaagcttctccgaacgaacccagtcaacatttgaaggcttcgcacaatcttcgttgcaaattccggtgtctcccagtttctcaagtactcttgtgagtctgttccagtcttcccccgagaggacacagagcaccttcgaggggttcccacagtctcccctgcagattcccgtcagcagtagctcgagctcaacactgctttag

SEQ ID NO: 230082 - DNA, 357 bp, Artificial Sequence
  Description of Artificial Sequence: Synthetic coding sequence
atgggcgataaggacatgcctactgccggtatgccgtcattactgcagagttcttctgaatccccccagtcctgccccgagggggaagattcccagtcacctctgcagatccccgtcagtccttcgagttcatctaccctgctgagcttgtttcagagctttagcgaacgtacccagagtacttttgaaggcttcgcccagtcatcactgcaaatcccagtctccccatcattctccagcactctggtgagcctgttccagagttcccctgaacggacgcagtccactttcgaagggtttccacaatctcccttgcagatccctgtgtccagctcaagttcctctactctgctgtag

SEQ ID NO: 230083 - DNA, 630 bp, Artificial Sequence
  Description of Artificial Sequence: Synthetic coding sequence
atgttaactaacgtgattagtagatataccggttacttccctgttattttccggaaagcacgcgaattcatcgaaatccttttcggaatatccctccgcgaggtcgatcccgacgattcctacgtattcgtgaatacactggacttaaccagcgaaggttgtctctccgacgagcagggaatgtctcaaaacaggctgctaattctaatcctcagcatcatcttcatcaaaggcacctatgcatcagaggaggtcatatgggatgttctgtctggcatcggcgtcagagcgggacgggagcactttgctttcggtgaacccagagaactgctcactaaagtttgggttcaggagcactatcttgagtacagggaagtgcctaactctagtcctcccagatacgaattcctgtggggccctcgagcccactcagaggtgatcaaacgtaaagttgtcgaatttttagccatgctcaagaacacagttccgattaccttcccgtcttcttacaaggacgccctcaaggacgtggaagagcgggcacaggcgatcatagatacaacggacgacagcactgcaaccgaaagtgcctcctcctcggtgatgtcacccagcttctcttctgaatag

SEQ ID NO: 230084 - DNA, 1122 bp, Artificial Sequence
  Description of Artificial Sequence: Synthetic coding sequence
atgccccctgtccctggtgttcccttccgaaatgtggataatgactctcccaccagcgtggagctcgaggattgggtggatgcccagcaccccaccgacgaagaggaggaggaagccagctctgccagctccaccttgtaccttgtgttctcaccctctagtttctcaacaagcagctccctgatcctggggggtccagaggaggaggaagtgcctagcggggttatccctaacctcaccgagtccattcctagctctcctcctcagggcccaccgcagggaccctcccagagtcctcttagttcttgctgctctagcttctcatggtcctctttttctgaggaatcgtcctctcagaagggagaggacactggtacttgtcaggggcttcccgatagcgaatcctcctttacatataccctcgatgagaaggtggccgaactcgtggagttcctgctcctgaagtacgaagccgaggaaccagtgacagaagctgagatgcttatgattgtgatcaagtataaggattatttcccggtgatcctgaaacgggctcgagagtttatggaactcctctttggtcttgctttgatcgaggtgggccctgatcatttctgcgtgtttgccaacaccgtgggcctaacagatgagggatctgacgacgaggggatgccagaaaactccctacttatcatcatattgtctgtaatcttcatcaaaggaaactgcgcctctgaggaagtgatttgggaagtcctgaatgcggtgggggtgtatgcaggtcgcgagcactttgtgtatggtgaaccgagagagctattgacaaaagtgtgggtgcagggccactatcttgaatatagagaggtccctcactcatctccaccctattacgagtttctgtggggtcccagagctcactccgagagcatcaagaagaaagtcctcgagttcttagcgaagctcaataatactgtgccatcatccttcccaagctggtataaggacgccctgaaggatgtcgaagagagagttcaggcaaccattgacacagctgacgatgccactgtgatggccagcgagtctcttagtgttatgtcttcaaacgttagcttttccgagtag

SEQ ID NO: 230085 - DNA, 1932 bp, Artificial Sequence
  Description of Artificial Sequence: Synthetic coding sequence
atgctgttaccttgccattgggtgctggacgccaccttttccgacggcagtctcggtcagtgggttaaaaatacatgtgcgacatacgccctgtcaccggtggtgctgcctccccaaccgcagccccgtaagaaggctacagataaggactacagtgccttccacctcggccatctcagagaagtgagacttttcctgcgaggaggaacaagcgatcagcgcatggacagcctcgtcttgtgccctacctattttaagctgtggcgaaccttgtcaggcagtcccggacttcagttatccgaccttcatttcggatctcagcctgaggggaagttctccctgcgcagggcggtctcagttaagcagagagaggagcctcaagactggccgctcaacgagaagcgtaccttgtggaaagacagcgatctgcctacttggcggagaggcacaggatacacattatcgctcccagctgtctctccaggcaagagactctggggcgagaaggccggaagcctgccagaatccgagccactatttacttataccctggacgagaaagtcgacaaactggtccagttcctgctcctgaaataccaagcaaaagagcctctgacccgcgcagagatgcagatgaacgtcataaacacttacaccggatacttcccaatgatattcagaaaagccagggagtttatcgaaatactctttgggataagcctcacggaggtggatcccgaccatttctacgtctttgttaacaccctggacctcacttgtgaggggtctttatccgatgagcaaggtatgccgcagaataggttactaatcctgatcctgtccgtgatctttatcaaaggaaattgcgccagtgaagaggtgatctgggaggtcctcaacgcgataggaccctggtcagccctcgctggctttgctgacgtgttgtctcggcttgcattgtgggagtcggagggtcccgaggcattctgtgaagaaagcggactcagatccgctgagggcagcgtgctcgatcttgcgaatcctcagggccttgccggacaccggcaggaagacgggagaaggggcctaacagaagcttcgccccaacagaaaaaaggaggcgaggacgaggatatgcctgcagccggtatgccacctctgcctcagtcacctcctgagataccaccacagggaccacccaagattagtcctcaggggccaccccagtcaccgccacaatcccctttagactcttgctcttcaccactcttgtggacccggctggacgaggaatcgtcttctgaagaagaggatacagccacttggcacgctctgcccgaaagcgagagccttcctcgctacgcattggatgagaaggtagccgagctggtccagttcttacttctgaagtaccagaccaaggagcctgtaacaaaagctgagatgcttaccaccgtgataaaaaaatataaagactactttccaatgatctttggaaaggcgcacgaatttatcgaactgatttttggtatagctctgaccgatatggaccccgataaccactcttatttctttgaagatacactggacctcacctacgagggctccttgattgacgatcagggcatgcccaaaaattgcctgctgatcctgatcttatcaatgatattcatcaagggtagttgtgtccccgaagaggtgatatgggaagtactctccgccatcggcccaatccagagacccgctcgagaagtcctggagttcctgagcaaattgtccagcatcatcccatcagcatttccgtcttggtacatggatgcactcaaggacatggaggatcgggctcaggcaatcattgacacaaccgatgatgcgaccgccatggcctctgccagcccttccgtcatgtcgacaaacttctgcccagaatag

SEQ ID NO: 230086 - DNA, 801 bp, Artificial Sequence
  Description of Artificial Sequence: Synthetic coding sequence
atgccagccgctggcatgccgcctctcccccagtcccctcctgagattccaccacagggtcctcctaaaatctctccgcagggccctcctcagtccccaccacaatctcccctcgattcctgcagcagccctctcctctggaccaggctggatgaggaatcgtcctccgaagaagaagatactgccacctggcacgcgctgcctgagtcagagtccttgccacgctatgctcttgatgaaaaggtggctgaactggtacagtttctgcttctgaaataccagacaaaggagccagtgactaaggctgaaatgctaactaccgtgatcaaaaagtataaagattattttccaatgatatttgggaaagcacacgagtttattgagctgatatttggaattgcactcacagacatggacccagataatcatagctattttttcgaagataccttggacctgacgtacgagggaagtcttattgacgatcaaggaatgcctaaaaattgtctactcatcttaatcctgagcatgatcttcataaaagggtcttgcgtaccagaggaagtcatctgggaagtactgtcggcaatcggcgtttgcgccggaagagagcacttcatctatggagaccccagaaagttactgaccatccactgggttcagagaaagtaccttgagtatcgggaggtgcctaacagtgcacctcctagatatgaattcctctggggcccacgggcacacagcgaggcgagcaagagaagtcttcgggtgttcattcaggctatacaatatcatccttag

SEQ ID NO: 230087 - DNA, 381 bp, Artificial Sequence
  Description of Artificial Sequence: Synthetic coding sequence
atggacaccgggcagctacagctaagcagagaacgctcacccggagctggccaacaggccagacgggaactatgtgggagaatcgccattagccagcacgggggaaaggcacaagcctctccctctcatagcttattgagccctctggacaaaactgatggggaaccctggtccgcactagccggttttgccgacgtattgagccgacttgctctgtgggagtcagaaggtcccgaggcattttgcgaggagtctgggctgagatcagctgagggctccgtgctcgacctggctaaccctcaaggtaaagggcctaaaggcgagctgcgggatttcgccccacgtacggaggaagccccagtgtgccctgcactgccatag

SEQ ID NO: 230088 - DNA, 1041 bp, Artificial Sequence
  Description of Artificial Sequence: Synthetic coding sequence
atgcctctctttcctaatttacctcggctatctttcgaggaggattttcagaacccgtccgttaccgaagacttggttgatgcccaagattccatcgatgaggaggaggaagatgcatcaagtacttctagcagcagcttccacttcctatttccaagctcttctagcctcagctctagctcacctttgtccagcccactgccctctactctgatcctcggagtgcccgaggacgaagacatgcctgctgcaggcatgccgcctcttccccagtccccaccagaaatcccaccacaaggcccacccaagatctctccacaaggcccaccccagtcaccacctcagtccccactggattcctgtagcagtcctttgctctggacacgcttggatgaagagtccagctccgaagaggaggatactgccacctggcacgcgctgcccgagtccgagtcactgcccaggtacgccttggatgaaaaagttgccgaactggtccagttcctcctgttgaagtaccagacaaaggaaccagtgacaaaagccgagatgctgaccaccgtgattaagaagtataaagattattttccaatgatctttggtaaggcccatgaattcatcgagctgatctttgggattgccctgaccgacatggatcccgacaatcactcttacttcttcgaagataccctggatctcacgtacgagggcagtctcatcgacgaccagggaatgccaaagaattgcctactgatcctgatcctctccatgatttttattaaggggtcctgtgttcccgaggaagtaatctgggaggtgttgtccgccatcggggtatgcgccggacgagaacatttcatttacggcgaccctaggaagcttctgacgatacactgggtccagaggaagtatctggaatatcgagaagtgcctaattcagctcctcccagatatgagttcctttggggaccgagagcgcactccgaagcaagcaaacgaagcctaagggtgttcatccaggctattcagtatcatccatag

SEQ ID NO: 230089 - DNA, 1041 bp, Artificial Sequence
  Description of Artificial Sequence: Synthetic coding sequence
atgcccctgttccccaatctcccccgtttgtcttttgaggaagactttcaaaacccctctgtcacagaagacctagtggacgcacaggactcgattgacgaggaggaagaggacgcctcctcaacttcctctagcagcttccacttcctcttccccagcagtagttcccttagcagctcatcacctttgtccagccccctgcctagcactctgatattgggcgtgcccgaagacgaggatatgccagccgcaggcatgcctcccctccctcagtccccacccgagattcctccacagggccctcctaaaataagtccgcagggaccacctcaatcgcccccacaatcaccgctggacagttgctcctctcctctgttatggactcgtttagatgaagagagctcaagcgaagaggaggacaccgccacctggcacgccctccccgaatctgagtctctcccccgttacgcgctcgacgagaaagtcgccgagctggtccagtttctcttgctgaagtatcagactaaggagcccgtaactaaggccgaaatgttgacgacggtgattaagaaatacaaggattactttcctatgattttcggcaaagctcatgagttcatagagctaatctttggcatcgctctcacagatatggatccggataaccattcctacttttttgaggacactctggatctgacctacgagggaagcctgatagatgatcaggggatgccgaagaattgcctcctaattctgatcctgtcgatgatcttcatcaaaggatcatgtgttcccgaggaagtgatctgggaagtcttaagcgccattggggtgtgtgcgggaagggaacacttcatttatggcgatcccagaaagttgctgactatacactgggtccagcggaaatacctagagtacagagaggtgccaaactccgcaccacctcgatatgagttcctatggggaccaagagcccactccgaagcctcaaagcggtccctgagagtgttcatccaggccatccagtatcacccctag

SEQ ID NO: 230090 - DNA, 2337 bp, Artificial Sequence
  Description of Artificial Sequence: Synthetic coding sequence
atggcgcagaaaatggactgtggtgcaggcctcctggggttccaagccgaggccagtgtcgaggatagcgctctgctgatgcagaccctgatggaagcaatacagattagcgaagctcccccaacgaaccaggccaccgccgctgcatcaccccagtcaagtcaaccaccaactgcgaatgagatggccgatattcaggtctctgcagcagctgcccgaccaaagagcgcctttaaagtacagaatgctacgacaaaagggcctaatggcgtgtacgatttcagccaagcccataacgctaaagatgtaccaaatactcagccaaaggccgcattcaaaagccagaacgcaacaccgaaaggtccaaatgcggcttatgacttttctcaagccgctacaacaggcgagttagcggcaaataagtccgagatggctttcaaagctcagaacgctaccaccaaagtgggtccaaatgccacgtacaacttctcccaatcacttaatgccaacgatctggccaacagtcgcccaaagacgccctttaaggcatggaacgacacgaccaaagcacctactgcagacacccagacacaaaatgtcaaccaagcaaaaatggctacatctcaggcagacatcgagacagaccctggcatctccgaacctgacggggctaccgcacagaccagtgccgatggcagccaggcacaaaatctagaatctcgcactattattcgtggaaaaagaactcggaagattaataatctgaacgtcgaggaaaacagctcaggtgaccagagacgggcacctttagcggctgggacttggcgctctgccccagtacctgttactacacagaacccacctggggcacccccaaacgtgctgtggcaaaccccattagcatggcagaatccttccggctggcaaaaccagacagctcggcagaccccaccagctagacaatcacccccagcaaggcagacccctccagcctggcagaaccccgtcgcatggcaaaacccagtgatatggcccaatccggtaatctggcagaaccctgtgatttggccgaacccaattgtgtggcctggccctgtggtctggcctaaccctctagcatggcaaaacccacccggatggcagacaccgcctggatggcagacgccccctggatggcagggcccacccgattggcaaggacccccagactggccactccccccagattggcccttgcctccagattggcctttgcccacagactggccgctgccacccgactggattccggcagattggcccatcccccctgattggcagaacctgcggccatcacctaatctgaggccaagtcccaattctcgagccagccaaaaccctggggctgcccagcctcgtgatgtagccttgctgcaggagagggccaacaaattggtcaagtacttgatgctcaaggattatacgaaggtaccaatcaagcgctctgagatgctccgagatattatacgggaatacactgatgtgtatcctgaaataattgagagggcctgttttgtcctcgagaaaaagttcggtatccaacttaaggagattgataaagaagagcatctgtacatactgatcagcacacccgagtcgctggcaggaatacttgggactaccaaggacacccccaaactgggcttgctcctggtaatcttgggggtgatcttcatgaatggaaatcgggctagcgaagccgtgctctgggaggcactccgaaagatggggctccgacctggcgtgcggcacccactgctaggtgacttgagaaagctgctgacttatgagttcgtaaagcagaagtacttagactaccggagggtcccaaatagcaatccacctgagtatgagttcttatggggcctgagatcataccatgagacatccaagatgaaggttcttcgctttatcgctgaggtccagaaaagagacccaagagactggacagcccagttcatggaagcagctgacgaggcactggatgccctcgatgccgcagccgctgaggcagaagctcgcgctgaggcccgaacacgtatggggattggagatgaggccgtatccggaccttggtcctgggacgacattgaattcgaactgcttacctgggacgaggaaggcgattttggggacccatggtccagaatcccattcacattctgggcgaggtaccaccagaacgcgcgttctcggttcccacagacattcgcgggaccaattattggtccaggaggaactgccagcgccaactttgctgctaattttggtgcgataggattcttttgggtggagtag

SEQ ID NO: 230091 - DNA, 2505 bp, Artificial Sequence
  Description of Artificial Sequence: Synthetic coding sequence
atggctcagaaaatggattgcggtgctggattactgggcttccagaatcccgacgcctgccgggctgtctgtcacccattgccacagcctcctgccagcacccttccgctttctgctttcccgacgctctgcgacccaccctattcacagctgcgcgatccccctgccgtcctcagttgttactgtacccctttaggcgcatcccctgcacctgccgaagcttcagtggaagatagtgccctgctgatgcagaccctgatggaagctatccagatcagtgaagcacctcctacgaatcaggctacagccgctgcctctccacagtccagccagccccctaccgccaacgagatggccgatatacaggtcagcgcggctgctgctagacccaaaagtgccttcaaagtgcagaatgcaactaccaagggacctaacggggtctacgacttctctcaggcccacaatgctaaagacgtgccaaatactcagcccaaggctgccttcaagtcccagaatgcaacccccaagggtcctaacgctgcatacgacttcagtcaagcagcaaccactggggagctggccgctaacaagtccgagatggcctttaaagctcagaacgccaccaccaaagtgggtcccaatgccacctacaactttagtcagtcattaaacgcaaatgacctagcaaattctcggcctaagacgcccttcaaagcctggaatgataccaccaaggcaccaaccgcagacacacaaacccagaacgttaatcaggctaagatggccaccagccaagctgacatcgaaacagaccccggaatctctgagcctgatggcgctaccgcgcagacaagtgcagacggttctcaggcacagaatctagagtccaggacaataatcaggggcaagcgcaccagaaagatcaataaccttaatgtggaggaaaacagtagcggcgatcagaggagggcaccgctggccgcaggcacctggaggtccgcaccagtccccgtgacgacccagaaccccccaggagcgccacccaacgtgctgtggcagacacctttggcctggcagaatccgagcggctggcagaatcagaccgctcgtcagacccctcccgcacgccagagtcctcctgccagacagacccccccagcctggcagaaccccgtcgcctggcagaaccctgtaatctggcctaacccggtcatctggcaaaacccggtgatttggcccaaccccatcgtctggccgggtcccgtcgtttggcccaacccacttgcctggcagaatccccctggctggcagactcccccaggatggcagacccctccaggctggcaaggcccacccgattggcagggcccaccggactggcctctgcccccagattggccactaccgccagactggcctctgcctacagattggccactcccacctgattggatacccgctgattggccaatcccaccagactggcagaatctgcgcccatctccaaatctgagaccctcgcctaatagccgcgcttcacagaatcccggtgcagctcagcccagagacgtggcccttcttcaagagagagccaataagctggtgaaatacttgatgctgaaggactacacgaaggtgccaatcaagcggagtgagatgttgcgcgacatcatccgggagtacactgatgtctacccagagatcattgagcgagcttgtttcgtcctggagaagaagttcggaatacagttgaaggagatcgacaaagaggaacatctttacattcttatttcaactcctgagagcttagctggaatcttgggcactaccaaggatacccctaaactcggactattgttagtgatcttgggcgtgatctttatgaatggtaaccgcgcttccgaagcagtgctgtgggaagcacttcgcaagatgggcctgagacccggagtgagacacccccttctgggcgaccttcggaagcttctcacatacgagttcgtgaagcagaaatatctcgactatcggagggtgccgaacagtaaccctcccgagtatgagttcctctgggggctgaggagctaccacgagacatctaagatgaaggtgctacgcttcatcgctgaagtgcaaaaacgagacccgagggattggaccgcccagtttatggaagccgcagatgaggcgctggatgctctggacgctgcagcagctgaagctgaagcgcgagctgaagcacggacaagaatgggaatcggcgatgaagctgtcagcgggccatggtcctgggatgatatcgaattcgagctcctgacctgggacgaggagggggacttcggcgatccctggtcccgaatcccttttaccttttgggcacgttaccaccagaacgctcggagtcggtttccgcagacatttgcagggcctattatcggacctggaggcactgcttctgcaaattttgcggcaaattttggtgccatcggatttttttgggtggagtag

SEQ ID NO: 230092 - DNA, 2337 bp, Artificial Sequence
  Description of Artificial Sequence: Synthetic coding sequence
atggcacaaaaaatggactgtggagctggactccttggctttcaagcggaggcatccgtggaggatagtgcactcctgatgcaaaccttgatggaggcgattcaaatctccgaggctccccctaccaaccaggccaccgccgctgctagtcctcagtcgtcccagccacccaccgctaacgagatggctgacattcaggtatctgctgcagcggctagacctaaatcagcctttaaggttcagaatgctaccaccaaggggccaaatggggtgtatgacttttcgcaagcacacaacgctaaggacgtacctaatacgcaacccaaggccgcttttaagagccagaatgccactccaaagggccctaacgcggcttacgatttctcacaggccgctaccaccggcgaacttgctgccaacaagagtgagatggcgtttaaggcccagaacgctactactaaggtgggccctaatgcaacttataattttagccagtccttaaatgcgaacgatctagcaaacagccgccctaaaacgccctttaaggcatggaatgatacaactaaggcgcctacagccgacacacagacacaaaacgtgaatcaggccaaaatggccaccagccaggccgacattgagaccgaccctggtatcagcgagcctgatggagccaccgctcagactagtgccgacggctctcaagctcaaaacctggagtctcgcacaataattcgaggaaaacggaccagaaagattaacaatctcaacgtcgaggagaatagttctggcgaccagcgaagagcccctctggcagccggaacgtggcgctctgcgccagtgccggtcaccacccagaacccacccggagctccgcctaacgtattgtggcagactcccctcgcctggcaaaatccctctggttggcaaaaccagaccgccagacagaccccacctgcccgacaaagtccgccagcgcgacaaaccccgcctgcttggcagaaccctgtcgcttggcagaatcccgtgatttggcccaacccggtgatctggcagaatcccgtcatttggcctaacccgattgtatggccaggacccgtggtgtggcccaaccccttagcttggcaaaaccctcccggatggcagacccctccaggctggcaaactcctcctggttggcagggaccccctgactggcagggacctccagactggcctctgccccctgattggcctttgcctcctgattggcctctgcctacagactggcctctgccacccgactggatcccagctgactggccaattccaccggactggcaaaacctacggcctagccccaatctgcgaccctcgcccaacagcagagcaagccagaatccaggcgctgcacagccaagggacgtggccctgctgcaggagcgggcaaataaacttgttaagtaccttatgttaaaggattacactaaggttcccatcaaaaggtctgaaatgctcagggacataatccgagagtacacagatgtctaccctgaaattatcgaacgtgcctgctttgtgctggagaaaaaattcggcatccaacttaaagagattgacaaagaagagcacctatacatcctcatttccacccccgaatccctggcaggaatactgggaaccactaaggacacacccaagttgggactgctgcttgtgatactgggtgtgattttcatgaatggtaatcgggctagcgaagccgtgctctgggaggctctgcgcaaaatggggctccgcccaggggtcagacaccccctgctcggcgaccttcggaagctgctgacatacgagttcgtaaagcagaaatacctggactatcgtagggttcctaattcaaatcccccagagtatgagtttttgtggggcctccggtcctaccatgagacgagcaaaatgaaagtcctgcgctttatcgccgaagtgcaaaagcgggaccccagagactggacggctcaatttatggaagcggcagatgaggcccttgacgcactcgacgctgctgccgctgaggccgaggctagggctgaggccaggacacgaatgggtataggggacgaagctgtgagtgggccttggtcatgggatgacatagagtttgaactgctgacatgggacgaggaaggggattttggcgacccatggtcacgcatcccattcactttctgggctaggtatcatcaaaatgcacggtcacggttcccccagacatttgctggccctatcatcgggcctgggggtaccgcatccgctaactttgccgctaatttcggggctatcggctttttctgggtggagtag

SEQ ID NO: 230093 - DNA, 2337 bp, Artificial Sequence
  Description of Artificial Sequence: Synthetic coding sequence
atggcacaaaagatggactgcggtgctgggctgctgggctttcaggccgaggcttccgttgaggattccgcgctactaatgcaaacgctaatggaggccattcaaatctccgaggcacccccaacaaaccaagctacagccgctgccagtccccagtcaagccagccacccacagcaaacgaaatggcagacattcaggtctccgcggcagctgcacggccaaaatccgcttttaaagttcaaaacgccacaactaaggggcctaacggggtttacgatttctctcaggcgcacaatgccaaggatgtacccaacactcagccaaaggctgcattcaaatctcagaacgccaccccaaagggaccaaacgcagcctacgatttttcacaggctgctacaacaggagagctggctgccaacaagtcagaaatggcattcaaggcccagaacgccacgaccaaggtgggcccaaatgccacctacaatttcagccagtccctgaacgccaacgacctagccaactcccgcccaaagaccccctttaaggcctggaacgacaccactaaagctccaactgcagacactcagacccagaatgtgaaccaggccaaaatggccacatcccaggcagatatagaaacggacccgggaatcagcgaaccagacggagccactgcacagacatcggctgacggatcgcaggcacagaacctggagtctcgcaccatcattaggggcaaacgcacaagaaaaatcaataatctgaatgtggaggaaaatagtagtggcgatcagcggcgagcaccactggccgcagggacttggcgttccgcacctgtaccagtcactacccagaaccctccaggggctccacccaatgtgttatggcagactccactggcctggcagaacccgagtggatggcagaaccagactgcgcgtcagacgcccccagccagacagtcccctcccgcaagacaaacgccccctgcgtggcagaatccagtggcgtggcaaaatcccgtgatctggccaaaccctgtgatatggcagaaccccgtcatctggcctaacccaatcgtctggcccggacctgtcgtctggcccaatcccctggcttggcagaaccctcccggatggcaaaccccacctggctggcagaccccccctggttggcaggggccaccggattggcagggcccacctgactggccattgcctcccgactggccgttgcctccggactggcccttaccaactgactggccattgcctcctgattggattccggcagactggcccataccaccggactggcagaacctccgtccctctcctaacttaagaccgtccccaaactctcgcgcttcacaaaatcccggagccgctcagcccagagatgtggcattactgcaggaaagggcaaataagctcgtcaaatacctgatgctgaaagactacacaaaagtgccgataaagaggagtgaaatgctcagagacattatccgtgagtatacggatgtgtatccagagattatcgagagagcttgctttgtgctggaaaagaagttcggaattcagctgaaagaaatcgataaagaggagcacctctatattctcatcagcacccccgagagtctcgccggaattctcggaaccaccaaagatacaccgaagctggggctcctgctcgttatcttgggagtaattttcatgaacggaaatagggcttcagaggctgtcctgtgggaggccctcaggaagatgggcctgcggccaggcgttcgccatccgttgctgggagatctgaggaaactcctgacttatgagttcgtgaagcaaaagtacttagattaccggagagtgcccaatagcaaccccccagagtacgaatttctgtggggcttgagatcttaccatgaaacaagcaagatgaaggttctgcgattcatcgcagaagtccagaaacgtgatccaagagactggactgcccagttcatggaagctgccgacgaggctttagatgcattggatgcagccgctgccgaagcggaggctcgagccgaagctaggactcgtatgggcatcggtgacgaagccgtctcggggccatggagctgggatgatatcgagttcgaacttctcacctgggacgaagagggcgactttggcgacccttggtccaggatcccttttaccttctgggctaggtaccatcagaacgctcggagtcggttcccgcagacattcgccggtcccattattggtcctgggggaacagcgtctgctaactttgctgctaattttggggctattggattcttttgggtcgaatag

SEQ ID NO: 230094 - DNA, 414 bp, Artificial Sequence
  Description of Artificial Sequence: Synthetic coding sequence
atggcgcaaaaaatggattgcggcgcaggcctgctgggcttccaggctgaggcctctgtggaagatagtgcactgttgatgcagacacttatggaggcaatccaaatcagtgaggcgcctcctacgaatcaggctacagctgcagcgagccctcagtcctcacaacccccaacagctaacgaaatggctgatatccaagtgagtgcagcagctgccagaccaaaatctgccttcaaagtgcagaacgctacaacaaagggcccaaatggagtatatgatttttcccaaagtctgaacgctaacgaccttgcaaacagccgccctaagactcaggtatcactgaacctgacagtgcagctccaccgccatcaacagatggtaccaagacttaggatctggtccccgggtcaatag

SEQ ID NO: 230095 - DNA, 3942 bp, Artificial Sequence
  Description of Artificial Sequence: Synthetic coding sequence
atgagcggctggcgctatctaatctgtgtcagcttccttctgacaattctgctcgaactgacttaccaggggcctccagtgccagccagctcatccactaagctgctgatgacctcctattcaatgaggagtaccgtcgtctcccgttacgcccatactttagtgacatccgtcctgttcaatcctcatgctgaggctcatgaagcgatcttcgacctggacctgcctcacctggctttcatctccaatttcactatgactatcaacaacaaggtatacatcgccgaggtgaaagagaaacaccaggccaaaaagatctacgaggaggcgcaccagcaggggaagaccgcagcccacgtaggaattagagaccgcgaatcagagaagtttcgcatcagcaccagtctagctgctgggacggaagtgacctttagtctggcgtatgaagagctgctgcagcgtcaccagggacagtaccagttggtcgtgtcactgcggccaggccaactggttaaacgactgtccatagaagttactgtgtctgagagaacgggcatatcctacgtgcacatccccccattgcgcacaggccgtttgagaaccaacgcccacgcctcagaagtcgattccccaccctcaacacggatcgagcgcggagaaacctgtgtcaggatcacatattgtccgaccctgcaagaccagagttcaatctctggctcaggaatcatggctgactttctggtccagtacgacgtggtcatggaggacatcattggagatgtccagatctatgatgactactttattcattattttgcccctcggggtttgccaccaatggaaaaaaatgttgtctttgttattgacgtcagcagttccatgttcggtaccaagatggaacagacaaaaacggcaatgaatgtgatattgtcagaccttcaggcaaacgactatttcaatatcatttcgttctctgataccgtaaacgtatggaaggccggaggatcgatccaagctactatccaaaacgtgcattctgcaaaggactatctgcattgtatggaggctgatgggtggactgacgtcaacagcgccctcctggccgcagcatcagttctgaatcattctaatcaggaacccggaagggggcctagtgtcgggaggattccactcatcatctttctcacagatggtgaaccaacagctggggtcacaacgccaagtgtgatactgagtaatgttcgccaggctctagggcacagagtgtccctgttcagcttagcattcggcgacgacgcagacttcactctgctcaggaggctatcattagagaaccgaggtatcgctaggcggatctacgaggacactgacgcagctctgcagctgaagggcctctacgaagaaattagtatgcctctgctcgccgatgttcggctcaactacctggggggattggtaggcgcttccccatgggccgtttttcccaattacttcgggggttcagagctggtggtggccggacaggttcaacctggcaagcaagaactgggaattcaccttgctgctaggggacctaaggaccagctgctggtcgctcatcatagtgagggtgccacaaataactctcaaaaagcctttggttgcccaggcgagccagcacccaatgtggctcactttatccgcaggctctgggcgtatgtaaccattggagagctgctagacgcacacttccaagctagggatactaccacgagacaccttctagccgctaaggtactgaacctgagtctggagtacaatttcgtcacacccctgactagtctcgtcatggtacagcctaagcaggcctctgaagaaactagacgccaaacttccacgagcgcaggcccagacactatcatgccttcaagctccagccgtcatggactcggagtgagcaccgctcagcccgcactcgttcccaaggtgatcagccctaagagccgcccagtcaagccgaaattctacctttccagtactacgaccgcctccacgaagaaaatgctttcctccaaggaactcgagccccttggggagagcccccacacattgtccatgccaacctatcctaaagccaagatccctgctcagcaggactcaggaactcttgcccagccgacattgcggaccaagcccacgatcctggtaccatctaattccggtacactgctgcctcttaaacctggcagcctgtcccaccaaaaccctgacatcctccccactaactcccgtactcaggtccctccggtaaaaccgggtatcccggcttccccaaaggccgataccgttaaatgcgtcacgcctctgcacagcaaacccggtgctccatcacacccgcagctgggagcgctcacctctcaagcaccaaaggggctaccccagtcacgacccggtgtctcgaccctgcaggtcccaaaataccccctccacacaagaccccgagtgccagctcctaaaaccagaaataacatgccacatctgggacctggtatcttactgtccaagacacctaaaattttgttgagcctgaaaccgagcgcaccaccacaccagatcagtaccagcatcagcctgtccaagccagaaaccccgaacccccacatgccccagacacccctgccgcctcgacccgatcgtccccgacccccactccctgagtctctgtccacattcccgaatactataagtagtagtactggtcccagcagtaccacaacgacctcagtcttgggcgagccactccctatgcccttcactcctacactgcctcctggcagattctggcaccaatacgatctgctgcctgggccacaacgcaccagacaggttcttggcccttcccgaccaggcgtgcctaccatgagtctgctgaattcatcgagacccaccccagaggggtctcctcctaatcttccgatcttgctgcctagctctatcctgccggaggccatctctcttctcctgctgcccgaggagctcgagctgttatccgaatcgatggtggaatctaaatttgtcgaatcgttgaatcctcccgctttctacacattcctgacacctgatgaagacgggagtcccaactgggatggcaattccgaggaaatcttgggcggagctggaggctcaatggaatcccagggttccagcgttgggctcgccaaaggcaccctgccctccatcttcaccttctcaagcagcgtcgatggcgacccccatttcgtgatccagatcccccacagcgaagaaaagatctgctttacactgaatggccatccgggagatcttctacaattgattgaggatcccaaggcagggctgcacgtgtcaggaaaactactgggggctccgcctcgtcccggacataaagatcagacacgcacatatttccaaatcattactgtcacaacggacaagcccagggcttatacaattacaatcagtcgctcgtctatatctttgaggggcgaggggacgctacgccttagttgggaccagcccgctctcctgaaacgaccacaactggaactgtacgtcgcggctgccgcaagacttacacttcggcttgggccttacctggagtttttggtcctccgccacagatatcgccacccttctaccttgcaacttccccatctaggattctatgtggccaatgggagtggcctaagtccttctgccagggggttaatcggtcagtttcaacacgccgacatccggcttgtaactggtcctatgggtccctgtctccgtcggcatcacgggccagatgtacccgtgattctgggaaagcgcttgctgaaagactctccacggctgctccctcgctgggcctcttgttggttggttaagagatctcacgttgagctgctgttaggtcacccgtacctgtcttatgttctgtag

SEQ ID NO: 230096 - DNA, 1767 bp, Artificial Sequence
  Description of Artificial Sequence: Synthetic coding sequence
atgtctgatacctccgagtctggggctgggctcacccgctttcaggctgaagcatcagagaaggattcctcctcaatgatgcagacactcctcaccgtcacccagaacgttgaagttcctgaaactcccaaagcaagtaaagcgactgaggtatccaagacacctgaagcacgcgaggcccctgccacacaggcaagtagtaccactcagctcaccgacactcaggtgcttgcagccgagaataagtctcttgctgcagacaccaaaaagcagaacgcagaccctcaggctgtaaccatgcccgcaactgaaacaaaaaaagtcagccacgtggcggatactaaggttaacaccaaagctcaagagaccgaggcggcaccctcccaagccccagcagatgagcctgaaccggaatccgctgccgctcagtctcaggaaaaccaggatactcggccaaaagtcaaagctaaaaaagcccgtaaggtaaagcacctagacggggaggaggacgggtccagtgaccagtcccaggcttccggcacgactggtggtagacgcgtctcaaaagcactgatggcatccatggcgagacgtgcctcacgaggtccaatcgctttttgggcacgacgagcatctcgcaccaggttggccgcttgggcgagaagggctttactttccctcaggtcccctaaagctcgaagaggcaaggccagaagaagagcggctaaactgcagtcatctcaggaaccggaagcccctcccccaagagacgttgcactcctgcaagggcgagctaacgatctagttaaatacctgctggcaaaggatcaaacaaaaatccctattaagcgttctgacatgctgaaggacatcattaaagagtacacagatgtgtaccctgagatcatcgagcgtgctggctactcactggagaaggtgttcggcatccagcttaaggagatagacaaaaacgatcatctgtacattctgctctctaccttggagcccaccgatgccggaattctaggaacaaccaaagacagccctaaactgggcctgctgatggtgctactgtctataattttcatgaatggaaatcggagcagtgaggctgtgatttgggaggtgctccgaaagctagggttaagacccggtatccaccactctctgtttggggacgtcaaaaagcttattacagatgagttcgtgaagcagaaatatctcgattacgcaagagtccctaacagcaatccccctgagtacgagtttttttgggggcttcggtcatactatgagacctctaaaatgaaggtcttgaagttcgcatgtaaggtccagaagaaggaccctaaagagtgggccgctcagtatagggaagccatggaggctgatttaaaagccgcagctgaggcagctgcggaggctaaggctcgcgctgaaatccgcgctcgcatggggatcggtctcggatctgaaaacgcggctggcccttgcaactgggatgaggctgacattggcccttgggctaaagctcgtatccaggctggcgcagaagccaaagccaaggctcaggagagtggatcagcatccaccggagcaagtactagtactaataattcggcttccgccagcgctagcacatctggcggattttcagccggagccagtctaactgccactctcaccttcgggctgttcgccggtctgggcggtgccggtgcaagcacgtctggatcctctggcgcttgtggcttcagttataagtag

SEQ ID NO: 230097 - DNA, 1653 bp, Artificial Sequence
  Description of Artificial Sequence: Synthetic coding sequence
atgtggcgcagccagaggcaccgacggccacaacgggtctccaaaacaccagaagccagagaagctccggcaacccaggctagtagtacaacacagctgacggatacccaagtgttagcagcagagaacaaaagtctcgcagctgacacaaagaagcagaacgccgatccacaggctgtcaccatgcctgccactgagactaagaaagtgtctcatgtggctgataccaaggttaataccaaggcccaggaaactgaggcagccccttctcaggccccagcagacgagcctgagccagaaagcgctgcagcacagagccaggagaatcaagatactcggcctaaagtcaaggctaaaaaagctaggaaagtgaagcacctagacggggaagaggatgggtcctcagatcagtctcaagcctctggcactacagggggtagaagggtctccaaggccctgatggcatctatggcacgtcgcgcaagcagagggccaatcgccttttgggcacgtcgggctagtcgaaccagactcgctgcctgggctaggcgagcactactgtccctccggtctcccaaagctcgacgaggaaaggcccgacgaagagcggcaaagcttcagtcttctcaggaacccgaggccccaccaccacgtgatgtggcgctcctgcagggaagagctaatgatctagtgaagtatttgctggcaaaggatcagactaaaatacccataaagagaagtgatatgctgaaggatattattaaggagtacactgacgtatatccagaaatcattgaaagagccggttactctctggaaaaggtgttcggtatacagctgaaagagatcgacaagaatgaccacctatacattctgctgtctaccctggaacccaccgatgctggtattctcggcaccaccaaggatagtccaaaactgggtttattaatggttttgctcagcatcatattcatgaatggtaatcggtcttctgaggcagtgatctgggaagtgctgcgtaagctggggctgcgcccagggatccaccattcacttttcggtgacgtcaagaaattaatcactgatgagtttgtcaaacaaaaatacctggattacgccagagtgccgaattcaaaccccccagaatatgaattcttttggggtttaaggagttattatgaaactagtaagatgaaagttttgaagttcgcatgtaaggtgcagaagaaggaccccaaggaatgggccgctcagtacagggaagccatggaagccgacctgaaggcggcagccgaagcggcagctgaagcgaaagccagggccgagattagggctaggatgggtatcgggctgggatccgagaacgctgctgggccatgtaattgggatgaggccgatatagggccttgggcaaaagcacggattcaagccggagccgaggctaaggcaaaagcccaagagagtggctcagcctcaaccggcgcaagcacatctacgaacaattccgcatccgcctccgcatccacatcgggcggtttctccgctggagcaagtctgacagccacacttaccttcggcctgttcgctgggctaggaggagctggagcctccaccagcggcagcagtggggcttgcgggtttagctataaatag

SEQ ID NO: 230098 - DNA, 1821 bp, Artificial Sequence
  Description of Artificial Sequence: Synthetic coding sequence
atgtcggatactagcgagtcaggagccggtctcacccgatttcaagccgaggcaagtgaaaaagactccagctcaatgatgcaaacactcctcaccgtaacccagaacgtcgaggtaccagaaacccccaaggcgtccaaggccctggaggtgtctgaggatgtgaaggtcagcaaggcaagcggtgttagcaaggccaccgaggtgtctaaaactccagaagctagggaagcccctgctacgcaggctagctcaaccacacaactgactgatacccaggtgttggcagccgagaacaagtcactcgccgctgacacgaagaaacaaaacgccgatcctcaagcggtaaccatgccagccactgaaaccaagaaagtctcccatgttgccgatacaaaggtcaacaccaaagcacaggagaccgaggccgctccatctcaggctcctgccgatgaacctgagcccgagtcagctgccgctcaaagccaggagaatcaggacacacgtcctaaggtgaaggccaagaaagctcgcaaggtcaaacacctggacggtgaagaagacggctcttcggatcagagccaagccagtggtaccaccggtggccgacgagtgtccaaggctctgatggcctcgatggcacgtcgtgcttcccgagggcctatcgcattttgggctcggagagctagccgcaccaggctcgccgcatgggctcggagggccctcctgtctttgcggtctcctaaggcacggaggggaaaagctcgaaggagagcagccaaattacagagttcccaggagccagaagctccccctccccgagatgtggccctgctgcaaggcagagcaaacgacctcgtcaagtaccttttggccaaggaccagaccaagatccccatcaaacggagtgacatgctgaaagatatcataaaggaatacactgacgtttatcctgagataatagagcgggctgggtatagcctggagaaggttttcggtattcagctcaaagagatcgataaaaacgaccacctttacatcctgctgtccaccctggaaccgacggacgccggtatcttaggaaccacaaaagacagtcccaagttggggttgcttatggtgcttctgagtattatcttcatgaatggcaataggtcaagcgaggcggtcatttgggaggtgttgcggaagctggggctgcggccaggaatccaccacagtctgttcggagacgtaaaaaaattgattacagacgagtttgtgaagcagaaatacctggattacgcaagggtaccaaactcaaatccccctgagtatgagtttttctggggcctcagaagctactacgagacgtcaaaaatgaaagtcttgaagttcgcttgtaaggtgcagaaaaaggacccaaaggagtgggctgcacagtaccgggaggcaatggaggcagatttaaaagccgctgcagaggctgctgctgaagccaaagccagagcagagatacgcgcacgcatgggaatcgggttgggcagtgaaaatgccgctggaccctgcaattgggacgaggcagacatcgggccatgggccaaggcccgtatacaagccggtgcagaagcgaaggccaaagcccaagagagtggcagtgctagcacaggcgcaagtacctccaccaataatagtgcatctgctagcgcgtccacgagcggcggattcagtgccggtgcttccctaacagccacactgacctttggcctcttcgctggattgggaggagccggtgcatctacgtcaggcagctcaggcgcttgtggattcagttacaagtag

SEQ ID NO: 230099 - DNA, 1821 bp, Artificial Sequence
  Description of Artificial Sequence: Synthetic coding sequence
atgtctgatacttcagaatctggcgcaggtctgactaggtttcaggccgaagcctcagaaaaagattctagctccatgatgcaaacccttctcacggtgacccaaaatgtggaagtgcctgagacaccaaaggcatccaaggccctggaagtgtcagaggatgttaaagtgagcaaggccagtggggtcagcaaggctacagaggtgtctaaaactccagaggctagagaagccccagcaacccaggcgagctctacgactcaacttacagacacgcaggtgctcgcggcagaaaataaatctttggcagccgacactaagaaacagaatgccgacccacaggcagtgaccatgcccgctaccgagacaaagaaggtgtcccatgtggcggacacaaaggtgaacaccaaagctcaggagacagaggccgcaccgtctcaagcaccagccgatgaacccgagcctgaatcggccgcagcccagtcccaggagaaccaggacacacggccaaaggtcaaggctaagaaggccagaaaggtgaagcaccttgatggggaggaggacggtagttctgaccagagccaggcaagcggtacaacggggggtcggagagtgagcaaagctcttatggcgtcaatggctagacgcgcttctcgcggtccaattgcgttctgggcacgcagagcatcccgcactcgcttggctgcttgggcgaggagggcactcctgagcctccgatccccaaaggccaggcgcggaaaagcgaggcgtcgagcggcaaagttacaatcgtctcaggagcctgaggcgcctccacctcgcgatgttgcactcctgcaggggagggccaacgacctggtcaaatatctcttggcaaaagatcagaccaagattccaattaaaaggtcagacatgttgaaagacataataaaggagtacacagacgtgtatcccgaaattatcgaacgagcgggatacagtctcgaaaaggtgtttgggatacagctgaaggaaatcgacaagaatgatcacctgtatatcctgctttcgaccctggaacctactgacgcgggaattctggggactacaaaggattcaccaaaactggggttacttatggtattactgagcattatttttatgaacggaaacagatcctctgaagctgttatatgggaggtgctgcgcaaactcggcttacgtcctggaatacaccacagtcttttcggcgacgtgaaaaaactgatcacagacgagttcgtgaagcagaaataccttgattacgccagagtccctaatagtaaccccccagaatatgaatttttctggggcctgcgaagctactatgagactagcaagatgaaggtactcaagtttgcctgcaaggtgcaaaagaaggaccctaaggaatgggccgcacagtacagggaggcgatggaggcggaccttaaggccgctgccgaagcagccgctgaggctaaggccagggccgagatccgcgctcgtatggggatcgggttggggtccgagaacgccgcaggaccttgtaattgggacgaggctgacattggcccttgggccaaagctagaatccaggccggagccgaggccaaggctaaagcgcaggagtccggctctgcctctacgggggcatccacaagcacgaacaacagcgcaagcgcctccgcctctacaagtggcggattttctgctggcgcatctctaacagcaacgctgaccttcggtctcttcgctgggctcggtggggctggagctagcacctctggatcctctggagcatgcgggttttcctacaaatag

SEQ ID NO: 230100 - DNA, 1566 bp, Artificial Sequence
  Description of Artificial Sequence: Synthetic coding sequence
atgtctgatacctccgagtcaggagcaggcctaacccggtttcaagcagaggcgtccgaaaaggactcttcgtctatgatgcaaacgctgctcaccgtgactcagaatgtcgaggtcccagagacccctaaggcttcatccactactcagctaactgacacacaggtgctggcagccgagaataagagcctggccgctgatacaaaaaaacagaatgccgacccacaggcagtgactatgcccgctaccgaaacgaagaaggtgtctcacgtagccgacaccaaagtcaacactaaggctcaggaaaccgaagccgcacctagtcaggctccagctgacgagcctgagcccgaatccgctgctgctcagagtcaagaaaaccaagatactcgacccaaggtaaaagccaaaaaggctaggaaggtgaagcacctggacggcgaggaagatggcagtagcgaccaatcccaggcctcaggaacgaccgggggtagaagggtgagtaaggccagacggagggctgcgaaactgcaatccagccaggagcccgaggcaccacctcctcgagatgtcgctcttctgcaggggagagcaaacgatctggtaaaatatttgctcgctaaagatcagacaaaaataccaataaagcgctctgacatgttaaaggatattattaaggaatatactgatgtgtacccagagattatcgaacgcgcagggtactccctggagaaggtttttggcatacagctaaaagagatcgacaagaatgatcacctctatatcctcttgagcacactggaacctaccgatgccggaatcctaggaacaacaaaggacagtcctaaacttggtttactcatggtgctgctgtctatcatttttatgaacggcaaccgcagttccgaggccgtaatatgggaagtgctgaggaagctgggactccggccaggaatccatcattcactgtttggagatgtaaagaaactcattactgatgaatttgtgaagcagaaatacctggattacgcacgggtcccgaatagtaatccaccagagtacgagtttttctggggactgagaagttactacgaaacatctaagatgaaagtcctgaagttcgcctgcaaagtgcagaaaaaagatccaaaagagtgggcggcacaatatagggaggcgatggaggccgatctgaaagccgctgccgaggctgctgctgaggccaaggccagggccgagattagagcccgtatgggtatcggactcggcagtgaaaacgcagctggcccatgtaattgggatgaggccgacattggcccatgggccaaggcaaggatacaggctggtgccgaagccaaagctaaggcgcaggagagcggtagcgcaagcacgggcgcatctacaagtacgaataattctgcttccgctagcgcgagtaccagcggagggttctcagcaggcgcaagtttgaccgccacactgacattcggcctcttcgctggtcttggaggagccggagcctcaacaagcggcagctctggcgcatgtggatttagttacaagtag

SEQ ID NO: 230101 - DNA, 1566 bp, Artificial Sequence
  Description of Artificial Sequence: Synthetic coding sequence
atgagcgataccagtgaatccggcgctggtcttactagattccaggccgaggctagtgagaaggattcatcgagcatgatgcaaacattgcttacagtaacccagaacgtggaggtcccagagacgcctaaggccagctcaacaacacagctaacagatactcaggttttggccgctgagaacaaatcactcgcggctgacacaaaaaaacagaacgctgaccctcaagcagtgactatgccagcgacggagacaaagaaagtgtcacacgtggccgatacaaaggttaacacaaaagcccaggagaccgaagcagctcctagccaggcaccagctgatgagcccgagcccgagagtgccgctgcacaaagccaggaaaaccaggatacccgacctaaagtgaaggctaagaaggcaaggaaagtcaagcatctggacggggaggaggatggctctagcgaccaaagtcaggctagtgggacaactggcggacggcgtgtctccaaagctagacgacgcgctgccaagttacagtcctctcaggagcccgaggcacccccaccgagagatgtggctcttctccaggggagggccaacgatttggtgaaatacctcttggctaaggaccagacgaagatcccaataaaaaggtccgacatgctaaaggacatcataaaagaatacaccgatgtttaccccgaaattatcgagagagccggatacagcctcgaaaaagttttcggaatccagctgaaagaaatcgataaaaacgatcacctgtacatcctgctctctacgttagaacctacggacgccggaattctggggacgacaaaagattctcccaagctgggactcctcatggttttgctgtccataatctttatgaatgggaatagaagcagcgaggcagtgatctgggaagttctgaggaagctcggcctcagacccggtattcatcactccctctttggagacgtgaaaaaattaataacggacgaattcgtcaaacagaaatatctggattatgcaagagttcctaattcaaacccccctgagtacgagtttttttgggggctccgctcctattacgagactagcaaaatgaaggtgcttaaatttgcttgtaaggtgcagaagaaagatcctaaggaatgggctgctcaataccgcgaggctatggaggccgaccttaaagcggctgccgaggccgcagccgaggctaaagccagagcggaaattcgcgctcggatgggcatcggtctgggctctgaaaacgccgctgggccttgtaattgggacgaggctgatatcggtccttgggcaaaggccaggatccaggctggcgctgaggccaaggcaaaagcacaggagagcggctcagcatcaaccggggctagtacgtctaccaacaactctgcctctgcgtcggcctccacatcaggaggcttttctgccggagcgtctcttaccgctactctcacctttggcctgtttgcagggctcggtggagcaggagccagtacaagcggaagtagtggagcctgtggtttctcctacaagtag

SEQ ID NO: 230102 - DNA, 1821 bp, Artificial Sequence
  Description of Artificial Sequence: Synthetic coding sequence
atgtctgacacctccgaatctggggctggactgacgaggtttcaggcggaagcttccgagaaggacagcagcagtatgatgcaaacacttcttacagtgacccagaacgtggaggttcctgagacacccaaagcttcaaaggctctagaagtaagtgaggacgtcaaagtaagcaaggcctctggagtgagtaaggctacagaggtgagtaagacccccgaggcaagagaagcgcctgcaacacaggcctccagcacaactcaactcacggacacacaggtgctagctgcggagaataagtctcttgctgctgacactaagaagcagaacgctgatccgcaggccgtgacaatgccagcaacagagaccaagaaagtcagtcatgttgctgatactaaagtgaataccaaggcccaggaaactgaagctgcaccctcccaggctcctgccgacgagcctgagcccgaatccgccgctgctcaaagccaggaaaaccaggacacacggcctaaagtaaaagcgaagaaagctcgcaaggtaaaacacctggacggggaggaggatgggagttctgatcagtctcaggcctctggcacgacgggcggtcggcgagtttctaaggcactcatggctagcatggctcgtcgagcttcgcgcggtccgatagccttttgggcgagaagagcctctagaaccaggctcgccgcatgggctagaagagcactgctaagcctccggtccccgaaggccagacgcggtaaagccagaaggcgggctgccaaacttcagagctctcaagaacccgaagcccctccccctagagatgtcgcgctcttgcaggggcgtgctaatgatctggtgaagtatttattggccaaagaccaaaccaagatccccataaagcgttctgatatgctcaaggacataataaaggagtacacagacgtgtacccggagatcatcgagagggccggatattccttagagaaagttttcggaatacagctgaaggagatagataagaatgatcatctgtacattctgttgtctacactggaaccgactgacgcaggaattttgggaaccaccaaagattccccaaaactgggcctgctcatggttctcctgtctatcatattcatgaacggaaacagaagttccgaggccgtgatctgggaggtactgcgcaagctcggcctacgtcctggaatccaccatagcctgtttggtgacgttaagaagcttataacagacgagttcgtgaagcagaaatatctggactatgcacgtgttcccaactctaatccccctgagtatgagtttttttgggggctgcgatcttactatgaaacttctaagatgaaagttctcaaatttgcatgcaaggtgcagaagaaagatcctaaagagtgggctgctcagtatcgcgaggccatggaggccgacttgaaggcggctgccgaagcagctgccgaggccaaagctcgcgctgaaatacgagctaggatgggtattggcctcggtagtgagaacgcagcagggccttgtaattgggatgaggccgatataggaccttgggctaaagctagaatccaggcaggagctgaggcgaaggcaaaggcgcaggagtccgggtcagcatcgactggcgcaagcacctccacgaacaatagcgctagcgcatctgcaagtacatccggcggattcagcgccggagcgtcgttgactgctaccctcactttcgggctatttgccggtctaggaggggcaggggcttccacatctggctcctcaggtgcatgcggattctcctacaagtag

SEQ ID NO: 230103 - DNA, 1821 bp, Artificial Sequence
  Description of Artificial Sequence: Synthetic coding sequence
atgagcgatacttcagaatccggagcaggcctcacccgctttcaggcggaagcgagcgaaaaggactcatctagtatgatgcagacattgctgacagtaactcagaacgtggaggtgcccgaaacgcctaaagcgtccaaggccctggaagtttccgaagacgtcaaggtctccaaagccagcggagtttccaaagcaactgaggtgagtaagacacctgaggccagagaagccccagccacccaggcctcgtcaacaacccagcttacagacacacaggtcctggctgccgaaaataagtccctcgctgctgatacaaagaaacagaacgctgatccacaggctgtaactatgccagccacagaaacaaaaaaggtgagtcatgtggcagacactaaagtcaataccaaggctcaggagacggaggccgcaccaagccaggccccagccgatgaacccgagcccgagagtgcggcagctcagagccaggagaaccaggacactcgacccaaagtgaaggctaaaaaagctagaaaggttaagcacctggacggggaggaagacggaagctcagatcagtcacaggcatcaggtacgacggggggtagacgggtgagtaaggccctcatggcctcaatggccaggcgagcatccagagggccaatagcattttgggctcgacgggcttctcgcactcgactcgccgcatgggcgaggcgtgccctactgtccctgagaagcccaaaagccaggaggggaaaggccaggagacgcgcagctaagctccagtcgtcacaagagccagaggcaccacctccaagggacgtagcactgttgcagggtcgcgcaaatgacctcgttaagtacctgctcgccaaggaccagacgaagatccccattaaacgcagcgatatgctcaaggacataattaaggagtacacagacgtgtatcccgagattatcgaacgtgccggatattctcttgaaaaggttttcggcatccagctcaaagaaatcgataagaacgatcatctatacatcctgctgagtactctggaacctactgatgccggaatattggggaccacaaaggacagcccgaagctgggactgttaatggtgctgctgagtattatttttatgaacggtaatcgaagctctgaagcagttatctgggaagtgctccgcaaactgggtctacgccctggtattcaccacagtctgttcggcgatgtcaagaagctgataactgacgaatttgtgaagcagaagtatctggactacgcacgagtgccaaatagcaatccgccagagtacgaatttttctgggggctgagatcgtattacgagacgtccaagatgaaggtgctgaaatttgcttgcaaggttcagaagaaagaccctaaggaatgggctgctcagtatcgtgaagcaatggaagctgatctgaaagcagccgctgaggctgcagccgaagccaaggcccgagccgaaatcagggccaggatggggattggacttgggagcgagaacgccgcaggcccatgtaactgggatgaagctgatatcggcccttgggcaaaagccaggatccaggccggagcggaggcgaaagccaaagcacaggaatccggaagcgcctctaccggcgcttcaacatcaacgaataactccgctagcgcttccgcctctacgagtggcggttttagtgccggagcaagcttaacggccaccctgacctttggtctattcgctggacttggaggggctggcgctagtactagcggctcttccggcgcttgcggattctcgtacaagtag

SEQ ID NO: 230104 - DNA, 2220 bp, Artificial Sequence
  Description of Artificial Sequence: Synthetic coding sequence
atggctgaggggagtttctctgtacagagcgagtcatactcagtggaagatatggatgagggatccgacgaggtcggggaagaagaaatggttgagggcaacgattacgaggaatttggcgcattcgggggttatgggactctcacatctttcgacattcacattttgcgagcgttcgggtccctcggcccaggcctcaggattttgtccaacgaaccttgggagctcgagaatccggtgcttgctcaaaccctggtcgaagccctgcagctcgaccccgagacgcttgcgaacgagacagcggcaagggctgccaacgtcgcaagagctgcagcatcaaacagggctgctcgagctgccgctgcagctgcaagaaccgcgttttctcaagttgtggcgtcgcaccgcgtggccactccgcaggtatctggagaggatacccaaccaactacatacgccgcagaagcacagggcccaacacccgagcctcccctggcttccccccagacctcccagatgctggtaacatcaaagatggcagctcccgaagctcctgcaactagcgcacagtctcaaactggctctccagcccaggaagcagcgacagagggcccatcctcagcctgtgcctttagccaggccccatgtgccagggaagtggatgctaacagaccgagtaccgcattcctcggacagaacgatgtgttcgacttcactcagcctgcaggcgtatcaggcatggcctttcccagacccaagcgaccagccccagctcaggaggccgcaacagaagggccttccgccgcttcaggagtgccgcagactggcccagggagagaagttgctgccactcggcctaaaactaccaaatccggaaaggcgctggctaagacgcgctgggtggaaccacaaaacgtggtggctgccgcagctgcgaaggctaagatggctacaagtatccctgagcctgagggggcagcagccgctaccgcgcagcactccgctgagccctgggcgcgtatgggtggcaaaaggacaaaaaagtccaagcacctcgacgatgaatatgaatcctctgaggaagagagagagacacccgctgtacccccaacttggcgggcatcgcagccctcactcaccgtacgagcccagctggcccctaggcctccgatggctcccaggtcgcagattccgagtagacatgtgctgtgtctgcccccaagaaacgtgacattgcttcaagaacgggctaacaagttagttaagtacctgatgatcaaagattataagaagatccctattaaacgggcagatatgctgaaggacgtgattagggagtatgacgagcattttcccgaaatcatcgagagggccacatatactctcgagaaaaaattcggcatccatttgaaagaaatagacaaggaagagcacctgtatatcctggtgtgcactcgggatagttccgctagactcctgggcaaaacaaaggacaccccacgactgtcacttttgctggtaatcctgggcgtcatattcatgaatggtaatcgtgccagtgaagcagttctgtgggaggcactgagaaaaatgggactccggccaggagtgagacatccctttttgggcgacctgaggaagctcatcacagacgactttgtgaagcagaagtacctcgaatacaaaaaaattccaaactctaacccacctgagtatgaattcttatgggggctaagagccaggcacgagaccagcaaaatgagggtgctgcgctttatcgctcaaaaccagaatcgggacccccgagagtggaaggcccacttcctggaggctgtggatgatgccttcaaaaccatggatgtggatatggccgaggaacatgccagggctcagatgagagctcagatgaacataggagacgaggccctaatcggacgttggagctgggatgacatacaggtcgaactgttaacttgggatgaagatggggatttcggagatgcatgggcccgtatcccgtttgccttttgggcacggtaccatcagtatattctgaactcgaatagggccaaccgcagagcgacctggagagcgggtgtctcaagtggcactaacggaggtgcctccacatctgtgctcgacggaccgtctacttcctccaccatacgaactcggaacgctgctcgcgctggtgcaagctttttcagctggatacagtag

SEQ ID NO: 230105 - DNA, 2274 bp, Artificial Sequence
  Description of Artificial Sequence: Synthetic coding sequence
atggctgagggatcctttagcgtccagtccgagagctactctgtcgaagatatggatgaggggagcgacgaggtgggggaggaggaaatggtcgagggcaatgactacgaggagttcggagcatttggtggctacggaactctgacgagtttcgacatacatattctccgggctttcggcagcctcggtccgggtctgcgtatactctcaaatgaaccttgggaacttgaaaatcctgtgctggcccaaaccctcgtggaggccttgcagctggatcccgagacattagctaatgagaccgccgctagggcggcaaacgttgcccgtgctgctgcaagcaatcgagctgcgagggcggctgctgcggctgccaggacggcattttctcaagttgtcgccagccacagggtggctactccccaggtaagcggagaggatactcagcccaccacttacgctgccgaggcacagggcccaactcccgaacctccactagcctccccccagacatcccagatgctggttacatctaagatggctgctccagaagctcctgctacttctgctcaatcacaaacaggctcacccgctcaggaagcagcaacagagggcccatcttccgcgtgtgccttttcccaggcaccgtgcgcaagagaggtcgatgctaacaggccctcgacagcattcctcgggcaaaacgacgtcttcgactttacccaacccgcaggtgtgagtggcatggcgtttccacgaccaaaaaggccagcaccggctcaggaagctgcaaccgagggaccctctgccgcaagcggtgtccctcaaaccggtcccggacgggaagttgctgctaccagacccaagactaccaaatcagggaaagcactggcaaaaacccgctgggtggagccccagaacgtggtcgcagccgcagccgctaaggccaaaatggcgacaagcattcctgaacctgagggcgcagccgctgctacagctcaacattccgctgagccttgggcaagaatgggaggaaaacggacgaagaaatcaaagcacctcgacgatgagtacgagtcaagcgaagaagagcgcgaaactcctgcagtgccgcctacgtggagagcatcccaaccttcccttaccgtgcgagctcagcttgcacctaggcctcccatggctcccagatctcagatcccttcccggcatgtgctgtgcctgccccctcgcaacgtcaccctccttcaggagagagccaacaagttagtgaagtatttaatgatcaaggattacaaaaagattcctatcaagcgggctgatatgctgaaggacgttatccgtgagtacgatgagcactttcccgaaattattgaaagagcaacttacaccctggagaaaaagttcggaattcatctcaaagagattgataaggaagagcacctttacatcctcgtatgtactcgggattctagtgcacggctacttggcaagacaaaggataccccccgtctgtctttgctcctggtcattctgggagtcatcttcatgaatgggaaccgggcttcggaggccgtgctttgggaggccctgcgtaagatggggttgagacccggtgtgcgccaccccttcctgggcgacttgcgtaagctaatcaccgacgactttgtgaagcagaagaatcccgagctgcgggaggagacccccctctccatggcgccaagttggtacttggagtacaagaagatcccaaattcaaacccacccgaatatgagtttttatggggcctccgggcaagacacgagacttcgaagatgagagttttgcgttttattgcccaaaatcagaatagagaccccagggagtggaaggcccattttctagaagctgtggacgacgcgttcaagacaatggatgttgatatggccgaagaacacgcaagggcccagatgcgcgctcagatgaacattggcgatgaggctctgatcggtcgctggtcttgggacgacatccaggtcgagctcctcacctgggatgaagacggcgactttggcgacgcgtgggctagaatccccttcgccttctgggccagatatcaccaatatatcctgaactctaatcgggcaaaccgccgagctacttggagagccggagtgtcatccggcactaacgggggagcatccacaagcgtgctcgatggccctagtacctccagcaccattaggacaaggaacgccgctcgcgctggagctagttttttttcatggatccagcatcgctag

SEQ ID NO: 230106 - DNA, 2226 bp, Artificial Sequence
  Description of Artificial Sequence: Synthetic coding sequence
atggccgagggtagcttctcagtgcaatccgagagctatagcgtggaggacatggacgaaggctcagatgaagttggcgaggaggaaatggttgagggaaatgactatgaagagtttggcgctttcggagggtatggcacgctgacctcattcgatatccacattctgcgcgcttttggcagccttggaccagggctccgcatactaagcaacgaaccctgggagcttgagaatcccgtgcttgcccagaccctggtggaagccctgcagctggaccccgagactctcgcgaacgagacagccgctagggctgccaacgtcgccagagccgctgcatccaaccgggctgcccgtgcagcagctgccgcagcccgtactgcgttttcccaagtggtggcctctcaccgcgtagccacgcctcaggtgtctggggaagatacccagcctaccacttatgctgcggaggcccagggacccacaccagagcctccactggcctccccacagacctcccaaatgctggtcacaagcaaaatggccgcacctgaagccccagccacatctgcgcagtcccaaaccggttcaccagctcaggaagctgctacagagggccctagctccgcatgtgccttcagtcaggccccatgtgcaagagaggttgacgcaaataggccctctactgctttcttaggccagaacgacgtgttcgatttcactcagcctgccggagtgagcggaatggctttccctaggcctaaacgccctgccccagcgcaggaggctgctaccgagggacctagcgccgctagtggagtcccccagaccggtcctgggcgtgaggtcgccgctactcgcccaaagactacaaagagtgggaaagctctcgccaaaacaagatgggtcgagccccagaacgtggtggctgctgcagctgctaaggctaaaatggctacttctatcccagagccagaaggcgcagccgctgccactgcccaacatagcgcggaaccttgggccaggatgggaggtaaaagaactaagaagagcaaacatctggatgacgaatacgagagctccgaagaggagagagaaacaccggctgtgcccccaacctggcgcgcttcgcaacctagcctgacagtgcgtgcgcagttagcccctaggcctccaatggctcccaggtcacagatcccaagtaggcatgtcctgtgccttccgccacgcaacgtaacactcctgcaagagcgagcgaacaagttagttaagtacctcatgataaaggattacaaaaagatcccgatcaagagagctgacatgttaaaggatgtcatacgtgagtatgacgaacacttcccggagatcattgagcgcgctacctatactctcgagaagaaatttggaatccacttaaaggagattgacaaagaggagcacctgtacatcttggtatgcaccagagattcaagcgccaggttactgggaaaaacaaaagataccccaaggctgtcattattgctggtcatcctaggggtcatatttatgaacgggaaccgtgccagcgaggctgtcctgtgggaagcccttcggaaaatgggtttaaggcccggagtcagacatccttttcttggggatctgcgaaaactcataaccgacgatttcgtgaagcagaagtacctcgaatacaagaaaatcccaaacagcaacccacccgaatatgagttcctgtggggattgcgtgcaaggcacgagacgtctaaaatgcgagtactgcggttcatagctcagaatcagaaccgggaccccagagagtggaaagcccacttcctggaagctgtggatgatgcattcaaaaccatggacgtggatatggccgaggagcatgccagggctcagatgcgcgcacaaatgaatattggtgacgaggcactcattgggcgttggagttgggacgatatccaggtggagctcctcacttgggatgaggacggcgattttggggacgcatgggcgcgaatcccatttgctttttgggcaagataccatcagtatattctcaacagcaaccgcgcaaacagaagagcaacatggcgcgcaggcgttagcagcggtaccaatggtggtgctagcactagcgtgctggacggtcccagcacctcgtctacaatcagaacgcggaatgcagctcgggctggagctagctttttttcatggatccagcacaggtag

SEQ ID NO: 230107 - DNA, 2220 bp, Artificial Sequence
  Description of Artificial Sequence: Synthetic coding sequence
atggctgagggaagtttcagtgttcagagcgagtcgtactcggtcgaggatatggacgagggcagcgacgaggtcggggaagaggaaatggtcgaaggtaatgattacgaggagtttggagcctttggagggtatggtactcttacttctttcgatatacatatcctaagagcgttcgggagcctaggtcccggactgcgcatcttgtcaaatgaaccctgggaacttgagaatcccgtgctcgcacagactctcgtagaggccctacaattggatcctgagactctggctaacgagacagccgctagggctgctaacgtggcgcgagccgcagcctctaatcgggctgcaagagccgcagccgctgccgcacggacagccttttcacaggtcgtcgcttctcaccgcgtggcgaccccccaagtatctggggaagacacccagcccaccacctacgcagcagaggctcagggccctacaccagaacccccactcgctagcccccaaactagccagatgctggtgacatctaagatggccgcacctgaggctcccgcaaccagcgctcagagccagacagggtctcctgctcaagaagctgctaccgagggtccttcttccgcctgtgctttctcacaggccccatgtgcacgggaggtggacgccaatagaccctcaacagccttcctgggacagaacgatgtgtttgactttacccaacccgctggagtgtctggcatggcttttccccgtccaaaaaggccggcaccggcacaggaggctgctacagaagggccatcggccgcaagcggagtgccccagacaggacctggaagagaggtggcagccaccagaccgaagaccacaaaaagcggtaaagctctggcaaagacccgttgggttgaaccccagaatgtggtggctgctgctgcggctaaggctaagatggccacttctattcctgagccagagggagctgccgcagccacagcgcagcactccgccgaaccctgggccaggatgggaggaaaaagaaccaaaaagagcaaacacctcgacgacgaatacgaatcttccgaggaagagagagagacacctgctgtaccccctacctggagggcatcacaaccctccctgactgtgagggcacagctcgcacccagaccgcctatggcccctcgctctcagattcctagccgccacgtgctgtgcctgccccctagaaacgtaacactcctccaggaaagggccaataaattggtcaaatatctgatgatcaaggattataagaaaattcccatcaagcgggctgacatgctgaaagatgtgattcgtgaatacgatgaacactttccagaaatcattgaacgggctacttacactctggagaagaagttcggaatccacctgaaagagatcgataaggaggaacacctgtatattctggtttgcacccgcgatagttccgccagactgttaggtaaaaccaaagatacacccagattgtccctgctgctcgttatactcggggtgatctttatgaatgggaaccgagcgtctgaggctgtgctatgggaagctctgcgcaagatggggttgcgccctggggtgaggcacccgttcctaggagacctgaggaagttgatcaccgacgatttcgtgaagcagaaatacctagaatacaagaagatccccaactccaacccgccagaatatgaattcttgtggggcctccgggctcggcacgaaacttcaaagatgcgggttctacgtttcattgcccaaaatcagaacagggaccccagggagtggaaagcccactttttggaggcagtggatgacgccttcaagactatggacgtggatatggcagaagagcatgcgagagctcagatgcgggctcagatgaatatcggggatgaagccctcataggtagatggagctgggacgatattcaagtggaactactgacatgggacgaagatggagattttggcgacgcatgggccaggattcctttcgccttctgggcaaggtatcaccagtacatcttgaatagtaacagggcgaaccggagagctacatggcgcgctggtgtgtcatctggaacaaacggcggtgcctctacctccgtgctcgacggaccttcaacctcttcaaccattcgcacaagaaatgctgcgcgagctggggctagcttcttcagctggattcagtag

SEQ ID NO: 230108 - DNA, 2274 bp, Artificial Sequence
  Description of Artificial Sequence: Synthetic coding sequence
atggccgaagggtcatttagcgttcagtccgagtcttatagtgtggaggacatggatgagggttcagacgaggttggcgaagaggaaatggtcgagggtaacgattacgaagagttcggcgcttttggtgggtatggtacccttacttcattcgacatacatatattgcgtgcttttggcagtctcggtccaggcctcagaatccttagtaacgaaccatgggaattagaaaatcctgtacttgcccaaactctcgttgaagccctgcagctggatccggagactttggcaaatgagactgctgctcgcgctgctaacgtggctcgggctgccgcatcgaatcgcgcagctcgggctgctgctgccgctgctaggactgcattttcccaggtggtggcaagccatcgcgtcgcaacgccacaggtctcaggagaggatacacagccaactacatacgccgctgaggcacaagggccaactcctgagccccctctggcaagcccccagacctcccaaatgctcgtgacttcgaaaatggctgctccggaagctcccgctactagtgcgcagagccaaaccggctctcccgctcaggaggccgctaccgaaggcccatctagcgcctgcgcttttagccaagctccctgcgcaagagaggtggacgctaataggcccagtactgcgttcttgggccagaacgacgtcttcgatttcacccagccggctggggtttcagggatggcattccccaggcccaaacgccctgcaccagctcaggaggctgcaacagagggtccttccgccgcatctggtgtgcctcagactgggcctggcagggaggtagctgctacacggcctaaaactaccaaaagcggtaaagctctcgcaaagacgcggtgggttgagccacagaatgttgtggctgccgcagcagcgaaggccaaaatggccacgtctattccagaaccagagggtgctgccgcagcaaccgcgcagcactcagctgagccgtgggcccgtatgggcggaaaacggactaaaaagagcaagcatctggacgacgagtacgaaagttccgaagaagaacgggaaacaccagctgttccacccacctggcgggcatctcagccgtctctgactgtgcgggctcaactggcccctagaccacctatggctcccaggtctcagatacccagccgtcatgtgctgtgtctgcctccacgaaacgttactctcctccaggagcgggctaataaacttgtcaagtacctgatgatcaaggactacaaaaagattccaatcaagcgcgctgatatgctcaaggacgtgatccgtgagtacgacgagcactttccagagattatcgagagagcaacgtataccctggaaaagaagtttggcatccatctcaaagagatagataaggaggagcacctttacattctcgtgtgcacacgagactcgtctgctcggttactaggaaaaacaaaggacacacctagattgtctttactccttgtgatcctaggtgtgatctttatgaacggcaatcgagcatcagaggccgtgctgtgggaagctttacggaagatgggcctgaggccgggagtacgccacccattcctgggggacctgcgcaagttgattacggacgacttcgtgaagcagaaaaatccagaactgagagaggagactccactctctatggcaccgtcatggtacctggagtacaagaagattcctaactcaaatccaccggaatacgagttcctgtggggcttacgcgctcggcacgagacgtcaaaaatgagggttttacgttttatcgcacagaaccaaaatcgtgatccaagggagtggaaggcccacttcctggaggccgtcgatgacgcgtttaagacgatggatgttgatatggccgaggaacacgcacgtgctcaaatgagagctcagatgaatatcggagacgaagccctgatcggcaggtggagttgggacgatatccaggttgagctcctcacatgggatgaggacggggatttcggtgacgcctgggctcgtattcctttcgctttctgggcaagatatcatcaatacatactcaacagcaatcgcgctaacagacgagcgacatggcgggcaggagtcagctctggaacaaacggaggggctagcaccagtgtactggatggcccttcgacaagtagcactattcggacaagaaacgctgccagggccggagcgagtttcttttcctggatacaacatagatag

SEQ ID NO: 230109 - DNA, 2226 bp, Artificial Sequence
  Description of Artificial Sequence: Synthetic coding sequence
atggcagaggggtcattttccgtccagagtgagagttacagcgtggaggacatggacgaggggagcgacgaggttggggaggaggagatggtggaagggaacgattatgaggagttcggcgcattcgggggttatggtactctcacatccttcgatattcatattctgagagccttcgggagtctgggcccaggcctgagaatactctctaatgaaccatgggaattggagaaccctgtgttagcacagacactggtggaggcattgcagctggaccctgagacacttgccaatgagaccgcggcaagggcagcaaacgtggcccgtgcggctgcatctaacagagccgcacgagcagcagccgctgcagcgaggacagcattttcacaagtcgtggctagccatagggtcgcgacaccacaggtgtcaggggaagacacgcagccaactacctacgccgctgaagcgcagggcccaacaccagagccacccttagcaagcccacagacaagtcagatgcttgtaacctctaagatggccgcaccagaggcaccagccactagtgctcaatcgcaaacagggagcccagcacaggaagccgctacggaaggaccatcttcagcctgtgctttttcccaagccccatgtgctcgcgaagtggacgcaaatcgacccagcacagcctttcttggccaaaacgacgtttttgactttacccagccagctggagtgtcgggcatggctttccctcgacccaagcggccagcaccggctcaggaggcggcaaccgagggtccttctgccgctagcggcgtaccacagacaggcccaggtagggaagtagccgcaaccaggcctaaaacaacaaaaagcggaaaggctttagccaagacacggtgggtcgagccccagaatgtagtggcggctgctgctgctaaagctaagatggctacatcaattcccgaacctgaaggtgccgctgctgccactgcccagcactcagcggagccgtgggcaagaatgggcggtaaaaggaccaagaaatcaaagcacctcgatgatgaatacgagtcatctgaggaggagcgagaaaccccggctgtgcccccaacatggagggcatcccaaccgtccctcaccgtccgggcacaactggcgcctcgtccccctatggcaccacgatcccagataccttctaggcacgttctgtgcctgcctcctcgcaacgtaactttgctccaggaacgagcgaacaaactcgtcaagtaccttatgattaaggactataagaagatccccattaagcgcgctgatatgctgaaagacgtgatccgcgagtacgacgagcactttcccgagattatcgagcgtgctacatataccctcgaaaagaagtttggtattcatctcaaagagatcgacaaggaagaacacctatatatcctggtgtgcacgagagactcatcagctaggctgttgggcaaaaccaaagatacgccccgactgtccctcctgctagtgattctcggagtgatttttatgaatggtaatagggcgtccgaggctgtgctgtgggaagccctcagaaagatgggcctgagacctggggttcggcaccctttcttaggcgatctacggaagttgataacagatgacttcgtgaagcaaaagtatttagaatacaagaagattcctaacagcaaccccccagagtacgaattcctctgggggcttcgagccaggcacgagacctccaaaatgagagtgttacgcttcattgcacagaaccagaacagagatcctcgggaatggaaagcgcatttcctcgaggccgttgacgacgcctttaaaacaatggatgtggatatggccgaggagcacgctcgcgctcagatgcgggcacagatgaacatcggtgatgaggccctgattggcaggtggtcttgggacgacatccaggtggagctccttacctgggatgaggatggcgactttggcgatgcctgggcacggatccccttcgccttctgggccagataccatcagtacatcctcaactccaacagggcaaaccggagagccacttggcgagccggtgtgtcaagcggcacgaatggaggtgccagcacctctgtgctcgatgggcctagcacatcctccacaatccgtacccggaacgccgcaagagcaggtgcatctttcttcagttggatccagcatcggtag

SEQ ID NO: 230110 - DNA, 2874 bp, Artificial Sequence
  Description of Artificial Sequence: Synthetic coding sequence
atgtccctggtgtctcaaaactcgagacgtagaagacgcagggtcgctaaggccactgctcacaatagctcctggggggagatgcaggcgccaaacgcccctggtcttccagccgacgtgcctggttcagacgtgccacagggacctagtgactcgcagattctccaggggttatgcgcatccgaggggccaagtacttcagtgttaccaacgtccgccgaaggaccttctacttttgtaccaccaactatctcagaggcttcttcggctagtgggcaaccgacaatcagcgaaggcccagggacgtcagtcctgccaacaccctctgaaggactctcaacgtctgggccacccacaataagcaaaggcttgtgtactagtgttacactagcagcttccgaaggaaggaacacaagtcgcccacccacgtcatctgaggagccctccacttcagttcctcctacggcctcagaggtgcctagcacgagtctcccccctactcccggtgaaggcacaagtacatcagtgcctcccacggcatatgaaggtccttccactagcgtggtgcctaccccagacgaaggccctagtactagtgtcctgccaactccaggcgagggtcccggaacaagtgtgccccttgccgctacagagggactctctacatctgtccaggccacacctgacgagggcccatcaactagcgtgccccctaccgccacggaaggtctaagtacacccgtcccacctacacgggatgagggaccctccacttccgtccctgcaaccccgggagagggaccaagcaccagcgtcttaccagccgcatctgatggtcagtccatcagcttggtgcctacccgaggaaaaggctcttctacatccgtgccaccgaccgccacagagggtctcagtacctcggtacagcccaccgcaggggagggcagtagtaccagtgtgccaccaacccctgggggaggcctgtccaccagcgtgccacccactgccacagaggagttgagcacgagtgtaccgcctacgccaggggaaggcccttctaccagtgtgcttcccatcccaggggaagggttatctaccagcgtgccaccaaccgcctctgacggatctgacacttccgtgccacctacaccaggtgagggcgctagcacactcgtacagcccaccgcacccgatgggcctggatcctcagttctgcctaacccaggagaggggcctagcactcttttctctagcagtgcatccgtggacagaaacccgagcaagtgttctctggttctaccgtctcctcgcgtgaccaaagcttccgtggacagcgatagtgagggacccaagggcgcagagggacccatagaattcgaggtgctcagagactgtgaatcacctaactcaatctccataatgggcctcaatacaagccgagtggcgattaccctcaaaccccaagacccaatggagcagaatgtcgcggagcttctgcagtttctgctggtgaaagaccaaagcaagtatccaattcgtgaatccgagatgcgcgagtatatagtgaaagaatacaggaaccagtttcctgagatacttcgcagggctgccgcacatctcgagtgtatattcaggttcgaacttcgggaattggatcccgaggcacatacttatattctactcaacaagctgggtccggtgccattcgaagggctcgaggagtcccccaatgggccaaaaatgggccttctaatgatgattctcggccagatctttcttaacggcaatcaggcaaaagaagcagaaatatgggagatgttatggcgtatgggagtgcagcgtgaacggcgactcagcatctttggcaatccaaaaagattgttaagtgtggagtttgtgtggcagcgatatctcgattacaggccagtgaccgattgcaagccagttgagtacgagttcttttggggaccacggtcccatctcgaaactaccaaaatgaagattctgaagttcatggccaagatttacaataaagacccaatggactggcccgaaaaatataatgaggctctcgaggaagatgccgctagagcctttgccgaaggatggcaggctttgccccattttcgccgtccttttttcgaagaggcagctgccgaggtgcccagtcccgacagcgaagtttcttcctactccagcaagtatgctccacactcctggcctgagtcacggctagaaagcaaagcacgcaaactggttcaattgtttctgcttatggactccaccaagcttccaatccctaagaaggggatactttactacattgggcgagaatgcagcaaagtatttcctgatcttcttaacagggcggctcgtacactcaatcacgtctatggaacggagttagtggtcctcgatcctagaaaccacagttatacgctgtacaaccgcagagaaatggaggagactgaggagatcgtggattctcccaaccggcctggaaataatttcctaatgcaggttttatcttttatcttcatcatggggaatcatgcccgagaaagtgctgtgtgggcattcttgaggggcctcggcgtacaggccggtcggaaacacgtgatcacctgcaggtatttgtcccagcggtatattgattctctgcgggtgcccgacagtgacccagtgcaatacgaatttgtctggggtccacgcgctcgactagaaacctccaaaatgaaagcgctcagatacgttgcccgaattcatagaaaggagccacaggattggccccagcagtatcgggaggccatggaagacgaggctaacagggcagatgtgggacatcgccagatcttcgttcacaacttcaggtag

SEQ ID NO: 230111 - DNA, 1572 bp, Artificial Sequence
  Description of Artificial Sequence: Synthetic coding sequence
atgtcattagttagtcagaacgccagacactgcagcgccgaaattacggcagattacggggacggcaggggggagatccaagccaccaacgcaagcggctctcccacatccatgctcgtggtggatgcaccccagtgcccccaggctccgataaattcacaatgtgtcaatacgtcccaggcggtccaggacccaaacgacctggaagttctgatcgacgagcagtccaggcgcctaggagcactgcgtgttcacgatccattggaggaccgatccatcgcgttggtaaactttatgcgaatgaagagtcagactgagggtagcattcagcagtccgaaatgctggaattcctgcgagaatacagcgaccagtttccggagatcctcagaagggcatcagcccacttagaccaggtgttcggcttaaatttgcgagttatcgatccccaggccgacacatataatctggtgtccaagcgaggcttccaaatcacagaccgcatcgcagagtctctggatatgccaaaggccagcctccttgctctcgtactgggacatatcctattgaacggaaacagagcgagagaggcaagtatttgggatctactgctgaaggtagatatgtgggacaaaccccaaaggattaacaacctgtttgggaatactcgcaacctcctgacaaccgattttgtctgcatgcgttttctggagtattggcccgtctacggtacaaaccctctagagtttgagttcctttgggggtcccgcgcacatcgcgagattacaaaaatggaagcactaaagtttgtttccgacgctcatgatgaggagccttggtcctggcctgaagagtataacaaggccctcgaaggagataaaaccaaggagcggagtctcacggcaggtctcgagttctggtctgaggacacaatgaacgacaaagccaacgacctggtgcagttagccatcagcgtgactgaagagatgcttcccatccaccaggatgagctgctggctcacaccggaaaagaatttgaagatgtcttcccgaacatcctgaacagggctacgctgattctggatatgttctatggcctctcgctgatcgaggttgatacctccgagcacatctacctcttggtgcagcagcctgagtctgaggaagagcaggtgatgttagagtcactcggccgtcccacccaggagtacgtgatgcctatcttgggcctgatattcctgatggggaaccgggtaaaagaggctaatgtttggaacctgttgcggaggttttcagtagacgtggggaggaagcacagtattaccagaaagctcatgcggcaacgctacctggagtgccggcctctgagttacagcaaccccgtcgagtacgaacttttatggggcccacgtgctcaccacgaaactataaaaatgaaggtcctggaatatatggctaggctgtatcggaaaagaccccagaactggcctgagcagtacagagaagccgtcgaggacgaggaagcaagagcaaaatctgaggccacaattatgttttttctggatccaacgtag

SEQ ID NO: 230112 - DNA, 924 bp, Artificial Sequence
  Description of Artificial Sequence: Synthetic coding sequence
atgctgcaaacccccgagagtcgcggtctccccgtgcctcaagctgagggtgagaaggatggaggtcacgacggcgagaccagggctcccactgccagtcaggagcgccctaaagaggagctgggcgctggcagagaagagggggcagcagaaccagccctcacacgtaaaggcgcaagagctctggctgctaaagccttggccagacggagggcataccggaggctaaatcgaactgtagctgagctggtgcagtttctgttggtcaaggacaaaaagaagagccctattactaggtcagagatggtgaagtatgtcatcggagacctgaagatcttattcccagatatcatcgccagggccgctgaacacttgcggtacgttttcggttttgaactaaaacagtttgacagaaaacaccatacctacatacttatcaacaaactgaaacccctcgaggaggaggaagaagaggatttagggggtgatggacctagactgggactgttgatgatgatcctgggactgatatacatgagggggaatagcgccagggaagcccaggtttgggaaatgttgagacggctaggcgtgcagccttccaagtaccattttttgttcggctacccaaagcgtctgatcatggaggactttgttcagcagcggtacctgtcgtatcggcgagtcccgcataccaaccccccagaatacgaatttagttggggtcctagatccaatctagaaatatctaagatggaggttctggggtttgtggctaaactgcataaaaaggagccacagcattggcctgtgcagtaccgcgaggctttggcggacgaggctgatcgcgcacgggctaaggctagagcggaggccagcatgagagccagggcttccgccagagcaggcatccacttgtggtag

SEQ ID NO: 230113 - DNA, 396 bp, Artificial Sequence
  Description of Artificial Sequence: Synthetic coding sequence
atggcaaggagccttgtttgccttggagtcatcatccttttgagcgcctttagtggcccaggcgtgcgcggtggccctatgcctaagcttgctgatagaaaactgtgcgccgaccaagaatgttctcaccctatcagcatggctgtggccctgcaggactatatggcccctgattgcagatttctgaccatacaccggggacaggtggtgtatgtcttctcaaagctcaagggtcggggacggttgttctggggaggatctgtgcagggtgactactacggcgacctggccgctagactcgggtacttcccaagctctatcgtcagagaggaccagaccttgaaacctggtaaggtggacgtcaaaacagataagtgggatttttactgccagtag

SEQ ID NO: 230114 - DNA, 642 bp, Artificial Sequence
  Description of Artificial Sequence: Synthetic coding sequence
atggcagaaacttacgactttctgttcaagttcctcgttataggttcagctggcacggggaagagctgcctcttacaccagtttattgaaaataaattcaaacaggattctaatcacacgatcggggtggagttcggatcaagagttgttaacgtagggggtaaaactgtgaagctgcagatctgggacaccgctggccaagaacgatttcgctctgtgacgcgatcctactataggggggctgctggggctttgttggtatatgatatcactagccgcgagacttacaattcgctggcagcctggctcacggacgctaggactctcgcctcaccaaacattgtggtaattctttgtggaaacaaaaaggaccttgaccccgagcgagaagtcacgtttctcgaagcaagccggtttgctcaggaaaatgagctcatgtttttggagacatcagctttaactggagagaacgtggaggaagcttttctgaaatgtgccaggaccatcctcaacaagatcgactcgggggaactagaccctgagcgcatgggttcaggcatccagtacggagacgcaagtctgagacaactgagacaacccagaagcgcacaggcagtcgcccctcagccatgcggctgttag

SEQ ID NO: 230115 - DNA, 366 bp, Artificial Sequence
  Description of Artificial Sequence: Synthetic coding sequence
atggcagagacgtacgactttctattcaaattccttgtgatagggagtgcaggcacaggcaaaagttgcttactgcaccagtttatagagaacaaattcaagcaagatagtaaccatacaataggcgtcgagttcggcagccgggtggtgaacgtagggggtaagactgtgaagctgcagatctgggatacagcgggtcaggagaggttcaggtctgttaccaggtcctactatcggggagccgctggagccttactggtgtacgacatcacacgggctgacgtgcctggggaccagcgaagtcatcggagggaacgcggagggggtgtgccccaggtctgcccgcattatccacaacaagattag

SEQ ID NO: 230116 - DNA, 396 bp, Artificial Sequence
  Description of Artificial Sequence: Synthetic coding sequence
atggccaggtcattggtctgcttaggagtgatcatccttctcagtgccttctcaggccctggagtgcggggagggcctatgccaaaacttgctgataggaagctttgcgccgaccaggagtgctcacacccgatttccatggccgtcgctctgcaggactatatggccccagactgccgattcctgacaatacatcggggacaagttgtgtacgtgttctcaaagctgaaagggcgaggtcgtctgttctggggcggatccgtgcaaggtgactattacggagatctagccgcacgattgggctattttcccagctctatcgtgagagaagaccagaccctgaagccagggaaagtcgatgtgaaaacagatacctcttcgtccaattcgtggtag

SEQ ID NO: 230117 - DNA, 2358 bp, Artificial Sequence
  Description of Artificial Sequence: Synthetic coding sequence
atggactccgtgccagctactgtgcctagcatagcagccacaccaggagatcccgagctcgttggcccacttagtgtgctgtacgctgccttcatcgctaagttactggagttggtggcaacactccccgacgatgtgcaaccgggtcctgatttctacggtctgccatggaagcccgtgttcataactgcattcctcggcattgcgtcctttgctatattcctctggcgcacagtcctcgtggtgactgacacactggtatctgtaacagaacagcagatctcagagaaattgaaaacgattatgaaagagaatacagagctggtgcagaagctatctaattatgagcaaaaaataaaggaaagcaaaaagcacgtccaggaaaccagaaagcagaacatgatcctcagtgacgaggcaatcaaatataaagataagatcaagaccctggagaaaaatcaggaaattctggacgacactgctaaaaacctgagggtgatgctggaaagcgaaagggagcagaatgtaaaaaatcaggacctgatctcagagaataagaagtcgattgaaaagctgaaagatgtgatctccatgaatgccagtgagttttcggaggtccagatagcactcaacgaggctaagctatccgaggagaaagttaagagtgagtgccaccgggtgcaagaagaaaacgctcgactgaagaaaaagaaggagcagctgcagcaggagatcgaagattggtcgaaactgcacgccgaactgagcgagcagatcaaaagctttgagaaatcccagaaggacctggaggttgcattgacacacaaagacgacaacatcaatgcgttgacgaactgtatcactcaattaaacctgctggaatgtgaatccgagagcgaggggcagaataagggcggtaatgattctgatgagctcgccaatggggaagtggggggagaccgcaacgagaaaatgaagaatcaaataaagcaaatgatggacgtatcacgtacccagacagccattagcgtggtcgaggaggatctgaagctgctgcagctgaagctcagggcctcggtcagtacaaagtgcaacctcgaagaccaggtaaagaagctcgaagatgatcgtaactctttacaggccgcaaaggccggactggaagatgaatgcaaaacgctgaggcagaaggtggagatcttaaacgaactgtatcagcagaaagagatggccctccagaaaaagctgtcacaggaagaatatgagcgacaggagagggaacatcgcctgtctgcagcagacgaaaaggcagtgagcgctgctgaggaggtaaagacctataagcgtcgtatcgaggaaatggaggatgagcttcagaagaccgaaagaagtttcaaaaatcagattgcaacccacgagaaaaaggcccatgagaattggttgaaggctagagccgcagagagggccattgctgaagagaaaagagaagctgccaatctgagacacaagctcctggagctcacacagaagatggccatgttgcaggaggaaccggttatagttaagcctatgccgggtaaacctaatactcagaatccccctagacggggacctcttagccagaatgggtctttcgggccatctcctgtgagcggcggagaatgctctcctccattgactgtcgaacccccagtgcggccactgagcgctaccttgaataggagggatatgccaagaagtgagttcggcagcgtcgatggacccctacctcatccacgctggagcgccgaggcgagcggcaagccatcaccatcggaccctggaagtggtaccgctacaatgatgaatagttcctccaggggcagttccccaacaagagttctcgatgagggcaaagtcaacatggccccaaaagggccaccacctttccccggagtgccgctcatgagcacaccaatggggggtcccgtacctcctcccattaggtatgggcctcccccacagttatgtggaccctttggacccaggcccctcccacctcccttcggacctggtatgaggcctcccctcgggctcagggagtttgctcctggcgtgccgcctggtcgacgagacctacctcttcatcctcgcggattcttgcctggtcacgccccattcaggccgctgggttcactcggaccacgagagtattttatcccgggaactcgacttccacccccaacgcacgggcctcaggaatatccccctccccctgcggtacgagatttattgcctagcggaagtcgggacgagccccctccggcatcccaatccaccagccaagattgttctcaggcgctgaagcagtcgccttag

SEQ ID NO: 230118 - DNA, 5546 bp, Artificial Sequence
  Description of Artificial Sequence: Synthetic coding sequence
atggctgcggcacctggcctgctcgtatggctgctggttttgcgactaccctggcgcgtgcctgggcagctggatcctagcacaggcaggcggtttagcgagcacaagttgtgcgccgatgacgaatgcagtatgttgatgtacaggggagaagcattggaggacttcactggacccgattgtaggttcgtgaactttaaaaagggcgatcctgtgtacgtgtactacaaacttgccagagggtggccagaggtgtgggcgggttccgtgggacggactttcggatactttccaaaggaccttatccaggtcgttcacgagtatactaaagaggagctgcaggtgcccacggacgaaaccgattttgtgtgcttcgatggcggtagagacgactttcacaattataatgtggaggaattgctgggctttctggagctctacaactccgccgctaccgattcagaaaaggctgtggaaaaaaccttgcaagatatggaaaaaaaccctgagctttccaaagaacgggagcccgaacccgagcccgtggaagcgaacagtgaagagagcgattcagtgttctcggaaaacacagaggacctgcaggagcagttcaccacacagaagcaccactcacacgctaattcccaagccaaccacgctcagggtgagcaggcttcttttgagtctttcgaggagatgttgcaggataagctgaaagtccctgagtcagaaaacaataagacctcaaactctagtcaggtatctaacgaacaggataaaattgatgcttacaaattactgaaaaaggaaatgactttggatctgaaaacgaagttcggcagcaccgccgatgcgctggtgtcagatgatgagaccacacgcctggtaacctccctggaagatgactttgacgaggagctggataccgagtactatgccgttgggaaagaggacgaagaaaaccaagaggatttcgatgaattaccattgttgacatttacagacggggaggacatgaaaacacctgctaagtctggggtagaaaagtatcccacagacaaagaacagaattcgaatgaagaagacaaggtacaattgaccgtcccccctggcattaagaacgatgacaagaacattctgaccacgtggggcgacactattttttcaatcgtgaccggcggtgaagaaactagagacactatggatttggagtcttcttcctccgaggaggagaaagaggatgacgatgacgcgctggtacctgacagcaagcaaggcaaaccacagtccgccacagactactccgaccctgataacgtcgacgatggcctttttatcgtagatatccctaagaccaataatgacaaggaggtgaacgcggagcatcatatcaaggggaaaggtcggggtgttcaagagtcaaaacgcggactggttcaagataagaccgaactggaagatgaaaaccaggagggaatgactgtgcatagttcagtccactctaataacctcaactctatgccagcagcagaaaaaggaaaagacaccctcaaaagcgcttatgatgatactgagaacgatctcaaaggcgctgccatacatatctcaaaggggatgctgcacgaagaaaaaccgggagagcagatcttggaaggcggatccgagtcggaaagtgcacagaaggcggcaggtaatcagatgaacgatcgaaaaatccagcaggaaagccttggcagcgcacctctcatgggcgatgatcatccaaatgcctcgagagattctgttgagggtgacgctctagtgaatggagcgaaacttcacacattatctgtcgagcaccagcgtgaggaattgaaggaagagctcgtactgaaaacacagaaccagcccagatttagctcacccgatgagatcgatctgccccgtgagttggaggatgaggtcccaatcttgggcagaaatttaccctggcagcaggaaagggatgtggcagcaacggctagcaagcagatgagcgaaaaaatccgactttcagagggagaagcaaaggaggactcccttgatgaagaattctttcaccacaaagccatgcaggggacagaggtgggtcagaccgaccagactgatagcacgggaggccctgcattcctatcgaaggtggaagaggacgactatccttccgaggaactcctggaggacgaaaacgctataaatgctaagcggtcaaaagaaaagaatcctgggaaccagggcaggcaatttgacgtcaaccttcaggtccctgatagagcggtgctaggaacgatccacccagaccctgaaatcgaagagtctaagcaagagaccagtatgatactggactccgagaagacatctgaaaccgcagcgaagggagtgaatacaggcggaagggaacccaacaccatggttgagaaggaaaggccccttgcagacaagaaagctcagcgcccattcgagcgcagcgatttttctgatagtatcaagatacagacccctgagttaggggaggttttccaaaataaagattcggactacctcaaaaatgacaatccagaggagcacctcaagacctctgggctagctggtgaaccggagggggaactgagcaaggaggatcacgaaaacaccgagaagtacatggggacagaaagtcaggggagtgctgcagctgagcctgaagacgattctttccactggaccccccacaccagcgtggagcctggtcattcagacaaaagggaggaccttcttataatatctagtttcttcaaagagcagcagagcctgcagcgctttcagaagtacttcaatgtgcacgaattggaggcactacttcaggagatgtctagcaaactcaaatcggcccaacaagaatccttgccatataacatggaaaaagtgctggacaaagtgttccgggcttctgagtcccagatattgagcatcgccgagaagatgctggatactcgggtcgcagagaaccgggacctcggcatgaacgaaaacaatatatttgaggaggcagcagtactggacgacatccaggatctgatctattttgtccgatacaaacactccaccgccgaagagacagctactctggttatggcaccaccactcgaagagggccttggcggagccatggaggaaatgcagcccttgcatgaggataatttctctcgcgaaaaaactgccgagctgaatgtccaggttcccgaggagccaacccatctggaccagcgggtgatcggtgatactcatgcttcagaggttagccagaaacctaacacagagaaggacctggaccccggacccgtaaccacagaggatacacccatggatgctatcgatgcaaacaaacagcctgaaaccgccgctgaggaacctgcctccgtgacccctctagagaatgctattttgttaatctacagctttatgttctacctaacgaagtctctcgtggcaactctccctgatgatgtacagccagggcctgatttttatggactcccttggaagcccgtttttattactgccttcctcggtatagcaagttttgccatttttctgtggcggaccgtcctcgtggtgagcaatacagtgtactacgtaacagaacagcagatttcagaaaagctcaaaaccatcatgaaagagaatacagaactcgttcaaaaactgtcaaactacgaacaaaaaatcaaagagtctaagaaacatgtacaagagaccagaaaacagaacatgatccttagcgacgaagcaatcaagtataaggacaagattaaaaccctggagaagaatcaggagatcctcgacgatacagcaaaaaacctgcgggtgatgttggagagcgaacgcgaacagaatgtgaagaaccaggatttgctgcaacaagagatcgaagattggtccaaactgcacgcagagctgtctgagcagataaagagctttgagaagagtcagaaggacctggaagtcgctctgacacataaagatgataatattaacgccttgaccaattgcatcactcagctaaacctgctggagtgcgagtccgaatccgaaggccagaataaggggggtaacgactccgacgagcttgcaaacggagaagtcggcggagatagaaatgaaaaaatgaaaaatcagatcaagcagatgatggatgtttctcgtacccagacagcaataagtgtcgttgaggaagacctgaagctgctgcaattgaaactgcgtgccagcgtttcaacgaagtgtaacctggaggatcaggtcaaaaaattagaggacgatcgcaattctctccaggcagcgaaagccggtctggaggatgaatgtaagactcttaggcagaaggtggaaatcctcaacgaactgtaccaacaaaaggagatggcattgcagaaaaagctgtcgcaggaagagtatgagcggcaggaaagggagcaccgtctcagtgccgctgatgagaaagctgtttccgccgcagaggaagtcaagacctacaaaagaaggatcgaggagatggaggacgaactgcaaaaaacagagaggtctttcaagaatcaaattgctacccatgaaaaaaaagctcacgaaaactggctgaaagccagggccgctgagcgcgctatcgctgaggagaaacgggaggcggctaacctgagacataagctgttggaactcacccagaagatggccatgttacaagaagagccagtgatcgtcaagcccatgccagggaagccgaacacccagaacccacctcgtcgaggaccactctcgcagaacggctcttttggcccttcccctgtgtcaggcggtgaatgcagtcctccgctcacagtcgaaccacctgtgcgtcccctcagcgctactcttaatcgccgtgacatgcccaggagtgagttcggcagtgtggatggtcccctcccacacccacgttggtctgccgaggcttctggcaagccctccccttctgatccaggcagcggaacagccacaatgatgaattcgtcttcacgcggtagtagccctacacgcgttttggatgaggggaaggtgaatatggcaccaaaagggcctcctcccttccccggagttcctctgatgtctactcctatgggtggacctgtgcccccaccaatccggtacgggccaccaccccaactgtgcggacccttcggacccagacctctaccacccccttttggcccaggtatgcgccctccactggggctgagagagtttgcaccgggagtgcctcccggtcggcgagacctccccttgcatcccagaggttttctgccaggccatgcgcctttcagaccactggggagcttaggccctagggaatatttcatacctggcacacgcctgccaccaccaacccacggaccccaggagtaccccccaccacctgcagtacgagatctgctccccagcgggagtcgggatgagccaccccctgcctcccagagcactagtcaggactgctctcaggcccttaagcagtctcctta

SEQ ID NO: 230119 - DNA, 2358 bp, Artificial Sequence
  Description of Artificial Sequence: Synthetic coding sequence
atggactccgttcctgccactgtccccagtattgccgctacaccaggggatcctgagctggtgggtcctttgtcggtactgtacgccgctttcattgctaaactgcttgagctcgttgctaccttaccagacgatgtccaacccggaccagatttttacggtttgccctggaagcctgtgtttatcaccgccttcttagggatagcttcatttgcgattttcttatggcgcactgtcctcgtggtaaaggaccgcgtgtaccaagtgacggagcagcagatctctgaaaaactgaaaacaattatgaaagagaacactgagctcgttcagaaactttcgaattatgagcagaagattaaagagtccaagaaacacgtgcaggagactagaaaacaaaatatgatcctgtccgacgaggccatcaagtataaagacaagatcaagactctcgaaaagaaccaggaaattctggacgataccgctaagaacctgcgcgtgatgctggagagcgaacgggagcaaaacgtcaaaaatcaagatttaatttccgagaataaaaaatcaatcgagaaactcaaagacgtcatttctatgaatgcatccgagttctccgaagtacaaattgcactcaacgaagcaaaattgtcggaagaaaaagttaaaagcgagtgccaccgtgtgcaggaagaaaacgccagactaaaaaagaagaaagaacagctgcaacaggagatcgaggattggagcaaactgcatgccgaactaagcgagcaaattaaatcctttgaaaagtcccagaaggacctcgaggttgctttgacgcacaaagatgacaatattaatgctctgacgaactgcataactcagctgaaccttctagagtgcgaatctgaatctgagggacagaataagggagggaacgactctgacgaattggcaaatggagaagtgggaggagacagaaatgagaagatgaagaaccagataaagcagatgatggatgtgtcaagaactcagactgccatctctgtagtggaagaagatctcaagttgttgcagctcaagctcagggcatcggtgagtactaagtgtaaccttgaggatcaggttaaaaaactggaggacgaccgcaattctctgcaggcagccaaggccggtctcgaagacgagtgcaaaaccttgcgacaaaaggttgaaattctgaacgagctctaccagcagaaggaaatggctctacagaaaaagttatcacaggaggagtacgagaggcaagagcgcgagcatcgactctctgccgctgacgagaaggccgtctcagccgcagaagaggtgaaaacctacaaacggagaattgaggaaatggaggatgagctccagaagaccgagagatcattcaagaaccagatcgcaactcatgaaaaaaaagcacatgagaactggcttaaggctagagccgcagaacgagctatcgcagaagaaaaacgggaggccgctaatttacgtcataaactcctcgaactgactcaaaagatggccatgctgcaagaggagccagtgatcgtgaagcctatgccaggaaagcccaacactcagaatccaccccgaagggggccactgagccagaatgggtcattcggcccaagccctgtgtccggaggcgagtgctcccccccactgacagtggaaccacccgtccggcctctctcagccactctgaatcgcagagacatgccacgcagtgagttcgggagcgtagatgggcctttgcctcacccaaggtggtccgcagaggcgagcggaaagccttccccatcagatccaggaagtgggaccgctaccatgatgaactcatctagcagaggaagcagccctacccgtgtcctcgacgaaggaaaggtcaacatggccccaaaaggaccccctccttttccaggggttccactcatgtcaactcccatgggtggacctgtgcctcccccaatccgctacggccctcccccacagctatgcggaccatttggaccacggccactcccacctcccttcgggccaggaatgagaccccctctcggccttcgagaattcgcccctggagtcccgccaggaagacgtgacctaccattgcatcctagggggtttctaccaggccatgctcctttccgccctttgggatcacttggtccccgagagtactttattccaggaaccaggctgccaccccctacgcatggacctcaggaataccctccgccacctgcggtgcgggatctgctcccttcgggatcaagggacgagccgccacctgcctcccaaagtacatctcaggactgttcccaagcccttaaacagtccccatag

SEQ ID NO: 230120 - DNA, 5723 bp, Artificial Sequence
  Description of Artificial Sequence: Synthetic coding sequence
atggcagccgctcccggactgctggtatggctgctggtcctgcggttaccatggagagtacctgggcaactggacccttctaccggtcgacgcttctccgaacacaagctgtgcgccgacgatgagtgttctatgctgatgtatcgcggagaggcactagaggactttactggacctgattgccgctttgtgaattttaagaagggagaccccgtttacgtatattataaactcgctaggggctggccggaggtctgggctgggtcagtcggccgaacctttggctacttcccaaaagatcttatacaggtcgtgcacgaatataccaaagaggaattgcaggttccgacagacgagactgactttgtgtgttttgatggtgggagggacgactttcataactataacgtggaggagctcctgggatttcttgaattgtataactccgccgctaccgacagtgagaaggctgtggaaaaaaccctgcaggatatggagaaaaaccctgagctttccaaagagcgggagccagagcccgagcccgtcgaggccaactccgaggagtcagactctgtcttcagcgagaacaccgaggacctgcaggaacagtttacaactcaaaaacatcattcccatgcgaacagccaggcgaatcacgctcagggggagcaggccagcttcgagagcttcgaagagatgctgcaagacaagttgaaagtccccgaatctgagaacaataagacgtcaaatagttctcaagtttccaatgagcaggacaaaatcgatgcatacaaactgctgaagaaagaaatgacgctcgatttgaagactaagttcgggagcaccgcagatgctttagtttcagatgatgagacgacgagactcgttacaagcctggaggatgattttgatgaggaactggatacggagtattacgctgtggggaaggaggacgaagagaatcaggaggattttgatgaactgccactactgacctttaccgatggagaagacatgaagacccccgcaaaaagcggagtggaaaaataccctactgacaaggagcagaactccaatgaagaggacaaggtgcagctcaccgtccccccaggaatcaagaatgatgataaaaacatccttaccacatggggagatacaatcttctccatcgtgacgggtggtgaggaaacccgggatactatggaccttgagtcttctagtagcgaggaagaaaaagaggacgacgacgacgctctagttccggacagcaaacaaggcaagccacagagcgcaacggactacagtgatcctgataatgtggacgacggtctgtttatagtggatatccctaagacaaacaacgataaagaagtcaatgccgaacaccacataaagggaaaggggagaggtgtgcaagaaagcaagcgcggtttggtccaggacaagacggaactagaggatgagaatcaagaaggcatgacagtccactcctcagtccactcaaacaacctcaactcaatgcccgctgcggagaaagggaaggatacccttaaatccgcttatgacgacaccgagaatgacctgaagggtgccgctatccatatttcaaaaggaatgctgcatgaggagaaacctggggagcagattctcgagggcggaagtgagtccgagtcagcccagaaggccgcaggcaaccagatgaacgatcggaagatccagcaagaaagtctgggttctgctccactgatgggggatgatcacccaaacgcaagccgcgattctgtggaaggcgacgccctggtcaatggagccaagctgcatacactgagcgtagagcaccagagggaggaactgaaggaggagctggtgttgaagacccagaaccagcctcggttctcttcccctgacgagatcgatctgcccagagagctggaggacgaggttcctatcctcggtcggaacttgccctggcagcaggagcgagatgtggctgccactgcatccaagcagatgtctgagaagatacgcttgagcgagggtgaagccaaagaggattctttggatgaggaattcttccaccacaaggctatgcaaggaaccgaggtggggcaaacagatcagacagactcgactggagggcctgcattcctttctaaagtcgaagaggacgactatccctcagaggagctgctggaagacgagaacgccatcaatgccaaacgatcaaaagagaagaatcctggcaaccagggacggcagtttgacgtgaacttacaagtgcccgacagggcagtgctgggcactattcaccccgacccggagattgaggaaagcaaacaggagacaagcatgattttagattctgagaaaacaagcgaaaccgctgccaagggagtgaatacgggtgggcgagaacccaacaccatggtggaaaaggagagacctcttgctgacaagaaggctcagagacctttcgaaaggtccgactttagtgactccataaaaatacagactcccgagctgggtgaagtgttccagaataaggacagcgattacttgaaaaacgacaaccccgaggagcacttgaaaacatcggggctggcaggagagcccgagggtgaactctccaaggaagatcatgaaaatacagaaaagtacatgggcaccgagagccagggaagtgcagcagccgaacccgaggacgacagttttcactggaccccacatactagtgtggaaccagggcactctgataaaagagaagacctgttgataatttcgtcattttttaaggagcaacaaagcctccagcggtttcagaagtactttaacgtccacgaactggaggcgctacttcaggaaatgtcctcgaagttgaagtccgctcagcaggagagtcttccctataatatggagaaggttttggacaaggtatttagggcatctgagagccagattctcagtatcgctgagaaaatgctcgacacgcgagtggccgaaaaccgcgacctgggtatgaatgagaacaatatcttcgaggaggccgctgttcttgacgatatacaagatctaatctattttgtgcgatacaaacactcaaccgcagaagagaccgctactctggtgatggcaccacccctcgaggagggcctcgggggagccatggaggaaatgcaacccttacatgaggataacttctccagggagaaaacagctgaactgaacgtccaggtgcctgaggaaccgacgcatttggaccagcgcgtgatcggtgacacacacgcctcagaggtgtctcaaaaaccaaatacggaaaaagatcttgaccccggacctgtaactaccgaggatacccccatggatgccattgatgccaacaagcagccagaaacggccgctgaggagcccgcttcagtgaccccactagaaaatgcaattctattgatttatagttttatgttttacttaactaaatcattagtagccactctacctgacgatgttcaacctgggccagatttctatggcttgccttggaagccagtattcataacagcgttcctgggcattgcaagcttcgctattttcttgtggagaacagttctagtggtgagcaacactgtctattacgtgacggagcagcaaataagcgagaaactgaagacaattatgaaagagaatacagaattggtacaaaagctcagcaattacgagcagaaaattaaggaatccaaaaagcatgtccaggaaacaagaaagcaaaacatgattctgtctgacgaggcaataaagtacaaggataagatcaaaaccctcgagaagaaccaggagatcctcgacgataccgcaaaaaatttacgagtgatgctggaatctgagcgagaacagaatgtcaagaaccaggatttgatatctgagaataaaaagtccatagaaaaactgaaggacgttatcagcatgaacgcttctgagttctccgaggtccagattgcactcaacgaggcaaagttgtctgaagaaaaggtgaagagcgagtgtcatagagtgcaggaagagaacgcgagactgaaaaagaaaaaggagcagctgcagcaagagattgaagattggagcaagctgcatgcagagctttcagaacagataaaatccttcgagaaaagccagaaagatcttgaggtggcgctgactcataaggacgataatataaacgccctgacgaactgtataacccagcttaatttactcgagtgtgaaagcgagagcgagggccagaataaaggtgggaacgatagcgacgagctggcaaacggagaggtgggtggcgacagaaacgagaagatgaaaaatcagattaagcaaatgatggacgtaagccgcactcagacggcaatcagtgttgtggaagaggatctgaagcttctccagctgaaactccgggcaagcgtttccacgaaatgcaatctggaggaccaggtgaagaaacttgaggatgacagaaatagtctccaggcagccaaggcaggactggaagatgaatgcaaaacattgcgccaaaaggtggaaatactcaatgagttgtatcagcagaaagagatggcactccagaagaagcttagtcaggaggagtatgaaagacaggagcgggagcatcggctgtcggcggctgacgaaaaggctgtgtccgctgctgaggaagtcaagacatataagagaagaattgaagagatggaggatgagctgcagaagaccgaacggtcttttaagaaccaaattgctacacatgagaaaaaggctcacgaaaattggcttaaggctagggccgctgagcgggcaattgccgaagagaaacgagaggctgcaaatctgagacataagcttctggagctgactcagaagatggccatgcttcaggaagaacctgtgatcgtcaaaccaatgcctggcaaacctaacactcagaacccaccccgtcgtggccctctgagtcagaacgggtcctttggaccatcccctgtgtccgggggagagtgctcccccccattgactgtagaaccaccggtgagacctttaagtgccacactgaatagaagagacatgcctcggagcgaattcggatcagtggacgggcctctgccacatcctcgctggtctgcggaagcctcaggtaagccaagccccagcgatcctgggagcggcaccgcaacaatgatgaattcaagttctcgcggttctagccctactcgagtgttggacgaaggtaaggtgaacatggcaccaaaggggccacccccattccctggagtcccattgatgtcaacacctatgggaggtccagtgcctcctcccatccgatacgggcctccgcctcaactttgtgggccattcggccctaggccgttacctcccccattcgggcctgggatgcgacctcctctcggcttgagagaattcgccccaggcgtacccccagggcgacgtgatctacctttacacccgcgaggctttctgcctggacacgctccatttaggcctcttgggtcacttgggccaagggagtatttcatacccggaacaagattacctcccccaacacacggaccgcaagagtaccctcctcctcctgcagtgagggatctcctgccaagcggatccagggacgaacctccacccgcttctcagagcacaagccaagactgtagccaggctctgaagcagtcccccta

SEQ ID NO: 230121 - DNA, 1503 bp, Artificial Sequence
  Description of Artificial Sequence: Synthetic coding sequence
atggccgcagcccctggattgctcgtctggctgctggtgcttaggctgccatggcgggtgcccggacagctggacccctccacagggcgtcgatttagcgaacacaaactctgcgccgacgatgagtgctccatgctaatgtaccggggtgaagctctggaagattttactggcccagattgtcgattcgtcaactttaagaagggcgaccccgtgtacgtatattacaagttagcccgtggatggcctgaagtgtgggccggaagcgtgggcagaacatttggttacttcccaaaggacctgatacaggttgtgcacgaatatacaaaggaagagctgcaggtgccaacagatgagactgactttgtttgttttgacgggggtcgcgatgatttccacaactacaatgtagaggagctccttgggtttctggagctttataactctgccgcaaccgactcagaaaaggcagtggaaaagacccttcaggacatggagaagaaccccgaactaagcaaagagcgggaaccagaacccgaacccgttgaagcaaacagcgaggaatcagactccgtgtttagcgagaacacggaggatctgcaagaacagttcacaacacaaaagcatcactcccatgccaattctcaggcaaaccacgcgcaaggcgaacaggcctctttcgagagttttgaagagatgctgcaggacaagttgaaagtcccagagagcgaaaacaacaaaacctcgaattcaagtcaagtctctaatgaacaagataaaatcgacgcgtataagttgctgaaaaaagaaatgactctcgacctgaagacaaagtttgggtccaccgccgacgctctggtgtctgatgacgagaccacccggttggtcaccagcctcgaggacgattttgacgaggaacttgatacagagtactatgccgtcgggaaggaggatgaagagaatcaagaggattttgatgagttgcccctgttgacattcaccgacggggaggatatgaaaacccctgccaagtccggcgtcgaaaaatatccaaccgacaaggagcagaacagcaatgaagaggataaggtccagcttacggtgccacctggaatcaaaaacgatgacaagaacattcttacaacatggggcgataccatattcagcattgtgacaggcggagaagagaccagggatactatggatttggaaagcagctcctcagaggaagagaaagaagacgatgatgatgcactggtgcctgacagtaagcagggaaagccacagtccgcaaccgattacagtgaccccgataacgttgatgatggtctctttattgtagatatacccaagaccaataacgacaaggaggttaacgccgaacatcacataaaaggaaaggggaggggtgtgcaagagtctaagcgcggtttggtgcaggacaagactgaattggaagatgaaaatcaggaagggttcaaaacagaacccatcaagctgtag

SEQ ID NO: 230122 - DNA, 5723 bp, Artificial Sequence
  Description of Artificial Sequence: Synthetic coding sequence
atggctgccgctcccggtttacttgtctggctgctcgtgctgcggttgccatggagagttccaggtcagctggatccaagcactgggaggaggtttagtgaacataagctgtgtgctgacgatgagtgctccatgctaatgtatcgcggtgaggccttagaggatttcaccgggcctgactgtagattcgtgaacttcaaaaagggcgacccggtctacgtgtattacaagctggcacggggttggccggaagtgtgggcaggttcagtaggtagaaccttcggctacttccctaaagatctgatacaggtagtccacgaatatacgaaggaagagctgcaggtccccacagatgaaacagacttcgtctgttttgatgggggacgtgacgattttcacaactacaatgtggaggagctactaggctttttagagctgtataattcagctgctacggacagcgaaaaagccgtggagaaaacgctgcaggatatggagaagaaccccgagttgtcaaaagagcgcgagccagaacccgaacccgtggaagcaaatagtgaagaatcggatagtgtgttcagtgagaacaccgaggacctacaagagcagttcaccacacagaagcaccactcacacgctaatagccaagccaatcatgctcagggagagcaggcaagcttcgagtcttttgaggaaatgctgcaagacaaactcaaagtgcccgagtccgaaaataacaagacttccaattcttcacaggtgagcaatgagcaggataagatcgacgcatacaaactactaaagaaagaaatgactcttgatctcaagaccaaattcggatccactgctgatgcactggtgtccgacgatgagacaacgaggcttgtaaccagtctagaggatgacttcgatgaagagctggacacagagtattatgccgtgggaaaagaggatgaggagaaccaagaggactttgacgaactgcccctgctcactttcactgacggggaggacatgaagactccggctaagtctggcgtcgaaaaatatcccacagacaaggaacagaattctaacgaggaggataaagtgcagctgaccgtgcctccagggattaaaaatgatgacaaaaacatccttaccacttggggcgacactattttctcgattgtgaccggtggcgaagagactagggacaccatggatctggagagctctagctctgaagaggagaaggaggatgacgacgatgctttagttccggattctaaacagggaaaacctcagtcggcgacagattattcagaccctgacaatgtcgatgatggacttttcatcgtagatattcctaaaacgaacaacgacaaggaggtcaacgccgagcaccacatcaaaggcaagggcagaggagtgcaagagtctaaaaggggactggtccaggacaagacagagttggaggacgaaaatcaggaagggatgaccgtccactctagtgtgcattctaacaaccttaacagtatgccggcagctgaaaagggcaaggatactctgaaatctgcctacgatgatactgagaatgacctgaaaggagcagccatacacatcagcaagggcatgctacacgaggagaagcctggggaacagatcctcgaaggcggatccgagagcgagagcgctcaaaaggcggctggaaaccagatgaacgaccggaagattcaacaagaatcactggggagcgcacctctgatgggggacgaccacccgaatgcctcacgcgactccgtggagggcgatgccctagtgaacggagccaaacttcataccctgagcgtggagcatcaacgagaggagctcaaggaagagttagtgctgaaaacacaaaatcagcctcggtttagcagtcccgacgaaattgacctgccaagggaactggaggatgaagtgcctattctggggagaaatttaccttggcagcaggagcgcgatgtggcagcaactgcatcaaaacagatgtctgagaagattagactatccgaaggcgaagctaaggaagatagcctagacgaggaattcttccaccataaggcaatgcaaggaactgaggtgggtcagacagatcaaactgacagtacggggggtcccgctttcctctcaaaggtggaagaggacgattaccctagcgaggagctgctggaggacgaaaatgccattaatgccaaacgaagcaaagaaaaaaatcctggaaaccaggggaggcaattcgacgtgaatctgcaagtgcctgatcgggctgttctggggactattcaccccgatccggagatcgaggagtcaaagcaggaaacttccatgatcctggattcggagaaaaccagcgaaacagccgcaaagggagtaaatacgggagggagagagccaaacaccatggttgaaaaagagagaccgttggccgataagaaggcccagaggccctttgaaaggagcgatttttccgatagcataaagatccagacccccgaactgggtgaggtttttcagaataaagattccgactatcttaaaaacgataaccctgaggaacaccttaaaaccagtgggctagctggggaaccggaaggagaactaagtaaggaggatcacgaaaataccgaaaagtacatgggcacagaatctcaggggtcagcggctgcggagccagaagatgatagctttcactggactcctcacaccagcgtagaacctgggcacagcgacaaacgtgaggatctcctcattatctcatctttctttaaagagcagcagtccctgcagcgcttccagaaatactttaacgtccacgaacttgaggcactgctgcaggaaatgtcctccaagctgaaatcagcccagcaggagtcccttccatacaacatggagaaggtcctggataaagtattcagggcaagcgagagccagattctctctattgctgagaagatgctggacactcgtgtagcagagaatagggacctgggaatgaacgaaaataacatcttcgaagaggccgctgttctggacgatattcaggacttgatttacttcgtacgctataagcatagtacggcagaggaaaccgccactttagtgatggctccccctcttgaggagggactcggaggagctatggaggagatgcagccactgcatgaggataacttttcgcgggagaagactgcagaactaaacgttcaagtgccagaagagccaacccatctcgaccaacgcgtgatcggcgacactcacgctagtgaagttagccagaagccgaacacagaaaaagacctggacccaggaccagtcactactgaagatactcctatggacgctattgatgctaacaaacaacccgagactgctgcggaggaaccggctagtgtgactccccttgagaacgccattttgctgatctatagcttcatgttttatctcacgaaaagccttgtggccacactgcccgatgacgtgcaaccaggccctgatttctacggtctcccttggaaaccagtcttcattaccgcatttctgggtatcgctagctttgctatcttcctgtggcgaactgtgctggtggtgaaggaccgcgtctaccaggtcacagagcagcaaatcagcgaaaagcttaaaacaattatgaaagagaacacagagcttgttcagaagctgtccaactatgaacaaaagattaaggagtcaaagaagcacgtccaggagacacggaagcagaatatgatcctgtcagatgaagctattaaatacaaagataagataaaaacactcgagaagaaccaagagatactagacgataccgcaaaaaatctcagggtaatgttggaatctgagagggagcagaacgtgaaaaatcaggacctaatttcagagaacaagaaatctatagaaaagttgaaggacgtcatttctatgaacgcatcagaattctcagaggttcagattgcgctcaacgaagctaaactttctgaagaaaaggtcaagagcgaatgtcatcgggtgcaggaagagaacgcacggctcaaaaagaaaaaggaacagcttcagcaagaaatcgaagattggtcaaagctccacgccgagctctccgagcagatcaaatcattcgaaaaatcccagaaggatctggaggtggccttaacccataaggacgataacattaatgccctcaccaattgtattactcagctgaatctgctggagtgcgagagtgagagcgagggacaaaataaaggaggcaacgacagcgatgagctggctaatggagaagttggaggagacaggaacgaaaaaatgaaaaatcagatcaaacaaatgatggatgtgtccaggacacagactgctattagcgtcgttgaggaagaccttaaactgttgcaactgaagctccgagcctccgtatctaccaagtgcaatcttgaagatcaggtgaagaaattggaagatgacagaaactccttgcaggcagccaaggcaggactagaggatgagtgtaagacgttgagacagaaagtggagatcctgaacgaactctatcagcagaaggagatggccctacagaagaaactgtctcaggaggaatacgaacgccaggagcgtgagcacaggctgagcgccgctgatgagaaagcggtgtctgcagccgaagaagtgaagacatataagagacgaatagaagaaatggaggatgagttgcagaaaacagaacgaagctttaagaaccagatcgcaacccacgagaaaaaggctcatgaaaactggctgaaggcgagggctgcagagcgagcaatcgcggaagagaagcgtgaagctgcgaacctgcgccacaagctccttgaattgacccagaagatggcaatgctgcaggaggagcccgtgattgtgaagcctatgcctggaaagcccaatacacagaaccctccaagacgcggacccctcagtcaaaatggcagcttcgggccttccccagtttcaggaggggagtgtagccctccgctgacagtggagccacctgtccggccactttccgccaccctgaatagaagagacatgcctcgctctgagtttggcagtgtagatggccctctgcctcaccctagatggagcgctgaggcttctggcaaaccatccccgagtgacccaggcagcggcactgctaccatgatgaactctagtagccgaggctctagtcctactcgcgtactggacgaagggaaggtaaatatggccccaaagggccctcctccattccccggtgttcctttgatgagcacacccatgggcggacccgttccccctcctatccgctatggcccaccccctcagctgtgcggcccattcgggcctaggccactaccccctccatttgggccaggcatgaggcctcccttaggattacgggagttcgctccaggagttcctccagggaggcgggatctgcctctgcaccccagggggtttctgccagggcacgccccatttcggcctctcggcagcttgggacctagagagtacttcatacctgggactcgtctgcctcccccaactcatggaccccaggagtaccccccaccaccagccgttcgagatctgctcccaagtgggtcgagggatgagccccctccggcttctcagtccaccagccaggactgttcacaggctctcaagcagtcacctta

SEQ ID NO: 230123 - DNA, 3051 bp, Artificial Sequence
  Description of Artificial Sequence: Synthetic coding sequence
tgactggtcccagatagcaagcaagggaaacctcagtccgctactgattattccgaccctgacaatgtagacgacggcctgtttatcgttgatatccccaaaaccaataacgacaaggaggtgaacgctgaacaccacatcaagggtaagggacgcggtgtgcaggagagcaagcgaggcctggtgcaggataagaccgagctggaggatgagaaccaggaaggcatgaccgtgcattctagtgttcactcaaataacttgaactcgatgccagctgccgaaaagggtaaagatacccttaaatcagcctacgatgacaccgaaaacgatcttaagggagccgctatccatattagcaagggaatgctccacgaagaaaaacccggtgagcagatactggaaggcggaagtgaatccgagagcgcacagaaagcggctgggaatcagatgaatgatagaaaaatccaacaggagtctctggggagcgctcccttgatgggggatgaccatcccaacgctagtagggactccgtcgaaggcgacgcgttggtgaatggcgcaaagctgcataccttatccgtggaacaccagcgcgaggagcttaaggaggagctcgtcctgaaaacccagaatcagccaaggttcagtagccctgatgagatcgatctgcccagagaacttgaagacgaagtacccatcttgggacgcaatctcccttggcaacaggagagggacgtcgcagccactgccagcaagcagatgagcgagaaaatacgtctgtctgagggggaggccaaagaagacagcttggatgaggagttctttcaccacaaagccatgcagggtacagaggtagggcagacagaccagactgacagcactggcggacccgcattcctatccaaggtggaagaagacgactacccttctgaagaactcctcgaggacgaaaacgcaatcaatgccaagaggagcaaggagaagaatcccggaaaccagggcagacaattcgatgtgaacttgcaggttcctgatcgagccgttttgggaacaatacaccctgatcctgaaattgaggaatccaaacaggagaccagcatgatacttgatagcgaaaaaacctcagagacggcggctaaaggggtcaacaccggtggcagggagccaaacactatggttgagaaggaacgtccgcttgcagacaaaaaagctcagcgccctttcgagcggtcagatttttccgactccattaagatccagacacccgagctgggagaggtgtttcagaataaggactcagactacctgaagaacgacaacccagaggaacacctgaagacctctggacttgctggagaaccggagggggaactgtcaaaggaagaccatgagaatactgagaaatacatggggaccgagtcacagggttcggcagccgctgaaccagaggatgattctttccactggacgccgcacacctctgtcgagcccggacactcagataagcgggaagatttgctgatcatctcttccttctttaaggaacaacaaagcttgcaaaggttccagaaatactttaatgtgcatgaactagaagcacttctacaggaaatgtcctccaagctgaagtccgcccagcaggagagcttaccttacaacatggaaaaagttttagataaagttttccgggcttcagagtcccaaattctaagcatagctgagaagatgctggacacacgggttgccgagaatcgggaccttggcatgaatgagaataatatcttcgaggaggcagccgtgctcgatgacatccaggacctgatttacttcgttaggtacaaacatagcacagccgaggagactgctactctggtaatggcccctccgctcgaggagggactgggtggggcaatggaagaaatgcagccacttcacgaagataacttcagcagggagaagacggccgaattaaatgtgcaggtgcctgaggaacctacacacctggaccagagagtaatcggagacacgcatgcttcagaagtgtctcagaagccaaacacagagaaggatctggaccctgggcctgtgaccacggaggacacacctatggacgccatcgacgccaacaagcagccagagaccgccgctgaggagcccgcaagcgttactccactggaaaacgccatccttctgatctacagcttcatgttctacctcaccaagtcactggttgctacactgccagatgacgtgcagccaggtccagacttctatggactcccctggaagccggtgttcattacggcctttctcggaattgcctcctttgctatcttcctttggcgcacagtactagtggtgaaagatagagtctatcaggtgactgaacagcagatttcagaaaaactgaagacaattatgaaagagaatacggaattagtccagaaactgagtaactatgaacagaagattaaggagtccaagaagcatgtgcaagaaactagaaagcagaacatgatactaagcgatgaggccatcaaatacaaggacaagatcaaaactctggaaaagaatcaggagattttggacgataccgctaagaatctccgggtaatgctcgaatccgaaagggaacaaaacgtgaaaaatcaggatctgctacagcaagaaattgaagactggtccaaattgcacgcagagttgtcagaacagatcaaaagttttgagaagtcccagaaagaccttgaggtggcactgacccataaggacgacaatatcaacgccctgaccaattgcattacccagttaaacttactggaatgtgagagcgaaagcgagggacagaataagggagggaacgactcggacgagctagccaatggagaagtcggtggggataggaatgagaagatgaagaaccagataaaacagatgatggatgtgtctcgcactcaaacggccatctcggtcgtggaagaagatctcaagcttttgcagctgaagctccgagcttcagtgtccacaaagtgtaatttagaagaccaagtttag

SEQ ID NO: 230124 - DNA, 324 bp, Artificial Sequence
  Description of Artificial Sequence: Synthetic coding sequence
tagtcggcggaagcttctggtaaaccaagtccaagcgacccgggttccggcactgccaccatgatgaattccagcagtcgcggttcttcacccacaagggttctggacgagggcaaagttaacatggctcctaaaggcccaccccctttccccggtgttccactgatgtctaccccaatgggagggcctgtgccaccccctattcgctatgggccacctccccagctatgcggccctttcggacctaggcctctcccaccgccatttgacaaagatggcagaccaggcactgtcgcacacgcttgtaaccccagtacattgtag

SEQ ID NO: 230125 - DNA, 1803 bp, Artificial Sequence
  Description of Artificial Sequence: Synthetic coding sequence
atgggtaagaagctggatctgagcaaattaacagatgaggaggctcaacacgtactggaggtggtgcagcgcgacttcgatctgcgcagaaaggaagaggagcgcctggaagcacttaagggcaagatcaaaaaggaatctagcaaaagggagctgcttagcgataccgcacacctcaatgagactcactgtgcaaggtgcctccagccgtatcagttgcttgtgaacagcaaaagacagtgtcttgaatgcgggctatttacatgtaagtcttgcggacgggtgcatccagaagagcaaggctggatatgcgatccttgtcacttggctagggtggtgaagattggatcactcgagtggtactatgagcatgtcaaagcgcgatttaagcgctttggtagcgctaaggtgatccgttccttgcatggcaggctgcaagggggagccggtccagaacttatttctgaggagaggtccggcgacagcgatcaaaccgacgaagatggagaacctggcagtgaggctcaagcgcaggctcagccttttgggagcaaaaagaagaggctgttgagcgtgcacgattttgactttgaaggggattccgacgatagcacccagccacagggtcactctctgcatctctcctccgtgcctgaagcccgagactccccacagtccctgactgacgagagttgtagtgaaaaggctgctcctcataaggctgaaggtctggaggaagcggataccggagcttccggttgccattcccatcctgaggagcagcctacgagcattagcccctctcggcatggggcactggccgaactgtgccctcccggagggtcccaccggatggctctgggaacggcggcagcccttggatccaatgtaattaggaacgagcagttgcctttacagtatttagcagacgtggacacaagtgatgaggagtccatcagagctcacgtcatggcctcccaccattctaagaggcgaggtcgcgcttcatcagaatcacaaatatttgaattgaacaaacatatttcagccgtggagtgcctgctgacctacctggagaacactgtggtgccacccctggctaaaggtctcggcgcaggcgtcagaacggaggcagacgttgaggaggaggcccttagacgtaagttggaagagttgaccagcaatgtatccgaccaggagacctcatccgaggaagaggaagccaaagacgagaaagcggagcctaatagggacaaatctgtcggtccacttccgcaggccgaccctgaggtgggcaccgccgctcaccagacaaaccgacaggagaagtctcctcaggacccaggcgatcccgtccaatataatcggacgacagacgaagagctctccgagttggaagacagagtggccgtcacagcatcggaggtgcagcaggctgagtcagaagtgtccgacattgagtcccgcatagctgcactgcgtgccgctggactgacagtgaaaccttctgggaagcctaggagaaaaagtaacctgcctatctttttacccagggtcgctggtaagcttggtaagcgacccgaggaccctaatgctgacccctctagcgaagctaaggctatggccgtcccctatctgctgcgcaggaaattctccaactctttgaagtcccaggggaaggatgatgattcgttcgatcgtaagagtgtgtataggggctccctcactcaacggaacccgaacgctagaaagggcatggctagccataccttcgctaaacctgtggtggctcatcaatcttag

SEQ ID NO: 230126 - DNA, 1719 bp, Artificial Sequence
  Description of Artificial Sequence: Synthetic coding sequence
atgggaaagaagctggacttgtcaaaactgacggatgaagaggcccagcacgtgctggaagtcgtacaaagggattttgatttaagaagaaaggaggaggaaaggctggaagcccttaagggaaaaatcaaaaaggagagctccaagagggagctgctgagcgacacggcgcacctgaatgagacacattgcgcgagatgtctccaaccatatcagctcctggtcaattcaaaacgtcagtgcctggagtgcgggctgtttacctgtaaaagctgtggtcgggttcatccagaggagcagggctggatttgcgatccatgccatctggcgcgagtggtcaaaattggatcactggaatggtattatgagcatgtgaaagcacgctttaagagatttggcagcgccaaagtaatcaggtcacttcatgggagactgcagggcggagcagggcctgagttgatcagtgaagagagatccggcgactcagaccaaactgatgaggatggagaaccgggtagcgaagcacaggcccaagcccaaccatttgggtccaagaagaaaaggctactgagcgtacatgactttgacttcgaaggggacagtgacgactctacccaaccgcagggacacagtctgcatctgtctagtgttcctgaggccagagacagcccccagagcctgactgatgagagttgtagcgagaaggctgccccacataaggccgagggtctggaggaagccgataccggggctagtggctgtcactcccacccagaggagcagccgacaagcataagcccaagccgacatggggcattggccgagctgtgcccgcctgggggtagccaccgcatggctctgggcactgcggctgcgctcggaagtaacgttatccggaacgagcagctgcccctccagtaccttgccgacgtggatacttccgatgaggaatcaattcgcgctcacgtcatggccagtcatcacagtaagaggcggggtagagcatcctctgagagtcagggcttaggggctggtgtccgtaccgaggcagacgtcgaggaggaagcgcttagacgtaaattggaagagctcaccagcaatgtgagtgatcaggaaacgagctctgaggaggaagaggccaaagacgagaaagctgagcctaacagggacaagtctgtcggcccattaccccaggcagatccggaggttggtaccgccgctcatcaaactaatcgccaggagaagtccccacaagatcccggagatccagtgcaatacaacagaaccactgatgaggagttgtctgaactggaagatcgagtggccgtgactgcctcagaagtacagcaggcagagtccgaggtctcagatatcgagtcccggatcgcagcattgcgggcagccggactcacagtgaaaccgtcagggaagcccaggcgtaaatccaaccttcccatcttcttgccacgggtcgccggtaaattgggcaagagacccgaagatcccaacgcagacccttccagcgaggctaaggcgatggcggtgccatacctgctgaggagaaagttctctaacagtcttaagtctcagggaaaagacgatgactccttcgataggaaatcagtgtaccggggaagtctgactcagcggaaccctaacgctcggaaagggatggcctcccacacttttgcgaaaccagtggtggcacatcaatcctag

SEQ ID NO: 230127 - DNA, 396 bp, Artificial Sequence
  Description of Artificial Sequence: Synthetic coding sequence
atggggaagaaactggacctgtctaaactgacagacgaagaagcccaacatgttttggaagtggttcagcgtgatttcgatcttagaagaaaggaggaggagcggctagaggccctcaagggaaaaatcaaaaaagaatccagcaagcgggaactgctgtccgatacagcccatcttaacgaaacccactgtgccaggtgtctccagccctatcaactgctggtcaattccaaacggcagtgcctcgagtgtggacttttcacttgcaaatcctgtggcagggttcaccctgaggagcagggctggatctgcgatccttgtcacctggccagggtggtgaaaattggatccttggaatggtattacgagcatgttaaagccaggtttaagaggtag

SEQ ID NO: 230128 - DNA, 213 bp, Artificial Sequence
  Description of Artificial Sequence: Synthetic coding sequence
atgggcaaaaaactcgatcttagtaaactgacagacgaggaggcccagcatgttctcgaggtggttcagagagatttcgacttgcggagaaaagaagaagagcggcttgaggccctgaagggtaagatcaaaaaagagtcctccaaacgcgagcttttatccgacacggcccatcttaacgaaactcactgtgccagatgcttacaaccctag

SEQ ID NO: 230129 - DNA, 1656 bp, Artificial Sequence
  Description of Artificial Sequence: Synthetic coding sequence
atgggaaagaaattggatctgtccaaactgacagatgaggaggctcagcacgtgctggaggtcgtacagagggattttgacctaaggagaaaggaagaggagaggctggaggcactgaaaggaaagattaagaaggaatcatctaaacgggagctcttaagcgacacagcccaccttaatgagacccattgtgctcgctgcttgcagccctatcaactgctcgttaactctaaacgccagtgcctggaatgcggtctgtttacttgcaagagctgtggtcgcgttcacccagaggaacaggggtggatctgcgacccctgtcatcttgctagggtagtgaaaatcggatcactcgagtggtattatgagcacgtcaaagccagatttaaaagattcggttcagcaaaggtaatacgtagcctgcacggacggctgcaaggcggtgccggaccggagctgatctctgaagagagatcaggggatagcgatcagaccgatgaagacggcgagcctggaagcgaggcccaggcccaggcccaaccctttggctctaagaagaagaggctcttgtctgttcacgactttgactttgagggcgacagtgatgattctacacaacctcagggacacagccttcatctctccagtgtgccggaggctagggactcgcctcagagcctgacggacgaaagctgctctgaaaaggctgcccctcataaggctgaagggttagaggaggcagataccggcgctagtggttgccatagccatcctgaggagcagcccacttctatctcacctagtaggcacggtgccctcgcagaactgtgccctcccggaggcagccacagaatggcgcttggcacagcagctgccctggggagtaatgtgataaggaatgagcaactgcccttgcagtatttggccgacgtggacacgagtgatgaggagtcaattcgagcacacgtcatggcaagccatcattcaaagcggaggggcagagccagcagcgagtctcagatcttcgagctcaacaaacacatttcagccgtggaatgtctgcttacctatctagaaaacacagtggtaccacccctcgccaaagggctgggagcaggcgttagaacggaagcggatgtggaagaggaagccttaaggcgaaagctcgaggagctgacttccaacgtgtcagaccaggaaacgtctagtgaggaggaggaggcgaaggatgagaaagctgaacctaatcgggataagtctgtgggtcctctcccacaggcggatccagaagtcggaactgccgcacaccagaccaatagacaagagaagagtccccaggaccctggagaccccgtacagtataaccgcactaccgacgaagaactcagcgaattggaggatcgcgtggctgtaacagcatccgaggtgcagcaggccgaatccgaagtgtccgatattgagagtaggatagctgcattgagagctgcaggattgacagtcaaaccctcgggcaagcctaggagaaaaagcaatttgccggcattgtatgaggggacgttaagtctctgttccgaagacctgaagcacacacaccctgactctgtgaagtccaagagatctagattgaaccatgttgcatcctgtgggaatccctag

SEQ ID NO: 230130 - DNA, 675 bp, Artificial Sequence
  Description of Artificial Sequence: Synthetic coding sequence
atgggtctgagggactggttaagaacagtgtgttgttgctgcgggtgcgaatgcctggaggagcgagctctccccgagaaggagcctttggtgagcgacaacaatccttacagttcctttggggctaccctggtcagggatgacgagaaaaatctgtggtccatgccacacgacgtgtcacacacagaggccgacgacgacaggacgctctacaatctgattgttatcagaaaccaacaagcgaaggattccgaagagtggcagaaactgaattacgatattcacacactccgtcaggttcggcgagaagttagaaaccgctggaagtgtattctggaagatctcggattccaaaaggaggccgacagtctgctgtcggttacaaaactttcaactatctccgattcaaagaacaccaggaaggcaagagaaatgctgctcaagctggctgaagaaaccaatatctttcctacgtcctgggagctttccgagaggtacctattcgtagtggaccgactgatcgccttagacgcagctgaggagtttttcaagctagcaagaaggacttatcctaagaagcccggagtcccatgcttggcggatggtcaaaaagaactgcacttgtggggagacctgtcctgccgtctggcacacatgcagggggtactgcattag

SEQ ID NO: 230131 - DNA, 645 bp, Artificial Sequence
  Description of Artificial Sequence: Synthetic coding sequence
atggggctgcgcgactggttacgtaccgtctgttgctgttgtggatgtgagtgcctcgaagagcgcgctctaccagagaaagaaccactggtaagcgataacaatccctacagttccttcggcgctactcttgttcgggacgatgaaaagaacctctggtctatgcctcatgatgtgtcccacacagaagccgacgatgataggaccttatataacctgatcgttataagaaaccaacaggctaaggactctgaggagtggcagaagctgaattacgatattcatacacttcgccaagttaggcgtgaggtaaggaaccggtggaaatgtatcttagaagacttaggctttcaaaaggaagcggattctctgctgagcgtgactaagctgtctaccattagtgacagtaaaaacacccgtaaggcacgggagatgctgctcaaattagctgaagaaaccaatatcttccccaccagttgggaattgagcgagagatatttattcgtggtagatcgtctgatcgccctcgatgccgctgaggaattcttcaagctggctcgtaggacataccccaagaaaccgggtgtcccttgccttgcagatgggcagaaagagctgcactatctgcctttcccctctccgtag

SEQ ID NO: 230132 - DNA, 645 bp, Artificial Sequence
  Description of Artificial Sequence: Synthetic coding sequence
atgggtctgcgcgattggctgagaactgtttgctgctgttgtggctgtgaatgcctggaggaaagggctctgccagagaaagagccgcttgtctccgacaataacccatattccagcttcggggctacgctagtgcgcgatgacgagaagaatctctggtccatgccacatgatgtctcccataccgaagctgatgacgatcggacactgtataatctgatcgttattcgtaaccagcaggcaaaagactccgaagagtggcagaagctgaactatgacattcatactctccggcaggtaagacgagaggttagaaaccgatggaaatgtatcctggaagacttggggtttcagaaggaagctgacagcctgcttagtgtaaccaagttaagcaccattagtgattcaaaaaatacgcgcaaggcccgagagatgctgctcaagttggctgaggagaccaatattttccctacttcctgggaactgagtgagaggtatcttttcgtggtggaccggctgatagctctcgacgccgcagaggaattcttcaaactcgccagaagaacctaccctaagaaaccgggagtcccatgtcttgctgacggccagaaagagttacactaccttccctttccatcgccctag

SEQ ID NO: 230133 - DNA, 1053 bp, Artificial Sequence
  Description of Artificial Sequence: Synthetic coding sequence
atgcaaggcaatggatctgcactgccaaacgcctcgcagccggtcctgcggggtgatggcgctcggccttcgtggctggccagcgccctggcttgcgtgttgatttttaccattgtggtggatattctgggcaatttgctggttatcctctctgtctaccgcaacaagaagcttcgaaatgcaggtaacatcttcgttgtgtcattagctgtggcagatttggtggtagccatatatccataccctttggtcctcatgtcaattttcaataacggttggaatttaggctacctccattgccaggtgtccggctttctcatgggactgtctgtaatcggatcaatcttcaacataactggaatcgccataaataggtactgttatatctgccacagccttaagtatgataagttatattcatctaagaattccctgtgctacgttttacttatctggctgctgacgctggcagccgtgctcccaaacctacgggctgggacactgcagtatgatcccagaatttactcatgtaccttcgctcagtctgtgtctagcgcgtacacaatagccgtggtggttttccacttcctggtgcccatgatcattgtgatattctgttacctgcgcatctggatactagtgctccaagtaaggcaaagagttaaaccagaccggaagcccaaattgaagcctcaggattttagaaacttcgtgaccatgtttgtggtgtttgtgctgtttgcgatatgctgggcccctcttaactttatcgggctggcagtcgcgtctgatccagcctccatggtgccacgcataccggagtggctatttgtggcaagctattatatggcgtatttcaattcttgcctgaacgctatcatttacgggttgctaaaccagaatttccgaaaagagtacaggcgaataattgtctccctgtgcacggctcgcgtgttcttcgtggatagttcaaacgacgtggccgaccgggtcaaatggaagcccagccctctgatgacaaacaacaacgtggtgaaggtggattctgtatag

SEQ ID NO: 230134 - DNA, 1089 bp, Artificial Sequence
  Description of Artificial Sequence: Synthetic coding sequence
atgtcggagaacggatcattcgccaattgctgtgaagcgggtgggtgggcggtaaggccaggttggagtggagccggaagcgcccgaccatcaagaactcccaggccaccctgggtggcccctgcactcagcgcagttctcatcgtgacaaccgcagtagacgtggtgggcaacctgctggtcatcctctctgtcctccgcaatcgaaaactgcgcaacgcaggaaatctgttcctcgtgtctctggccttggccgatcttgttgttgccttttatccctatccgcttatcttagtggccatattttacgatggctgggccctaggagaggaacactgtaaggcctcagcctttgttatgggtttaagtgttattggcagcgtgttcaatatcaccgctatcgctatcaatagatattgctatatctgtcatagcatggcttaccaccggatttaccgccgatggcatacgccgctgcatatctgccttatatggctcctgactgtggtcgcccttctgcccaattttttcgtcggcagtttagaatacgaccctcggatttattcatgcacttttattcagacagcgagtacacagtataccgcggctgtcgtggtgatccattttctactccctatcgccgtcgtctccttctgctatctgaggatttgggtcctggtgctgcaagcccgacgaaaggccaagccagagagcaggctgtgcctgaagccatctgacctgcggagcttcttaacaatgtttgtcgtctttgtgatctttgcaatttgttgggccccactgaattgtataggtctggcggtggcgatcaacccacaagaaatggccccacagattccggagggactctttgtgacttcatacttacttgcatacttcaactcctgtttgaacgctattgtttacggcttgctcaatcaaaatttcagacgggaatataaacgtattctgctagctttatggaatcccagacactgtatacaggacgcctccaaggggtcccacgctgaaggactccaatctcccgcaccccctatcatcggggtccagcaccaggcagacgccttatag

SEQ ID NO: 230135 - DNA, 3864 bp, Artificial Sequence
  Description of Artificial Sequence: Synthetic coding sequence
atgagtaaggtgatccagaagaaaaaccactggacgtcacgtgtccacgaatgcacagtgaaaaggggacctcagggagagcttggcgtgactgtccttggaggcgctgagcacggggaattcccctatgtgggggctgtggcggctgtggaggccgcaggtctccctggcggtggcgaaggaccaaggttaggggagggtgagctgttactggaggtacagggtgtgcgggtttctggcttgcccagatatgacgtgctcggcgtgatcgattcctgtaaggaagccgtaacctttaaggccgttagacagggtggacggctgaacaaggacctgagacactttctgaatcagcggtttcagaaaggctcccctgatcatgagctgcagcagaccatccgggataatctctaccggcatgccgttccatgcactacccgttcccccagagagggagaggtccctggagttgattataatttccttactgtgaaggagttcctcgatctggagcaaagtggcaccctgctcgaggtggggacctatgagggcaactactatgggacaccaaagcccccttctcagccggtttcaggtaaagtcattactactgacgccctgcattcactgcagtctgggagcaaacagtctactccaaaacgcactaagagctacaatgacatgcaaaacgctggaattgtgcacgctgaaaacgaagaggaggacgacgtgcccgagatgaactcaagcttcaccgccgattcaggtgagcaggaggagcatactctgcaagaaaccgctctccctcctgttaattcatccatcatcgcggcaccgataactgatccttcccaaaaattcccacaatatctaccgttgtccgcagaggacaatctgggccctctaccagagaattgggagatggcgtacactgagaacggagaggtgtacttcatcgatcataacacaaaaaccacaagctggttggacccaaggtgcctgaacaaacaacagaagccccttgaagagtgtgaagatgatgagggagtacataccgaagagctggacagcgagttggagctgcccgctggctgggagaaaattgaggaccccgtgtacggcatctactacgtggatcatattaacaggaagacccagtacgagaaccctgttcttgaagctaagcgcaaaaaacagctagaacaacagcaacagcagcagcagcagcaacagcagcagcaacagcaacagcagcaacagcagaccgaggagtggactgaggatcattccgctttagtccctccggttattcctaatcacccccctagcaaccctgagccagccagggaggtgcccctccagggcaagccattcttcaccaggaacccctccgagctcaagggtaaatttatccacaccaaattgcgaaagtcatcccgagggtttggatttacagttgtcggtggggatgagcctgacgaatttctgcaaataaagagtctcgttcttgacggaccagccgcactggatgggaagatggagacgggggatgtaatcgtgagtgttaacgacacctgtgtgctcggccacacacacgcccaggtcgtcaagatcttccagtctatcccaatcggggcatcagtggatctcgaactctgtcgcggatatcccttgcccttcgatcccgacgatcccaacacctcccttgttacatccgttgctattctggataaagaaccaatcattgtcaacggccaggagacatatgacagccccgctagtcattcctccaaaacgggcaaggtgaatggtatgaaggatgccaggccctcatcacctgccgacgttgcaagcaactcttcccacgggtacccaaatgatacggtctcattggcctcctccattgccactcagccggagctgatcaccgttcacattgtaaagggtcccatggggttcgggttcaccatcgcagactctcccggtggaggaggacagcgcgtcaaacagattgttgactcgccgaggtgcagaggtctgaaggagggggacttaatcgtggaagtgaataagaagaatgtgcaggctctaacacacaaccaggtcgtggacatgctggtcgagtgccccaagggatcagaggtgacgttgttagtccaaagagggggattaccagtgcctaaaaagtcgcccaagtcgcagcctcttgaaagaaaagatagccagaacagctcccagcattccgtaagcagtcatcgaagcctgcataccgcctcgcctagccactccacccaagttctgccagagtttccccctgctgaagctcaagcacccgatcagaccgacagcagtggacagaagaagccagatccgtttaaaatctgggcccaaagcagaagcatgtacgagaacaggcccatgtccccctcgccagcatccggactatctaagggcgagagagagcgtgaaatcaacagtacgaacttcggcgagtgccccatccccgattaccaggagcaggatatcttcttatggaggaaggagaccggtttcgggttcagaattttaggcggaaacgagccgggagagccaatatatataggacatatcgtccccctcggggctgcggataccgatggtcggctgcgctctggagatgaactgatatgcgtggacggtactcccgtgattgggaagtcccaccagctggttgtgcagctgatgcagcaggccgctaaacaaggccatgtcaaccttaccgtccggagaaaggttgtgtttgctgttccaaagacggagaacgaggtgcccagccccgcttcgtcccatcattcttccaatcagcctgccagcctcacagaagagaaacggacaccccagggatctcagaattccctcaacacggtgtcatcaggctctgggtcgactagcggcatagggtcagggggtgggggaggttctggcgtcgtatctacagtagtccagccgtacgacgtcgagattagacgaggcgaaaacgaggggttcggctttgttatcgtgtcttccgtgtcccgcccagaagcgggaacaacatttggaaatgcttgtgtggcaatgccacacaagatcggacggatcatcgagggtagccccgctgaccggtgtgggaaacttaaagttggggataggatcttggccgtaaatgggtgtagcattactaacaaatctcattccgacatcgtgaacctgataaaggaggcagggaatactgtgaccctgcgcatcattcccggagacgagtcaagcaatgctacactgttgaccaatgctgaaaagatcgctacaattaccaccacccacaccccatcccagcaaggcacgcaggagacaagaaacacaactaaacctaagcaggaatctcagttcgagttcaaagctccacaggcaacccaggaacaggatttctataccgtggagctcgaacggggtgctaaagggttcggcttttcccttcggggaggcagggaatacaacatggatttatatgtgctcagactcgccgaagacggccctgctgagcgctgcggaaagatgcgaattggagatgagatcctggaaatcaacggagaaacaacaaaaaacatgaaacactcccgcgcaatcgagctgatcaagaacggaggtcgcagggttagactcttcctgaaacgcggtgatggatcggttccagagtatgccatgattcccccaaacatagcagcctgtatgaggaacgagaagctcggagaggcctgtttctatctgatgggccacaaccagacaactacaccagccgctaccgctacggccccaccgcctgtgcacaaggtttttagaaagtag

SEQ ID NO: 230136 - DNA, 4389 bp, Artificial Sequence
  Description of Artificial Sequence: Synthetic coding sequence
atgtcgaaggtaatccagaaaaagaaccactggacctcccgggttcacgagtgtacagtaaaacggggaccccaaggagagctcggggtgaccgtcctaggcggagccgaacatggagagtttccttacgttggcgcagtggctgctgtagaagctgctggcctccctggtggaggggagggcccaaggctgggagaaggagagctgctgctagaagtccaaggagtccgcgtgtctggactccccagatacgatgtgcttggtgtgattgattcgtgtaaggaagctgttaccttcaaggcagtccggcagggaggcagacttaataaagacctgcgacactttctgaaccagcggttccaaaaaggatcccctgaccacgagcttcagcagaccattcgggataacctgtaccgacacgccgtgccgtgcaccacacggagcccgagagagggagaagttccaggcgttgattacaacttcctgacggtgaaagagttcctggacttggagcaaagcggtacccttttggaagtgggaacatatgaaggcaactactatggcacccctaagcctccgagtcaacctgtatcaggcaaggtcatcaccactgacgcccttcacagcttgcaatctgggagtaaacagtctactccaaagcgtactaagagctacaatgatatgcagaatgcaggaatagtccacgccgaaaacgaagaagaggacgatgttccggagatgaactcctcttttacggctgactcaggtgagcaagaggaacatactctgcaggaaactgccttgccccctgtgaactcaagcatcatcgccgctccaattaccgatccttcacaaaaattcccccagtacttgccactgtctgccgaggataacctcggaccattgccagagaactgggagatggcatacacggagaatggagaggtttactttatcgatcataataccaaaaccaccagctggctcgatcctcggtgtcttaataagcagcagaagccattggaagagtgtgaagacgatgagggcgtccacacagaggagctggatagcgaattagagctgcctgcaggatgggaaaaaatcgaggatccagtctacggaatatattatgtcgatcatattaataggaaaacacagtacgagaatccggttctggaagctaaaagaaaaaaacaattggagcagcaacagcagcagcagcagcagcaacagcagcaacagcagcaacagcagcagcagcagacagaggagtggaccgaagatcattccgctctggtcccacccgtaattccaaatcatcctcctagcaaccccgagcctgcgagggaggtgccgctccagggcaaaccgttcttcactaggaaccctagtgaactgaaaggcaagttcatacacacgaagcttaggaagtcctcgagaggctttggcttcacagtcgtgggtggcgacgagccggatgaattcctgcagattaaatcactggtactggatggcccagccgcactagacgggaaaatggagaccggtgacgtgatcgtttcggtgaacgacacatgcgttctgggccatacccacgctcaggtcgtcaagatttttcaatctatcccaatcggagctagcgttgatttagaactgtgtcgaggatacccactcccctttgatccggacgaccccaatacaagcctggtaacctcggtagcgatcctagataaggagccgatcatcgttaacggccaagagacttacgatagcccggcatcgcacagtagtaaaaccgggaaggttaatggaatgaaggatgctcggccaagcagcccggctgatgtggcgagcaactccagccacggttatcctaatgacactgtatctttagcctccagtattgccacccagcccgaactgattacggttcacattgtgaaggggcctatggggtttgggttcactatagctgacagtcccggtggaggaggacagcgagtaaagcaaatagtggactccccccgttgtcgcggattgaaggagggggacctgatcgtcgaggtgaacaaaaagaatgtgcaggcccttacacacaatcaggtggtggacatgttagtggagtgtcctaagggctctgaggtgacgcttctggtacagagaggaggattgcccgtccctaaaaaaagtccaaagtcccaacccctcgagcgtaaggattcacaaaactcttctcaacattcagtttccagtcacaggtcactacacacggcttccccaagccatagtacccaggtgctaccggaattccccccagccgaggcccaagcccctgaccaaaccgattcaagcggtcagaaaaagccagatccatttaaaatctgggctcagtcaaggtccatgtacgagaataggcttccagattatcaggaacaggacatcttcctttggcggaaagaaacaggctttggatttcggatactcggcggaaacgagcccggagaaccgatttacattggccacatcgtccccctgggggctgccgacacagatgggagactgcgatcgggtgacgagctgatatgcgtcgacggtacccctgtgatcggtaagagccaccaactggttgtccaactgatgcagcaagctgccaaacagggccacgtgaatctgaccgtgcgtcgcaaggttgttttcgccgtgccaaaaactgagaacgaagttccaagccccgcttcttctcaccacagttcaaatcagcctgcctccctgacggaggagaagcggacaccgcagggcagtcagaattcccttaatactgttagctcaggcagtggctcaacaagcggcatcggttcggggggtggcggaggctccggtgttgtgtccacagttgtgcagccgtatgacgtcgaaattagacgaggagagaatgagggctttggtttcgtgattgtgagttctgtcagccggcctgaagcaggtacaactttcggcaacgcgtgcgttgccatgcctcacaagatcggcagaatcatcgagggttcccctgccgataggtgcggcaagcttaaggtcggcgataggatactggccgtgaatgggtgttccatcactaataagtcacactctgatatagtaaacctgattaaggaagcaggtaacactgttaccctgaggataattccgggagatgagtcctccaatgcaacgctccttaccaacgccgagaaaattgccacaattactactacccatacaccctcccagcagggaacccaggagacccgaaataccaccaaacctaaacaggaatcccagtttgagttcaaggcccctcaggccacgcaggaacaagacttctacactgtggaattggaaaggggcgctaagggctttggctttagcctgcggggaggtagagagtataacatggacctttacgtgctgaggctggctgaggacgggccagccgaacggtgtggaaagatgcggataggggatgaaattctcgaaatcaatggcgagaccactaaaaacatgaagcacagtagggctattgaactcataaagaacggcggaagaagagtcaggttattcctgaagcgtggagatggctccgtccctgagtacgacccgtctagcgaccgccacgggcctgctaccggtcctcagggagtgcctgaagtccgggcaggcccagatcggagacagcatcctagcttagaatctagttaccccccagatttacacaagagctctcctcatggagagaagcgggctcatgctagagaccctaagggtagtagagagtacagccggcagccaaatgagcatcacacatggaatggcacaagtaggaaaccagactccggggcttgccgcccaaaggacagggcccctgagggacgccgagatgcccaggccgagcgggcagctgctgccaacggccctaaacggaggtctccagagaagcggagagaagggacccgctctgccgacaatacgcttgagagacgcgagaaacatgaaaaaagacgggacgtatcacctgaaaggagaagagagaggtcccctactaggcgtcgggacggcagcccatcacgaagacgacgcagtttagagagactcttagaacagagacgtagccctgagcggcgacgcggtggctcgcccgagcgaagagcaaaaagcaccgacaggagaagggcacgcagtccagaaaggagaagagaaaggtctcttgataaacgaaatcgagaggacagagcttctcacagagaaagggaggaggcaaacctgaagcaggacgccggtcgatctagcagacaccctcctgaacagcgcagacgaccatacaaggaatgttctactgatttgagcatatag

SEQ ID NO: 230137 - DNA, 3552 bp, Artificial Sequence
  Description of Artificial Sequence: Synthetic coding sequence
ggtgggagactgaataaggacctgaggcacttcctgaatcaaagattccagaaaggatcgccggaccacgaattgcagcagacaattcgggacaacctgtacaggcatgccgtgccatgtaccacgagaagccccagggagggcgaagtgcccggtgttgactataacttcctaacagtaaaagagtttctggatctggagcaaagtggtacgttactggaggttggcacttacgaggggaactactacggcacacctaagcccccaagccagcctgtctctggaaaagtgattaccaccgacgctctccacagccttcagtctggaagcaaacagtccacacctaagcgaaccaaatcttataacgatatgcaaaacgccggaatcgtgcatgccgagaatgaggaggaagacgatgtgccagagatgaatagcagtttcactgccgactccggcgagcaggaggagcatacactgcaggagactgccttgcccccagttaacagcagtatcatcgccgcacctatcacagatcctagccagaaattccctcagtaccttcctttaagcgctgaagacaacctggggcctttgcccgagaattgggagatggcatacaccgagaacggtgaagtgtacttcattgaccataacaccaagaccacgagctggctggaccctcgatgccttaataagcagcagaaacccctggaggagtgcgaggacgacgagggagtccacacagaggaactcgacagcgaattggaactccccgctggctgggaaaaaatagaagacccagtctatggcatctactatgtagatcacatcaaccgaaagacacaatatgagaacccagttctggaggcgaaaagaaaaaagcagcttgagcagcagcagcaacagcagcaacaacagcagcaacaacagcagcaacagcagcagcagcaaaccgaagaatggaccgaggaccattctgctctggtgcctccagtgatcccgaatcaccctcccagcaatccggagccagccagggaagtaccactgcagggtaaacctttctttacacgtaatcccagcgaacttaagggcaagttcatacacacaaaactgcgaaagagttctcggggattcgggttcaccgtggtgggaggggacgagccagacgagttcctccagatcaaaagcctggtgctggacggtcctgccgcacttgatgggaaaatggagacaggcgacgtcatagtgagcgtgaatgatacatgcgtgctgggccacacacacgcgcaggtcgtgaagattttccagtccattcccattggtgcatcagtggacctggagctgtgcagaggataccctctcccttttgatcccgatgaccctaatacttctctggttaccagtgtggccatactggacaaggaacctattatagttaatggacaggagacatacgattctcccgcatctcattctagcaaaacgggcaaagtcaatggcatgaaagacgccagacctagctccccagctgatgttgcgagtaatagcagccacggctaccctaacgacacagtcagtctggcctcctcaatcgcaacgcagcctgagctgatcacagtccacatagtgaaggggccaatggggttcggcttcacaattgctgattcccccggaggaggaggccagagggtgaagcagatcgtcgatagcccaagatgtcggggactgaaagagggtgatctaatcgtggaagttaacaaaaagaacgtgcaggcgctcacccacaatcaggttgtggatatgctcgtggagtgtcctaaaggcagcgaagtgaccctgctcgtgcagagggggggtctccccgtacctaagaagagtccaaagagtcaaccgctggaacggaaagactcacagaactcttcacagcactcagtttctagtcaccggagcctgcacactgccagcccatctcattccacccaagtactcccggagtttccgccagccgaggcacaggccccagaccaaactgatagctccggccagaagaaacctgacccatttaaaatatgggcccagagcagatctatgtatgagaataggcctatgtcgccttcacctgcttccggattgagtaaaggcgagagggagcgagagattaactccactaacttcggcgagtgccccatccccgactatcaggagcaggacatcttcctgtggaggaaggaaaccggctttggatttcgaatattaggaggtaacgaacctggcgaaccaatctatattggacacatagttccactaggcgctgcagacacggatggtagactgcgaagcggggatgagttgatttgcgtcgatgggactcctgtgatcggcaagtcccaccagctggtagtacagttaatgcagcaagctgccaagcagggccacgtgaatttgactgtaagacggaaggtggtgtttgctgtgcctaagaccgagaacgaggtaccctctccggcaagctcccatcactccagtaaccagcccgctagccttactgaggagaagcggacccctcaggggagtcagaattctctgaacacagtgagctccggcagcggcagcacttcgggcatcggcagcgggggaggcggagggtccggggtggtctcaaccgtcgtccagccctacgacgtcgagatccgtcgtggcgagaatgagggtttcggctttgtcatcgtttcctccgtgagccgaccggaggctggtactacctttggaaacgcctgtgttgccatgccgcataaaattgggagaatcatcgagggatctcccgctgataggtgtggtaagctcaaggtgggagacaggatcctagccgtcaacggctgcagcatcaccaacaaatcgcactctgacattgtgaatctcataaaagaggcagggaacaccgtgacacttaggattattcccggagacgagagtagcaatgcaacacttctgactaacgccgaaaagatcgcaactatcactacaactcatactccatctcagcagggcactcaagagactcgtaataccaccaagccaaagcaggagagccagttcgaattcaaggcccctcaggcaacacaggagcaggatttctacaccgtggagttagagcgcggtgcaaagggatttggattcagtttgaggggcggaagagagtacaacatggatctgtatgtcctgcgcctggccgaggatgggcctgccgagcggtgcgggaagatgagaattggggatgagatcctggaaatcaacggcgaaaccacaaaaaatatgaaacattctcgcgctatagaactcatcaagaacggcggtaggagggtgaggctgttcctgaagcgcggagatggctcagtgcctgaatatgccatgatcccccctaatattgccgcatgtatgcgcaatgagaagcttggtgaagcctgtttctacctcatgggtcacaaccaaaccaccactccagcggctaccgctacagcgccaccaccagtacacaaggtgtttaggaagtag

SEQ ID NO: 230138 - DNA, 3771 bp, Artificial Sequence
  Description of Artificial Sequence: Synthetic coding sequence
atgagcaaagtgattcaaaagaaaaatcactggacttctcgggttcacgagtgtaccgtaaagcgcggtccacagggtgaattaggtgtaactgtcctcgggggtgctgagcatggagagttcccctacgttggcgcagtggccgctgtggaagcagctgggctcccagggggaggtgaaggacctcgcctgggcgagggtgagttgttgctggaggtacagggggtacgggtgtccgggctcccaaggtatgacgtgctcggcgtgatagactcctgcaaggaagcagtgacattcaaggccgtgcgtcaggggggacgcctgaataaggacctccggcacttcctgaaccagaggttccagaagggcagccccgaccacgagcttcaacagactatacgggataacctgtacaggcatgccgttccctgtacaactcggtcacccagggaaggcgaagtgcctggtgtggattacaacttcctgacagtcaaggaattccttgacctggagcaatctggtacattactggaagtcgggacttacgaagggaactattatggaacgccaaagcctccaagccagcctgtttcggggaaagtgatcactaccgatgccctgcattctcttcagtcggggagtaagcagagcactccaaaaagaacaaagtcgtataacgatatgcaaaatgctgggatcgttcacgctgaaaatgaggaggaggacgacgtacccgaaatgaatagtagcttcactgcagacagcggtgagcaggaggagcacaccttgcaggagacagcacttccccctgtcaattcatctatcatagctgctcccatcaccgatcccagccaaaaatttccacagtatctcccactgagcgctgaggataacctgggtcctctgccggagaactgggaaatggcatatacagaaaacggtgaggtttattttattgaccataacacaaaaacaacatcttggctggaccctcggtgtctgaataagcagcaaaaaccacttgaggagtgcgaggatgacgagggggtgcacactgaggagctggactccgaactcgagctaccagccggttgggagaagattgaagaccccgtctatgggatatactacgtagaccacataaatcgcaagactcagtacgagaacccagtgctggaagcaaagaggaagaagcaattggagcagcagcagcagcagcagcaacagcaacagcaacagcagcagcagcaacaacagcagcagacagaagaatggactgaggatcattctgcactcgtgcccccagtaattccaaatcaccctcccagcaacccagaaccggctagggaggttcctctgcagggcaaaccttttttcactcgcaatccaagtgaactcaaagggaaattcatacacactaagctaaggaaatctagcaggggcttcggcttcacggtggtcggtggggacgaacccgacgagttcttgcagatcaagtctctcgtactggatgggccagcagccctagacggtaagatggagactggggacgttatcgtatcagtcaacgatacttgcgtgctgggccatacccacgctcaagttgtgaagatattccagagtattcccattggggcatcagtcgatctggagttgtgccgcggttaccctctccccttcgaccctgatgacccaaacacctcactcgtaacttcggtggcaatattggacaaagagcctatcatcgtgaacgggcaagagacctacgattcccccgcatcgcactcctctaagactggaaaggtcaacggtatgaaagatgccagaccctcgtcacccgctgacgttgctagcaattcatctcatgggtatcctaatgacaccgtctcactagcctccagcatcgcaactcagcccgagctcattacggtgcacatcgtgaaggggccaatgggctttgggtttacaattgccgacagtccgggaggcggtggccaaagggttaagcagatagtcgactcgcccaggtgtaggggccttaaagagggtgacctgattgtagaggtgaataagaaaaatgtccaggcactcacgcacaatcaggtggtggatatgctcgttgaatgcccaaagggatctgaggtcaccctgttggtgcagcggggtgggctgcccgttcctaaaaaaagtcccaagtcccagccattggagcgcaaggattcccaaaactctagccagcattccgttagctcacatcgcagcctgcataccgcctcaccatctcactccacccaagtgctgcccgaattcccaccagcagaggctcaggcaccagaccagactgattctagtggccagaaaaaacctgacccattcaagatttgggcacagagtcgtagtatgtacgagaaccgcccaatgagtccaagccccgcttccggactttccaagggagaacgggagcgggagattaacagtaccaacttcggggagtgccccattcccgactaccaagaacaggacatttttctttggcggaaagagactgggttcgggttccgcattctggggggaaacgaacctggagaacctatctatatcggacatatcgtacccctaggcgctgccgacactgatggacgcctgcggtccggagatgagctgatctgtgtggacggcacaccagtcatcggcaagagtcaccagctggttgtgcagctcatgcaacaggccgcaaagcagggtcatgtcaatctgacagtcagacgcaaggttgtctttgcggtgccaaagaccgagaatgaggtcccatctccagcaagctcccatcacagcagcaaccagccagctagcttaaccgaggaaaagcggacacctcaagggtctcagaacagtcttaacactgtgtcctcggggtccggtagtacgtctggaattggctctggcggtggcggtgggtccggggtagtcagcaccgtggtacagccgtacgacgtggaaatacggaggggtgaaaacgaggggtttggctttgtgatcgtgagttccgtgtctagacccgaagccggaactaccttcgccggaaacgcttgcgtggctatgccacacaagatcggcagaattatagagggtagtcctgccgatagatgtgggaagctcaaagtcggcgaccggatccttgctgtgaatggctgttctataactaacaaatcccactcagacatcgtgaatctgatcaaagaagctggcaacactgtgactctgcgcatcatccccggtgatgaaagcagcaacgccaccctgctcaccaatgccgagaagatagcaaccatcactacaacccacaccccctctcaacagggtacccaggagacccgtaatactactaagccaaaacaggaatcacagtttgagtttaaggcccctcaggccacccaggagcaggatttttacaccgtcgaactcgaacgcggtgccaagggatttggtttttcactccggggtggtcgagaatataacatggatctgtatgttctgagactggctgaagacggccctgcagaaagatgtgggaaaatgaggattggggatgaaattttggagatcaatggcgaaaccactaaaaatatgaagcatagtcgagcaattgagttaattaagaacggtggccgtcgagttagattgttcctgaaaaggggagacggttcagtgcccgagtacggagggtcaaactatgaaaacattccctccttccccggaatgacaccctag

SEQ ID NO: 230139 - DNA, 1488 bp, Artificial Sequence
  Description of Artificial Sequence: Synthetic coding sequence
atggcagctgagccccagccaagctccctttcctaccggaccaccgggtccacttatttgcatcccctgtctgagctgcttggcattccgcttgaccaggtgaatttcgtcgtgtgccagttggtggcactgtttgctgccttctggttccgaatttatctgagaccgggaacgacatcatctgacgtacggcacgctgtggcgacaatctttgggatatatttcgttattttctgtttcggctggtattccgtgcatctcttcgtcttggtactgatgtgctacgctattatggttaccgctagcgtcagcaacattcaccggtattctttcttcgtggcaatgggctatctgacgatttgccacataagtaggatttatatcttccactatggaatcctgacaactgatttctcagggccactgatgatcgtgactcagaaaatcaccaccttggcgtttcaggtgcatgatgggctgggtaggagggcggaagatttgagcgcagagcagcatcgattagctatcaaggtcaagccttccttcttggaatatttatcctacctgctgaactttatgagcgttattgccggaccttgcaataattttaaagattatattgccttcatcgaggggaaacatatccatatgaaattgcttgaggttaattggaagagaaagggatttcattccctccctgagccttctcccaccggcgctgtgatccataagttgggtattactttagtaagccttctcctgttcctgaccctgaccaagacttttcccgtgacctgcctagtggatgattggtttgttcacaaagcttcttttccagccagattatgttatctttacgtcgtgatgcaggctagtaaacctaaatactatttcgcatggactctggcagacgccgttaataacgctgccggattcggtttctctggcgtagataaaaacggcaacttttgttgggatctattgtcgaatctaaacatctggaaaatagagaccgctactagttttaaaatgtatttagagaactggaatattcagactgctacctggctcaagtgtgtatgctaccagcgagtgccgtggtaccctacagtgttaacctttatcctgagcgccctgtggcatggggtgtatccaggatattacttcaccttccttactgggatccttgtgaccctggcagccagagccgtgaggaacaactatagacattacttcctgagctccagggctctgaaggcagtctatgacgccggtacttgggcagtgactcaactggcagtgtcctacacagttgccccttttgtgatgttagcagtagagcccaccatctccctgtacaagtctatgtatttctacttacacatcatttcgttactgataattctgtttctccctatgaagccgcaagcgcacacgcaacgccgtccgcagaccctgaattctattaataagcggaagaccgattag

SEQ ID NO: 230140 - DNA, 726 bp, Artificial Sequence
  Description of Artificial Sequence: Synthetic coding sequence
atggcagcagaacctcagccctcttcactgtcttacagaacaacagggtcaacttatctgcaccccttaagtgagttgctcggaattccccttgaccaggtgaattttgtagtgtgtcagttggtggccctttttgcagcgttttggtttcgcatttatctcagacctggaactacaagttctgacgttcggcatgccgtcgcgacaatattcggaatttattttgtgatattttgcttcggttggtacagtgtccacttatttgtgctcgtcttaatgtgctatgccattatggtgaccgcctccgtgtctaatatccacaggtactcattttttgtggctatggggtatctgactatttgtcatatcagcaggatctacatatttcattatggaattctgactaccgacttttcaggccctctgatgattgtaacccaaaagattaccacccttgcctttcaagtgcacgacgggttgggccgaagagccgaggacctctcagcagagcagcacaggctcgcaattaaagtcaagccctcgttcctcgagtaccttagttacctgctgaactttatgtccgtgatagccggaccatgcaataacttcaaggactatatagcctttattgagggcaagcatatacacatgaaactgctggaggtgaactggaagcggaaggggttccactccctgcccgagccctcacccactggtcacctgtag

SEQ ID NO: 230141 - DNA, 1041 bp, Artificial Sequence
  Description of Artificial Sequence: Synthetic coding sequence
atggagttttctctgaggatcttcttgggactcgggcgtagggcagaggatctgtccgccgagcaacatagattagccatcaaggtcaagccaagcttcttagagtatctatcatacttgttgaattttatgtctgtcattgctggtccttgtaataattttaaagactacatagcattcattgaaggcaaacacattcacatgaaactgttagaggtgaattggaaacgcaaagggttccatagccttccagagccgtctcctaccggagctgtaatacataagctgggaatcacacttgtcagccttctgctgtttctgaccctgactaagacattccctgtgacctgtctggtcgacgattggtttgtacataaggcttccttcccggcacggctctgttatctgtacgttgtaatgcaggctagcaagccaaaatattatttcgcctggacacttgctgatgctgtaaacaacgctgccggatttggtttctctggcgttgacaaaaacgggaatttctgttgggatctactgagcaatttaaatatctggaaaattgagaccgccaccagcttcaaaatgtacctggaaaactggaatatccagacagccacttggctgaaatgtgtgtgctatcagcgggtcccttggtacccaaccgtgcttacattcatcttatcagccctgtggcacggggtatacccaggatactacttcacattcctgactggcattctagtcacactcgctgcgcgagctgtcagaaacaactaccgtcactactttctcagctcgagggctctgaaggccgtgtacgatgctggaacctgggcggtcacccaactcgctgtgagttacaccgtcgcacctttcgttatgttggcagtggagccgacaatctccctgtacaaatccatgtatttttatctgcatattatatctctcctgatcatcctgttcttacccatgaagccccaggcccacacccaacgcagaccccaaactcttaactccatcaacaagcggaaaacagactag

SEQ ID NO: 230142 - DNA, 1563 bp, Artificial Sequence
  Description of Artificial Sequence: Synthetic coding sequence
atggcgaccacttctactaccgggtccactctgttacaaccgctctctaacgcagtgcaattgcccatagaccaggttaattttgtcgtttgccagctcttcgcactcctggctgccatctggtttaggacctatttgcattccagcaaaacatcttcatttattagacacgtggtagccactcttctgggactgtacctggctctcttctgcttcgggtggtacgctctacacttcttagtccagtcaggcatctcttattgtataatgattattatcggcgtggagaacatgcacaactactgcttcgtgtttgccctgggctacctgacggtatgtcaagtcaccagggtctacatcttcgactacggacagtattctgccgattttagtggaccaatgatgataataacacagaagatcacatccctggcctgtgagattcatgatggaatgttccggaaagatgaggaactcactagtagtcagagagatctggctgtgcggcgaatgccttccctgcttgagtatttaagctacaactgtaattttatgggtatcctggcgggacctctgtgctcctacaaagactatatcactttcatcgaaggacgctcttatcacataacccaatcgggagaaaatggaaaggaggaaacacagtatgagaggaccgaaccatctcccaataccgccgttgtgcagaagttactcgtttgtgggttatcactgctattccaccttacaatttgtaccactcttccagttgagtacaacatcgacgagcactttcaggccactgcatcatggccaacaaagattatttatttgtatattagcctgcttgcagctcggcctaagtactactttgcatggactctggcagacgcaatcaataatgcagcgggatttggctttcggggttacgacgagaatggagctgctcgctgggacctgatatccaacctgcgcattcagcagatcgagatgtccacgagctttaaaatgttcctagacaactggaatattcagacagcactctggttgaagcgcgtgtgttacgaacggacctctttctccccaactatccaaacctttatactgagtgccatctggcacggtgtttacccgggttactacctcaccttcttaaccggcgtacttatgaccctagcggctcgtgctatgagaaacaattttagacactacttcattgagccaagtcagctgaagttgttctacgatgtgattacgtggattgtcacccaggtcgccatctcatatacagtggtcccgtttgttctcctcagcattaagcccagtctgactttttactcctcctggtattattgtctgcacatcctgggcatccttgtgctcttgctgttacctgtgaaaaaaacacagaggcggaaaaacacccacgagaatatccagctgtctcagtcaaagaagttcgatgaaggcgagaactcactgggccagaactccttttctactactaacaatgtctgcaatcaaaatcaagaaatcgcttctcgacacagcagcctgaagcagtag

SEQ ID NO: 230143 - DNA, 1308 bp, Artificial Sequence
  Description of Artificial Sequence: Synthetic coding sequence
atggagtggctgtggctgttttttttgcacccaatatccttctaccagggagctgctttcccttttgcactgttatttaattacctgtgtatcatggactctttcagcacccgagctaggtatttgttcctgctcaccggcggaggcgctcttgcggtcgcggcaatgggttcctacgctgtcttggtatttaccccagcagtctgcgctgtggcactcctgtgctctcttgcaccgcagcaggttcataggtggacattctgcttccagatgagctggcaaacactgtgtcacctgggtctgcactacaccgagtattatcttcatgaaccaccttctgtgcggttctgcattacactgagctccctgatgctgctgacacaaagggttacaagtctgtcactggatatctgcgaaggaaaagtcaaggcagcatccggaggttttcgttctcgttcgagcctgagcgagcatgtctgcaaagccttgccatatttttcctacctgctgttcttccctgcacttttgggagggtctctatgttcctttcagcggttccaagcacgcgttcaagggagctctgccttacaccctcgacatagtttctgggctctgtcctggaggggccttcagatactcggactggagtgcctcaatgtcgcggttagcagagttgttgatgctggcgcaggactcactgactgtcaacagtttgagtgtatttacgtggtctggactacagcaggccttttcaaattgacctactatagtcactggattctggatgattcccttcttcacgccgctggctttggcccagaactgggacagagcccaggcgaagaaggctatgtgccagacgccgacatctggaccttagagcgcacccacagaatcagtgtgttttcgcgcaaatggaaccaaagcaccgccagatggttgaggcggttggtgttccagcacagccgcgcatggccactgctgcaaacctttgccttttcagcatggtggcatggtctgcatcccggtcaagtattcggattcgtgtgctgggccgtgatggtggaggctgactacttgatccactccttcgcaaacgagttcattcggtcctggcctatgcggctgttctatcggacgctgacatgggcgcacacacagttaataatcgcctacatcatgctcgccgtcgaggtgcgctcactgtcatccttgtggcttctgtgcaactcatataactccgtcttcccaatggtctattgtattctcctgttgctgctggctaagcggaaacacaagtgcaactag

SEQ ID NO: 230144 - DNA, 1341 bp, Artificial Sequence
  Description of Artificial Sequence: Synthetic coding sequence
atgacactcaaggcctctgagggggaatcaggcggatcaatgcacacagctctgtctgatctgtatctggagcatttactgcagaagaggagtcggccagaggccgtgtctcaccctcttaatactgtcactgaggatatgtacaccaacggatcaccagcccctggaagccccgcacaggtaaaggggcaagaggtccggaaggtgagactgatacagtttgagaaagtgactgaggagcccatgggtatcacactgaagctgaatgagaaacagtcctgcaccgtcgcaagaatccttcatgggggtatgatccaccggcagggctctctgcatgtcggggatgaaattttggaaatcaatggaacgaacgtgaccaaccacagtgtggatcagctacaaaaggctatgaaggagacaaagggcatgatcagtctgaaggtcatacccaaccagcagtctagactaccggctctccaggaggcaggtttgaagttcgccacgggcgatatcattcagataataaataaggatgacagtaattggtggcagggccgagtggagggatctagtaaagagagtgctggtctaatacccagcccggagttgcaggaatggagagtggcctcaatggcacagagcgcccctagcgaagcaccatcctgctcaccttttggaaaaaagaaaaagtacaaagacaagtatctggccaaacactccagtatctttgaccagcttgatgtagtgagctacgaggaagttgtccgattacccgctttcaaacgtaagacgttggtactcatcggagcgtccggagtgggcagatctcatattaagaacgctctgctgtcccaaaaccccgaaaagtttgtctaccccgtcccatacaccactagacccccaagaaagtctgaagaggacggcaaagagtatcactttatctccaccgaggagatgacaagaaacatctccgccaatgagttcctggagttcgggagttatcagggtaatatgtttggcaccaaattcgaaacagttcatcagattcacaaacagaacaagatcgccatactcgacatagaaccccagacactgaaaattgtgcgtacggctgaattatctcccttcattgtgttcattgccccaaccgatcagggcacacagacggaggctctgcaacagctacagaaggactccgaggcaatcagaagccagtatgctcattatttcgacctgtcactcgtaaataacggcgtggatgaaaccctcaagaagctccaagaagctttcgaccaggcatgtagcagtccacagtgggtgcctgtctcctgggtatactag

SEQ ID NO: 230145 - DNA, 1401 bp, Artificial Sequence
  Description of Artificial Sequence: Synthetic coding sequence
atgaccctgaaggcctctgagggggaaagcggaggctcgatgcatacggctttaagcgacttgtatctcgagcacctgctccagaagaggagtcggcctgaggccgtctctcatcctttgaacacggtcaccgaggatatgtacactaacggaagccccgcacctgggtcccccgctcaggtgaagggacaggaagttcgcaaagtccgtctgatacagtttgaaaaggtgaccgaagaacctatgggcatcaccttgaaattgaacgaaaagcaaagctgtacagtggcgagaattcttcatggcggtatgatccaccgtcagggctccctgcacgtgggagatgagattctggagattaatggaactaatgtgactaatcattcggtggaccagctgcagaaagccatgaaagagactaagggtatgatatccttgaaagtgattcctaaccagcaaagcagactccccgcactgcaaatgttcatgcgagcccagttcgattacgatccaaaaaaggataacctcatcccttgcaaagaagccggactgaaatttgcaaccggagatatcatccagatcataaataaagatgattcaaattggtggcagggtcgggttgagggctcttctaaggagtctgccggactcattccatcacctgaacttcaagaatggcgagttgcctctatggcccagagcgcccctagcgaggctccgagctgctcccccttcggcaaaaaaaagaaatacaaggacaaatatcttgctaagcattccagcatcttcgatcagctcgatgtggtcagctatgaggaggtcgtgagacttcctgcgttcaagaggaagaccctagtgctgatcggagcctcaggcgtgggcaggagccacatcaaaaacgccctactctcacaaaaccctgaaaagtttgtgtatccagtcccttacactacacggcctcccagaaaatccgaggaggacgggaaggaataccatttcatatctacagaagagatgacccgtaacatctctgccaatgaatttctggagttcggttcatatcagggcaacatgtttggaaccaagtttgagactgtccaccagattcacaagcagaacaaaatcgctatcctggacatcgaaccgcagacgttgaagatagtgcgaactgccgaattgagcccctttatcgtctttatcgccccaactgatcagggcacacagaccgaagctttacaacagctccagaaggactccgaagcgatccggagccagtatgcccattattttgaccttagtctggtcaataatggggtcgacgagaccctcaagaaacttcaagaggcctttgatcaagcctgtagttccccccaatgggtccctgtttcatgggtgtattag

SEQ ID NO: 230146 - DNA, 1311 bp, Artificial Sequence
  Description of Artificial Sequence: Synthetic coding sequence
atggaatcatgggctgtgagtcaccctctgaataccgtgactgaggacatgtataccaatgggagtcccgcaccaggttcacctgcccaggtgaagggccaggaggtgagaaaggttcgactgattcagtttgagaaggtgaccgaggagcctatgggtataactctgaaattgaacgagaagcagagttgtacagtcgcccgaatactgcacggcggaatgatccatcggcaggggtcgctgcacgtgggagacgagatactggagattaatggtaccaacgtcacaaaccacagcgtggatcaacttcagaaagccatgaaggagactaaggggatgattagcctgaaggtaattccaaatcagcaatctagactgccagccctgcagatgttcatgagagcgcaatttgactacgatcctaagaaggataacctgatcccctgcaaagaggctgggctgaaattcgctaccggggatatcattcagatcataaacaaggatgactccaactggtggcagggaagagtggaaggcagttccaaagaatccgcagggttgatcccttcacctgaattacaggaatggagggtggcatctatggcccagtcagcccctagtgaggccccatcttgttccccattcgggaagaagaaaaagtataaagacaagtacctggccaagcacagctctattttcgaccaactagatgtcgtgtcctatgaggaggtggtccgcctgccggcatttaagcgcaaaacccttgtgctgataggggcttcgggcgtgggcagatcccatattaaaaacgctcttctgagtcaaaatcctgaaaagttcgtgtatcccgtgccctacaccacaagacccccacgcaaatctgaagaggatgggaaggagtaccactttataagcaccgaggagatgactagaaatatttccgccaacgaattcttggagtttggctcatatcaggggaatatgtttggcactaagttcgaaactgttcaccagatccacaagcagaataaaatcgctattctggacattgaaccccagacactcaaaatcgtaaggacagccgaattgtcaccctttatcgtatttatcgcaccaacagaccagggcacccaaactgaagccttgcagcagcttcagaaggattcggaagcaattagaagtcagtatgctcattatttcgacttgtcgcttgtcaacaatggtgtagatgagactttgaaaaagcttcaagaggcctttgaccaggcttgctcttcccctcaatgggtgccagtaagctgggtgtactag

SEQ ID NO: 230147 - DNA, 1659 bp, Artificial Sequence
  Description of Artificial Sequence: Synthetic coding sequence
atgcccgtagccgcaaccaacagcgagacggcaatgcagcaagtcctcgacaatctgggctcactgcctagtgcaactggggcagccgagttggatctgatctttctccgcggtattatggaaagccccattgttcgatctcttgccaaggcccatgaacgcttagaagagaccaagcttgaggccgtacgggataataatctggagttggtacaagaaatccttcgggatctcgcccacgtggctgagcaatcgagcactgcagccgagctggcacacatcctgcaggagccacattttcagtccctgctggagacacacgactcggttgcttctaagacctatgagaccccccctccatcccccggtctggaccctaccttctcaaaccaacctgtcccacctgatgcagtgagaatggtcgggattcgtaaaacagcaggtgagcacctcggagttactttcagggtcgaaggcggagagctggtgatagcacgaatcctgcacgggggtatggtagcacagcaagggctgcttcatgtgggggacataatcaaagaggttaacgggcaaccagtgggcagcgatccgcgagccttgcaagagctccttcggaacgctagtgggtccgtgatcctaaagatactgccttcatatcaggagcctcaccttcctagacaggtgtttgtcaaatgccactttgactatgaccctgcacgagactctttgattccttgcaaggaagcaggacttcgcttcaacgctggggacctcttacagatcgtcaaccaggatgacgctaactggtggcaggcgtgccacgtggaggggggtagtgctggactcatcccaagccagttgctcgaggagaagcggaaagcttttgttaaacgggacctggaactaacacccaacagtggcaccctctgtggaagcctgtccggcaagaagaagaaacgaatgatgtacctgaccaccaagaacgcagagtttgataggcacgaactgctcatttatgaggaagtcgccagaatgcctccttttaggcggaagacacttgtgcttattggggctcagggggtgggcagacgcagccttaagaataaactgataatgtgggatccagaccgatacgggacaacagttccctacacatctaggcgcccaaaagacagcgaacgcgagggccaggggtactctttcgtctctaggggagaaatggaagcagacgtgagggctggtagatacctggaacatggcgaatacgaaggaaacctgtacggaacacggatcgactcaataaggggggtggtagctgcaggaaaggtgtgcgtgctcgatgtgaatccccaggccgtcaaggtgttaagaaccgctgaatttgttccctatgtagtatttattgaggccccagactttgagacattgagagcaatgaatagggccgctttggagtccggcatctccacgaaacagctgacagaggctgacctgcgacgcaccgtcgaggaaagttctcggatccagagaggatatgggcactattttgacttatgcttggttaacagcaatctggaacgcactttcagagagctgcagaccgccatggaaaaactcagaactgagccccagtgggtgcctgtgtcgtgggtgtattag

SEQ ID NO: 230148 - DNA, 1731 bp, Artificial Sequence
  Description of Artificial Sequence: Synthetic coding sequence
atgcccgtggctgccacaaactctgagacggcaatgcagcaggtgttggataatcttgggagcctgccgtctgcaactggcgcagcagagctggatttgatttttctgcggggaattatggaatcgcccatcgtaaggtcccttgctaaagtgatcatggtgttgtggttcatgcagcagaatgttttcgttccaatgaaatacatgctcaagtatttcggtgcacacgagcggctggaggaaacgaaactcgaggccgtgcgcgacaacaacctggagctggtgcaggagatcttgagggatctcgctcacgttgctgagcagtcatccacggccgcagaattggcgcatatcctgcaagagccacactttcagagtctgctcgagacacacgactccgtggcaagtaagacttacgagactccgccaccatctcccggactagacccaacttttagtaatcagccggtgccacccgatgccgtgcgaatggttggcattcgtaagactgctggtgaacatctcggagtgactttcagggtcgagggcggtgagctggtgatagccaggatcctgcacggaggtatggtggcccagcagggactgctgcatgtaggcgacatcattaaggaggtgaatggtcagcctgtcggaagtgaccctcgagccttgcaggagcttcttagaaatgcatccgggagtgttattctgaaaatcctgcctagctatcaggaacctcacttaccacgacaggtgttcgtcaaatgtcattttgattatgaccctgcaagagattccctgattccgtgtaaggaggctggcctgcgcttcaacgcgggtgatctgctgcagatagtgaaccaggatgacgccaactggtggcaggcctgtcacgtagagggaggcagcgcgggactgatcccgtcccagctgttagaagagaagagaaaagcctttgtcaagagggatctggaactgaccccgaatagcgggacgctctgtggatccctgtcggggaagaagaaaaaacggatgatgtatttgaccacaaagaatgcggagttcgaccggcatgaactccttatatacgaagaggtcgctcgaatgccaccatttagaagaaaaaccttggtcttgatcggtgcccagggcgtcggtaggaggagcttaaagaataagctcattatgtgggaccccgaccggtacggtaccactgttccatatacaagtaggagaccaaaggactccgagagagaaggccagggttacagttttgtctccagaggagagatggaggctgacgtgagagccggacggtacctggaacacggcgagtacgaaggaaatctttatggcaccagaattgatagcataaggggggtcgtagctgcaggaaaggtgtgcgtgctggacgtgaatccccaggcagtgaaagtgttaaggaccgcggaattcgtcccatacgtggtattcatcgaagcgcctgattttgagacactaagagccatgaatcgggcagccctggaatccggcatcagtaccaagcagctcacagaagctgacctgcgcagaacggtggaggaatctagtcgcatccagagaggctacgggcattatttcgatctgtgccttgtgaacagcaatctggagaggacctttagggaattacaaacagcgatggaaaaattgcggacggagccacagtgggtgcctgtgtcatgggtgtattag

SEQ ID NO: 230149 - DNA, 96 bp, Artificial Sequence
  Description of Artificial Sequence: Synthetic coding sequence
atgccggtcgcggcaactaactccgagacagctatgcagcaggtgctggacaatctgggatcactcccgagtgccacgggggcagcagaactgtag

SEQ ID NO: 230150 - DNA, 456 bp, Artificial Sequence
  Description of Artificial Sequence: Synthetic coding sequence
atgcccgtggcagccaccaactctgagaccgctatgcaacaagtcctcgataatctgggaagcctccccagcgccaccggcgcagcagagttggatctgattttcctccgcggtatcatggaaagcccgatcgtgcgaagtctggcaaaagctcatgagcggctggaagagaccaaactggaggccgtgcgggacaacaatctggagcttgtgcaagagatcctgcgcgacctggcccatgttgctgagcagagttccactgcagcagaactcgcccacatactgcaggaaccacactttcagtcacttctggagactcacgacagtgtggcctcgaaaacttatgagacgccgccaccgtctccaggactcgatcccacgttctctaaccagcctgtgccaccagatgctgtgaggatggtgggtatacgcaaaaccgctggcgaacacctgtag

SEQ ID NO: 230151 - DNA, 381 bp, Artificial Sequence
  Description of Artificial Sequence: Synthetic coding sequence
atgcctgtcgccgcaactaatagcgaaacagccatgcagcaagtactggacaatctggggtccctcccatccgctaccggcgctgccgagctcgacctgatcttcctgcgcggaataatggaatcaccaattgtccgcagtctggcaaaagcacatgaaaggctcgaggagaccaagcttgaggctgtccgcgacaacaatctggaattagtccaagagatcttgcgggacttggcccacgttgccgaacagtcttctaccgccgcagaattggcccacattctgcaggaaccccattttcagtccctcctggaaactcacgacagcgtggcaagtaagacctacgagacccctccgccatccccgggactggatccgtag

SEQ ID NO: 230152 - DNA, 222 bp, Artificial Sequence
  Description of Artificial Sequence: Synthetic coding sequence
atgcctgtcgcggctaccaacagcgaaaccgccatgcagcaggtattggataaccttggtagcctacctagtgctacaggggctgcagaactggatttaatttttcttaggggcatcatggagtctcctatcgttcggtcactcgcgaaggcccatgaaagactcgaagaaaccaagctggaggctgtgagggataacaatctggaactagtgcaagagtag

SEQ ID NO: 230153 - DNA, 447 bp, Artificial Sequence
  Description of Artificial Sequence: Synthetic coding sequence
atgccagtggctgctaccaattctgaaacggcgatgcagcaggtgctggataatctgggcagtctgcctagtgctacaggtgcggcagaactggatctgatcttcctcagggggatcatggaatcccccatcgttaggtctctagctaaagctcacgaaaggttggaggaaaccaagcttgaggctgtgagagataacaacctggaacttgtccaggagatcctcagagatctggcccacgtcgccgagcagagctccaccgcggctgaactcgcccatatcctgcaggagccgcattttcagtcccttctggaaacacacgattctgtggcctccaagacgtacgagactccccctccctcgcccggactagaccccactttctcgaaccaaccagtgcctcccgatgcagtccgaatggtcggtattcgtaaaaccgcaggttag

SEQ ID NO: 230154 - DNA, 1626 bp, Artificial Sequence
  Description of Artificial Sequence: Synthetic coding sequence
atgcagcaggtgctcgacaatctcggatccctgccctccgcgactggtgccgcagaacttgaccttatcttcttgaggggtatcatggagtctcccatcgtgcgttctctggcaaaggcccacgagcggctggaagagaccaaattggaggctgtccgcgacaacaatctagagctggtccaggaaattctccgcgatttggctcacgtggcagaacagtcttcaaccgctgctgagctggcacacatccttcaggagcctcattttcaaagtctgctcgaaacccatgactccgtggcttcaaaaacctacgaaacacccccaccatcccccggactggatccgactttcagcaaccagcccgtgccgcctgacgcagtgaggatggtcggaatcaggaagacagccggagaacacttaggggtgacttttcgtgttgaggggggagagttggttatagctaggatactacatggtggtatggtggcccagcagggactgctgcatgtgggtgacattatcaaggaggtgaatggccaacctgtggggagcgaccctagagctttgcaggaactgttgcgcaacgcatccggatcagtaatcctgaaaattcttccctcttatcaagaaccccatctgccccgtcaggtgtttgtgaaatgtcacttcgactacgatccagctagagacagcctgatcccgtgcaaggaggcaggcctcaggttcaacgctggagatctgttgcaaattgtgaaccaggacgatgcaaactggtggcaagcctgccacgtggagggagggagcgcagggctgatccccagccagttgctcgaggagaagcggaaggcattcgtcaaaagggatttggaactcacccctaatagcggcaccctgtgtggcagtctctctggcaagaagaagaagaggatgatgtatttgaccaccaaaaatgctgaattcgatcggcatgagttgcttatttatgaagaggtggccaggatgcctccctttcgccgtaaaactttggtgctgattggtgcccaaggcgtaggtcggcgaagcctcaaaaacaaactgataatgtgggaccccgacagatatggaaccaccgtaccctacaccagcagaaggcccaaagattcagagcgagaaggccaagggtactccttcgtgtctaggggtgagatggaggccgatgtccgggctggccgatacctggaacatggggaatacgagggcaacctgtatgggacgagaatagatagcattagaggcgtcgtcgctgcagggaaggtctgtgtcctcgacgtgaacccccaggccgtgaaggtgttacggaccgctgaattcgttccatatgtcgtattcatagaggcccctgatttcgagacactgagggcgatgaatcgggctgctttagagagtggcatctccacaaagcagttaacggaagccgatcttcgtcgcaccgtcgaggaatcatcccggatacagaggggatatggacattattttgatctctgccttgtgaattcgaatctcgaacgaacctttagagaactgcagactgcaatggagaagctacgtacagaacctcagtgggttcccgtctcctgggtgtattag

SEQ ID NO: 230155 - DNA, 1167 bp, Artificial Sequence
  Description of Artificial Sequence: Synthetic coding sequence
atggagctgcagtaccctccacccccaccttcccctaggatttgtagagaacggagtgggggagacaatgcatctatgcctgtcctttctgaggacagtggacttcatgagaccctagccctgctgacgagtcaattgagacctgactcaaatcataaggaagagatgggctttctgcgagatgtcttcagcgagaaatccctgtcatacctaatgaagatccacgagaagctaaggtactacgagagacagagtccaactcctgtcctgcattcagctgtcgccctggcagaggacgtgatggaggagctccaggctgcctcagtccactccgatgaacgagagttgcttcaactcttgagcacccctcacttacgagcggtcctgatggttcacgacacggtggctcagaaaaatttcgacccagtcctgcctcccctgcctgacaacattgatgaggattttgacgaggagagcgttaagatcgtgcggctggtgaagaacaaagagcctttgggtgcgacaattcggagggatgaacacagtggggcagtggtcgtggcccgaatcatgaggggcggagcggctgatagatccggattggtacacgtcggggacgaactgagagaggtcaacggaatcgccgtattgcacaagaggcccgacgagatctctcagatcctggcccagtcacaaggctccatcactcttaagatcattcccgctacacaagaagaagataggctcaaggagagcaaagtgttcatgcgcgctctgtttcactataaccccagggaggacagagccatcccatgccaggaggccggacttccattccaacgccgtcaagttttggaagtagtgtcccaggacgaccccacgtggtggcaggctaagcgcgtgggagacacaaaccttagagctggcctgatcccaagcaagggtttccaggagaggcgcttgtcctaccgcagagcatatggcacacctatctcccctcagttttctcaacccaaacaggaactttccctcccgaggcactgggctcccactcaactgctgccatcatgcggcgcacactgccccggaggaaaggggacgcacacacccacgctcattcccattctactgtcgccatcactgcaactggagttcatacagtattag

SEQ ID NO: 230156 - DNA, 1758 bp, Artificial Sequence
  Description of Artificial Sequence: Synthetic coding sequence
atgcccgtcctgagcgaagacagtggcttacacgagacattagccctgctaacgtcacaattaagaccggacagtaatcataaggaggagatgggattcctccgtgacgtgttctccgaaaaatctttgtcctaccttatgaaaatacacgagaagctgcgctattatgaaagacagagtcccactccagtgctacattccgcagtggccctagcagaggacgtaatggaggaactgcaggctgccagcgtgcattctgacgagcgcgagttgcttcagctcctctctacacctcacttgagggcagtgctgatggttcacgacaccgttgcccaaaagaactttgacccggtcctcccacccttgcccgacaatattgacgaagacttcgacgaagaatctgtgaagattgtacgtctggtgaaaaacaaggaaccactgggggctactatcaggcgggatgagcactcaggagccgtcgtggttgccaggattatgagagggggagccgcagacaggtcaggcctggtccatgtgggcgacgagctgagagaagttaatggtatcgcagtgcttcataagagacccgacgagatcagccagatcttagcccagagccagggcagcattacactgaagatcatacccgcaacccaagaggaggatcggctaaaagagtctaaggtattcatgcgagcccttttccattataatccaagggaggacagggctattccctgtcaggaagcgggacttcccttccagcgtagacaggtcttagaggtggtgagtcaggacgaccccacatggtggcaggccaaaagggttggggatactaatttgcgggctggcctgatcccgtcaaagggttttcaggagcgtcgcctgtcatatagaagagccgctggtacactgccatctcctcagagcctgcgtaagccgccttatgaccaaccctgcgacaaggagacttgtgactgcgaaggatacttgaagggacactatgtcgctgggctgaggcgcagtttcaggttgggttgcagagaaagactgggaggaagccaagagggtaagatgtcctctggagcagagagccctgaactgctcacctatgaagaggtggcgaggtatcagcaccagcccggtgaaaggcctaggctggttgtgcttattggatccttaggcgcacggctccacgagttaaaacagaaagtcgtagccgagaatccacaacactttggtgtagccgttccccacacaacacggcctcggaagagtcacgagaaggagggagtggaataccacttcgtaagtaagcaagcattcgaggctgacctgcaccacaacaaattcctggaacacggcgagtacaaggaaaacctatacgggaccagcttagaggctattcaagccgtgatggccaaaaataaagtttgccttgtagatgtcgaaccggaggccctcaagcaactgagaacatctgagtttaaaccatacatcatcttcgtgaagcctgccattcaagagaaacgaaaaactccccctatgtctcccgcatgtgaagacaccgccgctccttttgacgaacaacagcaggaaatggctgcatccgccgcttttatcgatcgacattacggtcatttggtggatgccgtgttggtgaaggaagacctgcagggcgcttactctcagttgaaagtggttctggaaaagttatccaaggatacgcactgggtacctgtgtcttgggtccggtag

SEQ ID NO: 230157 - DNA, 1833 bp, Artificial Sequence
  Description of Artificial Sequence: Synthetic coding sequence
atggagctgcagtatcccccaccaccaccctcaccgcgaatttgtagagagagatcaggcggtgacaacgcttctatgcctgtgctaagcgaggacagcggtctacacgaaactctcgccttattgaccagccagctccgaccggattcgaaccataaggaagaaatgggctttctgcgagacgtctttagtgaaaagtcgttatcgtacttgatgaagatccatgagaaactgagatactacgaacgccagagcccaacacctgttttacactccgcggtagccctggcagaagacgtgatggaggaactacaggcagcctcagttcattccgacgaaagggagcttctacaactgttgagtactccacacctcagagcggtgctcatggtgcacgacactgtggcgcagaagaattttgatccagtactgccccctctgcccgacaacatcgacgaagattttgatgaggaatcggtgaaaattgtgcggcttgtaaagaataaggaacccctcggcgctaccattcgccgagatgaacacagcggagcagtagtggtggcacggatcatgcgaggcggtgctgctgatcgttccggcttagtccacgtgggagacgagctacgcgaagtcaatggtattgctgttcttcacaaacgccctgatgaaatctctcaaatcctggcacagtcccaaggctcaataacgctgaagattatccccgctacacaggaggaagaccgcctcaaggagtctaaagtgtttatgagggccttgtttcattataacccccgtgaggaccgcgctataccatgtcaggaagctggcctcccttttcagcgccgtcaggtgctggaagttgtaagtcaggacgacccgacatggtggcaggctaaaagggtcggggacaccaatctccgtgcaggactgatcccttccaaaggttttcaggagagacggctctcatacagaagggcagcgggtacgctgccgtcacctcaatctcttaggaagcctccttatgaccagccctgtgacaaggagacgtgcgattgcgaaggctaccttaagggtcactacgttgccggactccgcaggagtttccgtcttggttgcagagaacgcctaggtgggagccaagaaggaaaaatgtcaagcggagcagagagcccagaacttctgacatatgaggaggtggctcgataccagcaccaaccaggagagaggcccagactcgtggtgcttatcggtagcttaggcgcacgccttcatgaattgaaacagaaagtagtcgccgagaacccgcagcactttggggtggcagtgccacacactacacgcccaaggaagtcccacgagaaagaaggagtggagtatcattttgtcagcaagcaggccttcgaggcagacctccatcataacaagtttctggagcacggagagtacaaggagaatttgtatggcactagtctggaggctattcaggctgtgatggctaagaacaaagtgtgtctcgtagatgtggaaccagaagctttaaagcaacttcgcacttctgaattcaagccgtacattatatttgttaagccagcgatacaggagaaacgcaagactccaccaatgtcaccggcttgtgaagataccgccgcaccattcgacgaacagcaacaagaaatggccgctagtgcagctttcatcgatagacattatggccatctggtggacgcagtcctggttaaggaagatctgcagggggcttactcacaacttaaagtcgtcctcgagaagttgagtaaggatacacactgggtgcccgtgtcttgggtgcggtag

SEQ ID NO: 230158 - DNA, 1782 bp, Artificial Sequence
  Description of Artificial Sequence: Synthetic coding sequence
atgattcagagcgacaagggcgctgacccaccagacaagaaagacatgaagttatctacggccactaacccccagaacggcctgtcacagattttgcggcttgttcttcaagaactatctctcttctacggcagggatgtgaatggagtctgcctgttatatgacctgctccattccccttggctgcaggctctcctcaaaatttacgactgcctgcaggaattcaaggaaaagaaactggtcccagccaccccacacgctcaggtgctgtcgtatgaggttgtcgaactgcttagggagacacctactagtccagagattcaagagctccgccaaatgctgcaggctccacacttcaaagctctgctgagcgcccacgacaccatagcacagaaggactttgaacccctcctccccccactcccagacaatattccagaatccgaggaagctatgaggatagtgtgccttgtcaagaaccaacagcctctcggagctaccatcaagaggcatgaaatgaccggcgacatcctggtcgcacgcataatacatgggggtctggccgagcggagtgggttgctttatgcaggagataagctagtggaagtgaacggcgttagcgtagaaggattggacccagaacaggtaatacatatcctggcaatgagtcgcggaaccattatgttcaaggtggtgcccgtctcagatcctccagtcaactctcagcagatggatcccgacattccctgtatggatgcgggactgccctttcaaaagggagatatcctgcagatcgtggaccagaacgatgctctgtggtggcaggctcgcaaaataagcgatcctgcaacatgtgctgggctggtcccctctaatcatttgctcaagaggaaacaacgagagttctggtggagccagccataccagccccacacatgtttgaagtcgacgttgtataaggaggagtttgtcggttacggacagaaattctttatcgctggctttagacggtcgatgcggttatgtcgccgaaaatcccacctctccccgctccacgcctcagtgtgctgtacaggctcatgctatagtgccgtgggtgccccttacgaggaggtggtgaggtaccagaggagacctagcgataaatatagattaatcgtgctgatgggcccatcaggagttggagtgaacgaactgcgccgacagctgattgaatttaacccctcgcattttcagtctgctgttccccataccacccgaaccaagaagtcctatgagatgaatggtcgagaataccactatgttagcaaggagacatttgaaaatctgatatactcacaccgaatgctggagtatggggagtacaagggacatctgtacggtaccagtgtcgacgccgtgcaaaccgttctcgttgaaggtaagatctgtgtgatggacttggagccgcaagatatccagggggtacgcacccacgagctcaaaccttacgtgatcttcataaaaccttcgaacatgcgttgtatgaagcagtcaaggaaaaatgccaaggtgataacggactactacgtggacatgaagtttaaggacgaggatctgcaggagatggagaatctggcccaaaggatggaaacccagttcggccagttttttgaccacgtaattgtaaacgatagtctccatgatgcttgtgcgcagttactttcagccattcagaaagcacaggaggagcctcagtgggtcccagcgacctggattagctccgatacagaatcacagtag

SEQ ID NO: 230159 - DNA, 1809 bp, Artificial Sequence
  Description of Artificial Sequence: Synthetic coding sequence
atgatccagtccgacaaaggcgctgacccgcctgacaagaaagacatgaagcttagtaccgccacaaatcctcagaacggtctgagccagatcctccgcctggttctgcaggaactgtctctgttctacggcagagacgtgaacggcgtgtgcttgctctacgacctcctgcactcgccatggctccaggcactgctaaaaatatacgactgtctccaagagttcaaagagaagaaactcgtgccagccacaccccacgcacaggttctgagctacgaagtggtggagctcctgcgagaaaccccaacatcaccggagatccaggagctccggcaaatgctccaagctccacacttcaagggagccactatcaagagacatgagatgacaggtgatatcctcgttgctaggatcatccatggtggactcgccgaacggtccggccttttatacgcaggagataaattagtcgaagttaatggcgtatcagtggagggcctcgatcccgaacaggtgatccacatcctggctatgtcaagggggactatcatgtttaaggtggttccagtctctgatccaccagttaattcccaacagatggtatatgtgcgggcaatgacagagtactggccccaggaagaccccgatatcccttgcatggatgccggactgccctttcaaaagggagacatccttcagatcgtggatcaaaacgacgctctgtggtggcaggcacgcaagatatctgaccctgccacatgtgccggtctagtcccctccaatcatttgctcaagcgctggtctttcgcattggtcgcccaggcaggggtccagtggcactatcttgattctctgcaacccctgccccctgggttcaaacggttctcttgtctatcgttgcctagatcatgggactacattgaagatgacatgaagattgacgaaaaatgcgtggaagcagaaaaggagtctatagagaccgacaaggaggagttcgttggatacggacagaaatttttcatcgctggcttcagacgttcaatgcgtttgtgtagaaggaagtcgcatttaagtcccctgcacgcaagcgtgtgctgcacgggcagctgttattccgcggtgggagcaccttacgaagaggtggtcagataccaacggagaccctccgacaaataccgactgattgtgttaatgggaccttcgggagtaggtgtgaacgagcttcggaggcagctgatcgaattcaacccttcgcacttccagtccgcagttccacatacaactcgcactaagaaaagttacgagatgaatgggagagagtaccattacgtgtccaaggaaaccttcgaaaaccttatctacagccatagaatgctggagtacggagagtacaagggtcacttgtacggtacatcggttgatgcagtgcaaacagtcctagtagaagggaaaatttgcgtaatggatctggaaccacaagatattcaaggtgtgcggacccatgaactgaagccatatgtgatctttattaagcctagtaatatgcgctgtatgaagcagagcagaaagaatgctaaagtgattactgactactatgtcgatatgaagtttaaagacgaggatctgcaggaaatggagaacctggcccaacgcatggagacccagtttggccagttttttgaccatgtgattgtgaatgatagtctgcacgacgcttgcgcccagctcttaagcgcgattcagaaagcccaagaggagcctcagtgggtccccgcaacttggataagctcggacaccgagtcccaatag

SEQ ID NO: 230160 - DNA, 1914 bp, Artificial Sequence
  Description of Artificial Sequence: Synthetic coding sequence
atgatccagagcgacaaaggcgctgacccccctgataaaaaggatatgaaactctccacagccacaaaccctcaaaacgggctcagccaaatcctaaggctggtcctgcaggagctgtctttgttctatggcagggacgtcaatggagtctgtctcctctacgaccttctgcacagtccttggttacaggctttgctcaaaatttatgattgtttacaggagttcaaggagaagaaactagtccccgctacaccacacgcacaggttctcagctacgaagtggtcgagctgctgagagagacccccacctctcccgagatccaagagctcagacagatgttgcaggcccctcactttaaggccctgctttctgcacatgatactatagctcagaaggactttgaaccgctcttgccccctctaccagacaatatccccgaatccgaagaggcaatgcgcatcgtttgtctcgtaaaaaatcaacaacccctcggagccaccattaagcggcatgagatgacgggcgatatcctggtggccagaatcatacatgggggactggccgagcggtcaggtctgctttacgctggcgataaattggttgaggtcaacggcgtctccgtggagggcctggaccccgagcaggttatccacatactggccatgagccgcggaactatcatgttcaaggtcgtccccgtgagcgatccacctgtcaatagccagcagatggtgtacgtgcgagctatgaccgagtattggccccaagaggaccccgacattccatgtatggatgccggtctaccgtttcaaaaaggagatatcctacaaattgtcgatcaaaacgacgccctctggtggcaggctagaaagatcagtgaccctgctacatgtgctggtttagtgcccagtaatcaccttctcaaacgcaagcagcgggaattctggtggagtcaaccttaccaacctcacacttgcctgaaatccaccttgtccatcagcctgaagggggaggacgacatgaagatagacgagaagtgcgttgaggctgagaactctactgccgaatctgaggaactcaattccgacaaggaagaatttgtcggctacggccagaagttcttcatcgctggctttcggaggtccatgagactgtgtagacgtaagtcccacttatcaccactccatgccagcgtgtgctgtaccggctcttgctactctgctgtcggagccccatatgaggaagtcgtgaggtatcagcggagaccaagtgataagtacaggctgattgtgttaatgggtccaagcggagtgggggtaaacgagctcaggcgccagctcatcgaatttaaccctagccactttcagtctgctgtaccacacacgaccagaacaaagaaatcttacgagatgaacggccgagagtatcactacgtgtctaaggagaccttcgaaaacctgatttattcacacaggatgctggaatatggcgagtataaggggcatctctatggaacgtctgtagacgccgtacagacagtcctggttgagggtaagatttgcgtgatggacctcgagccccaggacatccagggtgtgaggactcatgaattgaagccttacgtgatattcataaaaccctcgaatatgagatgtatgaagcaatcacggaaaaatgcaaaggttatcacagactactacgtcgatatgaaatttaaagacgaagacctccaggaaatggagaacctagcccagagaatggaaacccaattcgggcagttctttgatcatgtgatcgtcaacgacagtctgcatgacgcttgtgcacagttgctttctgcaatccagaaggctcaagaggagccacaatgggtgcctgccacgtggatcagcagcgacactgaaagccagtag

SEQ ID NO: 230161 - DNA, 1701 bp, Artificial Sequence
  Description of Artificial Sequence: Synthetic coding sequence
atgatacagagcgacaagggcgcagatccacccgataaaaaggatatgaagctctccacagcaacaaacccccagaacggcctgtcgcagatactgaggctcgtgcttcaggagctatccctattctacggaagggacgttaatggcgtttgcttactgtacgacctgctccactccccttggttgcaggcattattgaaaatttacgattgtctacaggagtttaaggagaagaaattggtgccagctacaccccatgcacaggtgctcagttacgagggtgctacaattaaacgtcacgagatgactggagacatactggtggcccgaattattcacggtgggcttgcggagaggtcagggcttctgtatgcaggcgacaagctcgttgaggtcaacggcgtctcagtggaaggcctcgatcccgagcaggtcatccacattctcgcaatgtctagaggcaccatcatgtttaaggttgtgcctgtgagtgatcctccagtcaacagtcagcaaatggtgtatgtacgggctatgaccgaatattggccacaggaggatcccgacatcccttgtatggacgccggactcccctttcagaaaggagatatcttgcagatagtggaccaaaatgacgccttatggtggcaggctcgtaaaattagtgatcctgccacctgtgctggcctcgtgccatccaatcacctgctcaagcggaaacagagagaattttggtggagccagccatatcagccccatacgtgtcttaaaagcaccctgtctatctctctgaagggtgaggatgacatgaagatagacgagaaatgcgttgaagccgagaattcaacggcagagagcgaggagctgaactctgacaaggaggaattcgttgggtacggccagaagttttttatcgctggtttccggaggtctatgagactgtgtcgcaggaaaagtcatctgtcacctctgcatgcaagtgtgtgttgtacagggagctgttacagcgccgtgggggcaccatatgaggaagtggtgcgctatcagaggcggccatccgataagtaccgcttaattgtcctgatggggccaagcggagtcggcgtaaacgaactgaggaggcagctgattgagttcaacccatcccacttccagagcgccgtgcctcacacgacgagaaccaagaaaagctacgaaatgaacggacgggaatatcactatgtgagcaaagagactttcgagaaccttatttactcccatcgcatgctagaatatggagagtacaaaggtcacctgtacggaacctccgtggatgcagtccagacggttctggtggaagggaagatatgtgtaatggacctagagcctcaggacattcagggtgtacggacccacgagctcaagccctacgtgatttttattaaaccatctaacatgcggtgtatgaaacaatccaggaagaatgcaaaagtaatcactgattattatgttgacatgaaattcaaagacgaggacttgcaggagatggaaaacctggcccagagaatggaaactcaatttggccaatttttcgatcacgtcatagttaatgactcattacatgatgcatgtgctcaacttctttctgccatacaaaaggcccaggaggaaccacaatgggttcccgctacatggatttcaagcgataccgagagtcagtag

SEQ ID NO: 230162 - DNA, 1914 bp, Artificial Sequence
  Description of Artificial Sequence: Synthetic coding sequence
atgatacagtctgacaagggggcagaccctcctgacaaaaaagatatgaaactgagtacggccacaaacccgcaaaatggactatcccaaatcttgaggctggtactccaagagctaagtctgttctatggacgagatgtgaacggagtgtgccttctatacgatctcttgcatagcccctggctgcaggccttacttaagatatatgactgtctgcaggaattcaaggaaaaaaagttagtaccagctacaccacacgcacaggtgctgagctacgaggttgtagaactgctccgggagaccccaacgagtccggaaatccaagagctacgccagatgctccaggccccacatttcaaggcactgttatcagcacacgacactattgctcagaaggactttgagcccctgctccctccactccccgacaacatcccagagtccgaagaggccatgagaatagtctgtttagtgaaaaaccagcagccattaggagccaccataaagaggcacgagatgactggcgacatcttggtggccaggatcatccatggtggactagcagaacgctctgggctcctctacgccggtgacaaactggtcgaggtcaacggtgtgagcgtcgagggtctggaccccgaacaagttatccacatcctcgctatgagtagaggaactatcatgttcaaagtcgtgccagttagtgacccccctgtcaattcccagcagatggtgtacgttcgcgcaatgacagagtattggcctcaggaggacccagacattccctgtatggacgccggactgccttttcagaagggggatattctccaaattgtggaccagaacgacgctctctggtggcaggcaaggaagatctcagaccctgccacctgtgccggtctggtaccctctaatcatctgttgaagagaaaacagcgcgaattttggtggtcgcagccctaccaaccacacacgtgccttaaatcaactctgtccatatctatggaagaagaggatgatatgaaaatcgatgagaaatgtgtggaggccgatgaggagacatttgaatccgaagagctcagcgaagataaggaggaatttgtgggctatggccaaaaattcttcattgctgggtttagaaggagcatgagactctgtagaagaaaaagtcatctatcacctctccatgcttctgtgtgctgcacaggttcttgttacagcgccgtcggagcaccatacgaggaggtagtcagataccaaagaaggcctagcgataaatacaggcttatcgtcctgatgggcccatctggagtgggtgtcaatgagctaagaaggcagttgatcgagttcaacccaagccactttcaatcagccgtgccacacactacccgcaccaaaaaatcatatgaaatgaatggtcgggagtatcactatgtaagcaaagagacattcgagaatctgatttattcacaccgcatgctagagtatggcgagtataaggggcacctgtacggcacaagtgtggatgcggtgcaaactgtgttggtggagggaaagatctgtgtgatggacctggagccccaagacattcaaggagtgcgaacgcacgagctgaagccttatgttattttcattaaaccatcaaacatgcggtgcatgaaacagtcccgtaagaatgcaaaggtgataacagactattatgtggacatgaaatttaaggatgaggacctgcaggagatggaaaacctggcgcagaggatggagactcaattcggacagtttttcgaccatgtgattgtgaatgatagcttgcacgacgcgtgcgcgcaactgctttcagctattcagaaagctcaagaagaaccacagtgggtgcccgcaacctggattagttcagacactgagtctcagtag

SEQ ID NO: 230163 - DNA, 2028 bp, Artificial Sequence
  Description of Artificial Sequence: Synthetic coding sequence
atgactacgagccatatgaacgggcacgttaccgaagaaagtgactctgaagtgaaaaatgttgatttggcctcgccggaggagcatcagaagcaccgagaaatggcggtcgactgtcccggtgatcttggaacacgaatgatgccgatccggagatcagcccagctggagcgcatccggcagcaacaggaagacatgagacgtaggagagaggaggaaggaaaaaaacaggagctcgacttgaattcctctatgcgtctgaaaaagctggcccagattccccctaagacaggtatcgataatcccatgtttgacaccgaggagggcatcgtgttggagtcaccccactacgccgtcaagatactggagatcgaagatctgttctcctcactcaagcacattcaacataccctggtggactcacaaagccaggaggacatttctctactcctccagctagtgcagaataaggactttcagaacgctttcaaaattcacaatgctattacagtacatatgaacaaggcatccccgccttttccactcatctcaaacgctcaagaccttgcccaggaagtacaaaccgttctgaagcccgtgcatcataaagaagggcaagagctaactgccttgctcaacacaccccacatccaggccctgctgctggctcatgacaaggtggccgaacaggagatgcagctcgaacctattactgatgagagggtgtacgaaagtattggacaatacgggggagagactgtcaaaatagtgcgtatcgagaaggccagggacatacccctgggggctacagtgcgcaacgaaatggatagcgtaatcatctcccggatagtgaagggaggcgcagcggaaaagtccggattgctgcacgaaggagacgaagtgctggagattaatggcattgaaattcggggtaaagatgtgaacgaagtgtttgatctgctgtctgatatgcatggtacactgacatttgttctgattccctcccaacagatcaagccccctcctgcaaaggagaccgtgattcacgtgaaagcccacttcgactacgatccttcagacgatccatacgttccttgtcgcgagcttggactcagcttccagaagggtgatattttgcacgtgatcagtcaggaagaccctaactggtggcaggcctacagagaaggggatgaagataaccagccgctagcaggactggtgcctggaaaaagctttcagcagcagagggaagctatgaaacagaccatcgaagaggataaagagcctgagaagtccggtaagctctggtgtgctaaaaaaaataaaaaaaagcggaaaaaggtactgtacaatgctaataaaaatgatgattacgataacgaggagatcttgacatacgaagaaatgtctctgtaccatcaaccagctaatcgaaagcgccctatcatcctgattggtcctcagaattgtgggcagaacgagctccgccagagacttatgaacaaggaaaaggaccggttcgcttctgctgttccccataccactaggagccgccgtgaccaggaggtggcaggcagagattatcatttcgtgtcacgtcaggccttcgaagccgacatcgctgcagggaagttcatcgaacacggtgagttcgagaaaaatctgtatggcacctccatcgattctgtacggcaggtcattaatagtgggaagatctgcctcctcagcttgcgaacccaaagcctgaagactcttcgcaattcggatctgaagccctacattattttcatcgccccaccaagtcaggaacggctgcgcgcactactcgccaaggaaggcaagaaccccaagcctgaagagttaagagaaattattgaaaagacaagagagatggagcaaaataacgggcactacttcgatacggctattgtcaattcggacttagacaaggcttaccaggaactgctccgcctgatcaataagttagacactgagccacagtgggtcccttccacatggttgcggtag

SEQ ID NO: 230164 - DNA, 1926 bp, Artificial Sequence
  Description of Artificial Sequence: Synthetic coding sequence
atggctgttgactgtcctggggatctcggaaccaggatgatgcccattagacggagtgcacaattggagcgtatcaggcagcagcaggaagacatgcggagaagacgcgaagaggagggaaagaagcaggagctggacttgaattcttctatgcgcttaaaaaaattggcacagattccccctaaaactgggatcgacaatcctatgttcgatactgaggagggtattgtgttggaaagtccacactatgccgttaaaatccttgagattgaagatttgttctcgagccttaagcacattcagcacaccctggttgattcacaaagccaagaggacatctccttgttgctccagctggtccaaaacaaggactttcagaacgcatttaagatccacaacgctatcaccgtgcacatgaataaagccagtccgcctttcccactgatttccaatgctcaagatctggcccaagaagtgcagactgtactcaagcccgtgcaccacaaggagggccaggaactgacagcacttctgaatacgcctcatatccaggcattattacttgcccacgacaaggtggccgagcaggaaatgcagctcgaacccatcacggacgagagagtgtatgagagcataggccagtatggtggtgaaactgtaaagatcgtcaggattgaaaaggccagggacatcccactgggcgctaccgtaaggaacgagatggattcagtcattatatctagaatcgttaaaggaggtgctgccgaaaagagcggtctgctgcacgaaggagacgaggttctggaaattaacgggatcgagattcgcggtaaggacgtcaacgaggtttttgatctcctctcagacatgcatgggacactcacatttgttctgatcccctctcagcagatcaagccccctcccgcaaaagaaacagtgatccacgttaaagcgcatttcgattatgacccatctgacgatccttacgtcccctgtagagaacttggcctgtcctttcaaaagggcgacatccttcatgtcatctcacaggaggatcccaactggtggcaggcctatcgtgagggggacgaagacaatcaacctcttgccggattggtgccagggaaatcattccagcagcagcgagaagcaatgaagcagactattgaagaagataaggaacctgaaaagtctggtaaactgtggtgtgccaagaaaaacaaaaaaaaaaggaaaaaggtcctctacaacgctaacaaaaacgacgattacgacaatgaggagatcctcacctacgaggaaatgtctctgtaccaccagcctgccaatcggaaacggcctatcattctgataggtccccagaactgcggacaaaatgagcttaggcaacgacttatgaacaaggaaaaggacagatttgcctccgcagtgccccacactactaggagcagacgtgatcaagaagtggccggaagggactaccacttcgtgtcccgacaggccttcgaagctgacatcgccgctggcaaatttatcgaacatggagaatttgaaaaaaacttgtacgggacttctatagactccgtgcgccaggttattaactcaggaaagatctgtctgctgagtctcagaacgcagtcacttaaaaccttgcgcaactccgacctgaagccttacataatctttatcgcccctccttcacaggaaaggctgcgtgcgctcctcgccaaggagggcaaaaatccgaaacctgaggaacttcgtgaaattatcgaaaaaactagagagatggagcagaataatggccattactttgatacagcaatcgttaattctgacctggacaaggcttaccaagaactccttagattgattaataagctggataccgagccacagtgggtaccaagcacctggctgcggtag

SEQ ID NO: 230165 - DNA, 15 bp, Artificial Sequence
  Description of Artificial Sequence: Synthetic coding sequence
atggctgtcgactag

SEQ ID NO: 230166 - DNA, 450 bp, Artificial Sequence
  Description of Artificial Sequence: Synthetic coding sequence
atggccgtggactgtccaggagatctggggacgcggatgatgcccatcagacgtagcgcccagctggagcgtatacgtcagcagcaagaggacatgagaaggcggcgagaagaggaggggaaaaagcaagaacttgatctcaattcctcaatgagacttaaaaaactagcacaaattccacctaagactggcatcgacaaccctatgtttgacaccgaggaaggaatcgtgctggagagtccacactacgccgtgaaaatcctggagattgaggacctgtttagttccctcaaacatatccagcatactctggtggacagccagtcccaggaagacatctccctgctgttgcagctggtgcaaaacaaagactttcaaaatgcatttaagatccataatgcgattactgtacacatgaacaaagcgtcaccaccattcccactgatttag

SEQ ID NO: 230167 - DNA, 870 bp, Artificial Sequence
  Description of Artificial Sequence: Synthetic coding sequence
atgactggagtgtttgaccgcagggtcccaagtatccggtcgggagacttccaggctccattccagacctccgcggcaatgcaccacccttcacaggagtctcccacactgcccgaatcgtcggcgacagattcagactactactcacccaccggaggggcaccccacggctattgctccccaaccagtgctagttacgggaaagccctaaatccttatcaataccagtaccacggcgtcaacggctcagcagggagttaccccgctaaagcatacgctgactatagttacgcctctagctatcaccaatatggcggagcttacaatagagtccctagcgccacaaatcaaccagaaaaagaggttactgaaccagaagtgaggatggtgaacggtaagcccaaaaaggttcgcaaacccagaaccatttattcctccttccagttggccgcacttcagagacgattccagaagactcaatatttagcacttccggaacgggctgaactggcagctagtctaggacttacacagacccaagttaagatttggttccaaaacaaacgtagcaagataaaaaagattatgaagaacggagaaatgcccccagagcacagtccgagctcctccgatccaatggcatgcaactcccctcagtcacctgccgtatgggaacctcagggatccagccggagcctttctcaccacccacacgcgcatccacccaccagtaatcagagcccagcgagctcttatctggaaaatagtgcctcttggtacacctctgccgcatctagcatcaactcccatttgccaccaccaggctccctgcaacaccctctggccctggcatccgggactttatattag

SEQ ID NO: 230168 - DNA, 1623 bp, Artificial Sequence
  Description of Artificial Sequence: Synthetic coding sequence
atgcagcaagtactcgaaaatttgactgagctgccctctagcactggggctgaagagatcgatttgatcttcctgaagggaattatggagaatccaatcgttaagagtttggccaaggctcatgagcgcctggaagatagtaagctcgaagctgtttctgacaacaatttggaactggttaatgaaatactggaggatatcacaccactgatcaatgtggatgagaatgttgccgagctcgtgggcattctgaaggaaccccactttcagtctctgctagaagctcacgacatcgtggcctcaaagtgttatgactcacctccctctagtcccgagatgaataactccagtattaacaaccagcttctgcctgttgatgccatccggatcttaggcatacacaagcgcgctggagagcctcttggcgtgacatttcgcgtggagaataacgacttggtgatcgctagaattctgcacggaggcatgatcgatcggcagggcttgctccatgtcggggatattattaaagaggtgaacggccatgaagtgggaaataacccgaaggagcttcaggagctcttaaaaaatatttccggttcagtgactttgaaaatcttgccaagttatagggacaccataacgccacaacaggtgttcgtgaaatgccatttcgattataacccctataatgacaacttaattccatgtaaagaggcgggacttaagttttctaaaggggaaattttgcaaattgtgaatcgagaggacccaaattggtggcaagcttctcatgtaaaggaagggggaagtgcgggacttatcccatctcaatttcttgaagaaaaaagaaaggccttcgtgagacgagattgggataactccggtcccttttgtggaaccatcagctctaagaagaagaagaagatgatgtatctgacaacgcggaacgccgagttcgaccgccatgagatacaaatttacgaggaggtcgctaagatgccccctttccagcggaaaaccctcgttctgatcggtgctcagggagtgggaagaaggtccctcaaaaatcggtttatagtgctcaacccaacaaggttcggcactacagtaccttttacatctaggaaacctcgggaggacgaaaaggatggtcaggcgtataaatttgtgtcccgatcagagatggaagcagatatcaaagcagggaagtacttggaacacggagagtacgagggcaacttatatggcacgaagatcgattctatcctggaggtcgtgcagactggcagaacttgcattctcgacgtgaaccctcaagcgttgaaagtgttgcggaccagcgaattcatgccatatgttgtgttcatcgccgctccagagctcgagacactcagagccatgcacaaagcagtcgtggacgccggaataaccactaaacttctgactgacagtgatctgaagaaaaccgttgatgagagcgcaaggatacagcgggcatataaccactactttgatctgattatcattaacgataacttggataaagccttcgagaagcttcagacagccatcgagaaacttaggatggaacctcagtgggtgcctattagctgggtatactag

SEQ ID NO: 230169 - DNA, 1287 bp, Artificial Sequence
  Description of Artificial Sequence: Synthetic coding sequence
atgaataacagtagtattaataaccaattgttgcctgtggacgcgattcggatcctcggcatccacaaaagagccggtgagcctctgggtgtgaccttcagagtagagaacaacgatctggtaattgccaggatattacacggaggcatgatcgatagacagggactgcttcacgttggcgatatcataaaggaggtcaacgggcatgaagtgggtaacaacccgaaagagttacaggagctgctgaaaaacatatccgggagcgtgacattgaagatcctgccaagctacagagatacgatcacccctcagcaggtttttgttaagtgtcacttcgattataacccatataacgataatctgatcccctgcaaagaagccggtctaaagttctctaagggcgagattctgcagatcgtgaacagggaggacccgaattggtggcaggcgtcccacgtgaaggaaggtggcagtgccggactgattccatcccagttccttgaggagaaaaggaaagctttcgttcggagggactgggacaacagcggacctttctgcggtacaatcagctcaaaaaaaaagaagaaaatgatgtatctcactactcgcaatgcagaattcgaccgccatgaaatccaaatttatgaagaagtcgccaaaatgcctcccttccaaaggaagaccctggtgcttattggagcccagggggtgggccgacgcagtctgaaaaaccggttcatcgttctgaatccaactagattcggcaccaccgttccttttactagccgcaagcctagagaggacgagaaagacggtcaggcttacaaattcgtgtctcggtctgaaatggaagctgacatcaaggctggcaaatacttggagcatggggaatacgaaggcaacctttatggaacgaaaatagactctatactggaagttgtgcagactgggcgaacatgtatcctggatgtgaatccacaggcacttaaagtcctgaggacaagtgagttcatgccctacgtggtgtttattgcggcacccgaattggaaaccctcagggcaatgcataaggccgtcgttgacgccggaattacgaccaagctgttgacggacagcgaccttaagaaaacagtggatgagagcgcgcgaattcaacgagcttataaccattacttcgacctaatcatcataaatgacaatctggataaggcttttgaaaagttacaaactgcaattgagaaattaagaatggagccacagtgggtccccatttcatgggtctactag

SEQ ID NO: 230170 - DNA, 924 bp, Artificial Sequence
  Description of Artificial Sequence: Synthetic coding sequence
atgcagcaggtgttagagaatcttacagagctgccttcgtccaccggcgcagaagagatagatcttatcttcttgaaaggcatcatggagaacccaattgtgaaaagtctggccaaagcccacgagcgccttgaagattcaaagttggaggctgtctccgacaataatctcgaactggttaacgagattctggaagatattacacccctgatcaatgtagacgaaaacgtggccgagctggtaggaatcctgaaagaaccccatttccagagcctcctggaagcccatgatatcgttgccagtaaatgctacgattcccccccatcatcacccgagatgaacaattccagtatcaacaatcaactgttgcctgtggacgcaatccgcattctgggtatccacaaacgcgctggtgaacctttaggagtcaccttccgagttgagaacaatgacttggtcatcgcccgaattctgcatgggggaatgattgaccgccagggcttgctgcatgtgggtgacatcataaaggaggttaatggccatgaggtgggtaacaaccctaaagaacttcaggagctgcttaagaacatttccggttctgtgacattaaagattctgccttcgtacagagacaccataactcctcagcaggtgtttgtgaaatgccactttgactacaatccgtacaatgataatctgataccttgcaaagaggccggactgaagttcagtaagggcgaaatactacagatcgttaacagggaggatccaaactggtggcaggcaagtcacgttaaggaggggggatccgctggcctgatcccttctcagtttttggaagagaagcggaaagcattcgtaaggagggactgggacaattccggcccattttgcggaacaataagctcgaagaagaagaagtag

SEQ ID NO: 230171 - DNA, 654 bp, Artificial Sequence
  Description of Artificial Sequence: Synthetic coding sequence
atgcaacaggtcttggagaacctcaccgagctgccgagttcaaccggggcagaggaaattgatttgatattcctgaaaggcattatggaaaatccaatcgtgaagagtcttgcaaaggcccatgaacgactggaggattctaaactggaggccgtgtccgacaataacctggaattagtcaacgagatcctggaggatattacgcctctgattaacgtggatgaaaatgtagctgagctggtgggtattctgaaagagccacattttcagagcttacttgaggcacatgatatcgtggcctccaagtgctacgatagtcctccttcctcccccgaaatgaataactcctctatcaacaaccaactgctgcctgtagacgctatcaggattcttggaattcataaaagggctggcgagccgcttggcgtgacttttagagtggaaaacaacgatctggttatagctagaatcctgcatgggggtatgatcgatagacagggccttctacacgtaggcgacattattaaagaagtcaacggtcatgaggtgggaaacaacccaaaagaactgcaggagctcctcaaaaacatctctggcagtgtgaccctgaagatcctcccctcttatagggacacaatcactccccagcagtag

SEQ ID NO: 230172 - DNA, 1731 bp, Artificial Sequence
  Description of Artificial Sequence: Synthetic coding sequence
atgccagcgcttagcaccggcagcggatcagacacaggcctttacgagctgctggccgcactccccgctcagctccagccacatgtcgactctcaggaggacctcacatttctgtgggacatgtttggtgagaaaagcctccacagcttggtcaagattcacgaaaaattacactattacgaaaaacagtcacctgtgccaattctccacggcgcagcagcgttggccgatgatctggctgaggagctgcagaacaaacctctgaactcagaaatcagagagctgctaaagttgcttagcaagcctaacgtgaaagcgctgttgtccgtgcacgacactgtggctcagaagaactatgatcctgtgcttcccccaatgcctgaggacatcgacgatgaggaggatagtgtaaagatcatccgcctggttaaaaaccgggaaccgctgggcgctaccatcaagaaagacgaacagacaggcgcaatcatcgttgctaggattatgagaggcggagcagccgacagatccggtttgattcacgtgggggacgagctgagggaagtcaacggaattcccgtcgaggacaagagaccagaagagattatccagatacttgctcagtcgcaaggggcaattacctttaaaatcatcccagggagtaaggaggaaaccccctcaaaggagggaaagatgtttataaaggccctctttgactataatcccaatgaggacaaagccattccgtgcaaggaagcgggactgagcttcaagaagggcgatatcctccagatcatgagtcaggacgacgcaacttggtggcaggcaaagcatgaagccgatgctaatcctagagcaggcctcatcccgtccaagcatttccaggaacggaggctggctctgaggcgtccagagatccttgtgcaacctctgaaggttagcaacagaaagtccagtgggttccgtaagtcgtttcgtctgagccggaaggacaagaaaaccaacaagtctatgtatgagtgcaaaaagtcggatcaatacgatacagccgacgtgcccacatacgaggaagtgactccatacagaaggcagactaatgagaagtacagattggtggtgctggtggggccagtgggagtgggtctgaatgaactgaaaagaaaactgctgatcagcgacacccagcactacggcgtgaccgtgccgcacacaacacgagctagacgctcccaggaatcagatggcgtcgaatacatttttatcagcaaacacttgttcgaaaccgacgtgcagaataacaagtttatcgagtatggagagtacaaaaacaactactatggcacctcgatagattccgtccgcagtgttcttgctaaaaacaaggtgtgtctcttggatgttcaaccacatacggtgaaacacctgcgcacactggagttcaagccatatgtcattttcataaagccgccatcaattgagagactgcgggaaacccgaaagaacgcaaaaatcatatcttccagggacgaccaaggggctgccaagccttttaccgaagaagatttccaagaaatgattaaaagcgcccagatcatggaaagtcagtacggacacctgttcgataaaatcatcattaacgatgacttgacggttgctttcaatgagctgaaaactactttcgacaagctggaaacggagactcactgggtgccagtctcatggcttcattcatag

SEQ ID NO: 230173 - DNA, 1731 bp, Artificial Sequence
  Description of Artificial Sequence: Synthetic coding sequence
atgccagccttgagtacgggatcaggcagcgatactggcttgtatgagctgttggctgccttgcccgcacaactccaaccacacgtggactcacaggaagacctcacattcctgtgggacatgttcggcgaaaagtccctgcacagcttagtgaaaatccacgaaaagcttcactactacgagaagcagtcccccgtccctatcctgcacggcgctgcagccctggcagacgacctggccgaagaattacagaataaaccccttaactctgaaattagagagcttctgaaattactctctaagcctaacgttaaggcattgctgagtgtccatgataccgtggctcaaaagaactacgacccagtactcccgccaatgcccgaggatattgatgatgaagaagactctgtcaaaattatcaggctcgttaaaaacagagaacctctgggggcaacaatcaagaaggatgagcaaacaggggctatcattgtggcccgtatcatgcggggtggagccgcagacagatctggtctgattcacgtgggggacgagctgcgtgaggtcaatggcatcccagtagaggacaaaagacccgaggaaatcatccaaatcctggcgcagagccagggagccattaccttcaaaataatcccagggagcaaagaagaaacaccatctaaggaggggaaaatgttcatcaaggcgttgtttgattacaatccaaacgaggacaaggccataccttgtaaggaggctggattgagttttaagaagggcgatattctgcagatcatgagccaggatgacgctacttggtggcaagccaaacatgaagccgatgccaatcctagggctggactgatcccatccaagcactttcaagaaagacgcctggccttgagacgacccgagattctagtccagccgttgaaggtgtcaaatagaaaaagctcagggttccgcaagtcgtttcgacttagtaggaaggacaagaagacgaataagtcaatgtatgaatgtaagaaaagtgatcagtatgataccgcagatgtccccacatacgaagaggttacaccttatcgccgacagactaacgagaagtaccgcctagtggtgctcgtgggcccagtgggagtggggctgaacgaattaaaacggaaacttctaatcagcgacactcaacactacggggtgacagtgcctcacacaacacgtgcaagaagatcccaggaatccgacggggtggagtacatcttcattagcaaacacctatttgagacggacgtgcaaaataataagttcattgagtacggcgagtataagaataattattacggtacctcaatagatagtgtacgatctgtcctggcaaaaaacaaggtgtgcctattggacgtccaaccacataccgtgaaacatttgcgcactttggagttcaaaccttacgtaatatttattaaacccccttctattgaaaggctgagagagacacggaaaaatgctaaaataatctcctctcgcgatgatcaaggcgctgctaagcctttcaccgaggaggactttcaggagatgatcaagagtgctcagattatggagtcccagtacgggcacctgtttgacaaaattatcatcaatgacgaccttacagtggcctttaacgagctcaagacaacgtttgataaactcgagactgagactcactgggtgcctgtgtcctggctgcacagctag

SEQ ID NO: 230174 - DNA, 1731 bp, Artificial Sequence
  Description of Artificial Sequence: Synthetic coding sequence
atgccagcattgtcgaccggaagcggatcagataccggcttatatgaactgctcgcagccctccctgcacagctgcagccacacgtagattctcaggaagacctaaccttcctgtgggatatgtttggcgaaaagagcctacatagcctcgtaaagattcacgaaaagctccactattacgagaagcagtcccctgttcccattctgcatggggcagccgcactagctgatgatctggcagaagagttacaaaacaagcccttaaattcagagattcgcgagcttttgaagctgttgtctaaaccaaatgtcaaggcactgctgtccgtgcacgacaccgtagcccagaagaactatgaccccgttctccccccaatgcccgaggatatcgacgatgaggaggattcggtgaagattattcggctggtgaaaaacagggaaccactgggcgcaaccatcaaaaaggacgagcagacaggagcaattattgtggcgaggatcatgcggggtggtgcagctgaccgcagcggccttatccacgttggagatgaattacgcgaagttaacggaatccccgtcgaggacaagaggcccgaagagatcatccagattcttgcccaatctcaaggtgctataacctttaaaatcataccaggttctaaggaggaaaccccgagtaaagagggcaaaatgttcatcaaggcgctttttgactacaacccaaacgaagacaaggctatcccctgtaaagaagccggtctctcttttaaaaagggcgatatattacagattatgtcacaggatgatgccacttggtggcaggccaaacacgaggccgacgctaatcctcgagctggattaatcccctcaaagcattttcaggagcgcagacttgcactgcgcaggccagaaatattggtgcagcctcttaaggtgagtaaccggaagtctagcggcttcagaaagtcatttcgcctgagcagaaaagataaaaagacaaataaatccatgtacgaatgtaaaaagagtgaccaatatgataccgctgacgttcccacttatgaagaggtgacaccatatcgtagacaaacaaatgaaaagtaccggcttgtcgtgcttgtcggccctgtgggtgttggtctgaatgagctgaaaagaaagctgttaatctctgacacccagcattatggtgtgaccgttccgcacacaacacgggcaaggaggagtcaggagtctgatggagtggagtacatttttatttccaaacacctcttcgaaacagacgtgcagaacaacaaattcatagaatatggagaatataagaacaattactacggcacttccatcgactccgtccggtcggtattggcgaagaataaggtttgcctccttgatgtccaacctcatactgtgaaacacttaagaacattagagtttaagccttacgttatttttattaagccaccttctattgagagactgagggagacacgaaagaatgctaagataatctcctctagagatgaccagggagccgcaaagccctttaccgaagaagactttcaggagatgataaaatcagctcagattatggagtcacagtacggccacttgtttgataagatcatcatcaacgatgacctgaccgtggcttttaatgagcttaagacaaccttcgacaaactggaaacagagacccattgggtgcccgtgagctggctacactcctag

SEQ ID NO: 230175 - DNA, 939 bp, Artificial Sequence
  Description of Artificial Sequence: Synthetic coding sequence
atgcctgccttgtcaaccggctcagggtcagacacgggactgtacgagctgctggctgctcttcccgcacaattgcagcctcatgtggatagccaagaggacctcacattcctgtgggatatgtttggtgaaaagagcttgcatagcctggtcaaacatttccaagaacgccgtctggcgttacggcgacctgaaatcctggtacaaccgctaaaagtctcaaacagaaaatccagcggcttccggaagagttttagacttagccggaaggataagaagacaaacaagtccatgtatgagtgcaagaagagcgaccaatacgacactgcagatgtgcctacctacgaagaggtaacaccttaccgacgccaaacaaatgagaagtataggttggtggtcctggtgggtcccgttggcgtcggtctgaacgaattaaaaaggaaacttctgatttcagatacacagcactacggcgttaccgtcccgcataccactcgcgcaaggcggagccaggagtcagacggagtagagtacatttttatttccaaacatctctttgaaacagacgtgcagaacaataagtttatcgagtatggtgagtacaagaacaactactacggaaccagcatcgactccgtccgctccgtgctggcaaagaacaaggtgtgccttctcgatgtacagccgcacactgttaagcacctgcggactttagagtttaaaccttacgtaatcttcataaaacctccctctattgaaagactgagagaaactcggaagaacgctaagatcatctcaagcagagacgaccaaggcgctgccaagccattcacagaggaagatttccaggagatgataaaatctgcacaaatcatggagtctcaatacggccacttatttgacaagatcattataaatgacgatcttaccgtcgcctag

SEQ ID NO: 230176 - DNA, 1125 bp, Artificial Sequence
  Description of Artificial Sequence: Synthetic coding sequence
atgccagaagacatcgacgatgaggaagactccgtcaagatcatacggctggttaagaacagggaaccgttgggggctaccatcaaaaaggatgagcagacaggcgctatcatcgtcgccagaattatgcggggtggcgctgcagataggtcaggtctgatacatgtcggcgatgaattgcgagaggttaacgggatcccggtggaggacaagaggcctgaggaaattattcagattttagctcagtcccaaggagcaattacctttaagattattcctggctcaaaggaagaaacacccagtaaggagggtaagatgttcatcaaagctctgtttgattataatcctaatgaagacaaagccatcccttgtaaagaggcaggtctgagtttcaaaaagggtgacattctgcagataatgagtcaggacgatgccacctggtggcaggcaaagcacgaagctgacgccaatcctcgcgctggtttgattccaagcaagcactttcaggagaggcggcttgctctgcggagacctgaaatccttgtgcagccacttaaagtgagtaaccgaaagtctagcggcttcagaaagagtttccgtctcagtaggaaggataagaagacgaacaagtccatgtacgagtgcaaaaaaagcgatcagtacgataccgcagacgttccaacttatgaggaggtgacgccctatcgaaggcaaacaaatgagaagtacagattggtagttctggtcggtccagtgggagtcggattgaacgaattgaagcggaaactcctcatctctgatacccagcactacggagtgaccgtaccccatacgactagagcacggagaagccaggaaagtgatggggtggagtacatttttatctcaaagcatctcttcgagaccgatgttcagaacaataagttcatcgagtacggcgagtacaagaacaactactatgggacgagcattgactccgtgagatccgtcctcgctaaaaataaagtatgtctgttggatgtccagcctcacggcccatggtttctcctgcctttaatggcagtgccctggggcgcaaaacccccaaatgcacggatgacatgtgggagtccacttgacttgtag

SEQ ID NO: 230177 - DNA, 1731 bp, Artificial Sequence
  Description of Artificial Sequence: Synthetic coding sequence
atgcccgcactaagcacgggctcgggatcagacactggactctacgagctcctggccgcactccctgcgcagctacagccccatgtcgacagtcaggaggacctgactttcttgtgggacatgttcggtgagaagtccctccactctctcgttaagatacacgaaaagctccattactacgagaagcagagtcctgtgccgattcttcatggcgctgccgctttggcggacgacctggccgaggagttgcaaaataaacctctgaactccgaaatcagggaactgctgaagcttttaagcaaaccaaatgtgaaggcactgctgtccgtgcacgacacagtggctcaaaagaattacgaccctgtgttacctcccatgcccgaggacatcgacgacgaggaggattctgttaagatcattcgcctggtgaaaaaccgggaaccccttggcgctaccataaagaaagacgagcagaccggggcaattatcgtcgcccgtattatgagagggggtgcagccgaccggtcaggtctgatccatgtgggggacgagctgcgcgaagtgaacgggatcccagtggaggataaacgaccggaggaaattattcagatcctggcgcaatcacaaggggcaataacatttaagataattccgggttccaaggaggaaacgccttcaaaggaagggaagatgtttatcaaggccctgttcgattacaatcccaacgaggataaggcaatcccatgtaaggaggcaggactatcattcaagaagggagatatattgcagattatgtcacaggacgatgcaacatggtggcaggctaagcatgaggccgatgcaaatcctcgagccggtctgattccatcaaaacactttcaggaacgtcgcctcgcgctcaggagaccggagattttggtccagccactgaaggtgagcaaccggaaatcaagcggttttcgcaagagctttaggctctcccgaaaggacaaaaagacaaataagtcaatgtacgaatgcaaaaagtccgatcagtatgatacggcggatgtaccaacatatgaggaggtcaccccctaccggagacagaccaacgagaaataccggttggtggtactggtgggtccagtgggggttggtctcaatgagcttaagcggaagttgctcatctccgacacgcagcactacggggtgactgttccccatactactcgcgcacgaagaagccaggagagtgacggcgtggagtacatttttatcagcaagcatcttttcgaaaccgacgtgcaaaacaacaagtttattgagtatggagagtataaaaataactattatggaacatccattgattctgtcagatcagtgctcgcaaaaaacaaagtttgtctgttggacgtgcagcctcacacagtcaaacatctaagaacactcgagttcaaaccctatgtaatattcatcaagcccccttccatagagagactccgggagacacgcaagaatgcgaagatcatttccagtcgggacgaccaaggggcagccaaaccctttacggaagaagactttcaggaaatgattaagtctgctcagatcatggagtctcagtacggacatctatttgataagatcataattaatgacgacctgacggtggcttttaatgagctgaagacgaccttcgataaactcgagacagagacccactgggtccccgtctcttggttacactcctag

SEQ ID NO: 230178 - DNA, 870 bp, Artificial Sequence
  Description of Artificial Sequence: Synthetic coding sequence
atgctcgggtggtgcgaggccattgcaaggaatccccacagaatacccaacaacactcggaccccagagatatccggagatctggccgacgcttcccagacaagtactcttaacgaaaagtcaccgggaagaagcgctagtcggagctccaacatttctaaggcctctagcccgactacagggaccgcacctagaagtcagagccgcttatctgtgtgcccctccacccaggacatttgtcgcatttgtcattgtgagggtgatgaagagagtcccctcattacaccctgccgatgtaccggcacactgaggttcgtgcaccagtcctgcctgcatcaatggatcaaaagctcagacactcgatgctgcgagttatgtaagtatgatttcattatggaaacaaagctcaaaccgcttcgcaagtgggaaaaactgcagatgactactagcgaacggaggaagatcttctgctctgtgactttccacgtcattgccataacctgcgttgtttggagtctgtacgtgttgatcgatcgcacagctgaagaaattaaacagggtaatgacaatggggtgctggaatggcccttctggacgaagctggtcgtcgtggcaatcggatttactgggggacttgtgttcatgtacgtgcagtgcaaagtttatgtgcagttgtggcggcgattgaaggcctacaaccgcgtgattttcgtccaaaactgtcccgacaccgctaaaaaactcgaaaagaactttagttgtaacgtcaacacggatattaaggatgccgtggtggtaccagtaccccagacaggagctaattccctcccatccgctgagggaggacccccagaggtagttagtgtgtag

SEQ ID NO: 230179 - DNA, 819 bp, Artificial Sequence
  Description of Artificial Sequence: Synthetic coding sequence
atgaccagctcccatgtgtgctgtaatttcctcaacatgtggaaaaagtccaagatttccaccatgtactatcttaatcaggatgcaaaactgagcaacctgtttttacaggctagcagtccgactacaggcaccgccccacggtcacagtcgaggctgagtgtgtgcccaagcacccaggacatttgcaggatctgtcattgtgagggtgatgaagagtccccgctgattactccatgccgctgcacaggcacccttagattcgtgcaccagagctgcctccaccagtggataaagtctagcgacacacgctgctgcgaactgtgcaagtatgacttcatcatggagacaaaacttaaacccttaagaaaatgggagaaactgcaaatgacaaccagcgagcgacgaaagatcttttgctcagtcacattccacgtcattgccataacatgcgtggtctggagcctgtatgtgctaattgacagaactgcagaggagatcaagcaaggcaacgataatggggtgctggagtggcctttttggacaaagttggtggtagtagccatagggttcaccggaggccttgtcttcatgtatgtccagtgcaaggtctacgtccaactctggcggcgactcaaggcatacaatcgcgtcattttcgtacaaaattgccccgacacggctaagaagttagaaaaaaacttttcctgcaacgtgaacaccgatatcaaggacgccgtcgtcgtgccagtgcctcagacaggggcaaacagtctcccatcagccgaaggtgggcctccggaagtcgtgtcagtgtag

SEQ ID NO: 230180 - DNA, 870 bp, Artificial Sequence
  Description of Artificial Sequence: Synthetic coding sequence
atgctgggttggtgcgaagccattgccagaaaccctcacagaatacctaataacaccaggactccagagataagcggtgatttagctgacgcgtcccagacaagtaccctcaatgagaaatctcctgggaggagcgcgtcacgaagctcaaacattagcaaggcctcctcacccactaccggaaccgcccctagatcccagtctcgcttgagcgtgtgtcccagcacccaggatatatgtaggatttgccactgtgagggtgatgaagaaagccccttgatcactccctgcaggtgcactggcaccctgaggtttgtacatcagtcttgcttacaccaatggattaaatcttctgatacccgctgttgcgagttatgcaagtacgatttcattatggagactaaacttaagccgctgagaaagtgggaaaaactacaaatgaccacttctgaacggaggaaaatcttctgttctgtaacgttccatgtcattgccatcacctgcgtagtgtggtcgctatacgtactaatagacaggacggctgaagagatcaagcagggcaatgacaacggtgttctcgagtggccattttggactaagctggtagtggtggccatcggattcacaggtggcctcgtcttcatgtacgtgcagtgtaaggtgtacgtgcagctgtggagaagactgaaggcgtataatcgtgtgatatttgttcagaactgtccagatacagcaaaaaaactagaaaaaaacttctcgtgcaatgtgaacacagacatcaaagacgcggttgtggttcccgtaccacagacgggcgctaattccttgccgagcgctgagggcggtcctcccgaggtggtcagcgtgtag

SEQ ID NO: 230181 - DNA, 426 bp, Artificial Sequence
  Description of Artificial Sequence: Synthetic coding sequence
atgctggggtggtgcgaagctatcgccaggaacccgcacaggatcccaaataacactcgtacacctgaaatcagtggcgaccttgccgacgcctcacaaactagcactttgaacgagaaatccccaggccgatcggcgtccaggagcagcaatatttccaaggcatcctcccccacaactggcaccgcgccacgcagccagagccggctgtcagtatgcccgtctacccaggacatctgcagaatctgccactgtgaaggcgacgaagagtcacccctgataacaccctgtcggtgcaccgggaccttgagatttgtgcaccagagctgcctccaccagtggatcaaatcttcggacaccagatgttgcgagctgtgcaagtacgacttcattatggaaacgaaacttaagccgttgcgcaaatag

SEQ ID NO: 230182 - DNA, 2427 bp, Artificial Sequence
  Description of Artificial Sequence: Synthetic coding sequence
atgctacacgacgctagagatcgtcaaaagtttttcagcgacgtgcaatacttaagagatatgcagcacaaggtggactcggaatatcaggcatgcctgcgaagacaagaatacagaagggaccccaacgagaaaaagcgggatcaattttggggccaggaaacgagttttgagagatctcgcttcagctcaaggagctcttctaagcagtcctcctctgaggaagatgctctgaccgagcccagatccagcatcaaaatctccgcgttcaagtgcgatagcaagttgccggctatcgaccagacttcagtgaagcaaaagcataaatcaacaatgaccgtaaggaaggcagaaaaggtagaccccagtgagccgagtcctgcggatcaggcaccaatggtgttgctgcggaaacggaagccgaacctccgacggttcacagtttccccagaatcccactcacctcgcgcaagcggggataggagccgtcagaagcagcagtggccagccaaggtgccagtccccaggggcgcagatcaagtagtccagcaggaaggcctcatgtgcaataccaagcttaaacggcctaaccaggagagaagaaacttggtgcctagttcacagcctatgacagagaacgcaccagatcgggctaagaaaggggacccctcagcaccgtctcaatcggagctccacccagccctctcgcaagccttccaaggcaaaaattctcctcaagtgctatctgaattcagcgggcctcctctcacccctacaacagttgggggacccaggaaagcttcattccgtttccgggatgaggatttctattctattctatccctgaactcgcgtagggagagtgatgataccgaagaagaaacacagtccgaggaatgtttatgggtgggggtgcgctcaccatgcagcccttcccatcacaagagatcaaggttcgggggaacatccacccctcaggccaaaaataagaatttcgaggagaatgccgaaaactgcaggggacactcgagccgcagaagcgaaccaagtcatgggagcttgaggatctccaacgcaatggagccagccactgagcgaccaagtgccggacagcgactgtcccaggacccaggattgccggatagggagtcggcaaccgagaaggatcgcggtgggagcgagaatgccaagaaaagccccctctcctgggatactaaaagcgagcccaggcaggaagtcggcgtgaatgccgagaatgtatggagcgattgtataagcgtggagcacagacccggaacccacgactctgagggctattggaaggactacttgaactccagccagaatagcctggactactttatctccggtagaccgatctccccccgatcaagtgttaatagctcttacaatccccctgcctcttttatgcactcggcgctccgggatgacattcccgtggatttgtccatgtcttcaacatcagtccatagctccgattccgagggcaattccgggttccatgtctgtcaacccttgtctcccattaggaaccgcaccccttttgcgtcagctgagaatcataattactttcctgtgaattcagcacatgagttcgccgtgcgcgaagccgaagacaccactctgacttcccagcctcaaggcgctcctctgtataccgacctcctcctcaacccccaagggaacctatccctcgtggactctagtagtagctccccgtccagaatgaattctgagggccatctgcatgtctcaggttcgctacaggagaacacccccttcacattctttgccgtgagtcacttccccaaccagaacgacaatggaagcagaatggccgctagtgggtttactgacgaaaaggagacatccaaaattaaggccgacccagagaagttaaagaaactccaagagagtctgctggaagaggacagtgaagaggagggagacctgtgtcggatttgccaaatcgcgggtggatccccatccaatcctctcctggaaccctgcgggtgcgtaggcagcctgcagttcgtgcatcaggagtgcttaaagaagtggctcaaagtgaagatcacttccggagccgaccttggagcagtgaaaacatgtgagatgtgtaagcaaggccttctggtggatctgggagacttcaacatgatcgagttctatcagaaacaccagcagagccaagcccaaaacgagctgatgaacagtggcctataccttgtcctcctgttgcacttgtatgagcaacgattcgcagaattgatgaggctgaatcataaccaagtcgaaagggagaggctctccaggaactatcctcaaccaaggaccgaagaaaacgagaatagtgaacttggtgacggcaatgaagggtctatttcccagtctcaggttgtctag

SEQ ID NO: 230183 - DNA, 2427 bp, Artificial Sequence
  Description of Artificial Sequence: Synthetic coding sequence
atgcttcatgacgctagagaccggcagaagtttttcagcgacgtgcagtatctgagagatatgcaacacaaagtcgacagcgaataccaggcctgtctgcgcaggcaggaatacagacgtgaccccaatgaaaaaaagagagatcagttctggggacaggagacatcctttgagcgctccaggttcagctcccgctcatcctccaaacagtcgagctctgaagaagacgccttaacagaacccaggagctcgattaagataagcgccttcaaatgcgacagcaagctgccagctatcgaccagacttcagtgaaacagaagcataagagcactatgacagtaagaaaagcggagaaggttgacccttcagaaccatcacccgctgaccaggccccaatggtgttgctgcgtaagcgcaagcctaatctccgccgatttacagtttctcctgaatcacactcccctagggctagcggagatagaagccggcagaagcagcagtggccagcaaaggtgccggttcctagaggcgcagaccaagtcgtgcagcaggagggtctaatgtgcaacacaaaactgaagcgtccgaatcaggaacgtaggaacctggtgccctcttctcagcccatgacagaaaacgctcctgatcgggctaagaagggcgatccgagcgccccatctcagtctgagcttcaccccgctctttctcaggctttccagggtaaaaacagcccacaggtcctgtcggaatttagcggccctcctctcacaccaaccaccgtggggggtcctcggaaggccagttttcggttccgtgatgaggatttctatagtatcctctcccttaattccaggagagagtccgacgacactgaagaggagactcaaagtgaagagtgtctctgggtaggggttcgctcaccttgctcaccaagccaccacaagcgaagtcgatttggcggaacctcgaccccacaggcaaaaaacaagaatttcgaagaaaacgcagagaactgtagaggccacagctcaagaaggagcgagcccagccatggctccctccgtatctccaacgccatggaacctgctaccgagagaccttcagcgggtcaacgattgtcacaggatccaggactgcctgacagagaatcggccacagaaaaagacagaggaggtagcgaaaatgccaagaagagcccgctgtcctgggacacaaagtcggaaccccgacaggaggtgggcgtaaacgctgagaacgtgtggtctgattgtataagcgtggagcacagacccggaacccacgactcagaagggtactggaaagattatcttaattcctctcaaaatagcttggactacttcatttccgggaggccaatttcaccccgatcctcagtaaacagttcctacaacccgcctgcctctttcatgcactccgcactacgcgacgacatcccagtagacctgtcgatgtcatcaacctccgtccattcctccgattccgagggcaacagtggatttcacgtatgccaaccgctgtcgccaatcaggaacagaactccctttgctagcgccgagaatcataattattttcctgtgaactctgcgcacgagtttgctgtaagggaggcagaagacacaactctgactagccagccacagggtgctcccttatataccgatttactgttaaatccgcagggaaacttatcactggttgattcgagctcttcatccccttccaggatgaactccgaaggtcacctgcatgtgagtgggagtctgcaggagaacacaccattcaccttctttgccgtcagtcactttcctaaccagaacgataatggctctcggatggctgccagcgggttcaccgacgaaaaagaaacgagcaaaatcaaagctgatcctgagaagctcaaaaagctgcaggaaagcctccttgaggaggattccgaggaggaaggcgatctgtgccggatttgccaaattgccggaggatctccaagtaatcctctactggagccttgtggctgcgtgggctccctacaatttgtgcatcaggagtgtctgaagaaatggctgaaagtcaagattacatctggcgctgacctcggggctgtgaaaacttgcgagatgtgcaagcaagggctcttagtggacctcggggattttaacatgatcgagttttaccagaagcaccaacaatcccaggcacagaacgaactgatgaacagcgggttgtatctggtgctgctgctccacttgtatgaacagcggttcgctgagctcatgcgtctcaatcacaaccaggttgagagagagcggctttctaggaattatccacagccacggacagaggaaaacgaaaactcagaattgggagatggtaacgagggtagtatttctcaaagccaggtggtctag

SEQ ID NO: 230184 - DNA, 2400 bp, Artificial Sequence
  Description of Artificial Sequence: Synthetic coding sequence
atgctgcacgacgcccgagacaggcagaagtttttttccgatgtgcagtacctccgcgacatgcagcacaaggtggactccgagtatcaggcatgtctcaggcgtcaggagtaccggagagaccccaacgagaagaagagggaccagttttgggggcaggaaacatcttttgagcgttctaggttctcgtcacggtcttcttcaaagcagagctctagtgaggaggatgcgttgacagaaccaagatcttcaattaagatttccgccttcaaatgcgacagcaaactccccgctatcgaccagactagcgttaaacaaaaacacaagtctactatgactgtgaggaaagctgagaaggtagaccctagcgagccaagcccagatcaagcacccatggtacttttgagaaagagaaaaccgaatttgagacggttcactgtgtctccagaatcccacagtccgagggcatccggggaccggtcccggcagaaacagcagtggccggctaaagttccagtgccacgcggtgcggatcaggtggtccaacaggagggattgatgtgtaatacaaagctcaaaagaccaaaccaggagcgccgtaatcttgtccctagcagtcagcctatgacggaaaatgcccctgaccgagccaagaaaggagatccctctgcgccaagccagagtgaactgcatccggctcttagtcaggcattccaggggaaaaattccccacaagtgttgagcgaattcagcggccctcctttgacccctaccactgtgggaggccctcgaaaggccagttttcggttcagagatgaggatttctattctatcctgtcactgaacagtaggagagagtcggacgatactgaagaggagacacagtccgaggagtgtttgtgggttggtgtgcggtcaccctgtagtccctcccatcacaagagaagccggttcggagggacatctacgccgcaggctaaaaataagaattttgaggaaaatgctgagaattgcagaggccattccagccgtaggtccgaaccatcacatggctcgctgcggatttcgaacgcgatggaacctgcaaccgaacgtccctctgccggacagagactaagtcaggatcccggattgcccgaccgggaatcggccacagagaaggatagaggcggatccgagaatgcaaaaaaatcaccactctcatgggacaccaagtcagaacctcgtcaggaagtgggagtgaatgcagagaacgtttggtctgattgcatcagcgttgagcaccgccctggaacccacgactcagaagggtactggaaagactatctcaattcctcgcagaattcccttgattactttatcagtgggaggccaatttcgccacgctcttcagtgaacagcagttacaacccacccgcatctttcatgcatagcgcgctaagagacgatatcccagtggatctgtctatgtcaagtaccagcgtccacagctcagattccgagggtaactcaggtttccacgtctgtcagcctctcagccccatacggaataggacacctttcgcctcagccgagaaccacaattactttcctgtgaattccgcgcacgagttcgccgtcagggaagctgaggatacaaccctgacgagccagcctcagggcgcacccctgtatacagatctgttgctgaatccacaggggaatctgtccctggttgattcatcttccagttcccccagtcgcatgaacagcgaagggcatctacacgttagcggttctctacaggagaacacaccatttaccttctttgctgtctctcacttccctaaccaaaacgataatggcagccggatggcagcaagcggcttcactgacgaaaaggaaacaagcaaaattaaagccgatcctgaaaagctgaagaagctccaggagtcgctgctggaggaggacagcgaagaagagggcgacctctgtcggatttgtcaaatcgctgggggaagcccctctaaccccttgctggagccatgtggatgtgtaggatcgctgcaatttgtccatcaagagtgtctgaaaaaatggctgaaggtgaaaatcacgagcggtgccgatctgggggcagtgaagacgtgcgaaatgtgcaaacagggcttgctcgtagatctcggcgacttcaatatgatagagttttaccagaagcatcaacagagccaggcccagaacgaactgatgaatagcggcttgtatttagtgctgctgctgcacctctacgagcagaggttcgcagaattgatgcgcctgaatcacaaccaggtcgaaagggaacggctgagtcgtaactacccccagcccagaacagaggagaatgagagtagattctggggaccagttctaccattctag

SEQ ID NO: 230185 - DNA, 1209 bp, Artificial Sequence
  Description of Artificial Sequence: Synthetic coding sequence
atgagcttcgaagggggacatggagggagcagatgtcgtggcgcagaatctggagacgcagaaccgcctccccagcccccaccccctccaccgccaacgccaccacccggagagcctgcacccgtccccgcagcccctagatatctgcctccattgccggcaagcccggagacaccggaaagagcagccggtccttccgagcccttaggcgaggtggccccacggtgccgcggagccgacgagctaccccctcccccacttccgttgcaaccagccggtcaggaagttgcagccgcaggcgacagtggtgaggggcctagaagactgccggaagccgctgccgcaaagggtggtcccggtgaatcagaggctggcgctggcggagaaagagaaaggcggggagcgggtgaccaaccagagactcgctcagtctgttcttccagatccagtagctcaggcggtggggatcagcgagccggtcaccagcatcagcatcatcagcccatctgcaaaatttgttttcagggcgcagagcagggtgaattgttgaatccctgtcgttgtgatggcagtgtgcggtacacacaccagctgtgtctattgaagtggatctctgagaggggcagctggacttgtgaactgtgttgctacagatatcacgtaattgccattaagatgaagcaaccttgtcagtggcagagcatatctatcacccttgttgagaaggttcagatgatagccgtcatcctcggaagcctctttcttattgcttcagtgacttggctcctgtggagtgcattcagcccgtatgccgtgtggcagcgcaaagatatcctgttccaaatttgttacggcatgtacggctttatggacttggtttgcataggtctgatcgtacacgagggcgctgccgtctaccgtgtctttaagaggtggcgagctgtgaaccttcattgggacgtacttaattatgacaaggccaccgacatagaggagtcctccagaggggaatcctcaacctctcgaaccctgtggctgcctctgacagctttaagaaatagaaatttggtgcaccccactcagctgacctcccccaggtttcagtgtgggtacgtcctgttacatctttttaatcgaatgagaccgcacgaggatttgtccgaggacaactctagcggtgaggtggtcatgcgggtgaccagtgtgtag

SEQ ID NO: 230186 - DNA, 1818 bp, Artificial Sequence
  Description of Artificial Sequence: Synthetic coding sequence
atggccctgagaaaaggcggactcgccttagctctgttattattaagctgggtcgccctaggcccacggtcattagagggagctgatcccggaacacctggtgaggccgaggggccagcctgtccggctgcgtgtgtatgcagctacgacgacgacgctgatgaactgagcgttttttgtagtagtagaaacttaaccagactgcctgacggtgtccctggtggtacacaagccctgtggctggatggcaataatctcagttctgtcccacccgctgcctttcagaacctcagcagccttggatttctgaaccttcagggtggacagctaggatctttagaaccgcaggccctcctcgggctggagaatctctgccacctgcatctggagaggaatcaactgcggagcctcgctttaggcacctttgctcacacgcccgctcttgcatcgcttggcctgtccaacaaccggttgtccaggctcgaagatggcctgttcgagggcctcggttcactgtgggatttgaacttggggtggaattcgctggccgttctccccgacgcagcttttcgagggttgggaagtctgagagagctggtgctagccggtaaccgcctcgcgtatttacaacccgctcttttcagcggcctcgccgaactcagagagctggacctatccaggaacgcattaagggcaattaaggcgaacgtgtttgttcagctgcccagactccagaagctgtatctcgataggaacctgattgctgccgtcgcccctggagctttcctgggcctgaaagcgttgcgctggctggatctcagccataatcgggtcgcaggattgctcgaggacacttttcccggtttgctgggtctccgggtcctgcgtctgtcccacaatgccatcgcatcgctgaggcctcggaccttcaaagatctgcatttcctagaagaactacagctggggcataaccggatccgtcagctggccgaacggagcttcgagggcttagggcagctggaggttttgaccttggaccacaatcagctgcaggaagtgaaagcaggcgcatttctaggtcttaccaatgtggctgtgatgaacctgtctggaaattgtctgcgtaatctgcccgagcaggtgtttaggggtctgggtaagctgcacagtctgcacctagagggctcttgcctcggacgcatcagaccacacactttcaccggtctgagcggtctcaggcgcctcttcctaaaggataatgggctcgtgggcatcgaagaacagagcttgtgggggctggcagagttacttgagctggatttgacatcaaatcagctaacacatctccctcatcgtttatttcaggggttgggcaaattagagtacttgctcttgagcaggaacagactggctgaattaccagcggacgcactgggccctctgcagagggccttctggttggatgtttctcataacagactcgaagctctccctaacagcctgctcgcacccctgggacgactgcgatatctgtcactgagaaacaattcattaagaacctttacacctcagccacctggtttggaaaggctctggctggaaggaaacccctgggattgtggatgtcctctcaaagcccttcgagacttcgccctccagaatcctagcgcagtgccacgcttcgtgcaggctatctgtgagggcgatgattgccagcctcccgcatacacctataataatatcacatgcgcttcaccacccgaagtagtcggtctcgacctgagagacctttccgaagctcatttcgcaccatgttag

SEQ ID NO: 230187 - DNA, 531 bp, Artificial Sequence
  Description of Artificial Sequence: Synthetic coding sequence
atgacgactggcgactgctgccatcttcccggaagcctgtgcgactgctcgggaagcccggcattctctaaggtcgtggaagctaccggtctcggccctccacagtatgtggcccaggtaacctcacgggacggccgactactgtctactgttatccgagctctcgacaccccatcggacggccctttctgtcggatttgtcacgaaggtgccaatggggaatgcctgctcagtccgtgcggctgcaccggaactctgggcgcagtgcacaagagctgtctggaaaagtggctcagtagtagcaacacgtcttactgcgagctgtgtcacacagagttcgcggtggagaagaggcctcgccctctaactgaagtaagctttcgataccattgccagttatatagcgagtggagaaagacaaatcagaaggtaaggttaaaaatccgagaggctgattcacccgaggggcctcagcacagcccgttggcggctggtctgctcaagaaagttgctgaggaaacgcccgtctag

SEQ ID NO: 230188 - DNA, 741 bp, Artificial Sequence
  Description of Artificial Sequence: Synthetic coding sequence
atgactactggggattgttgtcatctccccggtagcctgtgcgattgttctggaagtcccgctttctctaaagtggtcgaagctaccggcctcgggccaccacaatacgtggctcaggtgaccagtcgcgacgggagactgttatctacagtgattagagccctggataccccatcagatggccctttctgcaggatatgtcatgaaggtgccaatggagaatgcttgttgtccccatgcggctgtacagggaccctcggcgcagtgcacaagtcctgtctcgagaagtggctttccagctctaacacaagctactgcgagctgtgtcacacagagtttgctgtggagaagcgtcctcgccctctgaccgaatggctgaaggatccagggccaaggacagaaaaacgcacgctctgttgcgatatggtgtgttttctgtttataaccccacttgctgccatctctggctggttatgtcttaggggagctcaggatcacttgcgtctgcattcccagctagaagccgtgggtctgatcgccctcacaatcgcactatttaccatttatgtgctatggactctggtctcatttcggtaccattgtcagctgtattcggagtggcggaagaccaatcagaaggtgcgactgaaaatacgggaggctgatagccccgagggccctcaacattcaccactcgctgctggactcctcaaaaaagtggctgaggaaactcccgtctag

SEQ ID NO: 230189 - DNA, 762 bp, Artificial Sequence
  Description of Artificial Sequence: Synthetic coding sequence
atgactactagccggtgtagccacctgcccgaagttctaccggattgcacaagtagcgccgctccagtggttaagaccgttgaggattgcggatccctagtcaacgggcaaccacagtacgtgatgcaagtgtccgctaaggacggccagctgttgtctacggtcgtgcggaccctcgccactcagagtcctttcaacgataggcccatgtgcaggatatgtcacgagggctcatctcaggaagacctacttagcccgtgtgagtgcacagggacattgggaacaatccatcggagttgtctcgaacattggcttagctcctccaacacaagctattgcgagctttgccatttcaggttcgcggtagagagaaaaccaaggcctctcgtagaatggttgagaaatccgggacctcagcatgagaagagaaccttattcggcgatatggtctgttttctcttcatcactcccctcgctaccatcagcgggtggttatgtttgagaggggctgtggaccatctccatttcagtagccggctggaggcggttgggctgatcgccctcacggtagccttgttcacaatatacctgttttggacgctggtctccttcagatatcactgtcgtctttacaacgagtggcggaggactaaccaacgggtgatcctcctcattccaaagagtgttaatgtgcctagcaatcagccctcattgctcgggctccattctgtgaagaggaattctaaggagacagtagtttag

SEQ ID NO: 230190 - DNA, 1233 bp, Artificial Sequence
  Description of Artificial Sequence: Synthetic coding sequence
atgctcatgcccctgtgcggactgctatggtggtggtggtgctgctgtagtggctggtattgttacggcctgtgtgcaccggctccccagatgctcagacatcagggtctgctgaagtgtcgatgccgtatgctgttcaacgacctgaaagtcttcctacttcggaggccgcctcaggcacccttgccgatgcatggcgacccacagccacctggcctggcagccaataacactttacctgccctgggggctgggggatgggccggatggcgcggacccagagaagtggtgggccgtgagcctccacctgtccccccacccccacctctgccaccgtcttccgtcgaagacgattggggaggcccagccactgaaccacctgctagcctgttgagctctgctagctcagatgacttctgcaaggaaaaaaccgaggaccggtactccctagggagcagcctggactcaggcatgaggactcccctgtgcaggatctgtttccagggacccgaacaaggggagctgctctccccatgccggtgcgatgggtctgtgaaatgtactcaccagccctgcctcatcaaatggatctcggagaggggttgctggagttgtgaactttgctactacaagtatcacgtgattgccatctcaacaaagaatccactgcagtggcaggccatctccttaacggtcatcgagaaagtgcaagttgccgctgctatcctgggatctctcttcttgatcgcttctatcagctggctaatatggagcacgttttccccaagtgcccgatggcagcggcaggatcttctcttccagatttgctacgggatgtatggctttatggacgtggtctgtatcggactcatcatccacgagggtccgagcgtttaccgtatctttaagcgttggcaggctgtcaaccaacaatggaaagtgctgaattatgataaaacaaaggatttagaagaccaaaaggctggaggtaggaccaacccaagaaccagcagctctacccaggccaatatcccatcatctgaggaggaaactgctgggacccccgcacctgaacagggacctgcgcaggcagcagggcatccctcaggacccctgtctcaccatcactgcgcatacacgattctccacatcctgtcacacctgcggcctcacgagcaacggagccccccaggatccagtagggaacttgtcatgagggtgactacagtgtag

SEQ ID NO: 230191 - DNA, 837 bp, Artificial Sequence
  Description of Artificial Sequence: Synthetic coding sequence
atgcctgatcaggctcttcagcagatgctggatcgatcctgttgggtgtgctttgcgacagacgaggacgataggactgctgaatgggtccgcccttgcagatgtcgagggtctaccaagtgggtccaccaggcatgcctgcagagatgggtcgacgaaaagcagagagggaattccacggcacgtgtcgcttgcccacaatgtaacgccgagtatctcattgtcttcccaaagctcggaccggtggtttacgtgctggatctagccgacaggctaatatcaaaggcgtgtcccttcgccgcagcaggtatcatggtgggcagcatttactggacagcagtgacctatggggctgtgacagtcatgcaagtagtgggccacaaagaaggcttggatgtgatggagcgcgcagatcccctgttcttactgatcgggttacctacaattcctgtgatgctcattctgggtaaaatgatacgctgggaggactatgtcctaaggctttggagaaaatattctaacaagctgcagatccttaactcaatatttcctggaatcggttgtccagtgccaagaatccccgctgaggcaaacccgctcgcagaccatgtcagcgcaaccaggattttatgtggagcactagtgttccccacgattgctaccatcgtgggaaaattaatgttttcaagtgtgaactccaatctacagcggaccatccttgggggtattgctttcgttgcaattaaaggcgctttcaaagtctactttaaacaacagcaatacctccgacaagcgcatcggaagattctaaactaccctgaacaggaggaagcatag

SEQ ID NO: 230192 - DNA, 2733 bp, Artificial Sequence
  Description of Artificial Sequence: Synthetic coding sequence
atggataccgccgaagaggacatctgtagggtgtgtcgctccgaaggaactcctgagaagcccctgtatcacccatgcgtgtgtactggctcgatcaagtttatccaccaggaatgcttggtacagtggctgaaacacagccggaaagaatactgtgaactgtgcaagcaccgatttgcatttacacccatttacagccctgacatgccttctagattgccgattcaggatatatttgccggactggtgacttccatcgggacagccataaggtactggttccattatacattggtggcttttgcctggctgggggtggtacccctaaccgcatgccgaatctacaagtgcctgtttactggttctgtttcatcgctgctgacgctgcccctggatatgctcagcacggaaaacctgcttgccgattgcctccaaggatgcttcgttgtcacatgtaccctttgtgcttttatatctctcgtctggttgcgggagcagatagtgcacggcggagcccctatttggctggagcacgctgctccgccatttaacgccgctggccaccaccagaacgaagctcccgcaggaggtaacggggctgagaatgtcgccgcagaccagccagcaaatccgccagcagagaatgcagtcgtgggcgagaatccagacgctcaagacgatcaagcagaggaagaggaggaagataacgaggaggaagacgacgccggagtggaagatgccgcagacgcaaacaacggggctcaggatgacatgaattggaatgcattggagtgggaccgggcagcagaggagctgacttgggagagaatgttaggcttagacggttccctggtgtttctggagcacgtattttgggtagtgagcctcaatactctgttcatcctggtgttcgcgttctgtccataccatataggacatttctctttggtggggttgggctttgaagagcatgtgcaggcctcccatttcgaaggtctgatcacaaccattgtgggttacatcttactggcgatcacgcttatcatctgtcacgggttagctaccctggtaaagtttcacagatccagacggctactgggggtgtgttacatcgtggtgaaggtgagcctgttggtcgtggttgagatcggagtattcccattgatctgcggttggtggttggacatttgcagtctggaaatgttcgatgcaacattgaaggaccgcgagctttcatttcagagcgcgccagggacaactatgttcctccattggctggtcggtatggtctatgtattttatttcgcgtcatttatcctactccttcgggaggtcctcaggcccggagtgttgtggtttctgcgaaacctcaacgatccggacttcaatcccgtacaagagatgattcatttgccaatttaccgccacctgcgcagattcatcttgtcagtgatagtcttcggcagcattgttttgctcatgctgtggctccctattagaatcattaagtctgtgcttccgaacttcctgccatataacgtcatgctgtactctgacgctcccgtgtcagaactctcgctagaattgcttctcctgcaggtcgtgctgccggcattgttggaacagggtcacactagacagtggttgaaaggactggtgcgcgcatggactgtgacggcaggctaccttctggatctccactcttacctcctcggagaccaagaagaaaatgagaattctgccaatcagcaggtgaataataaccagcacgcgagaaataacaatgccattcctgtggtcggagaagggcttcacgccgcacatcaagcaatccttcagcagggcggacccgtagggtttcagccctaccggcgaccactcaatttccccctgaggatcttcctgctgattgtgtttatgtgcatcactttgctcatcgcatccctcatctgcctgaccctgccggtgtttgctggcaggtggctcatgagcttctggacaggcaccgccaagattcatgaattatacactgcggcttgtggtctctacgtgtgctggctcaccatcagggcggtcaccgtcatggttgcgtggatgcctcagggccgacgggtgatcttccagaaggtcaaggaatggtcgctaatgataatgaaaactctgatcgtagccgtgttactggccggagtggtccctctcctcctgggattgctttttgagcttgtgatagttgcaccactccgggtgcccctagaccagacacccctgttctacccatggcaagattgggccctgggcgtcctgcatgcgaaaatcattgcggctatcactttgatgggcccacagtggtggctgaagacggtgatagaacaggtttacgccaacggtattcgtaacatagatttacactacatagtacgaaagctcgccgcaccagttatttctgtcctcctcctcagtctttgtgttccatacgttattgcgtccggcgtcgtgcccctgttgggagtcactgccgaaatgcagaatctggtacatcggaggatttatccttttctccttatggtcgtcgtacttatggctattctgtcatttcaggtcagacagtttaaaagactgtatgaacatatcaagaacgacaagtacctcgtaggtcagagattggttaactacgagcgcaagagcgggaagcaggggagttctcctcctccaccacagagcagtcaagagtag

SEQ ID NO: 230193 - DNA, 2115 bp, Artificial Sequence
  Description of Artificial Sequence: Synthetic coding sequence
atggaaagcaagccatcccggattccaagaaggatctccgtgcagccctcctctagcctgtctgccaggatgatgtccgggtcccgaggctcatctcttaatgatacataccactcaagagattctagcttccggctcgacagcgaataccaaagtacgagtgctagtgcatcagcctcaccgtttcagtctgcctggtacagtgagagtgagataacccagggcgcacgttcgcggagtcagaaccagcagcgagaccacgattcgaaacgccctaagctctcctgcacaaattgtaccacctcggctggacgcaacgtaggtaatggcctcaataccctgtccgatagctcatggagacattctcaagtgcctcggtccagctctatggtcctgggctcttttgggactgacctgatgagagagcgtagggacctggaaagacgcacggactcctccatctctaatcttatggactactcacatcgcagtggcgactttaccacctctagttatgtgcaagatcgggtgcctagctattcccagggtgcacgcccaaaagagaacagtatgagtacacttcagcttaatacatcctctaccaaccaccagctgccttctgaacaccagacaatcctatccagtagggacagccgaaatagcctccggtccaatttctcaagcagagagagtgaaagtagtaggtccaacacccagcctggcttttcctactcaagctcccgagacgaggctcccattatttctaattctgaaagggtggtgtcttctcagagacctttccaggagagctccgacaacgaaggcagacgcaccactcggcgattactgtctagaattgcctccagcatgagttccacattcttttcccgccgtagcagccaagactccctcaacactcggtcactgaacagcgagaactcctatgtaagtccgaggatcctgaccgcctcccaaagcaggagcaacgttcccagtgcatctgaagtgccagataaccgggcatctgaagccagccaagggtttcggttcttaaggcggaggtggggactgtcatcactgagtcataaccactcctccgagtcagactcagagaattttaatcaagaaagcgaagggcgtaacacgggtccctggctgtcctcttcactccgcaaccggtgtacaccacttttttctagacgtaggcgggaaggcagagacgaatcatctcgtattcccacatctgatacttctagtagatctcatatctttaggcgagagtctaacgaggtggtgcatctggaggctcagaacgaccccctgggagccgcagcaaaccgaccacaagcctcagcggcttccagtagtgccacaacggggggtagtactagcgactcagcacagggcggacgaaacaccgggatttctggtatcctgcctggtagcctgttccggttcgctgttcctccagcattgggctctaacctcacggataatgtgatgattacagtggatattattccttccggctggaactctgccgacggtaagtccgacaagactaagagcgctccctcacgtgatcccgaacgattacagaaaattaaggaatctctgctcctggaggattctgaggaggaagagggtgatctctgtcgcatctgccagatggcagcggcaagttcaagtaatctgctgatcgagccctgcaaatgcactggttccctgcagtacgttcaccaggactgtatgaagaaatggctgcaagccaagatcaactcaggaagctccctggaggcagtaaccacgtgtgagttgtgcaaggagaagcttgagcttaacctggaagacttcgacatccatgagcttcatcgcgcacacgcaaacgagcaggccgagtatgaattcatcagcagcggactatatctcgtggtgttgctgcacctttgcgagcagagcttttccgacatgatgggtaataccaatgagccctccacccgagttaggttcattaacctggccagaaccctgcaagcacacatggaggatcttgaaacctccgaggacgactctgaggaagacggagaccacaatagaaccttcgatatcgcatag

SEQ ID NO: 230194 - DNA, 2115 bp, Artificial Sequence
  Description of Artificial Sequence: Synthetic coding sequence
atggagagcaaacccagtcggatccccagacgcatctccgtgcaaccctcttcaagtctgagcgcaaggatgatgtccgggagtcgcggttcgagcctgaatgacacctaccattcgagggatagttcttttagactggactccgaataccagagtacctcagccagcgcatccgcctcaccttttcagagtgcctggtattccgagtcagagataactcagggggcacgcagtcgctcccagaatcagcaacgcgatcatgactcaaagcggccaaaactgagttgtaccaactgcactacatccgccggtaggaacgtgggcaatgggttgaatacactatccgacagcagctggcgacactcccaggtgcctagatcttctagcatggtcctaggcagctttggcacagacttgatgagagaacgcagggatttggagcgccgtaccgattcaagcatcagtaatcttatggattattcccaccggtctggggattttacaactagttcgtacgtccaagaccgggtcccctcctactcgcagggtgctaggccaaaggagaattccatgtcaacattacagctgaacaccagcagtacaaaccatcagctgccttcagagcaccagactatcctgagctcgcgcgactctcggaattctcttaggtccaatttcagttcccgggaatcagagagctctagaagtaatactcaaccaggcttttcgtactcaagctctcgggacgaggccccaattatctctaatagcgagagggttgtatcctctcagcggccattccaggagtccagcgataatgaggggagacgaacgacaagacggttgctcagtcggattgccagtagcatgagcagcaccttcttcagtcgcaggagtagtcaggactcactgaacacccgctccttaaatagcgagaatagctatgtgtcccctcgcattctcacggcctctcaatctcgctccaatgtcccaagtgctagtgaggtgcccgataatagagcttcagaggcctcgcagggttttcgattccttagacgcaggtggggcctctcaagcctgagccacaatcactcatcagagtccgactccgaaaacttcaaccaggaaagtgagggccgaaacacaggcccatggctgagctcaagcttgcggaaccgctgtacgcctctattctccaggagacgaagagaggggagggatgagtcttcccgaatacccacttccgatacgagctctagatcccacatttttcggcgagaaagtaatgaagtagtccacctggaggctcagaatgatccactaggcgctgcagctaaccgacctcaggcctcagctgccagctcctcagccaccactggaggatcaactagtgattccgcccagggtggcaggaataccggtatctccggcatattgccaggctccctttttagatttgcagtaccccctgccctgggtagcaatctcacagacaacgtgatgatcaccgtggacatcatcccctcgggatggaattcagctgacggcaagagcgacaaaactaagtccgccccttcaagagaccctgaaagactccagaagatcaaagagagccttctacttgaagatagcgaggaagaggaaggcgacctgtgtagaatttgccaaatggctgctgccagcagcagtaacctccttattgaaccatgcaaatgtactgggagcttacagtatgtgcaccaggactgcatgaaaaagtggcttcaggctaaaatcaactctggctcatccctcgaggccgtgacaacctgtgagctgtgtaaagaaaagctagaattgaatctcgaggacttcgatattcacgagttgcaccgggctcacgcaaacgaacaggctgaatatgaattcatctctagcgggctgtacctagtggttctgctgcacttgtgcgagcagagcttttctgacatgatgggcaacactaacgagccgagtacccgggtccgatttattaatctggccaggacccttcaggctcacatggaggacctggagacttcggaagacgactccgaagaggacggggaccataaccgtacctttgatatcgcctag

SEQ ID NO: 230195 - DNA, 306 bp, Artificial Sequence
  Description of Artificial Sequence: Synthetic coding sequence
atggagagcaagccttcaaggattccccgtcggatctcagtgcagccaagtagcagcctgtctgcaagaatgatgtccggctcccggggaagttcattaaatgatacctatcactcacgcgatagttcatttcggctggacagtgaatatcagtctacatctgcctcggcttccgcaagtcccttccaaagtgcctggtattctgagtcagaaattacacaaggggcacggagtcggtcccaaaatcagcagcgcgaccacgactcgaagcggccaaaactctcatgcaccaactgcactacgtag

SEQ ID NO: 230196 - DNA, 1908 bp, Artificial Sequence
  Description of Artificial Sequence: Synthetic coding sequence
atggagagtaagccttctagaataccacgcaggatcagcgtccagccgtcctcaagccttagcgcccgaatgatgagcggctcccgcggttcatccctgaacgatacctaccattctagggatagctcatttcggctagactcagagtatcaatccacaagcgcttccgcatctgccagtccatttcagtctgcctggtactcggaatcagagattacacagggcgctaggtcacggtcccaaaaccaacagcgagatcatgatagtaagagaccaaagctctcttgcacgaattgtactacctctgcaggcaggaatgtggggaatggcctcaatacgctgtctgatgtacaggaccgcgtgccgagctacagtcagggagctcgcccaaaggaaaacagcatgagtactttgcagttgaataccagctccacaaatcatcagctcccttccgagcatcaaaccatactctcaagccgggacagccggaactcactccgcagtaatttttcctcccgtgaaagcgagtccagtagaagcaacactcaacccggatttagttacagtagcagccgagacgaggcccctatcatttctaactctgaacgagtagtgtcctcccagcgcccatttcaagagtccagcgacaacgaagggaggcggactaccagaagactcctgtctcgaatagcttccagtatgtctagcaccttctttagtcgaagatctagccaggatagcttgaataccagatcacttaatagtgagaattcttacgtttctcccaggatcctgactgccagccagagcaggtctaatgttccaagcgcgagcgaggtgcccgacaatcgcgcttccgaagctagccaggggttcagatttctgagacgccgatggggcctatcctcactttcacacaaccactctagtgagtccgattcagagaattttaaccaggaatccgaaggcagaaacactggaccctggctgtcctctagtctacgcaatagatgtacaccactctttagccgccgaagacgcgagggtagggacgagtcctcgagaatccccacctctgacacctcaagtcgatctcacatttttcgcagagaatcgaacgaagtcgtgcatctggaagctcagaatgatcctctgggggctgcggctaacagaccccaggcatccgcagcctcctcgtcggctaccacagggggaagcacatccgacagtgcacagggcggacgaaacaccgggatttcaggcatcctgcctggtagcctgtttagattcgccgttcctccagcactaggaagtaacctaaccgacaatgtgatgataaccgtagacattattccttctggctggaacagtgccgatggcaagagcgacaaaactaagagtgccccatcccgcgaccccgaacgattacagaaaataaaagagtcgctgttgcttgaggactctgaagaagaagagggcgacttgtgcagaatctgccagatggccgcagccagttccagcaaccttcttattgagccttgcaagtgcacagggagcctccagtatgttcatcaggattgtatgaaaaagtggctgcaggcaaagataaacagtgggagctctctagaggctgtcaccacatgcgaactgtgtaaggaaaaactcgaattaaacctcgaagactttgacatccatgaattgcacagggcccatgcaaacgaacaagccgagtacgagttcatctcctctggcctgtacctcgtcgtactgctccacctatgcgagcagtcctttagcgatatgatgggtaataccaatgagccctcgaccagggtgagactacagcggatgattcccaagaaaaccgagaccatcacagggcaccttattctgcccaacttcatctag

SEQ ID NO: 230197 - DNA, 876 bp, Artificial Sequence
  Description of Artificial Sequence: Synthetic coding sequence
atgtccatgcccttgcatcaaatctctgccatcccaagtcaggacgcaatttctgccagagtttaccgtagtaagactaaagagaaggaaagagaggaacagaatgagaagactctcggacactttatgagccatagctccaacatatcaaaggccggaagtcctccctccgcgtcagctccagcgcctgtgtcttctttcagcaggacttcgattacccctagttcacaggacatttgccgtatttgtcactgcgagggagacgatgagtccccacttataacaccatgtcactgcaccggctctctgcatttcgttcatcaagcatgtttacagcaatggataaagagctccgacaccaggtgttgcgagctctgtaagtacgagtttattatggagacgaagctaaagccactgcggaagtgggagaagctgcagatgacttcttccgaacgcaggaaaataatgtgttccgtcaccttccacgtgattgctattacatgcgtggtctggagcttgtacgtcttaatcgaccgaacggccgaggagatcaaacagggacaagcgacgggaatcttggaatggcccttctggacaaaactggttgtagtggcaatcggtttcaccggtggtctgctgttcatgtatgtgcagtgtaaggtgtacgtccagctgtggaagcgactgaaagcttacaatagagtgatttatgtgcagaattgtccagagacctcaaaaaaaaacatattcgagaaaagcccgttaactgaaccaaatttcgaaaataagcacggctacggcatctgtcacagcgatacaaactcaagctgctgtaccgaaccggaggacaccggggctgaaatcattcacgtgtag

SEQ ID NO: 230198 - DNA, 876 bp, Artificial Sequence
  Description of Artificial Sequence: Synthetic coding sequence
atgagcatgcccctacatcagatcagcgcaattcctagccaggacgccatcagcgccagagtctaccgaagtaagactaaagagaaggagagggaagagcagaacgagaagactcttggccacttcatgagtcattcttctaacatctccaaagctggaagccctccctccgcttccgctccagcacctgtttcttcttttagtaggacgagtataaccccatcttcccaggatatctgcaggatatgtcactgcgagggtgacgatgagtctccgcttataaccccttgccactgcaccggatcactgcatttcgtacaccaggcatgcctgcaacagtggataaaatcatctgacacccgatgctgcgagctttgtaaatatgaattcattatggagacgaaacttaagcccctgcgtaagtgggagaagctgcaaatgacaagttcggaacgcagaaagataatgtgtagcgtgacgttccacgtgatcgccattacctgcgtggtctggtcattgtatgtgctgatcgaccgaactgccgaagagattaagcaaggccaggcgactggaattcttgaatggcccttttggaccaaactggtggtcgttgcaataggtttcaccgggggactgctgttcatgtacgtacagtgcaaggtatacgtgcagctttggaagagacttaaagcatacaatagggtgatttacgtgcagaactgccccgagacatccaaaaagaatatctttgagaagagtccactgacagaaccaaattttgagaacaagcacggctacgggatctgtcactctgatacaaatagtagttgctgtactgagcctgaagataccggggcagagattattcatgtatag

SEQ ID NO: 230199 - DNA, 876 bp, Artificial Sequence
  Description of Artificial Sequence: Synthetic coding sequence
atgtctatgccactccaccaaatatcggccattccatcacaggacgctataagcgcgcgtgtctatcgatccaagacaaaagagaaggaacgtgaggaacaaaatgagaagacactgggtcactttatgtcccactcaagtaacatctcaaaagctgggtcgcccccttccgcatctgctccggctcctgtctctagcttctcaaggactagtataaccccatcgtcccaggacatatgtagaatctgccactgtgaaggagatgatgagtccccacttatcaccccctgtcactgtaccggatccctacactttgtccaccaggcgtgcctacagcagtggatcaagagcagcgacaccaggtgttgcgaactgtgtaaatacgagttcatcatggagacaaaattgaagcccctgaggaagtgggagaagcttcagatgaccagttccgaacggcgtaaaattatgtgtagtgtgacatttcatgtcatcgcaatcacatgtgtggtgtggtccttgtacgtgctcatcgatcggacggcagaagaaattaagcagggtcaggcaaccggtatcctggaatggcctttctggacaaagctcgtcgtggtggccatcggtttcaccgggggactcttgttcatgtacgtgcagtgtaaggtgtacgtgcagttgtggaagcgattgaaagcctacaaccgggtgatatacgtacaaaactgcccggagacgtccaaaaaaaatatcttcgaaaaatctccacttacggagccgaatttcgaaaacaagcacggatatggaatctgtcactccgacacaaatagtagctgctgtacagaaccggaggacaccggcgctgaaattatacacgtgtag

SEQ ID NO: 230200 - DNA, 1371 bp, Artificial Sequence
  Description of Artificial Sequence: Synthetic coding sequence
taaatctgtaaggacacattgcaggcaagtaagaggaactcctttggaagcgagtgggcccaggcgctcaagcccgcaaaaaacaccaaagcccgacgaacactaaaatttagcaggtcactaaatgatgttggcgaaaaggctcaggacactagcgagtcttttgcttatgtcgagagaacctgctctgagggcaagctgattctgccacaggacacctgcctccgaactaaccggttccaccacaaagagaagcggaccctgaaccacaagcctctgggcaactctaagcattcgtgtgtgagctgcctgagcgctgggagaagcaccgctagcgaggtggaggcaggaaaaggcggaaggcctggactgttattggaggagaaggctgatggggaggccacctccagatcacgacagctgctccagtacttgttcagcctgagccacggcctttcagctagcagccttcaccggtttcacgaactggagagctgcgctgcacgattgcataccgcgaagagctcgtcagggctagcaggctcgatgggcttctgctctgatgaaatgggagatgacgacgttttcgaggacagcacctcggcgaagctgaagtcaagggttctgagggctccactctgctcaaccgagaaggattcagatcttgactgcccttctcccttttcagagaagttgccaccaatcagtcctgtaagcacatcaggcgacgtatgtcggatttgccactgtgaaggtgacgatgagagtccactcatcactccatgtcattgtaccgggtctctgcactttgtccatcaggcctgcctacagcagtggattaagtcttctgatacgcggtgctgtgaactttgcaagtatgagttcataatggagactaaactcaaaccactgcggaagtgggaaaaacttcagatgaccagttcggaaaggcggaagattatgtgcagcgtgacatttcacgtcattgctatcacctgtgtagtgtggtccctatatgtgttgatcgatcggacagcagaggagatcaagcagggacaagctacaggcatcctggagtggccgttctggaccaagcttgtagtggtggccatcggatttactggcggactcctttttatgtacgtgcagtgcaaggtgtacgtgcagctctggaagagactcaaagcatataaccgcgtcatctacgtacaaaactgcccagaaacatcgaaaaagaacatctttgagaagagccccctgacagaaccgaactttgagaacaaacatggctatggtatctgccactccgatacaaacagttcctgctgtacggagcccgaggacacaggagctgagatcatccatgtgtag

SEQ ID NO: 230201 - DNA, 270 bp, Artificial Sequence
  Description of Artificial Sequence: Synthetic coding sequence
atgtctatgcccctgcaccaaatttccgcgatcccatctcaagatgccatcagcgcccgagtgtacaggtctaaaactaaggagaaggaacgggaggagcagaacgaaaagacgctgggacacttcatgtcacactctagtaacatttcaaaagccggatctcctccctcagctagtgcgcctgctcctgtgtcgagttttagccggacctctatcactccgtcttcacaggacatctgtcgtatttgtcattgcgaaggggacgattag

SEQ ID NO: 230202 - DNA, 1041 bp, Artificial Sequence
  Description of Artificial Sequence: Synthetic coding sequence
atgctaaagtctcggctccgcatgtttctcaacgagttaaagttattagtccttaccggtgggggaaggcccagagccgagccccaaccacggggtgggcgtggtgggggttgcggctgggcccctttcgccggatgcagtacaagagacggcgacggcgatgaggaggagtattatggaagcgagccccgtgcccgaggtttggccggagataaggagcctagggccggacctttgcctcccccagcaccgccactccccccacctggcgcactggacgccctgtcactgtcaagctcgctggactctggcctgagaaccccccagtgtcgcatctgcttccaggggcctgagcagggcgagttactgtcaccctgccggtgcgacggctccgtgcggtgtacacaccaaccatgtctgattagatggatcagcgagcgtggaagttggtcatgtgaactttgttatttcaaatatcaggtgctggcaatcagcacaaagaacccgcttcagtggcaggccatatccttaaccgtcattgagaaagtgcaaatagccgcaattgtgctcggcagtttatttttggtcgcatcaatctcctggctgatttggagcagtctgtcaccctcagccaagtggcagaggcaggatttactcttccaaatctgttacggcatgtatggctttatggatgtcgtatgcattggtcttattattcacgaggggagctccgtgtacagaattttcaagcgctggcaagccgtcaaccagcagtggaaggttctgaactatgacaagacgaaggatatcggaggcgacgctggcggaggaaccgccggaaaaagcggccctcggaacagccggaccggacctacctctggtgctacgagtcggcctcctgcagcccagcgtatgcgaaccctcctgccccagaggtgtggctacaccatattgcacctcctgggccagctacgcccacccgacgcccgttctagttctcacagcggtagggaagtggtgatgcgggtgaccaccgtgtag

SEQ ID NO: 230203 - DNA, 702 bp, Artificial Sequence
  Description of Artificial Sequence: Synthetic coding sequence
atggtatcggacaagtgccatatcctggatctcatcaaagcccagcgtaggcaaatgcttatcctaccggagggcttcagggaaggttcctggagcactctgcttttcagggccacacatcacttggccctacacccatttttaggactgtttggcgcactgtccccaacccagtggcaggctatttctctgactgtcatcgagaaagtgcagattgccgcaatcgtgctgggaagcctgtttctggtggctagcatttcttggctgatttggagctccctcagcccctctgcaaaatggcagcgacaagatctgttattccagatctgctacggcatgtacggttttatggacgttgtatgcataggactgatcatccatgagggctcttccgtatatagaatctttaagcggtggcaggcagtcaaccagcaatggaaggtactgaactatgacaagactaaggatattggaggagacgccggaggaggtactgctggcaagagtggacctagaaactcaagaactggccctactagcggcgcaaccagcaggccgcctgcggcacagaggatgagaacactcctccctcagcggtgtggatatacaattctccatctcctgggtcagctcagacctccagatgccaggagctccagccatagcgggagagaagtcgtgatgagggttaccacagtctag

SEQ ID NO: 230204 - DNA, 3159 bp, Artificial Sequence
  Description of Artificial Sequence: Synthetic coding sequence
atgaagctagtgaacatctggctactgcttttggtggtcctcctttgcggcaaaaaacacctgggggataggcttgagaagaagtcatttgaaaaggctccttgtccgggatgctcacacctcactctgaaggtggagtttagcagcactgttgtggaatacgaatacattgtcgcttttaatggatatttcacggctaaggccagaaactcctttatctcttcggctctcaagtcctcggaggtggacaattggagaattattccaagaaataacccctcttcagactaccccagtgatttcgaagttatccagattaaagagaagcagaaggctgggctcttgacactggaggaccatcccaacataaagagagttactccacagaggaaggttttccgcagtttaaagtacgcagagagtgaccccacagtcccctgtaatgagactcggtggagccaaaagtggcagagttcccgacctttgagaagagccagtctgagcttggggtctggcttttggcacgccacgggccgacacagcagccgacgccttctgagggcaatcccccgacaggtggcccagactttgcaagccgacgttctgtggcaaatgggttatacgggcgcaaatgtccgagtggctgtgttcgacaccggtctgtccgaaaagcaccctcattttaaaaacgttaaggagaggaccaattggaccaatgagagaactctggacgatggtctaggacatgggaccttcgtggctggtgtgatcgcttccatgagggagtgtcagggcttcgctcctgatgctgaacttcacatcttccgcgtgttcacaaacaatcaggtatcatacaccagctggtttctggatgcttttaactatgctattctaaaaaagatcgacgtactgaatctctccattggcggtcctgactttatggaccatcccttcgtcgacaaagtttgggaactgacagccaacaatgtgatcatggtgtccgctatcggcaatgatggaccattgtacggcactctcaacaaccctgcggaccaaatggatgtgatcggtgtaggcggaattgattttgaagacaacattgcacggttttcctccagaggcatgacaacatgggagctgccgggtggctatggcaggatgaaacccgatatagtgacatatggggcaggggtccgcggaagcggggttaaaggtgggtgccgcgcactgtcaggcacttcagtcgcctcaccagttgtcgccggtgccgttacgttgctggtctccactgtgcaaaagcgtgaactagttaatcctgccagcatgaaacaggcactgatcgccagcgccagaagactgcccggagtcaatatgtttgaacagggacatgggaagctggatttactgcgggcttaccagatattgaacagttacaagcctcaggcttccctcagcccctcatatattgacctcactgagtgtccctatatgtggccttactgctcccagcctatctactatggtggaatgcctacagtagtgaacgtgactattcttaacgggatgggggtgaccggaaggattgtcgacaagccagactggcagccgtacctcccccagaatggcgacaacatagaagtggcattctcttattcatctgtcctttggccatggtcggggtacctggccatttccatctctgtaactaaaaaagccgcaagttgggaaggtattgcgcaggggcacgtcatgataacggtggctagcccagctgaaaccgagtcaaaaaacggagccgagcagacttcgacggtcaagctcccgatcaaagttaagatcataccaactccacccaggagtaagagggttctgtgggaccaataccataatctgcggtatccgcctgggtatttcccgcgagacaacctacgcatgaagaatgatcccttggattggaatggcgatcacatacacaccaactttcgggacatgtaccagcatctcaggagcatgggctacttcgtggaagttctgggagccccattcacttgcttcgatgcgtcacagtacgggacactcctgatggtcgattctgaagaagagtatttccccgaagagatcgcaaagctcagacgggatgtagacaacggcctctcactagtcattttcagtgactggtacaacacgtcggtcatgcggaaagttaagttttacgacgagaacaccaggcagtggtggatgccagacaccggaggtgccaacattcccgctttaaatgagcttctgtctgtgtggaacatgggattctccgacggtctctacgagggggagtttaccttggccaaccacgatatgtattatgcctctggctgctcaatcgcgaaatttcctgaggatggtgtggtaatcactcagacgtttaaagatcaaggtttggaagtgctaaaacaggaaacagccgttgttgagaatgtccccatattggggctgtaccagatacctgctgaagggggtggcaggattgtactgtatggagatagcaattgcctggatgatagccataggcagaaggactgcttctggctcttggatgccctgctgcagtacacgtcttacggtgtcacccccccaagcctctcgcactctggcaatcgtcagcggcctccctccggtgcagggagtgttacacctgaacgcatggagggcaatcacctgcacagatatagcaaggtgctggaagcacacttgggcgatcctaaaccacgccctcttcccgcatgtcctcggctgtcttgggccaaaccacagcctcttaacgagacagctccgtctaatctatggaaacaccaaaaattattgtccatcgatctcgataaggtggtgcttcctaactttcggagtaaccgcccacaggtgcgtcccctgagtccaggcgaatcgggagcatgggatatacctggaggaattatgccaggaagatataatcaagaggtggggcagacgataccagtattcgcattcctgggcgcaatggtcgttcttgctttcttcgtcgtgcagattaacaaagccaaatccaggcccaagcgccgaaagcctcgagtcaagagaccccaactcatgcagcaggtccatcctcccaaaacaccttccgtgtag

SEQ ID NO: 230205 - DNA, 1494 bp, Artificial Sequence
  Description of Artificial Sequence: Synthetic coding sequence
atggctcttgttggcttgcccggacacttacacttctgtgaccaggagtccggcttcctcggcagacattgttccggtccatgccatgaccactgtggctttcctagccgggacagagtgaaaaaatggtgcagaaccgatttcaacagcaaacttcctattaaagtgaagataattcctacccctcccaggtcgaagagagtactgtgggatcagtatcacaacttgcgctacccgccaggatatttcccgcgagacaatctcagaatgaagaacgatcccctggactggaacggggaccacattcacacaaatttcagagatatgtaccagcatctccgttctatgggctacttcgtggaagtgctcggagcaccatttacctgttttgatgcttctcagtatggcaccttgcttatggtggactctgaagaggagtattttccggaggaaattgctaagctaaggcgagatgtggataatggcctatccctggttatattttccgactggtacaacacttcagtgatgagaaaagttaaattttacgatgaaaatactagacaatggtggatgcctgacactgggggtgccaatatcccggctctcaacgaacttctctcagtgtggaacatggggttctcagacggcttgtacgagggggaattcacactggcaaatcatgacatgtattatgcttctggttgctctatcgccaaatttcctgaagacggcgtggtcatcactcagacatttaaggaccaaggccttgaggtcctgaagcaggagaccgctgtggtggaaaacgttccaatcctcggtttatatcagatcccagctgagggaggagggaggattgtcctgtacggcgactccaactgtctggacgattcacaccgccagaaggattgcttctggctgctggatgcactcctgcagtacacctcttatggggtgacaccaccgtctctgtcacatagcggcaatcggcagaggcctccgtccggcgcaggcagcgtaactcctgaacgcatggaaggcaaccacctacatagatactcaaaggtgctggaggctcacctgggagaccctaagcctaggcctcttccagcctgtcccagactaagttgggccaaaccacagccactaaacgaaactgcaccctcaaacctgtggaaacatcagaagctgctgagcatagatctcgacaaggtggtgctccccaattttagaagcaaccgccctcaagttcgcccactgtcaccaggcgaatccggagcttgggatatccccggtggcatcatgcccggacgctataaccaggaagtgggccagaccatccctgtgttcgccttcctgggtgccatggtcgtcttagccttcttcgtggtgcagattaacaaggccaagagtcgcccaaagagacgaaagccacgcgttaaaaggccccagcttatgcaacaggttcatccccctaagacacccagcgtgtag

SEQ ID NO: 230206 - DNA, 993 bp, Artificial Sequence
  Description of Artificial Sequence: Synthetic coding sequence
atgattccggtctccctggtggtggtggtggtgggagggtggactgtggtgtatctgactgacctcgttctgaaaagctctgtgtatttcaagcactcatacgaggactggttggaaaataacgggctgtcaatctccccttttcatatcaggtggcagactgccgtgtttaaccgcgctttctactcgtggggcaggcgtaaagctagaatgctgtaccagtggttcaattttggaatggtttttggtgtgatcgccatgttcagtagcttctttttgttggggaagaccctgatgcagacacttgctcaaatgatggccgatagcccatcttcgtactcctctagctctagcagctcaagctcctcctcttcctcatcttccagttcatctagttctagcagcagtttgcacaatgagcaagtgctgcaggtggttgtccccggtataaatctccccgtgaatcagcttacctatttcttcaccgcagttctcatatcgggagtggtgcacgagattgggcacggcatcgccgctattagagaacaggtccggtttaacggctttgggatattcctgttcataatttaccctggagctttcgtggatttgtttacgacacaccttcaactgataagccctgtacaacagctccgcattttttgtgctgggatatggcataattttgtcctcgccctgttgggaattctggctctagtgcttctgccagtcatccttttgcctttttattacaccggtgttggtgtgctgataactgaagttgcggaagactcacccgcaatcgggccaagaggactctttgttggcgaccttgtgacacacctccaggattgtccagtgaccaatgtgcaggactggaatgagtgcttggacaccattgcatacgaacctcaaattggatattgtattagcgcctccacccttcagcagctgtccttccctgtgagaggggtgtatatttcttctatctag

SEQ ID NO: 230207 - DNA, 1560 bp, Artificial Sequence
  Description of Artificial Sequence: Synthetic coding sequence
atgattcccgtttccctggtcgtggttgtcgtgggcggatggactgttgtctatctcaccgacttagtgctgaagtcatccgtctacttcaaacactcatatgaagactggttggagaacaacggtttgagtatttccccctttcacatcagatggcaaactgcagtcttcaatagagccttttatagctggggtagaaggaaagctaggatgctgtaccaatggttcaacttcggcatggtgtttggggtcattgccatgttctccagcttcttcctactcgggaaaacccttatgcaaaccttggcgcagatgatggccgactctccttcctcttatagcagcagctcaagctcttcatcatcaagctcttcatctagcagttcttcctcaagttccagcagctcattgcacaatgagcaagtcctgcaggtcgtagtccctggcattaacctgcccgtgaatcagctgacctacttcttcaccgccgtcctgatctctggggtggtccacgagattggtcacgggattgctgccatccgcgagcaggttcgcttcaacgggtttggcatctttctattcattatctatccaggggcttttgtagatctcttcacgacccaccttcaactaatctcacccgtgcagcagctcaggattttctgcgccggaatatggcacaacttcgtcctcgcactgctagggatactagctttggtgctcctgcccgtgatactgttgcctttttattacaccggcgtgggtgttctgattaccgaagtggctgaggactcgccagcgatagggcctagaggtcttttcgtcggcgacctcgtgacacacctccaggattgtccagtcaccaatgtccaggactggaacgagtgtctcgatacaattgcttatgaacctcaaattggatattgtatttctgcatccacccttcagcaactgtcatttcctgttagagcttacaagagattggacggcagcacagaatgctgtaacaatcattcattgactgacgtttgtttttcctacagaaataactttaacaagagactgcatacgtgtctgcctgccaggaaggccgttgaagcaacacaagtgtgccgaacaaataaggactgtaaaaaaagttcgtcttctagcttctgcatcattccatctctggagacacatacacggttgataaaggtcaaacacccacctcagattgacatgctctacgtcgggcaccccctgcacctgcactacaccgtgagtatcacgtccttcattccgaggttcaactttctgtcaatagacctgcccgtggttgtcgagacttttgtgaagtacttgatcagcctgtccggagcattggctattgtgaacgccgtgccatgtttcgctcttgacggccagtggatcctcaattcattccttgacgccaccctcacttccgtcattggcgataacgacgtgaaggacctcataggctttttcatcctgctgggagggtctgtccttctggctgctaacgtcactctggggctctggatggtaacggctagatag

SEQ ID NO: 230208 - DNA, 207 bp, Artificial Sequence
  Description of Artificial Sequence: Synthetic coding sequence
atgcaccaaacgtactccagacattgccgtcctgaagaaaggtggagccaggaggggtggaacataccagccaatggtttcaacatctgccgctgcctcaacattggtatgaaactgagactctggaataacctgaacaagtcgaacatcttaggggctcttaaaattaaaaggagagagatacgtgccccattcctcctgccgtag

SEQ ID NO: 230209 - DNA, 762 bp, Artificial Sequence
  Description of Artificial Sequence: Synthetic coding sequence
atggtgcttttaaaactgctggaagtttacagaaaggggagcgcgggaacttttcataagagcaccatttttggcaacactatcatgaccagccagcccgtgccaaatgagacgatcatcgtcctgccttcgaacgttataaacttcagccaggccgagaaaccagagcctactaatcaaggacaggactcattaaagaagcacctccacgctgaaattaaggtgatcgggaccatccaaatcttatgtggaatgatggttctctcgcttggaattattctcgcttcagcatcctttagccccaacttcacccaggttacttccaccctgctcaattcagcatacccattcatagggcctttttttttcatcataagcggcagtctgagtattgctaccgagaagcggttaactaaactgctggttcatagtagtctggttggatccatcctgtcagcactgtctgcactcgtaggcttcatcatccttagtgttaagcaggctaccctgaatcctgccagcctacagtgcgagctggacaaaaacaacattcccactcggagttacgtgagttatttctaccatgactccctgtacacaaccgactgttatacggccaaggcgagtctggctggcacactgtcattaatgctgatttgtacactgttagagttctgtcttgccgtgctaactgcagtactgaggtggaagcaggcctatagcgactttcccggagtgtccgtcttagctggctttacttag

SEQ ID NO: 230210 - DNA, 804 bp, Artificial Sequence
  Description of Artificial Sequence: Synthetic coding sequence
atgaaggctgaggccaccgtgataccaagtagatgtgccagagggttaccatcatggcaggtcctgagccctgtacagccctggcagaccagcgcccctcaaaacaccacccagcctaagctcctcgcccctcatcagcacgaaaagtcccagaaaaaaagctccttgctgaaggagctcggcgcatttcacatcactatcgctctgctccatctggtattcggcggttatctggcgtcaatcgtgaagaatctccatttagtggtgctgaagtcttggtaccccttctggggtgctgcatcattcctgatttctgggatccttgctatcactatgaaaaccttcagcaagacttacctgaagatgctttgtctcatgacaaatttgatatccctgttttgcgtgttgtccgggctgtttgttatctctaaggatctatttctggaatcccccttcgagtcacccatttggcgcatgtatcctaactctaccgtacacattcagcggttagaactcgctctattatgtttcaccgttctggagctgtttctgcccgtgcctaccgctgtcaccgcctggagaggcgattgcccatctgccaagaatgacgacgcctgcctagttccgaatacccccctccatctgaagggcctcccggtagagccacctcctagttatcagagtgtgattcagggcgatgcgcaacataagcagcaccagagattgcgggaagtgaaacaagtggctccagacacctggatcgtgaccgacggagcggctatctggacacagaccgccaactag

SEQ ID NO: 230211 - DNA, 804 bp, Artificial Sequence
  Description of Artificial Sequence: Synthetic coding sequence
atgatgtcatctaagcctacgagccacgccgaggtcaatgaaacaatccccaatccttaccctccaagcagctttatggctcctggtttccagcagccactgggcagtatcaaccttgagaaccaggcgcagggggctcaacgggcacaaccttatgggatcacatcacccggaatttttgcctcttcccagccgggacagggcaacatacaaatgatcaacccaagtgtgggcaccgccgtgatgaattttaaggaggaagccaaggccctgggagtcatccagatcatggtgggcctgatgcacattgggttcggcatcgtgctttgcttgattagcttttcttttcgcgaggtactggggtttgcttcaaccgccgtgatcggtggttacccgttttgggggggactgtctttcatcatcagcggaagcctgtccgtatccgcaagtaaagagctcagccggtgcctcgtcaaggggtcactgggcatgaatatagtctccagcatcctggcttttatcggtgtgatattattgctcgtggacatgtgtatcaacggtgtcgccggtcaggactactgggcagtcctgtctggaaaaggcattagcgccactctcatgatctttagcctgctcgagttcttcgttgcatgtgcgactgcccatttcgcaaaccaggctaatactacaaccaacatgtccgtgctggtgatacccaacatgtacgaatcaaaccccgtcacacccgcttcatcctctgctccgccacggtgcaacaactacagcgccaacgcgcctaagtag

SEQ ID NO: 230212 - DNA, 345 bp, Artificial Sequence
  Description of Artificial Sequence: Synthetic coding sequence
atgatgtctagcaaacctacatctcatgccgaagtgaacgagactatccccaatccataccccccatccagcttcatggcccctggattccagcagcccttgggaagcatcaacctcgaaaatcaagcccaaggcgcacagcgggctcagccctacgggattacgtcccctgggatttttgctagctcccagccgggtcagggaaacatccagatgatcaacccatcagttggaacggccgtgatgaattttaaagaagaggctaaagctctgggggtaattcaaatcatggtgggattaatgcacatcgggtttggcatcgttctgtgtctcattagcttttag

SEQ ID NO: 230213 - DNA, 666 bp, Artificial Sequence
  Description of Artificial Sequence: Synthetic coding sequence
atgatgtcttccaaacctactagccatgctgaggttaatgaaacgataccaaatccttacccaccatcctcgttcatggctccgggattccagcagccgctgggctcaataaatctggagaatcaggcgcagggggcacagcgggctcagccctatggtattactagccctgggatttttgcctcttcccagcctggccagggtaacattcagatgattaacccctcggtcggaacagccgtgatgaatttcaaggaggaagctaaggcccttggcttcatcatctcagggtccctcagtgtgtctgctagcaaagagctgtctagatgcctggtgaagggctcgttgggaatgaacatcgttagttctatcttagcgtttatcggggtgattctactgctggtcgacatgtgtattaacggtgtggcgggacaggactattgggctgtgctgagtgggaaggggattagcgcgaccctaatgatcttctctctcctggagttcttcgtcgcctgcgccacagcgcattttgctaatcaagcaaacactacaacaaacatgtcagtattggtgatcccgaatatgtacgaatccaaccctgtgaccccagcctcatcctctgcgccaccccgttgcaacaattactcagccaatgcacccaagtag

SEQ ID NO: 230214 - DNA, 972 bp, Artificial Sequence
  Description of Artificial Sequence: Synthetic coding sequence
atgaccgaacaagtgatcggcgcaaattctgttccaggaattattgccccagacaatgtgcacgtgatccagcctagcaacccagtggcctcaggtaaccatctgcaaccctctgaagtcaccacgtacccaatctcacccaaagtcatccattgcgacacaggtcgagcgaatcttcagaacctgctggtagtaaaccagaacagcgccgcaggggtgcagtcacagcccatcgggtaccagcgccagtaccccgtgggcacagcaagccttcagactgtgccaggggttatacagtacactcaggggacaacgaacttacagacatggcctggagacctgcaaaatcccctgaacgccaatcctggactaacacacacatcaaatagtagtcagtggaatacctcttttgcctcttttacttcttttaacccaaagaagttcatcaatgaggaggtgcgaacgcttggcgctattcagatcctaatcggccttacacatatttttagcgccatcaatcccgtactttactactacccttttgtgacatggctttctggctatcctctctggggtgggctctcctatatcgtgagcggctccctctctgtgtgggcagccaaagatcccagcccctgcgtcgtcaacagtagtatctcctttaacattatatcagccctcttcgccttcgctggcattttcatcatcatcactgatctgagtctttattacgttacaacttattctaaagcggtcagtggaggtctgctgccctttgctttacttgagttcattctcacatgtgttgtgtcccacttcggatgccaggcaacatgttgtaggcagttcgaaaatgtggccgtgatccccaccgtcttttctttcaaccccgcaaacactaccaccagtcccgttaacgcgaccaccggacctgtaaatgccgctacagggcctgtttctgcaacgaactag

SEQ ID NO: 230215 - DNA, 735 bp, Artificial Sequence
  Description of Artificial Sequence: Synthetic coding sequence
atggatacggagagtaatcggcgtgctaacttagccttgcctcaagaaccttcatcagtccctgcttttgaagtgctggagattagtcctcaggaagtgtcttctggtcgcctgttaaaatctgcctcctccccacctcttcacacctggctgacggtgctgaagaaagagcaggaatttcttggagtaacacagattcttacagcaatgatctgtctctgttttggtaccgtggtttgcagcgtcctggatataagtcacatcgagggcgacatttttagctctttcaaggctggatatcccttttggggcgctatcttcttttctatctcaggcatgctgtcgatcatcagtgagagacgaaatgcaacatacctggttcgtggcagcttaggggctaacactgcttccagtatagcaggcggtaccgggatcaccatactgattattaacctgaagaaatccttagcttatatccacatccacagttgccagaagttcttcgagaccaagtgctttatggccagcttcagcaccgagatcgtcgtgatgatgctcttccttacaattctaggactcggttccgccgtcagcctgacaatttgtggtgccggtgaggaacttaagggcaataaggtgcccgaagatagagtgtatgaagagctgaacatatatagcgccacgtacagcgagctggaggaccccggagaaatgtcaccccctattgatctctag

SEQ ID NO: 230216 - DNA, 126 bp, Artificial Sequence
  Description of Artificial Sequence: Synthetic coding sequence
atggatactgagagcaatcggagagctaatcttgcattgcctcaggagccttcatcggtccccgcatttgaagttcttgaaatctctcctcaggaggtcagctccgggagactgcttaaatcctag

SEQ ID NO: 230217 - DNA, 645 bp, Artificial Sequence
  Description of Artificial Sequence: Synthetic coding sequence
atggcatctcacgaggttgataacgccgaactgggtagcgctagcgctcacggtactccgggttcagaggctggcccagaggaactcaatacatcagtttaccagcctatcgacgggagtccagattatcaaaaggccaaactgcaggtgttaggagctattcagattctcaacgcagctatgatcctcgccctgggcgtattcttgggatctctgcaatacccctaccacttccagaagcatttcttcttttttaccttttacacaggataccctatttggggagcggtgtttttttgcagctcagggaccttaagcgttgtggctggaataaagcctactcgcacctggattcagaatagcttcggcatgaacatcgcgtcagctacgatagctttggtgggcaccgcctttctgtcactgaacattgcagtcaatattcagagtcttaggtcatgccactcgtcctcagagagccctgacttgtgtaactacatgggctcaatttccaatggcatggtatccctgctgttaattcttacgcttttggaactatgcgtgacaatctcgacgatagcaatgtggtgcaatgccaactgttgtaattctcgggaagagatctcaagtcctccaaattcagtttag

SEQ ID NO: 230218 - DNA, 507 bp, Artificial Sequence
  Description of Artificial Sequence: Synthetic coding sequence
atggcatcacacgaggtcgataacgccgagctgggctcagcctcagctcatggaacccctggttctgaggccggaccagaggaattgaacacgtctgtgtatcaacctattgacggatccccagattatcaaaaggctaagttgcaggtgctgggattttgtagtagcggaaccttaagcgtggtcgcgggtatcaaaccaacaaggacctggattcagaattcctttgggatgaatatcgcttccgccaccatcgccctggtgggcacagcctttctcagcctgaacattgccgtgaatatccagtctctcaggagttgccacagttctagtgaatctcctgatctctgcaattatatggggagcatctccaatggcatggtatctctattgctgattctaaccctgctggaactttgcgtaactatcagtaccatagccatgtggtgcaacgcaaattgctgcaacagccgggaggaaatttccagcccaccgaacagcgtctag

SEQ ID NO: 230219 - DNA, 276 bp, Artificial Sequence
  Description of Artificial Sequence: Synthetic coding sequence
atgaatatcgctagtgccacaatagctctggtgggaaccgcatttctatcactgaacattgccgtcaatatacaatcactgaggtcgtgccatagtagctccgagagcccggacttgtgtaattatatggggagtatcagcaatgggatggtgagcttgcttctaattctgaccctgctggagctatgcgttacaatcagtacgatcgccatgtggtgcaatgccaattgctgtaatagtcgcgaagaaatcagcagcccacccaactcagtttag

SEQ ID NO: 230220 - DNA, 507 bp, Artificial Sequence
  Description of Artificial Sequence: Synthetic coding sequence
atggcaagtcacgaggtggataacgccgaattgggctctgcttcagctcacggaactcccggatcggaggcaggccctgaggagctcaacacctctgtgtaccagcctatagacgggtcaccggactatcagaaggcaaagcttcaggtgctgggcttttgctcctccggaaccctgtcagtggtggcagggataaaacctaccaggacctggattcaaaacagttttggtatgaatatcgcatccgctacaattgctctcgttgggaccgcgttcctttccttgaacatcgctgtcaacattcaaagtctgaggagctgccacagctcgagtgaaagtccagatctatgcaactacatgggctcgatctccaatggcatggtctcgctcctgctgatcttgaccttgttggaactgtgcgttacaattagcactatcgctatgtggtgcaacgctaactgctgcaacagccgagaagaaatttcatcacctccaaattctgtgtag

SEQ ID NO: 230221 - DNA, 720 bp, Artificial Sequence
  Description of Artificial Sequence: Synthetic coding sequence
atgcaccaaacatatagtcggcattgtaggcctgaggaatctactttctcagcagccatgactactatgcaaggaatggagcaagcgatgccgggagctggaccaggtgtgccacagctgggaaacatggcagtcatccactcgcatttgtggaaagggctgcaggagaaatttctcaagggcgagccaaaggtgctgggggtcgtacaaatcctcacagccttaatgagcttatcaatgggaatcactatgatgtgcatggcgtctaatacatacgggtccaacccaatttcagtgtatatcggctatacaatctggggctctgtgatgttcatcatttctggatccttgtcaatcgcagccggtatccggactaccaagggactcgtacgcggatcacttggcatgaacatcacttcttccgtgcttgctgctagcggcatcctcattaatacgttcagcctcgccttctacagttttcaccatccttactgcaattactacggaaactccaataactgccatggaacaatgtcaatcctaatgggacttgatggaatggtgctgctgttgagcgtcttggaattctgcatcgctgtaagtctctctgcgttcggctgcaaggtgctgtgctgtacacctggtggcgtggtgcttatactgccgagccattcacacatggcagagacagcctcacccacccctctgaacgaggtctag

SEQ ID NO: 230222 - DNA, 663 bp, Artificial Sequence
  Description of Artificial Sequence: Synthetic coding sequence
atgaccacaatgcaggggatggagcaagcgatgcctggggctggtcccggagttcctcagctggggaacatggccgtcatccatagccatctgtggaaaggcctgcaagaaaaattcctcaagggggaaccaaaggtactgggggttgtccagatcctgacagctctgatgtctctgagtatgggtattaccatgatgtgtatggcttcaaatacttacggctccaatcccattagtgtgtacatcggatacacaatttggggatcggtcatgttcataatcagtggctctctatcgatcgccgcaggaatccggactaccaaaggcctggttcgtgggagcctaggcatgaacatcacaagctccgtgcttgccgcttccgggatcctgatcaatacattcagcctcgctttttattcctttcaccacccatattgcaactattacgggaattccaataactgccatggaacgatgtcgattctcatgggtctggacggcatggtacttctgctctccgtccttgagttctgcatcgctgtgtctctttccgcttttggctgcaaggttttgtgttgcacacccggaggtgtggtgctgattctgcctagtcacagtcatatggcggaaacggctagcccaacacctctgaacgaagtgtag

SEQ ID NO: 230223 - DNA, 663 bp, Artificial Sequence
  Description of Artificial Sequence: Synthetic coding sequence
atgaccaccatgcagggcatggagcaagccatgcctggcgcagggcctggtgttcctcaactaggaaatatggccgtaattcactcgcatctgtggaaaggcctgcaggaaaaattccttaaaggcgaacccaaagtcctcggagttgttcaaattttgactgccttgatgagtttatccatgggcattacaatgatgtgtatggcaagtaatacgtatggctccaacccaatctctgtgtatatagggtacacaatctggggcagcgtgatgtttataatttcagggagtctgtccattgccgctggtatcagaacaacaaaagggctggtgcgtggctcactcggaatgaacattacttctagcgtgctggccgctagcggcatcctcatcaacacctttagcttagcattctattcttttcatcatccttactgtaattattacggaaattccaataattgccacggaaccatgagcatcctgatgggactggacgggatggtgctgctgctgagcgtgcttgagttctgcattgctgtgtcactgtctgctttcggctgtaaggtcttgtgctgcacccccggtggcgtggtcctaattttaccctctcacagtcatatggctgagactgcctcccccacccccttgaacgaggtctag

SEQ ID NO: 230224 - DNA, 561 bp, Artificial Sequence
  Description of Artificial Sequence: Synthetic coding sequence
atgcaccagacatactcgcgacactgtagaccagaagaatccacgttctcggcagccatgaccaccatgcaagggatggagcaggccatgcccggtgccggtccgggagtgccacagctgggcaacatggcggtcatccacagccacctgtggaagggattgcaggagaaatttcttaaaggcgaacctaaagtcctgggggttgtgcaaattctgactgcactgatgagcctgagtatggggattacaatgatgtgtatggcgtccaacacctacggaagcaaccccatctcggtgtacattgggtatacaatctggggctcagttatgtttataatctctggaagtctgagcatcgccgctggcatacgaacaactaaggggttggggctggatggtatggtgcttctgttgtccgtcctggaattttgtattgctgtctccctgagcgcatttgggtgcaaggtcttgtgttgcacacccggaggggtcgtgctgattctcccaagtcattcccacatggcggagactgcctccccaacacccctgaatgaagtgtag

SEQ ID NO: 230225 - DNA, 399 bp, Artificial Sequence
  Description of Artificial Sequence: Synthetic coding sequence
atgaccacgatgcaggggatggagcagacaacccccggagctggcccagacgtcccacagctgggtaacattgacgtgatccacagttacctttgcaagggcctgcaggagaagttttttaaacggaagccaaaagtcctaggggtggtccggattctgatagccctgatgagtttatccatggggattataatgatgtgcgtcgccttttcctcgtacgaagagcatcccatattcgtctacgtagcctatacaatatggggatcggtaatgtacccctaccagctccagcaagaactggaacagcagaaggtgtggaattacctcaagaacctatcatggcgcatcatgggctcttatctgtgctttggcgaacggagtgagttgaagccactttag

SEQ ID NO: 230226 - DNA, 333 bp, Artificial Sequence
  Description of Artificial Sequence: Synthetic coding sequence
atgacgaccatgcagggtatggaacaaaccacaccaggcgcagggcctgatgtgccacaactcggcaacattgatgtgattcattcttatctgtgtaaggggctgcaggagaaatttttcaaacgaaagccaaaagttctgggtgttctatgcggtcacaagttctcgacccacagtgtgtccctgtcagtggctgcaggtattagaaccacaaaggggctggagctcagcgaggagtttaaactggagaataacggcattatcttcgtgttctggcgagaaatcagagtcgagactaccattcggaggcaagtccggcgattgcttaagtag

SEQ ID NO: 230227 - DNA, 615 bp, Artificial Sequence
  Description of Artificial Sequence: Synthetic coding sequence
atgtcgtacattcacatctgcgttaaggactgtaaacgatctagttcgcggggtaatccaaaatctctggggttttgtgtcgacatcagctttcaacttattcgggtggtgaggatcctgatcgccctgatgtctctgagtatgggcataatcatgatgtgtgtggccttttcatcctatgaggagcatcccatctttgtatatgtggcatatacaatctgggggtcagtgatgtatccttaccagctgcagcaggagctcgaacagcaaaaagtctgcatttatagagtcctgaatggcgctcaagctggagtgcaatggagggacctgggaagcctacagccacctccccctagcaggttgccctggccccctaaggtccctcgagttcagccactcccagggcgacacccagtgtgggaggtgagatcagtctccgcttggccccctattgtctgggacgttagatcaccttcggcatggctcccttcactggaatcagaggaaaggctctgccccgcagctatcccatctaggaaatggggagcacctttaccgggtcaccaccccatctgggaggtgagatctgttagcgcgcgtccaccgattttttag

SEQ ID NO: 230228 - DNA, 399 bp, Artificial Sequence
  Description of Artificial Sequence: Synthetic coding sequence
atgaccaccatgcagggcatggagcaaaccacacctggagctggtccggatgttccgcagctgggcaatatcgatgtcattcacagctatctctgcaaaggccttcaggagaaattcttcaagcggaagccaaaagtgctcggtgtcgttcgaattctcatcgctcttatgagcttaagcatgggcattataatgatgtgtgttgcctttagcagctacgaagagcaccccattttcgtatatgtcgcttacactatctggggcagtgtgatgtacccttatcaactgcagcaggaactcgagcaacagaaagtatggaactatctgaaaaaccttagctggcgcattatgggctcatatttgtgctttggcgagaggagcgaactgaagccactgtag

SEQ ID NO: 230229 - DNA, 603 bp, Artificial Sequence
  Description of Artificial Sequence: Synthetic coding sequence
atggatagcagcacagcgcacagtcccgtcttcctggtgtttcctcccgagatcacagcatccgaatatgaatctaccgaactctcggccacaacattctccacacagtcacctcttcagaagctctttgcacggaaaatgaagattctcggaactatccaaatactattcggaatcatgacattcagctttggcgtgatcttcttatttacactgttaaaaccatatccccgatttccattcatcttcctcagtggctatcctttctggggcagcgtgctgtttatcaactcaggcgcatttttgattgccgtgaaaagaaagaccactgagactttaatcattctctctcgcataatgaattttctatcagctcttggggcaatcgcgggtataatcctactgacattcgggttcatcctagaccagaactacatctgtgggtactcccaccaaaactctcaatgtaaggctgtgacagttctctttttgggaattctcattacattaatgacgttttctataatcgaactttttatatctcttcccttttccatccttggttgtcacagtgaggattgcgattgtgaacagtgttgctag

SEQ ID NO: 230230 - DNA, 747 bp, Artificial Sequence
  Description of Artificial Sequence: Synthetic coding sequence
atgacaagccaaccagtgcccaacgagactataattgttctgccatctaacgtcattaacttttcacaggcagaaaaaccagaaccaaccaaccagggacaagattctctgaaaaagcatttgcacgccgagatcaaggtgattgggacaattcaaatcctgtgcggcatgatggtgctgtcactcgggataattctggcctcagcttcatttagcccaaactttacacaagttacatcgacactgctgaacagcgcttatcccttcattggccctttctttttcatcatttctgggtccttgtctatcgcaaccgaaaaacgcctgaccaaattactggtgcattcctcactggtgggcagcatactcagcgcgctgtctgccttagtcggtttcataatactgagcgtaaaacaggctaccttgaatcctgccagcctgcagtgcgaattagacaaaaacaatatccctacccggtcgtacgtgtcctacttttaccacgattcactttatacaactgactgctacacagctaaagcctccctcgccggaacactttcactaatgcttatatgcactctactggaattttgtctcgctgtgctgactgctgtcttgcgctggaagcaggcctattctgatttccccggaagcgtgcttttccttccacatagctacataggcaactccggcatgtcatctaaaatgacccatgattgtggatacgaggaactgttaacctcgtag

SEQ ID NO: 230231 - DNA, 537 bp, Artificial Sequence
  Description of Artificial Sequence: Synthetic coding sequence
atgaccagccagcctgttcctaacgaaacaatcatcgtcctgcccagtaatgtgatcaacttcagtcaggcagagaaaccagaaccaaccaatcagggtcaagactccctgaaaaaacatttacacgccgagattaaagtcattgggaccatccaaattctgtgcggaatgatggtgctaagcctggggattatcctggccagcgcatcttttagccctaacttcacccaggtcacctcaaccttactgaactcagcataccctttcataggcccattcttcttcatcatcagcgggtcactgtccattgctactgaaaaacggctcaccaagcttttagtgcacagctccctcgtcgggtctattctctctgctttgtccgctctcgttgggttcatcatcctgtcagtcaaacaagcgacactcaatccagcatcactgcagtggaacagcttgagcgatgctgacctgcactctgcaggaattcttccctcttgtgctcactgctgcgcagccgtggaaacgggactgttgtag

SEQ ID NO: 230232 - DNA, 543 bp, Artificial Sequence
  Description of Artificial Sequence: Synthetic coding sequence
atgacatcccagcctgtccccaacgagacaatcatcgtccttccttcaaacgttatcaacttctcccaggctgagaaacctgaaccgaccaatcaggggcaagattcactgaaaaagcatctacacgctgagattaaggtgatcgggtttataatctcgggctccttatccatagcaaccgagaaaagactgactaagctactagtacactcgagcctcgttgggtcaatattatccgccctttccgcactggtgggcttcatcatcctttccgtgaagcaggccaccctgaatccagccagcctccagtgtgagctggataagaacaacattcctacaaggagctatgtttcctacttttaccacgattctttatacacaactgactgctataccgccaaggcaagcttagccggaactctaagcttgatgctgatatgcacccttcttgaattctgcctggctgtgctgaccgccgtcctacgctggaaacaggcttattccgactttcccggtgtttcagtgctggcgggtttcacctag

SEQ ID NO: 230233 - DNA, 678 bp, Artificial Sequence
  Description of Artificial Sequence: Synthetic coding sequence
atgacgtcgcagccggttcctaacgaaacaatcatcgtactaccttccaacgtaataaacttttctcaagccgaaaagccggaaccgacaaatcagggccaagactccctaaaaaaacacctgcatgcagagattaaggtgatcggtacgatccagatattgtgtggcatgatggttttaagtctcgggattatcttggctagtgcctccttttcacccaattttacccaggtgacctccacgctgctgaatagcgcatacccatttattggacccttttttttcataatctctggatccctctctattgccacagagaaaaggttgacaaaactgctagtgcattcttctctggtgggtagcatcttatccgcactgtcagctttagtgggctttatcattctgagcgttaaacaagcaacactgaatcctgccagcctgcagtgcgaactggacaagaacaacatcccgacacgtagttacgtatcctacttttatcacgacagcctgtatactacagactgctataccgccaaagccagcctggcgggtactctctcactgatgctgatatgcacactattagagttttgcctcgcggtccttactgcagtcctgcggtggaagcaggcctattcagacttccccggagtgagtgtgttagctgggttcacatag

SEQ ID NO: 230234 - DNA, 831 bp, Artificial Sequence
  Description of Artificial Sequence: Synthetic coding sequence
atggtgctgctgaagttgctcgaggtgtaccgaaaaggctctgccggaacatttcacaagtctaccatattcggaaacaccattatgaccagccagccagtccctaatgagactatcatcgttctcccctctaatgtgatcaatttcagtcaggcagaaaagcccgaaccaaccaaccagggacaagatagcctgaaaaaacacttacatgctgaaattaaagtcatcggcaccatacagatcctgtgcggaatgatggtcctgtctcttggcattatcttggcaagtgccagcttctcccctaacttcacgcaagtgactagcacactgttaaatagtgcttatcctttcattgggcctttctttttcattattagtggctcactcagcatcgctaccgaaaagagattgaccaagctgctagtgcactcgtcactggtggggtccattctttcagccctgtcagccctggtgggctttatcatactgtccgtgaagcaggcgaccttgaatcccgctagcctgcaatgcgagctggacaagaataacattcccactaggtcatacgtgtcttacttctatcacgatagtctctacactactgattgttacacagcaaaagcatctctagccggtacactgtcacttatgcttatttgcactctgctggagttttgcttagccgtactcactgctgtgctccgatggaaacaggcctattccgactttcctgggtcagtactgtttttgccacactcatacattggaaactctggcatgtcctccaagatgacccatgattgtggctacgaggagctgctcacgtcctag

SEQ ID NO: 230235 - DNA, 747 bp, Artificial Sequence
  Description of Artificial Sequence: Synthetic coding sequence
atgacctcccaaccagttcctaacgagactattatcgtcctgccttccaacgtgataaacttcagccaggcagaaaaaccagaacctactaatcagggtcaagattctctgaagaagcacctgcacgccgagataaaagtgatcgggacaattcagatcctttgtggcatgatggtcctcagcctagggatcattctggctagcgcctctttctccccaaactttacacaggtaactagtactttactgaactccgcatatcccttcatcggaccatttttttttatcatctctgggagcctgtctattgcaaccgaaaaaagactgaccaaactgctggtgcactcttcactggtaggctctatattatccgccctttctgctctcgtgggtttcattatactttctgtcaaacaggcaacactgaaccctgcgtcgctacaatgtgagctggacaaaaacaatatccctacacgaagctacgtgtcgtatttctaccacgacagcttatacaccactgactgctacacagcgaaggcaagcctggccggtacccttagcctgatgctgatctgcactcttctggagttctgcctcgcggtcctcacagctgttctgcgatggaagcaggcctactcagactttcctggcagtgtgctgttccttccccactcatacatcggaaactcaggaatgtccagcaagatgacgcacgattgcgggtacgaagagttgctgactagttag

SEQ ID NO: 230236 - DNA, 72 bp, Artificial Sequence
  Description of Artificial Sequence: Synthetic coding sequence
atgacctctcagccggtccccaacgagacgatcatagtacttccctcaaacgtgatcaatttctctcagtag

SEQ ID NO: 230237 - DNA, 444 bp, Artificial Sequence
  Description of Artificial Sequence: Synthetic coding sequence
atgacttcgcaaccgatttcaaatgaaactatcatcatgttgccgagcaatgtaattaacttcagtcaagcagagaaacccgaacctactaatcaggggcaggattcactgaaaaaaagactgcaggccaaggtaaaggtgataggcgtccattcctcgctggcaggatcgatattgagtgcacttagtgccctcgtggggtttatactgctgagcgtgaatcccgcagctctcaatcccgcaagtctgcagtgcaagctggacgaaaaagacatccccacacggctgctactgtcgtatgactaccactccccttacactatggactgtcatagagcgaaggcatctcttgctggcactttgtcgttgatgttggtgtctacagttctggaattttgtttggcggtcctgacggccgtgttgcagtggaaacagactgtatag

SEQ ID NO: 230238 - DNA, 723 bp, Artificial Sequence
  Description of Artificial Sequence: Synthetic coding sequence
atgctactgcaatcacagacaatgggagtatcacattctttcaccccgaagggcattaccatcccacagcgggagaagcccggacacatgtaccagaacgaggactatttgcagaacggtttgcctacagagaccaccgtgctcggaacagtgcagatcttgtgctgtttacttatttcctccctcggcgcaatccttgtgttcgcaccctacccttcccatttcaatccggctatctccacaaccttgatgtcaggctatcccttccttggtgccctctgtttcggcattacaggttccctgtccattataagtgggaagcagtctacgaagcccttcgatctatcctcactgactagtaacgcagtctcttctgtaacagcaggcgctggtctcttcctgctggccgattctatggtggcattgcggaccgcttcacagcactgcggcagcgaaatggattatctctcctctctgccttactcggagtattattaccccatctatgagataaaggattgtctcctgacatccgtcagtctgaccggcgttttggtggtcatgctaatttttactgtgttggagcttcttctcgcagcttactcttccgtcttttggtggaaacagctgtactctaacaatccaggttcttcattctctagtacccagtcccaagaccatatccaacaggtgaagaaatcatccagtagatcttggatctag

SEQ ID NO: 230239 - DNA, 588 bp, Artificial Sequence
  Description of Artificial Sequence: Synthetic coding sequence
atgctcctgcagtcccaaacgatgggcgtctctcacagcttcactcccaagggcataaccattccccaacgggaaaaacccggtcacatgtatcaaaacgaggattatctgcagaacgggctgccaacagagaccactgtgctggggtttggcataaccggttctttgagcattataagtggcaagcagagtacaaagccgtttgatctgagttcattaacctccaacgccgtcagtagtgtgaccgctggcgctggcctgttcctcctggccgactctatggttgccctgcggactgcctcccagcactgtggaagtgaaatggactatttgtcctcactcccatatagcgagtactattaccctatatatgaaatcaaagactgtctgttgacctcagtgagtcttaccggtgtgctagtggttatgctcatttttaccgtgttggagctgctcctggccgcatattcttcggtcttttggtggaaacagctgtacagcaataaccccggaagctccttctcttctactcagtcacaggatcacattcagcaagtgaaaaagagctccagtcgctcttggatctag

SEQ ID NO: 230240 - DNA, 510 bp, Artificial Sequence
  Description of Artificial Sequence: Synthetic coding sequence
atgctgctgcagagccagactatgggcgtttcccattccttcacacccaagggaattacgattccacagcgtgagaagccgggtcatatgtaccaaaacgaagattatctgcaaaatggcctgccaaccgaaacgaccgtgctgggatttggcatcaccggatcattgtcgattatctcaggtaaacagtctacaaaaccttttgatctaagctcccttacctctaacgcggtatccagcgtgacagcaggtgcaggactgttcctgctggctgattctatggtggcgctgcggactgcctcacagcattgcggtagcgagatggattacttatcctcgttgccctacagtgagtactactatcctatttatgaaattaaggattgtctcctgacaagcgtgtctctgacaggggtgctggtcgtaatgctgatattcaccgtcctggaactcctgttggccgcttatagttctgtgttctggtggaagcagttgtacagcaacaattag

SEQ ID NO: 230241 - DNA, 588 bp, Artificial Sequence
  Description of Artificial Sequence: Synthetic coding sequence
atgttattacaatcgcaaactatgggggtgtcacattctttcaccccaaaaggaataacaatcccccaacgtgagaagccaggtcatatgtaccagaatgaagattatcttcagaacggactgcccactgagacaacggtgctggggtttggcatcactgggtctctctccatcattagtggtaagcagagtactaagccattcgacctttcatccttgacaagcaatgcggttagttctgtcaccgctggcgcagggctgtttctactcgctgacagcatggtggccctgcggaccgcgtcacagcattgtggtagcgaaatggattatttgtctagtctcccatatagtgagtattactaccctatttacgaaattaaagattgcctgttgaccagcgtgtccctcactggtgtgctcgtggttatgctgatattcaccgtgctggaactgctcctagctgcatattcatccgtattctggtggaaacaactttacagcaataatcccggaagcagcttctcttccacacaaagccaggaccacatccagcaagtcaaaaaatctagctcacggtcctggatttag

SEQ ID NO: 230242 - DNA, 753 bp, Artificial Sequence
  Description of Artificial Sequence: Synthetic coding sequence
atgaactctatgacttcagcagtacctgttgctaattccgtcctggtcgttgcccctcacaacgggtatcctgtcactcctggcatcatgtctcatgtaccactgtaccctaattcccaaccccaggtgcatcttgtccctggaaatccaccatccctggtgtcaaatgtgaacgggcagcccgtccagaaagccctgaaagagggcaaaacccttggcgcaattcagattattattggcttggctcacatcgggttgggctccattatggccacagtgctggtcggggagtacttgtccatatctttttacgggggattccctttctgggggggactgtggtttatcatctccggctctttgagtgtggccgctgagaatcagccatacagctactgcctgctgtccggaagcctcgggctcaatatcgtttccgccatctgctctgctgtgggagtgatcctgttcattacagatttgtcgatcccacacccctatgcttaccctgactactacccctacgcttggggtgtcaatcccggaatggcaatcagcggggtgcttctcgtcttctgcctcctggaattcggcatcgcgtgcgcaagctcgcactttggatgccagctcgtgtgctgtcagagcagcaacgtgtcagtgatttacccaaatatctacgctgccaatcccgtgattactccagaaccagtgacaagtccccctagctatagcagtgagatccaggctaacaaatag

SEQ ID NO: 230243 - DNA, 2550 bp, Artificial Sequence
  Description of Artificial Sequence: Synthetic coding sequence
atggtccagaaggaaagtcaggccacccttgaggagagagaatccgagctatctagtaatcctgccgcttccgccggagcctctctggaaccccctgccgcacccgctcccggtgaagataaccccgcaggagcaggcggtgccgcagtcgcaggcgcagcaggcggagctcgtaggtttctttgtggggtggtggagggattctatggcagaccatgggtcatggaacaacgaaaggagctgttccgtagattgcagaaatgggagttgaacacttacctgtatgctcccaaggatgactacaagcatcgcatgttttggcgcgaaatgtactcggttgaggaggccgagcaacttatgacactcatctctgccgctcgggaatacgagatagaatttatctacgccatctcgcctgggttggacattacctttagcaatccaaaagaggtttccacactgaaacgaaagctcgatcaggtttctcagtttgggtgtagaagtttcgcacttttgtttgacgatattgaccataatatgtgcgctgccgacaaagaagtgtttagcagtttcgcccacgcccaggtatctataaccaacgaaatctatcagtacctgggagaaccagaaactttcttattttgtcccaccgagtattgcggcacattctgttaccctaacgtgtcacagtcaccctatttgcgtaccgttggggaaaagctcctgcccggaattgaggttctctggacaggccctaaggttgtatccaaagaaatccctgtggaatcaatcgaggaggtgtcaaagattatcaaacgcgcacccgtaatctgggataatattcacgccaacgattacgaccagaaaaggctattcctgggaccctacaagggcaggtccaccgagctgatcccccgattgaaaggcgtgctgaccaatcccaactgcgaattcgaggcaaactatgtcgcaatccatactctggctacctggtacaagagtaacatgaacggagtcaggaaggatgtggttatgagccgacaagttgcccattccggggcaaaagcctctgtcgttgatggtactcctttagtcgctgctccaagcttgaatgctaccacagtggtgacaacggtataccaggagcccataatgtcacaaggcgcagcattatctggggagcctactaccctcactaaggaagaggaaaagaagcaacctgatgaagagcctatggatatggtggttgagaagcaagaggaaacagatcataaaaacgacaaccagattttgtccgagatcgtagaggccaaaatggccgaggagcttaaaccgatggatacagataaagagtctatcgccgagtctaaaagcccagagatgtcaatgcaggaggattgcatttctgacatcgccccaatgcagacagacgaacagacaaacaaagaacaatttgttccaggacccaacgaaaagccactgtacaccgcagaacctgtgactctggaggacctgcagctcttagccgatcttttctacctaccttacgagcatggaccgaagggcgctcaaatgctgcgagaatttcagtggctacgcgcaaactcatccgtggtttctgtcaactgtaaaggaaaggattctgagaagatcgaagagtggaggtcaagggccgcaaaattcgaagaaatgtgtggcctggtgatgggaatgtttactaggctgagcaactgcgctaatagaacaatcctgtatgacatgtattcttacgtctgggacatcaaatcaattatgtcaatggtgaaaagcttcgtgcagtggcttggatgtaggagccactccagcgcccagttcctaattggcgaccaagaaccttgggccttccgcggaggactagctggagaattccagcctccgccactaactccaacttctaaagtatataccattcgcccatacttccccaaagatgaggctagcgtttataagatttgccgggaaatgtatgacgatggcgtaggactcccctttcagtcgcagcccgatctgatcggcgataaactggtgggtggacttttgagcctcagcctggattactgtttcgtattagaagacgaagacggtatttgcggatacgcactgggaacggttgatgtgacaccatttataaagaagtgtaaaatcagttggatcccttttatgcaggaaaaatataccaagccaaacggagacaaagagttgtccgaggctgaaaaaataatgctgtcatttcatgaagagcaggaagtgttgccagaaacttttctggccaattttcctagcctgatcaaaatggatatccacaaaaaagtgacagacccatccgtcgctaagagcatgatggcatgtttgctctcctcacttaaagctaacggatcccggggagcattttgcgaagttcgcccagatgataagcgaatactcgagttctattcgaagctgggttgtttcgagatagccaaaatggaaggctttcccaaagatgtggtgatcctgggccgttccctttag

SEQ ID NO: 230244 - DNA, 2751 bp, Artificial Sequence
  Description of Artificial Sequence: Synthetic coding sequence
atggttcagaaggaatcccaagccacattggaagagagagagagcgagctcagttccaaccctgctgcatccgcaggtgctagcctagaaccccctgccgcacctgccccaggagaggataacccggctggggcaggtggcgctgccgtcgctggggcagcaggcggagcacggagattcctatgcggagtcgtggaagggttttacggtagaccatgggtgatggagcagcgcaaggaactcttccgcagactgcagaagtgggagctgaacacatacttatacgctcccaaggacgattataagcaccgcatgttttggagagaaatgtatagtgtcgaagaggccgaacaactcatgacgttaataagtgccgctcgagagtacgagattgaatttatctatgccattagccccggactggacattaccttcagtaatcccaaagaagtgtccacactgaaaagaaagttggaccaggtgtctcaattcggttgtaggtcctttgccttgctttttgatgacatcgaccataatatgtgcgctgctgataaagaggtgttttccagttttgctcacgcacaggtttctatcactaatgagatataccaataccttggcgaacctgagacctttctgttctgccccactgaatattgtggaacattttgctaccccaatgtctctcaatctccttacctccgtacagtgggtgagaaactattgcctggcattgaggtcttatggacggggccaaaggttgtatccaaagaaatccctgtggagtcaatcgaggaggtgtcaaagatcattaaaagggccccagttatttgggacaatatccacgcaaatgattatgatcagaagagactgttccttggaccatacaaaggacgctccactgagcttatcccccgtcttaaaggagtgcttaccaatcccaactgcgagtttgaggccaactacgtggccattcacaccctcgccacttggtataagtcaaacatgaacggggtgcggaaagacgtggtgatgaccgactccgaagacagcacggtgtcaatacaaatcaagttggaaaatgaaggatctgacgaagacatcgagacggacgtcctttattcaccccaaatggcacttaagttggccctgactgagtggctacaggagttcggtgtgccccaccagtatagtagtcgccaagttgcccacagcggcgctaaagcttccgtggtggatgggacacctctggtggccgctcccagcctcaatgccaccactgttgtcacaaccgtgtaccaagaacccatcatgagccagggtgcagccctgtccggggaaccaactacactgactaaagaggaagagaagaagcagcccgatgaagagccaatggacatggtagtggaaaagcaggaagaaacagatcataagaacgacaaccagatactgtcggaaattgtcgaggccaagatggctgaggagctgaaacctatggacaccgataaggagagtattgccgagtccaaaagtcccgagatgtcaatgcaagaggactgcatctccgacattgcacccatgcagaccgacgagcaaaccaataaggaacagttcgtaccgggaccaaacgaaaagcctttgtacacggccgaaccggtcacactggaagatctgcagctgcttgcggacctgttctacttgccatatgagcatggtcccaagggcgctcagatgttaagggagttccagtggctgagggccaatagctctgtggtatccgtgaattgcaaggggaaagattcagagaaaatcgaagagtggcggtccagagctgcaaagtttgaagaaatgtgtggattggtaatgggtatgttcacacggctgagtaattgtgccaatcggacgatactctatgacatgtactcatatgtgtgggatatcaaatctattatgagcatggttaagagctttgtgcagtggcttggctgtagaagccactcttctgcacagttcttgattggtgaccaggaaccatgggccttcagaggcggactggccggtgagtttcagagactgctgccaatcgacggggcaaacgatctttttttccaacctcccccattaacgcctactagtaaagtttataccatccgtccctacttcccaaaggacgaggcgtctgtttacaaaatatgccgcgagatgtacgacgatggggtgggactgcccttccagagccaacctgacctgatcggcgacaaattagtaggcggactcctctcactgagcctagactactgtttcgtgctggaagatgaagacggaatctgcggttacgcgttgggtacagtagacgtcactccgttcattaagaaatgtaagatatcctggattccgtttatgcaggagaaatacactaagcctaatggcgacaaagagctcagcgaagctgagaaaatcatgctgtctttccatgaagagcaggaagttctgcctgagaccttcctcgccaattttcctagcttgattaaaatggacatccacaaaaaggttactgacccgagtgttgccaagtctatgatggcctgtctcctgtcctcgttgaaggcgaacggtagtaggggcgcattttgtgaggtccgacctgatgataaaagaattcttgagttttatagcaagttgggctgctttgagatcgccaaaatggagggctttccgaaggatgtggttatccttggcagaagtctgtag

SEQ ID NO: 230245 - DNA, 2034 bp, Artificial Sequence
  Description of Artificial Sequence: Synthetic coding sequence
atggtgcagaaagaatcccaggccaccctcgaagaacgcgagagcgaactttccagcaacccggcagcctcggcaggagcctcactcgagccacccgctgcccctgcaccaggtgaagataacccagcaggggctggcggtgccgcagtagcgggtgccgcaggcggagctcgaaggtttctatgtggcgtggtggagggattctacggccgaccctgggtcatggagcaaaggaaggagttatttagaagactccagaaatgggagcttaacacatatctgtatgccccaaaggatgactacaaacacaggatgttctggagggaaatgtactctgttgaagaagccgagcaactgatgactcttataagtgctgctagagaatatgagatcgagttcatctacgccatatcacctgggctggacataactttttcaaatcccaaggaggtgtctaccctgaaaaggaagttagatcaggtgtcacagttcgggtgcagatcattcgccctgctgtttgatgacattgatcacaatatgtgtgccgcagataaagaggtcttcagcagttttgcccacgcccaggtgtccattacgaatgaaatatatcagtatctgggagagccagagacatttcttttttgcccgacagagtactgcggaactttttgttatccaaacgtcagccagtcaccttaccttcgcacggttggtgaaaagcttcttcctggcattgaggtcctctggaccggtcctaaagtagtgtccaaagagattccagtggagagtatagaggaggtgtcgaagataatcaagcgtgcgccagtgatctgggacaatattcatgcaaacgattatgaccagaagcgactgttcttgggcccatacaaaggcaggagcaccgagttaatccccaggctaaaaggcgtgctaacgaaccctaattgcgagttcgaggctaactatgttgccattcataccctggcaacttggtataaatccaatatgaatggggtgcgaaaagacgttgtgatgacagacagtgaggattcaaccgtctctatccagatcaagttagaaaacgaagggtcagatgaagatatcgagacagatgtcctctatagcccgcaaatggcactaaaattggccctgacagagtggctccaggagtttggggtgcctcaccagtatagcagcaggcaagtcgcccacagtggggcaaaggcatctgtggtcgatggcactccactagttgcagcgcctagcttaaatgcaacaaccgttgtgacgacagtgtatcaggaaccaatcatgagtcagggcgcagctttgtccggcgaacctaccacattaaccaaggaagaggagaagaagcagccggacgaggagcctatggacatggtggtggagaagcaggaggaaaccgatcacaaaaatgataaccagatactgtccgaaattgtggaggctaagatggcggaggaattgaaacccatggatactgacaaggagtcaattgctgaatccaaaagcccggagatgagcatgcaggaggactgcatttcagacattgcaccaatgcagaccgatgaacaaactaacaaagaacaattcgtacctggcccaaatgaaaagccactgtacacagcagagccagtgaccctggaggaccttcagcttttagccgatctgttctacctcccttacgagcatggacccaagggggctcaaatgctccgggagttccagtggctgcgtgccaattcatcagtggtgtcggtaaactgcaaaggtaaagatagcgagaaaattgaggaatggcggagcagagcagccaagttcgaggagatgtgtgggctcgtgatgggtatgttcacccggctgagcaactgtgccaacaggacgattctctatgacatgtacagttatgtgtgggacatcaaaagcatcatgagtatggtaaagagctttgtccagtggttgggcaggtgcaccagaaacaatctcttctcttctaacattctttctttgtag

SEQ ID NO: 230246 - DNA, 456 bp, Artificial Sequence
  Description of Artificial Sequence: Synthetic coding sequence
atggtccaaaaggagtcccaggcgaccctggaggagagggaaagtgagttatcttcaaacccagcggcatccgccggtgcttccctcgaacctcctgcagctcctgcaccaggcgaagataatcctgcaggcgcaggtggggctgccgtggccggagctgctgggggagccagacgctttctttgtggcgtggtggaaggattttacggacggccatgggtgatggagcaacgaaaggaacttttccgacgcttacagaagtgggagctgaacacatacctgtacgcacctaaggacgactacaaacaccgcatgttttggagagagatgtattccgtcgaggaggccggttcatttctgttcttttacctcgttaccatccagctcgcggaaattgaacgagtcctgtgtgcctccaaggttatgacgatttgcgtgattagctgggcctgctag

SEQ ID NO: 230247 - DNA, 771 bp, Artificial Sequence
  Description of Artificial Sequence: Synthetic coding sequence
gccgctggtggagccaggcgcttcttgtgtggcgtggtggagggattctacgggagaccatgggtgatggaacagcgtaaagagttatttcgcagacttcagaagtgggagcttaacacctacctttacgcccctaaggacgattataagcacaggatgttttggcgagaaatgtattctgtcgaggaggcagagcaactaatgacactgatctccgccgcaagagagtacgagatcgaattcatttatgctattagcccgggactcgacatcaccttttcgaaccccaaagaagtgtccaccctaaaacgcaaattggaccaagtgagccagtttggctgcagaagctttgcgctgctttttgacgatatcgatcacaatatgtgcgccgctgataaggaggtgttttcttcgttcgcccacgcacaggtttcaataacaaatgaaatttatcagtacttgggcgagccagagaccttcttattttgtccaaccggtcccaaggtcgtcagcaaagagattcctgtggagagtatcgaggaagtctctaagataataaagagagcacccgtgatctgggacaacatccatgcaaacgattacgaccagaaaagattgtttcttggaccttacaaaggtcgaagcaccgagctcatccctaggttgaagggcgtacttacaaatccgaactgtgagtttgaggctaattacgttgcaattcacacacttgccacatggtacaagtcaaacatgaatggtgtccggaagtag

SEQ ID NO: 230248 - DNA, 2592 bp, Artificial Sequence
  Description of Artificial Sequence: Synthetic coding sequence
atggtgcagaaggagtcccaggccacactggaggaacgcgaaagtgaactaagctctaatcccgctgcatccgccggagccagcctggagccacccgctgcccctgcacctggagaggataaccccgcaggggctggcggagcagccgtcgctggagctgccggaggggcacggcgattcttgtgtggagttgttgagggattctacggcagaccatgggtgatggaacagcgcaaggagctgtttaggagactccagaaatgggaactgaatacctatctttatgcacctaaagatgactacaagcaccggatgttctggcgggagatgtattctgtggaggaagctgagcaactgatgactcttatcagcgcagcacgcgagtatgagatcgagttcatctatgctatctccccaggtttagacatcaccttcagcaatcctaaggaggtctcaacactaaagagaaagttagatcaggtgtcccagtttggctgtcggtccttcgcactgctcttcgacgacatcgatcataatatgtgtgcagcagacaaggaagtgttttctagctttgcacatgctcaagtcagcataaccaatgagatttaccaatacctcggggagcccgaaactttcctgttctgcccaacagaatattgcggaacattctgctaccctaatgtgtcacaatccccttatctgcggactgtgggggaaaagctcctgccaggaatcgaggtactgtggacagggccaaaagtggtcagtaaggagatccccgtcgaaagcattgaagaagtgtcaaaaatcattaaacgcgctccggtgatatgggataatatccatgccaacgactatgaccagaaaaggctcttcttgggaccttataaaggaagaagcaccgagctgatccctagattgaagggcgtcttaaccaatcccaattgtgagtttgaagcgaactacgtggccatacacacgttggccacctggtacaagtccaatatgaacggagtacggaaagatgtagtgatgtctcgccaagtagcccactccggtgctaaggcttccgtagtggatggcacccctctcgtggccgctccctcattgaatgccacgaccgtggtgacgaccgtatatcaagaacccatcatgtcccagggggctgctctctctggggaaccaacaacgctaacgaaggaagaagaaaaaaagcaacccgacgaagaaccaatggacatggtcgtcgagaagcaggaagaaactgatcacaaaaacgataatcaaatccttagcgagatcgttgaagcaaaaatggcggaggagctaaaaccgatggataccgacaaggagagtatagcggagtcgaagagtcctgaaatgtccatgcaagaagactgtatctccgacatagccccaatgcagaccgacgaacagaccaacaaagagcaattcgtgcccggtcccaacgagaaaccactctacacagctgagcccgtcactctggaggaccttcagctcctcgccgaccttttttacctcccatatgagcatgggccaaagggcgcacagatgttacgtgaattccaatggctccgggctaattcatctgtcgtatcagtaaactgcaaaggcaaggacagcgaaaaaatcgaagagtggcgttcacgcgcagccaaattcgaggagatgtgcggacttgttatgggcatgtttacacgcctctcgaactgcgccaatcgaaccattctgtacgacatgtacagttatgtatgggatataaaaagcatcatgtcaatggtcaagtcattcgtgcagtggttagggtgccggagccactcctctgcgcagtttttaataggcgaccaagagccatgggccttcagaggaggactggcgggtgaatttcagcgtctgctgccaattgatggggcaaatgacctgttctttcagcccccacctctcaccccaacctccaaagtctacaccatcagaccctactttcctaaggatgaggcttccgtgtataagatttgcagagagatgtacgacgacggagtggggctgccctttcaatcgcaacccgacctgatcggcgataaactggtgggaggtctgctgtccctgtcactagactattgttttgtgctcgaggacgaagacggtatttgcggctacgccttaggcaccgttgatgtcactcccttcattaagaaatgcaagataagttggattccctttatgcaggagaaatatactaaaccaaacggtgacaaggagttaagcgaagctgagaagataatgctgagcttccatgaagaacaggaggttctcccagagaccttcctggctaactttccttctttaatcaagatggacatccacaaaaaagttaccgacccctctgtcgcaaaaagtatgatggcgtgcttgttgtcatctctgaaagcgaatggatccaggggtgcattttgtgaggtgagacctgatgacaaacggatactggagttttattcaaagctcggatgcttcgagattgccaaaatggagggattccccaaggacgtcgtgatactgggtagaagcctttag

SEQ ID NO: 230249 - DNA, 1545 bp, Artificial Sequence
  Description of Artificial Sequence: Synthetic coding sequence
atggccgtctggcttgcccagtggctgggacccctcttgctggtgtctctgtggggcttgctagctccagcatcattactgagacgcctcggagaacacatacaacagttccaggaatcatctgcccaggggttagggctgagcctggggccaggcgcagctgcactgcctaaggtgggatggctggaacaactgctggacccttttaatgtttcagaccggagaagctttctccagcgctactgggtaaacgaccagcattgggtgggacaggatggccctatttttctgcacctgggcggagagggctcactgggcccaggctccgtaatgagggggcaccccgcagcattagccccagcatggggggcacttgtcatctcactcgaacaccgcttctacggcctgagcatccctgccggagggttggaaatggcacaactgcgtttcctgtcgtctcggctcgccttggcagatgtggtatcagctcggctggctctatctagactgttcaatatttcttccagctcgccttggatttgtttcggtggttcctatgccggaagcctggcagcgtgggccagactgaagttccctcacctaattttcgctagtgtggcaagttcagctccagtgcgcgcagtgcttgacttttcagaatataatgacgtcgtgtcgcgaagcttaatgagcactgcgatcgggggatcgctggagtgcagagctgctgtctccgttgctttcgcagaagtcgagcggcgtttaaggtctgggggtgctgcccaggccgctctgcgaaccgaactgagcgcctgcggacctcttggcagggctgaaaaccaggcggaactgctcggtgcccttcaggcactcgttggcggagtggtccagtacgatggccagactggagcacctttatccgttagacagctctgtgggctgctgctcggcggagggggaaacaggtctcattctacaccctattgcggtctgagaagggcggtccaaatcgtactgcatagtctgggccagaagtgtctcagtttttcaagagccgaaactgtggcccagctccgtagtacagaaccccagctctcaggagttggcgacagacagtggctctatcagacgtgtaccgagtttgggttctatgtcacctgtgaaaaccccagatgcccttttagtcagcttcccgcacttccgtctcaattagatctgtgtgagcaggtgttcgggctcagcgccctctcagtagctcaagccgtggctcagacaaatagctactatggtggtcagactcccggtgccaacaaggtgctattcgtcaacggcgacaccgatccttggcacgtgctgtcggtgacccaggctcttgggagctcagagtcaaccctgcttattcgtactggcagccactgtcttgatatggcgcctgagcgtccttcagatagtcccagcctccgactgggcagacagaacatttttcagcagctgcagacttggctgaaactcgcaaaggagtcacagataaagggggaagtgtag

SEQ ID NO: 230250 - DNA, 2106 bp, Artificial Sequence
  Description of Artificial Sequence: Synthetic coding sequence
atggacttatggaacctctcctggtttctttttttggacgctttgctggtgatctccggcctggccactcctgaaaattttgatgtggacgggggtatggatcaggacatattcgacataaacgagggactgggcctggatctcttcgagggggatatcagactggaccgggcacaaatcagaaatagtattatcggcgaaaagtatagatggccccacaccatcccctacgtgcttgaagactccttggagatgaacgctaagggggtcattctgaatgcttttgagcgctatcgcctgaagacttgtattgactttaaaccctgggccggtgaaacaaattatatctctgtctttaaggggtccggctgctggagctctgtgggcaatagacgcgtagggaagcaggagctgtcaattggcgcaaactgtgaccgcatagcaactgtacagcacgagtttttgcacgcactcggcttctggcacgagcagtctaggtctgatagagacgactacgttaggattatgtgggaccgcattctgtctggtcgtgaacacaacttcaatacgtatagtgacgacatctctgattcgctcaacgtaccatatgattatacctcagtaatgcattacagcaagaccgcttttcagaatggcacagagcccaccatcgtgacacgcattagtgacttcgaagatgtcatcggacaaaggatggatttttctgactctgacttactgaagttaaaccagctctacaattgctcatctagcctgtctttcatggacagctgctcatttgagttggagaatgtatgcggcatgatccagtcttctggggataacgccgattggcagagagtttcgcaggtccctcgagggccagagagtgaccattccaacatgggccaatgccaaggctcagggttcttcatgcacttcgacagctccagcgtgaacgtcggcgcaacagcagtactggagtccagaacattataccccaaacgaggattccaatgcttacaattttacctgtataattctgggtcagagagcgaccagctcaacatttacatccgggaatattctgctgacaacgtggatggaaatctgactctggtagaggaaataaaagaaatccccacagggagctggcaattgtatcatgttacactcaaggtaacaaagaagtttagagtcgtgtttgagggtcggaagggatctggtgcttcattggggggattaagcatagacgatataaacctatctgagacacgctgccctcaccacatctggcacattcgcaattttacccagtttataggatctccaaatggaacactctatagtcctcccttctattcgtcaaagggctatgctttccagatctacctgaacctggcgcacgttaccaacgcgggaatttattttcacttaatatcgggggctaatgacgatcaactgcagtggccttgcccatggcagcaggctactatgactctgctcgatcaaaaccccgatatccgacagcgcatgtccaatcaacgatctatcacaacagacccttttatgaccacggataacggaaattatttttgggacagaccctccaaggtgggaaccgttgctcttttctccaatggaacccagtttcgacgtggaggcggatatggcacttctgctttcatcactcatgaacggttgaaatctagagatttcatcaaaggggatgatgtgtacattctcctgaccgtggaagacattagtcaccttaactccacacaaattcagttgactcctgccccttccgtccaggatctttgttcaaagaccacatgtaagaatgatggtgtatgcacggtccgcgatggcaaagctgagtgccggtgccagtccggggaagactggtggtacatgggcgagagatgtgagaagcgaggctctacgagagacacaatcgtgatcgccgtgtcctccacagtcgcagtctttgcattgatgctgataattacgctcgtgtcagtgtactgtacgcggaagaaatatcgcgaacgcatgagctccaatagaccgaatctcaccccccagaaccagcacgctttttag

SEQ ID NO: 230251 - DNA, 894 bp, Artificial Sequence
  Description of Artificial Sequence: Synthetic coding sequence
atggcttccccccaactgtgtagggctttagtgtctgcacaatgggttgcagaagcccttagggctccacgggctggtcagccgttacagctgctggacgcttcttggtatctgcctaaactgggccgtgatgcgagaagggaatttgaggaacgccacattccgggagccgcattttttgatattgaccagtgttcggatcgcaccagcccgtatgatcatatgctgcccggagctgagcatttcgcagaatacgcgggacggctcggtgttggggctgcaacgcacgttgtgatttatgacgcatccgaccaaggattgtattctgctcctcgagtctggtggatgtttcgtgcctttggccatcatgctgttagcttgctggatggcggactgaggcactggttacggcaaaaccttcctctgtcaagcggcaaatcccagccagccccagcagaatttcgggcacagctcgacccggctttcattaagacctatgaagacattaaggaaaacctagaaagtcgtcgtttccaagtggtggatagccgagctacaggcagattccgtgggacagaacccgaacctcgcgatggtattgagcctggccatattcccggaactgtgaatatccccttcacagactttctgtctcaggaagggctagagaagagccctgaggaaatcaggcacttattccaggaaaagaaggtggatctatccaagcccctcgtcgccacgtgcggctctggcgtgaccgcctgtcatgtggctctgggcgcatatttatgcggcaagccagacgtcccgatctacgacggatcatgggtggagtggtacatgcgagcgagacctgaggacgtcattagcgaaggtaggggcaaaacccactag

SEQ ID NO: 230252 - DNA, 954 bp, Artificial Sequence
  Description of Artificial Sequence: Synthetic coding sequence
atggctgaacccggttctagagagagcgagaccagagcccgttctccctcggtggccgctatggcctctccgcagttgtgtagggccctcgtcagtgcacaatgggtggctgaggctttgagggcgccaagggccggtcaaccactgcaactcctagatgccagctggtacctgccgaagcttgggagagacgcacggcgagagttcgaagagagacatatacctggggcagcttttttcgatattgatcagtgctcagacaggacttcaccctatgatcatatgttacctggagctgaacacttcgctgaatatgccggaaggctgggcgtgggggcagctacacacgttgtgatctatgatgcgagtgatcaggggctctattctgcccctcgcgtgtggtggatgttcagagccttcggacatcatgccgtgtctctactcgacggcggtctaaggcattggttgcgccagaacctgccactgagtagtggaaagagtcagccagcccctgcagagtttagagcccaactggaccctgcattcataaagacctatgaggacatcaaagagaatttggagtcaaggcgatttcaagtagtggactctagagccaccggacggttccggggaaccgagcctgagcccagagatgggatcgagccaggccacatccccggaaccgtcaatatacctttcacagactttctatcccaggaaggtctcgaaaaatctcccgaggaaattagacatctgttccaagaaaagaaagtggatttgtccaaacctttagtggcaacttgtggctcaggagtgaccgcctgccacgttgctctgggggcttatctgtgtggaaagcctgatgtgcctatctacgatggatcctgggtcgaatggtacatgcgcgcacgtccagaggacgtaatcagtgagggacgtggcaaaacgcactag

SEQ ID NO: 230253 - DNA, 894 bp, Artificial Sequence
  Description of Artificial Sequence: Synthetic coding sequence
atggccagtccacaactttgtcgcgctttggtgtcagcccagtgggttgccgaagctctgcgggctccacgagccggtcagccattgcaactgcttgatgcaagttggtacctccccaaactgggtcgagacgctaggcgggagtttgaagagcgccatattcccggtgctgcttttttcgatatcgaccaatgtagcgatcgtactagtccgtatgaccatatgctacctggcgctgagcacttcgccgaatacgctggcaggctaggcgttggagccgctacccacgtcgtcatatatgacgcctcagaccagggcttgtacagcgcccctcgagtctggtggatgttccgtgcgtttggacatcatgcagtcagcctcctggacggtggacttcggcattggcttaggcagaatctcccactgagttcagggaaatcgcaacccgcaccagcagagtttcgggctcagctggacccagcctttattaagacttacgaagatattaaggaaaatctggaatccagaagattccaagtggtggactctagggcaaccggcagatttaggggtactgagccagagccaagagatggaattgagcccggtcacatcccagggactgtgaatatcccctttaccgattttcttagccaggaaggactcgagaaatcaccagaggagatacggcacttgttccaagagaaaaaagttgacttgtccaaacctctggtagccacctgcgggagcggagtgactgcttgccatgtggctctcggggcttacctctgcggtaaaccagatgtgcccatctatgacggctcctgggtggaatggtatatgagagccaggccagaggacgtgataagcgagggtagaggcaagactcactag

SEQ ID NO: 230254 - DNA, 894 bp, Artificial Sequence
  Description of Artificial Sequence: Synthetic coding sequence
atggcttcaccccagctctgccgggctttggtgtcggcccagtgggtggccgaggccctgagagccccaagggctgggcagccactgcagcttttagacgccagctggtaccttccaaagctgggtagagatgctagaagagaatttgaggagcggcacattcctggtgctgcattcttcgatatagatcagtgttccgacaggacttccccatatgaccacatgctgcccggtgctgaacacttcgctgaatacgctggaaggctgggtgtgggggctgcaacccacgtggtgatttacgatgcatcagatcaaggcctgtatagcgctcctagggtgtggtggatgttcagagctttcggacatcacgcggtgagccttttggatggaggcttgagacactggctacgccagaatttgcccctctcctccggcaagtcccagcctgctcccgctgaattccgggcacaactcgaccctgcgttcatcaaaacgtatgaggatatcaaagagaatttggaatcgaggaggttccaggtcgtcgattcccgtgccactggccgatttcggggaaccgaacctgagccaagggatggaattgaaccaggacatattcccggaacggttaatattcctttcactgactttctgagccaggaagggctagagaagtcaccggaggaaattaggcatcttttccaggaaaaaaaagtcgatctctctaagcccttggttgcgacgtgtggcagcggcgtaacagcttgccacgttgcattgggtgcatatctttgcgggaaacccgatgtcccaatctacgatggctcgtgggtcgagtggtatatgagggctagaccagaagacgtgatttctgagggccgaggtaaaacacactag

SEQ ID NO: 230255 - DNA, 894 bp, Artificial Sequence
  Description of Artificial Sequence: Synthetic coding sequence
atggcttctcctcagctgtgtagggccctcgtcagcgctcagtgggtggctgaagcacttcgcgcacccagagccggacagcctctacagttactggatgcctcatggtatctgcctaaactggggagagacgctagacgggaatttgaagagcggcatatacccggtgccgcattttttgatatagaccagtgctccgacaggacttcaccctacgatcacatgctgcctggtgctgaacatttcgcggagtacgcagggcgtctgggagtgggcgctgctactcatgtggtgatctatgatgcaagcgaccagggactctactcggcacctagagtttggtggatgtttcgcgctttcgggcaccacgccgtgtcccttttggatggcggactcagacattggcttcggcagaatctcccgctctcctccggcaaaagtcagccagcacccgcagagttccgcgctcagcttgatccagctttcatcaagacgtacgaggatattaaggagaatctggagtcccggcgttttcaggtagtggactcgagggccacgggccgattccgcggtactgagcctgaaccacgcgacggcatagaacctgggcacattcccggaaccgtaaacatcccctttactgatttcttgagtcaggaaggtctggaaaagagccccgaggagataagacatctctttcaagagaaaaaagtagacttgagcaaacctctggttgctacatgtggctctggcgttaccgcttgccatgttgccttgggggcttacctgtgtgggaagcccgacgtgcccatctatgacggatcctgggtggagtggtacatgagagcgcgacccgaggacgtgatctccgagggaagggggaagacccattag

SEQ ID NO: 230256 - DNA, 894 bp, Artificial Sequence
  Description of Artificial Sequence: Synthetic coding sequence
atggctagcccgcagctgtgcagagccctcgtctcggctcagtgggtggcagaagcgcttagggccccacgggcaggacaaccactgcagctgctggatgccagctggtaccttcccaagctgggtagggacgcacgcagggaatttgaggagagacacattccaggtgccgctttttttgatatcgatcaatgctcagacagaacttccccctacgatcatatgctccctggagctgaacacttcgctgagtatgctgggagattgggcgtgggcgcagcgacccatgtcgttatctatgatgcttctgaccaagggttgtactcagctcccagagtgtggtggatgtttcgagccttcgggcaccatgccgtcagcctcctagatggcggactgagacactggctgcggcagaacttgccactttccagtggaaagagtcagcctgccccagccgaattccgcgctcagctcgatccagcttttattaaaacctatgaggacattaaagaaaacctggagtcaaggcgcttccaagtggtcgactcgcgagccacaggacgattcagggggacagagcccgagcccagagatggaattgaacccggtcatattcctgggacggtgaatattccctttacagacttcctatctcaggaaggcctggagaaaagtcctgaagaaatcaggcacttattccaggaaaagaaggtcgatttgagcaaaccgttagtcgctacctgcggcagcggtgttactgcttgccatgtagctctaggcgcatatctctgcgggaaacccgacgtgcccatttacgacggtagctgggtggagtggtatatgcgcgctcgtcccgaggacgtgatctctgaggggcgtggcaagacccactag

SEQ ID NO: 230257 - DNA, 738 bp, Artificial Sequence
  Description of Artificial Sequence: Synthetic coding sequence
atggcttcaccgcagctctgccgcgcactggtcagtgcccagtgggtcgctgaagcactacgcgctcctcgcgctggacagcccctgcagttattagacgcttcctggtacctacccaaactaggaagagatgccaggcgcgagtttgaggaacgccacattccgggtgccgcttttttcgacatcgaccagtgctcggatcggacatctccttatgatcacatgttgcccggagccgaacatttcgccgagtacgccggtcgcttgggagtcggcgctgctacgcatgtcgtgatatatgatgcttccgatcagggactgtattctgctccgcgagtgtggtggatgttcagagccttcggacatcacgccgtatccctgctggatggcggtctgcggcactggctcaggcagaatctccccctttcttcaggaaagtctcaacctgctcctgccgaatttcgggctcaactagacccagcattcattaaaacttacgaagatatcaaggaaaacctcgaatcaaggcgcttccaagtcgttgactcccgcgctaccggaaggttcagaggcaccgagcctgagccccctgcagttgggatagagcccggacacatccccggaaccgtcaatataccattcactgatttcctgtctcaggatgggtcgtgggtggagtggtatatgcgcgctagaccggaggatgtgatttccgaaggtaggggtaaaactcactag

SEQ ID NO: 230258 - DNA, 765 bp, Artificial Sequence
  Description of Artificial Sequence: Synthetic coding sequence
atggaccctgctgcatcgtcttgtatgcgctcgttgcaacctcctgcacccgtttgggggtgtttgaggaatccccatagcgaagggaacggagcctctggactaccccactatccacccacccctttttccttccatcaaaagccagacttcttagcaacggcaacggctgcgtatcccgacttctctgcgagctgtctggcggctactccccacagcctgccccaagaggagcatatctttaccgagcagcacccagcatttccccaatcaccgaattggcattttcccgtgtccgacgctcgaagaaggcccaactcaggccctgctgggggatctaaggagatgggcacgtcctccctcggtttagtggatacaaccggtgggccaggagatgactacggcgttctggggtctacagctaacgagaccgagaaaaaatcttcccgtagaaggaaagaaagctctgacaatcaggaaaatagggggaagcctgaggggagctccaaagctcggaaggaacgcacagcgtttaccaaggagcagctgagggagctggaagccgagtttgctcatcataactacctcaccaggctccgcagatacgagattgccgtcaatctagacttaagcgagagacaggtgaaggtctggttccagaatcggagaatgaagtggaagagagttaagggcggacagccaatctcgccgaacgggcaggaccccgaagacggcgacagcacagctagcccctctagcgaatag

SEQ ID NO: 230259 - DNA, 555 bp, Artificial Sequence
  Description of Artificial Sequence: Synthetic coding sequence
atggatccggcagcaagttcatgtatgaggagcctgcagccacctgctcccgtctggggatgcctccgcaacccgcactcagaaggtaacggcgcatccggcctccctcattacccacccactccttttagcttccatcaaaagccagattttttggccactgcgacggccgcttacccagacttttccgcgtcctgccttgccgcaactccccactcattgcctcaagaggagcacatttttactgagcaacacccagcttttcctcaaagccctaactggcacttccctgtgagcgatgcacgacgtaggcccaacagcggacccgcaggcggttcgaaagagatgggcacctcctctttgggcctagtggacaccacaggaggcccaggagatgactatggagtcctcggaagcactgctaatgaaactgaaaaaaagagcagccgcagaagaaaggagagttccggccagtctgttgtgcccgaacctaaggacgaggtcgaggcatgtgaggggagaagcgcccatctcccacaatgggccggaccatag

SEQ ID NO: 230260 - DNA, 420 bp, Artificial Sequence
  Description of Artificial Sequence: Synthetic coding sequence
atgggaacgtcttcactggggctggtcgatactacagggggtcccggagatgattatggggtgctcggtagcaccgccaacgagaccgaaaaaaaatcgagccgaaggcgaaaagaaagttctgacaatcaagagaatcggggaaagccggagggatcatctaaggctcggaaagaacgcaccgcatttacaaaggagcagcttagggagctcgaggctgagtttgcccatcataattatctgacaagactgaggagatacgagatagccgtgaatctggacttgtccgaacggcaggttaaggtttggttccagaacaggcggatgaaatggaagagggtaaaggggggtcaaccaatctcacctaatggccaggaccccgaggacggcgacagtactgcttccccctcatctgaatag

SEQ ID NO: 230261 - DNA, 915 bp, Artificial Sequence
  Description of Artificial Sequence: Synthetic coding sequence
atggaacaccccctcttcggatgcctccgcagccctcatgcaactgcccagggccttcatcctttttcccagagttcccttgccctgcacggaaggtcggaccatatgagttatcccgagctctctactagttcctcctcatgcataatcgcaggctatcctaacgaagagggcatgtttgcctcccagcatcatagagggcaccatcaccaccaccaccaccaccaccatcaccaccaccagcaacagcagcatcaggccctgcagacgaactggcatctacctcagatgagctcgccccctagcgccgcacggcatagcctatgtttacagcctgattcagggggacccccagaattgggtagctcacctcctgttctctgctcaaattcttcatctttgggttctagcacccccactggtgcggcatgcgcgcctggtgactacggacggcaggctctgtcccccgcagaagcagagaaaagatctggcggtaagcgcaagtcagattcgtccgactcacaggaagggaactacaagtccgaagtaaactccaaacctcgtaaggaaaggacagcgttcacaaaagagcaaataagagagttagaggccgagtttgctcaccacaattatttaactcgcctgcgtaggtacgagatcgccgtgaatcttgacctgaccgaaagacaggtcaaggtttggtttcagaatcggagaatgaagtggaaacgtgtgaaagggggacaacagggcgcagctgccagagaaaaggagctcgtgaacgtgaaaaaagggacactgctgccttctgaactgtccggcatcggcgcagccacgttgcaacagactggcgacagtatcgctaacgaagattcccacgattctgatcacagctccgagcatgcacacctgtag

SEQ ID NO: 230262 - DNA, 705 bp, Artificial Sequence
  Description of Artificial Sequence: Synthetic coding sequence
atggccgcatcaagatgggccaggaaagcggttgtcctgctatgtgcatccgacctactgctgctgttactgttactccctccacccggttcatgtgctgcagaagggtcacccggaacaccagatgaaagcacacctccacccagaaagaagaagaaagatataagggattacaatgacgccgacatggctcgtctcttagagcagtgggagaaagacgacgacatcgaggagggtgacctgccagagcacaagcgtccatctgccccagtcgatttctcaaagatcgacccaagcaaacccgaaagcatacttaagatgaccaagaagggcaagaccctcatgatgttcgttaccgtgagcggcagcccaaccgagaaagagacggaggaaatcacctccctctggcaaggcagcttattcaatgctaattatgacgtacagcgtttcatcgtgggctcggatagggccatcttcatgctgcgggatggaagctacgcatgggaaattaaggacttcctggttggccaagataggtgtgcagatgtgacactcgagggacaggtgtatccaggaaagggaggtggttctaaggagaaaaacaagaccaaacaggacaagggcaagaagaaaaaggagggagacctgaagagtagaagctctaaggaggagaacagagctggaaataagcgggaggacctgtag

SEQ ID NO: 230263 - DNA, 705 bp, Artificial Sequence
  Description of Artificial Sequence: Synthetic coding sequence
atggcggcttctaggtgggcgaggaaggccgtggttttgctgtgtgccagtgacctgcttctccttctgctcttgctgcccccacccggaagctgcgccgctgagggttccccgggaactcccgacgagagtacacctcccccacggaaaaagaagaaggacattagggactacaacgacgctgatatggccagactgctggaacagtgggagaaggacgacgatattgaagagggagatctcccagaacataagcgcccatccgcccctgtggacttcagcaagatcgacccctctaagcctgagtcaatactcaagatgacaaagaaagggaaaaccctgatgatgttcgtgaccgtgtctggaagcccgacagagaaggagaccgaggagataacatctctgtggcagggttccttattcaacgcaaactatgatgtccaacgttttatagtagggagtgaccgggctatatttatgctccgggacggctcttacgcatgggagataaaggattttctcgtagggcaggacagatgcgccgatgtgaccctggaagggcaggtgtatcctgggaaagggggaggttctaaggagaaaaacaaaaccaagcaggataaagggaagaagaagaaggagggagatctgaagtcccggagcagtaaagaggagaaccgtgctggcaataagcgagaggatctctag

SEQ ID NO: 230264 - DNA, 1194 bp, Artificial Sequence
  Description of Artificial Sequence: Synthetic coding sequence
atggcacaatctccgcctccccagtccctcctggggcacgaccactggatttttgcgcagggatgggggtgggcgggacattgggacagtacctctccagcatccagtagcgattccagcggtagttgtccatgcgacggggctaggggtttgccccagcctcagccaccgagctgtagtagccgggcagccgaagccgcagctaccacaccacgaagggctcgcactggacccgctggagggcagcgccaatcggcctctgagagagagaaactgcggatgaggaccttagccagggctctacacgaactacggcgatttctcccgccttctttggcacctgctggccaatcactaacaaaaatcgagacccttcgccttgcaatccggtatattggtcatttatccgccgtcctcgggttaagtgaggagtccctgcagtgtcggagaaggcaaaggggggatgccggatccccttggggatgtcccttatgccccgacaggggcccagcagaagctcagacccaggcggagggccaaggccaaggacaaggccaggggcagggacagggtcagggccaaggccagggtcagggccaggggcagggccagggccgtcggcctggcctggtgagtgctgtcctggcagaagcctcctggggctcaccaagcgcttgtcccggagcccaggctgccccagagcggctcggacgcggtgtgcatgatacagacccctgggctacccctccctactgcccaaagatacagtcaccgccttactcttcccagggcaccactagcgacgctagcctttggaccccccctcagggatgtccatggacccagtcttctcccgagcctcggaatcccccagtaccctggactgccgcacctgccaccttggagctagccgctgtctaccagggtctgtccgtgtcccccgagccctgtctaagcctgggagctccctccctattgccacatccatcttgccagagactccagcctcagacccccggtcggtgctggtctcatagtgctgaggtagtcccaaatagcgaggaccagggtcccggtgccgctttccagctctctgaggctagtcctccacaatcctcgggactccggttttccggttgccctgagctgtggcaggaggacctggaaggggctcgcttgggaattttctactag

SEQ ID NO: 230265 - DNA, 3510 bp, Artificial Sequence
  Description of Artificial Sequence: Synthetic coding sequence
atggagcctcgggagagtggcaaggctcccgtgacatttgatgacatcactgtatacctgttgcaggaggaatgggtgctgctgagccaacagcagaaggagttatgcggcagcaacaaacttgtggctcctcttggacctaccgtcgcaaacccagagctgtttaggaagttcggcaggggccctgaaccatggctgggatcggttcaggggcaaagaagtttgctagaacaccatccgggtaagaagcagatgggttacatgggcgagatggaggtccaaggtccaacccgggagtcaggtcaatccttgcccccacagaaaaaagcataccttagtcatttatccaccgggtccgggcatatagaaggcgactgggcaggtcgaaaccggaagctgctcaaaccgagaagcattcagaagtcttggttcgttcaattcccatggttgattatgaacgaagaacagacggcgctgttctgttccgcctgccgggagtacccatcaatccgagataagcgctccaggttgattgagggctatacaggacctttcaaagtagagaccctgaagtaccatgctaaatccaaggcccatatgttctgcgttaacgcgctggctgcacgagaccccatttgggccgcacgattcagaagcatccgcgacccaccaggcgacgtgctcgccagtcccgagccgctgtttaccgctgattgtccaattttttacccgcctggcccactcggaggattcgactctatggccgaattgcttccttcttctcgcgctgagctggaagatcctggtggagacggcgcaatccccgctatgtacctcgattgtatttccgatctgagacagaaggaaatcactgatgggatccactcaagtagcgatatcaacatactttataatgacgcagtcgaatcctgtatccaggatcctagcgccgaggggctctctgaagaagtcccagtggtgtttgaagaattaccagtcgtctttgaagacgtggccgtgtactttacccgtgaagagtggggaatgcttgataagagacagaaggagctttatcgagatgtgatgcgcatgaactacgaactgctggctagtctgggccctgcggcagccaaaccggacctgatatcaaaattggaacgacgagccgctccatggattaaagatcccaacggccctaaatggggaaaaggccgacccccaggaaacaaaaagatggtggccgttagggaggcagatactcaggctagcgccgctgattctgcgctgcttccaggctcacccgtggaggcacgggcatcctgctgctcaagcagcatctgtgaggaaggagacggtccaagacgcatcaagcgcacttacaggccccgatccatacagcggtcgtggttcggccagtttccttggctcgttattgaccctaaggagaccaagcttttttgtagtgcctgtattgagcgccctaatttgcacgacaaatcttcccggctggtgcggggatataccgggccatttaaggtagagacactcaagtaccatgaagtgtcaaaagcccatagactctgcgtcaacaccgtcgaaataaaagaggatacacctcacacagcgctggtgcccgagatatcttcagatttgatggcgaatatggagcacttcttcaacgcggcttactcaattgcctaccatagccgccctctcaatgattttgaaaagatactgcagctcctgcagtccactggcaccgtgatcctgggcaaataccgtaaccgaactgcctgcacacaatttatcaaatatatttcagagacactcaagagggaaatcctagaggatgtgcgaaattcaccttgtgtgtccgtacttcttgattcgagcactgatgcaagtgaacaggcctgcgtgggcatttatatcagatatttcaagcagatggaagtaaaagagagttacatcaccctcgcccctctgtattccgagacagcagacgggtacttcgagacaatcgtgtcggctcttgatgagctagacataccattcagaaaacctggctgggtcgttggactcggtactgacggctccgcaatgttgtcttgtaggggaggtctggttgagaagtttcaggaggtgatccctcaattactgcctgtccactgtgtagcccaccgtctgcatcttgccgtggtggatgcttgtggatcaattgacctggttaagaagtgtgacagacacataaggaccgtgtttaagttttaccaatctagcaataaacggctgaatgagctgcaggagggcgcagcccctctggaacaggaaataatccgactgaaagatctgaatgcagttcgttgggtcgccagccgaagacggaccctgcacgcattgctggtttcatggcctgccttggccagacatctgcagcgtgttgccgaggccggtggccagatcggacacagggccaaagggatgctcaaattgatgcgaggttttcatttcgtgaagttttgtcacttcctcttagattttctcagcatttatagaccactcagtgaggtgtgtcagaaggagatcgttctgatcacggaagtgaacgcaaccctaggaagggcgtacgtggccctggagtcccttagacatcaggcaggcccaaaagaagaggagtttaatgccagcttcaaggacggccgattacacggaatctgtcttgacaaactggaggtggctgagcagcgattccaggcagaccgagagcgtactgtgttaacaggtattgagtatctacaacagcggttcgacgctgaccgacctcctcagctcaagaacatggaagtgttcgacactatggcatggccttccggcatcgaactcgcctctttcggtaacgatgacattctgaacctggcaaggtactttgagtgtagcttacctactggctattctgaggaggccctgctagaagagtggttgggtctgaagacaatcgcgcaacatctccccttttcaatgttgtgcaagaatgccctggctcaacactgtagattcccccttttaagcaaattgatggctgtggtggtttgtgttcctattagcacctcttgttgtgaaagagggttcaaggcgatgaacaggattcgtaccgatgagcgcaccaagctgagcaacgaggtgttaaatatgctcatgatgacggccgtaaatggggtcgccgttacggagtacgacccccaacccgctatccagcattggtacttaacatcctctggacgtagattttcacatgtgtatacttgcgctcaggttcctgccaggagccctgcatccgccagactgaggaaggaggaaatgggcgctctctacgtggaagaacctagaactcaaaagccacccattttaccgtctcgggaagcggctgaagtattgaaggactgcatcatggagccgccagaacggctcctctatcctcacacaagccaggaggcccctggaatgtcttag

SEQ ID NO: 230266 - DNA, 981 bp, Artificial Sequence
  Description of Artificial Sequence: Synthetic coding sequence
atgagagaatggtgggtgcaggttgggttactggcagtgccactgctggctgcctatcttcatatccctcccccacagttgtcccccgctctgcactcatggaaatctagcggaaagttttttacatataagggtttacgaatattttaccaggacagcgttggggttgtgggtagtcccgagatcgtggtcctccttcacggctttccaacctctagctacgactggtacaagatctgggagggtctcactttaaggtttcaccgcgtgatcgccttggacttcctgggctttggtttctccgacaagcccagaccccaccactactccatcttcgagcaagccagcatcgtcgaagccctgctcaggcaccttggactccagaaccgacggatcaatctgcttagccacgactatggtgatatagtggctcaagagctcctatacaggtacaagcagaatagaagcgggagactgacaatcaaaagcttgtgcctttcaaatggaggaatcttccccgagacccaccgtcctttgcttctgcagaaactgctcaaggatggcggtgtcttaagtcctatcctcacccggctgatgaacttttttgtgttctcaagggggctgacccctgtatttggtccatacactcgcccttcagagagtgagctgtgggatatgtgggcagggataaggaacaacgacggaaatctagttatagacagtctactgcagtatatcaaccagagaaagaaatttcggcgtagatgggtcggcgctcttgcatcagttaccattcctatacactttatctacggaccacttgatcccgttaacccataccctgagtttctggagctctatagaaagacgctcccacggtctacagtgagcatattggatgaccacatttcccactatcctcagctggaagaccctatgggcttcttaaacgcatacatggggttcattaactccttctag

SEQ ID NO: 230267 - DNA, 981 bp, Artificial Sequence
  Description of Artificial Sequence: Synthetic coding sequence
atgcgcgaatggtgggtccaggttggccttcttgctgtgcctctgctggccgcttatctccacatccctcctccccagctgtctcccgctttacactcatggaagtcttcaggcaagtttttcacctacaaaggattgagaatcttttaccaagactccgtaggggtcgtcgggtctcctgagatagttgtccttctgcatggctttcccacctcgagctacgattggtacaagatatgggagggattgactcttaggttccacagagtcatcgcactcgacttcctcgggtttggcttttctgacaagcctcgaccccaccattatagcatattcgaacaagcctcaatcgttgaagccctcctacgccacctcggcctccagaaccggagaataaaccttttatcacacgattacggagatatagtagcccaagaactgctctacagatacaagcagaatcgaagcggacgactcaccatcaaaagcctctgcctttctaacggaggtattttcccggagacccacagacccctgttgttacagaagctgctaaaagacggcggagttctgtcccctattttaacccgcctcatgaatttttttgtcttctcacggggattgacgccggtctttggtccatacacaaggcccagcgagtctgaactttgggacatgtgggccggaattcggaacaatgacgggaatcttgtgattgactctcttctacagtatatcaatcagagaaaaaagttcagaaggcggtgggtgggggcattggcctcggtcacaatccctatccatttcatctacggaccactggatccagtgaacccctatcccgagttcctggaactttatcgaaagacgctccctagatctaccgtatcaattctggatgatcacatctcacactatcctcaactggaggaccccatgggcttccttaacgcatacatgggattcataaactctttttag

SEQ ID NO: 230268 - DNA, 357 bp, Artificial Sequence
  Description of Artificial Sequence: Synthetic coding sequence
atgagggagtggtgggtgcaggtgggactgttagctgtgccgctgttggctgcctacttacacattccccctcctcagctgtcaccggcacttcactcatggaaaagctccggcaaattttttacatacaaggggttacgcatcttttaccaagattctgtcggggtggttggctcacctgagatagtcgtgctcctgcatgggttccccacttcctcatatgactggtacaaaatctgggagggcctgaccttgcgatttcaccgggtgatagctctcgattttctcggttttgggtttagtgataaaccacgaccacaccactattcgatcttcgagcaagcatccatcgtgtag

SEQ ID NO: 230269 - DNA, 624 bp, Artificial Sequence
  Description of Artificial Sequence: Synthetic coding sequence
atgcgggaatggtgggtgcaggtgggcctcttggctgttcccctgcttgccgcttatctccacatcccaccccctcagttatccccagctctccatagctggaaatcttcaggcaaatttttcacctacaaggggctccgcattttctatcaagatagtgtgggcgtcgttggatctcctgaaattgttgtgctgctacatggctttcctacttcctcctatgactggtacaagatatgggagggtctgacgctgagattccacagggtgatagcactggacttcctggggttcggcttcagtgataagcctaggcctcaccactacagcatcttcgaacaagcttctattgttgaggccttgctacgacacctgggtctccaaaacaggcgcataaaccttctttcccacgattacggtgatatcgtagcccaagagttgctctataggtataaacagaacagaagcggcagactgacgattaaaagtttatgtctcagtaacgggggtatattcccagagactcacaggcctcttctcctccagaagcttcttaaagatgggggtgtactttcacccattttgaccaggctaatgaatttcttcgtgttctcccggggatag

SEQ ID NO: 230270 - DNA, 483 bp, Artificial Sequence
  Description of Artificial Sequence: Synthetic coding sequence
atgcgggaatggtgggtgcaagtagggttactggccgtccctctgttggccgcttatctccacatccctcccccacagctgtctcctgctctccactcctggaaatcctcggggaagttctttacatacaaaggactgcggatcttctatcaggattccgtcggggtagtgggatcccctgagatcgtggtgctattgcacggttttccgacctcctcgtacgattggtacaagatctgggaggggcttacgctgagatttcatcgtgtgattgctctggactttctgggcttcggattcagcgacaagccacgtccccaccactatagcattttcgaacaggcaagcatagtagaggcgctgctgcgacacctgggactccagaatagaagaattaacctcctgagccacgattatggcgacatcgtcgctcaagaactgttgtacaggtacaagcagaatcgctccggacgattgacctag

SEQ ID NO: 230271 - DNA, 384 bp, Artificial Sequence
  Description of Artificial Sequence: Synthetic coding sequence
atgcgagagtggtgggtccaggtaggccttctggctgtgcccttactggccgcatatctgcatattcctcccccacaactgtcgcctgcgctacactcctggaagagctctggaaagttcttcacatacaagggcctccggattttttaccaggattctgtgggggttgtcggctcccccgagatcgtggtactgctccacgggttccccacaagttcatacgattggtacaagatttgggagggactgacgctgagattccatcgggtcattgccctggattttctgggctttggcttcagcgataagcctcgaccacatcactacagcatcttcgaacaggcaagtattgtagaggcccttcttcggcatctgggcctctag

SEQ ID NO: 230272 - DNA, 522 bp, Artificial Sequence
  Description of Artificial Sequence: Synthetic coding sequence
atgcgggaatggtgggtacaggtaggcctgctggcagttcccctgcttgccgcttacctccacattccaccccctcaacttagcccggcacttcactcatggaaaagcagcgggaagttctttacttacaagggccttcgcattttctaccaagatagcgtcggggtcgtcggatctccagagatcgtggtcctcctgcacggatttcccacctcttcatacgactggtacaaaatctgggagggactgaccctcagattccacagagtcatagccctggacttcctcggctttggcttcagtgacaaacccaggccacatcattattccatttttgagcaggcctcaatagtggaggctctcctgcgacatctaggactccagaaccgcaggatcaatttactgtctcacgattatggagacattgtggcccaggaattgctgtaccgctacaagcagaataggtcaggaaggctcacaatcaagagcctctgcttaagcaacggtggaaattgcctatag

SEQ ID NO: 230273 - DNA, 879 bp, Artificial Sequence
  Description of Artificial Sequence: Synthetic coding sequence
atgcgcgagtggtgggtccaggtgggcctattagctgtgcccctgttagcagcctacttgcacattccacccccacagctttctccggctttgcacagttggaaaagtagtgggaaattctttacatataaagggctccggatcttctatcaggacagtgtgggagtggttgggagccccgagatagttgtacttctgcacggatttcctacttcctcctatgactggtacaagatctgggaagggctcaccttacggttccatagggtcattgctcttgatttcctcggctttggcttttctgataaacctcggccacatcattactctatctttgagcaggcatccattgtcgaagctcttcttaggcatttgggtttacagaatagacgtataaaccttctgagtcacgactatggagacatcgttgcccaagagttattatataggtataagcagaatcggagcggcaggctgacgatcaagtcactgtgtctgagtaacggcggaatcttccctgaaactcatcggccactgctgctccagaaactcctgaaggacggcggagttctgtccccgattctgacccgcctgatgaactttttcgttttctctcgcggtctgctgcagtacattaaccagaggaagaagttcagacggaggtgggtcggcgcactggccagtgtcaccatacctatccacttcatttatggcccattggaccccgtcaatccttacccggaatttctagaactgtaccggaaaaccttacccagatcgactgtgtctattctcgacgatcatatctcccattatccacagttagaggatcctatgggttttcttaacgcatatatgggattcatcaactctttctag

SEQ ID NO: 230274 - DNA, 879 bp, Artificial Sequence
  Description of Artificial Sequence: Synthetic coding sequence
atgagagagtggtgggtgcaggtcgggttactagctgttcctctgcttgccgcttatctacacattccaccccctcagctaagccccgcattgcattcatggaagagtagcgggaaattcttcacgtataaagggctgcggatcttctaccaggatagcgtgggagtggtaggctccccggagattgtcgtattgcttcatggcttcccaacgtcctcttacgattggtataagatttgggaaggcctgactcttaggtttcacagagtaatcgctctggactttctgggcttcgggttttctgataaacctagaccacatcactacagtattttcgaacaagcttcgattgtagaggctctcctcagacacctgggcctgcagaaccgcagaattaatctcctatcacacgattacggggacatcgtggcccaggagcttctgtatcggtataaacagaacaggagcgggaggctgacgattaagagcctctgccttagcaacggaggcatcttcccagaaacccatcgcccactgctcctacagaaactgctgaaggatggcggagttctgtcgcctattctgacacgactcatgaactttttcgtcttcagccgaggacttctgcagtacataaatcagagaaagaagtttcgcaggagatgggtgggcgctctggcctccgtgaccatccccattcactttatctatggaccactcgacccggtcaatccataccctgagtttctggagctgtaccgtaagaccctccccaggagcacagtctctattctggacgaccacatatctcactatccccaactcgaggaccctatgggtttcctgaatgcttacatgggcttcatcaactctttttag

SEQ ID NO: 230275 - DNA, 582 bp, Artificial Sequence
  Description of Artificial Sequence: Synthetic coding sequence
atggacaatctacgagaaactttcttatctttggaagatggactcgggtcttccgattcgccaggattgctgtcctcttgggactggaaagatcgtgcaggtccgttcgaactgaatcaagcctcgccatcccaatctctttcccctgcaccatctttggaatcttactcctcttccccctgcccagccgttgctggcctgccctgcgaacacggcggagcctcaagcggtgggtccgagggttgcagtgtgggcggagccagtgggctcgtcgaagtggattacaacatgttggccttccagccaacccatttgcagggcggtggcggaccaaaggctcagaaaggaaccaaagtgcggatgtctgttcagagacggagaaaggcctcagagcgagagaagttgaggatgaggactctggccgacgctctccacacattgcgcaactatcttccacccgtctactcccaacgaggccagccactgaccaagattcagaccctgaagtatacaattaaatacattggcgagcttacagacctcctgaatcgcggaagggaaccgagagctcagagcgcttag

SEQ ID NO: 230276 - DNA, 1893 bp, Artificial Sequence
  Description of Artificial Sequence: Synthetic coding sequence
atggctttaccgaccgctaggcccctcctgggtagctgtggtacgccagccctcgggtccctcttattcctcctgttcagcctgggttgggtccaaccctcccggacactcgcaggcgagaccggccaggaagccgctcccctggatggcgttctggcaaatccacccaatatctccagcctgagcccacggcagctgctgggttttccctgtgcagaggtgtctggcttaagtacagaaagagtccgcgaacttgctgtggctctcgctcaaaaaaatgttaaactctccacagagcagctacgatgcttggcgcatcgcctcagtgagcccccagaagatttggatgcgctaccccttgacctactgttattcttgaaccccgacgctttctccggtccccaagcctgcacgagattcttttccaggataaccaaagctaatgtggatctcctgcccagaggtgccccagaacggcagagactgctgcctgccgctttggcgtgttggggggtgcggggatccttgctcagcgaggcagacgttcgtgcacttggcggtcttgcttgtgaccttcccggtagatttgtggccgagtccgctgaggttctgttgccaagattggtgagctgcccaggacctcttgatcaggatcagcaagaggctgctcgcgcagctctccagggcggtggacccccatacggacctccttcaacttggagcgtgagcacaatggatgctcttcgtgggctcctgcccgtgctgggacagccaattatccgtagtatcccacaaggaatcgtcgctgcctggcgccaacgctctagtcgtgaccctagctggagacagcctgagcggacaatactgaggccgaggttccgcagggaggtagaaaagacagcctgtccctccgggaagaaagccagagaaatcgacgagtccctcatattctataaaaaatgggagttggaggcttgtgtggatgctgctttgttggccacccagatggatagagtcaacgcaatcccgttcacatatgagcagctggacgtgctgaaacacaagctagacgaattatatccacaggggtaccccgagtctgtaatccaacaccttgggtacctttttcttaaaatgtcccctgaagatatccggaagtggaacgttacgtcactggagacgctaaaagcgctcctggaggtgaataagggccacgagatgtccccccaggcccctcgacggcctttacctcaggttgcgacactgatcgaccggtttgtcaagggacggggacagttggataaagatacacttgataccctcacggccttttacccgggttacctctgctcccttagcccagaagagctgagttccgtccctcctagctccatctgggccgtaagaccccaggatttggacacatgtgatcccagacagctggacgtgctgtaccctaaggcacgactagccttccagaacatgaacggttctgagtacttcgtgaaaatacagtcattcctgggcggagcccctactgaggacttaaaagccctgtcacaacagaacgtctcaatggacctggcaacttttatgaaactgcgaacagacgcagtgcttcctctgactgtagctgaggtacagaaactccttggccctcatgtcgagggcctgaaggccgaagaaaggcatcgacccgtcagggactggatcctccggcagcgccaagacgaccttgacaccctcggcctcggattacagggcggtattcctaacggttatctcgtgctcgacttgtcaatgcaggaggccttatcaggcaccccgtgtttactgggacccggacctgttttgaccgttttggccttactgctggcaagcactctggcctag

SEQ ID NO: 230277 - DNA, 1869 bp, Artificial Sequence
  Description of Artificial Sequence: Synthetic coding sequence
atggccctccccaccgccaggccactgctcggatcgtgcggaactccagcccttggtagcttgttattcctgttattttccctcggttgggttcaaccaagtcggacgttggccggagagacaggccaggaggcagctccactggacggcgtgctggctaatccacccaatatcagttctttgtcccccagacaacttcttggtttcccctgcgcagaagtttcaggcctatctaccgaacgagtacgcgaattggcagtggcactggctcaaaagaacgttaagctgagcacggaacagctaagatgtctggcacaccggttgtctgaacctccggaggacctggacgcgctgccgctggacctgcttctgtttctgaatcctgacgcattctccggcccacaggcatgcacaagattttttagtaggatcacgaaagctaacgtggatctgttgccgaggggcgctcccgagaggcagagactacttcctgcagcccttgcctgttggggagtcaggggatccctcctttctgaggccgatgttcgcgctctcgggggtttggcctgcgacttgcctgggcgtttcgtggctgagagtgcggaagttttgctaccccgacttgtatcctgcccaggacctcttgatcaagaccagcaggaggcagcccgtgccgctctgcaagggggtggaccgccttacggccctccatccacctggtctgtaagtaccatggatgctctgcgcggattgctgcccgttctgggccagcccattatccggtcgatcccacagggcatcgttgccgcttggagacagcgctctagtcgtgatccttcttggcgccagccagaaagaacaatcctaagaccgcgttttcgaagggaagtagagaagaccgcatgcccatccggcaagaaagcccgagaaatcgatgagtcgttgatattttacaagaagtgggagctggaggcctgtgtggacgctgcactcctcgctactcagatggacagagttaacgctattcctttcacctacgagcagctggatgtactgaagcataagctagatgagctgtatccacagggatacccagagagcgttattcagcatctgggatacttgttcctaaagatgtctcctgaggacattagaaaatggaacgtcacatcccttgagacgcttaaagcgctcctggaagttaacaaagggcacgagatgtctccacaggttgctacactgatcgatcgattcgttaaaggcagggggcaacttgacaaagacaccctagacaccctcaccgctttttaccccggatatctgtgtagtctatctcctgaagagttatcctctgtcccaccatcatccatctgggcggtccggcctcaagacctggatacctgcgaccctaggcagctcgatgtgctgtacccaaaggccagactagcattccagaacatgaacgggagtgaatatttcgtgaaaatccagtcttttctaggcggagctccaacagaagatctgaaggctctcagccagcagaacgtgtccatggatttggccacttttatgaaactcagaacagatgcggttctgcctttgaccgtagcggaagttcagaagctcctggggcctcacgtggagggcttgaaggccgaggagcgccaccgcccagtgcgcgattggattcttaggcagcgccaagacgacttagacactctgggattaggactccagggcggaattcctaacggatatctagtgttagatcttagtatgcaagaagctctcagcggcacaccatgccttctgggccctggaccagtgttaaccgtgctcgctctgcttcttgcctctactttagcgtag

SEQ ID NO: 230278 - DNA, 1893 bp, Artificial Sequence
  Description of Artificial Sequence: Synthetic coding sequence
atggctttacctacagcccgacctctgcttgggtcctgcggaaccccggctctggggagcctcctctttcttctgttttccctgggctgggtacagccttcaaggacccttgcaggagagaccggacaggaagctgcaccgctggatggcgtgctagccaatcctcccaatatttcatccctgtcacctcggcaacttttaggatttccgtgtgccgaagtctctggcctgagcacagaaagagtcagggagctcgcagtcgctctcgcccagaagaacgtaaaattatccacagagcagttgcgctgtttagcacatcggctttcagagcctccagaggacctcgatgcacttccactggatctgttactgtttttaaatccagacgctttttccggtccccaggcgtgcactagatttttctcaagaatcactaaggccaatgtcgatctgctaccaagaggagctcccgagaggcagagactgcttcctgcagctttggcctgctggggagtgcggggatctctgctaagcgaagctgacgtgcgtgccctggggggtttggcctgcgatctcccaggaaggtttgtggcagaaagcgccgaagtgctgttacccaggcttgtgtcctgcccaggtccccttgaccaggaccagcaggaggcagcgagggccgctttgcagggaggcggtcctccctatggaccaccctcaacttggtccgtctcaacgatggacgctttgagaggcctgcttcctgtcctcgggcagcctattattcgttccatccctcagggaatcgtcgccgcatggcgacagagaagcagtagggatccaagttggcgacagcctgagcgcactattctgagacctcggttccggagagaggtggagaagacagcctgtccttctggtaagaaggcaagagagattgacgaatccctcatcttttacaaaaaatgggaactcgaggcatgtgttgatgcagcgctcctcgccacccagatggatcgtgtcaacgccattcccttcacctatgaacagcttgacgtcctcaagcataagcttgatgaactgtatccccagggctacccggaaagcgtgatacagcaccttggatacctattcctcaagatgtcaccagaggacattcgtaaatggaatgtgacctccttggaaactctaaaggccctgctggaagtaaacaaaggtcacgagatgtccccgcaggcacctcgtcggccactgccccaggtggccactctgatagaccgattcgttaagggcagagggcagctggacaaagataccctcgacacacttaccgcattttaccccggttacttgtgcagcctgtcgcctgaggagctgtcaagtgtccccccaagctcaatttgggcagtaaggccccaggacttggatacctgtgatcccaggcagctcgatgtgctgtacccaaaagctcgcctcgccttccaaaacatgaacggatctgaatatttcgtgaaaatacagagcttccttggaggcgctcccacagaggatctgaaagcactgtcacagcagaatgtctccatggatttagccacctttatgaagttgcgaaccgatgccgtattacctctgaccgtggcagaggtacaaaaattgctgggtcctcacgtggaagggcttaaagctgaagaaaggcaccggcctgtgcgggactggatccttaggcagcgacaagacgatttggatacactcggactcggtttacagggcggaatccccaatggttatctggttttagacctgagtatgcaagaggccctgtccggtactccatgcctgctcggccctgggcctgtactgaccgtcctggccctgctgctggcgtccactctcgcatag

SEQ ID NO: 230279 - DNA, 1869 bp, Artificial Sequence
  Description of Artificial Sequence: Synthetic coding sequence
atggccctgccgacggccaggcccctgctgggatcttgcggcacacctgcccttggcagtttgctgttcctattgttcagtctcgggtgggtccagccgtcccgcaccctcgcgggtgaaacagggcaggaggccgcacccctcgacggggtcttggccaatcctccgaatatctcatccctaagtccccgtcagctgttgggctttccatgcgcggaagtaagcggcctgagcacagagagagtgagggagctagccgtggccctggcacagaaaaatgtgaaactttccacagaacagcttcgctgtctggcacatcgcctctctgagccccctgaggatctcgacgcattgcctctcgatctgttattgttcttaaatcccgacgcgttctctggacctcaggcttgtacgcgttttttttcaaggatcaccaaagctaacgtcgacctactccccagaggggcacctgagaggcagagactcttacctgcagccctcgcatgctggggcgtgaggggctccctgctatccgaagcagacgtgcgcgcactcggtggtttggcttgtgacctgcccggacgattcgtcgctgagagcgcggaggtgctgctgccgaggttggtgtcatgtcctgggcctctggatcaggatcagcaagaagctgctcgagcggcactgcagggcggaggccctccgtacggccctcccagcacatggtctgtgtcgacaatggatgccctgaggggcctgttgccggtgttgggccaacccattattcgtagcatcccccaagggattgttgcggcttggagacaacggagcagcagggacccatcttggcggcagccagaacgcacgatcttgaggcccagatttagaagagaggtggaaaagaccgcttgtcctagcggtaaaaaagcaagggaaattgatgagagtctgatattttacaagaaatgggaattagaggcctgcgtcgacgccgctttgcttgcaacacagatggatcgtgtgaacgccattccattcacatacgagcaactggatgtcctgaaacacaaattggacgagttatatccccaggggtatccagagtcagttatccagcatttaggctacctgtttcttaagatgtcgccagaagacatccggaagtggaacgttacgagcctggaaaccctgaaggccctccttgaggtcaataaagggcacgaaatgagcccgcaggttgcaaccctgatcgatcgtttcgtaaagggcagaggccagttggacaaggatactcttgatactcttactgcattctatcctgggtacttgtgcagcttgagtcccgaggaactgagttccgttcccccaagctcgatctgggctgtgaggccacaggatctggatacttgtgacccacgccagctggacgtgctctatcccaaagcaaggctggcattccagaacatgaacggtagcgagtattttgtgaagatccagtcgtttctgggtggcgctccaactgaggacctgaaggcgctgagccagcagaacgtctccatggatctggctaccttcatgaagctccgtactgacgctgtgcttccacttaccgttgccgaagtgcaaaagcttctagggcctcacgttgaaggactaaaggcagaggaacgtcatcggccagtgcgggattggatcctgaggcagcggcaggacgatctggacacactggggcttggactccaaggtggaatccccaacgggtatctggtgttagacctgtctatgcaggaggcattgtccggaaccccttgcctcttgggccctggacccgtgctgaccgtcttggcactcctcctggcttctactttggcctag

SEQ ID NO: 230280 - DNA, 1869 bp, Artificial Sequence
  Description of Artificial Sequence: Synthetic coding sequence
atggcccttccaacagcgaggccactgttagggagctgcggtactcctgcccttggaagtctcctgttcctgctgtttagcctcggatgggtgcaaccgagtagaactctggccggagaaacgggacaggaggcagccccactggacggagtccttgctaacccacccaacatcagcagcctgtcacctcgccaactgctggggtttccttgcgccgaggtgagtgggttaagcaccgagcgcgttagagagctggcagtcgctcttgcccaaaagaacgtcaaattatctaccgagcagctgcggtgcttggcccaccggctctcggagcctcctgaagatctggatgctttacctctggatttgttgttgttccttaaccccgacgccttctctgggcctcaagcttgcacacgtttcttctcacgcataaccaaggctaacgtggacttgctgccacggggagctcccgagaggcagcggctgttgccagcagcattagcctgctggggagtgcgaggctctcttttaagcgaggcagatgtgcgagctctgggcggtctggcttgcgatcttcctggccgttttgttgccgagtccgctgaagtgcttcttcctcggctcgtgagctgcccgggtccactcgaccaagaccagcaagaagccgctcgcgctgccctccagggcggaggtcccccttatggacctccgtctacgtggtctgtctccaccatggatgctttacgcggactgctgcctgttctgggacagccaattatacggtcaatccctcaaggaatagtggccgcatggaggcagcggtctagccgcgacccatcgtggcggcagcccgaacgcaccatattgcgccctcggttcaggagggaagtcgagaaaactgcctgtcccagtggaaagaaagcacgcgaaattgacgagagtctgattttctataagaagtgggaattggaggcatgtgtagatgcagccctgctggccacccagatggatcgtgtgaacgccatcccatttacatacgaacagctggacgtactcaagcacaaactcgacgaactctacccacagggctacccagagtcggtgatccagcatttgggatatctgttcttaaaaatgtcacccgaggatatcagaaagtggaatgttacatccttggaaaccctcaaagctctcctggaggtcaataaagggcatgagatgtccccccaggtggccactctcatagaccgattcgtgaaagggagagggcaactcgataaggacaccctggatactttaacagccttctaccccggttatctgtgttctttatctccagaggagctttcctccgtgcccccttcctccatttgggctgtgcgcccacaggatctcgacacctgtgacccacgccaactggatgtcctgtaccccaaggcaagattagcttttcagaatatgaatgggtccgagtactttgttaagatccagtccttcctggggggagcccctacagaagatctaaaggccctttctcagcaaaacgtgtctatggatctcgctaccttcatgaaacttcggaccgacgccgtgctgccactcacggtggctgaagtgcagaaactcctaggcccacacgtggaggggcttaaagccgaggaacgccatagaccggttcgcgactggattctccggcagcgccaggatgatctggacacgctcgggctgggcctccagggtggtatccccaacgggtacctggtgctggacctctctatgcaagaagctctctcgggaactccatgcttgctcggcccaggtccagtgctcactgtacttgcccttctactggcgtccacactggcatag

SEQ ID NO: 230281 - DNA, 1782 bp, Artificial Sequence
  Description of Artificial Sequence: Synthetic coding sequence
atgagagattccaccggcgctggtaatagtctcgtacacaagagatcccccttgagaagaaaccagaagacacccacaagcctgactaaactgtccctgcaggatggtcataaggcgaaaaaacctgcctgtaagtttgaggaaggtcaagacgtcctagcccgatggtctgacggacttttttatttgggaaccataaaaaaaattaacatacttaaacaaagttgcttcattattttcgaagactcatctaaaagctgggtcctttggaaagatattcaaactggtgcgactggatctggggagatggtgtgtacaatttgccaagaggaatatagcgaggcaccgaacgagatggtaatttgtgacaagtgcggccagggctaccaccaattatgccataccccccacattgactgttctgtaatcgatagcgatgagaaatggctctgcagacagtgtgtatttgctaccacaacaaaacgaggaggcgctcttaagaaaggtcccaacgcgaaggctctgcaggtaatgaagcaaacgttaccctacagtgtggccgatttagaatgggatgcgggacacaagacaaatgtgcagcagtgttactgttactgtgggggtcccggagattggtacttgaaaatgcttcaatgctgcaagtgcaagcagtggtttcacgaagcctgcgtgcaatgtctacagaaacccatgctttttggagacaggttctacaccttcatttgctccgtctgctcctccggacccgaatacctaaagagactcccactgcagtgggttgatatagcccacttgtgcctgtataacctgtcagtcattcacaagaagaagtattttgatagcgagttagagctcatgacttacataaacgagaactgggatagattacacccaggggaactggccgacacacccaaatcggagaggtacgaacacgtgttagaagccctaaacgattacaaaacaatgttcatgtcagggaaggagataaagaaaaagaaacatctgttcgggcttaggatacgggtccccccagtgcccccaaatgtagcatttaaagccgaaaaagagcccgaaggaacttcccatgagttcaaaatcaaggggaggaaggctagtaaaccgattagtgactcccgcgaggtgtcaaacgggattgagaaaaaagggaagaagaagagtgtgggcagacctccgggtccatatacccgaaaaatgattcagaaaaccgccgagcctctcctggacaaggagagcatttccgagaacccaacgctggatctcccttgtagcatcggtcgcacagaaggcaccgcacatagcagcaacacttctgatgtggacttcacgggcgcaagctctgctaaagaaactacaagcagttcgatatctcgccactacggactctccgattctcgaaaaagaacaaggacaggacgctcttggcccgctgctattcctcatctgcgtagaagacggggaagactgccccgtcgtgctctgcaaacccagaacagtgagatagtgaaggacgatgaggggaaggaggactaccaattcgatgagcttaatacggaaatactcaacaatctggcagaccaggaactccaactgaaccacctcaaaaactctatcacctcatatttcggggcagctggccgaatcgcctgtggggaaaagtatagggtgttggcgcgacgggtcacgctcgacggaaaggtgcaatatctggtggaatgggagggcgcaaccgcttcatag

SEQ ID NO: 230282 - DNA, 1611 bp, Artificial Sequence
  Description of Artificial Sequence: Synthetic coding sequence
atgcgtgactcaacaggggcaggcaatagtctggtgcataagcgctcaccacttcgcaggaaccagaaaactcccacgtccctgactaaactaagcctgcaagatgggcacaaagccaaaaaaccggcatgcaaattcgaagaagggcaggacgtcttggccagatggagcgatgggcttttttacctcggcacgataaaaaagattaacatcctgaaacagtcgtgcttcattatctttgaggattcctctaaatcatgggtgttatggaaggacattcagacaggagcaacgggtagtggcgaaatggtttgcactatttgccaagaggagtattccgaggccccaaatgagatggtaatttgcgataaatgtgggcagggctaccaccagctgtgccatacccctcatattgactgttccgtgattgatagcgacgagaagtggttgtgccggcagtgcgtcttcgctaccactaccaagcgcggaggagccctcaagaaggggcctaatgctaaagcgctccaggttatgaaacaaactcttccctactcagtggcagatctcgagtgggatgcagggcataagactaatgtgcagcaatgttattgttattgcggcggaccaggagattggtacctaaagatgctacaatgttgcaagtgcaagcagtggttccacgaggcgtgcgtacagtgccttcagaagccgatgttattcggcgatagattttacacgttcatctgctccgtttgctcaagtggcccagaatatcttaagcgactccctttacagtgggttgacatagctcacctgtgcctctataatctgagtgtcatccacaaaaagaaatactttgactccgagctagagctgatgacgtacattaatgagaactgggaccggctccaccctggtgaacttgcggacacccccaaatctgagagatacgaacatgttctggaggccctgaacgactataaaacaatggaggtcagcaatggtattgaaaagaaaggtaaaaaaaaatcagttggcaggcctccgggtccctacacacgtaaaatgattcagaaaactgccgagcccctgctggataaagaatcaatctcagaaaaccctacacttgacctgccttgttcaatcgggaggacggaaggaactgctcactcctcgaacacaagcgacgtggatttcactggagcatctagtgcaaaggagactacttccagttccatttctagacactatgggctctcagactcccgcaaacgaactaggacaggtcggtcgtggcctgctgccataccacacttgcggcgacgaagggggaggcttccccgaagggcgttgcagactcagaacagtgagattgtaaaggacgacgagggaaaggaggattatcagtttgacgagcttaatactgagatcctgaacaatttagctgaccaggaactccagctcaatcacttaaagaactctatcacctcctacttcggcgctgcaggacggatcgcctgcggagagaagtatagggtgctggcgagaagagtgactctcgacgggaaggtacagtacctcgtcgagtgggaaggggctactgcatcatag

SEQ ID NO: 230283 - DNA, 861 bp, Artificial Sequence
  Description of Artificial Sequence: Synthetic coding sequence
atggtctgtacgatctgccaggaggagtatagtgaggcccctaatgagatggttatttgtgacaaatgtggccaggggtatcaccagctgtgtcacacacctcatatcgactgctctgttattgactcagatgaaaaatggttgtgccggcaatgcgtgttcgctacaaccaccaagcgcggaggtgccctcaagaaaggtccaaatgcaaaggcacttcaggtcatgaagcagaccctcccatactcggtggccgatctggaatgggacgcgggtcataaaaccaatgtgcagcagtgctactgctattgcgggggtcctggggattggtatctaaaaatgctgcagtgctgcaaatgcaagcagtggttccatgaagcttgcgtccagtgtttgcagaagcctatgctgtttggcgataggttttacacattcatctgttccgtgtgctcttctggtcccgagtacctgaagcggctgccactgcagtgggtggacatcgctcatctgtgtctatacaacctcagtgtcattcacaagaagaaatatttcgatagcgagctggaattaatgacttacattaacgagaattgggatcgcctacaccccggagaactggccgacaccccaaagtctgagcggtacgagcatgtactggaggccctgaacgactataaaacaatgttcatgtctggcaaggagattaaaaagaagaagcacctgttcggtctgcgaatcagagttccgccagtgccacctaacgtggccttcaaagcggaaaaggaacccgaggggacctcccatgaatttaagttaaaagctgagaggcaccccaatttgtatctgatacaggggaaatag

SEQ ID NO: 230284 - DNA, 1476 bp, Artificial Sequence
  Description of Artificial Sequence: Synthetic coding sequence
atggtgtgcacaatctgtcaggaggaatactctgaggccccaaacgaaatggttatctgcgataaatgtggtcagggctatcaccaactgtgtcacaccccccacatcgactgctctgtcatagactcagacgaaaaatggttatgcaggcagtgcgtgtttgccaccacaactaagcgagggggagcactcaaaaagggtccaaatgcaaaagctttacaagtaatgaaacagacattgccttactctgttgcagacctcgagtgggatgcagggcacaagacaaatgtccagcagtgctattgttactgcgggggtcccggagactggtatctgaaaatgctgcagtgttgcaaatgcaagcagtggttccatgaggcttgtgtgcagtgcctgcagaagcctatgttgtttggcgacaggttttatacctttatctgtagtgtgtgttccagtggaccggaatacttgaagcggctgcctttacagtgggtggatatagctcacctctgcctatacaatctgagtgttatccacaaaaaaaaatacttcgactccgagttagaactgatgacctatattaatgagaattgggacagactacaccccggtgagctagctgatactccgaagtcagagaggtatgagcacgtgctcgaggcactgaatgactacaaaactatgtttatgagtggtaaggagattaaaaagaagaagcacttgtttgggctccggattcgggtaccccctgttcccccaaatgtcgctttcaaggctgagaaggaacctgaaggcacgtcacacgagttcaagatcaagggaaggaaggccagcaagccaatcagcgactcaagggaagtctccaatgggatcgagaaaaagggcaaaaaaaagtccgtcggacgaccccctggcccttacaccaggaaaatgatccagaagactgcagagcccctgcttgataaggaatctatatcggagaatcctacacttgacctaccgtgttccattggcagaaccgagggtaccgctcatagcagcaatacttccgacgtcgactttacaggagcttcctctgcgaaagagaccactagctcatcgattagtcgtcactacggtctttcagacagtcggaaaagaacgaggacgggacgctcctggccggctgcgatcccccacctccgcagaagacgagggagattacccaggagagctctccagacccagaactctgaaatcgtgaaagatgacgagggcaaggaggattaccagtttgatgagctaaatactgaaattctgaacaatctggctgatcaagaactgcagctgaaccatctcaaaaactccatcacatcttatttcggggctgctgggcgtattgcttgtggcgaaaagtaccgcgtactggccaggagggtgacactcgatggaaaggtgcagtacttagttgagtgggagggcgctacagcatcctag

SEQ ID NO: 230285 - DNA, 1476 bp, Artificial Sequence
  Description of Artificial Sequence: Synthetic coding sequence
atggtttgtaccatttgtcaggaagagtatagcgaagcccctaatgagatggttatctgcgacaagtgcggccaaggctaccaccagctgtgccataccccccatattgactgttccgtcattgattcagacgagaagtggctgtgccgccagtgcgttttcgccacaactaccaagcggggaggtgccctaaagaaggggccaaacgcaaaggctcttcaggtgatgaaacagaccctaccatattccgtggctgatctcgagtgggacgcaggacataagacaaacgtccaacaatgttattgctactgtggagggccaggagactggtatcttaaaatgctccagtgctgcaagtgtaagcagtggtttcatgaggcgtgtgtacagtgcctccagaagcctatgttatttggagaccgcttttatacatttatctgctctgtatgttcatccgggcctgaatatttgaaacggctgcctcttcagtgggtcgacatcgcccatctctgtctttacaatctatcagtgatccataagaagaagtattttgacagcgagctggaacttatgacttatattaatgaaaattgggacagacttcaccccggtgaactcgctgatacccccaaatccgaaagatatgaacacgtgttggaggctcttaatgactacaagaccatgtttatgtcaggaaaagaaataaagaaaaaaaaacatctctttggtctgagaatcagagtgcctccagtcccaccgaatgttgcctttaaggccgaaaaggaacccgaggggacttcccacgagttcaagattaagggccgaaaggcttctaaacctattagcgattccagggaggtgagcaatggcatagagaaaaagggcaagaagaagagtgtgggccgtcctcccggaccctatacccggaagatgatccagaaaacagccgaacccctccttgacaaagaaagtataagcgagaaccctaccctggatctcccctgcagtatcggccgaactgaaggcactgcccatagttccaatacaagtgacgtggattttacgggagcgtcctcagcaaaagagaccacaagctcatctatctcacggcactacggactctcagactccagaaagagaactcggaccggcagatcttggcctgccgctatcccccacctgcgcaggaggagaggcagattgccaagaagggccctccaaactcagaactctgaaatagtgaaggacgatgagggtaaagaagactatcaatttgacgagcttaatactgagatactgaacaacctggctgaccaagaattgcaactgaaccaccttaaaaatagtatcacgagttactttggcgctgccggtagaatcgcctgtggagaaaagtacagggttctcgctaggcgggtcacccttgatggcaaagtgcagtacctagtggagtgggagggtgctacagcttcttag

SEQ ID NO: 230286 - DNA, 1191 bp, Artificial Sequence
  Description of Artificial Sequence: Synthetic coding sequence
atggccatgatagagctaggctttggtcgccaaaactttcaccccctgaagagaaaatccagcttgctgctgaagctcattgcagtcgtgtttgccgttctgcttttttgcgaatttctgatctactacttggccatctttcaatgcaactggccggaggtgaaaacgactgcctcagacggcgagcagacaacccgtgagccggtgctgaaggccatgtttttagcggatacacatttgctgggggagttcctgggccactggctcgacaaactgcggagagaatggcaaatggagcgagccttccagaccgccctgtggctgctgcagcctgaagtggtgttcattctgggtgacatttttgacgagggcaaatggagcacccccgaggcctgggcagatgatgtggaacgctttcagaaaatgttcagacacccttcgcacgtgcagctgaaagtcgtcgccggtaaccatgatattgggtttcactacgaaatgaatacttataaagtcgaacggttcgaaaaagtattttcttctgaaagactcttctcctggaaaggaatcaacttcgtcatggttaatagcgtcgccctcaacggggacggctgcggcatttgtagcgagacagaagcagagttaatcgaggttagtcatcgcctcaattgcagccgagaggcgaggggcagttctcggtgcggtcctggacctctgttgcccaccagcgccccagtgttgctgcagcactaccctctgtatcgcaggagcgacgccaactgctctggcgaagatgccgctccagccgaggagagagatatcccattcaaggagaattacgacgtcctgagcagagaagcttcccagaagctgctgtggtggctgcagcccagactggtactttctggccacacgcatagtgcatgcgaagtccatcatggaggtagggttcccgaactgtctgtgcctagtttctcatggcggaataggaataacccgtcatttattatgggcagtatcacccccacagactataccctgtcaaaatgttatttacctagggaggacgttgtccttatcatctactgcggtgtggtggggttcctggtcgttctgacactgacccatttcggactattggccagcccattcctgagcgggttaaatctacttgggaagcgaaaaacacggtag

SEQ ID NO: 230287 - DNA, 1002 bp, Artificial Sequence
  Description of Artificial Sequence: Synthetic coding sequence
atggcaatgatcgagctgggatttggtcggcaaaacttccatcccttaaaaagaaagagttccctcttgctcaagctcatagctgtggtgtttgccgtgctgctgttctgcgagtttctgatttactatcttgcgattttccaatgtaattggccagaggtgaagaccacagcttcagacggtgagcagactacaagggagcccgtgctgaaagccatgtttctagccgacacacaccttctgggcgagtttctcggtcattggcttgacaaactgcgccgagagtggcaaatggagcgggcattccagactgccttgtggctcctgcaacccgaggtcgtatttattctgggcgatatcttcgatgaaggtaagtggagcacccccgaagcttgggccgacgacgtggagcggttccagaagatgttcagacatccatcccacgtgcagctcaaggttgtggccggaaaccacgatattggcttccattatgagatgaacacttacaaggtcgaaagatttgagaaagtatttagttcagaaagactgttctcttggaaaggcatcaacttcgtaatggtaaatagcgtcgctctgaatggtgatggctgcggcatttgctcggaaaccgaggccgaactcatcgaagtgagtcacagactcaactgtagtagagagcttctgtggtggctccagccgaggctggtcttgagtggacacacccattcagcgtgcgaagtccaccatggtgggagagtcccagaactatcagtgccctcatttagttggagaaatagaaataatcccagcttcatcatgggtagtattacccctaccgattacactctgagcaaatgttatttgccgagggaagacgtggtgctgattatttactgcggagtagtggggtttcttgtcgtactgacgctgactcactttgggttgctggcttctcccttcctgtccggtttgaacctgctgggcaagcggaaaacccggtag

SEQ ID NO: 230288 - DNA, 732 bp, Artificial Sequence
  Description of Artificial Sequence: Synthetic coding sequence
atggagcgggcttttcagacagcactgtggctcctgcagcccgaagtggtgttcatccttggcgacattttcgacgagggtaagtggtctacaccagaggcttgggcagacgatgtggagaggtttcaaaaaatgttccgtcatcccagtcacgtccagctgaaggtggtggccggaaaccatgatataggctttcattacgagatgaatacttacaaggtggagagattcgaaaaggtcttcagttccgagagattgttttcttggaagggcattaatttcgtgatggttaactcagtagcattgaatggagacgggtgtggcatctgctcagagactgaagccgaactaattgaggtgtcccatcggcttaactgcagccgcgaggctcgaggcagcagccgttgcggccctggccctctgctgcctacgtcagctcctgtgctccttcagcattatccactgtatcggcgatcagatgcgaattgctctggggaggacgctgcgccagccgaggagagagacattccatttaaagaaaattacgacgtgctctccagagaggcatcacagaaactcctgtggtggctgcaacccagattagtcctgagtgggcacacacattccgcctgtgaagtgcaccacggaggccgtgtgccggagctttcagtgccgtccttcagttggcgcaacagaaataatccaagcttcattatgggtactgatgcttag

SEQ ID NO: 230289 - DNA, 1194 bp, Artificial Sequence
  Description of Artificial Sequence: Synthetic coding sequence
atggccatgatcgaactcggctttggacgccagaacttccacccactgaaacgtaagtcatctctgctgttgaaactaattgccgtggtgttcgccgtcttgctcttctgcgagttcctcatctactatctcgccatcttccagtgcaactggcctgaagtgaaaacaacagcctctgacggtgaacagactactagagagcctgtgttaaaggccatgtttcttgcggacacccatctgctgggtgagtttttgggacactggctggacaagctgaggcgtgagtggcagatggaacgcgcttttcaaaccgccttgtggctgctgcaacctgaggttgtgttcattctcggcgacatatttgacgaagggaagtggtccactcctgaggcgtgggcggacgatgtggagagattccagaagatgtttagacacccaagccacgttcagttgaaggtcgtggccggtaatcacgacatcgggtttcattatgagatgaacacctacaaagtggagcgtttcgaaaaggtgttcagctcagaacgcttgttttcctggaagggaataaacttcgtcatggtcaattctgtggctttgaatggggatggatgcggcatatgcagtgagactgaggccgagctgatcgaggtctcacacagactgaattgtagccgggagcaggctagaggaagctctcggtgtggccctggcccactgttgccgacttcagcccctgtactcttgcagcactatcctctgtaccgcagaagcgatgccaattgttctggagaggacgctgcccctgccgaagagcgagatatcccatttaaagagaattatgacgtcctttcccgtgaggcaagccagaagctgctatggtggttacaacccagattggtcttgtcgggccatactcattccgcttgcgaagttcaccatggcggacgggtaccggagctttctgtgcccagcttctcctggcggaatcgaaacaatccttcgtttattatgggctcgatcacacccaccgactatactctgagcaagtgttacctgcctagggaggatgtggtgctcattatctactgcggggtcgtcgggtttttagttgttctcacgctgacccacttcgggctactcgcgagccccttccttagcggcctgaatctgttaggcaaacgcaagactaggtag

SEQ ID NO: 230290 - DNA, 1026 bp, Artificial Sequence
  Description of Artificial Sequence: Synthetic coding sequence
atggccatgatcgagctgggctttggacgccaaaacttccacccccttaaacgcaagtcttctctgttgctgaagctgattgctgtagtgtttgctgtcttgctcttctgtgagtttctcatctactacctggcgatcttccagtgcaactggccggaggtgaaaaccactgcttcagacggagaacagaccacaagagaacccgttctgaaggccatgtttcttgcagacactcacctcctgggggaatttttaggtcattggttagataagctgcggagagagtggcagatggaaagagcctttcagactgcattgtggctcctccaaccggaagtcgtatttatacttggcgacatcttcgatgagggcaagtggtccacaccggaagcctgggctgacgatgttgagcgattccaaaaaatgtttcggcacccctcgcacgtgcaattaaaggtggtggccggtaatcacgacatcggcttccactatgagatgaacacttataaggtagaacgctttgaaaaggtcttctcgtccgagcgcttgttctcatggaaagggatcaacttcgtgatggttaactcagtggccttaaatggcgacggttgcggaatctgctctgagaccgaagccgagctgatagaggtgagccaccgtttaaattgttccagggaacaggctagagggtcctctcgctgcggacctggtcctctgctgccaacgagtgccccagtgctgcttcagcattaccccctatatcgccgatccgatgcaaattgcagcggggaagatgcagcccctgcagaagagcgcgatatcccatttaaggaaaattacgacgtcctgagtcgcgaagcaagtcaaaagctgctttggtggctgcagccacggctagtgttgagcggtcatacccattccgcttgcgaagtccatcatggcggacgagtgccagaactctcggttcccagcttttcatggcgcaacagaaacaatccatctttcatcatgggcaccgacgcttag

SEQ ID NO: 230291 - DNA, 1191 bp, Artificial Sequence
  Description of Artificial Sequence: Synthetic coding sequence
atggccatgatcgagctcggtttcgggcgtcagaatttccacccactgaaaagaaagagcagtctactgctgaagctgattgctgtcgttttcgcggtgctgcttttttgtgagttccttatttattatttggctatatttcagtgtaattggcctgaagtgaagacaaccgcaagcgacggtgagcagacgacccgagagccagtcctgaaggccatgttcttggcggacacacacttactgggcgaattcttaggccactggctcgataagctgagaagagagtggcaaatggaacgagctttccagacagctctctggctgctacaaccggaggtagtgtttattctgggagatatatttgacgagggaaagtggagtacccccgaagcctgggccgatgacgttgaacggttccagaaaatgttcagacacccatcacacgtccaactcaaagtcgtggccggtaaccatgacattggcttccactatgagatgaatacctacaaagttgaacgattcgaaaaggtcttctcttctgagagactgttctcatggaaaggtataaattttgttatggtaaactcagtcgccttgaacggggatggctgcggtatatgttccgagacagaagccgagctgattgaagtctctcatagactgaattgcagccgggaggccagggggtcaagccgatgcggcccaggcccactcctacccacatctgccccagtgttgttgcaacactatcccctgtatagaagatccgacgctaattgtagcggtgaggacgcagcacctgccgaggaacgggatatccccttcaaggagaactatgacgtcttatccagggaagcaagccaaaagctgctctggtggttgcaaccgagactcgtgctgtcaggccacacccatagcgcgtgcgaggtgcaccatggtggcagagtgcccgaactatcagtgccatcctttagctggcgcaacaggaacaacccttccttcattatggggtccattacaccgacggactatacactgtctaaatgctatctgccacgcgaggacgtggtattgatcatctactgcggcgtcgttggtttccttgtcgtcctgacccttacccatttcgggttacttgcctccccctttctgtcaggccttaatcttctgggaaaacgaaaaacgcggtag

SEQ ID NO: 230292 - DNA, 360 bp, Artificial Sequence
  Description of Artificial Sequence: Synthetic coding sequence
atgtggcgctctagatgggatgcgagcgtgcttaaggccgaggcccttgcgcttctgccctgtggactaggcatggccttctcacagtctcacgtgatggcagctcggagacaccagcattccagacttattatcgaggtggacgaatattcctcaaaccctactcaagctttcacgttctacaacattaaccagggcaggttccagcccccacatgtgcagatggtagacccagtgccccacgacgccccaaaaccaccagggtacacacgcttcgtgtgcgtctcggatacacattctcgaacagaccctattcagatgccttacggcgacgtactgatccacgcgggtgacttttag

SEQ ID NO: 230293 - DNA, 663 bp, Artificial Sequence
  Description of Artificial Sequence: Synthetic coding sequence
atgccttacggcgacgttctcattcatgctggggacttcacagagctcggactgccgtccgaggtcaaaaagttcaacgaatggctgggttcactgccctatgagtataaaatagtcattgcgggaaaccatgagttgactttcgaccaggaatttatggcggatctcatcaagcaggacttttactactttcccagcgtttccaaactcaaacccgagaactatgagaatgtgcagtctttacttaccaattgcatctacctacaagatagcgaggtgactgtgagggggttccggatatacgggtctccatggcagccctggttctacggctggggattcaacctgcctcgtggacaggccctattagaaaaatggaacctgattcccgaaggagtcgatattcttataacacatggccctcccttagggttcctggactgggtgcctaagaaaatgcaacgagttgggtgtgtggagcttctcaacaccgtgcaaaggcgcgtccaacctaggctgcacgtttttggccatattcacgaaggctacggggttatggctgacggcacaaccacatatgttaatgcatcagtgtgcactgttaattaccagcctgtgaacccccctatcgtgatcgacctgcctacccctagaaactcctag

SEQ ID NO: 230294 - DNA, 981 bp, Artificial Sequence
  Description of Artificial Sequence: Synthetic coding sequence
atgtggaggtctcgctgggatgcaagcgtcctgaaggccgaagccctcgctctccttccatgcgggttaggcatggctttcagccagtctcacgtgatggctgcgaggcgccaccagcatagtcggctgatcatagaggtcgacgagtactcttccaaccccacccaggcattcaccttctacaatattaaccagggcagattccagcctccccacgtgcaaatggttgacccggtgccccacgacgcaccgaagccacctggctacacgcgctttgtgtgcgtctctgatacacattctcggactgatccaatacagatgccctatggggatgtgctcatccacgctggggatttcacagagctggggctcccctcagaagtgaagaaatttaatgaatggcttgggtctctcccttacgagtataaaatcgtgatcgccggtaaccacgagctgacatttgatcaggagttcatggccgacctgattaagcaagacttctattattttccctccgtttccaagttgaagcccgagaactatgaaaacgtgcagagccttctgaccaattgcatttaccttcaggattcagaggttacagttcggggatttagaatttatggttctccctggcaaccctggttctacgggtggggctttaacctgccacggggacaagcgctgctcgagaaatggaacttgatccccgagggagttgacattctaataacccacggccctccccttggcttcctggactgggtacccaagaagatgcagagagtcggatgcgtggagctcctgaataccgttcagagaagagtgcaaccacgactacatgtattcggtcacatccacgaggggtatggagttatggctgacggtacgacaacctatgtcaacgctagcgtttgcactgtgaactatcaacctgtcaaccctccaatcgtgattgatctcccaaccccacgcaatagctag

SEQ ID NO: 230295 - DNA, 507 bp, Artificial Sequence
  Description of Artificial Sequence: Synthetic coding sequence
atggctgatctgattaagcaagatttttactactttcctagtgtgtcgaaactgaaaccagagaattacgaaaatgtacaatccctccttacgaattgtatttacctccaggatagcgaggtcactgtccggggtttccgcatatacggatccccgtggcagccttggttttacggctggggcttcaatttgcccagaggacaagctctcctggagaagtggaacctgatccctgaaggcgtcgacatcctgataacacacggcccacccctgggatttctggactgggtccccaaaaagatgcagagggtcggatgcgtggaactcctaaacacagttcaaaggcgggtccagccccgacttcatgtctttggtcatatacatgaaggatatggcgtgatggcggatggcaccacaacctacgtgaatgccagcgtatgtacggtgaactaccagccagtgaatccccctatagtcattgatctccctacacctagaaacagctag

SEQ ID NO: 230296 - DNA, 981 bp, Artificial Sequence
  Description of Artificial Sequence: Synthetic coding sequence
atgtggcgctcccggtgggatgcctctgttctaaaagccgaggcacttgccttgcttccatgtggcttgggaatggccttcagccaatcccatgtgatggccgctcggaggcatcagcactcacgactgatcattgaggtggatgaatacagttcaaaccctacccaggcgtttaccttttacaacatcaatcaaggacggttccagccaccacacgtgcagatggtggatcctgtgccacacgacgctccaaagcccccagggtacaccagatttgtttgtgtttcagacactcacagccgaactgatccaattcagatgccgtatggcgacgtactaatccatgctggggactttacagaactgggcctgccctccgaggtcaagaagttcaatgagtggctcggcagtctgccatacgagtacaagatcgttatcgctggcaatcatgagctcacctttgatcaagaatttatggccgacctcatcaaacaagacttttactattttccttcagtatccaagttgaaacctgaaaattacgagaacgtccagagtttgctgaccaactgcatatacctgcaagactcggaggttacagttagaggttttaggatttacggatccccatggcagccatggttctacggctggggttttaatcttcctcgcggacaagcactcttggaaaaatggaacttaattcccgagggcgtggatattctgatcacacatggccctccactgggcttccttgactgggtcccgaaaaagatgcaacgcgtggggtgcgtggaattgctcaacaccgtacagaggcgagtgcaacccaggctgcacgtgttcggtcatatccacgagggatacggtgtcatggcggatgggactactacctatgtgaacgcaagcgtttgtactgtgaattatcagccagttaacccaccaatcgtcatagacctcccaactccaaggaatagctag

SEQ ID NO: 230297 - DNA, 225 bp, Artificial Sequence
  Description of Artificial Sequence: Synthetic coding sequence
atgtggaggagcagatgggatgccagtgtgttgaaagccgaagcactggcacttcttccgtgcggattgggaatggcgttttctcagagccacgtcatggccgcaaggcgccaccagcattctcgcctgataattgaggttgacgagtactcctcgaaccctacccaggccttcaccttttacaatattaaccagggacgtttccagcctcctcacgtacaatag

SEQ ID NO: 230298 - DNA, 1080 bp, Artificial Sequence
  Description of Artificial Sequence: Synthetic coding sequence
atgaatgggagggagacccaaagcgtgtcgcgaagcgggggaggccctgggtgtggtgggggttctggagggaggtgtcgcggaggacgccgacgaagtatgtggagaagcaggtgggatgcgtccgtcctgaaagccgaggctctagccctactgccgtgcggtcttgggatggcattctctcagtcgcatgtgatggcggctagacgacatcaacactcccggctcatcattgaggtcgacgagtactctagcaaccctacacaagctttcactttttacaacatcaaccaggggcgtttccagccgcctcatgtgcagatggtcgatcctgtgcctcacgacgctccgaaacctccaggctacactcggtttgtctgcgtgtccgacacccactctcgaactgatccgattcagatgccttacggagatgtgctgattcacgctggcgatttcaccgagctaggcttacctagtgaagtgaaaaagttcaatgagtggcttgggtccctgccttatgagtataaaatcgtcatcgccggtaaccacgaactaacctttgaccaggagtttatggcagacctgattaagcaggacttttattacttcccatctgtgtccaaacttaagcctgaaaactacgagaatgtgcagtctctattaactaactgcatttacctccaagatagcgaggtcacagtgcgaggcttccgaatctacggaagcccctggcagccatggttctatgggtggggattcaatctacccaggggccaggctctcctggagaaatggaatctgatcccagagggcgtcgacattctcattactcatggacctccgttgggcttcttagactgggtgcccaagaagatgcaaagggtcgggtgcgtggagctgctcaatactgtgcagcgcagagtccaacctaggcttcatgtgttcggccatattcatgagggatacggagttatggcagacgggactaccacctacgtgaacgccagcgtatgcaccgtcaactaccagcctgtgaacccgccaatagttatcgatctgcctaccccaaggaattcttag

SEQ ID NO: 230299 - DNA, 981 bp, Artificial Sequence
  Description of Artificial Sequence: Synthetic coding sequence
atgtggcggtcccgctgggatgccagcgtattaaaggccgaagccttagcactcctgccgtgcggcctcggaatggcgttttctcagtcgcatgtgatggccgcaaggcggcatcagcatagcaggctgatcattgaggtggacgaatattctagcaacccaacgcaagcctttactttctacaacattaaccagggcagatttcaacctccccatgtccaaatggtggacccggtgcctcacgacgccccaaaacctcctggctatacacggttcgtgtgcgtgtcagatactcactcgagaactgaccccatccagatgccatacggggatgtgctgatccatgctggtgacttcacagagcttgggctgcccagtgaggtgaagaaattcaatgaatggctcggctcactgccatatgagtacaaaattgtgattgcagggaaccacgaactcacttttgaccaagagttcatggcggatctcatcaagcaggatttctactacttcccgagtgttagcaaactgaagccagagaattacgagaacgtgcagagcctgttgactaactgcatttatctgcaggactcagaggttactgtgagaggctttcggatttacggatcgccatggcagccctggttctacggctggggctttaacttaccacgaggtcaggccctgctggagaaatggaatttgatcccagagggcgtcgacattcttattactcacgggccacccttgggctttctggattgggtaccgaagaagatgcagcgggttgggtgcgttgagttactgaacacagtccaaaggcgagtgcaaccacgcttacatgtatttggccacatccacgagggatacggtgttatggctgacggaaccacgacatatgtgaacgcctccgtttgcaccgtcaactaccagcctgtgaaccccccaatcgtaattgaccttccaacccccagaaactcatag

SEQ ID NO: 230300 - DNA, 915 bp, Artificial Sequence
  Description of Artificial Sequence: Synthetic coding sequence
atgtggcgaagcttctctcagagtcacgttatggcagccagaaggcatcagcactccaggctgattattgaagtggatgaatatagcagtaacccaacccaggccttcaccttttataatattaaccagggccgttttcagccacctcacgttcagatggtggatcccgttccccatgatgcgccaaagcccccagggtatacgcgttttgtgtgcgtgagcgacacgcattctcggacagaccctatacagatgccttacggcgacgttctgatccatgccggagactttacagaacttggtctgccatcagaagtgaagaaatttaatgagtggttgggttctctgccgtacgagtataaaatcgtcatagcaggcaaccatgaacttactttcgaccaagagttcatggcagacttgatcaaacaggatttctattactttccgtcagtaagcaagctcaaaccagagaactatgagaacgtgcagtccctcttgaccaactgcatctatttacaggacagcgaggttaccgtgaggggatttcgcatctatggctctccctggcagccctggttctatggctgggggttcaacctgcctagaggacaggcactactcgaaaaatggaatctcatcccagagggagtagatatcctcatcacccacggtccaccacttggctttttagactgggtgcctaagaaaatgcagcgcgtgggctgtgtcgagctgctaaacactgttcaacggagagtacaacctcgcctccacgtttttggccatattcacgagggctatggggtgatggccgacggaacgactacttatgtgaatgcctccgtgtgcaccgtgaactaccagcccgtaaaccccccaatagtgatcgatctgcccacgcccagaaatagctag

SEQ ID NO: 230301 - DNA, 885 bp, Artificial Sequence
  Description of Artificial Sequence: Synthetic coding sequence
atggctcacgggatccccagccagggtaaagtaacaataaccgttgacgaatatagctctaacccaacacaggccttcacccactataacatcaaccagagccggttccaaccacctcatgtgcacatggtggacccgattccttatgacaccccaaagcccgcaggtcacactcggttcgtgtgcatcagtgacactcactcccggaccgatgggatccagatgccatacggggatattcttcttcacaccggagactttactgagttaggtttgccttccgaagtgaaaaaattcaatgactggctgggaaacctcccttacgagtataagattgtcatcgccggaaaccatgagctgacattcgataaggagtttatggctgacctcgttaagcaggactattacaggtttcctagcgtgtcgaaactgaaaccagaggattttgataatgtgcagagtctgcttacaaattcaatttacctgcaggattccgaagttaccgtgaaaggcttccggatttatggcgcaccttggacgccatggttcaacggctggggtttcaatcttccgagagggcagtcactgctggataagtggaacttaataccagagggaatcgacattctcatgacacatggtccccctttggggttccgagattgggtgcctaaggagctacaacgggtcgggtgtgtggagttgttgaacaccgtgcagcgcagagtgcgacctaaacttcatgtgttcggtgggatccacgaaggatacgggattatgactgacggctacaccacatacattaacgcttccacttgcacggtctcgttccagcccactaatcctccaataatattcgaccttcccaacccgcaaggatcctag

SEQ ID NO: 230302 - DNA, 834 bp, Artificial Sequence
  Description of Artificial Sequence: Synthetic coding sequence
atggctcacggtatcccaagtcagggtaaggtcacaatcacagttgacgaatatagtagcaatccaacacaagcatttactcactacaatatcaatcaaagccgcttccaaccaccacatgtgcatatggtggacccaattccctacgatacacccaagccagcaggacacactcggttcgtgtgcatctcagacacccattcacgaactgatggaatccagatgccttacggagacattttgctgcatacaggcgattttaccgagctcggccttccaagtgaggtgaagaagtttaatgattggctgggtaacctcccctatgaatacaaaatcgtgatagctgggaatcacgagttgacattcgacaaggaattcatggcggatctcgtgaaacaggattattaccgcttcccaagtgttagcaaattgaagccagaggactttgacaacgttcagtctttgctgacaaactcgatttacctgcaggatagtgaagtcacagtgaagggttttcggatttatggggctccatggacgccctggttcaacggctggggattcaacttaccacgcggtcagtctttgctagataagtggaatctgattccagaggggatcgacattttgatgactcacggccctccgcttggttttagagattgggtgcccaaggaacttcaaagagtcggctgtgtggagctcctcaacactgttcagagaagggtccgacctaagttacacgtgttcggcggtattcatgaggttaatccagtatcaatctctaaggctttgcgtacaaaaatttgtagcttaccttcaaagactagttag

SEQ ID NO: 230303 - DNA, 132 bp, Artificial Sequence
  Description of Artificial Sequence: Synthetic coding sequence
atggcccacgggatcccaagccagggcaaggttactatcaccgttgatgaatattcatccaatccaactcaggcgttcacccactataatataaatcagtctaggttccagcctccacacgtgcacatgtag

SEQ ID NO: 230304 - DNA, 186 bp, Artificial Sequence
  Description of Artificial Sequence: Synthetic coding sequence
atggaccctaattgcagttgcgccaccggcggaagttgcacttgcaccggctcttgcaagtgtaaagaatgtaagtgtacatcctgcaaaaagtcttgctgcagctgttgccccatgtcatgcgcaaagtgtgcacagggctgcatatgtaagggcgcatctgagaaatgctcctgttgcgcatag

SEQ ID NO: 230305 - DNA, 186 bp, Artificial Sequence
  Description of Artificial Sequence: Synthetic coding sequence
atggaccctaactgcagttgtaccaccgggggaagctgtgcctgcgcaggctcctgtaagtgtaaagaatgcaagtgtactagctgcaagaaatgttgctgttcatgctgtcccgtggggtgtgccaagtgcgcgcagggatgtgtgtgcaaaggcagttctgaaaagtgccggtgctgcgcctag

SEQ ID NO: 230306 - DNA, 186 bp, Artificial Sequence
  Description of Artificial Sequence: Synthetic coding sequence
atggacccaaattgtagctgcgcaacgggagggtcttgtacatgtgcgggttcatgtaagtgcaaggagtgcaagtgcacatcttgcaaaaaaagctgttgttcctgctgtccagtcggttgtgccaagtgcgctcaaggctgtgtttgtaagggtgccagtgagaagtgttcctgttgcgcctag

SEQ ID NO: 230307 - DNA, 384 bp, Artificial Sequence
  Description of Artificial Sequence: Synthetic coding sequence
atggatcccaactgctcctgtgctaccgggggatcgtgcacctgcgcaggttcttgcaaatgcaaggaatgcaagtgtacatcttgtaagaagtctgagtgcggtgccatcagcagaaacctgggattgtggctcagattggggggaaactcacgtttagccctctcagcctctttttggggaacaggcttgagtctccctagtctgcccgtgagcttccccctgcaggccttctgccccaagtttaggtggggtaggacagcctttttttcgtgggataccaatcccaactgcacgccatacggctttcgtactgagttatgtcaaaccaaaaagagcattctctgggtctgggtgctttccagttcgcaagcatgttactag

SEQ ID NO: 230308 - DNA, 186 bp, Artificial Sequence
  Description of Artificial Sequence: Synthetic coding sequence
atggatccaaactgcagctgcgctgccggtgtgagttgtacatgtgcagggagctgcaaatgcaaagaatgcaagtgtacttcttgtaaaaaatcttgttgcagttgttgcccagttggctgtagcaaatgtgctcagggttgcgtttgcaaaggcgctagcgagaaatgctcttgttgcgactag

SEQ ID NO: 230309 - DNA, 189 bp, Artificial Sequence
  Description of Artificial Sequence: Synthetic coding sequence
atggacccaaattgtagttgcgccgcagccggtgttagttgtacttgcgcgggatcctgcaaatgcaaggaatgtaagtgcaccagctgtaagaaaagctgctgctcctgctgtcccgttggctgtagcaagtgcgctcaaggctgcgtgtgcaaaggggcaagtgagaaatgctcttgctgcgattag

SEQ ID NO: 230310 - DNA, 189 bp, Artificial Sequence
  Description of Artificial Sequence: Synthetic coding sequence
atggatcctaactgcagctgcgctgcagctggcgtgtcatgtacatgcgccagttcttgcaaatgcaaagaatgtaaatgtacatcctgtaagaagtcttgctgtagttgctgtcccgtgggatgtgccaagtgcgcgcaggggtgcatttgcaagggcgcttccgaaaaatgcagctgctgcgcttag

SEQ ID NO: 230311 - DNA, 186 bp, Artificial Sequence
  Description of Artificial Sequence: Synthetic coding sequence
atggaccctaactgtagttgcgccgctggcgtgagctgcacttgcgcctccagttgcaaatgtaaggagtgcaaatgcactagttgcaagaagtcctgctgttcatgttgcccagtgggctgcgccaaatgcgcgcagggctgcatatgcaagggcgctagtgaaaaatgcagctgttgcgcctag

SEQ ID NO: 230312 - DNA, 186 bp, Artificial Sequence
  Description of Artificial Sequence: Synthetic coding sequence
atggatccaaattgcagttgcgaggctgggggatcctgtgcatgcgcaggtagctgcaagtgcaaaaaatgtaagtgcacatcctgtaaaaagagctgctgcagctgctgtccacttgggtgtgccaaatgcgctcaaggctgcatttgcaaaggagcctccgagaagtgttcatgctgcgcctag

SEQ ID NO: 230313 - DNA, 186 bp, Artificial Sequence
  Description of Artificial Sequence: Synthetic coding sequence
atggatccgaactgttcatgcagtcccgtgggttcttgcgcttgcgcgggatcttgtaagtgcaaagagtgcaagtgtactagttgtaagaaaagctgctgcagttgctgccctgtcggatgcgccaaatgcgcccaaggatgtatttgtaaaggaacatccgacaaatgttcatgctgcgcatag

SEQ ID NO: 230314 - DNA, 186 bp, Artificial Sequence
  Description of Artificial Sequence: Synthetic coding sequence
atggaccccaattgcagctgcgcagctggagacagttgcacgtgcgctgggtcttgcaagtgtaaggaatgcaagtgtacatcttgtaagaaatcttgttgtagctgctgtcctgtgggatgtgctaagtgcgcccagggatgcatctgcaagggcgcttccgataaatgttcatgttgcgcttag

SEQ ID NO: 230315 - DNA, 207 bp, Artificial Sequence
  Description of Artificial Sequence: Synthetic coding sequence
atggaccccgaaacatgtccttgcccatccggaggtagctgcacctgtgctgacagctgtaagtgcgagggatgtaagtgcacttcatgcaaaaaatcctgctgttcatgctgtccagctgaatgtgagaaatgtgccaaagattgcgtctgcaagggcggtgaggccgcagaagctgaggccgaaaaatgtagttgctgccagtag

SEQ ID NO: 230316 - DNA, 687 bp, Artificial Sequence
  Description of Artificial Sequence: Synthetic coding sequence
atgaaaatcaagccagggtttatgggcaaggcgacccccccttacgatgttcagttccacatggaggcatctgttgagaattgtatcatagtaagtatgaatactgccgatccgggatcccaaggcattactcatagtctgctgctgcaagtcattgatgacaaaggatccattctccctcccaacacagaaggaaatatcggcattcggattaagcccgttcggccagtgtccctgttcatgtgctatgagggcgacccggaaaaaacagcaaaagtggaatgcggggatttctacaatacaggagatcgtggaaagatggacgaggaaggctatatatgctttctgggaagatccgacgacatcatcaatgctagtggataccgaatcggtccagccgaagtcgaatctgcactggtagagcatcccgctgttgctgaaagcgctgtagtggggtcccccgacccaattcgaggagaggtcgtgaaggcttttatcgtgctgactcctcaattcctgtcacacgataaagaccagttaacgaaggagttgcagcagcatgttaaatccgtcacggcgccttacaagtaccctagaaaagtggaattcgtctcggaactgccaaaaacaataactggcaaaattgagaggaaggagctgcggaagaaggaaactgggcagatgtag

SEQ ID NO: 230317 - DNA, 1527 bp, Artificial Sequence
  Description of Artificial Sequence: Synthetic coding sequence
atggaagagggacccctgcccggaggcctcccgtctccagaggacgctatggtcaccgagttactgtcacctgaaggcccttttgcctcggaaaacattggacttaaagcccctgtgaaatatgaggaggatgagtttcacgtcttcaaggaggcttatcttggaccagcagaccccaaggagcccgtgctgcacgcttttaaccctgcattaggagctgattgcaaagggcaggtgaaggcaaaactggccggaggcgactcagacggaggagaactgctaggcgagtacccaggtatacccgagctgtctgctctggaggacgtagcgttacttcaggcccctcagcctccagcctgcaacgttcacttcctctcatcactgcttccggctcaccgtagcccagccgtgctgccactgggtgcctgggtgctcgaaggtgcaagccaccccggtgtcaggatgatccccgtggaaatcaaagaggctggcggaaccaccacctctaacaaccccgaagaggccacactgcaaaacttactggcccaagagtcatgctgtaagttccccagctcccaggagctggaggatgcctcttgctgcagcctgaagaaagatagcaatcctatggtaatctgtcagctgaagggcggaacccaaatgctgtgtatcgacaatagtaggacaagggaactcaaggccttgcacctcgtcccgcaatatcaagaccaaaacaattaccttcaaagtgacgtacccaagcctatgacagccttggttgggaggttcttaccagcctcaactaagcttaatctcatcacacaacagcttgagggcgctctgccttccgtagtgaatggctcagctttcccatcaggctcaaccctgcctggccctccaaagataaccttggctggatattgcgattgtttcgcctccggggacttttgtaataactgcaactgcaataattgctgcaacaatctacaccacgacatcgagaggttcaaggctataaaggcctgtctggggcgaaatccagaggcatttcagcccaaaattggtaaaggacagttgggaaacgttaaaccacagcataacaaagggtgtaactgccggcgatccggatgcttgaagaattactgtgagtgttacgaagcccagatcatgtgctcatcaatctgcaagtgtattggctgtaagaactacgaggagagccccgagcgtaaaaccttgatgagcatgcccaattacatgcagacaggagggcttgaaggctcacattacctgcctccaactaagttctccgggctgcccagattttcgcatgaccgtaggccatcctcttgtattagctgggaggtggtggaggcaacctgcgcatgcctcctcgcccaaggagaggaggctgagaaggaacactgttctaaatgtctagcagagcagatgattctcgaggagttcggacggtgtcttagccaaatcctgcacacagagttcaagtccaaggggctaaagatggagtag

SEQ ID NO: 230318 - DNA, 756 bp, Artificial Sequence
  Description of Artificial Sequence: Synthetic coding sequence
atggaagaggggcctctgccaggtgggctaccctcgcccgaggacgcaatggtgacagagctgctgagtccagaggggccttttgcgagtgaaaatatcgggctaaaggccccagtaaagtacgaggaggacgagttccatgttttcaaagaggcctatttggggccagctgaccctaaggaacctgtcttacacgcattcaatccagcgctcggagcagactgcaaaggccaggtcaaggccaaactcgcgggaggggacagtgatggtggcgaattgctgggcgaatatccaggcattcctgaactgtcagcccttgaggatgtcgcattgctccaggcccctcagccacccgcttgcaacgtgcatttcttatcctcactcctccctgctcataggtctccagctgtgctgccactgggtgcttgggttctggaaggtgcatctcaccctggcgtccggatgattcccgtagagataaaggaggcgggaggcaccactaccagcaacaaccccgaggaggccaccctgcagaacctgttagcccaggagtcctgctgcaagttcccctcaagccaggagctggaggacgcctcttgctgctccctgaaaaaggactccaaccctatggtcatttgccagctcaaaggtgggactcagatgctctgcatcgataacagcagaacacgcgagctgaaagcactacatctggtgcctcagtatcaagaccagaacaactacctgcaaagcgcctag

SEQ ID NO: 230319 - DNA, 921 bp, Artificial Sequence
  Description of Artificial Sequence: Synthetic coding sequence
atggaagaggggcctttaccaggtggactgcctagccccgaggatgccatggtgacagagctgctatccccggagggaccattcgcttccgaaaatatcggattaaaggccccagtgaaatacgaagaagatgagtttcacgtgttcaaagaggcatatttaggccctgcagaccctaaagagccggtgttgcatgcctttaatcctgctctgggcgcagactgcaaaggccaggtgaaggctaaactggcaggaggagactctgacggcggagagcttctgggagaataccccggtattcccgagctttcagccttggaagacgttgcgctgctccaagccccacagccaccggcatgtaatgtacacttcctgtccagtcttttacccgctcaccgtagtccagcggttctacccttaggcgcatgggtgctagagggtgcatctcatcccggagtgcggatgattcccgtagagatcaaagaagccggtgggaccacaaccagcaataatccagaagaggctacactgcagaacctgttagcccaagagtcatgttgtaaattccccagttcacaggaactggaggacgcgagctgctgctcactgaaaaaagattccaatcccatggtcatctgtcaactgaagggtggcactcagatgctctgcatcgacaattcacgcactagggagctgaaggctctacacttagtcccccaatatcaggaccagaataattacctgcagtctgatgttcccaaacccatgaccgctctggtcggcaggttcctgcctgcgtctacaaagttaaacctgatcacccagcagttagagggcgctctgcctagcgtcgtgaacggcagcgccttccctagcgggtctaccctgccgggacccccaaagattacactggccggatag

SEQ ID NO: 230320 - DNA, 2262 bp, Artificial Sequence
  Description of Artificial Sequence: Synthetic coding sequence
atgggcgagcactctcccgacaacaacatcatctattttgaagctgaagaggacgaactgaccccagatgacaagatgcttcgatttgtcgataaaaacggactcgtgccctcttctagcggtacagtatatgatagaacaactgtactaatcgaacaagatcccggaacactagaggatgaggacgacgacggccagtgtggggagcacctcccatttctcgtcggcggagaggagggcttccacctcatcgatcacgaggctatgtctcaagggtacgtgcagcatattatatctcccgaccaaattcacctcacaataaatcccggaagcactcccatgccacgtaacatagaaggagccacgctaactctccagtccgagtgtccagagactaaacgtaaggaggttaagagataccagtgcacctttgaaggctgtccgcgaacctactctaccgccggaaacctcaggacccaccaaaaaacacatcgcggtgagtacacctttgtttgcaaccaggaggggtgtggtaaagcttttctcacatcatatagcctgcggatccatgtgagagtgcacactaaggagaagccatttgagtgcgatgtccaaggttgcgaaaaggcgttcaatactctttaccgcctgaaagctcaccagcgactgcacacaggaaaaacatttaattgcgagtccgaaggttgcagcaaatacttcaccacactgagcgatctacgtaaacacatccgcacccataccggagaaaagccatttaggtgcgaccatgatggctgtggaaaggcttttgcagcgtcgcaccaccttaaaacacacgtgaggacccacactggtgaaaggccgttcttttgccccagtaatggttgtgagaaaacattctctacccagtattctctaaagtcacatatgaagggccacgataacaagggccattcgtacaacgctctgccccagcataacgggtcagaggacaccaatcactccctgtgcctgtctgacttgagccttctcagcactgactcagagctgcgtgagaatagcagcacaacgcagggccaggacttgtctacaatctcacctgcaatcatattcgagagcatgttccagaattctgacgacaccgctatacaagaggatccgcagcaaactgccagcctgacagagtcatttaatggcgatgccgagtccgtctccgatgtcccaccatccacaggcaactcagcttctttatcgctgccccttgttctccagccgggactctccgagcctccgcagccgttactacctgccagcgccccttcagccccaccccctgccccatccctcggacctggcagccagcaggccgctttcggaaatccacctgccctcctgcagcccccagaggtccctgtcccccattccacgcagttcgccgctaatcaccaggagttcctgccccatcctcaagcaccgcagccaatagtcccgggtctgagcgtggtggcaggggcatctgctagcgccgctgctgttgcatccgcagtggccgcaccagcaccaccccagtccaccactgagcccttacccgctatggtgcaaaccctgccacttggcgctaatagtgtgctgactaataatcctaccatcacaatcacaccaacaccaaacaccgcaatcctccagagttccctcgttatgggggagcagaatcttcagtggatactgaacggtgctacttcttcccctcagaaccaggagcaaattcagcaggccagcaaagtggagaaagtgttttttactaccgctgtgccagtcgcttctagcccaggttccagcgtacagcagatcggattgtctgtcccggtgatcatcattaagcaggaggaagcttgtcaatgccagtgcgcgtgtcgggacagcgcgaaggaacgcgctagctcacgccgtaaaggctgcagttccccccctcccccagagccttcccctcaagctcccgatggcccttcacttcagctgcccgcacagactttttccagcgctccggtgcccggatcctcctctagtactcttcccagcagctgcgaacagagtcgccaggccgaaacaccaagtgacccacagactgagacactgtcagccatggatgtgtctgagtttctgtctctgcaatcactggatacacccagcaacctcatccctattgaggcattactgcagggggaagaagagatggggcttacttcaagtttctctaagtag

SEQ ID NO: 230321 - DNA, 603 bp, Artificial Sequence
  Description of Artificial Sequence: Synthetic coding sequence
aagcagtcccaggtgaagagataccagtgtacgttcgaggggtgcccccgaacgtacagcacagccggaaatctccgaactcaccagaagactcatcggggtgaatacacctttgtctgcaaccaggaaggttgtgggaaggcctttctgacctcctacagtctccggatccacgtgagggtccacacgaaggaaaagccctttgaatgcgacgtgcagggttgcgagaaagcatttaataccttataccgcctcaaggcccaccaacgcctccataccggtaaaacctttaactgcgagagcgaggggtgcagcaaatattttactacgctctcggatctgaggaagcatattagaacacatacaggcgaaaagccgtttcggtgcgaccacgacgggtgcggcaaggcctttgccgcatctcaccacctcaaaacccatgtccgtacccacacgggagagcgtccgttcttttgtccttccaatggttgcgaaaaaacgttcagtacacagtacagcctgaagagtcatatgaaaggccacgataacaaaggtcactcctataatgctctgccccagcacaacggtagcgaatctacatag

SEQ ID NO: 230322 - DNA, 2559 bp, Artificial Sequence
  Description of Artificial Sequence: Synthetic coding sequence
atgctgatcactgagaggaagcactttcggtcggggaggatcgcacagagtatgtctgaagccaacctaatagacatggaggcaggcaagctgagtaagagctgtaacattaccgagtgccaggaccctgacctcctgcataattggcccgacgcatttaccctccgcggaaacaatgcatctaaggtggccaacccgttttggaatcagttaagcgcgtcaaacccatttctggatgacattacgcaattacgcaacaatcggaagcgcaacaatatttcgatcctgaaagaagacccttttctgttctgccgggaaattgaaaatggaaatagcttcgatagttcaggtgacgagctcgacgtgcaccagctgttgcgccagacctccagtaggaattccggcagaagcaagagtgtttctgaactgctcgatattcttgacgacaccgcccacgcacatcaatccattcacaacagtgaccaaatcctgctgcacgatctagagtggttaaaaaatgaccgcgaggcctacaaaatggcctggttaagccaacgtcagcttgctaggtcctgcctggatttgaatacaatctcacagtctccaggatgggcccagacacagctggccgaagtgacaatcgcgtgcaaggtaaaccaccaaggcggaagcgtgcaactaccagagagcgatattactgtgcacgtgccacagggacacgttgccgtcggcgagtttcaggaagtcagcctccgggctttcctggacccgccacacatgctcaatcatgatctgagctgtactgtgtccccgctgttagagattatgctaggcaacctaaacaccatggaagccctgctactggagatgaaaattggcgcagaggtcagaaaggaccccttctcgcaggtgatgactgagatggtgtgtctccacagcctgggcaaggaggggcctttcaaagtcctgtccaactgctatatatataaggatacgatccaggttaaactgatcgacctttctcaggtcatgtacttagttgtggcagcccaagcgaaagcgttgccaagcccggctgctacgatttgggattatatacacaagaccacatcgattggaatttacgggcctaagtacatccacccctctttcacggtcgtcctgactgtctgtgggcacaactacatgccagggcaactgactatttccgacattaagaagggcggtaaaaatattagtcccgtggtatttcagctgtggggtaaacaaagttttcttctcgacaagccacaggacctgtctatttccatcttttcctgtgaccctgattttgaagttaaaaccgagggtgaaagaaaggaaatcaagcagaaacaactcgaggccggtgaagtcgttcaccagcagtttctgttctcactagtggaacaccgtgagatgcatttattcgatttttgcgtgcaggtggagccacccaatggggagcccgtggcacagttcagcattactacccccgacccgactccgaatctgaagcgtctgagcaacctccctggatacctacagaagaaagaagagattaaatctgcaccactcagtcctaagatcctggttaagtaccccactttccaggataagacacttaatttctcaaattatggcgttacccttaaagcagtccttagacagtctaaaatcgactatttcctcgagtatttcaaaggagacacaatcgccttgctgggcgagggcaaagtgaaggcgatcggacagtcaaaagtgaaggagtggtacgtcggggtcctgagggggaaaattggactggtccactgcaagaacgttaaggtgatttctaaagagcaggttatgtttatgtcagattccgttttcacaaccaggaatctactggagcagatcgtgttacctctcaaaaagctgacttatatatatagcgtggtactaacgctcgtgagtgagaaggtctacgattggaaggttttagccgatgtgctggggtattcccacctgagcctggaggactttgatcagatccaggcagacaaggagagcgagaaggtttcctacgtcatcaaaaagttgaaagaggactgccatactgagagaaatacccgcaagttcctctacgaacttattgtagcactcttaaagatggattgccaggagctggtggccagacttatccaggaggccgctgtgttaacctccgcagttaaactgggaaaaggctggcgagagttggccgagaaactggtccgcctgaccaagcaacagatggaagcgtatgagattccacacaggggcaacacgggagacgtggccgtggaaatgatgtggaagcctgcatacgacttcctgtatacctggtccgctcattacggcaataattacagggacgtgctccaagacctgcagagcgctctcgacagaatgaagaaccctgtgactaagcattggcgtgagttaaccggcgtccttattctagtgaactctctcgaagtgcttcgtgtcactgctttctctacttccgaggaagtctag

SEQ ID NO: 230323 - DNA, 2559 bp, Artificial Sequence
  Description of Artificial Sequence: Synthetic coding sequence
atgctgatcacagaacggaaacattttcggtccggccgtatcgcacagtccatgtccgaggcgaatttgatcgatatggaggccggaaagttgagcaagtcctgtaacataaccgaatgccaagatccagacttgttgcacaattggcccgacgcgttcactctcagggggaacaacgccagcaaagtagctaatcccttttggaaccagctctccgcaagcaaccccttcttagacgatatcactcagctaagaaacaacagaaagcgcaataacatctcaatcctcaaggaggaccccttcctgttttgtagagagatcgagaacgggaactctttcgactccagtggcgatgaactcgatgtccaccagctcctaaggcagacatcgtccagaaattcaggcaggagcaagtctgtgtctgagctactagatatcctggacgacacggcccatgcacaccagtccatacataattccgaccagatcctgcttcacgatctggagtggctgaagaatgatcgagaggcatataaaatggcctggcttagtcagcggcaacttgccagatcatgcctggatctgaataccatctcccaatcaccaggttgggcccagactcaactcgccgaggtgacaatagcctgcaaggtcaatcaccagggagggtctgtgcagctaccagaaagtgatattaccgtgcacgtgcctcagggccacgtggcggttggtgagttccaggaggtgtccttacgagccttcctggaccctcctcatatgctgaatcacgacctgagctgtaccgtgtctccactgctggagatcatgctggggaacctgaataccatggaggccctgttattggagatgaagattggagccgaggttcgtaaggaccccttttcccaagtgatgacagaaatggtttgcctgcactctctcgggaaggagggacctttcaaagttctgtccaattgctacatttacaaagacactatccaagtgaagcttatagatctttcacaagtgatgtaccttgtggtcgcagcgcaggccaaagcgctgccttcaccagccgctacaatttgggactacattcacaagaccacctctatcggtatttacgggcctaagtacatccacccttcatttaccgtggtactgactgtgtgcggccacaattacatgcccggtcagctaaccataagtgatattaagaaaggaggaaagaacatctcacctgttgtgtttcagctctggggcaaacaaagctttttgctcgataaaccccaggatctgagcatttcaattttctcctgcgatccagactttgaggtcaagactgagggtgaaagaaaggagattaaacagaagcagctggaggctggggaggttgtgcatcaacaatttctttttagcctggtggagcacagagagatgcatttgtttgatttctgtgtgcaggtcgagccacctaatggcgaaccggttgctcagttttcgattaccaccccagatcccacccccaacctcaagcgcctgagcaatctccctggctacctgcagaaaaaagaagagatcaagtcagccccactgagcccaaaaattctcgtgaagtaccccacctttcaagataaaacattgaacttttcaaactacggggtgacattgaaagcagtgttgcggcagagcaaaatcgactacttccttgaatatttcaagggagatactatcgccctgttgggtgagggaaaggtgaaggccattggacagagtaaggtgaaggagtggtatgtcggcgtgctcaggggcaaaatcggactggtccattgtaagaacgtcaaggtgatctctaaagaacaggttatgtttatgtctgacagtgtcttcacaactcgcaatctcttagagcagatagttctgccactgaaaaagttaacctacatttatagtgtggtccttaccctggtaagtgaaaaggtttacgactggaaagtcctcgccgacgttttgggttattcccatctgtccttagaagatttcgatcagattcaggccgacaaagaatcagaaaaagtctcctatgtcataaagaagctcaaggaagattgtcacacagagcgcaacacccggaagttcttgtacgagttgattgtggctctgctgaaaatggattgccaggagctcgtcgcccgactcatccaagaggcagccgtgttaaccagcgctgtaaagttaggaaaaggctggagagaacttgcggagaaactagtccggctaacaaaacaacagatggaagcctacgaaatcccccatcgtggcaatacaggagacgtcgcggttgagatgatgtggaaacccgcttacgatttcttgtatacatggtcagctcattacggcaataactaccgggatgttttacaggacctccagtctgctctggacagaatgaagaaccctgttacaaaacattggcgcgaactgacaggagtgttgatcctcgtcaatagcctggaagtgctgcgcgtgacggcattctccacaagcgaggaggtctag

SEQ ID NO: 230324 - DNA, 1308 bp, Artificial Sequence
  Description of Artificial Sequence: Synthetic coding sequence
atgctgctcggcggacctccacggtctcccagatctggcacctcccccaagggtccctggagtagcacgggccatgtccagtttggtaaatcacctcagacctggcccagaagaactcgccctaggagtcccgagcccgctgcccctagcggcgtacggggaagcacatggacccgcaggcgggatacaccacgacgtgcgggaccgactgctctgtcccggtacgtcggtcacctgtggatgggccgaaggcctccgagtcctgaagccagaggacccgtgcccaggtcaagtgccgcttcacgggcaagaagaagcctggctagccccggtatctcgcccggaccactgacagcaaccatcggcggagccgtggcgggagggggtccgagacaaggtcgagccgaggcacacaaagaagtgtttccgggtcagagagtggggaaaatggccgctcccatggaactcttctgctggtctggtggttggggtttaccctctgtcgacctggacagcctggccgtcctcacatatgcaagatttaccggagcaccacttaaagtacataaaatctcaaatccgtggcagtcaccatccgggacactcccggctctcagaacctctcacggagaagttatctctgtgcctcacaaaatcattacccatctcaggaaggaagtacacaccttttggatagatactaaaaattacgttgaagtgacacgtaaatggtacgctgaggcgatgccctttccacttaacttctttctcccaggacgcatgcaacgccagtacatggagcgtttgcaactgttgaccggcgaacacagaccagaagacgaggaggaactcgaaaaagagttatatcgggaggcgagagagtgtttgacccttctttcccagagactggggtcacagaaattcttcttcggggacgcaccggcatctctggacgcattcgtgtttagctatcttgcactgctgctgcaggccaagctcccttctggcaaactacaggtgcacctccgcggtctgcataacctctgtgcctattgcactcacattctcagcctttacttcccttgggatggcgcagaggtgccaccccagagacaaacaccagccggacctgagaccgaggaggagccctaccgcagaaggaatcagattctgagcgtgctggcaggcctcgccgctatggtgggatacgcgttgttgagcggaatcgtgtctattcaacgagctacaccggctcgggctccaggtaccaggactttagggatggcggaggaggatgaggaggaatag

SEQ ID NO: 230325 - DNA, 1401 bp, Artificial Sequence
  Description of Artificial Sequence: Synthetic coding sequence
atgctgttgggtgggccacctcgatcacctagaagcgggactagccccaaaggaccctggtcctcaaccggccacgtccagtttggcaaaagtccgcagacatggcctaggcgaacgaggcccaggagccccgagcccgcagcaccctccggagttcggggttccacctggacccgacgacgcgacaccccccgtagagccggtcccactgcacttagcaggtacgtcggccacctttggatgggcaggcgtccacctagccccgaggcccgagggcctgttcccaggtccagtgctgctagccgcgcaaggcggagcctggcgagtcccggtatttccccaggaccactgacagcaactattggtggtgcggtagcaggaggtgggcctagacagggtcgggctgaggctcacaaggaggtgttccccggtcaacgcgtggggaagatggccgctccaatggaattattctgttggagcggcggatggggactccccagcgtggatctggacagtctggctgtgctcacttacgcaagatttaccggagctcctctgaaagttcataagatttcgaatccgtggcaatccccaagtggcactttgcccgcactacggacctcacacggtgaagtgatctccgtacctcataagataatcacgcacctacgcaaggagaaatacaacgccgattacgaccttagtgccagacagggagctgatacattagcttttatgtcacttctggaagagaaactgctgcccgtgcttgtgcatactttttggattgatacgaagaattacgtggaagttactaggaagtggtacgccgaagctatgccgtttccactaaacttcttcttgcctgggcgaatgcagcgacagtatatggaacgtctgcagctgcttacaggtgaacacaggcccgaagatgaggaagagctagaaaaagaactgtacagagaagcaagagagtgcctgacgctgctcagccagcgcctcggatcccaaaaattttttttcggcgacgctccggcatcccttgacgccttcgtgttcagttacctggcgctgttgctgcaagcgaaattgccctctgggaagcttcaggtacacctgcgcggactccataatctctgtgcctattgtactcacatcctgagcctgtacttcccctgggacggcgctgaggtaccacctcaacggcagacccccgcaggcccagagacggaggaggagccgtatcgacgacgcaaccagatactgagcgtccttgccggacttgcagccatggtcggatatgcccttctttcgggtattgtgagcattcaacgtgctacacccgctcgtgctcccggaaccaggactttaggaatggctgaagaagatgaggaggagtag

SEQ ID NO: 230326 - DNA, 951 bp, Artificial Sequence
  Description of Artificial Sequence: Synthetic coding sequence
tgagagggaggtcaagatggcggtgcacacggcgctgtcttgctggtcaggggtcttggcgcagctgtgagcggaccagggcaacctggaagagcggacctttgtcaaatttattggtgctctaccgagggaacacaagaccagcagccgttagctgagccattccgctatccggtgagcctgggcggaacactgccggcactccggactagccacggagaagttatctccgtgccccacaagatcataacccacttaaggaaggagaagtacaacgcagattacgacctatccgccagacagggggcagacacactcgcctttatgtcactcctggaagaaaaactgctccccgtactcgttcacaccttctggatcgataccaagaactatgtcgaggtcactcgtaagtggtatgccgaagccatgccttttccattgaatttctttctgccgggtaggatgcagcgccagtacatggaaaggcttcagctcttaaccggagaacacagacctgaagatgaggaggagctggagaaagagctctacagggaggcaagggaatgcctgactctgctatctcaacggctgggcagccagaaattctttttcggggacgccccagctagtctcgatgccttcgttttctcctacttagctctcctgctgcaggccaagttaccgtctggcaaattacaggtgcatctgagaggcctgcataatctctgcgcgtactgtacccatattctgtccctgtacttcccctgggacggggctgaggtgccccctcagcggcaaacccccgcaggcccagagaccgaggaggagccctacagacgcaggaatcaaatcctgagcgttctggcgggattggccgcaatggtcggttacgccctcctgagtggtatagtgtctattcagagggcaacaccagcccgagccccaggatag

SEQ ID NO: 230327 - DNA, 1188 bp, Artificial Sequence
  Description of Artificial Sequence: Synthetic coding sequence
atgaatgggccagtggacgggctctgcgatcacagcttatccgagggcgttttcatgttcaccagcgagtccgtaggcgagggtcaccctgataagatatgtgatcagatttccgacgcagttttagatgctcacctgaagcaagatccaaacgcgaaagtcgcgtgcgagacagtgtgtaagacagggatggtcttactgtgtggggagattactagtatggccatggttgactaccagagggttgtgagagacacgatcaagcatattggctacgacgactccgcaaagggctttgatttcaagacctgcaacgttcttgttgccctggagcagcaatctccggacattgcccaatgtgtgcatttggatcgaaacgaggaggatgtgggggcaggggatcagggcctaatgttcggttatgcgactgacgagacagaagagtgcatgccgctgaccataatcctcgcacacaaactaaacgcacgcatggccgatcttaggcggtccggccttcttccttggctgagacccgatagcaagactcaggttaccgttcaatacatgcaagataatggagctgtgatccccgtgcggatccatactatcgtcatatcagtgcagcataacgaagacatcacactggaagaaatgcgccgagctttgaaggagcaggtgattcgcgctgtggtgccggctaagtatttggacgaggatactgtctatcacctccagccttccggccgttttgtcattggcggacctcagggcgacgccggtgtcaccgggagaaaaatcattgtggatacctatgggggatggggcgcacacggaggtggggctttttccggaaaagactacacgaaggtcgaccggtcagcagcgtacgcagctagatgggttgccaaaagcttggtgaaggctgggctgtgcaggagggtgcttgtgcaagtttcctacgccattggtgtggccgagcctctaagtatctcaatcttcacctacggcacatcccaaaagaccgaacgggagctgcttgacgtggttcataagaattttgacttaaggcctggagtgatcgtaagggatttggatctaaaaaaacccatttatcaaaaaactgcgtgctacgggcacttcgggcgatcagagtttccctgggaggtgcctcgcaaacttgtattttag

SEQ ID NO: 230328 - DNA, 1188 bp, Artificial Sequence
  Description of Artificial Sequence: Synthetic coding sequence
atgaatggacccgttgacggactgtgtgatcattccctgtccgagggcgtctttatgtttacttctgagagcgtcggtgaagggcatcctgataagatctgcgaccaaatatccgatgccgtgctggacgcacatcttaagcaggaccccaatgcaaaagtggcctgtgagacagtgtgcaagacaggtatggtattgctttgcggagagataacctcaatggccatggtggattatcaacgggtagtgagagatacaataaagcatattggttacgacgactctgccaagggattcgacttcaaaacctgtaacgttctggtcgctctagagcaacagtcccctgacatcgcacagtgtgtacatctggatagaaacgaggaagacgttggtgctggggaccaagggttgatgttcggatatgccaccgatgagaccgaggagtgcatgcctctgacgatcatcctggcacacaaactcaacgccaggatggcagacctgagacgtagcgggcttttaccatggctccgccctgattccaagacacaggtaacggtgcaatacatgcaggataacggagccgtgatacctgtccgaatccacactatagtcatcagcgtacagcacaatgaagatatcacccttgaggagatgcgtagggcactaaaagagcaggtgattcgggctgttgtcccagccaaatatctggacgaggacactgtgtatcacctccagcccagtggacgatttgtaattggcggaccacagggcgacgctggagtgaccggacggaaaatcatcgtggatacttacgggggatggggggcacatggcggtggtgctttttccggaaaggactatacgaaggtggataggagcgccgcatacgcagcacgctgggtggctaaatctttggtgaaggccggactctgcaggcgcgtgctagttcaagtttcatacgctattggagtcgcagaacctctctccatcagcatcttcacttacggcacctcccagaaaaccgagcgcgagttactagatgtagtccacaagaatttcgacctgcggccaggcgttatcgtgagagatcttgatttaaaaaagcccatatatcagaagacagcctgttacggtcattttgggcgatctgagttcccttgggaggtgcccagaaagctggttttttag

SEQ ID NO: 230329 - DNA, 438 bp, Artificial Sequence
  Description of Artificial Sequence: Synthetic coding sequence
gagagcgtcggcgaaggtcaccccgataagatttgcgaccagatcagcgacgcagtgctggatgcccaccttaagcaggatccgaacgccaaggtggcttgtggcttcgatttcaaaacttgtaatgtgctcgtggctttggagcagcaatctcccgatattgctcagtgtgtgcatctggaccggaacgaagaggacgtgggtgccggagaccagggactcatgttcggatacgcaacagatgagactgaggagtgtatgcccttaaccataatactggcacacaagctcaacgctaggatggccgacttgaggcggtcagggctgctaccgtggcttagacctgatagtaaaacacaagttactgtccagtatatgcaggataatggggctgtgattccggtaaggattcatacgatcgtaatcagtgttcagtag

SEQ ID NO: 230330 - DNA, 1188 bp, Artificial Sequence
  Description of Artificial Sequence: Synthetic coding sequence
atgaacggccagttgaacgggtttcacgaagcattcatagaggagggaactttcctctttacctccgaatccgtgggcgagggacaccctgacaaaatttgtgaccaaatcagcgatgcagtactggacgcgcatttacagcaagatcccgatgctaaggttgcctgtgagactgtcgcgaaaaccgggatgatattgctcgccggagagatcacgagtcgtgctgctgtggactaccagaaagtggtgagggaggcagtgaagcatattggctatgacgacagttccaagggtttcgactataaaacttgtaacgttcttgtagcactagagcaacagtcccccgatatagcccaaggagtgcatttagatagaaacgaggaggacatcggagccggagatcaggggcttatgtttggttatgccacagacgaaactgaagagtgtatgccattaacgatcgtactagctcacaagctgaatgccaagctagctgagctgcggagaaacggaacccttccttggttacggcctgactccaaaacacaggtgaccgtccagtacatgcaggatagaggagccgtgcttccaattcgtgtgcacacaattgtcatctccgtccagcatgatgaggaggtgtgcctcgacgaaatgcgcgacgcactgaaggagaaagttattaaagcggtggtcccagcaaaatacttggacgaggacacaatctaccacctgcagcccagcggcagatttgtgatcgggggaccgcagggtgacgcaggcctgacagggagaaagattatcgtggacacatatggaggatggggagcccatggtgggggagcattcagtggaaaagactacacaaaggtggaccgctcggctgcgtacgcagcccgatgggtcgccaagagcctggtgaaaggaggactatgtagacgggtgcttgtacaagttagctatgcgattggcgtgtctcaccctctgtccatatcgattttccactacggaacctcacagaagagcgaacgggagctgctagagattgtgaaaaaaaatttcgacttgcgtcccggagtgattgtgagggaccttgacctgaaaaagcccatataccagaggaccgccgcatatgggcattttggcagggattcgttcccctgggaagtgcccaagaaattgaaatactag

SEQ ID NO: 230331 - DNA, 531 bp, Artificial Sequence
  Description of Artificial Sequence: Synthetic coding sequence
atgaacggacagttaaacggcttccatgaggcttttatcgaggaaggcacattcttgttcacatccgaatccgtgggcgagggccacccagataaaatctgcgatcaaataggggatgctggcctgactggaaggaagattattgtcgacacctacggcggatggggcgctcatggcggaggtgcctttagtggaaaggattacactaaagttgatcgaagcgcagcctacgctgccaggtgggtggctaaaagtctggtcaaggggggattgtgtcgtagggttctcgtgcaggtgtcttacgccatcggcgtcagccatcctttgtccatcagcatttttcactatgggactagccagaagtccgaaagggagctgttagagatagtgaaaaagaactttgatctgcggccaggagttatcgtcagggaccttgacctgaagaagcccatctaccaaagaactgctgcttatggacacttcggaagggacagctttccttgggaagtaccaaaaaaactgaaatattag

SEQ ID NO: 230332 - DNA, 549 bp, Artificial Sequence
  Description of Artificial Sequence: Synthetic coding sequence
atggcacgcttgctatggttgctccgcggtctgaccctcggcacagctcccaggcgcgctgtgaggggccaagcaggcggtggcggaccaggaaccggacctggactgggagaggctggcagcctggcaacatgtgaactccctctggccaaatcggaatggcagaagaagctcacccctgagcagttttatgtcacccgggagaaaggtaccgagccgcctttctccggaatctacttgaataacaaggaggcaggaatgtatcactgtgtttgttgcgacagtccactgttctcctctgaaaagaagtactgttctggaaccggctggccttccttcagcgaagcacatggcacttcaggatcggatgagagtcataccggtatcctccggagacttgacacaagtctaggctccgcgagaactgaggtcgtctgtaaacagtgcgaggctcacttgggtcacgtgttccctgacggtcccggtcctaatggacagcgattctgtataaacagcgtggccctcaaatttaaaccaagaaagcactag

SEQ ID NO: 230333 - DNA, 558 bp, Artificial Sequence
  Description of Artificial Sequence: Synthetic coding sequence
atgtctgccttcaatctgttacacctcgtgactaagagccagccagtggcgcttcgtgcgtgtggtctgccatcgggcagctgccgggataagaaaaattgtaaggtggtcttctcccagcaagagttaagaaagcggctgaccccactacagtatcatgtgacccaggaaaaggggactgagtctgcctttgaaggcgaatatacccaccacaaggaccctggcatctacaaatgtgtggtatgtggcactcctctcttcaagtccgagactaagttcgattcaggatcaggctggccctctttccacgacgttattaacagcgaggctataactttcactgatgatttcagctatggcatgcaccgggttgaaacttcttgtagtcaatgcggcgcacatctagggcatatcttcgacgacgggccacggccaacgggaaagcggtattgtatcaactccgccgcactcagtttcacccccgctgatagctccggcaccgcagagggaggtagcggtgtggcctccccagcacaggccgataaggccgaactctag

SEQ ID NO: 230334 - DNA, 579 bp, Artificial Sequence
  Description of Artificial Sequence: Synthetic coding sequence
atgagccccagacggaccctgccacgccctctgtccctttgtttatctctttgtctgtgtctgtgcttagccgcagccctgggctcggctcagtccggaagttgccgtgacaagaaaaactgcaaggtggttttctcgcagcaagaactacgcaagagactgactcccttgcagtatcacgttacacaggagaagggtaccgagtccgcatttgagggggagtatacccaccacaaagaccctgggatctacaagtgcgtcgtctgcgggacgcccctctttaaatccgagactaagtttgattccgggtccggctggccctccttccatgacgtgatcaacagcgaagccattactttcaccgatgacttcagctatggcatgcaccgtgtcgaaactagttgttcacagtgtggggctcatcttgggcatatatttgacgacggacccaggccgactgggaaaaggtattgcatcaacagtgcagcattgtctttcacccccgcagatagctccggcacggcagaaggaggaagcggggtcgcaagtcctgcccaggctgacaaggctgaactttag

SEQ ID NO: 230335 - DNA, 495 bp, Artificial Sequence
  Description of Artificial Sequence: Synthetic coding sequence
atgagcgcctttaacttgctgcaccttgtaaccaagagccagccggtggctctaagagcctgtggtcttccatccggatcctgccgcgacaagaaaaactgcaaggtggtgttttcacagcaggaactgcggaaacgtctcacccccctgcaataccacgttacacaggagaagggcaccgagagtgcatttgaaggcgagtacacccaccataaagaccctggtatctacaagtgcgtggtatgtgggacccccctttttaagtctgaaacaaagttcgatagcggatctgggtggccaagtttccatgatgtcatcaatagcgaagccatcacctttactgatgacttctcttacgggatgcacagggtagaaacatcttgctcacaatgtggcgctcatctgggacacatttttgatgatggacctcgcccaaccgggaaacgctattgcattaattcagctgctctgagcttcacacccgcagactcttag

SEQ ID NO: 230336 - DNA, 558 bp, Artificial Sequence
  Description of Artificial Sequence: Synthetic coding sequence
atgtcagccttcaatctgctccatctggtcaccaagtcccagccggtggcgctccgggcttgtggcctccccagcggtagctgccgtgataagaagaattgcaaagttgttttttctcagcaagaattgagaaagcgcctgaccccacttcagtatcatgttacgcaggagaagggaacggaatctgccttcgagggcgagtatacccatcataaggatcccggtatctataagtgcgtggtttgcgggacccccttgtttaagagcgagacaaagttcgactcaggctccggatggcctagtttccacgacgtcatcaactctgaagctataactttcaccgacgacttcagctacggcatgcacagggttgagacaagttgcagccaatgtggggctcacctgggacacatctttgatgacggtccccgacctactgggaagagatactgcattaattccgcagctctgtccttcaccccagcagacagttctgggactgccgaggggggatccggcgtggctagcccagcccaggcagacaaagcagaactctag

SEQ ID NO: 230337 - DNA, 354 bp, Artificial Sequence
  Description of Artificial Sequence: Synthetic coding sequence
atgagcgcttttaacctgctacacctcgtgactaaatcgcaacccgttgcactgagagcttgcggtttaccttccggtagttgcagggataagaaaaattgtaaggtggttttctcccaacaggagctgcgtaagcggctgacccccctgcagtatcatgttactcaggagaaggggactgaaagtgccttcgagggggaatacactcaccacaaggacccgggaatctacaaatgtgtcgtgtgcggcactcccctgtttaagagcgagacaaagttcgatagcggatcaggttggcccagtttccacgatgtgataaactcagaagcaataacctttacagacgatttctag

SEQ ID NO: 230338 - DNA, 2703 bp, Artificial Sequence
  Description of Artificial Sequence: Synthetic coding sequence
atgcgcctgttcgtgtcagatggcgtccctggctgcctgcccgtccttgctgcagctggcagagctcgcggtagggccgaagtgctgatctcaacagtggggccagaggactgcgtggtcccctttctcactagaccaaaagtgcccgtcttacagctcgacagcggcaactacctattctctacctccgctatctgtcgatattttttcctgttgagcggatgggagcaggatgatctgacaaatcagtggctcgagtgggaggcaactgagctgcagcctgcactttccgctgcactgtattacctcgttgtccaaggaaaaaaaggcgaggatgtgctaggttcagtgagacgcgctcttacacatattgatcattccctttcgaggcagaactgtccctttttggccggagaaacggaatccctggctgatatcgttttgtggggagcactctatcctctgctgcaagatcccgcatatctccctgaggaactcagcgcactccactcctggtttcagacattatcgacccaggagccgtgtcagagagcagcggaaaccgtgctcaagcagcagggtgtgttagcactaaggccctacctgcagaagcagccacagccctcccccgcagaaggacgcgctgtcaccaatgaacctgaggaggaagagctggccacactgtccgaggaggaaatcgccatggcagttacagcctgggagaagggcttggagagtttacctcccctacgcccacagcagaaccccgtccttcccgttgccggagagaggaacgtgctgatcaccagtgccctgccttatgtcaacaacgtgcctcacttgggaaacattattggttgtgtcctgtctgctgatgtgttcgctagatactctcggctcagacagtggaatactctctacctctgcggtaccgatgagtacggaaccgctaccgaaactaaggccctcgaagagggattaacacctcaggagatttgcgacaaataccacattatccatgctgacatatatcgttggtttaatatttcctttgacatttttggtcggactaccaccccacagcagactaaaatcacccaggacatatttcagcagctgctcaagagaggattcgttcttcaggatactgtggaacagttgcgttgtgaacactgtgccagatttcttgctgatcgctttgtggagggcgtgtgcccattttgcgggtacgaagaggccagaggtgaccaatgtgacaaatgcggaaaacttatcaacgcggtcgagttaaagaagccccaatgcaaggtgtgtcggtcttgccccgtggttcagtcctcacagcacctcttcctcgaccttccaaaactcgagaagcgtctcgaagagtggctgggccgtacattaccagggtctgactggactcctaacgcgcagttcattacacgatcctggttgcgggatggcttgaagccaagatgcatcacccgtgacttaaagtggggaaccccagtccccctggagggatttgaagacaaagtgttctatgtgtggtttgacgccaccatcggctatctttccatcaccgccaactataccgatcagtgggagcggtggtggaagaaccctgagcaagtggatctgtaccagtttatggcaaaggacaacgtcccttttcattccctcgtctttccgtgtagcgctcttggcgctgaggataactatactctggtctcccatctgatcgctaccgagtacctgaattatgaggatggcaaattttccaaatcacgtggcgtaggcgtgttcggcgacatggctcaggacactggaatccccgctgacatttggaggttttatctgctgtacatacggccagaaggacaggacagcgccttcagctggactgatttattgctgaaaaacaattctgagctgttgaacaacttgggtaacttcataaatcgagcaggaatgtttgtcagtaagttttttggcggttacgtgccggaaatggttcttacccccgatgaccagcggttgctcgcgcacgttacactcgagctgcagcattaccaccaattactggagaaagtaagaattcgcgacgccctccgctcaatattaaccatatcaagacacggaaaccagtacatccaggtgaacgaaccatggaagaggataaaaggctctgaggctgataggcagagagccggaacagtgacaggactagctgtcaatattgccgcactgctctctgtcatgctgcagccctacatgcctaccgtcagtgcaactatacaggcccagctgcaactgccccctcctgcatgctccatactgctgacaaacttcctgtgcacgctccccgcaggccaccagatcggaacagtttcaccactgtttcagaaactggagaatgatcagatcgagtcccttcgtcaaaggttcggcggtggccaggccaagacaagcccaaaacctgccgtagtagagactgttacgaccgccaagcctcaacagatccaggccctgatggatgaagtgaccaaacaaggtaatatcgtgcgggaactgaaagctcagaaagcagacaagaacgaggtggccgctgaggtcgctaagttgttggacctcaaaaaacagcttgccgtggcagaggggaagccacccgaagcccctaaaggtaagaaaaaaaagtag

SEQ ID NO: 230339 - DNA, 1908 bp, Artificial Sequence
  Description of Artificial Sequence: Synthetic coding sequence
atggccgtcaccgcgtgggaaaaaggactcgaatcgttgccacctctaagaccccagcagaaccccgttttacccgtcgctggagaaagaaacgtactgataacttctgccctgccatatgtcaacaatgtcccccatctggggaacatcatcgggtgtgtgttatctgccgatgtctttgctagatacagccgcctgagacaatggaacaccctgtacttgtgtggcacagatgaatatggcaccgcaaccgaaactaaggcactcgaggaagggctcactcctcaggaaatatgtgacaagtatcacatcatccatgcagacatataccgctggtttaacatctccttcgatatctttggacgcaccaccaccccacaacagaccaagatcacccaggatatcttccagcagctactcaaaagaggcttcgtactgcaggataccgttgaacagcttaggtgcgagcactgcgccagattcctagccgaccgcttcgtggagggcgtctgccccttctgtggatacgaagaggctagaggagaccagtgcgataaatgcggaaagctgatcaatgccgtcgaactgaagaagccacagtgcaaagtgtgtaggtcctgtccggtcgtacagagtagtcaacacctctttctggacctccctaagctcgaaaaaagacttgaggaatggcttggacgcactctgcctggcagcgattggactccaaatgctcagttcatcactcgcagctggctcagagatggcctcaagcccaggtgcatcacgcgcgacctgaaatgggggacaccagtgcccttggagggatttgaggataaggtattctatgtgtggttcgatgcgactatcgggtatttgagcatcaccgcaaattatactgatcagtgggaacgctggtggaaaaatccagagcaagtggatctgtatcagtttatggcaaaagataacgttcccttccattccctggttttcccttgctcggctctgggtgctgaagataattacacgctggtaagtcatttgattgccacagaatatcttaactatgaggacggcaagttttcaaagagcaggggggtcggggtgttcggcgacatggctcaagacacggggatccccgcagacatttggcgcttttatctgttgtacatacggcctgaaggccaagatagcgctttcagctggacagacctgctgttgaaaaacaacagcgaactactgaataacctgggaaacttcattaacagggccggaatgtttgtctcaaagtttttcggaggctacgtgcccgaaatggtgcttactccagacgatcagagactgctggcccatgtcacactagaattgcagcactatcatcagctcctcgagaaggttcgcattagggacgccctaaggagcatcctgactataagcaggcatggcaatcagtacatccaggtgaacgagccatggaaaaggataaagggtagcgaggctgacaggcagcgcgctgggaccgttacaggcttagccgtgaatatcgccgcactcctctctgtgatgctgcagccatatatgccgaccgtttccgcaaccatccaggcccagctgcagttgccgccacccgcatgctccatcctgcttaccaacttcctttgtaccctcccagcaggccaccagatagggacagtctcccctctgtttcagaagttggaaaacgatcaaatcgagtcactgcggcaaaggtttggaggtgggcaggtgcgtaagcttaaagcggtccccagtttgcacaatagtcactctattacatccctgatctccttgagtagtccacatcctagtctcttccccagcttcgggcctgcagcatcatctctaactgtgtttctgtcttgtctgaactag

SEQ ID NO: 230340 - DNA, 1641 bp, Artificial Sequence
  Description of Artificial Sequence: Synthetic coding sequence
atgagactgttcgtctctgatggagtgcccggatgcctgccggtgcttgcagccgctggtagagccagggggcgtgccgaggttcttatcagtaccgtcggtcccgaagattgcgtcgtgccattcctcacccgccctaaagtacctgtgctgcagttggattcaggtaactatcttttctccaccagcgcaatctgcagatatttctttctcctgtcaggctgggaacaagacgacttgactaatcaatggctggagtgggaagcaaccgaactgcagccggcattgagcgccgctctgtattacttggtggttcagggaaagaagggggaggacgttcttgggtcggttagacgcgcactgacgcacatagaccactccctatctcgtcagaattgccctttcctggcaggagagactgagtcacttgccgacatcgtcttgtggggcgcactgtacccactgctgcaggacccagcatacttgcccgaggaactttctgctctgcacagctggttccaaacactctcaacacaagaaccatgccagcgagccgcagagactgtgctgaagcagcagggtgtgctggccctgagaccgtacttacaaaaacagcctcagccaagccccgctgaggggcgagcagtcacaaatgagcctgaggaggaggaactggccaccctctctgaagaagagatcgcgatggccgtgactgcctgggagaaagggctggaaagcttgcctcccttgcgaccccagcagaaccctgtacttccagtggccggagaacgaaacgtgctgattacttctgcccttccttacgtgaataacgttccccatctcggaaatatcatcggttgcgtactgagcgctgacgtgtttgcacgctacagcagactgcggcaatggaatacactatatctgtgcgggactgacgaatatggcaccgcaactgaaactaaggccttggaggagggactgacaccgcaagagatatgcgataagtaccacatcatccatgccgacatctacagatggttcaatatctctttcgacatcttcgggagaactaccacccctcagcaaaccaaaatcactcaggatatctttcaacagctcctgaagaggggattcgttctgcaggatacggtggaacagcttcgctgtgagcactgtgccaggttcctcgctgaccgctttgttgagggtgtttgtcctttttgtggatatgaggaggcccgaggcgaccagtgtgataagtgcggcaaattaattaacgcagtcgaactgaaaaagcctcagtgcaaagtctgcaggagttgccctgtagttcagtcgtcccagcacctcttcctcgacttgccaaaacttgagaagcgcttggaagaatggcttgggcgtacactcccagggtcagactggacacctaacgcccagttcattacccggtcatggttgcgggatggcctcaaaccgagatgtattacacgtgacctgaagtggggaacccctgtgcctttggaagggttcgaggataaggtgttttacgtgtggttcgacgccacaataggatacctgagtattacagctaactacactgaccagtgggaacgatggtggaagaaccccgaacagccctag

SEQ ID NO: 230341 - DNA, 1782 bp, Artificial Sequence
  Description of Artificial Sequence: Synthetic coding sequence
atgttgaggaccagcgtgctccggctgctgggcagaactggtgcgagtagactatctctgcttgaagacttcggcccacggtattactccagtgggtcactgagcgcaggcgatgacgcctgcgacgtaagagcgtactttaccacgccaatcttctatgtgaatgcagcaccccatatcggtcatctttactcagcccttctggccgatgcactctgtcggcatcggagattgcgaggacccagtacggctgccaccaggtttagcactggcaccgacgagcatggtctaaaaatccagcaggcagccgctactgccggtctcgcaccgacggaactttgcgaccgtgtctcagaacagtttcaacaactgttccaagaggccggtatcagctgcaccgactttataaggacaacggaagctcgccatcgggttgccgtgcagcatttctggggggtgttaaaatcccgagggctcctgtataagggggtctatgagggctggtactgtgcgagcgacgagtgctttctccccgaggccaaggtgacgcagcagccaggcccaagcggagattccttcccagtcagtctggagtctggccatccagtgtcgtggactaaggaagagaactatatatttaggcttagtcagttccgtaaaccattgcagcgatggctccggggaaaccctcaggcaatcactcctgaaccttttcaccacgtggtgttacagtggcttgacgaggaacttcccgacctatcggtaagccggcgtagctcccacctccactgggggatccctgtgcctggcgatgatagtcagacaatctacgtgtggctggatgctctcgtgaattatcttaccgtaatcggctatccgaatgccgagttcaagagttggtggccagctacatcgcacatcattggaaaggacatcctcaagttccacgctatttactggcccgcattcctcctgggggctggaatgtcaccccctcaaaggatttgtgtccattctcactggactgtttgtggccagaaaatgtctaaatcacttggcaacgtcgtggaccctagaacatgtcttaacaggtacaccgtggatgggtttcggtacttcctactcagacagggtgtacccaactgggattgcgactattatgatgaaaaggtggttaaattactgaactcggagcttgcagacgccctgggcggtttattgaaccgatgcactgctaagcgcataaatccttctgaaacttatcccgctttctgcaccacctgcttcccatcagagccgggactcgtgggcccaagcgtaagggcacaggctgaggactatgcactggtgtccgccgtggctacgttgccaaagcaggtggcggatcactacgataactttaggatttacaaggccttagaagccgtgagcagctgtgttcggcagacaaacggctttgtgcaaaggcatgccccttggaagctgaactgggaatctcccgtggatgccccatggttagggactgtgctccacgttgccctggagtgtctcagagtgtttggcactctgctccagcctgttacgccaagcctagccgataagctgctgtcaagacttggcgtctccgcaagcgagcgcagcctgggcgaactgtatttcttaccacgcttttacgggcacccgtgtcccttcgaaggcagaaggctgggacctgagactggactgttgttccctagattagaccagtctagaacttggcttgttaaggctcacagaacctag

SEQ ID NO: 230342 - DNA, 1563 bp, Artificial Sequence
  Description of Artificial Sequence: Synthetic coding sequence
atgcttcgaactagtgtcctgaggttattgggcaggaccggggctagccgtctctcccttttagaagacttcggaccaagatactacagcagtggttctctatccgcaggcgatgacgcttgtgacgtgcgggcttattttaccacccccatcttttatgtgaatgccgctccacatattggtcacctctattcggctctgctggcagatgccctgtgtcgacaccgccgactcagaggaccttccacagcggcaacccgcttcagcacagggaccgatgagcacggcctgaaaattcagcaggcagcggcaactgccggattggccccaacagagctgtgcgatagagttagtgaacaatttcaacagctgtttcaggaggctggcatttcctggaccaaggaggagaactacattttcaggttgtcacaattcaggaaaccacttcagcggtggctgcgtgggaatccccaagctatcactccagaacccttccatcatgtcgttctgcagtggctggacgaggagctccccgacctaagcgtttcccggaggagttcccatctgcactggggaatccctgtgcccggtgatgactcccaaaccatctacgtctggctggacgcgttggtcaactatctgaccgttataggctaccctaatgccgaattcaaaagctggtggcccgctacaagtcatattatcggtaaggatatccttaaatttcacgccatttattggccagcctttttattaggtgctggcatgagccctccacagcgaatctgtgtgcattcccattggactgtatgtggacaaaagatgtctaagtcactgggcaatgtcgtggatccgagaacatgccttaatcggtacactgtcgatggtttcaggtatttcctcctgagacagggggtcccaaattgggattgcgactattacgatgaaaaagtggtcaaactcctgaacagcgagctggccgacgcactgggaggcctgctgaataggtgcaccgccaagagaatcaacccatcagaaacctatcctgctttttgtactacgtgttttcccagtgaaccaggccttgtggggcctagcgtgcgcgctcaggccgaggattacgctcttgtgagcgcagttgcgacgctgcccaaacaggtggctgaccattacgacaatttccgcatttataaagcccttgaagcagtgagttcttgtgtgcggcaaactaatgggttcgtccagcggcatgcaccatggaagctgaactgggagtcgcccgtggacgcgccatggctgggcaccgtcctgcatgtagccctagaatgcctgagggtgtttgggacattgctccagccagtgaccccctcgttggcggacaaactgctcagtagacttggagtgtctgcctccgagaggagtcttggggagctctacttcttacctcggttctatgggcacccttgccctttcgagggccgtcgactggggcctgaaacaggtctgcttttcccgagactcgaccagagccgcacttggctagttaaggcgcatagaacttag

SEQ ID NO: 230343 - DNA, 1461 bp, Artificial Sequence
  Description of Artificial Sequence: Synthetic coding sequence
atggtggccggaatgttaggcttacgggaggagaaatcagaggaccaggacctgcagggcctgaaggacaagcctcttaaattcaagaaggtcaagaaggataaaaaggaggagaaagagggcaaacacgagcctgtgcagccttccgcgcaccactccgccgaacccgctgaagctggcaaggcagaaaccagcgaaggatcgggatctgccccagccgtccctgaagctagcgcatcaccaaaacagcgaaggtctataatccgagaccgtggccctatgtatgacgatcccaccctgcctgaaggctggactaggaaacttaagcagcggaaaagcggcaggagcgccggaaaatatgacgtgtacctcatcaatccccagggaaaagccttcaggtcaaaggtagaactcattgcttattttgaaaaggtgggagacaccagccttgacccaaatgacttcgattttaccgtcacaggaaggggctccccctctaggagagaacagaaaccaccaaaaaagccaaaaagtccgaaggcccctggcaccgggagagggcgtggtcggccaaaaggctccggcactacgagacctaaggctgccacctccgaaggcgtgcaggtgaagagggttttggagaaaagtcctggcaaacttctggttaaaatgccctttcagacctcccccggaggaaaggctgagggaggaggggcaaccaccagtacccaggtcatggttattaagagacccggacgcaaacggaaagcagaggcagatccacaggctatccccaaaaaacgcggtaggaagccaggaagcgttgtggccgctgccgcagctgaggctaaaaaaaaagctgttaaggaaagctcaataaggtcagtacaggagacggtgttgcctatcaagaagagaaagactagggaaaccgtgtcaatcgaagtgaaagaggtggtgaagcctcttcttgtgtccacgctgggggaaaaatcaggtaaaggcttgaaaacatgcaaaagcccaggcagaaagagcaaagagtcctccccgaaaggacgaagctcttcagccagctcccccccaaaaaaggagcatcatcaccatcatcatcacagtgagagcccaaaagctccggtgccgttgctgcccccacttccacccccaccgcctgagccagagagctctgaagacccgactagtccgccagaaccccaggatctgagttccagtgtttgcaaggaggagaaaatgccgcgaggtggcagcctggagtcagacggatgtccaaaagagcccgcaaagacacaaccagctgtggcgaccgcggcaaccgctgccgaaaaatacaaacatagaggagagggagagcggaaggacattgtctcatcctccatgccgaggccaaacagggaggagccagttgatagccggacccctgtcaccgaaagggtatcatag

SEQ ID NO: 230344 - DNA, 816 bp, Artificial Sequence
  Description of Artificial Sequence: Synthetic coding sequence
atggtggccggaatgctagggctgagggaggagaagtctgaggaccaggacctacagggactaaaggacaaaccgctgaagtttaagaaggtaaagaaggataaaaaggaagagaaagaaggtaaacacgagcctgtccagcccagcgctcaccacagcgccgaacctgctgaagcaggcaaagcggagactagtgaaggctcgggttctgctcctgccgtccctgaggcaagcgctagcccaaagcagaggcgaagcatcattagagatcgagggcctatgtacgacgaccctacgctccctgagggatggaccagaaagctcaagcaacggaagagcggcaggagtgctggaaagtacgatgtttatctaattaacccgcaggggaaggccttcaggtccaaagtagaactcatcgcttatttcgaaaaagtgggagataccagcctcgatccgaacgacttcgatttcactgtgacaggaagagggagcccaagcaggcgagagcagaaaccacctaagaaacccaagtcacccaaagccccaggcaccggcaggggtcgcggaagaccaaagggctcaggaactacacggcctaaggcggctacatctgagggagtgcaggtgaaacgcgtacttgaaaaaagccccggtaaactgctggtcaagatgccattccagacatccccaggtgggaaagccgagggtgggggtgcgactaccagtacccaggtgatggtgatcaaaagaccagggagaaagcgaagtcccagggcccctagaacccctcctgctccacttagcccgaggacttag

SEQ ID NO: 230345 - DNA, 153 bp, Artificial Sequence
  Description of Artificial Sequence: Synthetic coding sequence
atggtagccggaatgttaggcttacgggaggaaaagagcgaggatcaggatctacaggggctgaaggacaagcccctgaaatttaagaaagtgaagaaagacaagaaggaagagaaagaaggaaagcacgagccggtgcagccttcagcgtag

SEQ ID NO: 230346 - DNA, 1497 bp, Artificial Sequence
  Description of Artificial Sequence: Synthetic coding sequence
atggccgctgctgccgctgctgcaccttcaggaggaggcggaggtggggaagaagaaaggctcgaagagaaatctgaagaccaggacttgcagggcctgaaagacaagccgctgaaattcaagaaggtgaagaaggacaaaaaggaggaaaaagaaggcaagcatgagccggtccagccaagcgcacatcactcagccgagccggctgaagctggcaaggcggagacctccgaggggtccgggagcgccccagcggtgccggaggcctccgcctcgcccaaacagagacggagcataattagagataggggcccaatgtacgatgatcctaccctgcccgaagggtggactaggaagctcaagcagagaaagtctggcagatcagcgggaaagtatgacgtttaccttatcaaccctcagggaaaggcatttcggagcaaagttgaattgattgcttatttcgagaaggttggcgacaccagccttgatccaaatgatttcgactttacggtgactgggcgaggaagccctagcaggcgcgaacaaaaacctcctaaaaaaccaaagtctcctaaggcacctggtacaggtagggggagaggtcgcccaaagggatcgggcaccacccggccaaaggctgctaccagtgaaggagtgcaggtgaaacgcgtgcttgaaaaaagccctggcaagctgctagtaaagatgcctttccagaccagcccgggagggaaggcggaaggcggtggagcaaccacctcaacacaggtgatggtcataaaacggccaggacgtaagcggaaggccgaggccgacccccaggccatcccaaagaagaggggacgcaagccaggctccgtcgtggcagcggcagccgcagaggcaaaaaaaaaggccgtcaaggagtctagtattaggagtgttcaagaaacggttcttcctataaagaaaagaaaaaccagggagacggtgtcaattgaagtcaaagaagttgttaaacccctgcttgtcagtacacttggggagaaatcaggcaaggggctcaagacctgcaaaagtcctggacgcaaaagcaaggaatcctcaccaaaaggcaggtcgtcctccgcatcctcccctcctaagaaggagcatcatcatcaccatcaccactccgaatccccgaaagccccagttcctttactgccgccattgcctccaccacccccagagcccgagtcatcagaagatcccacgagccccccagagccgcaggatctttcctcctctgtttgcaaagaggaaaaaatgccacgcggtggctctttggagtctgatggttgtcccaaagagcccgcaaaaacacaaccagccgtggccacagccgcaacggcagccgaaaaatataagcatcgcggagagggtgaaagaaaggacatcgtctcctcatcaatgcccaggccaaatcgggaagaacctgtagacagccgcacgcccgtcaccgagcgggtgtcatag

SEQ ID NO: 230347 - DNA, 1185 bp, Artificial Sequence
  Description of Artificial Sequence: Synthetic coding sequence
atggttgcaggcatgctgggcctgcgggaggaaaagtctgaggaccaggacctgcaaggtttgaaagataaacccttaaaattcaaaaaagttaaaaaagataaaaaagaagagaaggaagggaagcacgaacctgtgcagcctagcgcacaccattcagcagagcccgcagaggctggcaaagctgagacatctgaaggatctgggagcgcccctgctgtgccagaggctagcgcctcacctaagcagcgaagatctatcatacgagacagaggacctatgtatgatgaccccactctccctgagggatggacacgtaagctgaagcagcggaaatcggggcgaagcgccggaaagtacgacgtatatctgatcaatccccaaggaaaagccttccgctctaaggtggagctaattgcttacttcgagaaagtcggcgacacctccctggatcccaacgatttcgatttcaccgttacagggaggggtagtcccagtagacgcgagcagaagccacctaagaagccaaaaagcccaaaggccccagggactggcaggggccgaggcagacctaagggttcggggacaacacgtcctaaggcagcaactagcgaaggagttcaggtgaagagagttcttgagaaaagccctggaaaattgctcgtgaaaatgccatttcagacgagccccggaggtaaggcagagggaggcggtgctacgacaagtacacaggtgatggtaatcaagcgcccagggcgtaaacgaaaagccgaggccgacccacaggccattcctaaaaaaagagggaggaaaccaggctcggtagtggcagctgctgccgcagaggcgaagaagaaagcagtcaaggagtccagcattcgtagcgtccaggaaacagtcttaccaattaagaaacgcaaaacaagggagactgtctccattgaggtgaaagaggtggtcaaacctttgctcgttagtacgctgggagagaaatcagggaaggggttaaaaacttgcaaaagcccagggaggaagagcaaggagagttcacctaagggccgttcttcttccgccagttctccacctaagaaggagcaccatcatcaccaccaccactcagaatcccctaaagccccagtacctacccgaattaaagcagccgtggtgtcgtccccctatggctag

SEQ ID NO: 230348 - DNA, 1818 bp, Artificial Sequence
  Description of Artificial Sequence: Synthetic coding sequence
atggcagaggattggctggactgccctgctctcgggccaggttggaagagaagggaggtgtttcgaaagtcgggggctacatgcggccgttctgatacatactaccagtccccaaccggagataggatccgctccaaggtagagcttacccgatacctcggccctgcatgcgatctgaccttgtttgactttaagcagggcatcctgtgctacccggctccaaaggcccatccagtcgcagtggcctccaaaaagcgcaaaaaaccgtcccggcctgcaaagactaggaagcgccaggtcgggcctcagtcaggcgaagtccgcaaagaagctcccagagacgagacaaaagcagataccgacacggctcctgccagttttcccgcaccaggatgctgcgaaaattgtggcatttctttcagcggcgatggcacccagagacagaggctaaaaacgttatgcaaagattgccgagcacagagaatagcattcaatcgggaacagagaatgttcaagagagtcggatgtggcgaatgtgctgcttgccaggttaccgaagactgtggggcttgcagcacatgtctgctccaactgccgcatgatgtcgcctctggcttgttctgcaaatgtgagcgacgcaggtgtcttcggatagtagagcggtctcgcggatgcggggtttgccgaggctgtcagacacaagaagattgcggccactgtcccatctgcttaagacctcctaggccagggttgagaagacagtggaagtgtgttcagcgcaggtgtctgaggggcaagcatgctcgcagaaagggagggtgcgactccaagatggctgcccgtcgaaggcccggagcccagcccctgccacctcccccaccaagtcagagccccgaaccaacggaacctcaccctagagccttagccccttcccccccagctgaatttatctactattgcgttgacgaggacgagcttcagccctataccaatcgtaggcagaataggaaatgcggtgcgtgcgccgcatgccttcgacgaatggattgtggacggtgtgacttttgctgcgacaagcccaaatttggcggatctaaccagaaacgccaaaagtgtcggtggaggcagtgcttgcagttcgcaatgaaaagacttttgccatctgtctggagcgaaagcgaggatggggcaggaagccctcctccatataggcgacgaaagcggcctagctctgccaggcggcatcacctcggacctaccctgaagccaaccctggccacccggacagcccagcccgaccacacacaggctccaactaaacaggaagcgggtggaggcttcgtcctgcccccacctggaaccgacttggtgttcctgcgtgagggcgcatctagtcccgttcaggtcccagggcctgtggccgcaagtactgaggcgctactgcaggaggcgcagtgctccggtctgtcatgggtggtggccctccctcaggtcaaacaggaaaaggctgacacccaggatgaatggacaccagggactgccgtcctgactagtcccgtgctggtgccaggatgtcccagcaaggccgtggacccagggttgccctctgtaaagcaagaaccacctgatccagaggaggataaggaggagaataaggatgactcggcatccaaactggcccctgaagaggaagctggaggggctgggacgcccgtgatcactgagatcttctctctcggcggaacaagattcagagataccgctgtgtggctcccccgttcaaaggacctcaaaaagccgggtgcacggaagcagtag

SEQ ID NO: 230349 - DNA, 1761 bp, Artificial Sequence
  Description of Artificial Sequence: Synthetic coding sequence
atggctgaggattggttggattgtccagcacttgggccaggttggaaaaggcgagaagtgtttcgcaaatccggagcaacatgcggacgctcagacacctattaccagtcccccaccggagatcgcattcgctctaaggtggaacttacaagatacctgggcccagcctgcgacctcacgttgttcgatttcaaacaggggatcctgtgctatcccgcaccgaaagcccaccccgtggcggtggccagtaaaaagcggaagaagccatccagacctgccaaaactcgaaaaaggcaagtgggtcctcaaagcggggaagtgaggaaagaagccccaagggacgagacaaaggctgacacagacaccgcccctgctagtttcccagctccgggttgctgcgaaaactgcggtatcagctttagtggggatggaacgcaaagacaaaggctcaagacactgtgcaaagactgcagggcgcagcggatcgcctttaacagagaacagcggatgttcaagcgtgttgggtgtggagagtgtgcggcttgccaagtgacagaggactgcggtgcttgcagcacttgtctgctgcaactgccacacgacgtggcctctggtctcttctgcaagtgtgagcggaggaggtgtttgaggatcgttgaaaggtctagaggatgcggcgtgtgtcgaggatgccagacccaggaggattgcggtcattgccccatctgcctgcgcccacccaggccagggctgagacgccagtggaagtgcgttcagcgcagatgtttgcgaggaaaacacgcaagacggaagggaggctgtgactcaaaaatggcagcgcgtcgcaggcctggggcacagcctctgcccccaccacccccaagtcagtccccagaacctaccgaacctcagccctatactaatcgacgccagaaccggaaatgcggggcttgtgcggcatgtctgcggagaatggactgtggcagatgtgacttctgctgtgacaagccgaagtttggtggatccaaccaaaagaggcagaaatgcaggtggaggcagtgccttcaattcgccatgaagcgccttcttcctagcgtatggtcagagtctgaggatggcgctggaagtccacccccttaccgcaggaggaagcgaccatcgagtgctcgtagacatcacctgggtcctacgcttaagcctacccttgctacacggactgcccagcctgatcatacgcaggccccaacaaagcaggaagctggcggaggttttgtcttgccaccgccaggcacagacctggtctttctcagggaaggggcttcatccccggtgcaagtcccaggcccagtggctgcttctactgaagcactgctccaggcagtggacccagggctgccatctgtgaagcaagagccaccagacccagaagaggataaagaggagaataaggatgattcagcctctaagctcgcacctgaggaggaagcgggaggcgctggaactcctgtgataaccgaaatcttttctctgggcggaacccggttcagggacaccgccgtatggcttccctcactgcaggggagacactccggaagggaggatggatgtaaggtgtgggagacagaggacaccgtagagcctacatcaactagttggaatccacgaggttggcccggaacccatgtttcactatcacctccgcctgcctcaatgatgtgggtgtcttgcaggagaagctggtgtcccagttctcagtcctag

SEQ ID NO: 230350 - DNA, 1653 bp, Artificial Sequence
  Description of Artificial Sequence: Synthetic coding sequence
atggcggaagattggctggactgcccagccctcggacccggttggaagcggcgagaggtgtttaggaaaagcggtgccacctgcggccgatccgatacatactaccagtccccgacgggcgaccgcattcggagtaaggtcgaactcacacggtaccttggacctgcttgcgacctcaccctgttcgatttcaagcagggtattctgtgttacccggcaccaaaagcccatcccgtggccgtggccagtaagaagcggaagaaaccttcccgtccagcgaagactcggaaacgccaggttgggccacagagcggtgaggtgaggaaagaagcgcctcgtgacgagaccaaggcagacacggacactgcccctgcttccttccccgctcctgggtgttgcgaaaattgcggcattagcttctcaggagacggtacccaacgccagcgattgaagacattatgtaaggactgccgcgcacagagaattgcattcaatcgagagcagcgtatgtttaagcgagttggttgcggtgagtgcgccgcatgtcaggtgaccgaggattgtggggcttgcagcacctgccttctgcaactcccgcatgatgtcgccagcggattgttctgtaaatgtgaacgcagacgttgcttgagaatcgttgaaagatccagaggatgcggggtttgtcggggatgtcagactcaggaagattgcggccactgtcccatttgtttgagaccacctcgccctggactccgacgccaatggaagtgcgtccagaggaggtgcctccgcggaaagcatgcccgtagaaagggcggttgtgattcgaaaatggcagccagaagacgcccaggcgctcagccactcccaccacctcctcctagtcagtctcccgaacccaccgaaccacacccacgtgcgctcgcaccgtccccaccagccgaattcatctattactgcgtcgatgaggacgagctgcagccatatacgaataggagacagaatcgcaagtgcggagcttgcgccgcttgcttaaggaggatggactgtgggagatgcgacttctgctgcgacaagcccaagttcggcggaagcaaccagaaacgtcagaaatgcagatggaggcaatgtctgcaattcgccatgaagcgactgctgccttctgtgtggtccgagtcagaagacggggctggctctcctccaccatatcgcagaaggaagcgtccatccagcgcacggcgacatcacctcggacccaccctgaagccaacccttgccacccgcacagctcaaccggaccacacacaggcccctacaaagcaggaagcgggagggggattcgtactccctccccctgggactgatctcgtcttcctgcgggagggtgccagctcccccgtccaggttccaggccctgttgccgctagtaccgaggctttgctgcaggcagtggaccccggactgccatctgtgaaacaggagccacctgaccccgaggaagacaaagaagaaaacaaagacgacagcgcaagcaagctggcacccgaagaagaggccggtggagccggaaccccagttgagcctactacacaacctcagtatagtggtaacttcgataacgacctgtacgagatttacctgatcgatatctag

SEQ ID NO: 230351 - DNA, 1650 bp, Artificial Sequence
  Description of Artificial Sequence: Synthetic coding sequence
atggctgaagactggctggattgtccagcgcttgggcctggctggaagcgaagggaggtgttccgaaaaagcggcgcaacatgtggacggtctgatacatattaccaatcacccacaggggaccgaatcagaagtaaagtggagctcaccagatatctgggccctgcctgtgatcttacgttattcgacttcaagcagggaatactctgctatcctgcccctaaggcccacccagttgccgtagcctccaaaaaaaggaagaaaccttctcggcctgccaaaaccaggaaaagacaggttggccctcagtccggagaagtgaggaaagaggcgcctagggatgagaccaaggcagatacagacactgcaccagcctcttttcctgctcctgggtgctgcgaaaactgcggcatcagtttttcaggagatggcactcagaggcaaaggctcaagactctctgtaaggactgtcgcgcacaacggatcgcctttaacagggagcagcgtatgttcaaaagagtcggttgcggagaatgtgcagcctgccaggtgaccgaagattgtggggcatgcagcacttgcctcttgcagctgccccacgatgtggcatccggcctattctgtaagtgcgaaagaagacggtgtctccgcattgttgaacggagccgcggttgtggtgtctgtcgcggatgtcagactcaagaggattgcggccactgtcctatttgtttgaggccaccacgccctggcttacgacggcagtggaaatgcgtccagcgacgttgcctgcggggaaagcacgccagacgaaagggcggatgcgacagtaagatggctgctagacgacgcccaggcgctcagccactgcctcctcccccaccatctcagagccctgagcccaccgagccccatcctagagccctagcaccatcccccccagctgagtttatatattattgtgttgacgaggacgaacttaaaaggttactcccatctgtctggtcagaatccgaggacggcgcaggttctccaccaccttaccggaggagaaagcggccaagctccgcccgtaggcatcatctgggtccgactctgaaacccacgcttgccacgcgcactgcccaaccagatcacacacaggctccaacgaaacaggaggcagggggaggcttcgtgttacccccaccaggaacagacctcgtgttcctccgggaaggcgcatctagtccagtgcaggtgcctggacccgttgccgcatcaacagaagcattactccaggaagctcaatgctccggattgtcatgggttgttgccttacctcaggtgaagcaggagaaggccgacacacaggatgagtggactcccggaacagccgtgctgactagccctgttttggtgcccggatgtcccagcaaggccgtcgaccccggactaccgtctgtgaagcaggagccgccagaccctgaagaagataaggaagaaaacaaagacgatagtgctagtaaactcgcacccgaggaggaagctgggggagccggtacccctgtgattacagagatattctctctgggaggaactcggtttagggacaccgctgtgtggctaccgcgtagcaaagacctcaagaaaccaggtgcgagaaagcagtag

SEQ ID NO: 230352 - DNA, 1512 bp, Artificial Sequence
  Description of Artificial Sequence: Synthetic coding sequence
atggccgaggattggttagattgccccgctcttggacccggatggaagaggcgagaggtctttaggaaaagtggggcaacatgtggcagatccgacacctattaccagagccctactggcgaccggattcggtccaaggttgagctgacaaggtacctgggcccagcttgtgaccttaccctcttcgacttcaagcaggggatcctttgctacccggcacccaaagcacatccggtcgccgtggcctctaagaagcgcaagaagccaagtagacctgccaaaacgcgtaagaggcaggtagggcctcagagcggcgaggtgcggaaggaggcccctcgcgacgaaaccaaggccgacacggacactgccccagcgtccttccccgctcccggatgttgcgaaaattgtggtatctccttttcgggtgacggaacccaacgtcagcgccttaagacactgtgtaaggactgtagagcccaaaggatcgcctttaatcgagaacagcgcatgtttaaacgcgttgggtgtggcgaatgtgctgcgtgccaggttacggaggactgtggcgcatgctcgacgtgtctcctgcagctgcctcatgatgtagcttccggtctgttctgcaagtgcgagaggagacgctgcctacgcattgtggagcggtccagaggttgcggagtatgccgagggtgccaaacccaggaggattgcgggcactgtcccatttgtctgcgacctcctcgccctggcctcaggaggcagtggaagtgtgtgcaacggaggtgtctgcggggtaagcacgcacgtagaaaaggaggctgcgatagtaagatggctgccaggcgccgtcccggagcccagccactgccccctccccctccttcacagagcccggagcccaccgagccacatccgagggcgctggccccttcacctcccgcagaatttatctattactgtgtggacgaggacgagttgaagagattgctccctagcgtgtggtccgagtctgaagacggcgctggaagcccacccccataccgaagaagaaagaggccctcatcagccagaaggcatcatttagggcctactttaaagcccaccctggcgacaaggacagctcagcccgaccatacacaagcacctacaaaacaggaagcgggtggaggattcgtcttgccgccacctgggaccgatctggtcttcctccgcgagggagctagttccccagttcaggtccctggaccagtcgcagcctctacagaggctctcttacaggccgtggaccctggtctgccatccgtgaagcaggaaccccctgatccagaggaggataaggaagaaaacaaggacgattccgcctctaaactggcccctgaggaggaagccggtggggctggcacccccgtcataacagagatattttctcttggcggaacccgattcagggacacagcagtgtggctgccccgatcaaaggacctgaaaaagcccggtgcccgtaaacagtag

SEQ ID NO: 230353 - DNA, 1671 bp, Artificial Sequence
  Description of Artificial Sequence: Synthetic coding sequence
atggccgaagactggctggattgccccgctctggggcctgggtggaaacgccgagaagtgtttcggaaatctggagcaacttgcggccgtagtgacacctactatcaatcccctactggggatcgcatcaggtccaaggtggaactgacgagatatctcggccctgcctgtgatctcactctcttcgacttcaagcaaggcatcctctgctaccctgctccaaaagcccatcccgtggccgtggccagtaaaaaaagaaagaaaccaagtcgaccggcaaagactcgcaagaggcaggttggtcctcagagcggtgaggtgaggaaggaagcaccacgcgatgaaacaaaggcagacacggacactgcgccagcatccttcccggctcctggctgttgcgagaattgcggcatttcgttcagcggggacggtacccagcggcagcggctaaaaacactgtgtaaggactgccgtgcgcagcggatagctttcaatagggagcagcgcatgttcaagtcccggggttgcggggtctgcaggggatgtcagacgcaggaagactgcggccactgcccaatctgcctgaggccaccaagacctgggctaagaagacagtggaaatgcgtgcagcgaagatgcctccgtggcaaacacgcccgaaggaaaggtggctgtgactccaaaatggctgcgcgtcggcgtccaggtgcccaacctctgcccccaccgccaccgagccaatcacccgaacctaccgaaccccacccacgcgctttggcaccatcgccgccagccgagttcatctactactgcgtcgacgaggacgagctccaaccttataccaatcggaggcaaaaccgcaaatgcggagcatgcgccgcttgtcttagacgaatggattgtggacgttgcgatttctgctgcgacaagcctaaatttggcggttctaaccagaagcgacagaaatgcaggtggaggcagtgtctgcagttcgccatgaagcgcctcctacctagcgtgtggagcgaatccgaagatggagccggaagcccaccaccgtaccggcgtcgtaaacggccttcctccgccaggcgacaccacctgggacctactctgaaacccactctcgctaccaggacagcccagccagatcacacgcaggcacctacgaagcaagaggccggtggaggctttgtgctcccaccaccaggtacagaccttgtgtttcttcgggaaggcgcatcatctcctgtacaggtccctggccctgtggcggcttcaacagaggccctcctccaggaagctcagtgctcaggcctctcctgggtcgtggcactgccacaggtgaagcaggagaaggccgatacacaggacgagtggaccccagggaccgctgtgctaaccagccctgtcctagtacccggatgtccttccaaggctgtcgatccaggactgccgtccgtgaaacaagaaccccctgatccagaagaagacaaggaggaaaacaaagacgactctgcatccaaactcgcgccagaagaggaagctggcggagcaggcacgccggtgatcaccgagatcttctccctcggtggcacccgattccgggacacagccgtgtggttgccccgatccaaagacctgaaaaaacccggagcccgtaagcaatag

SEQ ID NO: 230354 - DNA, 1818 bp, Artificial Sequence
  Description of Artificial Sequence: Synthetic coding sequence
atggctgaagactggttggactgccctgcgctgggcccagggtggaagcgcagagaggtgtttaggaagtccggcgctacatgtggtagaagtgacacatattatcagagccctaccggagataggattagatcaaaagtggagcttactcggtatcttggccctgcttgtgatctgacactgttcgacttcaagcagggcattttatgttaccctgccccaaaagcccatccagttgctgtagcatcaaaaaagagaaagaaaccatctaggccagccaagacacgcaaaaggcaagttggaccacagagcggggaagttcgcaaagaagcacccagggatgagaccaaggccgatacagatacggctcctgcttccttccctgcccctgggtgttgtgagaactgcggaatctcgttcagcggtgacggtacacagcgccaacggctaaaaaccctgtgcaaagattgtcgggcacagcgaattgcattcaatagggagcagaggatgtttaaacgcgttggatgcggagagtgcgcagcttgccaggtgaccgaagactgcggcgcatgctcaacctgtctcttgcagttaccccatgatgttgcctccggccttttttgcaagtgtgaacgcagacgttgtctgaggattgtggagcgcagccgcggatgcggcgtgtgccggggttgtcagacccaggaggactgcggacattgtcccatctgtctgagacctcctcggccaggtctgaggcggcagtggaagtgtgtccagcgcagatgtctgaggggtaagcatgctcgaagaaaaggcggatgcgacagtaagatggccgctaggcggagacctggggcacagccactgccccctccgcctccaagtcaaagtcctgagccaaccgagccacaccctagggccttggccccttcccccccagcggaattcatttactactgcgttgacgaggatgagttgcagccctatactaatcgcaggcaaaacagaaagtgcggagcctgcgcagcctgtttgcggcgaatggactgtggcagatgcgatttttgttgtgataaacccaagttcggcggatctaatcagaagcgacagaagtgccgctggaggcagtgtctgcaatttgccatgaaaaggctgttgcctagtgtctggtctgagtcagaagacggagctgggagtcctcctccttatcgaaggaggaagaggccttcatcagcaagaaggcaccatctaggcccaaccttaaagcccacactggccacaagaaccgctcaacctgaccatacacaggcgccaaccaagcaggaagctggaggcggatttgtcttaccccctccaggcaccgacctggtctttctacgcgagggtgcatcatccccggtgcaggtgcctggccctgttgccgcttccactgaagcactcctgcaggaggcccagtgtagtgggctttcctgggtggtggcactgccccaggtcaagcaagagaaggccgatactcaggatgagtggacacccggaacagccgtcctgacctcacccgtgctcgttcctggctgcccttctaaggccgtagatcctggcctgcctagcgtgaaacaggaaccgccagatcccgaggaggacaaggaagaaaacaaggatgactcagcctctaagttggcccctgaagaggaggctggtggggcaggaacccctgtgataacagagatctttagtctgggtggaaccagatttcgtgatacagctgtctggctccctcgcagtaaagatctgaagaaacctggggctagaaagcagtag

SEQ ID NO: 230355 - DNA, 1512 bp, Artificial Sequence
  Description of Artificial Sequence: Synthetic coding sequence
atggcggaagattggcttgactgccctgcacttgggccagggtggaagagacgcgaagtttttaggaagagcggcgcaacatgcggccgaagcgacacatactatcagagcccaactggagatcgcatccgcagtaaggtggaactgacccgctatctgggccctgcctgtgacctgactctgttcgacttcaagcaggggattctctgttacccagcaccaaaagctcaccccgtggccgtagcctccaagaaacggaaaaagccgagcagaccagccaagactcggaagagacaggtcggcccacagagtggggaagtaaggaaggaagcccctcgggatgagactaaggccgataccgacacagctcctgctagttttcctgctcctgggtgctgcgaaaattgcgggatctctttcagtggagacggcacacagaggcagcggctcaaaacattatgcaaggactgcagggcccagagaattgcttttaacagggagcagcgaatgttcaagcgtgtcggctgtggggaatgtgccgcatgtcaagtgaccgaggactgcggtgcctgtagcacatgtctccttcagctacctcacgacgtggcctccggcttgttttgcaagtgcgaaaggcgcagatgtctgcgcattgtggaaaggtcacgcggatgcggcgtatgtaggggatgccaaacgcaggaggactgcgggcactgcccaatttgcctgcgcccaccccgacctgggctgcgaaggcagtggaaatgtgtgcagagacgttgccttaggggcaagcacgcccgtagaaagggtggctgcgacagcaaaatggccgctaggcggaggcccggtgcccagcccctgcctcctccacctccatcccagtccccggagccgactgagcctcatcctagagcactggccccttcccccccagcggaattcatctactactgtgtagacgaagacgagctcaaaagactgctgcccagcgtgtggtccgagagtgaggatggcgctgggtcaccacctccttaccgcaggcgaaagcgcccaagctcagcacggaggcatcatctgggcccaacgctgaaacccaccttagctaccagaacagctcagcctgaccatacacaggcccctaccaagcaggaggctggcggtgggtttgtgctgccgccaccgggtacggacctggtgtttttacgcgaaggagcctcctcccctgtgcaggtgcccggtcctgtcgctgcgtctaccgaagccctgttacaggccgtggacccaggactgccgagcgtaaagcaggaaccacctgatcctgaggaggacaaagaagaaaacaaggacgattccgcaagcaaactcgcaccagaggaagaggcaggaggcgcaggaacccctgtcattactgaaatattctcactcggagggacccggtttcgggataccgctgtctggctgcctcggagcaaagacttgaaaaagccaggggcacgtaagcagtag

SEQ ID NO: 230356 - DNA, 1650 bp, Artificial Sequence
  Description of Artificial Sequence: Synthetic coding sequence
atggctgaggattggctggactgcccagccctcgggcctggatggaaacgcagggaggtgttcaggaaaagcggagcgacgtgtggcagatcagatacctactaccagagcccgactggagatagaatccgaagcaaagtggagctcacccgatatctgggtcctgcatgcgatttgaccctattcgactttaagcaggggatcctctgctaccctgcccctaaggcgcatcctgtcgcagtcgcttctaagaaacggaagaaaccttcacggcctgctaaaacccgcaagcgccaggtgggtccgcagagtggtgaagttagaaaggaagcccctagggatgagacgaaggcagacaccgacaccgctccggctagctttcctgccccaggttgttgtgaaaactgtggtatcagcttttctggcgacggaactcagcggcagcggctgaagaccctttgtaaggactgtagggctcagagaatagcatttaaccgtgagcagaggatgttcaaacgagtaggatgcggagaatgcgccgcatgccaagtgactgaggactgcggggcttgctcaacttgcctgctgcagttgccacacgatgtggcttctggtctcttctgtaagtgcgagcgcagacgttgcctccggatcgtagagcggtctagaggctgcggcgtatgccgcggatgtcagactcaggaagactgcgggcactgtcccatttgcttgcgtccacccaggcctggcctcaggcgacaatggaaatgcgtgcagaggaggtgcctccggggtaaacacgccagaaggaaagggggatgtgatagcaaaatggcagccaggcgcagacccggtgctcagcctctgcctcccccaccacccagccagtcccctgagcctactgagccccatcctagggcacttgcaccatccccacccgctgaatttatatattattgtgtggacgaggacgagctgaagcgtctgctcccgagtgtatggtctgagagtgaggatggggctggttctcctccaccgtacaggcgccgaaagcgacctagcagcgctcggaggcaccatctgggacccactctgaaacctacactcgctacacggaccgctcagcctgaccatacccaggcccctacaaaacaggaggccggagggggattcgtactacctccgccaggtaccgatctcgtgttcctgcgtgagggcgcttcttcacccgtgcaagttccaggccctgtagctgcctctactgaagctctgctgcaagaggcacagtgttccggacttagctgggtcgtggctcttccccaggttaagcaggaaaaagctgacacccaggatgagtggacccccggaacggcggtacttacatccccagtgctcgttcccggttgccctagtaaggctgttgaccctggcctgcccagcgtgaaacaggaaccgccagacccagaggaagataaggaggagaataaagatgattctgcttcaaaattagcccctgaggaggaggctggtggtgctggcactcctgttataacagaaatcttttctctcggcggtactcgcttcagggatacagccgtctggttgcctaggtccaaagacttgaagaagccaggggcaagaaagcagtag

SEQ ID NO: 230357 - DNA, 1818 bp, Artificial Sequence
  Description of Artificial Sequence: Synthetic coding sequence
atggctgaggattggctggattgcccagctctgggcccagggtggaagcggagggaggtatttagaaagagcggagccacttgcggaaggtccgacacctactatcagtctcccacaggcgaccgcatacggtctaaggtggagctgacaagatatctgggacccgcatgtgacttgactctatttgatttcaagcaggggatactgtgctacccagctcccaaggctcatccagtcgccgttgcctcaaaaaagagaaagaaaccatcaaggcccgctaaaacacggaaacggcaggttgggccacagtcaggggaagtgcgaaaggaggctccaagagacgagactaaggctgatacagatacggcccctgcctcctttccagcgccagggtgctgcgagaactgcggcatatccttcagcggagacggcacccaaagacagagactgaaaaccttgtgtaaggattgccgtgcccagaggattgcttttaacagggaacagcgtatgtttaaacgggtgggttgtggagagtgtgctgcctgtcaggtcactgaggattgcggcgcttgttcgacctgccttctacagctgccacatgacgttgcttcaggactgttttgcaaatgcgaaaggcggcgatgtctgaggatagtcgaaagatcccgcggatgcggcgtctgcagaggctgtcagacacaggaggactgcggacactgcccgatttgtcttcgaccgcctaggcccggtctgagaaggcagtggaagtgtgtccagaggaggtgtctgaggggtaagcatgcaagaaggaaaggaggctgtgactccaagatggctgctcgcagaaggcccggtgctcagcctctaccacccccaccccctagtcagtctcctgagcctactgagccacaccccagagcccttgcccctagccctccagccgaattcatctattactgcgtcgatgaggacgaactgcagccatacacgaatcggaggcaaaataggaagtgtggagcgtgtgcagcttgtttgcgcagaatggactgcggacggtgcgacttttgctgcgataagcctaaattcggcggtagtaaccagaagcggcagaagtgtcgttggagacagtgtctgcagttcgccatgaaacgattgttgccgagtgtatggtccgagtccgaggatggtgccggttctccacccccttacagacgcagaaaaaggcccagctctgctagaaggcatcatctgggtcctactctgaagcctacactcgcgacccgaaccgcacaaccggaccacactcaggcgcctaccaagcaggaggcagggggaggattcgtactgcctcccccagggacggatctcgtattcctccgagaaggggcttcaagcccagttcaggtcccgggtcctgtcgcagctagcactgaagcactgctccaggaggctcagtgttcagggctaagctgggtggtggctcttcctcaggtaaaacaggagaaagccgacacccaggatgagtggacacccggaacagccgtgctcacctctccagtgttagtgcctggctgtcccagcaaggctgtcgatcctggtcttccaagtgtgaagcaggaaccaccggaccccgaggaagataaagaagagaacaaggatgacagcgcttccaaactagcacctgaagaagaggctggtggggcaggaacaccggttatcactgaaatcttttcactagggggaaccagattcagagatacagcagtgtggctgccacgttccaaggatctcaaaaagcccggagccaggaagcagtag

SEQ ID NO: 230358 - DNA, 1971 bp, Artificial Sequence
  Description of Artificial Sequence: Synthetic coding sequence
atggggggtttccgcctgcgcaccggtaggaacgccgctctcaatagcgatcgcctccttctcctacctgttgcctccatggctgaggactggctggactgtcctgcgctgggtcctggatggaaacgacgggaagtgtttaggaaatccggggcaacgtgcgggagaagcgacacatactaccagtcacctaccggagaccgcattcgcagcaaggtcgagctgactcgctatctgggccctgcttgcgacctaactttgtttgacttcaaacagggcattctgtgctatccagctccgaaggctcatccagtcgccgtggcctcaaaaaaacggaagaaacccagccgtcctgcgaaaactcggaaaagacaagtgggaccccagtcaggggaggtgcgcaaagaggccccaagggacgaaacgaaagctgatactgataccgctcctgcaagctttcctgcgccaggttgctgcgagaactgcggcatcagctttagtggcgacgggacacagagacaacgattgaagaccctctgtaaagactgtcgagctcagaggatcgcgtttaatcgggaacagcgcatgttcaaacgtgtgggatgcggtgaatgcgctgcatgccaggttacggaggattgcggcgcttgtagtacctgcctcctgcagctcccccacgacgttgcaagcgggcttttttgtaaatgcgaacgcagacggtgcctgcgcatcgttgaacgttccagaggatgcggagtctgccgagggtgccagactcaggaggattgtgggcattgtccgatttgcctgagaccccctcgccctggcctgcgcagacagtggaaatgtgttcagaggcgatgcctcagacacctggcgcataggctccggagaagacatcagaggtgtcagcgtcggacgcccttggccgtggcccctccaactggtaaacatgcgaggcgcaagggcggatgcgactccaaaatggcagctcgccgtaggccaggcgcacagccactcccccctcctccaccaagtcagagtccagagccgacagaaccccatccgagagctcttgctcccagtcccccagcagaattcatttactactgcgtagatgaagacgaactccaaccttacaccaatagaaggcagaataggaagtgtggtgcttgtgccgcttgtctgaggagaatggattgcggccgatgcgacttttgctgcgacaaacctaagttcggcggatctaatcagaaaaggcagaagtgccgatggagacagtgccttcagtttgccatgaaacgcttgctgccatccgtctggtccgagagcgaagatggtgctggctcgcccccaccctacaggaggagaaagagaccctccagcgcacgtcggcaccacctcggccctacactgaagcctactttggccacaaggaccgcacagcccgaccacacccaagcccctaccaaacaggaagcaggtggagggttcgtgcttccccctcccggtaccgatttggtgtttctgagagaaggcgcatcgagcccagttcaggtccccggtccagtagcagctagcacggaggccctcttacaggaagcccagtgcagtggactatcttgggtagtcgctttgccgcaagtgaagcaggaaaaagccgatacgcaagatgaatggacgccaggcactgccgtccttacttcccctgtactcgtgcctggctgccccagtaaggccgtggacccgggattaccctcagtgaaacaagaaccacctgatccagaagaggataaggaggaaaataaggacgattccgcatctaagcttgccccagaggaagaagccggtggggctggcactcccgtaataacagagattttctctcttggcggtactagattccgggatactgccgtctggttgccaagatccaaggatctgaaaaaacctggcgctaggaaacagtag

SEQ ID NO: 230359 - DNA, 1611 bp, Artificial Sequence
  Description of Artificial Sequence: Synthetic coding sequence
atggccgaggactggcttgattgcccagcacttggacccggttggaagcggagggaagtctttcgtaaatccggcgcaacgtgcggacggtcagatacgtactatcagagccctacaggcgacagaatccggtctaaagtggagctaaccaggtatctgggacccgcttgtgacctcaccctgttcgactttaaacagggcattctgtgttacccagccccaaaggctcaccccgtggccgtggccagtaaaaagcgcaaaaagccatcccgtcccgctaaaacacggaaacgtcaggtcggacctcagagtggggaggtcagaaaggaggccccacgcgatgagacaaaagcagatactgatactgcccctgccagttttcccgcacccggttgttgcgaaaactgtggcattagcttctccggagacgggacccaacgtcaaagactgaagacactatgcaaagactgcagagcccagcggatcgcttttaatagggaacagcggatgttcaagcgagtgggctgtggcgagtgcgccgcttgtcaggtgaccgaagactgcggagcttgctccacttgtttactgcaactcccccacgacgttgcctcaggattgttctgcaaatgtgaacggaggcgctgcctccgaatagtggagcgctctagggggtgcggagtgtgcagaggatgccagacgcaggaggactgtggccattgtccaatttgcttacgcccaccgaggcccggacttcggaggcagtggaaatgtgttcaaaggaggtgcctgagaggaaagcacgccagaagaaagggagggtgtgacagcaagatggccgctcgtcgcaggcctggagcccagccactacctccgcctcccccttctcagtctcctgagcccacagagccccagccctacaccaaccggcgacagaacagaaagtgcggagcttgtgccgcatgtctcaggcgcatggactgtggccgttgtgacttttgttgtgataaacccaagttcggcggtagcaatcagaagcggcagaagtgcagatggcgtcaatgcctgcaattcgccatgaaacgcttactcccctcagtgtggagcgagtccgaggatggggctggaagcccccctccttaccggaggcgcaaacgcccttccagtgcacgccgacaccaccttgggccaacacttaagccaacacttgccacgcgaaccgcccagcccgaccacactcaagcgcctaccaagcaggaggcaggagggggtttcgttctgccgccacctgggacagacctcgtgttcctgagagaaggcgcaagcagtcctgtacaggtacctgggcctgtggccgcttccaccgaagcattgctgcaggctgtggaccccggtctccctagcgtgaaacaagagcctccggatcctgaagaggataaagaagaaaacaaagacgactccgcgtctaagttagcccctgaggaagaggccggaggtgccggtacacccgtcatcactgagattttctcactcggtggcaccagatttagggacactgcagtatggctgccgagatccaaagacctgaaaaagcccggtgcacggaaacaatag

SEQ ID NO: 230360 - DNA, 1893 bp, Artificial Sequence
  Description of Artificial Sequence: Synthetic coding sequence
atggccgaggactggcttgattgtcccgcactgggcccagggtggaaacgaagagaggtgtttagaaaatccggggctacatgcggtcgttctgatacctactaccaaagccccactggcgatcgaatcagatcgaaggtggagttgaccaggtacctgggaccagcatgtgacctcaccctcttcgattttaagcagggaatcctgtgctatccagctccaaaagcacaccccgtcgccgttgcctccaagaagagaaagaaaccatctagacctgcaaagacgaggaaacgccaggtcggacctcagtcaggagaagtgcggaaagaggcaccccgtgatgaaacaaaagccgatacggatacagctcctgcctcttttcctgcccctggctgttgcgagaattgcgggatatctttctctggggacgggacccaacggcagcgtctaaagacattgtgtaaagattgtcgcgctcagagaattgcttttaatcgcgagcaacggatgttcaagcgagtggggtgcggagaatgtgcagcttgtcaggttaccgaagactgtggcgcttgctctacatgccttctccagctcccacacgatgtggcgtctggtttgttttgcaagtgcgagcgaaggagatgtttgcgaattgtggagcgtagccgcggatgcggcgtctgccggggatgtcagacacaggaagactgcggacactgcccaatctgcctccggcctccgagacccggactccgtaggcagtggaaatgcgttcaaaggcgttgccttaggcacctggcacacaggctacggaggaggcaccaacggtgtcaaaggcggacacctctggcagtcgccccaccaacagggaaacatgctcgccgtaaaggaggctgcgattcgaaaatggccgctaggagacggccaggagcccaaccgcttccgccacccccaccgagtcagtcccccgaaccaacggaaccccatcccagggccttggcccctagtcccccagcagaattcatctactactgcgtggatgaagacgagctccagccctatactaacaggcggcagaacaggaagtgcggggcatgcgctgcatgccttcgcaggatggattgcggtcgttgcgacttttgttgtgacaaaccaaagtttgggggtagtaatcaaaagagacaaaagtgccgatggaggcagtgtttgcagttcgccatgaaacgactgctgccatccgtgtggtctgagtccgaagacggagcgggatctccaccaccttacagaagacggaaacgccctagttccgcccgaaggcatcacctcggtcccaccctgaagcccaccttggccaccaggactgcacagcctgaccatacccaggcacccactaaacaggaagcgggaggaggctttgtgctgcccccacccggtacagacttagtgtttttgagggagggcgctagctctccagttcaggtcccagggcctgtggcagctagcactgaggcactgcttcaggaggcacagtgctcaggcctgtcctgggttgtagcccttcctcaggtcaagcaggagaaggctgatactcaagacgagtggacaccgggaactgccgtgttaacctcccccgtactggtgcctggctgcccctcaaaagctgtggatccaggattgccttccgtcaagcaggagccgcctgacccggaggaagacaaggaagaaaataaagatgacagtgcatcaaagctcgctcccgaagaggaagccggaggagcgggaacgcccgtgataacagagatcttctccttaggaggtacccgtttcagggatacagccgtgtggcttccaaggtcgaaagacttaaaaaaaccaggtgccagaaagcaatag

SEQ ID NO: 230361 - DNA, 1704 bp, Artificial Sequence
  Description of Artificial Sequence: Synthetic coding sequence
atggccgaggattggctagactgccctgcccttggccctggatggaaaagaagggaggtgtttcggaagagcggcgcaacatgcggaaggtctgacacttattatcagagtccgactggcgaccgaattcgatctaaggtggaactgacacgctacctcgggcctgcttgtgaccttacacttttcgacttcaaacaaggcattctctgctatcctgcacctaaggctcaccccgttgcagtagcgagcaagaagcgcaagaaaccatcgcgcccagccaagacaagaaaacgccaagttgggcctcagtcaggcgaggtgagaaaagaagcccctagagacgagactaaggcggacaccgacaccgcgcctgcatcattccccgcaccgggttgctgtgagaactgtggcatctctttctctggagacgggacacagcgccagcggctcaagacactgtgtaaagattgccgggcacagagaattgccttcaacagagagcagaggatgttcaagtcaaggggctgtggtgtgtgtagggggtgccaaacacaggaggattgcggtcattgccctatctgtctgagacctccgcgacctggccttcggcgacagtggaagtgcgtgcagcgtaggtgcctccggggaaagcatgctcgaaggaagggaggatgcgatagtaaaatggcggcacgacgacggcctggggctcagccactcccccctccgccaccaagccagtcacctgagccaaccgaaccacacccacgcgcactcgctccgagcccaccagccgaatttatctactactgcgttgacgaggatgagctaccttatacaaatcggcgtcagaataggaagtgcggtgcttgcgctgcttgtctgagacggatggactgtggacgctgcgatttttgttgcgataagcccaagttcgggggttctaaccagaaacgccagaagtgtagatggagacagtgtctccagttcgcaatgaaacgactgttacctagcgtctggtccgaatctgaagatggcgctggctcgcccccaccttacaggaggcgaaagaggccctctagcgcaaggcggcaccacctcgggccaactctcaaaccaacactcgctacccggacagcccaacccgatcatactcaggctccgacgaagcaggaggctggtgggggattcgtacttccccctccgggtacggatcttgtctttctgcgggagggggctagctcacctgtccaagtacccggtccggttgctgcttccacggaggcactgttgcaggaagctcagtgcagtggattgagctgggtggtggctttacctcaggttaaacaggaaaaggctgatactcaggatgaatggacccctggtaccgccgtgctgacatcgcccgtgctggtgccgggttgcccgtcaaaggccgtggatcccggtctacccagcgtgaagcaagaacccccagatccggaagaggacaaagaagagaacaaggacgacagtgcctcgaaactggctccagaagaggaagcgggaggagcaggaactccggtgattaccgagattttctctctgggtggaacacgctttcgtgacacggctgtgtggcttccgcgttattaccatttagccctagactggaagtgcaattgtggctatcatctctgctgtagatccgttcttgttccttag

SEQ ID NO: 230362 - DNA, 1608 bp, Artificial Sequence
  Description of Artificial Sequence: Synthetic coding sequence
atggccgaggattggttagactgtcccgctctggggcctggttggaaacgcagggaagtgtttcgcaaatccggggcaacctgcggaagatcagatacctactaccagagccccaccggagaccgcattagatcaaaggtggaacttacacgctacttgggaccagcctgcgacttgacactcttcgactttaagcaaggtatcctgtgctatccagctcctaaggcccatccagtggcagtggccagcaaaaagcggaagaagccttcccggccagccaagaccaggaaaaggcaggtagggcctcagtctggagaggtcagaaaggaagcgccacgggatgagaccaaggctgatacagataccgcgccagccagcttccctgctcccggttgctgcgagaactgtgggatcagtttcagcggggatgggactcaaagacaaagactcaaaactctgtgcaaggactgtagggcacagcggatcgcatttaatcgggaacagcgaatgttcaaacgagtgggatgcggcgagtgcgcggcatgtcaggtgactgaagactgcggcgcttgttctacctgccttctccagcttccccacgacgtcgctagcgggctgttttgtaagtgcgagaggagaagatgtctcaggatagtcgagcgaagcaggggatgcggggtgtgtcggggttgccaaacacaagaagattgcgggcattgccccatctgccttcgccctccaaggcccggattgaggaggcagtggaaatgcgtgcaacggagatgcctgcgcggaaagcacgcccgacgcaagggaggctgtgattccaagatggctgcacgtcgaaggccaggggctcaacctctacccccaccacccccttcgcagtcccctgagcccacagaaccacatcccagggccctggccccttcgccacctgcagagttcatctactactgtgttgatgaggacgaacttaaaagactgctccccagcgtctggagtgaaagcgaggatggcgctggttcacctcccccttataggcggaggaaaagaccctcttccgccaggcgccatcatctgggtcctacgctgaagccaaccctggctacgagaacagcccagcctgatcacacgcaggctcccacaaagcaggaggccggaggcggatttgtgcttccccctcccggaaccgacctggtattcctcagagaaggagcttcctcccccgtccaggtacccggaccagtcgctgcctctaccgaggcactcctgcaggcagttgatcctggtctccctagcgttaagcaggaacctcctgatcctgaggaagataaggaagagaacaaagatgatagcgcctccaagctcgccccagaagaggaggcagggggagcgggtaccccagtcataaccgagatcttttctctcgggggaacccggttcagagacaccgccgtgtggttgcctcgggctggcactcgagaaggcaaaatggacgtgaagtgtgggaggccacggactcagtggtccccaagagctagggctgggacacatgaggacggacttgagccaatgtcggtcagccaccatctacaactgcgatag

SEQ ID NO: 230363 - DNA, 1968 bp, Artificial Sequence
  Description of Artificial Sequence: Synthetic coding sequence
atggctgaggattggcttgactgcccagccctcggtccaggttggaagcggagagaggtttttcgcaagagcggcgctacatgtggcaggtccgacacctattaccaaagcccgacaggggaccgaattcgcagtaaagtagagttgacaagatacctgggacccgcttgtgatctcaccctgttcgacttcaagcaaggcatactgtgttaccctgcccctaaggcccatccagtggctgttgccagcaaaaagagaaagaagccgtcccgtcccgcaaagacacgaaaaaggcaagtagggcctcagtctggtgaagttcgcaaagaagcgccacgcgacgagactaaagcggatactgacactgcccctgcgtcgtttcctgcccctggttgctgcgaaaactgtggaatctcctttagtggcgacggaactcagcgccaacgtctgaagacgctctgtaaggattgccgagcccagcgtatcgcattcaaccgggaacagcgcatgttcaagcgagtagggtgtggcgagtgcgccgcttgtcaggtgactgaagactgcggcgcttgtagcacttgtctactccagttgccccacgacgtggccagcggactgttctgtaagtgtgaacgcaggcgatgcctcaggattgtagaaaggagtaggggttgcggtgtctgtagaggttgtcaaactcaagaagactgcggccattgcccaatctgtctcagaccccctagacccggtctaaggcgacagtggaaatgtgtgcagagacggtgcttgcgtggcaaacacgctcggcgaaagggtggatgcgatagcaagatggccgctcgcaggcggccaggggctcagccccttccccctcccccaccctcccagagcccagaaccaactgagccccatcctcgtgctttggccccatctcctcctgctgagtttatctattattgtgttgacgaagacgagctgcagccctacactaataggcggcagaaccgtaaatgtggagcatgcgccgcatgtctgcggcgtatggactgcggacgttgtgatttttgctgcgacaaaccgaaatttggtggcagcaaccaaaagcgccagaaatgccgctggcgacagtgcctgcaatttgcgatgaaacggctactgcccagcgtgtggtctgagagcgaagatggcgcagggagcccaccaccctaccgtagaagaaagaggccctcgtctgctagacgtcaccacctgggacccacactgaaaccaacccttgcgaccagaacggctcagcctgaccatacgcaggcaccaaccaagcaggaggcagggggagggttcgttctgccaccaccaggcacagacctggtattcctgagggagggagcatcatctccagtgcaagtacccggacctgtggctgccagcactgaggccctgctccaggaggcccagtgcagcggactgtcatgggtcgtagccctcccgcaggtgaagcaagagaaggccgacacccaggacgaatggacacccggtacagcggtactgacctcccccgttttggtgcctgggtgcccgtctaaagccgtggaccccggacttccttccgtaaaacaggaacctccagatcctgaggaagataaggaggagaacaaggacgatagcgcgtccaagttagccccagaggaggaggccggaggagccggaactccagtgattactgaaattttctccctaggcggaaccagattcagggacaccgctgtctggcttcccagcctgcagggacgccacagcggtagagaagatggatgtaaggtgtgggaaactgaggataccgtggagccaacttctacatcatggaacccacgcggatggccaggtactcatgtttctctgtcccccccacccgcatcaatgatgtgggtgtcctgccggcgatcatggtgtcctagctctcagtcatag

SEQ ID NO: 230364 - DNA, 1236 bp, Artificial Sequence
  Description of Artificial Sequence: Synthetic coding sequence
atgcgcgcacatcctgggggaggcaggtgctgcccagagcaggaggaaggagagtccgcagcaggcggttccggggctggcggtgacagtgctatagagcagggagggcagggaagtgccctagctccgtcccctgtttcaggggtaaggcgggagggagcacgaggcggtgggcgaggacggggacgatggaagcaggcaggtagagggggaggcgtgtgcgggaggggacgtgggagaggtcgcggacgcggacggggaagaggcaggggcagaggccgagggagacctccttcggggggaagtggattaggaggtgacggtggaggctgcggagggggaggatcgggagggggtggtgctccacgtagggagcctgtccctttccccagcggatcagcaggtccgggaccccgtggtcctagagccacagagtcagggaagcggatggattgtcctgcgctgcccccagggtggaaaaaggaggaggtcattagaaagtcaggactcagtgctggcaaatcagacgtctactatttctcaccttctgggaagaagttcagatcgaagccgcagctggccaggtacttgggcaacaccgtcgatttatcatcattcgatttcagaactgggaaaatgatgccgtcgaaactccaaaagaacaagcagcgcctccgaaatgaccctcttaatcagaacaagggcaaacctgacctcaatacgacactgccgattcgccagactgctagtattttcaaacaacccgttacaaaagtcacaaatcatcctagcaacaaagtgaagtcagatcctcagaggatgaacgagcagcctaggcaattgttctgggaaaaaagactgcagggactgagtgcctccgacgtcacagagcaaattataaagactatggagttacctaaggggctgcaaggtgttggacctggatccaacgacgagaccctccttagcgccgtggcatcagctctacacacgagttcagctccaatcaccggacaggtgagcgccgctgttgagaaaaacccggcagtttggctgaataccagtcaaccactatgcaaggcatttatcgtgactgacgaggacatcaggaaacaggaagaacgcgttcaacaggtaagaaaaaagctagaagaggctctcatggctgatatacttagtcgggcagccgacaccgaggaaatggacatcgagatggactctggcgatgaagcttag

SEQ ID NO: 230365 - DNA, 909 bp, Artificial Sequence
  Description of Artificial Sequence: Synthetic coding sequence
atgagggcccaccccggaggcggaagatgctgccctgagcaggaggaaggtgagagtgcagccggtggttcgggcgctggcggagatagcgcaatcgagcaggggggacagggcagcgccctggctccgtcaccagtttcgggtgttaggagagagggcgctagagggggagggcgagggagggggcgatggaagcaagctgggagaggaggcggtgtctgtggcagagggcgaggacggggtcggggacgcggtcggggaaggggccgagggcgaggcagaggccgtcctccttccgggggttccggcctggggggagacggcggtggctgcggcggaggtggtagtgggggaggcggtgctcccaggagagagccggtgcccttcccctccggctcagcaggcccaggaccccgaggccctcgagctacagaatcaggcaagcgtatggactgtccggctttgcctcccggatggaagaaagaggaagtcatcaggaaatctggactcagcgccggaaaaagcgatgtgtattatttcagcccatctggaaagaaattccgtagtaaaccacagctggccagataccttggtaacaccgtggatctgtctagtttcgacttccggaccgggaagatgatgccctcaaagctgcagaagaataagcagcggctgcgcaacgatcctttgaaccagaacaaactacgctggaacacccataggcccgcaccctggcacgccctgtcaaggttgtgtctgctgattcgatgcctgctgtgcttggaatgtgcctaccctctgccactccatttggtgaacagctacagctccaaaacacaactgcactgtctgcatctttgggaggcatgtcccgcatactctagacagaaccagtcgttcccaccatag

SEQ ID NO: 230366 - DNA, 909 bp, Artificial Sequence
  Description of Artificial Sequence: Synthetic coding sequence
atgcgtgctcaccctgggggaggcaggtgctgtcctgagcaggaggagggagagtccgccgcagggggttctggggctggcggtgattccgcaatcgagcaaggcggacagggctctgccttggctcctagccccgtttctggagtaaggagggagggcgcaaggggcggaggtagggggaggggccgatggaagcaggcgggaagaggtggcggtgtgtgcggaaggggccgaggccgtggtcggggacggggtcgcggacgcggtagagggagaggcaggggcagacccccatctggaggcagcggccttgggggagacggtggaggctgcggtggaggaggcagcggcggagggggtgcgccaagacgggaacccgttccattcccaagcggaagtgctggccctggccctaggggccctagggctacggaaagcgggaaacgcatggattgccccgcactcccacctgggtggaagaaagaggaagtcatcagaaaaagcggcttgagcgcgggaaagtccgatgtatactattttagccctagcggtaagaagttccggagtaagccccagcttgcacggtacctgggtaacaccgtcgacctgagttcgtttgatttccgcacagggaaaatgatgccaagcaagctccaaaagaataaacagaggctgaggaatgacccactaaaccagaacaaactgaggtggaacactcatcgccctgccccttggcatgccctcagccgcctgtgtctactaattagatgcctcctctgcctggaatgcgcgtatccactgccccttcatttagtgaactcctactcttccaagacacagttgcactgtctgcacctctgggaagcttgtcctgcctattcccggcagaatcaatctttccccccatag

SEQ ID NO: 230367 - DNA, 876 bp, Artificial Sequence
  Description of Artificial Sequence: Synthetic coding sequence
atggagcgaaaaaggtgggaatgtcctgcgctgccccaggggtgggagagggaagaagttcccaggcgttcaggcttgtctgccggtcatcgcgacgtgttctattactccccttctggcaagaaatttagaagcaagccccagctcgcacggtatcttgggggaagtatggatctgtcgacatttgattttcgaacaggcaagatgctgatgtccaaaatgaataagagtcgccagcgtgtgcgctatgacagctcaaaccaggtgaagggcaagcctgacctcaacactgccctccctgtaagacagactgcttctatctttaagcaacccgtgacaaagattaccaaccatccgtctaataaggtcaaatcagatccacagaaggctgtcgaccaaccacgccagcttttctgggaaaagaaactgagcgggctgaatgctttcgacatcgctgaggaattggtcaagacaatggatctaccaaaggggctgcagggcgtgggacctggctgcactgatgagacgttactgtccgcgattgccagcgcactccataccagtacaatgccgatcacaggacaactgtccgctgctgtggaaaaaaaccctggagtctggttgaacaccactcaacccctctgtaaagcttttatggtgacagatgaggacatccgcaagcaggaagaattggtccagcaagtgagaaagaggctagaagaggcactgatggctgatatgctggcccacgtcgaggaacttgcaagggacggagaggcacccctggataaggcttgtgctgaagatgatgatgaggaggacgaggaagaggaagaggaggaacccgatccggacccagagatggagcacgtttag

SEQ ID NO: 230368 - DNA, 780 bp, Artificial Sequence
  Description of Artificial Sequence: Synthetic coding sequence
atggaacgaaagagtccaagcgggaagaagtttcggagcaaaccgcagctggcgcgttatctgggcggatccatggacctctccacctttgactttaggactggtaaaatgctaatgagtaaaatgaataaaagtagacagcgagtccgatacgactcgtccaatcaggtgaagggaaagccagatttaaacacagccctacccgttaggcagaccgcctccatcttcaaacagccggtgacgaagatcactaaccaccccagcaacaaggtgaaaagcgacccgcaaaaagccgtggaccagccgcgacagcttttctgggagaagaagctctccggtttaaacgccttcgatatcgccgaagagctggttaaaaccatggacctgccgaagggcctccagggggtgggcccaggttgtaccgacgagacgttactgtccgccatcgcctcagcactgcatacttccactatgcccattacagggcaattgtccgccgctgtcgaaaagaatcccggagtctggcttaatactacacagccgctgtgcaaagcctttatggttactgacgaagatatcagaaaacaagaagagctagtccaacaggtgcggaagcggttggaggaggccctaatggccgatatgctggctcatgtagaggaattggctagagatggagaagccccactggataaggcttgcgccgaagacgacgatgaggaagacgaagaggaagaagaagaggaacctgaccctgatccagaaatggaacacgtgtag

SEQ ID NO: 230369 - DNA, 4485 bp, Artificial Sequence
  Description of Artificial Sequence: Synthetic coding sequence
atgaacggcggaaaagagtgcgatggaggagataaagaagggggactccctgcgattcaggtgcccgtgggctggcagcgacgagttgaccagaacggtgtgctttacgttagtccttccggtagcctgctttcctgtctggaacaggttaagacttacctgctgacagacggtacgtgtaagtgcgggctggaatgcccattaatcctgccaaaagtttttaactttgacccaggcgctgccgtgaaacagcgcacagcggaggacgtcaaggctgacgaggatgtaactaaactgtgtatacacaagaggaagatcattgcagttgccaccttgcacaagtcaatggaggcgcctcacccctctctagtcctcacatccccgggaggcggaacaaatgctacccctgtggtcccctcccgggctgctacacccagatcagtccgaaacaagagccatgaagggattactaattcggttatgccggaatgtaagaatccatttaagttgatgattgggtcatccaatgctatgggcagactgtatgttcaagaactgcctggctctcagcagcaggaactgcatccagtgtatcccaggcaacgccttgggagttccgagcacggacagaaatctcccttccggggtagtcatggcggattgccctcaccagctagctcggggtcccagatatacggggacggatccattagccctcggacagacccactgggttcccctgacgtttttacacgcagcaatccaggattccatggggctcctaatagtagtcccatacaccttaatcggacacccctgtcgccaccatctgtcatgttgcacggctctccggtccagtcatcatgtgctatggctggcaggacaaatatccctcttagccctaccctgacaactaagtctcccgtgatgaaaaagcctatgtgtaacttctccacaaatatggaaattccccgagccatgtttcaccataaaccgccacaggggccaccgccacctccaccaccaagctgcgccttacagaagaaaccgctgacgtccgaaaaagaccctctcgggattcttgatcccatcccaagtaaacccgttaatcagaaccctgtaataataaaccctacctctttccacagcaacgtgcacagccaggtgcctatgatgaacgtctcgatgcctcccgctgttgtgcctttaccctcaaacttacctctgcccacagtgaagcccggacacatgaaccacggaagccatgtgcagcgcgtgcagcacagtgcatccacctctctttcaccgtcccctgtgacatcacccgtgcatatgatgggaactggaatcggtcggattgaggcatctccacagcgcagtagatcctctagcacgtcttcggaccatggtaactttatgatgccacctgtcggcccacaggctacctccagtgggatcaaagtgcccccaagaagtcccagatctactatcggaagccccaggcctagtatgccttcatccccatccactaagagcgatgggcatcatcagtacaaagatataccaaaccccctaatcgctggaatcagtaatgtccttaacacgccctcctctgcagctttcccaaccgcatccgccggttcctcatccgtgaaaagtcagccaggccttctaggtatgcctctaaaccaaattctgaaccagcacaatgcagctagcttccccgcttcctctctgctgtccgccgctgctaaggcacagttagcaaatcagaacaagctggccggtaacaactcttctagcagtagtaatagtggcgcagtcgctggctctggcaataccgaaggccactcgactctgaatactatgtttcctcccactgcaaacatgctgctccccacgggggaaggccagagtggcagggccgcattgcgggataagctcatgagtcagcaaaaagacgcgttgcgcaagagaaagcagccacctactacagttctctctttgctgagacaaagccaaatggacagctccgcagtccctaagccgggacctgatttgttacggaagcaggggcagggcagcttccctattagttcgatgtcccagctgctgcagtccatgagttgccagtccagccatctgtctagcaattcgacacctgggtgtggcgcttcgaataccgccctgccttgttctgcaaaccagcttcacttcactgaccccagcatgaacagctccgtgttgcaaaacatccccttgcgcggagaggccgtgcactgtcataacgctaacactaactttgtgcacagcaattcacctgtcccaaaccatcaccttgccggtctgatcaaccagatccaagcatcaggcaactgcggcatgctgagtcagagcggcatggctctgggaaactctctccaccctaacccccctcaatcaaggattagcactagctcaactccggtcattccaaattccatagtgagcagttacaatcagaccagtagcgaagcaggcggttctgggccttcaagttccatcgcaatcgccggtaccaaccatcccgcaatcacgaagaccacctccgtgttgcaggacggggtgatcgttaccaccgcggctggaaacccactgcaaagccagctccctattggaagtgacttcccatttgtcggtcaagaacacgcactgcacttccctagcaacagtacttctaacaaccacctgccacatccactgaacccttcactcctgtccagcctgccaatatccttaccagtcaatcagcagcatctactgaatcaaaatctgttgaatattctgcaaccgtctgcaggcgaaggagacatgagtagtataaacaacaccctatctaatcatcagcttacacatctccagtctctgcttaacaataatcagatgttccctccaaaccagcagcaacagcagctgctccagggttatcaaaatctgcaggcgtttcaaggccagtctaccattccatgcccagcaaacaacaacccaatggcttgcctcttccaaaacttccaggtacggatgcaggaagatgccgctctccttaataaaagaatctccacacaaccaggcctaaccgctctccccgaaaacccaaacactactctgccacccttccaggacactccctgtgaattacagccacggattgatcccagtcttggccagcaagtgaaggacggtctcgtcgtgggcggaccaggcgacgcatctgtggatgcgatctataaagctgtggtggatgccgctagtaaggggatgcaggtggtgattaccaccgcagtaaactccactacccagatcagtcctatccccgcactctccgcgatgtctgcattcaccgctagtatcggagacccactcaatttgtccagcgccgtgtctgccgtcattcatgggagaaacatgggaggggttgaccatgacggtcggctgagaaattcacgtggcgctaggctccctaaaaatctggatcatgggaagaatgtgaacgaaggtgatggctttgaatatttcaagagcgcctcctgccacacctctaaaaaacaatgggacggagagcagagtcccagaggagaaagaaacagatggaaatatgaggagtttctagatcacccaggccacatacactcaagcccctgccacgaacgccctaataatgtgtccaccctgccttttttgcccggagagcagcacccaattctgctgcccccacgcaattgccccggagacaaaatactggaagagaacttcaggtacaataactacaagcgcactatgatgagctttaaagagcgtctggaaaacactgtcgagagatgtgctcacatcaatggcaataggccccgacagtctagagggttcggggagctcctgagtacggcaaaacaggatttggtcctcgaggaacagagcccatccagtagtaacagcctggagaactctctggtcaaggactacatacattacaatggagatttcaacgccaagtcagtcaacggctgcgtgccttctccctctgatgcaaaatcgatcagttcggaggacgacctaagaaaccccgatagccccagcagtaacgagttaattcactataggcctcgaactttcaacgtgggggatctggtgtggggtcaaatcaaggggctcacctcctggcccggaaaactagtgagggaggacgatgtgcacaacagctgccagcagtccccagaggaagggaaagtggaacccgagaaattgaaaacccttactgaaggtcttgaggcctattcccgggtgcggaaacggaacagaaaaagcggtaagctgaataatcatctggaggcagctatccatgaagccatgagtgaactggataagatgtctggtactgtccatcaaatcccgcagggggataggcaaatgcgaccgccaaaacccaagaggaggaagatcagtagatag

SEQ ID NO: 230370 - DNA, 2178 bp, Artificial Sequence
  Description of Artificial Sequence: Synthetic coding sequence
atggccgcagcatctgcagtttctgtgcttttggtggccgctgagagaaatcggtggcatcgactaccgtccttgctcctgccgccacgcacctgggtatggcgacaacgaactatgaagtacaccacagcaactgggagaaacatcaccaaggtgctgattgcaaaccgcggtgaaattgcttgccgcgtaatgcgcaccgccaaaaagttgggggtgcagacagtcgctgtatacagcgaggcagatcggaactctatgcatgtcgacatggccgacgaggcctattccatcggccctgcgcctagtcaacagtcctacctgtccatggaaaagatcattcaagtggccaaaacatctgcagcccaggccatacacccaggttgcgggttcctctctgagaacatggagtttgcagagttgtgtaagcaggaagggattatcttcatcggcccaccaccaagcgccattagggacatgggcattaaatcaacatccaagtccatcatggctgcagctggagtgccagtggttgaaggctaccatggcgaggaccagtcagatcagtgcttaaaagagcacgctcgcagaatagggtatccagtgatgatcaaggccgtgcggggtggagggggtaaaggcatgcgaattgttcggtccgaacaggagttccaggagcaattggaatcagcaagaagggaggccaagaaatcattcaatgacgacgccatgctgattgaaaagttcgtggatactcctcggcacgtggaagttcaagttttcggcgaccatcatggaaacgccgtgtacctcttcgagcgtgattgctctgtacagcggaggcatcagaagataatagaggaagcgccagcgcctggcattaaaagcgaagtgaggaaaaaactgggcgaggctgccgtgcgtgcggctaaggctgtcaattacgtgggcgctggcacagtggaatttatcatggattctaaacacaacttctgcttcatggagatgaatacccgtttacaggtggaacaccctgttaccgaaatgattacaggcacagacttagttgaatggcagttacgtatcgctgctggcgaaaaaatccccttgtcccaggaggagatcacacttcaaggacatgcctttgaggcaagaatttatgccgaagatccctccaacaattttatgcccgtggctgggccacttgtgcaccttagtacacccagagccgacccgtcgacaagaattgagacaggagtgcgccagggtgatgaagtgtccgttcattacgatccaatgatcgcaaaactcgttgtttgggctgcagacagacaggctgccctgaccaagctgcgctactcactgcgccagtataacatagtgggactgcacaccaatattgactttctcttgaacctgtccggccatccagagttcgaagccggtaacgtccatacagacttcatccctcagcatcataaacagttgctcctgtcaaggaaagccgcagcaaaggagagcctttgccaggccgctctagggcttattcttaaggagaaagcaatgaccgacacattcactttgcaggcccatgaccaattttccccgttctcaagtagctcaggcagacgcctgaacataagttacaccaggaacatgacgctgaaggatggaaaaaataacgtggccatagctgtgacatacaaccacgacgggtcctacagtatgcagattgaggacaagactttccaggttcttggcaacctgtatagtgaaggcgactgcacatatcttaaatgtagcgttaatggagtggcaagcaaagcaaagctgatcattctggaaaatacaatatatctgttttcaaaggaaggctccattgagattgatatcccagtcccgaaatatctctcctcagtttcaagccaggaaacccaaggaggcccacttgctcccatgacaggcacgatcgagaaggtcttcgtcaaagcaggagacaaggtcaaagccggagattcactgatggttatgatcgcaatgaagatggagcatacgatcaagtccccaaaagacggcacagtgaaaaaagttttctaccgcgagggggctcaggccaatagacatacgcctctcgtcgaattcgaagaggaggagtccgataagagggagtcagagtag

SEQ ID NO: 230371 - DNA, 1728 bp, Artificial Sequence
  Description of Artificial Sequence: Synthetic coding sequence
atggagaagatcattcaggtcgccaagacttcggctgcgcaacacattcagtccattatggcagccgctggagtgcctgttgtcgaaggctatcacggcgaagatcagtctgatcagtgtctgaaagagcacgccaggagaataggctatcctgtgatgattaaggcagtcaggggcggagggggtaaaggaatgagaatcgtgcgaagtgaacaggagtttcaggaacagttggaatcggcacggcgtgaggcaaagaagtcttttaacgatgacgcaatgctcatcgagaagttcgtggacactcccagacatgtggaggtgcaagtgtttggggaccaccacggcaatgccgtttatctttttgaaagagactgctctgttcaaagacggcatcagaagataattgaggaggcgccagctcctggaatcaaaagcgaggtgaggaaaaaactgggagaggccgcagtgcgagccgctaaggcagttaattacgtgggggctggcaccgtggaatttataatggactctaagcataatttttgcttcatggagatgaacactagactgcaagttgaacaccctgtcactgaaatgatcacaggcacggacctcgttgaatggcaactccgcatcgcagccggtgagaagattcctctgtcccaggaggaaatcactttacagggccacgctttcgaggctaggatttacgcagaagatccatcgaacaactttatgcctgtggcgggaccgcttgtccacttgtccacacctcgggcagatccttccaccagaattgaaaccggtgtgaggcaaggggacgaagtgagcgtgcactatgatcccatgatagctaagctcgtggtctgggccgctgacaggcaggccgctttaaccaaactgcgatactctctgcgacaatacaatattgtgggtttgcacactaacatagattttcttcttaatctcagtggccatcctgagtttgaggccggaaacgtgcatactgactttatcccccagcaccacaagcagctgctcctgtctcgcaaagcggctgcaaaggagagcctgtgtcaggcggctctgggcctgatcttaaaggagaaggccatgacagatacctttacactgcaggcccacgatcaatttagcccattcagctcgagtagtggcagacgactgaacatcagctatactagaaacatgaccctgaaggacggtaaaaataacgtggccattgctgtgacgtacaatcatgatgggagttacagcatgcagatcgaggataaaaccttccaggtgcttggcaacctgtactctgaaggcgattgcacgtacctgaaatgttctgttaatggtgtggcaagcaaggccaaactgattatcctcgagaacacaatataccttttttctaaagagggatctatcgagattgatattcctgtacctaagtacctaagctccgtatcatcccaggagactcaggggggtccactggcccctatgactggtacaatagagaaagtgttcgtcaaggctggggataaagtgaaggccggagatagtttgatggttatgattgcaatgaaaatggagcataccatcaagagtcccaaggatggaactgtcaagaaggttttttaccgggagggagcccaggccaataggcacacaccactggtcgagttcgaagaggaggaaagcgataaaagagagagcgaatag

SEQ ID NO: 230372 - DNA, 1425 bp, Artificial Sequence
  Description of Artificial Sequence: Synthetic coding sequence
atggcagccgctagtgcagtttctgtgcttctggtggcagctgaaagaaaccgctggcaccgactcccgtcactgttattgccccctcgaacatgggtgtggcgccaaagaaccatgaaatatacaactgccacagacgaagcgtatagtatcggacctgctccatcgcagcaatcctacctctctatggaaaaaattatacaggtcgccaagacgtctgcagcacaagcaattcacccaggatgcgggttcctcagcgaaaacatggagttcgcagaactgtgtaagcaggagggcatcatatttataggccctcctccctctgcaattcgtgatatgggtatcaagtccacatctaaatcaataatggcagctgccggagtgcccgtggttgagggatatcatggcgaagatcagagtgatcagtgtcttaaagaacacgctcgccgaattggctacccggtgatgattaaagccgtcagagggggagggggtaagggcatgcgaatcgtgaggagtgaacaggagttccaggagcagctcgagagcgcacggagagaggccaagaagtctttcaatgatgacgcgatgctcattgagaagtttgtagacacacccaggcatgtggaagtccaggtgttcggggaccatcatggaaacgctgtgtatcttttcgaaagggactgcagtgttcagcgaaggcatcagaagatcatcgaagaagccccagcccctggaattaagtcggaagtgcgtaagaaactcggggaggcagctgtgagagctgcgaaagctgttaactatgtcggcgcagggacagtggagttcatcatggacagcaaacacaatttctgttttatggagatgaatactcgcttgcaggtggagcatccggtgaccgaaatgattacaggaacagacttggtggagtggcaactccgtatcgcggcaggggagaagatccccttgtcacaggaggaaataaccttacaaggccacgcttttgaagccagaatttacgcggaggacccgagtaataactttatgccagtcgctgggcctctggtacatctctccacaccacgtgctgatccctcaactagaatcgagacaggggtgcgccagggcgacgaagtatctgtacactacgacccaatgatcgccaagctggtggtgtgggccgcagaccgccaggctgcattaaccaaattgaggtactctcttcgtcagtacaatatagttggtctacataccaacctgacctcatactctacctgtctcgccacgcagtcgctgaaacttggtacatgcacccttatatcgagcctgaatactaccaatagctgctgcagcgtgggtagactgcagccaaaatcactctatgcaagacagccttgggtgtcatcttctaggcggaagccatag

SEQ ID NO: 230373 - DNA, 1281 bp, Artificial Sequence
  Description of Artificial Sequence: Synthetic coding sequence
atggagtttgctgagctctgcaaacaagagggcataatcttcatcgggcctccaccctccgccatccgagatatggggattaagtccacatcaaagagtatcatggcagctgccggtgtgccagtggttgaaggctatcacggcgaggaccagtctgaccagtgcttgaaagaacatgcccgtagaatcggctaccccgttatgatcaaagctgtcagaggaggcggagggaaggggatgaggatagtgagatccgagcaggaattccaggagcagctcgaatccgcaagacgggaagcaaaaaaaagcttcaacgatgatgcgatgctgatagagaagttcgtggatacacctcggcatgttgaggtccaggtgttcggcgaccaccacggcaacgccgtgtacctctttgaacgggactgttccgtacaacggagacatcagaaaatcattgaggaagcgcctgctcctgggatcaagagcgaggtgaggaagaagctgggcgaggcagctgttcgggctgccaaggctgtgaattatgtaggagccggaacagtggaatttatcatggatagcaaacacaacttctgttttatggagatgaatacgcgcttgcaggtggaacatcctgtgactgagatgattacaggaacagaccttgtggagtggcagttgcgaattgcggctggagagaaaattccgttaagtcaagaagaaatcactctccaggggcacgctttcgaggcacggatttacgccgaagatccctctaacaacttcatgcccgtggcaggacctctggtccatttgtctacgcccagggcggatccgtccacccgcattgaaaccggggttaggcagggggatgaggtttccgtgcattacgacccaatgattgccaagctggtagtgtgggccgcagaccgccaagccgctttgacaaagttacggtacagcctgcggcagtacaatatcgtaggattacacactaacatcgatttcctgctgaacttgagtggtcatcccgagttcgaggccggaaatgtgcacacggacttcattcctcagcaccacaagcagctcctcttatctagaaaggcggctgccaaggagagcctgtgccaggccgctctcggactcatacttaaggaaaaagccatgacggacacattcactctgcaggcacacgaccagttttcccccttctcgtcctctagcggtcgcaggctgaacatctcatacacaagaaacatgaccctgaaagatggaaagaataattag

SEQ ID NO: 230374 - DNA, 603 bp, Artificial Sequence
  Description of Artificial Sequence: Synthetic coding sequence
atggagaaaattattcaggttgcgaaaacatccgcggctcaggccattcacccaggctgtggattcctgagcgagaacatggaattcgcagaattgtgtaaacaggaaggcatcatttttatcggaccaccacctagcgctatacgggatatggggatcaagagtacttctaaatctatcatggctgccgctggcgtccctgttgtcgagggatatcatggcgaagatcaatccgaccagtgcctcaaagagcatgcaagacgaattggctaccctgtgatgataaaagccgtccggggagggggaggcaaggggatgagaattgtgagaagcgagcaggagttccaggagcagctcgagtccgctcgcagggaggctaaaaagtcctttaatgacgatgctatgctgattgagaagttcgtcgacactccacgacatgtggaagtccaggtgttcggcgatcaccatggcaatgccgtgtatttgtttgaaagagactgcagcgtccaaaggcgacatcaaaaaataatagaagaggctcctgccccaggcatcaagtctgaggtgcgcaagaagggaaggtcctgctcccagtcgtgttag

SEQ ID NO: 230375 - DNA, 1578 bp, Artificial Sequence
  Description of Artificial Sequence: Synthetic coding sequence
atgtgggcagtcctgcggctcgcgctgcgtccatgtgccagagcatccccagcaggacccagagcctaccacggagacagtgtggcgtctctagggacccagccagatctaggatccgccttgtaccaagaaaattacaagcagatgaaggcattagtaaaccagctccatgaaagagtggagcatatcaagttgggaggtggggagaaggcccgtgccttgcatatttcaaggggcaagctgctgccgagggagcgcatcgataaccttatcgacccaggctccccatttcttgagctgagccaattcgcagggtaccagctgtacgacaacgaggaagtgcccggaggtgggataattaccggcattgggcgagtctcaggtgtcgagtgtatgatcatcgctaatgatgcgacggtgaaaggcggagcatactaccctgtaactgtgaagaaacagctacgggcacaggagattgccatgcagaaccgactgccctgtatttatctggtagattcaggcggagcatatctgcctagacaagccgacgtttttccggatagagaccacttcgggcgaaccttctacaatcaagccattatgagttctaagaatatagctcaggtgaaggccgctactggcgaggaagtgtcagccgaagacctcgggggtgctgatctacattgtcggaagtccggggtgagcgatcattgggccctggatgaccatcatgcccttcatctgacacgaaaggtggtccggaacctgaactatcaaaaaaaacttgatgtcacgattgagccgagcgaggagccgctctttccggctgacgaactctatggtatcgtgggcgctaatttgaaacggagcttcgatgtgcgtgaagtgattgctagaatcgttgatggcagcaggtttacagaatttaaggccttctacggcgatactctcgtcacagggtttgctaggattttcggatatcccgtgggaatcgtcggaaacaacggtgtactgttctccgagtcagcaaaaaaaggaacccatttcgtccagctctgctgtcaaagaaacatccctcttctgtttctgcagaatattaccggatttatggtgggcagagagtacgaggcagagggcatcgcaaaggatggggctaaaatggtcgccgctgtcgcttgcgcccaagtccccaaaataacccttatcattggcggaagctacggagctggtaactacggcatgtgcggtcgagcatattcacccaggtttttgtacatctggcctaatgcccgaatctcagtaatgggcggagagcaggccgcaaacgtccttgccactatcaccaaagaccagcgggcacgggaaggcaaacagttcagtagcgcagatgaggcagctcttaaagagcctattattaagaaattcgaggaagaagggaatccatactactccagtgcacgagtttgggacgatggaataattgatcccgcagatacgcgactcgtgctcggcctatcttttagtgccgcactcaatgcccctattgagaagaccgatttcgggatcttccgcatgtag

SEQ ID NO: 230376 - DNA, 1692 bp, Artificial Sequence
  Description of Artificial Sequence: Synthetic coding sequence
atgtgggccgttctgcgcctggctttgaggccctgcgcaagagcgagtcctgccggtcccagggcttaccacggcgattcagtggcttccttagggacgcaaccggatctcggttccgccctgtatcaggagaattacaagcagatgaaggctctggttaatcagctgcacgagcgtgtcgagcatatcaagttgggcggaggcgaaaaggctcgagcgctgcacatcagcagaggcaagctattgcccagggagagaatcgacaatctaattgatcccggaagtccgttccttgagctgtcccagttcgcagggtatcaactgtacgataacgaggaggtgccaggaggaggaatcatcacaggcattggtcgggtctccggggtggagtgcatgattatcgcaaatgacgctacggtgaagggaggcgcatactatccggtgaccgtaaagaaacaactgcgggcacaggagattgctatgcagaatcgactgccatgtatctacttagtcgattccggaggagcctacctgcctcggcaggccgacgtgtttcctgaccgcgaccacttcggaagaaccttctataatcaggcaataatgagctcaaaaaatatcgctcagattgccgtcgttatggggtcctgcacagctggcggtgcctatgtgccagcaatggccgacgagaatataatcgttcgtaagcagggaaccattttcctcgccggacctcctctggtaaaggccgcaacgggagaggaggtgtctgcagaagacctgggtggtgctgatctgcactgcaggaaatctggagtgagcgaccactgggccttagatgatcaccatgcgctgcacctgacccggaaagtcgtgagaaacctgaactatcagaagaaactcgacgtgacaattgaaccgtccgaagagccactgttcccagccgatgagttgtacggaattgtgggggctaatctgaaaagaagcttcgacgtgcgggaagttattgctaggatcgttgacggctccaggttcaccgaatttaaagctttttacggggatacactggtcactggcttcgctcggatctttggctatccagttgggattgtaggcaataacggcgtcttgttctcggaatctgccaaaaagggaacgcactttgtgcaactgtgttgtcaacgtaatatccccctgctcttccttcagaacataaccggctttatggtgggaagggagtacgaagctgaggggattgctaaagatggcgcaaagatggtagctgccgtggcttgcgcccaggtccctaagataacactcattattggtggtagttacggcgctggaaattacggcatgtgcggcagagcttacagtcccagatttctgtacatctggccaaatgcgcgaatctctgtgatgggcggagaacaggctgcaaacgtgcttgcaactatcaccaaggaccaacgagcaagggagggcaaacagttctctagtgccgatgaagccgcactgaaggagccaatcatcaagaagttcgaagaggaagggaatccttattacagcagcgccagagtgtgggatgatgggataatagaccctgcggacactcgactggttctgggactttccttcagcgcagcgctgaatgcacctatcgagaagaccgattttggcattttccgcatgtag

SEQ ID NO: 230377 - DNA, 870 bp, Artificial Sequence
  Description of Artificial Sequence: Synthetic coding sequence
atggctaagcacatccaaaaagagattcagaggggcgttgagtcgtgggtctcgctcggcaaccggaggccgcacctgtccatcattcttgtcggggataacccagcgtcccatacttacgtaaggaacaagatacgggctgcaagcgccgtcgggatttgcagcgagttaatattgaagccaaaggacgtctcgcaggaggagctactggatgtgaccgaccagctgaatatggaccccagagtatccggaatcctggttcaattaccactccctgaccacgtcgacgagcgcactatctgtaacgggatcgctccggagaaagatgtggacggttttcacataatcaatattgggagactgtgcctcgaccagcatagcttgattcctgcaactgcctccgccgtatgggagatcatcaagcggacgggcatccaaactttcggcaaaaacgtggtcgtggccggtaggtcaaagaacgtgggtatgcctatagccatgttactgcatacagacggggagcatgagagacccggaggtgacgcaactgtaactatcgctcacagatacacaccgaaagaacaattaaaaattcacacccaactggccgatattattatcgtcgccgctgggatccctaaactaattacatcggatatggtgaaagagggtgccgctgtgatagacgtgggaatcaactacgtgcatgaccctgtcaccggaaagaccaagctcgttggcgacgttgacttcgaagctgtgaaaaagaaagccggatttataactcccgtgccaggcggagtcggtcctatgactgtggctatgctgctaaaaaacacactcctcgctgctaagaagatcatctattag

SEQ ID NO: 230378 - DNA, 672 bp, Artificial Sequence
  Description of Artificial Sequence: Synthetic coding sequence
atggctaaacacatacagaaggagatccagaggggagtggagagctgggtgagcttgggaaaccgacggcctcacctttccatcatcctcgtcggtgacaatcccgctagtcacacttatgtgcgtaacaagatccgagccgcttcagcagtgggtatttgttcagagcttattctgaagcccaaggatgtctctcaagaagaattgctggatgtgactgaccaacttaatatggacccaagggttagtggcatcctggtacagcttcccttacccgaccatgtggacgagcggaccatctgtaacgggattgcccctgagaaggacgtggatggtttccatattattaacattggtagactttgtctcgaccaacattcactgatccccgcaacggcaagcgcagtttgggagattattaagcgcactgggattcagacgttcggcaagaacgtggtcgtggctgggaggtccaaaaatgtgggtatgccaatcgctatgttactccacaccgacggcgaacacgagcgtcctggcggtgacgccaccgtgaccatagcacatagatacacccccaaggagcagctcaaaatacacactcagctcgctgacataataatcgttgccgcagagaggttccaccacttcgcccaggacttaagcaacagctag

SEQ ID NO: 230379 - DNA, 762 bp, Artificial Sequence
  Description of Artificial Sequence: Synthetic coding sequence
atggctaaacacattcagaaggaaattcaacggggagtggagagctgggtttctctgggtaaccgacggcctcacctgtctatcatcctagtgggagacaatcccgcatcacacacatatgtgagaaataagattagagctgcgtccgcagtcggcatttgttcagagctgattttgaagcccaaagatgtaagccaggaagaactcctggacgtaactgaccaactgaatatggatccaagagtgtcagggattctggttcagttgcctctgcccgaccatgtagacgagcggacaatatgcaatgggatcgccccagagaaggatgtcgacgggttccatattattaatattgggagactgtgccttgaccagcatagcctgattcctgctaccgcaagcgccgtctgggagatcattaaaaggaccggcatacagactttcgggaagaatgtggtggttgccggtaggtctaagaatgttggaatgcccattgccatgctactgcacacagacggagagcacgagcgtccaggcggagacgctaccgtcacaatcgctcaccgttacaccccaaaggagcagctgaaaatccatactcagctggctgatattatcatcgtggccgctggcatccccaaacttattacttctgatatggtgaaggaaggggctgccgtaattgacgtcggcataaattatgtccatgacccggtcactggaaaaacaaaactggttggtgacgttgatttcgaggcctag

SEQ ID NO: 230380 - DNA, 1044 bp, Artificial Sequence
  Description of Artificial Sequence: Synthetic coding sequence
atgacagtgcctgtacgcggattctccctgcttaggggcaggctcggacgtgcacccgctctcggcagaagcacagcaccaagtgtgcgggcaccgggagaaccgggtagtgccttcagaggattccgcagctccggcgtgcggcacgaggccattatcattagcgggacagaaatggctaaacacatccaaaaagaaattcagcggggtgtggaatcgtgggtctctttggggaaccggcgaccccatttatccattattctggtgggggataatccagccagccacacctatgtccggaataagatcagggctgcctctgcagtgggaatctgtagcgaactcatattgaagccaaaggatgttagtcaagaggagctgttagatgttactgaccagctgaatatggaccccagagtctcaggcatattggtacagctccctctgcccgaccatgtggatgagcggaccatctgcaacggcatcgcccctgaaaaggacgtggatggcttccatatcatcaatataggaaggttgtgtttggatcagcactctttgatccccgcaacagcaagtgctgtgtgggaaattatcaaacgtactggaatccagacgtttgggaaaaacgtcgttgttgccggacggtccaagaacgtggggatgcctatcgcaatgctcctgcatacagacggagagcacgagcgtcccggaggagacgctacagttactatcgctcaccggtatactcccaaggagcagttgaagatccacacccagctggcagatataatcattgtggcagctggaattcccaagctgatcacatccgacatggtcaaagaaggagccgctgtcatagacgtgggaatcaactatgtgcatgaccctgtcactggcaaaaccaagctcgtcggcgacgtggattttgaggcggtgaagaagaaagccggattcatcacacctgtgcccggaggcgtcgggccaatgactgtggctatgctgctgaagaacacactactggccgcaaaaaagatcatttattag

SEQ ID NO: 230381 - DNA, 441 bp, Artificial Sequence
  Description of Artificial Sequence: Synthetic coding sequence
atggatcctcgagtgtccggtatcctggtccagctcccattacccgaccatgtggacgaacggacaatttgcaacgggatcgcacccgaaaaagatgtggacggatttcatataattaatatcggacgactgtgtctggatcagcactctctcattcccgcaacagctagtgccgtatgggaaatcatcaagaggaccggaattcagacattcggcaagaacgtggttgttgccggacgaagcaagaacgtcggcatgcccatcgctatgctcctgcacactgatggtgaacacgagcgccctggcggagatgctactgttacaattgcgcaccgatatacacccaaagagcagctaaagatacacactcagctcgcagacatcatcatagtggctgccgagcgcttccaccacttcgcccaggacctctctaactcatag

SEQ ID NO: 230382 - DNA, 1257 bp, Artificial Sequence
  Description of Artificial Sequence: Synthetic coding sequence
atgccaatgttgctgcctcatccccaccaacacttcctgaaggggctcctgcgggctccctttcgctgctatcacttcattttccatagcagcacccacctcggttccggcattccctgtgcccagcccttcaattccctcgggctgcactgtactaagtggatgctgctctccgacgggctgaaaaggaagctctgcgtgcagaccactctaaaggaccacacggaaggattaagtgacaaagaacagcgcttcgtggataaactttacaccggcctgatccaaggacagcgcgcatgtctggccgaagctatcacgttagtcgaatcaactcattcccgtaaaaaggaactggctcaggtcctgttgcaaaaggttctgttgtaccacagagaacaggaacaaagcaataaaggaaagcccctggccttcagagttgggctctctggcccaccgggagccggaaaaagcaccttcatcgagtatttcggtaagatgctcacggagcgaggtcataaactttcggtcctagcagtcgacccttcctcttgcacatcggggggatccctcctgggcgataagacacgcatgacagagctgtcaagagatatgaatgcgtatatcaggccgtcaccgactcggggaacactggggggagtaacccggacaactaacgaggctatactcctgtgtgaaggtgccggatatgatatcatcctgattgaaaccgtaggagttggccagagtgagtttgctgtcgctgatatggtggacatgtttgtgctcctgctgcctcctgctggaggagatgaactgcaggggataaaaagaggtattatcgagatggccgacctcgtggcggtgacaaagtccgatggcgatctgattgtccccgctcggagaatccaggctgaatacgtgtcagccctgaagttgctaaggaagcgatcacaggtctggaagccaaaagtgatcaggatttccgcgaggagcggggaaggcattagtgagatgtgggacaagatgaaggatttccaggaccttatgctcgcctctggggagctgacagccaaacgaaggaagcaacagaaagtttggatgtggaatctgatccaggagtctgtgctggagcactttaggacccaccctaccgtacgcgaacaaattcctctactggagcagaaagtgcttattggggctctttcccccggtttggccgcagacttcctgctcaaggcattcaaatcacgggactag

SEQ ID NO: 230383 - DNA, 1275 bp, Artificial Sequence
  Description of Artificial Sequence: Synthetic coding sequence
atgcctatgctgctgcctcacccacatcaacattttcttaaggggctgctgagagcaccgtttcgttgctaccacttcatcttccacagctccacccatctcgggagtggcatcccatgcgcccaaccattcaattccctggggttgcattgtactaaatggatgctgttatcagacggcctgaaaaggaaattgtgcgtgcaaaccaccctcaaggaccatacagaggggctgagtgacaaagagcagcggtttgtcgacaagctctataccggcttaatacaaggccagcgcgcatgccttgccgaagcaatcacactggtagaatccacccatagccgcaaaaaggagctcgcacaggtcctactgcagaaggtactgttatatcatcgggagcaagaacagtccaacaagggtaaacccttagcttttagagtcggactttcaggcccacccggagcgggtaaatcaaccttcatcgagtatttcggtaagatgctcaccgagcggggtcacaagttaagcgttttggccgttgatcctagttcttgtaccagtggcggatctctactgggtgacaagactcgcatgaccgagttgagtcgggacatgaatgcctacatcaggccctcccccactcggggtacactgggcggagttacacgaacaacaaacgaggccatccttttatgtgaaggagccggatatgatattattctgattgaaacagtgggcgtagggcagtctgagtttgcagttgccgatatggtcgatatgtttgtcttgcttctcccccctgcgggaggggacgaattacagggaattaaacggggtattattgaaatggctgacctagtggccgtgactaagagcgacggtgatcttatcgtcccggctcgcagaatacaggctgaatatgtgtctgcccttaagctcctgcgaaagcgttcacaggtttggaaacccaaagttatacggatctccgctcgctcaggtgaaggaatctccgagatgtgggacaaaatgaaggatttccaggatctaatgctggcttctggggagctgaccgccaagcgaaggaagcagcagaaagtatggatgtggaacctgatccaggagagcgttcttgaacactttaggacgcatcctaccgtgcgtgagcagatcccgctgctcgagcagaaagtgttgataggggctctgagtccaggcctggccgctgacttcctgttgaaggctttgaaggctgaaactaataagattcatcccgtgtag

SEQ ID NO: 230384 - DNA, 414 bp, Artificial Sequence
  Description of Artificial Sequence: Synthetic coding sequence
atggctgacttggttgcagttaccaaatccgatggagatctgatcgtgccggcaaggcgtattcaggcagagtatgtcagcgcacttaagctcctgaggaaaaggagtcaggtctggaaacctaaagtcattagaatttccgcacgctccggggaggggatatccgaaatgtgggacaaaatgaaggactttcaggaccttatgctggcctcaggtgagctgactgctaagcgtcggaagcagcaaaaagtgtggatgtggaacctcatccaggaatcagtccttgaacactttcgaacgcatcccactgttcgggagcagattccattgctggagcagaaggtgctcatcggagcacttagcccaggcctcgccgcagatttcctcctaaaagccttcaaaagcagagattag

SEQ ID NO: 230385 - DNA, 480 bp, Artificial Sequence
  Description of Artificial Sequence: Synthetic coding sequence
atggctgggctcaccaggttcgctctggaattagtgacagaaaaaggtcacaccttcgctgaggagcttcagaagattcagtgcacactacaggacgtcggctcagcgttggccacaccctgctcgagcgctcgtgaggcgcacctaaagtacacaacttttaaagccggaccaatactggagttggagcagtggatcgacaagtacacctcacagctcccgccactgactgctttcattctcccctccggtgggaaaatcagcagtgcccttcacttctgccgcgctgtgtgtcgcagggcagagcggagagttgtgccactggtgcagatgggcgagaccgatgcaaacgttgccaaattcctcaatagactttctgactacctctttactctagcaagatacgccgcaatgaaagagggcaaccaggaaaagatttatatgaagaatgatcctagtgcagaatccgagggtctgtag

SEQ ID NO: 230386 - DNA, 753 bp, Artificial Sequence
  Description of Artificial Sequence: Synthetic coding sequence
atggccgtatgcggactaggcagccgactgggcctgggtagccgcttggggcttcggggttgctttggggctgccagactgttataccccagatttcagtcacgcggacctcagggggtggaagatggtgacagaccccagccctcatccaaaaccccgcgtatccctaagatctacacaaagacaggggataaaggttttagcagcacttttaccggggaaaggcgtccaaaagacgatcaggtgttcgaggccgtcgggaccactgacgaacttagcagcgccataggcttcgcgctggagctcgtcacggagaagggacacactttcgctgaggagctgcaaaagatccaatgcacgcttcaggatgtcggatccgcgttagccaccccctgctcctcagctagagaggctcacctcaaatacaccacatttaaggctggccctatactggagctcgagcaatggatcgataaatatacctcccagctccccccactgactgccttcatcctccctagtggtgggaaaattagttcagcgttacacttttgcagagccgtttgtagaagggccgaacgacgagtggttcctcttgtccaaatgggcgagacggacgctaacgttgctaaattcctgaatcgcctcagcgattatctatttacactggcaagatacgccgcaatgaaagaggggaatcaggaaaaaatatacatgaagaacgatcccagcgcagagagcgaaggcctctag

SEQ ID NO: 230387 - DNA, 849 bp, Artificial Sequence
  Description of Artificial Sequence: Synthetic coding sequence
atggaacctaaggtggctgagctgaagcagaaaattgaggacaccctttgccctttcggctttgaagtgtaccctttccaagttgcttggtacaacgagctcctgccacctgccttccacttgcccctgcctggccctactcttgccttcctcgtcttgtcgactcctgcaatgttcgatcgagcactcaaaccattccttcagagctgccatttgagaatgcttaccgatcccgtggatcagtgtgtggcctatcatttaggccgtgtgagagagagcctgccagagctccaaattgaaattattgctgactacgaggtacatcccaatagacgccctaagatcctggcgcagacagccgcacacgtggccggagcagcctactattaccagagacaagatgttgaggccgatccctggggtaaccagcggataagcggggtgtgtattcacccaagatttggcggttggttcgctataagaggagttgtgctcctgccaggcattgaggtccctgacctgccacctagaaagcctcacgactgcgtccctacccgcgcagacagaattgcgcttcttgaaggatttaactttcattggcgagactggacctatcgtgacgcggttaccccacaagaaagatactctgaagaacagaaggcttattttagcacacctccagctcaaagactggcattattaggactagctcagcctagtgaaaagcctagttctccttcacctgaccttccgttcactacacctgcacccaagaaaccagggaatccgtctcgggcaagatcttggctgtctcctcgagtcagccccccagcatctcccggaccatag

SEQ ID NO: 230388 - DNA, 891 bp, Artificial Sequence
  Description of Artificial Sequence: Synthetic coding sequence
atggccaatgtgctgtgtaaccgcgctaggctcgtgagttatctgcccggtttctgctccttggttaaacgcgttgtaaatcctaaagcattctccacagccggaagtagcggcagcgatgaaagccatgtcgccgcagcgcctccagatatttgttcccgcactgtgtggccagatgagaccatgggcccttttggaccccaggatcaacggtttcaattgcccggtaacattggatttgattgtcatcttaacggtacagcatcacagaaaaagagcctcgtgcacaagactctgcctgacgtgctcgctgagccactttctagcgaacggcacgagttcgtgatggcacagtatgtgaatgaattccaaggcaatgatgcacccgtggagcaggagataaattcagctgagacctacttcgagagcgcgagggtggaatgtgcgattcagacctgcccagaactccttcgtaaagactttgaaagcctcttcccagaggtggccaatggtaagttgatgattttaacggtgacgcagaaaacaaaaaacgacatgaccgtgtggtccgaggaggtggagattgaacgtgaggtactcttggagaagtttattaatggggctaaagagatctgctatgcccttcgtgccgaaggatattgggcagacttcatcgacccgagcagtggactcgcctttttcggcccatacacgaataacacactctttgaaaccgatgaaaggtacagacacctcggcttttccgtagacgacctcggatgctgtaaagtgataaggcactcactttggggcacacacgtggttgttggatccatttttaccaatgctactcctgattcccacatcatgaaaaagctgagtggcaattag

SEQ ID NO: 230389 - DNA, 891 bp, Artificial Sequence
  Description of Artificial Sequence: Synthetic coding sequence
atggctaatgtgctctgtaatcgggcacggctggtcagctatctgcctggcttctgttccctggtcaaacgggtcgtgaaccctaaggctttctccaccgccggaagttctggttccgatgaatctcacgtggcggcagctccacctgatatctgctcccggacggtttggccagatgagacgatgggtccatttggtccacaggaccagagattccagttgcctgggaacatcggattcgactgccatctgaatggaacggcatcccaaaaaaaatcacttgttcacaaaacactgcccgacgtccttgccgaaccactgtcatctgagcgccatgagtttgtgatggctcagtacgtgaatgaattccagggcaatgacgctccagtggaacaggaaattaactcagctgagacatactttgagagcgcgagagtcgagtgcgcaatacagacttgtccagaactacttcggaaggatttcgagtcactgttccctgaggtcgcaaacggcaagctgatgatcctgacagtcacccagaaaaccaagaatgacatgactgtgtggtcggaggaggttgagattgagagagaggtactgctggaaaaatttattaacggggcaaaagaaatctgttatgcgctcagagctgagggctactgggctgactttatagatcccagctctggactggccttcttcgggccatatacaaacaacacgctgttcgagactgacgagcgttataggcatctgggattttccgtggacgacctgggatgctgtaaggttattcgccactctctgtggggcacacacgtcgttgttggaagtatctttacgaacgctactccggattcacacattatgaagaagctgtcgggcaattag

SEQ ID NO: 230390 - DNA, 531 bp, Artificial Sequence
  Description of Artificial Sequence: Synthetic coding sequence
atggcacgggtcttgaaagccgcagccgcaaatgcagtcggcctttttagtaggctacaagcacctattcctactgtacgcgcttcgtcaacatcacagccactggatcaggttacgggaagcgtgtggaatttgggtcgtttgaaccacgtggcaatcgctgttccagatctggaaaaggctgcagctttctacaagaacatactgggggcacaggtctccgaggcagtgccgttgccagagcatggagtgagtgttgtgtttgttaacctcggcaacacgaagatggagcttctgcaccctttaggtcgggattcacctatcgccggattcctgcagaagaacaaagccggaggcatgcatcatatctgcatcgaggtggacaacatcaacgccgcagtgatggaccttaagaaaaagaagatccgctctctgtctgaggaagtcaagattggagctcacggcaaacccgttatattcctgcacccaaaagactgcgggggagtgcttgtagagctagagcaggcctag

SEQ ID NO: 230391 - DNA, 2070 bp, Artificial Sequence
  Description of Artificial Sequence: Synthetic coding sequence
atgattgagatggcggcagagaaagaaccctttttggttcccgcacccccacccccactgaaagacgaaagcggaggagggggtggacccaccgtgcccccacatcaggaggccgcaagcggggagcttcggggaggaacagaacgaggccctggcagatgtgcccctagtgcaggtagcccagctgcagcagttggtagggaatcacccggagccgctgccacctcctctagcgggccacaggcacagcagcaccgcggtggagggcctcaggctcagtctcatggagaagctcgcctgagtgatcctccgggtcgcgcagcacctcctgacgtgggcgaggagcgacgcggagggggaggcacggaactcggccctcctgcccctccaaggcctcgaaatgggtatcaacctcataggcctcccggagggggaggcggtaaacgcaggaactcctgcaacgtcggaggaggtggtggaggtttcaaacatcccgcttttaaaaggcgcagacgcgtgaatagtgactgtgactcggtattgccatccaatttcttactcggaggcaacatcttcgaccctctaaatctgaactctttattagatgaggaagtgtcccggacattaaacgctgaaacccctaaatcctcgcctttgcctgctaaagggcgagacccagtggagattctgatacccaaagacataaccgatccgttgtccttgaacacatgcacggatgaaggacatgtggttctagcgtccccactgaagaccgggaggaaaaggcataggcacaggggccagcaccaccagcaacagcaggcggctgggggttccgagtcacatcccgtgccgcctaccgctccgctaacccctctcctgcacggggagggcgctagtcagcaaccccgtcatcgtggtcagaacagagatgctccacagccatatgaactaaacacggctatcaattgcagggacgaagtcgtctcccccttgcctagtgctctccagggaccatcaggctccttgtcagcacctcccgcagcatctgtgattagcgcaccgccttcttccagttcacgacatcgaaagcgcaggagaacatcatctaagagtgaggcaggcgcacgaggtggcggtcaggggtccaaagagaaggggagaggatcatgggggggacgccaccatcaccatcatccactgcccgcagccggttttaaaaagcaacaaagaaagtttcagtatgggaactactgcaagtactacggttaccggaacccctcatgtgaggacggcagactcagggtactcaagcccgagtggtttcgaggacgggatgttctcgaccttggttgtaatgtgggtcacctcacactgtctattgcctgcaagtggggcccttcccgaatggtgggcctcgacatcgactcccgtctgatccattcagcccgtcagaacatacggcactatttgagtgaggaactcaggctgccgccacagacccttgaaggtgaccctggggctgaaggggaggaagggactactaccgtgagaaaaaggtcctgtttcccagcttccctgacagcatctagagggcctatcgcagcaccccaggtgccgctggacggcgctgacaccagtgttttccctaacaacgtagttttcgtaaccgggaattatgtcttagatcgcgatgatttggttgaggcccagacacctgaatacgatgtggttctttgcttgtccttgaccaagtgggtccatttaaactggggtgacgaaggacttaagcggatgtttcgaagaatctataggcacctgagacctggcggaattttagttctggagcctcaaccctggtcaagctacggcaagagaaagacgctgacggagaccatctacaaaaattactaccgtattcagctgaagcctgaacagttctccagctatcttacttctcccgatgtaggattctcctcttatgagctcgtcgccacgccacacaacacctccaaaggattccagcgccctgtctaccttttccacaaggcacggtccccttcccattag

SEQ ID NO: 230392 - DNA, 663 bp, Artificial Sequence
  Description of Artificial Sequence: Synthetic coding sequence
atggtaggactggatatcgactcgcgcttgatccactctgctaggcagaatataagacactacttatccgaagagttgaggttgccccctcagactctcgagggagatcccggtgccgaaggcgaggagggtaccactactgtgaggaaacgatcttgttttccggcaagcttaaccgcctccagaggacccattgcagccccacaggtgcctttggatggcgctgacacaagcgtcttccctaacaacgtggtgttcgtgacagggaattatgtgcttgaccgtgacgacctggttgaagcacaaaccccggaatacgatgtcgtgctctgcctgtctctcacaaagtgggtgcacctgaattggggagacgaagggctcaaacgtatgttccgtaggatctaccgtcacctgagacctggtgggattctggtcctggaaccgcagccgtggtcatcctacggcaaaagaaaaaccctgaccgagaccatctataaaaattattacaggattcagcttaagccagagcagttcagttcctatttgacttcacctgatgtggggtttagctcatatgagctggtcgccactcctcacaacacgtctaaaggcttccagaggcccgtttacctgtttcacaaggccagaagtccgtctcactag

SEQ ID NO: 230393 - DNA, 852 bp, Artificial Sequence
  Description of Artificial Sequence: Synthetic coding sequence
atggcttctgggacaacaacaacagcagtaaaaattggcatcattggagggactggcctagatgatcctgaaatcctcgaaggacgcacagaaaagtacgtagacactcctttcggcaagccctctgacgccttaatccttggcaaaataaaaaatgttgactgtgtcttgttggctagacatggaagacagcacacaataatgccctccaaggttaactaccaagcaaatatttgggctttgaaggaagaggggtgtacacatgtgattgtcaccaccgcttgtggcagcctgagagaggagattcagccaggggatattgtcataatagaccagtttattgacaggaccacaatgcgaccccagtccttttatgatggcagccacagctgtgccaggggagtctgccatattcccatggccgagccgttttgccccaagacgagggaggtgttaatcgaaaccgccaaaaagttggggctgcggtgccactccaagggcactatggtgactatagagggaccccgtttttctagcagggccgaatctttcatgttcagaacctggggtgccgatgtgattaacatgactactgtgcccgaagtggtgttagcgaaggaagcaggaatttgctacgcatctattgcaatggccacagactacgattgctggaaggagcacgaggaggctgtgagtgttgatcgggtgctgaaaacgctgaaagaaaatgcaaacaaagcaaagtccttgctactgaccaccattcctcagattggttctaccgaatggtctgaaaccctccacaacctcaagaatatggcgcagttttcagtgctgctacccaggcactag

SEQ ID NO: 230394 - DNA, 468 bp, Artificial Sequence
  Description of Artificial Sequence: Synthetic coding sequence
atggctgcggagacccggaacgtcgccggagccgaggctcccccaccccagaaacgatactaccgccagagagcacattccaatcctatggccgaccacactctgcggtaccctgtgaaaccagaggaaatggactggtctgagctttaccccgagttctttgcccctttaacccagaatcagtcacatgacgatccgaaagacaagaaggagaaacgtgcccaggctcaggttgagtttgccgacataggctgcggttatggcggactactcgcagacaaggacgtgcttccactcccaaggcccaccttccaggcagataaagctcaggttgcaaaccaccagtctcacccagcctctaggatctgcttaagggcaaaaagctggggcgcaggcgtgtaccataatagatgtgccggagcaaccaggcttgatgtccactcattccgaagagcccctacagtctag

SEQ ID NO: 230395 - DNA, 831 bp, Artificial Sequence
  Description of Artificial Sequence: Synthetic coding sequence
atggctgcagagaccagaaacgttgctggagcagaggcacctccacctcaaaaacggtactacaggcagagagcccatagcaaccctatggctgaccacacactgaggtatcctgtgaagcccgaggaaatggattggagcgaactgtacccagaattttttgcccctctcacccagaatcagtctcacgatgatcctaaagacaaaaaggagaagcgagcacaggcccaggtggaattcgccgacatcggctgtgggtatggaggcctcctggtggaactcagcccgctgttccccgacactctgatcctgggccttgaaatccgggttaaggtcagcgactatgtccaagaccgtattagggcactgcgcgctgcccctgccggaggttttcagaatattgcgtgcttgcgttctaatgcaatgaagcacttaccaaactttttctacaagggccagctgaccaagatgtttttcctgtttcccgacccccattttaagcgcacaaagcacaagtggaggattattagtcccacgctgctggctgagtatgcttatgtgttgcgggtgggaggcctggtgtatacaatcactgacgtcctggagctgcatgattggatgtgtacccacttcgaggaacaccctctctttgagcgagtcccacttgaagatctctctgaggacccagtcgtggggcacctcggtactagcacagaggaggggaagaaggtgttgcgtaatggaggcaaaaacttccccgctatttttcggaggatccaagaccctgtgctgcaggctgtgacaagccagaccagcttgccgggtcattag

SEQ ID NO: 230396 - DNA, 2274 bp, Artificial Sequence
  Description of Artificial Sequence: Synthetic coding sequence
atggctgaggttggcagaacagggatttcttaccccggagccctgctgcctcagggtttttgggccgcagtggaagtatggctcgagcgccctcaggtcgcaaataagagactctgcggcgctagactggaggcacggtggagcgccgcactgccatgcgcagaagcgaggggtcccggaacctccgccggatctgaacagaaagaacggggtccaggaccgggacagggtagtcccggagggggacccggaccgaggtctctgtccggccctgaacagggcacagcctgttgcgaactcgaggaagctcagggacagtgccagcaggaagaggcacagcgggaagccgcttccgtgcctctgagggactcggggcatcctgggcatgccgagggcagggaaggtgactttcctgctgccgatctggatagcctctgggaagacttcagtcagagccttgccagaggtaactcagagctgcttgcctttctgacctctagtggggcaggcagccagcctgaggctcagcgagagttggatgttgtgcttaggacagtgattccaaaaaccagccctcactgcccccttaccaccccacggagggaaatcgtagtgcaggacgtcctgaatgggaccattacctttctgcccctagaggaggacgacgaggggaaccttaaggtgaagatgagtaatgtttaccagattcagttgtcccattccaaggaagagtggtttataagtgtgctcatcttctgccccgagcgctggcactccgacggaatcgtgtaccccaagcctacgtggctcggcgaggagcttctggcaaaactggctaagtggtcagtcgaaaacaagaagagtgattttaaatcaaccctaagtctcatttctattatgaaatactccaaggcctaccaagagctcaaggaaaaatataaagagatggtgaaggtctggcccgaggtgactgatcctgagaaatttgtgtacgaggacgtggctattgcggcatatttgctgatcctgtgggaggaagagcgcgcagagaggaggctgaccgcaagacaatcgttcgttgatctgggatgcggaaacggactgctggtccacatactctctagtgaagggcacccaggacgcggtatcgatgtccggcgaaggaagatctgggacatgtacggaccccagacccaactggaagaggacgccattacccctaacgataagaccttattccccgatgttgattggcttataggaaatcatagcgacgagctgaccccatggattcccgtgatagccgcacggtcctcctacaactgccgctttttcgtgcttccttgttgtttctttgatttcattggcaggtacagtaggagacaatctaaaaagacacagtatcgcgagtatctggacttcattaaagaggtcggattcacttgtggcttccatgtggatgaagactgcctgaggatacctagtacgaagcgcgtgtgcttggtcggaaaatccaggacatatcccagttcgagggaagcctcggtcgacgagaaaagaacacagtatatcaaatctagacgcggatgccctgtgtcccccccaggatgggagctgtcccctagccctaggtgggtagccgcaggctctgcgggtcactgtgatggtcagcaagccctcgatgcccgtgtggggtgtgtcacaagggcatgggcagccgagcacggtgccggtcctcaagcagagggtccatggctgccgggttttcatcccagagaaaaagcagagagggtgaggaactgcgctgccctgcctagggacttcatcgatcaagtcgtgctccaggtagctaatctccttctgggtggcaagcagctgaatacaaggtcatcgcgcaacgggagcctgaagacctggaacgggggtgaatcgctatctctggccgaagtggcaaatgagctggacactgagactctccggaggcttaagagagagtgcggtggacttcagaccctcttgcgcaactcacaccaggttttccaggtcgttaacggacgagtgcacattagggattggcgcgaggagacattgtggaaaacaaaacagcccgaggcaaagcaacggttgctcagcgaggcttgcaagacaaggctgtgttggttttttatgcatcaccctgacggctgcgccctctcgactgactgctgccccttcgcccacggacctgccgaactgcggcctccgagaaccacaccacgcaagaaaataagctag

SEQ ID NO: 230397 - DNA, 1236 bp, Artificial Sequence
  Description of Artificial Sequence: Synthetic coding sequence
atgtgtattaaattctcctcagtaattgccaagaagaatgaacgctggcacagcgacggaatcgtgtaccccaaacccacctggcttggagaggaactcttagctaagctggcgaaatggtccgtcgagaataagaaatcagactttaaatctactctgtctctcatttccatcatgaaatacagtaaagcttaccaagaacttaaggagaagtataaggagatggtcaaggtgtggcctgaggtcaccgaccctgaaaagtttgtgtatgaggatgtggcgatcgccgcttacctgctaatcctgtgggaggaagaacgagctgagcggaggctcactgcaaggcaaagctttgtggacttaggctgcggcaacggcctgttggttcatatcctctcctctgaaggccatccgggtcggggaatcgacgttcgtcgacgcaagatctgggacatgtatggaccacagacacagttggaggaggatgccatcacacctaacgacaagacccttttccccgacgtcgattggctgatcggcaatcattccgacgagctgaccccgtggattcccgtgattgcagcacgctcatcttacaactgccggttcttcgttctcccctgttgcttctttgatttcatcgggaggtattcccgaaggcagtcaaaaaaaacacagtaccgggaataccttgattttattaaagaggtgggttttacttgtggcttccacgtggatgaggactgcctccgaatcccctccacgaaacgggtttgtctggtgggtaaatctaggacttacccatcatccagggaggccagcgtcgatgaaaaacgcactcagtatattaaatcccggaggggctgcccggtcagccctcctgggtgggagctgtcccctagtcccagatgggtcgcagctggcagcgccggacactgcgatggccagcaagctctggatgcaagggtgggttgtgtgacgcgggcttgggccgctgagcacggagctggccctcaagcagagggtccatggctacccggatttcatcccagagagaaggcagagcgcgtgaggaactgcgcagcgctccctagagactttattgaccaggttgtgctgcaagtggcaaatctgctgctaggcggaaagcagctgaacaccagatcctcccgaaatggctctcttaagacctggaatggcggtggcaagctgtcaactattctcggaaggggctag

SEQ ID NO: 230398 - DNA, 1743 bp, Artificial Sequence
  Description of Artificial Sequence: Synthetic coding sequence
atgagcgatacttggagttctattcaagcccacaaaaagcagcttgatagcctccgggagcggctccagcgaagacgcaaacaggatagtggccacctcgatttacgaaaccctgaagcggctctgtctccgacgttccgctccgacagcccggttcccaccgccccaacatccggagggccaaagcccagcacagcttccgcagtgccagagttagccacagaccctgaactcgaaaagaaactattacaccacttgagcgatctagcgttgacccttcctactgacgccgtgagcatttgtcttgccatatccacgcccgacgcacccgctacccaggacggggtggagtctctgcttcaaaaattcgcagcgcaggagctgatcgaggttaaacgtggactgctccaggacgacgcccaccccacactggtgacttacgctgatcattctaaactaagcgctatgatgggagccgtcgccgagaaaaaggggccaggcgaggtcgcaggcacagtcaccggccagaaacggagggcggaacaggactctacgacagtggctgcctttgcatcgtctctggtctcaggtcttaattcctctgcctcagagcctgccaaagaaccggctaaaaagtcacggaaacacgccgcaagcgatgttgatctggagattgagtcattgctgaatcaacagtcaacgaaagagcaacagtcaaaaaaggtgtcccaagaaattttggagctgttaaacaccacaaccgctaaggagcaatccattgtggagaaatttaggtcacgagggcgtgcgcaggttcaggaattttgtgattatggcacaaaggaggaatgtatgaaagcaagtgatgccgacagaccatgcagaaagctgcattttcgaagaatcattaataaacacacggatgagagcttgggcgattgtagttttctgaatacttgctttcacatggacacctgcaagtacgtgcactacgaaatcgacgcctgtatggattcagaagctcctggctcaaaggaccataccccctcacaagagttggctctaacccaatccgtcgggggagactcctccgccgatcgcctgttccctccccaatggatatgttgcgacatccgctaccttgatgtttctatcctgggtaaatttgctgtggtcatggccgacccaccctgggacatccacatggagctcccttacggaacgctgaccgacgatgagatgcgtcggcttaatatcccagtcctccaagacgacgggtttttgtttctgtgggttacaggcagggccatggagttgggccgtgagtgtctgaatctttggggatatgagcgcgtcgacgagatcatctgggtaaagaccaaccaattgcaaaggatcatacgtaccgggagaaccggacattggctaaaccatggcaaggagcactgcctcgtgggggtcaaggggaacccccagggatttaaccagggtctggactgtgacgtcatcgtggcagaagtaaggtctacatctcacaaacccgacgagatctatggtatgattgagcggctgtctccaggcactcgtaaaattgagctttttggtagaccccacaacgtccagccaaattggatcacccttggaaaccaactagatggaattcacttgctagaccccgacgtggtggcgaggtttaaacagcgataccctgacggaatcattagtaaacctaaaaatctctag

SEQ ID NO: 230399 - DNA, 492 bp, Artificial Sequence
  Description of Artificial Sequence: Synthetic coding sequence
atgtccgacacgtggagctccatccaagcacacaagaagcagctggattcacttagggagcggttgcagagacggaggaagcaggacagcggacacctggatcttcgcaaccccgaggccgctctgagccccacatttcggtctgattctccagttccaaccgcacccactagcgggggtcccaagcccagcacggcgtccgccgtccccgagctggccaccgaccctgagctggaaaaaaagctccttcatcatctgagcgacctcgcattgactctcccaaccgatgctgtgtcaatttgccttgctatatcgacgccagacgcgccagccacgcaggatggcgtggaaagtctcctgcaaaaatttgccgctcaagaactcatcgaagtgaaacgcggtttgctccaggacgacgcgcacccaactctcgttacatacgccgatcatagcaagttgagcgcaatgatgggcgcagtggccgaaaaatag

SEQ ID NO: 230400 - DNA, 462 bp, Artificial Sequence
  Description of Artificial Sequence: Synthetic coding sequence
atgtcagatacctggtcctccattcaagctcataagaaacagctggattcgctgagagaacggctccagcgtagaagaaagcaggattctggccatctggatctgcggaaccctgaagccgctctctctcccaccttccggagtgactcacccgtccccaccgctcccacttccggaggacccaaaccctccacagcctcagcagtgcccgaactggccacggaccccgagttagaaaagaagcttctccatcatttaagcgatctcgcactcactctgccaacggatgcagtttctatctgtctggctatctccaccccagatgcccctgctacccaggacggtgtcgagtccctgcttcaaaaatttgccgctcaggagttgatcgagcatcgtaaccagcagcggtcacagccgaggaaccagggtaacatgctcccgcaaatgctgatctggcgttag

SEQ ID NO: 230401 - DNA, 879 bp, Artificial Sequence
  Description of Artificial Sequence: Synthetic coding sequence
atgctaggggcttgggctgtggagggcactgccgtggcccttctgagacttttgctgctcctgctgccccctgccattagaggccctggactgggagtagcaggtgttgccggtgccgctggtgccggtctgcccgagtccgtgatttgggccgtgaacgcaggtggggaggctcatgttgatgtgcatgggattcacttccggaaagacccacttgaaggcagagtgggaagagcatctgattacggtatgaagttgcccattttgagatcaaatccagaggatcagatcctgtatcaaaccgaacgctataatgaggagaccttcggttacgaagttccaatcaaagaggaaggcgattatgtgttggttctcaagttcgcagaggtctactttgctcagagccaacagaaggtctttgacgtacgattgaatggtcacgtggtggtcaaagatcttgatatattcgaccgcgttgggcattccaccgcccatgatgagatcatcccaatgagtatccgcaagggcaaactatccgtacagggggaggtctctacctttaccggcaaactgtatatagagttcgtcaaaggctactatgataatcctaaggtgtgtgctctgtacattatggctggcacagtggacgatgtgccgaagctgcagccgcacccagggctggagaaaaaggaagaggaggaggaagaagaggagtacgacgaagggtctaacctcaagaagcagacaaacaaaaaccgtgttcagtcaggcccacgaacccccaatccatacgctagtgacaacagttcactcatgtttcccatcttggtagccttcggggttttcatccccactctcttttgtctttgccggttgtag

SEQ ID NO: 230402 - DNA, 1035 bp, Artificial Sequence
  Description of Artificial Sequence: Synthetic coding sequence
atgcttagtgaggtgttattagtcagtgctcctggtaaggtaatcctgcacggagaacacgcagttgtgcatggcaaagtagctctcgccgtgagcctgaatctcaggacgttcctccggctgcaaccacattctaacgggaaggtggatctgagtctccctaacattgggatcaagcgtgcttgggatgttgccagactgcaatctttggatacctcttttttagagcagggggatgtcactacaccgaccagtgagcaggtcgagaaattaaaagaggtggcaggactccctgatgattgcgcggtaacagagcgcttggccgtgctggcgtttctctacctttacctgtccatctgcagaaagcaaagatggaccaaggaagaccttgaacttataaacaagtgggcctttcaaggtgaaagaatgattcatggcaacccatcaggcgtggataacgcagtgagtacctggggaggagccttgagatatcaccaagggaaaataagctccttgaaacgcagccccgcactgcagatactgctgactaacacaaaagtaccacgtaatacaagagctctggtggccggagttcgtaaccgattgcttaagtttcccgaaatcgtggcaccattgctaaccagcatagacgccatcagtctggagtgcgagcgtgttctcggtgagatgggagaagcccctgcccctgaacaatacttagttctggaggaactgattgatatgaaccagcatcacctgaatgctcttggcgtgggacacgcttccttggatcagctctgtcaggtgacaagggcacgcggactccacagtaagcttaccggagcgggtggtgggggttgtggaattactttattaaaacccggattggagcagccggaagttgaggcaacaaagcaagccctaaccagctgtggcttcgactgcctcgagacatccatcggtgcccctggcgtctctatccattccgcaaccagtttggatagccgtgtccagcaggcattggatggattgtag

SEQ ID NO: 230403 - DNA, 516 bp, Artificial Sequence
  Description of Artificial Sequence: Synthetic coding sequence
atgctttccgaagttttactcgtctctgctccaggaaaggtcatcctgcacggagagcacgccgtcgtgcatgggaaggtagcacttgccgtctcgctcaatcttcgcactttccttagactgcagccacactcaaacgggaaggtggacctgagtctgcccaacatcgggatcaagcgtgcctgggatgttgctcggcttcagtcgctggataccagcttcttagaacagggcgacgtgacaacccccacctcggaacaggtggagaaattgaaagaggtcgccggactccccgacgactgcgccgttactgagcggctcgccgtgttggcattcctgtatctctacctatcgatctgcagaaagcagcgcgcactgccaagtctggatattgttgtctggagcgagcttccacctggagcaggattggggagctcagcagcgtactctgtttgtctggccgcagcccttctgacagtgtgcgaagaaattcctaatcccttgaaagatggatag

SEQ ID NO: 230404 - DNA, 1035 bp, Artificial Sequence
  Description of Artificial Sequence: Synthetic coding sequence
atgctttccgaggttctcctcgtttcagcaccgggaaaggtaatcctacatggcgagcacgcggtcgtacatggtaaggtggctctggccgtcagcctaaaccttaggactttccttagactgcagccccactcaaacgggaaggttgacctgagtctgccaaatatcgggataaagcgtgcctgggatgttgccagactccaatccctagacacttccttcttggaacagggggatgtgacaacaccaacctctgagcaagtcgaaaaactgaaggaagtggcagggctgcccgacgattgcgccgttactgaaaggctggctgtgttggctttcctatatttgtacttgagtatctgccgcaagcagcggtggaccaaagaggacctcgaactgattaataaatgggcgttccaaggcgaacgtatgatacacggcaatcccagtggggtggataatgcagtgtctacatggggaggagcgctgcgctaccaccagggaaaaatcagctctttaaagagatcacctgcccttcagattcttttgaccaacacgaaggtgccgagaaacactcgcgctttggtggcaggggtgaggaatcgtctactgaagttccccgaaatcgtagctcccttactgacgtcgatcgatgctatcagtctggaatgcgagagggtgctgggagaaatgggagaggcgcctgctcctgagcagtacctggtcttagaggaacttatcgacatgaatcagcatcatctgaacgccttaggagtcggccatgccagcttggaccagctgtgccaggtgacgagggccagaggcttgcactctaagctcacaggtgcgggtggtggcggatgcggtataaccctgcttaagcctggtctcgagcaacccgaggttgaagcaacgaagcaggccctaacttcctgtggctttgactgcctcgagacaagtattggcgctccaggcgtaagcattcattccgccaccagtctagattcaagagtccagcaagccctggacggtttgtag

SEQ ID NO: 230405 - DNA, 609 bp, Artificial Sequence
  Description of Artificial Sequence: Synthetic coding sequence
atgatccatggcaatccatcaggcgtggataatgctgtgtcaacctggggcggagcccttcgctaccatcagggaaagattagttccctaaaaaggagtcccgcactgcagattctccttaccaatacgaaagttccaaggaacaccagagcgctggtcgccggtgttcgcaaccggctgttgaagttccccgagatagttgcccctctactgacatctatcgatgcaatctctttggagtgcgaaagagtgctaggagaaatgggcgaggccccagcccctgagcagtatctggtgctggaggagctgatagatatgaatcagcaccatctcaatgcactgggtgtcggccatgcgtccctggaccagctgtgccaggtgacccgagccagaggtcttcattcgaagctaaccggagccggaggtggagggtgtggcatcacccttctgaagccaggactagagcagcctgaggtcgaagccaccaagcaagctcttacctcttgcggttttgactgcctcgagaccagtatcggggcaccaggagtgtctattcactcggctacgtccctggattcacgggtccagcaggccctggatggactttag

SEQ ID NO: 230406 - DNA, 606 bp, Artificial Sequence
  Description of Artificial Sequence: Synthetic coding sequence
atgctgagcgaagtgctgttggtctctgcgcctggcaaggttattcttcatggcgagcacgccgttgtccatgggaaggtagctctcgcagtcagtctgaatctccggactttcctgcgcttacagccgcactcaaatgggaaagttgatctcagtctgcctaacattggcatcaagcgggcatgggatgtggctcgcttacagagcctggacacttcatttctggaacaaggcgatgtcacaactcccacaagcgaacaagttgaaaagctgaaagaggtagctggcctgcccgacgattgcgctgtaactgagcggctggccgtacttgccttcctttatttgtacctctctatctgtaggaaacagcgggcattgccaagcctcgacatcgtggtgtggagtgagctgccacctggtgctggtctgggctctagcgctgcatactctgtctgcctggccgcagctctcctcactgtctgcgaggaaatccctaatccactgaaggacggggactgtgtgaatcggtggacaaaggaagacctagaacttatcaataaatgggcctttcagggagagagaatgattcacggcaatccttcctag

SEQ ID NO: 230407 - DNA, 1563 bp, Artificial Sequence
  Description of Artificial Sequence: Synthetic coding sequence
atgcctagtctggtcgtttccggtataatggagcgaaacggcggttttggggagctgggctgcttcgggggaagcgcaaaagataggggactcttagaggacgaaagagccctgcagcttgcccttgatcagctgtgcctgctgggcctgggagagccaccggcacctaccgctggggaggacgggggaggcggagggggaggcgcacccgctcagcctgccgcaccacctcagcccgctccccctccaccaccggcagctccacctgccgctcctacggccgcacccgcagcacagaccccccagcccccaacagcacctaagggagcttcagacgctaagctttgtgccttatacaaagaggccgagctccggctgaaaggcagtagtaacacgacagaatgtgtgcctgtgcctacatccgaacatgtagcagaaatagtaggaagacaaggatgtaagattaaggctttaagggccaagacaaacacatacataaagacacccgtgcgaggggaagagcccgtgttcatggttaccgggagaagagaggatgttgccaccgccaggcgggaaattatttccgctgctgagcacttctccatgatacgggcatccaggaacaaaagcggggctgcctttggcgtcgccccagcactgcctggacaagtcactattcgtgtgcgggttccttaccgggtggttgggctggtcgtcgggcctaaaggagctaccattaagagaatacagcagcagaccaatacttatattattactcccagtcgggacagagatcctgtgtttgagatcaccggggctcccggaaacgtggaaagagctagagaggagattgagacccatatcgccgttcggacaggcaagatcctggaatacaacaacgagaacgatttcctggccggttcacccgacgccgctatcgattcgaggtactcggacgcatggagagttcaccagccaggctgcaagccattgagcacctttagacagaattcactagggtgcatcggcgaatgtggcgtagacagcggctttgaagcacccagactcggcgagcaaggaggagactttggttacgggggatatctgtttcctggatatggcgtaggaaagcaagatgtgtattatggcgtggctgagactagcccaccattgtgggcaggtcaagaaaatgctaccccaacttcagtcttattttcttcggcttcatctagttcaagctcctccgccaaggctcgggcaggccctccaggcgctcatcgatctccagctacttcagcgggtccagaacttgccggactcccacgcagacctcctggggagccactgcagggttttagtaagctcggcggtggagggctaaggtcacccggtggaggtcgcgactgcatggtgtgcttcgagtcagaagtaaccgctgccttagttccctgcggccacaatctgttttgtatggagtgcgccgtgcgaatctgtgaaagaaccgaccctgagtgtccagtgtgccacattacagctacccaggccattcggatcttctcctag

SEQ ID NO: 230408 - DNA, 1710 bp, Artificial Sequence
  Description of Artificial Sequence: Synthetic coding sequence
atgcccagctctctgttcgcagaccttgaaagaaatggatccggcggtggaggtggaggttcttcgggcggtggcgaaaccctggatgaccaacgggcattgcagctggctctggatcaactgtctctgctaggtttggacagcgacgaaggagcttcactctacgatagcgagccaagaaaaaagagcgttaatatgacagaatgcgtaccagtccccagctccgaacacgtagcagagattgtggggagacagggatgcaagatcaaggcactgcgagcaaagaccaatacatatattaagactccagtgagaggtgaagagccagtgtttgtggtaaccgggaggaaagaagacgtggccatggccaggagagagattatttcagcggcagagcatttttccatgatcagggcttcccggaacaagaacaccgccctcaatggtgcagttccaggaccacccaatctccccggtcagactactattcaggtgcgggtgccttatagggtcgttggcctggtcgtgggccctaaaggcgcaaccatcaaaagaatccagcagcaaacccacacttacattgtgaccccgtcacgggacaaagaaccggtctttgaggtgacagggatgccggaaaatgttgaccgggctcgcgaagagatcgaggcacatatagccttgcgcacgggtgggattatcgagctcacggatgagaacgacttccatgccaatggaacggatgtgggctttgatctgcaccacggttcgggcggaagcggacctggctccctgtggagtaagccaacccccagcatcactcctacaccgggtcgaaaacccttcagttcttatcgtaatgattcaagctcgtctttgggatcagcctccactgactcttacttcggtggaggaactagtagcagcgctgccgcaacacagagactggctgactatagccccccttccccggctttaagttttgcccacaatggaaataacaataacaatggaaatggctacacctatactgcaggaggagaggctagcgtcccgtctccagacggctgtccagagcttcagcccacatttgatccggcacccgcaccgccacctggtgccccactgatctgggcccaattcgaacggtctcctggaggaggaccagcagcaccagtctcttcgtcgtgctcatcctcggcgtcctcttccgctagcagcagtagcgtggtatttcctggaggcggagccagcgctcctagcaacgcgaatttggggttgctcgttcaccgcaggttgcaccccggtacatcatgtccacgcctgtctcctccccttcatatggctcctggcgctggggagcaccatctggccaggcgagtccggtcagaccctggaggagggggactcgcttacgccgcttacgcaaacgggctgggcgcacagctcccagggctgcagccgagcgatacgagtggctcctcttctagctcatcatcgtccagcagctcttctagcagttcatcaggcctgagacggaaggggagcagggattgttccgtgtgcttcgaaagcgaggtcattgccgctctggtgccctgtggccacaatctcttttgtatggagtgcgcgaaccgcatttgcgagaagtctgagccagaatgcccggtctgccataccgctgttacccaggctattcggatcttctcatag

SEQ ID NO: 230409 - DNA, 1980 bp, Artificial Sequence
  Description of Artificial Sequence: Synthetic coding sequence
atgccatccggttctagcgccgcactggcgctcgccgcagcacccgctcctcttcctcagcctcccccacccccacctccacccccaccaccccttcctcctccctcaggcggtcctgagttagaaggggacgggctcctcctgagggagcgcctggccgctctgggactcgatgatccctcacctgcagagcccggagctcctgcactgagggctcctgcagccgcagcgcaaggtcaagcccgtcgcgcagcagagctgtctcccgaagagagagcaccacctgggcgtccaggcgctccagaagcagcagagctcgaactagaggaagatgaagaggagggggaggaggctgaactcgatggcgacctgttggaagaagaggagctagaagaagccgaggaggaggaccgttcctcgttactcttgttgtcacccccagccgcaaccgcatctcagacccagcagatccctggtgggtcactgggaagtgtcctgcttccagctgccaggtttgacgctcgcgaagcggcagctgccgctgctgccgctggcgttctatacggcggtgacgacgctcaggggatgatggcagccatgctttctcatgcctacgggccaggagggtgcggagcagccgcagctgcattaaacggcgagcaggctgcactgttgcgacggaaaagcgtgaatacaacagagtgcgttccagtgccttcgagtgaacatgttgctgaaattgtcggcagacagggatgtaaaattaaggccctgcgagctaaaactaacacctatatcaagacccctgtccggggtgaagagcccatctttgttgtgacaggaaggaaggaagacgtcgcaatggctaagcgggagattctgtctgccgctgaacatttcagtatgatccgcgcatcccgcaataagaacggaccagccctcgggggactgagctgcagccccaacttgccgggtcaaacaacggttcaggtgagagttccctaccgggtggttgggctggttgtgggccctaagggtgctacaattaaaagaattcagcaacagacgcacacttatatcgttactccgtcgcgtgataaagagccggtgtttgaggtgacgggcatgcctgagaatgttgaccgagcgagggaagagattgaaatgcatatagctatgagaactggtaattatattgagcttaatgaagaaaacgacttccactacaatggaactgacgtgagcttcgaaggtggaaccctgggatctgcctggttgtctagcaatccagtgccaccaagtagggcacgcatgatttcaaactaccgtaacgacagttccagctctcttggcagtgggagcaccgactcatatttcggaagcaaccgcctggccgattttagcccgacgtcccccttctccaccgggaacttctggtttggggacactctgccctcagtgggctccgaggatctggccgtggactctcctgcattcgatagcttgcctaccagcgcacagaccatttggactcctttcgaacccgtgaaccctctgagcgggtttggtagtgatccatctggcaatatgaaaactcagcgcagaggtagccagccatctactcctagactgtcgccaacctttcctgagtctattgagcacccactggcacggcgagtgcgctcagatcccccatctactggcaaccacgtcgggctacccatctacattccagctttttcgaacggaactaattcctattcttctagtaatggtggcagcacgtcgtcctcacctccagagagtaggcgtaagcatgattgtgtgatctgctttgagaatgaagtgatagctgctctagtcccatgtggccacaatttgttctgtatggaatgcgcaaacaaaatttgcgaaaagcggactccgtcatgccctgtttgtcaaaccgccgttacacaggctatacagatacattcttag

SEQ ID NO: 230410 - DNA, 498 bp, Artificial Sequence
  Description of Artificial Sequence: Synthetic coding sequence
tggaggtggacgtcatgtcggaggagcggatggggggcactggcaacccgtactcgcaggggaagaccgggaactcccccacctccgagaccttctccacctgacgttttcgccggattcgcccctcatcctgctgccttggggccaccaaccttgctggccgatcagatgagtgtgatcgggagcaggaaaaagtctgtcaacatgaccgagtgtgtgcccgtgccatcctccgagcacgtggcagagattgtgggccgacagggttgtaagatcaaagctctcagagcaaagacgaatacctatatcaaaacacccgtcagaggcgaggagcccgtgtttatcgtgactggtagaaaggaagacgttgaaatggccaaaagagagatcctgtctgcagccgaacatttttcgatcatccgcgctacacgctctaaagctggcggactgcctggtgccgctcaggggccacccaatctccctggacaaacaacctag

SEQ ID NO: 230411 - DNA, 2001 bp, Artificial Sequence
  Description of Artificial Sequence: Synthetic coding sequence
atgccatcatctttagggcaaccagatggtgggggaggaggaggcggaggcggaggcggtgtgggtgccgcaggcgaggatccaggaccagggccagcccctccacccgagggagctcaggaggctgcaccagcacctcggccacctcctgagccagacgacgcggcagctgccctccgcctggccctggaccagctaagtgcgttagggttagggggagccggtgataccgatgaggagggtgccgcaggagacggtgccgctgctgctgggggagccgatggaggtgccgcacccgaacctgttccacccgatggaccagaagcaggcgcaccacccacattggcccctgcggtcgccccagggtcgctaccgctgctggatcccaacgctagtcccccaccgccaccaccaccaaggccaagtcccccagatgttttcgcaggtttcgcacctcaccccgctgccttgggccctcccacgctcctagccgatcagatgtctgtgatcggctccaggaagaagtctgtgaacatgaccgagtgtgtgccagtgccctcaagcgagcatgttgcagaaattgtaggcagacagggttgtaaaatcaaggccttgcgagccaagacgaacacatatattaagacaccagtgcgcggtgaagagcctgtgtttatcgtgaccggcagaaaagaggacgtggagatggctaaacgggaaatcctctccgccgcagagcatttcagcattatcagggcaactcgctcgaaagcgggtggcctgcccggtgccgctcagggacctcccaacctgccaggacagaccacaattcaggtccgagttccataccgagtcgtaggcctcgtcgtgggccctaagggggctactatcaaacgcatacagcagcgcacccatacgtacatagtgacccccggaagagataaggagcctgtgtttgctgtgaccggaatgccagagaatgtggaccgtgcgcgagaagagatagaggcccatattactttaaggactggtgcttttacagacgccggaccagactctgacttccatgcaaatggcactgatgtttgtctagatttgctgggtgcagctgcatctctctgggctaaaacaccgaatcagggaaggcgcccacctaccgctacagccggactgaggggagatacggccctgggagccccttctgctccagaggccttttacgcaggcagcagaggaggccctagcgttcccgatcctggccctgcgagcccttactctgggtccgggaatggtgggtttgcatttggtgccgaaggtccaggcgctcctgtggggaccgccgctccagatgattgcgattttggcttcgatttcgatttcctcgccctggacttgacggtgccagccgcagctacaatatgggcaccgttcgagcgcgctgctccgcttcctgccttctccggatgcagtaccgtcaatggagcccctggcccaccggcagcaggcgcaagacgtagcagtggcgctggcacccctaggcattccccgacactccctgagcctggcggactgaggctggagcttcccctgagtcgccgtggtgcccctgatcccgtgggtgctctgtcttggagaccccctcaaggccctgtgagttttcccggaggtgccgctttttcaacagctacatccttaccgagttcgcccgctgccgcagcgtgcgcaccactggattctggtgcttccgagaattccaggaagccaccgagcgccagttccgcccctgccttggcacgcgagtgtgttgtttgcgccgaaggcgaagtgatggcagccttggtgccttgcggccataacctattttgtatggattgcgccgtccggatttgcggaaaatcagagcccgagtgccccgcttgtcggacgccagccacacaggccatcagggtcgagacagaaaccccgcagcctggaggagcatctgctttgcagcgccagtattag

SEQ ID NO: 230412 - DNA, 1956 bp, Artificial Sequence
  Description of Artificial Sequence: Synthetic coding sequence
atgccaagcagtctggggcaaccagatggcggaggtggtggcggtggcggaggaggcggagtgggcgctgctggagaggatcctggaccgggacctgcaccccctcccgaaggggctcaagaggccgcacctgccccacgcccaccccctgagccggatgacgcagcggctgcgctgaggctcgccttggaccagttgtctgccctgggactgggcggagcaggagataccgacgaagaaggtgccgcaggcgacggagcggctgctgccggtggcgcagatggtggagctgcacctgagcccgttccacccgatgggccagaggcaggggcaccgcctactcttgccccagctgtcgctcctggtagtttacccctgcttgatccaaacgcaagtcctccgccacctcccccaccaaggcccagtccccctgacgtgtttgcaggttttgctccccatccggcagcccttgggccaccaacactcttagcagatcagatgtctgtcatcggttctcgtaagaaatcagtgaatatgaccgagtgcgtgcccgtcccgtcttcggagcacgttgctgaaatagtaggacggcaaggatgtaagattaaggctcttcgggcaaagaccaacacctacataaaaacccctgttcgaggagaagagcccgtgttcatcgtcacggggagaaaagaggatgtcgagatggctaagcgcgaaattctaagcgcggctgagcacttttcgatcattcgggcaacaagaagcaaggcaggcggtctgccgggagcggctcagggccctcccaacctgccaggccagacgaccatccaggtcagagtcccctatcgagtagtaggcttggtggtcggtcctaaaggcgctactatcaaacgtattcagcagcgaacccacacttacatcgtgaccccgggaagagacaaggagcctgtgtttgccgttacaggtatgccagagaacgtagaccgggcaagagaggagatcgaagcccatataaccctgcgcactggtgcattcacagacgccggacctgactccgatttccacgcaaacggtacagacgtctgtctggaccttttaggcgcagccgctagtctgtgggcgaagaccccgaaccaagggagacgtccgccaacagcaaccgcaggattgaggggagacaccgctcttggagcaccatcggcgcctgaagcgttctatgccggtagtaggggtggacctagcgtgcccgacccgggaccagcaagcccctacagcggaagtggcaacggcggtttcgccttcggagctgagggaccgggagctcccgtcggaaccgcggcaccggatgattgcgattttggcttcgactttgacttcctggctttggatctcaccgtaccagctgctgccaccatttgggctccatttgaaagagctgcccctttacctgccttctccggctgcagtacggtgaacggtgctccaggaccccctgcagctggggcaaggagatcctccggcgctggaactccaagacattcacccaccctccctgagcccggtggcctgcgtttagaactacctctctctcggaggggcgctcctgatcctgtgggggctctgtcttggcggccaccacagggaccggtctcttttccgggaggcgctgccttttctacagctacttcactaccctcctcacctgccgctgcagcctgtgctcctctagactccggggctagtgagaattctaggaaaccaccctccgcgagtagtgccccagctctggcacgagagtgcgtggtatgcgcagaaggagaagtcatggcagcactggtaccctgcggccacaacctcttttgcatggattgcgctgtccggatttgtggcaaaagtgaacctgagtgcccagcctgccggacacctgctactcaggccatccatatattttcttag

SEQ ID NO: 230413 - DNA, 966 bp, Artificial Sequence
  Description of Artificial Sequence: Synthetic coding sequence
atgcagtgccgcctccccaggggtctggccggtgctttgctaacccttctgtgtatgggactgctgtgtttaagataccatttgaacctaagtccccagcgtgtccagggtacgccagagctgtcccagcctaacccgggacctcctaagttgcaactgcatgacgtttttattgctgttaaaaccacacgcgcattccacaggctaagacttgaactcctcctcgacacatgggtgtcccgcaccagggaacagactttcgtatttaccgattcccctgacaaagggctgcaggagcgcctgggcagtcacctggtggttactaactgcagcgcagagcactcacatcctgcactgagctgtaaaatggccgctgagtttgatactttcctggcctccggcttacgttggttttgtcatgtggatgacgataactacgtgaatccgagggctcttcttcaactgttgagggcttttccgctcgccagagatgtgtacgttggacgtccgagccttaatcgaccaattcatgctagcgaacctcagccacataatcgaaccagactggtgcagttctggttcgcaactggcggagctggtttttgcatcaatagaaagcttgctctcaagatggccccttgggcttctgggagccgatttatggatacatccgcactgataagattgcccgatgactgcaccatgggatacattatagagtgcaagttgggaggtcgtctccagccaagtcctttatttcactcccacctagagaccctacagctgctccgcacagcccagctccccgagcaggtcacactgtcatatggtgtcttcgaaggtaaattaaatgtgatcaagctgcaggggccattttcccccgaagaggatccttccaggttccggagtctgcattgcttactttacccagacaccccctggtgtccacagctcggcgcacgttag

SEQ ID NO: 230414 - DNA, 924 bp, Artificial Sequence
  Description of Artificial Sequence: Synthetic coding sequence
atgcagtgtagactccccagagggctggctggagccttgcttaccctcctctgtatggggcttctctgcctgcggtatcatctgaacctgtcaccccagcgcgtgcagggcaccccggagctaagtcagccaaatcccggtcctccaaagttgcaactccacgatgtgttcatcgccgtgaaaactaccagggctttccatagacttcgtctcgagctgctgctcgacacatgggtgtcgagaacacgggagcaggtgacacgcagccacctcgtcgtcacgaactgttcagcggagcattcccatcctgctctaagctgtaaaatggcagccgagttcgatacatttctggccagcggcctccgatggttttgccatgtcgacgacgacaactacgtaaacccccgagcactacttcagctcctacgagccttcccgcttgcgagggatgtgtatgtgggcagaccaagtctgaacaggccaattcatgctagtgaacctcagccacataacagaaccaggcttgtccagttctggttcgctacgggtggcgctggattctgcatcaatcgcaagctcgctctcaagatggccccatgggcaagtgggtctcgcttcatggataccagcgcactgataaggctgccagacgattgtaccatgggctacatcattgagtgtaaactcgggggtagattgcagccaagcccactgttccactcccacctcgaaacacttcagctccttaggacagctcagctcccagagcaggttaccctgagctatggagtgttcgaaggaaaactgaacgtaatcaaattgcaggggcctttcagtccagaggaggatccatcaagatttcggagtcttcactgcttgctgtaccccgacaccccatggtgtccccagctcggcgcaaggtag

SEQ ID NO: 230415 - DNA, 357 bp, Artificial Sequence
  Description of Artificial Sequence: Synthetic coding sequence
atgcagtgtcggctcccacgagggttggccggtgcgctactcaccctgctttgtatgggattactgtgccttaggtatcacctaaatttgtctcctcagcgtgtgcaaggcacccctgagttaagtcagcccaaccctggtcctccaaagttgcagcttcacgatgtatttatcgccgtgaaaaccacccgcgcatttcacagacttcgcctggagttgctcctggacacatgggtgagcaggaccagggaacagaccttcgtattcactgactctcctgataaggggctgcaggagcggctggggtccccagatagttctagtctgctgcaagggccaaccttatggtccccgtag

SEQ ID NO: 230416 - DNA, 399 bp, Artificial Sequence
  Description of Artificial Sequence: Synthetic coding sequence
atggccgctgaattcgataccttcctggcctcaggactgagatggttttgtcacgtcgacgatgacaattatgtcaatccgagggctctgctgcaactgctccgggctttcccactggccagggacgtgtatgtgggtaggccgtccctgaacaggcccattcatgcttcagaaccacagcctcataatcgcacccgtctggttcagttctggttcgcaacgggcggagctggcttttgcattaaccggaagctcgcactcaaaatggcgccttgggccagcgggagcagattcatggacacctctgctctcattaggctgcctgacgactgcactatggggtatattattgaatgtaaacttggaggcagactacagccttctcctctgttccactag

SEQ ID NO: 230417 - DNA, 132 bp, Artificial Sequence
  Description of Artificial Sequence: Synthetic coding sequence
atggcggctgaattcgatacgttccttgcctcagggctccgttggttctgccacgtcgatgatgataactacgtaaatcccagggccctcctgcaactgctcagggcatttcctctggcacgggacgtgtag

SEQ ID NO: 230418 - DNA, 264 bp, Artificial Sequence
  Description of Artificial Sequence: Synthetic coding sequence
tgatcccatttagaaactcttcagctgctccggacggcccagctgccggagcagataagtctgccgccattgagcgccttaagtcgatacaccctcgtgagccccgctggctgccctatgaatcctgaacttctcggtaagggttgggctgagacttccggttgcgcgctggctcccaaagtcgctctgtgggtaccgggaaagtgccttgttatagggtcaccatggcaggggctgcgcgtggtcggaaaaccacgcatctag

SEQ ID NO: 230419 - DNA, 999 bp, Artificial Sequence
  Description of Artificial Sequence: Synthetic coding sequence
atggggctgggcccagtgttcctactgctggcgggtatttttcccttcgccccacctggcgctgcggctgagccgcactccttgcggtataacctcacagttctgtcgtgggatgggtccgtccagagcggatttttagctgaggtgcacttggacgggcagcctttcttaagatatgacaggcagaagtgccgcgcaaaaccccagggccagtgggctgaagacgtgctaggtaacaagacttgggatagagaaacccgggacctcaccggaaatggtaaggatcttcgcatgaccctggcgcacatcaaggatcagaaggaggggttgcacagtctgcaagagattagagtgtgcgaaattcacgaggataactcaactcgcagttcccagcatttctactacgacggcgaacttttcctgtcccagaacttggagacagaggaatggactgtgccccaatcctctagagctcagacactggctatgaacgtccgaaatttcctgaaggaggatgctatgaagacaaaaacccactaccacgctatgcacgccgattgcctgcaggaactccggaggtacctggagagtggggttgttctgcggcgtacagtgccccctatggtgaatgtgacacgttccgaagcctcagagggaaacatcactgttacatgtcgggcatcatccttttatcctaggaacataatcctgacctggagacaggatggtgtgtctctgagccatgacacccagcaatggggggatgtgctgcctgatggcaacggaacataccagacatgggtggctactaggatctgtcggggtgaggagcaaagatttacatgttacatggaacattctggcaatcactccacacatccagtgccaagtgggaaagtgctcgtgttgcagagccactggcagactttccatgtgtcagctgtagccgcaggatgttgctacttctgctattattatttcctatgtccactgctctag

SEQ ID NO: 230420 - DNA, 585 bp, Artificial Sequence
  Description of Artificial Sequence: Synthetic coding sequence
atggggcaacgagaccagggtctggaccgggagcgtaagggcccacaggatgaccctggcagctaccagggccctgagagacgaaactttctgaaagaagatgccatgaagacaaagacccactatcatgcaatgcacgcggattgccttcaggaactgcggagatatttagagagcggagtggtgctgcgcaggacagtgcctccaatggtaaacgtgactagaagcgaggcgtccgaaggcaacatcacagttacatgtcgcgcaagctccttctaccccagaaacatcatactgacatggcgccaggacggcgtatctcttagtcacgatactcaacagtggggtgacgtactgcccgacggaaatgggacctaccaaacctgggtggccacaaggatctgcaggggtgaagagcagcgattcacatgttacatggagcattcgggaaatcacagcacacaccctgtgcccagtgggaaagtgctcgtgcttcagtcacactggcagacgttccacgtgtcagctgtggccgcaggctgttgctatttttgctactactacttcctgtgtcccctgctctag

SEQ ID NO: 230421 - DNA, 870 bp, Artificial Sequence
  Description of Artificial Sequence: Synthetic coding sequence
atgggccttggccctgtgttcctcctgttggctggaatcttccccttcgccccacctggggcagccgctgagcctcactccctccggtacaaccttaccgtcctttcatgggacggatccgtgcagagcggttttcttgccgaggtgcaccttgatgggcagccattcttgcggtatgatcggcagaagtgtcgagccaaaccgcaagggcagtgggccgaagacgtgctcggtaataaaacctgggatagggaaacgagagacctgaccggtaacggaaaggatctgcggatgaccctagcacacatcaaggatcagaaggaagtgcctcagtctagtcgggctcaaaccttggcaatgaacgtgcggaactttctcaaggaggatgccatgaaaaccaaaacccactatcatgccatgcatgccgactgtctacaggagctgcggaggtacctcgagagtggagtcgttctgcgccgaacagtgcctcctatggtgaatgtgactcgtagcgaggcttctgaagggaacatcactgtcacatgcagggcttccagcttttatcctcggaatataattctgacttggagacaggacggtgtttcactcagccatgatacacaacagtggggagacgtcctacccgacggaaacggcacttatcagacctgggtggccactcgaatctgtaggggtgaggagcagaggttcacgtgttatatggaacatagtgggaatcattccacacaccctgtgccatccggcaaagtcctggttttgcaatctcattggcaaacctttcacgtcagcgcagtggctgccggatgctgttatttctgctactattacttcttatgcccgcttctgtag

SEQ ID NO: 230422 - DNA, 738 bp, Artificial Sequence
  Description of Artificial Sequence: Synthetic coding sequence
atgggtcaaagagaccaacgtcttgatcgagaacgaaagggtccacaagatgatccagggtcttatcagggaccggagaggagaaacttcttgaaggaggatgccatgaagactaagacccactatcatgccatgcatgctgactgcttgcaggagttgcggagataccttaagagcggtgttgtattacgcagaaccgtgcccccaatggtaaatgtaacccgtagcgaggcaagtgagggcaatattacagtgacctgccgagcaagcggattttacccctggaacattaccctgtcctggcgccaagacggggtcagcctgtcgcacgacacccagcagtggggtgacgtgcttcctgatggcaatgggacctatcagacttgggtggcgacaaggatttgccaaggcgaggaacagaggttcacctgttatatggagcatagcggcaaccacagcactcaccccgtgccctcaggcaaggtgcttgtgctgcagtctcactggcagacattccacgtatccgccgtggccgctgctgccatcttcgtgatcattattttttatgttcgctgctgtaagaaaaagacatccgccgctgaggggccagagcttgtctctctccaggtcctggaccaacatccggtgggtacatccgatcacagagacgccacccaactggggtttcagcccctgatgtcagacctcggctcaacaggctctaccgagggcgcatag

SEQ ID NO: 230423 - DNA, 1152 bp, Artificial Sequence
  Description of Artificial Sequence: Synthetic coding sequence
atgggactgggacccgttttcttactcctggctggtatttttccgtttgccccacctggggcagccgcagaaccgcactctctcaggtacaaccttaccgttctctcctgggacggcagcgtgcagtctggctttctgacggaggtccatttggacggccagcctttccttcgatgcgaccgccaaaaatgtcgagctaaaccccaggggcagtgggccgaggacgtgctggggaacaagacttgggaccgggagaccagggacctgacgggaaacggaaaagatctccgtatgaccttggctcacatcaaggaccagaaagaaggacttcactctctccaggagatacgtgtctgcgagatccacgaggacaactcaactaggagctctcagcacttttactacgatggcgaattgtttcttagccagaacctggaaacaaaagagtggacaatgccccagtcttctagggctcagacacttgcaatgaacgttaggaactttctgaaggaagacgcaatgaagacgaagacacattatcacgccatgcatgctgactgtctgcaggaattgcgcagatacctgaagagcggcgtagttcttagaagaactgtccctcccatggtgaatgtgacacggtctgaggcttctgagggaaatattaccgttacttgtagggcctctgggttttatccctggaacatcactttgtcctggaggcaggacggcgtcagcctatcacacgatactcagcaatggggagacgtcctgcctgacggcaatggaacctaccagacatgggtggctacccgcatatgccagggcgaggagcagcggttcacctgctacatggagcatagtggtaaccactccacacaccccgtcccctccggcaaggttctggtgctacagtcccattggcaaacattccacgtgagtgccgtagcagcggcagctattttcgttataatcatcttttatgtacggtgttgcaagaagaaaacttctgctgcagagggaccggaacttgtatctttacaggtgctggaccagcaccccgtcggaacaagcgatcatcgcgatgctacccagctgggattccagcccctcatgtctgacctggggagcaccggatcaactgaaggggcttag

SEQ ID NO: 230424 - DNA, 870 bp, Artificial Sequence
  Description of Artificial Sequence: Synthetic coding sequence
atgggcctcggtcctgtgttcctcctgctggctggtatctttccctttgcaccccctggagctgccgctgagccccactcattaaggtataacctgaccgtgctgtcctgggacggatctgtacaatcaggctttttggcagaggtgcatctggatggacagccattccttagatatgacaggcagaaatgccgagccaagccccagggacagtgggcagaagatgtcttgggaaataaaacctgggatcgggagacaagggacctcaccggtaacgggaaggacctccgcatgaccctggctcacattaaggatcagaaagaagtcccccaaagctctcgcgctcagacactcgcgatgaacgtccggaatttccttaaggaagatgccatgaagaccaagactcattatcacgccatgcacgctgactgtctgcaggagctcagacggtacttggagagcggtgtagtgcttaggcgaacagtccctccaatggtgaacgtcacccgcagcgaagcgtcagagggcaatatcaccgtaacatgtcgtgcgtcatctttttatcctcggaacatcattttgacctggcgtcaggatggcgtctctttgtcccacgacacccaacaatggggagacgtgttacctgatggtaatgggacataccagacttgggtcgctacaaggatatgcagaggcgaagaacagcggtttacatgttatatggagcattcaggtaaccactctacccatcccgtcccttccggcaaggtccttgtgcttcagtcccattggcagacctttcacgtttctgcagtcgctgcgggatgttgttatttttgctactactactttctgtgcccactgctgtag

SEQ ID NO: 230425 - DNA, 999 bp, Artificial Sequence
  Description of Artificial Sequence: Synthetic coding sequence
atgggcttagggcctgtctttctgttacttgccggtatcttcccttttgccccacccggtgccgctgcagagccccacagtctgcgttataatctgacggtgctatcttgggatggatcggtgcagtccggttttctggccgaagtccacttggatggccagcccttcttgcgatatgacaggcagaagtgtcgtgctaagcctcagggacagtgggctgaagacgttctcggcaataaaacatgggatcgcgagaccagggacctcaccggaaatgggaaggatctgagaatgaccctagcgcacatcaaagaccagaaagaaggcctccactcactgcaggagataagagtgtgcgagatccatgaagataacagtactcgctcctcccagcacttttactatgacggggaactctttctctctcagaatctggagacggaagagtggaccgtgccacagagttctcgagcccagacactggctatgaacgtgcggaactttctaaaggaagacgccatgaaaacaaaaacacactatcatgccatgcatgccgattgcttacaggaactccgtaggtatctggaaagcggcgtggtgctgcgtaggaccgtaccacctatggtgaatgtgacccgatctgaagcgtccgagggcaacatcaccgtgacctgtagagcttcttctttttatcccaggaacatcatccttacctggaggcaagacggagtgtctctcagccatgacacacaacagtggggagacgtgctgcctgacggaaatggcacatatcagacttgggtggcgactaggatctgtaggggcgaggagcagcgttttacctgctacatggaacactcggggaaccactccacccacccagtaccatctggaaaggtgctggtgctccagtcccactggcaaactttccatgtgtctgccgttgcagccggatgctgttatttttgttattattattttctgtgcccactgttgtag

SEQ ID NO: 230426 - DNA, 585 bp, Artificial Sequence
  Description of Artificial Sequence: Synthetic coding sequence
atgggtcagagagaccaaggactggatcgcgaaagaaaaggaccacaggacgatccgggtagctaccagggtcctgagaggcgtaattttctgaaggaagacgctatgaagacaaagacccattatcacgctatgcatgccgactgcctgcaggagcttcggaggtatctagagtcaggggtggttctgcgtagaacagtgccccctatggtcaacgtaacccgttccgaggcatccgagggaaacataaccgtcacttgtagagcttcttctttctatccccgaaatattatactgacatggaggcaggacggagtgtccctgtcccatgatacccagcagtggggggatgtccttcccgatggaaacggcacatatcagacatgggtggccactcgcatctgtaggggcgaggagcagaggttcacctgctatatggagcactccggtaaccattccacacaccctgtcccatcaggtaaagtcctcgtgctgcagagtcactggcaaaccttccacgtgtctgctgtcgccgctggctgctgctatttttgctactattatttcctctgtcctcttctgtag

SEQ ID NO: 230427 - DNA, 831 bp, Artificial Sequence
  Description of Artificial Sequence: Synthetic coding sequence
ttcccatttgcccctcctggcgctgcagccgagccacattcgctaagatacaatcttaccgtcctttcttgggatgggtcagttcagagcggcttcctcgcagaagtccatctggacggccagccttttctgcgatacgatcgtcagaaatgccgggcaaaaccccagggacaatgggccgaggatgttctcggaaacaaaacctgggatcgtgagactagggacctcacaggtaacggcaaggacctgagaatgaccttagcccacatcaaagaccaaaaggaagttccgccaatggtcaacgtcacacggagcgaggcctcagaaggtaacataacggtaacttgtcgtgcctcctctttttacccgcgaaacattactctaacctggagacaggacggcgttagcctgagtcacgatactcaacagtggggtgacgtgttaccagacggaaacggcacataccagacctgggtagctacaaggatttgccagggcgaagaacagagattcacttgctatatggaacactcgggaaaccactccactcatccagtcccatctgggaaggtcctggtcctgcagtcacattggcaaacctttcatgtcagcgccgttgccgcagccgctgccgcaatcttcgtgattattatcttctacgtacgctgttgcaaaaaaaagaccagtgctgctgaggggccagagctggtctcactgcaggtgttagatcaacaccccgtgggtacaagtgaccatagagatgcaacacagctgggttttcagcctctgatgagcgccctaggatcaaccggatcaaccgagggggcttag

SEQ ID NO: 230428 - DNA, 1158 bp, Artificial Sequence
  Description of Artificial Sequence: Synthetic coding sequence
atgggcctcggccctgtatttctactgcttgctggtatttttccattcgcccctcctggagctgccgcagagccacactccttgcgatataatctgacggtgctgagctgggacggcagcgtccagtctgggttcttggcagaggtccatttggatgggcagccttttctaagatatgatagacagaaatgtcgagccaagcctcagggacagtgggcagaggatgtccttggcaataagacttgggatagggagacaagagatctgactggaaacggcaaggatctgcgaatgaccctcgcacatattaaagaccagaaggagggcctgcactcgctgcaggaaattcgggtgtgtgaaatccacgaggacaattctacccgatcttctcagcatttctactatgatggagaacttttcttaagtcaaaatgttgagaccgaagaatggacggtcccccaatcaagccgcgctcagactttggccatgaacgttcggaatttcttaaaagaagacgctatgaaaaccaaaacgcactatcacgccatgcacgccgattgtctgcaggagctcagacgctacttggagtccagcgttgtgcttcggaggagagtgccccctatggtgaatgtgacaagatcagaagcaagtgaggggaatatcactgtgacatgtcgggcttcgagcttctaccctaggaatattactctaacgtggcggcaagatggggtatcattgtcccatgacacacaacagtggggtgacgttctgccagacggcaatggcacgtaccagacatgggttgccaccaggatctgccagggtgaggagcagagattcacatgctacatggagcactcaggcaaccactcaactcacccggtgccctcggggaaagttttggtgctccagagccattggcaaacattccacgtgagcgcagttgccgcagctgcagcggcaatcttcgtaattattatattttatgtcaggtgctgtaaaaagaagactagtgcggcagagggccctgagttggtgtctcttcaggtcttggatcagcaccctgtaggaacctccgatcatcgcgatgccacccagctgggatttcagcctctgatgagtgctcttgggtccaccggcagtaccgaaggagcttag

SEQ ID NO: 230429 - DNA, 744 bp, Artificial Sequence
  Description of Artificial Sequence: Synthetic coding sequence
atgggacaaagagaccaagggctggatcgagaacgcaaaggcccacaggatgaccctgggagctaccagggtccagagaggagaaacttccttaaggaggatgctatgaaaacaaagacccattaccacgcaatgcacgccgattgcttacaagaattgcgcagatacctggaaagcagcgtggtcttgaggagaagagtgcccccaatggtcaatgtgacgcgcagtgaagcttcagaaggaaacatcacggtgacatgcagagctagctcattctaccccaggaacatcactctgacctggcgccaggacggtgtgtcattatcccacgatacccagcaatggggtgatgttctcccagacgggaacggaacctatcagacttgggttgctacacggatctgccaaggtgaagaacagcggttcacctgttatatggagcactcaggtaaccattctactcaccctgtgcctagtggcaaagtactggtattgcaaagccactggcagacttttcacgtgagcgcagttgcagccgcagcagcggctatttttgtgattatcattttttacgtgcgctgttgcaagaaaaaaacatcggctgctgagggaccagagctggtgagcttacaggttctcgatcagcaccctgttggcacctctgatcatagagacgccactcagctgggatttcagcctctaatgtcagcccttggatccacgggctccaccgagggcgcatag

SEQ ID NO: 230430 - DNA, 672 bp, Artificial Sequence
  Description of Artificial Sequence: Synthetic coding sequence
ttcccttttgcccctccaggagccgcagctgaaccccactctctcaggtacaatctgacagtcctctcttgggatgggtcagtacagagcggctttttagcagaggttcacctggacggtcagcccttcctccgatacgatagacaaaagtgtagggccaagccccagggtcagtgggcggaggatgttctagggaacaaaacatgggaccgggagaccagagatctcaccggcaacgggaaagatttgagaatgacactcgctcacatcaaagaccagaaagaagtgccccctatggtgaatgtgacccggtctgaagcctctgagggcaatatcactgttacctgccgcgcttcttcattttatccaagaaacatcatcctgacttggcgccaggacggtgtttctctcagccacgacacacagcagtggggtgatgtcctgcccgatggcaatggcacctaccaaacatgggtggccacacgtatctgtagaggagaagagcaaagatttacatgttacatggagcactctggtaaccacagtacccaccctgtgccatcaggtaaagtcctagtgttacagtcacactggcagactttccatgtttccgccgtcgctgcaggctgctgctacttctgttactactattttttgtgccccctgctgtag

SEQ ID NO: 230431 - DNA, 672 bp, Artificial Sequence
  Description of Artificial Sequence: Synthetic coding sequence
tttccctttgcgccacctggagctgcagcggaaccccactcgcttcgctataacctgactgtgctttcgtgggatggatcggtccagagtgggtttctcgctgaggtccacttggacggccaaccattccttcgatacgatagacagaagtgtagggccaagcctcaaggccagtgggctgaggacgtactgggtaataaaacatgggaccgcgaaacacgcgacttaaccggaaatggcaaagacctgaggatgaccctggcgcatattaaggaccagaaggaggtcccgcctatggtgaacgttacccgcagtgaagcttcggaaggcaatattacagtcacatgcagagcatcctcattctaccctcgcaacataatcctcacctggcgccaggatggcgtgagcctgtcccatgatacccagcagtggggagatgtcctgccggatggcaacgggacgtatcagacatgggtggcaacgcggatttgccgcggtgaagagcagcgcttcacgtgctatatggagcactcagggaaccacagcacccacccagtgccctccggtaaagtgctggtcctacagtcccattggcagacattccatgtatcagccgtggcagcagggtgttgttacttctgttattattatttcctttgcccgctcctgtag

SEQ ID NO: 230432 - DNA, 672 bp, Artificial Sequence
  Description of Artificial Sequence: Synthetic coding sequence
ttcccctttgcccctcccggagcggcagcagaacctcatagtctgagatataatctgacggtgcttagctgggacggcagcgtacagagcggcttccttgctgaagttcaccttgatggacagccatttctgcgttacgataggcagaagtgcagagccaaaccgcaaggccagtgggcagaggatgtcttaggcaacaagacctgggaccgagaaacccgggacctcacaggcaacgggaaagatttacggatgactctcgcacatataaaggaccagaaagaagtcccacccatggttaatgttacgcggagtgaggctagcgaagggaacatcacagtgacctgtcgggcttccagtttctatccgagaaacatcattttaacttggaggcaggatggggtgtcgctgagccatgatactcagcagtggggcgacgtcctgccagacggtaacgggacataccagacttgggttgcgacgcgcatctgccggggagaagaacagcggttcacgtgttacatggagcactcaggaaaccacagcactcatcctgtgccttctggcaaggtgttggtgttacagtctcattggcaaacattccacgtgagcgccgtggccgctgggtgctgttacttctgctattactacttcctgtgtcctctcctgtag

SEQ ID NO: 230433 - DNA, 999 bp, Artificial Sequence
  Description of Artificial Sequence: Synthetic coding sequence
atgggcctcgggcctgtttttctgctactcgctggaatcttcccatttgcgcctcccggtgctgctgctgagccccattccctcagatacaatctcacagtcctgtcttgggacgggtccgtccagtcagggtttttggccgaggtgcacttagacggccagcctttcctgcgttatgaccgacaaaaatgtagagcgaaaccccaaggccagtgggccgaggatgttctggggaataagacgtgggatagagaaactcgtgatctgaccgggaatgggaaggacctgcggatgactttggcccacatcaaggatcaaaaagaaggtctccactctctgcaagaaatcagggtctgtgagatccacgaagacaactctaccagaagctcacagcacttttactacgacggagaactgtttctctctcagaacttagaaacagaagagtggactgtcccacagtcttcccgcgctcaaactctggcaatgaatgttcgtaacttcctgaaagaggatgctatgaagacaaagacacactaccatgccatgcatgcggattgcctccaggagctgcgaaggtatctggagagtggagtcgtccttagaagaactgtcccccctatggtgaacgttactcggagcgaagcctctgaagggaacatcaccgttacttgtcgtgcgagctcattttaccctcgcaacattatcctgacttggcgacaagacggggtgtccctttctcacgatacccagcagtggggagacgtgctgcccgatggcaacggcacataccagacttgggtcgccacaagaatttgccgaggggaggaacaaaggtttacctgttacatggaacatagtggaaaccatagcacgcaccccgtgccatctggcaaagtgctagtcctccaatcgcactggcagacattccacgtgtccgccgtggctgccggttgctgttacttttgctactattactttctgtgtccgttgctctag

SEQ ID NO: 230434 - DNA, 1029 bp, Artificial Sequence
  Description of Artificial Sequence: Synthetic coding sequence
atgggcctaggtccagtgttcctcttgctcgctgggattttcccattcgctccaccaggcgctgccgcagaaccccactctctgagatataacctcaccgttttgtcctgggatggatcggtgcagagcggatttcttgcagaggtccatcttgacggacagccctttctgagatacgaccggcagaaatgtcgtgctaaaccacaagggcagtgggcagaagacgttttgggcaataagacgtgggatcgggaaactagagacctcaccggaaatggcaaagaccttcggatgacactcgctcatatcaaagaccaaaaggaggtgccgcagagcagccgcgctcagactctggccatgaacgtgaggaacttccttaaggaagacgccatgaagaccaaaacacattaccacgctatgcatgcagactgcctgcaagaacttcgccgttaccttgaaagctctgtggttctccgacgtcgtgtacctccaatggtgaacgtcactagaagcgaggcttctgagggaaacattacagtgacatgcagagcatccagcttctaccccaggaatatcacactgacctggagacaggacggtgtgtctctctcacacgacacacaacagtggggggacgtcctaccagatggcaacggaacataccagacttgggttgccactagaatttgtcagggcgaggagcagcgattcacttgttatatggagcactccggcaaccattcaactcaccctgtccctagtggaaaagttctcgtgctgcaaagtcattggcagacgttccacgtaagcgccgtggcagctgcagccgctgccatctttgtcatcattatcttctacgtgaggtgttgcaaaaagaagaccagcgccgcagaaggacccgagctggtgagccttcaagtgctggatcaacaccctgtcggtacaagcgatcatcgcgatgcaacacagttagggtttcagccgttgatgtccgctctgggttctacaggcagtacagaaggggcttag

SEQ ID NO: 230435 - DNA, 825 bp, Artificial Sequence
  Description of Artificial Sequence: Synthetic coding sequence
tttcctttcgcgcctccaggggctgccgctgaaccccacagtctgcgctataatttaacagtgctgtcttgggacggaagtgtacaatctggattcctaacagaggtgcacttggatggccaaccattcctgaggtgtgatagacagaagtgtagagcgaagcctcagggccagtgggccgaggacgtgcttgggaacaaaacttgggaccgggagacccgggatcttacaggcaatggaaaggacctccgcatgacactcgcccacattaaagaccagaaggaggtgccgcctatggtgaacgtcacccgcagtgaggcctcagaaggcaacataaccgttacttgtagagccagtgggttttatccctggaatattaccctatcgtggcgacaggacggagtgtctttgtcacatgacacgcagcagtggggagacgtcctacctgacggaaacgggacataccagacttgggtggccactcggatctgccaaggcgaggagcaaagattcacctgctacatggaacatagcggaaaccattccacacacccagtgccatccggaaaagtactggtcctccagtcacattggcagacctttcacgtgagcgccgttgcggcagcggctatctttgtaatcattatcttctacgtgcgctgttgtaaaaagaaaactagcgcagccgagggcccagagctagtgagtctccaggttttggaccagcatcccgtgggcaccagcgatcaccgcgacgccacccaactgggctttcagccactcatgagtgacctgggctccaccggctcgacggagggagcatag

SEQ ID NO: 230436 - DNA, 585 bp, Artificial Sequence
  Description of Artificial Sequence: Synthetic coding sequence
atgggccagcgagatcagggactggaccgggagcgcaaaggcccacaggacgatcctggaagttatcaggggccagagcgcagaaattttctgaaggaagacgccatgaagactaaaacccattatcatgcgatgcatgcagactgccttcaggaactcaggagataccttgaatctggcgtggtactgagaagaacggtcccacctatggtgaacgtgacacgttcagaagcgagtgagggtaatatcactgttacatgtagagcatcaagcttttatcccaggaacataattctgacatggaggcaggatggggtcagtctgagccacgacacccaacaatggggtgacgtgctcccagacggcaatggaacctatcagacatgggtcgccacgcgtatctgccgcggagaagaacagcgatttacctgttacatggagcactccgggaatcactctactcatcccgtaccttccgggaaggttctggtcctccagagtcattggcaaacattccacgtgagcgcagtcgccgctggatgctgctacttttgttattactatttcctctgtcctctgctttag

SEQ ID NO: 230437 - DNA, 870 bp, Artificial Sequence
  Description of Artificial Sequence: Synthetic coding sequence
atgggcctaggaccagtatttttgctgctagctggaattttccccttcgctcccccaggcgctgccgcagaaccacacagcctgcgctataacctgaccgtgttgtcctgggatgggagcgttcagtctggatttctcgctgaagtgcatctggatggccagcctttcctgcgctacgaccgccagaagtgcagagcgaaaccacagggccagtgggctgaggatgttctgggcaataagacctgggaccgagagacacgcgatctgaccggcaacggcaaagatcttcggatgacactcgcacacattaaagaccagaaggaggtccctcagagtagtagagctcagacactggctatgaatgtcaggaacttcctgaaagaagatgcaatgaagactaagacccactatcatgctatgcacgctgactgcctgcaagaactccggcgttacctggagagcggggtggtgcttcgcagaactgttccccctatggtgaacgttacacggtccgaagcctccgaaggtaatattaccgtcacctgccgcgcttcctccttctaccctagaaatatcattctgacctggagacaggacggagtatctctgagccatgacactcagcaatggggcgatgttttgccagatgggaacgggacctatcagacatgggtcgccacccgaatatgtagaggcgaggagcagaggtttacctgctacatggagcattcagggaaccatagcacccatcctgtgccctcaggaaaagttctggttctgcagtcccattggcaaacattccatgtttccgcggttgctgcagggtgctgttatttctgttactactactttctgtgccctttactatag

SEQ ID NO: 230438 - DNA, 999 bp, Artificial Sequence
  Description of Artificial Sequence: Synthetic coding sequence
atggggcttggacctgtgttcctcctgttggcgggtatcttcccattcgctccccctggcgctgctgctgaaccacattcactcagatacaatcttacagttctcagctgggatggatccgtgcaatctgggtttctcgctgaagtgcatcttgacggacagccatttctgagatacgacaggcaaaaatgtagagcaaaaccgcagggacagtgggccgaagatgttctgggaaataagacatgggatcgcgagacacgtgacctgacaggaaacggaaaggacttacgaatgactctcgctcacattaaggatcagaaggaaggtctgcactcgttgcaggaaatccgggtttgcgagatccacgaggacaactcaacccggtcctcacagcatttttattatgatggcgaactatttctgagccaaaacctggagactgaggagtggaccgtcccacagtctagccgagcacagacactggccatgaacgtgcggaatttcttaaaagaggatgccatgaagactaagactcactaccacgccatgcatgcagattgtttgcaagagctcagacgctatttggaatcgggcgtggtgctgaggagaacggtgccccctatggttaatgtgacgcgaagtgaggcatcagaaggaaacatcacagtgacctgtagagcatcaagtttttacccccgaaacatcattctgacttggagacaggatggtgtcagcctaagccatgacactcagcagtggggagacgttctgcctgatgggaacggcacctatcagacatgggttgcaacccggatttgccgcggagaagagcagaggttcacatgttacatggagcactccggtaatcattctacccaccctgtgccaagcggcaaggtcttggtattgcaatcgcactggcagacattccacgtttctgccgtcgcggctgggtgctgttatttctgctactactacttcctatgccctctcctgtag

SEQ ID NO: 230439 - DNA, 999 bp, Artificial Sequence
  Description of Artificial Sequence: Synthetic coding sequence
atggggctgggccctgttttccttttgctcgcaggcatcttcccattcgcacctcctggcgcagccgcagaacctcattctctaagatacaatctgactgtcttgagctgggatgggtcagtccagtctggctttctggccgaggtgcacctcgatggacagccatttttaaggtacgataggcaaaagtgcagagcaaagccacaggggcagtgggctgaagacgtgctgggcaataagacctgggaccgcgaaacacgcgacttgacgggcaacgggaaggatctgagaatgacactggcacacattaaagatcagaaagaagggctccattccttgcaagagattcgagtgtgcgagattcacgaagataattctacacggtcttctcagcacttctattacgacggcgaactgttcttgtcacagaacttggaaacagaagaatggaccgttccacaatcctcccgcgcacaaacactggccatgaacgtgaggaactttctgaaagaggacgctatgaaaacaaagacccattaccatgccatgcatgcagattgtttgcaggaactacggaggtatctagaatcgggggttgtactcaggagaacagtgccccctatggttaatgtgacccgttctgaagcgagcgagggtaacatcacggtcacctgtcgagcgagtagcttttaccccagaaacattattctgacctggcgacaagatggagttagtctcagccacgacacccagcagtggggagacgtcctcccagatgggaacggaacataccagacttgggtcgcaacccgaatatgtcgtggcgaagaacagcggtttacatgttatatggagcacagcggaaatcattcaacccatcctgtgccgtcagggaaagttctcgtgttacagagtcattggcaaactttccatgtgagtgccgttgcagctggctgctgctatttctgttactactattttctgtgccctctgttgtag

SEQ ID NO: 230440 - DNA, 1152 bp, Artificial Sequence
  Description of Artificial Sequence: Synthetic coding sequence
atgggcctaggtcccgtcttccttctgctcgctggcatcttcccatttgcccctccaggggcagctgcggaaccacatagtctcagatacaaccttaccgttctgagctgggatgggtcagtgcagtcagggttcctaaccgaggttcacttagatgggcagccgttcttaaggtgcgacaggcagaaatgtcgagccaagccccagggacagtgggccgaggatgtattggggaataaaacttgggacagagagactagagatctgaccggcaatggcaaagatctgaggatgacgcttgctcacattaaggaccagaaggaagggctccattccctacaggaaattagagtttgtgagatccacgaggacaattcgactcggtcctcccagcacttctattacgacggtgaactgttcctgtcccagaatcttgaaacaaaggagtggactatgcctcaaagcagccgcgctcaaactcttgcaatgaacgtcagaaacttcctgaaggaagatgcaatgaagaccaaaacacattaccatgctatgcatgcagactgtttgcaggagctgagacggtatctgaaatccggtgtcgttcttcgacgcactgtcccacccatggtgaatgtaactcgatctgaagcatccgaaggtaatatcactgtgacctgtcgcgcttccgggttttatccctggaatatcaccttaagctggcggcaggatggcgtttcgctgtcccatgatacccagcagtggggcgatgtgctccccgatggcaatggcacctatcagacatgggtggccacccgaatctgccagggggaggaacagaggttcacctgctatatggagcacagcgggaatcactccacacaccccgtgccaagtgggaaagtcctcgtgttacagtcccattggcaaactttccacgtgagcgccgtcgcagctgccgcaatttttgtaatcataattttttacgtgagatgctgcaagaaaaagacaagtgccgctgaagggcctgagctggtgtctttacaggtcctggatcagcaccccgtgggcacctctgatcatcgggacgccactcagctcggtttccagcctctgatgtcagatctgggcagcaccggctccacggagggcgcatag

SEQ ID NO: 230441 - DNA, 999 bp, Artificial Sequence
  Description of Artificial Sequence: Synthetic coding sequence
atgggtcttggacctgtgtttttgctgctggcaggcatcttcccttttgcgcctccgggagccgcagcagagccccacagtcttagatataacttgaccgttctgagttgggacggttccgtacagtcaggcttcctggccgaggtccacctggacgggcagccatttctgaggtacgaccgacagaaatgccgggctaagccacaaggtcaatgggcagaggatgtactgggcaataagacatgggatcgggaaacccgcgatctgactggcaacggcaaggaccttcggatgacacttgctcatatcaaggatcagaaggaggggctgcactctctgcaagagatacgtgtgtgtgagatccacgaagacaatagcaccagatcctcccagcatttctactacgatggggagctattcttgtctcagaatctggagactgaagagtggacagtcccccagtcgagtagagctcagaccctcgccatgaatgtgaggaatttcctgaaggaagacgccatgaagactaagactcactatcatgccatgcacgcggattgcctgcaggaactgagaaggtacctggagtcaggcgtggtgctgcggagaacagtgcccccaatggtcaatgtcacgaggagcgaggctagtgaaggaaacattacggtcacctgccgggctagctcattctatcccagaaatatcatactgacatggagacaggatggtgtcagtttatctcacgatacacaacagtggggcgatgtgctccctgatggcaatggaacctaccagacgtgggtcgctacacggatttgtcgcggagaggaacaacggtttacttgttacatggagcactcaggtaatcactctacccacccagttccctctgggaaagtcctggtgctgcaaagtcattggcagactttccacgtgagtgcagtggctgccggatgttgttacttctgttattattacttcctctgcccccttctgtag

SEQ ID NO: 230442 - DNA, 999 bp, Artificial Sequence
  Description of Artificial Sequence: Synthetic coding sequence
atggggctgggccctgtgttcctcctattagccggtatattcccctttgcccctcctggagcagctgccgaaccccatagtttaaggtataacctgacagttctctcttgggatggcagtgtgcaatccggttttctagcagaagtgcatctggacggtcagccgtttcttcggtatgaccgtcaaaaatgtagggcgaagccacagggacaatgggccgaggatgtgctggggaacaagacctgggaccgtgagacccgggacctgacgggtaacgggaaggatcttcggatgacattggcccacatcaaagatcaaaaagaagggctgcacagtctgcaggaaatccgcgtctgcgagatccatgaagataacagcactcgcagctcccaacatttttactacgatggagaattgtttctgtctcagaacgtcgagactgaggaatggactgtcccgcagagcagccgagcgcagacgttggccatgaacgtgaggaatttcctgaaagaggatgccatgaagacaaagacccactatcacgccatgcacgctgattgcctccaggagctaagaagatatctcgagagttccgtcgtactccggagacgcgtccctcctatggtgaatgttacccgctcagaagcatctgaaggaaatatcaccgttacctgccgagccagcagtttctaccctcgaaacatcacactgacatggcgtcaggatggggtgtctctctcccacgacactcagcaatggggggacgtcctgcctgatggaaatggcacctaccagacatgggttgctaccaggatttgccagggcgaagaacagagattcacctgctacatggaacattctggtaaccattccactcatccagtgccaagtggaaaagtgctggtgctgcagagccattggcaaaccttccacgttagtgctgtcgcagcttgctgctgctacttttgttattactacttcctttgccctctgctatag

SEQ ID NO: 230443 - DNA, 1152 bp, Artificial Sequence
  Description of Artificial Sequence: Synthetic coding sequence
atgggtctgggcagggtacttctcttcctggcagtagccttcccatttgcacctccagctgctgctgctgaaccccatagcttacggtacaacctgatggtgctgtcacaggatgggtccgtgcagtctggtttcctggccgaagggcacctcgatgggcaacccttcttgcgatatgatcgccagaaacggagggcaaaacctcaggggcagtgggcagagaatgtgcttggtgctaaaacctgggataccgagactgaggatctgacagaaaatgggcaggatctccgaagaaccctgacccatataaaggaccagaaagggggacttcatagtctgcaagagattcgggtgtgcgaaattcacgaagactcttccactaggggctcaagacacttttactacgacggggagttgtttttgagccagaatcttgagacccaggaatcaaccgtcccccagagttcccgtgcacagacactagcaatgaacgtgacaaacttctggaaagaagacgctatgaaaactaaaacacactatagagctatgcaagctgactgcctccagaagttacagcggtatctcaaaagcggagtggccatccgcaggaccgtgccacccatggtgaacgtcacgtgttctgaggtgtctgaagggaatattactgtgacgtgtagagccagctccttttacccgagaaatatcaccctcacatggcgtcaggacggcgtaagcctcagccataatactcagcagtggggggacgttcttcccgacggaaacggcacttatcaaacctgggttgcgactcgcatccgacagggcgaggaacaaagatttacctgttacatggaacacagcggtaatcacggaacgcacccagtgccatctggtaaggccttagtgttgcagtcccagcggacagacttcccctacgtctcagccgctatgccttgctttgtaattatcatcatcctgtgcgtcccgtgttgcaaaaagaagacatctgctgctgagggaccagagttagtttcccttcaggtgttagaccagcaccctgtagggaccggggatcaccgcgacgcggctcagctggggttccagcctttgatgtcagctaccgggtctactggctcgaccgaaggcacatag

SEQ ID NO: 230444 - DNA, 1152 bp, Artificial Sequence
  Description of Artificial Sequence: Synthetic coding sequence
atggggctgggcagggttctactgttcttggcagtggccttcccatttgcgcctcccgctgcggctgcggagcctcatagtttacgctacaatctcatggtcctcagccaagatggatcagtccagtcaggcttcctggctgagggacacctggacggccaacctttcttgcgctacgatcgccagaagcggagagcaaagccacaggggcagtgggccgaagacgttctcggagccaagacctgggataccgaaactgaagacctgaccgagaatggacaggacctgcgccgaaccctgacccatatcaaggaccagaagggcggtttgcatagcctgcaggagattcgagtatgcgagatccacgaagattcctcaactagaggaagccgccacttctattatgatggagaactatttctgtctcagaatttggaaactcaggagtcaaccgtaccccagtcctctcgggctcagactctcgccatgaatgtcaccaatttctggaaggaagacgcaatgaaaactaagactcactaccgagctatgcaggctgactgtcttcagaagctccaaaggtatctcaagagtggtgtagccatacgtcgtacagtgccgccaatggtgaacgtaatctgcagcgaagtatccgaggggaacatcaccgtaacctgcagggccagtagcttctatcccaggaatatcacgctgacatggcggcaagacggcgtttcgttgtcccacaatactcaacaatggggggatgtcctgcccgatggaaacggtacttaccagacatgggtggcaaccagaatcaggcagggagaagaacaacgatttacctgttatatggaacacagtggcaaccacgggacccaccccgtgccatctggaaaagccctcgtgctccagtcccagcggaccgactttccttatgtaagtgctgccatgccatgctttgtgataattatcattttgtgtgtgccatgctgcaagaaaaagacgagtgcggcagagggaccggagctcgtttccctccaagtgctagatcagcatccggtaggcacaggcgaccacagggacgctgcccagctagggttccaaccactgatgtctgctaccggcagtaccggcagcaccgagggaacatag

SEQ ID NO: 230445 - DNA, 1023 bp, Artificial Sequence
  Description of Artificial Sequence: Synthetic coding sequence
atgggcctggggagggtgttgcttttcctagccgtcgcgttcccctttgcccctcccgctgctgctgcagagcctcactcactccgctacaacctcatggtactgtctcaggacggtagtgtgcaatccggcttcctggccgaggggcatttagacggccagcctttcctgcgatacgacaggcagaaacgaagagcgaaacctcagggccagtgggctgagaatgtgttaggcgctaagacatgggatactgaaacagaggacctcaccgagaacggccaggatcttcgcaggactctgactcacattaaagaccagaagggggtgccacagtcgtctagggctcagacgttagctatgaacgtgactaatttctggaaggaggacgcaatgaaaaccaaaactcactatagagccatgcaggccgactgcctccagaagctacagagatatctaaagtctggagtggccataagaagaacagtgccaccaatggtgaacgtcacatgctccgaggtatcggagggaaacatcacagtgacctgtagggcatcttccttctaccccagaaatatcactctgacatggaggcaagatggagtatctctgagtcacaacacacagcaatggggggatgttttaccagacggcaatgggacctaccagacctgggtggcaacccggattcggcaaggggaggagcagcgctttacttgttacatggaacacagcggcaatcacgggacccatccagtgccatctggcaaggccctagtactccaatctcagcgcacagatttcccgtacgtctccgcggctatgccatgcttcgtgatcattatcatcctgtgtgtgccttgttgcaagaagaagacatccgctgccgagggtccagagctggtctccttgcaagtcctagaccagcacccagtggggacaggtgaccatagagatgccgcacagctgggattccagccactgatgtcggcaaccggaagtacaggtagcacagaggggacttag

SEQ ID NO: 230446 - DNA, 1023 bp, Artificial Sequence
  Description of Artificial Sequence: Synthetic coding sequence
atgggtctcggaagagtcttgctttttttggcagtcgccttccccttcgctcctcccgctgccgctgccgaacctcattccctgaggtacaacctcatggtgcttagccaggatgggagtgtgcagtcggggtttcttgccgagggtcatctggatgggcagccttttttgaggtatgaccggcaaaagcggagggccaaaccgcagggccagtgggctgaagacgtcttgggggcaaaaacatgggataccgaaacagaggacctgacggagaacggacaggacttacgccgtactttaacgcacattaaggaccagaaaggagtgcctcagagctctcgagcacagacgctagcaatgaacgtcacaaacttctggaaagaagatgcaatgaagacaaagacgcattacagggcaatgcaggccgattgtctccagaagctgcagcgctacctgaaatcaggtgttgccattaggaggaccgtgccacctatggtgaacgtcacttgctcagaggtctccgagggtaatattactgtgacctgtcgagcaagcagcttctatccgaggaatattacccttacctggaggcaggacggggtgagcttgtcccataacacccagcagtggggtgacgtattaccagacggaaatgggacataccagacatgggtcgccacaagaatccgccagggggaagaacagagattcacatgctacatggaacatagcggaaaccacggcactcatccggtgccatctggaaaggcactcgtacttcagtcccagcgcactgactttccctacgtatcagctgcaatgccttgctttgtgatcattatcatcttgtgcgtcccttgctgcaaaaaaaaaacctcagcagccgaagggccagaattggtgtccctccaagttctggaccagcacccagtggggacaggcgaccaccgagacgctgcccaactgggtttccagccgttgatgtcagccacgggctctacggggagtactgagggagcctag

SEQ ID NO: 230447 - DNA, 126 bp, Artificial Sequence
  Description of Artificial Sequence: Synthetic coding sequence
atgggactgggcagggtgctattgttcctggcggtcgcattcccattcgcccctcccgctgccgctgccgtcgagatgggcttccatagggtgtcacaagatgggttggacttgttgacaagttag

SEQ ID NO: 230448 - DNA, 1083 bp, Artificial Sequence
  Description of Artificial Sequence: Synthetic coding sequence
tagccccattctctacgctacaacctgatggtgctgagtcaggatggctccgtgcagtctggtttcttggctgagggtcatctggacgggcagccttttctgagatacgacaggcagaagagacgggcaaaacctcaggggcagtgggcagaagacgtgctgggtgctaaaacttgggacactgagactgaagatttaacggaaaacgggcaggatctgcgccgtacactcactcacattaaggatcagaaggggggacttcactccctgcaggagatccgggtgtgcgagattcacgaagatagtagcacacggggatctcggcatttttactatgatggagaactgttcctttcacagaacctggaaacccaggaaagcactgtcccgcagagctcacgagcccaaaccttagctatgaatgtgaccaatttttggaaagaggacgccatgaaaactaagacccactatcgcgcaatgcaggccgactgcctccaaaaactccaaagatatctcaagtctggggtggctatcagaaggacggtcccccctatggtcaacgtaacgtgtagtgaagtgtccgaaggaaatatcacagtgacttgccgagcaagctctttctacccacgcaatatcactctgacctggagacaggacggcgtttccctgtcacataatacccaacagtggggagatgttctgcccgatggaaacggaacatatcaaacatgggttgctacccgcatacggcagggagaggagcaaagattcacttgctacatggagcatagcggaaatcacggcacgcacccagtgcctagcgggaaggcgttagttctgcagtcacaacgcaccgatttcccctacgttagcgccgctatgccatgcttcgtgatcatcattattttatgcgtcccttgctgcaagaaaaaaacttccgcagccgagggccctgagcttgtttcactgcaggtgctggatcagcaccccgtgggaacaggtgaccatagggacgctgcccagctgggtttccagccactgatgtctgccaccggcagcacgggatccaccgaaggagcctag

SEQ ID NO: 230449 - DNA, 1152 bp, Artificial Sequence
  Description of Artificial Sequence: Synthetic coding sequence
atgggattgggcagagttctgctgtttctcgctgtggctttcccattcgctcccccagctgcagcagctgagcctcacagcctacggtataatctgatggtgctgtctcaagacggaagcgtccaaagtggttttctggctgaaggacacctcgatggccaacctttcctccggtacgaccggcagaagcggagagccaagcctcagggtcaatgggccgaggatgtcctgggcgcaaaaacttgggacactgagaccgaagacctaactgagaatggtcaggaccttagaaggacccttacacacataaaggaccagaaggggggattgcatagcctgcaagaaatcagggtctgcgagattcacgaagattccagcaccagggggtcaagacacttctactatgatggggaactgttcctgagtcagaacttggagacccaggagtccactgttccacagtctagccgggcacagaccctggctatgaatgtaaccaacttctggaaagaagacgcaatgaaaactaagacacactacagggctatgcaagccgattgcctccagaaactccagagatacctgaagagcggagttgcgattcgccgaacagtgccaccaatggtgaatgtcacttgctccgaggtgtcagaaggaaacatcacagtcacatgccgcgcaagtagcttttatcctcgcaacatcactttgacgtggcgtcaagatggtgtgtccttatcacacaatacccagcagtggggcgatgtgctgcccgacggcaacggcacctaccagacttgggtagcaactagaatacggcaaggagaggagcagcgcttcacatgttacatggagcacagcggaaaccatggcacccaccccgtgccctcaggtaaagcccttgtcctgcagtcccaaaggacagactttccttatgtttcagctgcaatgccatgttttgtgataataattattctgtgtgtcccgtgctgtaaaaaaaaaacttctgcggctgaggggccagaactggtgtctttgcaagtcctggaccaacaccctgtgggaacaggagatcatagagacgcagctcagctcggattccagccactgatgtctgctaccggttctaccggctcaactgagggagcctag

SEQ ID NO: 230450 - DNA, 1023 bp, Artificial Sequence
  Description of Artificial Sequence: Synthetic coding sequence
atgggtctcgggagggtgctgcttttcctggccgtcgcattccccttcgcaccgcctgccgctgcagccgaaccacacagtttgcgctataatcttatggtcctttcccaggacgggtccgtccagtctggattcctagctgaaggacacctggacggacagcccttcctgcgctatgacaggcaaaaacggagagcgaaaccacaagggcagtgggcagaagacgttcttggcgcagagacgtgggacacagagactgaagacttaactgagaatggtcaggatttgcggcgtaccctcacacacatcaaagaccagaaaggagtgccacagagcagcagagctcaaacactcgccatgaacgtgaccaacttctggaaggaggatgctatgaagactaaaactcactatagggccatgcaggccgattgtcttcagaagcttcagcgctaccttaaaagcggggtggccatccggaggactgtaccgcctatggtcaatgtcacttgcagcgaagtcagcgagggaaatatcacagtcacctgccgtgcatcttcattttaccctcggaatatcactttaacttggaggcaggatggggtttcccttagccacaacacacagcagtggggtgacgttttacccgatgggaacggcacgtaccagacgtgggtggctacaaggataagacagggtgaggagcagcgattcacctgctatatggaacactcgggaaatcatggaacccatccagtaccaagtggtaaggccctggttcttcaaagccagagaacagattttccctacgttagtgctgctatgccctgttttgtgattataatcatcctttgcgtcccatgttgtaagaaaaaaacaagtgccgcagaagggccagagcttgtgtccctgcaagtgttggatcagcaccccgtgggcacaggggaccaccgcgatgcagcccaactgggctttcagccactaatgtctgccacaggcagcactggctccacagagggagcctag

SEQ ID NO: 230451 - DNA, 1152 bp, Artificial Sequence
  Description of Artificial Sequence: Synthetic coding sequence
atgggcttaggaagggtgttgcttttcctcgcagtggcatttccttttgcccctccagcagctgccgcagagcctcatagcctcagatataacttaatggtcctgagccaggacggttccgtccagtcgggatttcttgccgaaggtcacctcgatggacaaccttttctgcgctacgatcgacagaaaaggcgcgcaaaacctcagggccagtgggctgaggatgtgttgggagcagagacttgggataccgaaacagaggacttgaccgaaaacggccaagatctacgcaggactttgacgcacatcaaggaccagaagggtgggctccacagtctccaagaaattcgcgtttgtgagatacacgaggactcgtcgacgcgaggttccaggcacttctattacaatggggagctgttcttgagccagaaccttgaaactcaggagtcaaccgtgccccaaagctctcgcgcacagaccttggcaatgaacgtgaccaatttctggaaggaggacgctatgaagacaaagacccactatcgggctatgcaggccgactgtctgcagaagttacaacgatacctgaaatctggcgtggccatacggagaacggtgccacctatggtgaatgttacatgtagcgaggtatctgaaggcaacataacagtgacatgtcgagcatctagcttctatcctagaaacattactctgacctggcgacaggatggcgtgagcctctcccataatactcagcagtggggggatgtgctcccggatggcaacggcacataccagacatgggtggccacccggattcggcagggagaagagcagaggttcacttgctacatggagcactccggcaatcatggcacccacccggtgcccagtggcaaggccctcgtcctgcagtcgcagagaacagattttccctacgtcagcgcagctatgccttgcttcgtaattataattatcctctgtgtaccctgctgtaagaaaaaaactagtgccgctgaagggcctgaactggtgtctctgcaagtgctggaccagcatcctgtggggactggcgatcaccgggacgcagcacagcttggatttcagccccttatgagcgccactggctctacagggagcactgagggagcctag

SEQ ID NO: 230452 - DNA, 1023 bp, Artificial Sequence
  Description of Artificial Sequence: Synthetic coding sequence
atgggcctgggaagagtgcttctgtttctggccgtggccttcccgtttgctcctcccgcagccgcagctgaacctcactcccttagatacaatctaatggtgctaagtcaagatgggagtgtccagagtggcttcctcgcagaaggccacctcgatggtcagccctttctgaggtacgatcgccagaaacgtagggctaagccacagggacagtgggccgaggatgtgttgggggcaaagacttgggataccgagactgaggacctgaccgagaacggtcaggacctcaggcgcactctgacacacataaaggatcagaaaggcgtgccccagtcctccagggcccagaccttggcgatgaatgtaactaatttctggaaagaggatgctatgaagacgaaaacacactacagggcaatgcaggctgattgcctgcagaaactgcagcggtatctgaagtctggcgtggccattaggcgaacggtgccgccaatggtgaacgtaatttgctctgaggtgtcagaaggaaacatcacagtgacatgccgggctagcagtttctatccaagaaacattaccttaacctggaggcaggacggcgtgagcctgagccataacacccagcagtggggggacgtcctgcctgatgggaacgggacgtatcaaacttgggtggctacccgaatcaggcaaggggaggagcaaaggttcacatgttacatggagcattctggcaatcacggtacacaccccgtgccaagtggtaaggccttagtactgcagtctcaaagaaccgacttcccttatgtgtccgccgcaatgccgtgcttcgtgatcattatcatcttgtgtgtcccctgttgcaagaagaagactagcgcagctgaaggcccagagttggtatctttgcaggtgctggaccaacaccccgtgggcaccggagaccacagagacgctgctcagctaggttttcagccgctgatgtctgcaaccgggagcacaggctctacagaaggaacatag

SEQ ID NO: 230453 - DNA, 1023 bp, Artificial Sequence
  Description of Artificial Sequence: Synthetic coding sequence
atgggcctcggtcgagtgcttctcttcctggccgttgctttcccgttcgctccgcctgcagctgctgcggagccccactccctcaggtataatctgatggtcctgtcccaggacgggtctgttcagtccgggtttctcgcagagggacatctggatgggcaaccctttctcaggtatgaccgccagaagcgtcgagcaaaacctcaggggcagtgggcagaagacgtgctgggtgccgagacttgggataccgaaaccgaggacctcacggaaaatggtcaggacctacgcaggactctgacccatattaaagatcagaaaggtgttcctcagtcatcccgggcacaaacactggccatgaatgtgacaaatttctggaaagaagatgcaatgaagactaaaacccattatagagcaatgcaggcagactgtctgcaaaagctgcagcggtacctgaaatcaggtgtggccatccgacgaacagtcccccctatggtaaacgtgacatgttctgaagtcagtgaaggcaatatcaccgtcacttgccgtgcctcatctttctacccacggaatataactctgacttggagacaggatggcgtgtcactgtcccataacacacagcaatggggagacgttttaccggatggcaatgggacataccagacttgggttgccacccgcatcagacaaggtgaagaacagaggttcacttgctacatggagcactccgggaaccatggaacacatccggtgccaagtggaaaagcgctggtgctgcagagccagcggaccgatttcccttacgtatctgccgcaatgccttgctttgttataatcataatcctttgcgtgccctgctgtaaaaagaagacatctgccgctgagggacccgagctggtgagcctccaagtgttggatcaacacccggtcggcacaggcgaccaccgagatgcagcgcagctgggatttcagcccctaatgtcagccaccggctcaacaggctcgactgaaggcgcatag

SEQ ID NO: 230454 - DNA, 1023 bp, Artificial Sequence
  Description of Artificial Sequence: Synthetic coding sequence
atggggctagggcgtgtgttgctgtttcttgctgtggcatttccttttgccccaccagcggcagcagcagaaccccactctctgcggtataatctcatggtgctgagccaggacggatcagtccagagcggattccttgccgaaggacatcttgatggtcagcccttcctgcgatacgaccgacagaagcgccgtgcaaaaccccaaggtcagtgggccgaaaatgtcctgggcgcaaaaacctgggacaccgagactgaggatctgacagagaacggccaagacctgaggagaaccctgactcacattaaagatcagaaaggagtgccgcagtcgtcgcgggcacagactcttgcaatgaatgtgaccaatttctggaaggaagatgctatgaagacgaaaacccactaccgggctatgcaggcagattgtctgcagaaactgcagcggtacttgaaatccggggtggctatcagacgaaccgtccctcctatggttaacgtaacttgtagtgaagtgtctgagggcaacatcactgtgacttgccgggcaagcagcttctaccctagaaatatcaccctgacttggagacaggacggcgtttcactcagtcataatacgcagcaatggggtgacgtgctgccagacggaaacggtacctaccagacctgggttgcgaccagaatccgccaaggcgaagagcagagatttacttgttacatggaacactcagggaaccacggcacgcacccagtgccatccggaaaggccctggtcctgcaatcccagcgcaccgactttccttatgtgagcgcagccatgccatgctttgtgattatcatcatactgtgcgtaccatgttgcaagaagaagacaagcgccgctgagggcccagaactggttagcctccaggttctcgatcagcacccggtaggtacgggtgaccacagagacgcagctcagctgggtttccaaccactgatgtcagccactggatctactggatcaacagaggggacttag

SEQ ID NO: 230455 - DNA, 1152 bp, Artificial Sequence
  Description of Artificial Sequence: Synthetic coding sequence
atgggccttggccgagttctcctttttcttgccgtggcatttcctttcgctccacctgctgcagctgccgagccgcactcccttaggtataatctgatggttttgtcacaggatggaagtgtccaaagcggattcctggcagaagggcatctggatggtcagccatttctccggtatgaccggcagaagcggagggcaaagccccagggccagtgggccgaggacgtccttggtgccaagacatgggatacggagaccgaagacttgacagagaatggacaggatttgagaagaactttgacccatatcaaagatcagaagggtgggttacacagtctgcaggaaattagagtttgcgagatccacgaggattcatctaccagggggagccggcacttctattatgacggcgagctgtttctgtcccagaacctcgagacccaagagtccacagtcccccagagcagccgagcccagaccctcgcaatgaatgtgactaacttctggaaggaggacgctatgaagactaagacacactatagagccatgcaggccgattgcctccagaagttgcagcgatacctgaagagcggtgtcgccatcaggcgaacggtgccccctatggtcaacgttacttgttcagaagtcagtgagggcaacattacagttacttgtcgcgctagttctttttatcccagaaacatcacactaacatggcgccaggacggagtgagcctgtcccacaatactcagcagtggggtgatgtactccccgatggcaacggcacataccagacttgggtggctacccgcataaggcagggcgaggagcagcggtttacctgctacatggagcatagcgggaaccatggaacccatcctgtgcctagcggcaaggccctagttctacagagccagcggactgatttcccctatgtgtctgcagcaatgccctgttttgtgatcatcattattttgtgcgtcccgtgttgcaagaagaagacttctgcggctgaggggccagaactcgtgtcattgcaggtgctcgaccagcacccagtgggcactggcgaccatagggacgcggctcaattagggttccagcctctgatgtcagcaacaggttcgactggctcaacagaaggggcatag

SEQ ID NO: 230456 - DNA, 1152 bp, Artificial Sequence
  Description of Artificial Sequence: Synthetic coding sequence
atggggttgggtagggtgctgctcttccttgctgtcgcattcccttttgcccctcccgcagcggctgcagagccgcactcacttcggtacaatctgatggttctttcacaggatggcagtgttcagagtgggtttttggcagagggtcatttagacggccaaccattcctgagatacgataggcagaaacgtagagcaaagccccagggacaatgggcagaaaacgtgctaggcgctaagacatgggacaccgaaaccgaggaccttactgagaacggccaagatctgagaagaactctgacacacatcaaggatcagaaaggcggacttcattcactgcaggaaatacgcgtgtgcgagatccacgaagactcctccactcgaggcagccgccatttctactatgatggagagcttttcctgtcccagaacctggaaacacaggaatctaccgtcccacagtcatcccgcgcacaaacactcgccatgaatgtgacaaatttttggaaagaagacgctatgaagactaagacacattatagggctatgcaggccgattgccttcagaaactgcaaaggtatttgaagagcggcgtggcgatccggaggactgtccctcctatggtcaatgtgacctgtagtgaagtatccgaaggcaacattaccgtgacatgcagagcatccagtttttaccctaggaatatcactcttacttggcgccaagacggggtaagtctttcccataacacacagcagtggggcgacgtactccccgatggcaacggaacatatcaaacatgggtggcaacacggattcgccagggcgaggaacagaggtttacatgttatatggagcacagcggcaaccacgggactcaccctgtgccgtctggtaaagcactggtgctgcagtctcaaaggaccgacttcccatacgtgagtgctgctatgccctgcttcgttattattattatcctgtgcgtgccatgttgcaaaaaaaagacaagtgccgctgaaggccctgagcttgtctccctccaggtgcttgatcagcaccccgtgggcaccggagaccacagagatgctgcccagttgggcttccagcccctgatgagtgctactggctccacaggttccacagagggcacatag

SEQ ID NO: 230457 - DNA, 1023 bp, Artificial Sequence
  Description of Artificial Sequence: Synthetic coding sequence
atgggtctcggaagggtgttgctgttcctagcagttgctttcccattcgcaccgcctgccgctgctgcagagccgcactccttgcgctacaatctcatggttttgagtcaggacgggagcgtgcagtcggggttcctcgcggaaggccatttagacggccagcccttcctgcggtatgaccggcagaaacgcagggccaaaccacagggtcaatgggctgaagacgtcttgggagcgaaaacctgggacaccgaaacagaagacctgactgagaatggccaagatctgcggagaacactcacccatattaaggaccagaaaggagtgccacagtcttcacgggcacagacactggccatgaacgtgaccaatttctggaaagaggatgcgatgaaaactaagactcactaccgggcaatgcaagcagactgcctgcagaagctgcagcggtacttgaagtccggggtggctattaggcgaaccgtgccacccatggtaaatgtaacttgtagcgaagtgtccgaaggcaacattacagtgacatgccgggcatcaagcttttatcctcggaacatcacactaacatggcggcaggatggcgtgtcgctctctcataatacacagcaatggggggatgtgctcccagacggcaacggaacataccagacgtgggtggccacaaggattcggcagggtgaggagcagcgctttacgtgctacatggaacattctgggaatcacggtacacacccagtgccctcaggtaaggccctggtcctgcaaagccaaagaacagacttcccatacgtgtccgcagccatgccctgttttgtgattatcatcattctgtgtgttccgtgctgtaagaagaaaaccagcgcagccgaggggccagaactcgtgtctctccaggttctcgatcagcatccggtcggaaccggtgatcacagagatgccgcacagctcgggtttcagcctctcatgagtgccacaggtagcactggatccaccgagggcgcatag

SEQ ID NO: 230458 - DNA, 954 bp, Artificial Sequence
  Description of Artificial Sequence: Synthetic coding sequence
tgaccacactcactacgctacaatctcatggtcctctctcaagatggctccgtgcagtcagggttcctggcagagggtcatttggatggccagccgttcctgaggtacgaccgccaaaagcgtcgggctaagccccaaggacaatgggcagaggacgtgctaggagccaaaacatgggacaccgaaaccgaagatcttactgaaaacggtcaggatctgaggaggactttgacacacatcaaggatcagaagggtgtgcctcagagttccagagcccaaacactggcaatgaatgtgacgaacttctggaaggaagatgcaatgaagaccaagacccattacagagcgatgcaggctgactgtctccaaaaactgcagagatacctgaagtccggggtggctatcaggcgtacagttccccctatggtaaacgtcacatgttcagaggtgagcgaaggaaacatcactgtcacgtgtcgtgcctcgagcttctacccccgtaatatcacactgacgtggcgccaggatggagtcagtctgagccataatacccagcaatggggcgatgtcctcccggacggcaacgggacctatcaaacctgggtggccacgcgtatccgccagggcgaggaacagcggttcacatgttatatggagcattcgggaaatcacggcactcatcccgttccgtctgggaaagcccttgtgctgcaatcccagcggacagactttccgtacgtcagtgccgcaatgccttgctttgtgatcataataattctgtgtgttccatgctgcaagaaaaagactagtgctgcagagggaccggagcttgtgagcctgcaggtcctggatcaacatccagtgggcaccggcgatcaccgcgacgctgctcaactgggatttcagccactcatgagcgccacgggcagtacgggatcaacggagggcgcttag

SEQ ID NO: 230459 - DNA, 1152 bp, Artificial Sequence
  Description of Artificial Sequence: Synthetic coding sequence
atgggattggggagggtgctgttattcctggcagtagccttcccattcgctccacctgccgctgccgcagagccacattctcttagatataatctgatggtgctttcccaggacgggagtgtacagtcaggttttttggcagaggggcatctagatggacagccctttctgcgttatgatcggcagaaacgcagagctaagcctcaggggcagtgggcagaggatgtgctgggggctgagacttgggacaccgaaaccgaggatttgacagagaatggacaggacctgcggaggacacttacgcatatcaaagatcaaaagggtggtctgcactcactgcaggagattagggtgtgcgaaatgcatgaggacagttccacaagggggtcaagacatttctactataacggtgagctttttctttctcaaaacctagagacacaggagtcaactgtgccccagtccagtagggcccagacgttagcaatgaatgtcaccaatttctggaaagaagacgcaatgaagaccaaaacccactaccgcgcaatgcaggccgattgcttacaaaagttgcagcgctatctaaaaagcggcgtagccataaggcggaccgttcccccaatggtgaacgtgacttgttctgaggtgagtgaaggaaatatcactgtgacctgcagagctagctccttttaccccaggaacataactttgacttggaggcaggacggagtgtccctaagtcacaacactcagcagtggggggacgtgctgcccgacgggaatggaacgtaccagacctgggttgccacgcgaatccgtcagggggaggagcagcgctttacatgctatatggagcactcaggcaaccatgggacacacccggtaccctccggcaaggcactggtgctgcagagccaaaggactgacttcccttacgtgtccgccgcaatgccctgttttgtgatcattattatcctttgcgtcccctgctgcaaaaagaagacctccgccgcagagggtccggaactggtaagtctgcaagtcttggaccagcatcccgtgggaacaggagaccaccgggacgccgcacaactgggcttccaacctctcatgagtgctaccgggtccaccggtagtactgaaggagcatag

SEQ ID NO: 230460 - DNA, 1056 bp, Artificial Sequence
  Description of Artificial Sequence: Synthetic coding sequence
atggtgctttcacaggacggcagcgttcagtctggctttctcgcagaagggcacctcgatgggcagcccttcctccgttacgaccgccagaagagacgtgcgaaaccacagggtcagtgggccgagaatgtcttgggcgctaaaacttgggacaccgaaaccgaggatctcactgaaaacgggcaggatctgcgacgaacactgactcacattaaggatcagaagggcggactgcactcactgcaggaaattcgcgtctgtgaaatccacgaggactctagcactcggggatccaggcacttttactatgacggggaactgttcctctctcagaatttagagacacaggaatccacagtgccacagtccagtcgcgctcagaccctcgccatgaatgtgaccaatttctggaaagaggacgctatgaaaactaagacacattaccgagcgatgcaagccgattgtctacagaaactgcagaggtacctgaaatctggtgtggctatccggaggaccgtgccacctatggtgaacgtgacgtgttctgaagtgtcggaaggtaacatcactgtgacgtgcagagcgtcctccttctaccctaggaatatcacacttacttggagacaagatggagtgtctttgtctcataacactcagcagtggggtgatgttcttccggatggaaatggcacataccaaacttgggtcgcgacgcgaattaggcaaggtgaggagcagaggttcacgtgctatatggagcatagcggtaatcacggcactcatcccgttcccagcggcaaggcactagtgttgcaaagccaacggactgatttcccctatgtctcagcagcaatgccctgtttcgtgatcatcattattctgtgtgtgccctgctgcaaaaaaaaaacctccgcagccgaaggccctgaactagtgtccctccaggtacttgaccagcatcccgtgggcacaggggatcatagagacgcggctcagctgggcttccagcccctcatgagtgcaaccggctcaaccgggagcacggaaggtacttag

SEQ ID NO: 230461 - DNA, 126 bp, Artificial Sequence
  Description of Artificial Sequence: Synthetic coding sequence
atgggactcgggagagttttactttttctcgccgttgcatttccatttgcaccgcctgccgcagcagcagtggagatgggatttcacagagtgtctcaggatggtctcgatctgctgactagttag

SEQ ID NO: 230462 - DNA, 126 bp, Artificial Sequence
  Description of Artificial Sequence: Synthetic coding sequence
atgggcctgggtcgggtgctgctctttttggcagttgctttccctttcgccccacccgcagctgccgctgttgagatgggcttccaccgtgtgtcacaagacggcttggacctcctcacaagctag

SEQ ID NO: 230463 - DNA, 1056 bp, Artificial Sequence
  Description of Artificial Sequence: Synthetic coding sequence
atggtcctttctcaggacggaagcgtccagagtggtttcttagctgaaggacatctggacggacagccgtttttaaggtatgatcgacagaaaaggcgtgcaaaaccccagggtcagtgggccgaggatgtgctcggggcagaaacttgggatacagagacagaagatctgaccgagaacgggcaggacctgcgccgaaccctgacacacatcaaggatcagaaaggcggactgcatagcttacaggagattcgcgtgtgtgagatgcatgaggactcctccacacggggttctcgacatttttattacaatggagaactgtttctgtcgcagaacctcgagacacaggagagcaccgtcccccagagctctcgcgcacaaacgctagctatgaacgtcacgaacttctggaaagaagacgctatgaaaacgaaaacccattaccgggctatgcaggcagattgcttacaaaagctgcagagatatcttaagtcaggggtagctatcagacgaactgtgccaccaatggtgaatgtgacatgttctgaggttagcgagggtaacattacggtgacatgtagagcatccagcttttacccacgaaatatcaccctgacctggaggcaggatggcgtcagtctcagtcacaatacacagcagtggggggatgtgctcccagacggcaatggcacttatcagacttgggtcgccacccggatccgccaaggcgaggaacaacgatttacatgctatatggagcattctggaaatcacggaacccatcccgtcccttctggtaaagccctagtcctgcagtctcagcgcactgactttccttacgtcagcgccgctatgccttgtttcgtgatcattatcatcctgtgtgtgccttgttgcaaaaagaaaacgtcagctgcggaaggtccagagctggtttctctccaggtcttagaccagcatcccgtcggaacaggggatcaccgcgatgccgctcagttgggcttccaaccccttatgagtgcaactggcagtaccggtagtactgaaggcgcttag

SEQ ID NO: 230464 - DNA, 1056 bp, Artificial Sequence
  Description of Artificial Sequence: Synthetic coding sequence
atggtattgtctcaggacggatccgtacagtctggctttctagccgaggggcacctggacggacagcctttcctgcggtatgaccgccaaaaaagacgggctaagcctcagggccaatgggcagaggacgtgttaggagccaagacgtgggacacagaaactgaggatcttacagagaacggacaggacttgcggaggaccctgacgcacattaaagatcagaaggggggactgcactccctgcaggaaattcgggtctgtgagatccacgaagacagttcgacacgagggtctcgtcatttctattacgacggagaattgttcttgtcacagaacctggaaactcaggagagtaccgtcccccaatccagccgtgctcagactctggccatgaacgtgactaatttctggaaagaggatgctatgaaaacaaaaacgcattatagagcgatgcaagctgactgtctgcagaagctgcagcggtacctcaagtcaggggtggcaattcgtaggaccgtgcctccaatggtgaacgtcatttgctccgaagtgagcgagggaaatatcacagtgacctgtcgggcatcgagtttttatcccagaaatattacactgacttggcgccaggatggagtgagtcttagccataacactcagcaatggggagacgttctgccggatgggaatggtacttatcaaacctgggttgcaaccagaataagacagggtgaggaacagcgtttcacctgctacatggagcacagtggcaaccacggaacacatcctgtgccttccggaaaggctctcgtgcttcagtcccagcgaacggatttcccctatgtttctgccgcaatgccttgttttgtcatcattatcatactctgtgtgccttgctgtaagaagaaaacgagcgcagcagaggggccagaactagtatcccttcaggttctcgatcaacaccccgtgggaactggggatcaccgcgacgctgcgcagctcggatttcagcctctgatgtccgcaacaggctccacaggtagcacagaggggacttag

SEQ ID NO: 230465 - DNA, 126 bp, Artificial Sequence
  Description of Artificial Sequence: Synthetic coding sequence
atggggctggggagagtactattgttcttagccgttgcctttcctttcgcccctcctgccgctgccgctgtcgaaatggggtttcatagggtttctcaagacgggcttgacttactgacctcctag

SEQ ID NO: 230466 - DNA, 126 bp, Artificial Sequence
  Description of Artificial Sequence: Synthetic coding sequence
atgggcctcgggagggtgctgttgttcctagccgtagcctttccatttgcaccccctgcagcagcggctgttgagatgggttttcatcgtgtgagccaggatgggttggatttgctaacctcttag

SEQ ID NO: 230467 - DNA, 1056 bp, Artificial Sequence
  Description of Artificial Sequence: Synthetic coding sequence
atggtgctgtcccaggacggatctgtgcagagcggattcctcgcagagggacacttggacggtcagcccttcctgagatacgacaggcaaaagcgacgagccaaaccacaaggacagtgggctgagaacgtcctgggcgcaaagacctgggacacagagacagaagaccttacggaaaatggccaagacctgagaaggactctcacacatattaaggaccagaagggcggattgcattctctacaggagatcagagtatgcgaaatccatgaagacagtagcacaagggggtctcgccacttttactacgacggggaactcttcttatctcaaaatctcgaaactcaagagtcaaccgtcccccagtcatctagggcccaaacactggcaatgaacgtgacaaacttttggaaggaggatgctatgaaaactaagacgcattatagagctatgcaagctgactgcctgcagaaattgcagaggtacctgaaatccggagtggcaatccgacgaaccgtgccccctatggttaacgtaacttgttcagaagtatcggaaggaaacatcacggtgacttgtagggcaagctcattttatcccagaaacattaccctgacatggcggcaagacggggtgagcctcagccacaatacccagcagtggggggacgttttgcctgacgggaatgggacatatcagacgtgggtggccacccgcatcagacagggtgaagagcagcgcttcacttgctacatggaacattcaggcaaccatgggacccatcccgtgccaagtggaaaggctctggtgctgcagtcacagcgtaccgattttccttacgtgtctgctgccatgccttgcttcgtcatcatcattatactctgcgtgccttgctgcaagaaaaagacctctgccgcagaagggcctgagctcgtcagcctccaggtcctggaccagcatccagtgggaaccggtgatcatagagacgctgcccaattgggtttccagcctttaatgtcagccaccggtagtactggatcgacggagggaacttag

SEQ ID NO: 230468 - DNA, 126 bp, Artificial Sequence
  Description of Artificial Sequence: Synthetic coding sequence
atggggttggggcgtgtgttgctgtttctggcagtcgcattccccttcgcgccacccgcagcggcagccgttgagatgggatttcatagggtttctcaggacgggttggatctcctgaccagttag

SEQ ID NO: 230469 - DNA, 126 bp, Artificial Sequence
  Description of Artificial Sequence: Synthetic coding sequence
atgggcctgggaagggtgctgctgttcttggccgtcgccttcccctttgccccacccgctgccgcagcggtagagatggggtttcaccgggtcagtcaggacgggcttgacttactcacttcctag

SEQ ID NO: 230470 - DNA, 1056 bp, Artificial Sequence
  Description of Artificial Sequence: Synthetic coding sequence
atggtcctgagccaggacggcagtgtgcagtccggattcctggccgagggccatcttgatggacagcccttcctccggtacgacaggcagaagcgcagggcgaagccacagggccaatgggcagaggacgtacttggcgctgaaacttgggacaccgagaccgaagacttgacagaaaatgggcaagatctccggcgtaccttgacccatatcaaggaccagaagggaggactgcattctcttcaagaaattagagtctgtgaaattcacgaggactcatcgactagagggtctaggcacttttactacaatggagagcttttcttgtctcaaaatctcgagactcaggagagcacagtgccccaaagtagccgcgcacagactctggctatgaacgtcacaaatttttggaaggaggatgccatgaagacgaaaactcattatcgggcaatgcaagccgattgcctccagaaattgcagcgttacctgaaaagtggggtggccattaggcgcacggtgcctccaatggtcaacgtgacctgcagcgaagtgagcgaaggtaacattaccgtcacgtgcagagctagtagtttttacccgagaaatattaccctgacctggcgtcaggacggagtctccctctcgcataatactcagcagtggggagacgtcctgcctgacggtaatggtacttaccagacctgggttgctacaagaattcggcagggcgaggagcaacgatttacatgttatatggaacactccgggaatcacggtacccacccagtgccctcaggtaaagcccttgtgctgcaatcacagcgcaccgactttccatatgtgagtgccgctatgccctgttttgttataattattattctctgcgtgccatgttgtaagaaaaaaacttctgctgccgagggacctgaactggtctcgctccaggtgcttgaccagcacccagtgggaaccggtgaccaccgagacgccgctcagcttggcttccaaccgcttatgtcagccaccggctctactggctcaaccgagggggcttag

SEQ ID NO: 230471 - DNA, 2088 bp, Artificial Sequence
  Description of Artificial Sequence: Synthetic coding sequence
atgtcaccacccaaagatccaagtccctctcttcccctcccgtcttcaagttctcatagcagcagccctcccagttcttcctctaccagtgtgtcaggtaacgcgcctgatggctccagtcccccacagatgactgccagtgaacccctcagccaggtcagcagaggtcatccaagtcctcctacccccaatttcaggagacgggcagtggctcaaggagccccaagagaaatacctctttacctcccgcatcatcctaaacccgagtgggccgagtactgcctggtgtcaccaggggaggacggcctgtccgatcctgctgaaatgacttccgacgaatgccagccagctgaagcacctctgggggatatcggcagcaatcatagagaccctcacccaatttggggtaaggaccgctcatggaccggtcaggaactgagcccccttgccggtgaggatagggagaagggtagcacgggagccagaaaggaagaggagggaggcccagtgctggtgaaggaaaaactgggccttaaaaagctggtgcttacacaagagcaaaagactatgttgctggactggaatgacagtattccggagagcgtccacctcaaagcaggagagcgcatttctcagaagagcgccgaaaatggccgaggcggacgagtgctaaaacccgtgcgtcccctgctactgccacgagcagcaggagaaccattaccaacacagcgcggagcccaggaaaagatgggtacaccggctgaacaagcccagggggaacgtaatgtcccaccaccgaagtcgccactgcggctcatcgccaatgctattcgcaggtcacttgagcccctcctgagcaatagcgagggcggaaaaaaagcgtgggccaagcaggaatccaaaacccttcccgcacaagcatgcacccggtcattctcactgagaaaaactaactcaaacaaggacggagaccagcacagccctggcagaaaccagtccagcgctttctctccgcctgatccagctctgagaactcatagtctccctaatcgaccatcaaaggttttcccagctctccgctccccgccatgttcaaagatcgaagatgttcccacgctactcgagaaagtctccctccaagagaattttccagacgcctcaaagccccctaagaaacgcatcagtttgttctcatctctgcgcctgaaggacaaatcttttgaatccttcctccaggagtcgcgacagaggaaagacattagagacttgttcggaagccctaaacggaaggtcctgcccgaggacagcgcacaggcccttgagaagctgttgcagcctttcaaaagtacgtcacttcgccaggcagcccctcccccacctccacctccgccaccacccccaccccctcccactgcaggaggggctgatagtaagaacttccccctgagggcccaggtgactgaggcgagttcttcagctagcagcacctcctccagttccgcagacgaggagttcgacccacaactgagcctccagcttaaagaaaagaagacactgcggaggaggaagaaattggagaaggcaatgaaacaacttgtgaagcaagaagaactgaaaaggctgtacaaggcgcaggctatccaacgccagttggaggaagtggaggaacggcaacgggctagcgaaattcagggcgtgaggctggagaaagctcttcggggtgaagctgattccgggacccaggacgaagctcagctgttgcaggaatggtttaagttggtcttggagaaaaacaagttaatgagatacgagtctgagcttctcatcatggctcaggaactggagctggaggatcaccagagccgactggaacagaagctgagagaaaaaatgcttaaggaggagtcccagaaggacgagaaagaccttaatgaagaacaagaggtgttcaccgaactgatgcaagttatcgagcagcgagacaaactagtcgacagcctcgaggagcagcgcattagagagaaagccgaggatcagcactttgaatcattcgtgttttcccgcggatgccagctgagtaggacctag

SEQ ID NO: 230472 - DNA, 90 bp, Artificial Sequence
  Description of Artificial Sequence: Synthetic coding sequence
atgtccccacccaaagaccccagccccagcctcccgcttccttcttcatcgtcgcattcttccagcccgccttcttcaagctccacgtag

SEQ ID NO: 230473 - DNA, 522 bp, Artificial Sequence
  Description of Artificial Sequence: Synthetic coding sequence
atgagtctcttgggacccaaggtattactgtttcttgccgctttcatcatcacttcagactggatccctctgggcgtcaacagccagaggggagatgacgtgacacaggcaacacccgaaacatttaccgaagaccctaatctcgtgaacgaccctgctacagacgaaacggtgctggccgtcttagcagatatcgccccatctactgacgacttagctagcctgagtgagaagaataccacagctgagtgctgggacgaaaagtttacttgcacccgtttgtactctgtgcaccgccctgtaaaacagtgtatccatcagctatgtttcacatcactccgcaggatgtacatcgtcaataaagagatttgtagccgtttggtctgtaaagagcatgaggccatgaaagatgagttatgtcgccagatggccggactcccccctaggcggctgagaagatccaattattttcggttgccaccatgcgaaaacgtggaccttcagagacccaacggtctgtag

SEQ ID NO: 230474 - DNA, 492 bp, Artificial Sequence
  Description of Artificial Sequence: Synthetic coding sequence
atgtccctcctgggaccaaaggtcttgcttttcctggcagccttcattatcacctccgattggattcccttaggtgttaattcccagaggggtgacgacgttacccaggctacccccgagacatttacagaagatccaaatttggttaatgatccggctacagacgaaacagtcctggcagtgctcgctgacattgcaccatccacggacgatctagagtgctgggacgaaaagtttacttgtactagactctactcggtacacaggccagtcaagcaatgtatccaccagctttgtttcacctctctgcgcaggatgtacattgttaacaaggagatctgctcccggctggtatgcaaggaacacgaagccatgaaagacgagctgtgtcgccagatggccggattacctccccgacgacttcggcgttccaactattttaggctgcccccatgtgaaaacgtggatttgcagcggcctaacggtttatag

SEQ ID NO: 230475 - DNA, 447 bp, Artificial Sequence
  Description of Artificial Sequence: Synthetic coding sequence
atgtcactcctggggcctaaggtgctgttattcttagctgcctttattatcaccagtgactggatcccactgggcgtcaactcccagcgtggagatgatgtgactcaggctactcctgaaacgttcacggaagaccccaatcttgttaatgatccagccaccgatgaaacggagtgctgggacgagaaattcacctgcacacggctatactccgttcatagacccgttaaacagtgcatacaccagctgtgcttcacaagtctgaggcggatgtatatagtcaacaaggaaatctgttcgcggcttgtgtgcaaggagcatgaggcaatgaaagatgaactgtgtaggcagatggctggcttgcccccacgtcgcctgcgaagatctaactatttccggcttcctccgtgcgaaaatgtcgacttacaacgaccaaatggcttgtag

SEQ ID NO: 230476 - DNA, 492 bp, Artificial Sequence
  Description of Artificial Sequence: Synthetic coding sequence
atgtcattgctggggccaaaagtcctgctttttctcgccgcattcattattacgagcgactggataccactcggtgtcaattctcagcgcggtgacgatgtgacccaagctactcccgaaaccttcaccgaggacccaaatctagtcaacgatcccgcaacagacgagaccgtgctagctgtgcttgccgacatcgcaccatcaaccgatgacctggagtgctgggacgaaaaattcacatgcacacgcttatactctgttcatagaccagtcaagcaatgtatccaccagctgtgctttactagccttagaagaatgtacattgtgaacaaggaaatctgttcccggctggtctgtaaagagcacgaagctatgaaggacgagttgtgcaggcagatggccggtctgcctccaagaaggctgcgtcgctcgaactacttccgcctccctccgtgcgagaatgtggatctccagaggcctaatggattgtag

SEQ ID NO: 230477 - DNA, 276 bp, Artificial Sequence
  Description of Artificial Sequence: Synthetic coding sequence
atgtctcttctgggtccgaaagtgcttctgtttctggcggcattcattatcacatctgactggatccccctcggcgttaacagtcaacggggagatgatgtcactcaagctacaccggagactttcactgaggacccaaacctagtgaatgaccccgcaactgacgaaactgtcctggctgttctcgctgacatcgcccctagcaccgacgacctggctagcctgtcggagaagaatacaacggctgagtgttgggacgagaagtttacgtgttag

SEQ ID NO: 230478 - DNA, 1320 bp, Artificial Sequence
  Description of Artificial Sequence: Synthetic coding sequence
atgtctgtgccatcagcccttatgaagcagccgcctattcagagcaccgcgggagcagtacccgtcaggaacgaaaagggggagatttcaatggaaaaggtaaaagtcaagagatatgtgagcgggaagcgccctgactatgccccaatggagtcttccgatgaagaagacgaggaattccagttcattaagaaagctaaggagcaggaagctgagcccgaggagcaggaagaagatagctctagtgatccaagactgagaaggttgcaaaatcggatttccgaggacgttgaggagaggcttgctcggcaccgcaagatcgtggagccagaggtggtgggcgaatctgacagcgaggtggagggagacgcttggagaatggagcgcgaagactcatcagaagaggaggaggaggagatcgacgacgaagagatcgagaggcggagaggtatgatgcgccagagagctcaggagaggaagaacgaggagatggaagtaatggaagtggaggatgaagggaggtccggtgaagagagtgagtcagagagtgagtatgaggagtacaccgattctgaagacgaaatggaaccaagattaaagcccgttttcatcagaaagaaggatcgcgttactgtgcaagaacgggaagctgaggctcttaaacaaaaagagcttgaacaagaagccaaaagaatggccgaggagagacgtaagtatacactgaaaatagtcgaagaagagacaaaaaaggagttagaggagaacaagaggtctctcgccgctctggatgcactaaatacagacgacgaaaatgacgaggaagagtatgaggcctggaaggtgcgggaactcaaacggattaagcgtgatcgcgaagacagagaggcgctggaaaaggagaaggccgaaattgaaagaatgcggaacctgactgaggaagaacggagagctgagctgagagctaacgggaaggtaataaccaataaggccgtcaagggcaagtacaaatttctgcaaaaatactaccatcgtggtgcttttttcatggacgaagacgaggaggtgtataagcgggatttctcggctcccaccttggaggaccacttcaataaaacgattcttccgaaagtgatgcaggtgaaaaacttcggtagaagcggccgtaccaagtatacacatctggtggaccaagacacaaccagctttgattccgcctggggtcaggaatcagctcagaatacgaagtttttcaaacagaaggccgcaggggtgagggacgtgttcgagcggccaagcgctaagaaaagaaaaaccacctag

SEQ ID NO: 230479 - DNA, 549 bp, Artificial Sequence
  Description of Artificial Sequence: Synthetic coding sequence
atgagagcagcatatcttttcttgcttttcctccccggactgctggctcaaggccagtacgacttagaccctttacctccgttccccgatcacgtgcaatacacccactattcagatcagatcgataatcctgactactacgactatcaggaggtcacaccacgtccatctgaggagcagttccagtttcaaagtcagcagcaggtccaacaggaggtaataccagctcccactccagagcctgggaatgctgagctggaaccgactgagcccggaccactagactgtcgggaagagcagtatccgtgcacacgtttgtatagtatccataggccctgcaaacaatgcctaaacgaggtgtgtttctacagtctgagacgagtctacgttattaacaaggagatttgcgtgcgaaccgtctgcgcccatgaagagctgctccgcgcagatctgtgccgagataaattttcaaagtgcggcgtgatggccagctcaggcctatgccaatctgtggctgcgtcttgcgcacgatcatgtggcagttgctag

SEQ ID NO: 230480 - DNA, 552 bp, Artificial Sequence
  Description of Artificial Sequence: Synthetic coding sequence
atgcgtgctgcttacctgtttctgctgttcttacctgctggtcttctcgcccaaggacagtacgacctcgacccactgcctccattccctgaccatgtacaatacacccattactccgaccagatcgataatcccgactactatgattatcaggaggtcacaccacgtccttctgaggagcagttccagttccagtcccaacaacaggtgcaacaggaggtgatcccggcacctacgccagaaccaggcaacgccgaactcgagcccactgaaccaggcccactggattgtcgcgaagagcagtatccatgcactcggctctactccatccatcgcccttgcaagcagtgcctcaacgaggtttgtttctatagtcttaggagggtgtatgtcatcaataaagagatttgtgtcaggactgtgtgtgctcacgaagagctgttaagggcagatctgtgccgggacaagttctccaagtgcggcgttatggcttcttctggattatgccaatctgtagccgcatcatgcgccaggtcatgcggatcctgttag

SEQ ID NO: 230481 - DNA, 549 bp, Artificial Sequence
  Description of Artificial Sequence: Synthetic coding sequence
atgcgcgctgcctatctctttctcctctttctaccaggtttgttggcccagggtcagtacgacttggaccccctgcctcctttccccgaccatgtccagtatactcactactccgatcagatagataaccccgattattatgattatcaggaggtcactcctcgcccaagcgaagagcagttccagttccagagtcagcagcaggtgcagcaggaggttattcccgctccaactccggagccgggaaatgccgaactggagcctacagaaccgggacccctagactgtcgagaggaacagtatccgtgcacgagactttatagcatacaccgcccatgtaaacagtgtctgaacgaggtgtgtttctacagcctcaggagggtctacgtcataaacaaggagatctgcgtcaggacggtatgcgcccatgaagagttattgagagccgacctgtgcagagataagttctccaagtgtggggtgatggcctcctccggcctttgccagtctgtcgccgcatcttgtgccaggagctgcggcagctgttag

SEQ ID NO: 230482 - DNA, 1089 bp, Artificial Sequence
  Description of Artificial Sequence: Synthetic coding sequence
atgaaactgcactgctgcctgtttacattagtggcctcaatcattgttcctgcagccttcgtgctggaggacgtggattttgaccagatggtttcactggaagcgaaccgctccagttataatgcaagcttcccatcatcatttgagctgtccgcttctagtcactccgacgatgacgtgataattgccaaggagggcacgagcgtgagtatcgaatgcctgctgacggcctcacactacgaagacgtacactggcataactctaaaggtcagcagctggacggccgatctcgtggtggaaagtggctggttagcgataactttctcaacattactaacgtggcattcgatgatagaggcctgtatacttgctttgtgacttctcctattcgtgccagctactcagtgaccttaagagtgattttcacctcaggtgatatgtccgtttattacatgatagtctgcctgattgcctttacaattaccttgatcctcaatgttacccgattgtgtatgatgtcctctcacctcagaaaaacagagaaggcgattaatgagttttttaggaccgagggcgcagaaaaacttcagaaagcgtttgaaatcgcaaaacgaatccccataattaccagcgcgaagaccctcgaattagccaaggtcacccagtttaaaacaatggaattcgcgaggtatatcgaggagttagctaggagcgtgccattgcccccactgatcctgaactgtcgtgcatttgtcgaggaaatgtttgaagcggtgagggtggatgaccccgatgacttaggagaacgcatcaaggagagaccggcacttaatgcccaaggaggcatttacgtaattaatcccgaaatgggcagaagcaattcacccggaggcgattccgacgatggtagtctgaatgaacagggccaggaaatcgctgttcaagtgtcggtccatctgcagtctgaaactaaatccatagatactgagagccaggggagttcacatttttctcccccagatgatataggaagtgccgagagcaactgtaactacaaggatggcgcttacgagaactgtcagctgtag

SEQ ID NO: 230483 - DNA, 1089 bp, Artificial Sequence
  Description of Artificial Sequence: Synthetic coding sequence
atgaagctccactgttgtctttttactctcgtggccagtatcatcgtgcccgctgcttttgtactggaagatgtagattttgatcagatggtttccctggaggccaatcgcagcagctacaatgcttcatttccttcctccttcgaactgagtgctagctcccacagcgatgatgatgttatcatcgccaaggagggcacctccgtgtcaatagagtgccttttgacagcatctcactacgaagacgtgcattggcataattccaagggccagcagctcgacggccgatctagagggggaaagtggcttgtgagtgacaactttttgaatattactaatgttgcatttgatgaccggggattgtacacatgctttgtgacaagtcccattagggctagttattctgttactctccgagtgattttcacaagtggggatatgtcagtctactacatgatagtctgtttaatagcgttcactattacactgatcctcaatgttacgaggctctgtatgatgagtagccacctgcgcaagactgagaaagcaattaatgaattctttaggacggagggtgccgagaaattgcagaaggccttcgagatagctaaacggattcccattatcacttctgctaagactctggagctggctaaggtcacgcagttcaagaccatggaatttgcgaggtatattgaagaactcgcccgtagcgttcccctgccgccactgattttgaactgtcgcgcattcgtggaagaaatgttcgaggcggttagagtggacgatcctgacgacttgggggagaggataaaggaacgaccagccctgaacgcacagggcggaatctacgtgattaacccggaaatgggacgctcgaattcacccggaggagacagcgatgatggatcactgaatgagcagggacaggaaattgcggttcaggtgtccgtccacttgcagtcggagacaaagagcatcgatacggagtcacagggaagctcccatttctcacccccagacgatattggaagcgctgaatccaattgcaattataaggacggggcatatgaaaactgccagctgtag

SEQ ID NO: 230484 - DNA, 651 bp, Artificial Sequence
  Description of Artificial Sequence: Synthetic coding sequence
atgtccgtctattacatgattgtctgtctcatagcattcacgatcaccctgatcctgaacgtgacccgcctatgcatgatgtcttcccacctgagaaagactgagaaggctattaacgagttcttcaggacagagggggcagagaaactgcagaaagccttcgaaatcgccaaacgtatcccaataatcaccagcgccaagactctggagcttgctaaagtcacacagtttaagaccatggagttcgctcgctacattgaagaacttgcccgtagtgttccgttgccacccctgattctcaattgccgggcattcgtggaagaaatgttcgaggccgtgcgcgtagatgacccagacgacctcggggaaaggatcaaggagcgcccagccttgaatgctcaaggaggcatttacgtgattaaccctgagatgggcagatccaactcccctggcggagatagcgacgatggaagccttaatgagcagggccaggaaatcgcagtccaagtgtctgtgcacctccagagcgagacaaagtccatagataccgagtcccaggggtcgtcccattttagtcccccagatgacattggatcagccgaatcgaattgcaactacaaggacggggcatacgaaaattgccagctatag

SEQ ID NO: 230485 - DNA, 54 bp, Artificial Sequence
  Description of Artificial Sequence: Synthetic coding sequence
atgaagttacattgctgcctcttcacccttgtggcatctatcatcgtgccatag

SEQ ID NO: 230486 - DNA, 330 bp, Artificial Sequence
  Description of Artificial Sequence: Synthetic coding sequence
atgaagttacactgctgtctgttcaccctggtcgcctccatcattgtgccggcagctttcgtactggaagacgtcgactttgaccagatggttagcctcgaagcaaaccgtagttcctacaacgcctccttcccgtcctcatttgagctgtctgcctcctcccactccgacgatgacgtgattatcgctaaggaggggacaagcgtgagcatcgaatgcctcctaacagccagccattacgaagatgtgcactggcacaacagtaagggccagcagctcgatggcaggagtcgcggtggtaaatggctcgtctccgataatttcctctag

SEQ ID NO: 230487 - DNA, 372 bp, Artificial Sequence
  Description of Artificial Sequence: Synthetic coding sequence
atgaagctccactgctgtctctttacacttgtggctagcattattgtgcctgcggcatttgtgctcgaggacgtggacttcgatcagatggttagtctagaggccaatcgtagctcgtacaatgcaagcttcccaagcagctttgagctttctgccagcagtcactcagacgacgacgttatcatcgctaaggagggaactagcgtcagtatcgagtgtctactcaccgcctcacattatgaggatgtgcattggcacaacagtaagggacagcaactggacgggagatcaagagggggtaagtggctcgtatccgataactttctcaacattactaatgtggctttcgatgaccgtgggctctacacctag

SEQ ID NO: 230488 - DNA, 768 bp, Artificial Sequence
  Description of Artificial Sequence: Synthetic coding sequence
atgaaggccctgctggccctccctctgctgctgctgttgtctacacccccatgcgctcctcaggtgtctggcatccggggtgacgctcttgagcgattttgtcttcagcagcccctcgattgcgacgacatttacgcacaaggttaccaatctgacggagtctaccttatctatccctcaggtcctagcgtacctgtacccgtgttttgtgatatgacaaccgaagggggaaaatggactgtgttccagaaacgctttaatggctccgtctctttcttccgcggatggaacgactacaaacttggatttgggagggctgacggagaatattggctgggtctccagaatatgcacttgttaacgcttaagcaaaaatatgaactgcgtgtggatttggaagactttgaaaataatacggcctatgcaaaatacgcggatttttctatttcacctaatgcggtcagcgccgaggaagacggatatactttgtttgtggctggcttcgaagacggcggagccggagactcactgagctaccatagtggacagaagttctcaacatttgatcgcgaccaagatttgtttgtgcagaactgcgccgcactctcaagtggtgccttttggttcaggagctgtcacttcgccaatctaaatggattttatctcgggggaagccacctatcgtatgccaatggcatcaactgggctcagtggaagggattctattattctctcaagcgtacggagatgaagatcagacgcgcttag

SEQ ID NO: 230489 - DNA, 840 bp, Artificial Sequence
  Description of Artificial Sequence: Synthetic coding sequence
atgggggaactgtcaccactccagcgtcctttggctacggagggtactatgaaagctcagggtgtgttgctgaaactggcgctgctggcgctgcctctcctcctgttgctgtctactccgccatgtgcaccccaagtgagcggtatccgcggagacgccctcgaaagattttgcctacagcagccattggattgtgacgatatctacgcacagggctaccagagtgacggcgtgtatctcatttacccaagcggcccatctgtgcctgtccccgtcttttgcgacatgaccacggagggaggtaaatggaccgttttccagaagcggtttaacggctccgtgtcgtttttcagggggtggaatgactataagttgggcttcggcagagcagatggtgaatactggctcggcctgcagaacatgcatcttctcaccctgaagcagaagtatgagctgagggtggatctcgaagacttcgagaataataccgcttacgccaaatacgccgacttttcaatcagtccaaatgcggttagcgcggaggaggacggatataccctcttcgttgcgggattcgaggatggcggtgcgggagactccctgtcctatcatagtggtcagaaattctctacctttgacagggatcaggatctgtttgtccagaactgcgctgccctgtccagtggggctttctggtttcgatcctgtcacttcgccaacctgaatggcttctatctcggcggttcccacctatcttatgccaacgggatcaactgggctcagtggaaaggtttctattattctttaaagcgcaccgaaatgaagattcgtcgggcttag

SEQ ID NO: 230490 - DNA, 468 bp, Artificial Sequence
  Description of Artificial Sequence: Synthetic coding sequence
atggtcgacctgacccaagtgatggacgacgaggtctttatggcgtttgcctcttacgctacaatcatcctctccaagatgatgctgatgtcaaccgccacggctttttaccggctgacaaggaaggtgtttgccaaccccgaggactgcgttgctttcgggaagggagaaaatgcaaagaaatatctgcggaccgatgatcgagtggaaagagtgcgccgtgcccacctgaacgacctcgaaaacattattccttttctcggtatcggcttgctgtatagtctgtccgggccagatccgtctacagctatcttgcattttaggctatttgtgggcgcacgcatttaccatacgattgcgtatttgactcctctgccacaacccaacagagcgttgagtttcttcgttgggtacggcgtgaccctcagtatggcctataggctgctcaagtctaaactgtatctttag

SEQ ID NO: 230491 - DNA, 468 bp, Artificial Sequence
  Description of Artificial Sequence: Synthetic coding sequence
atggtcgacctgacacaagtgatggacgacgaggtctttatggccttcgcatcatacgcgacaattatactcagcaagatgatgctaatgtcaactgcgactgctttttataggttaactcggaaagtttttgccaacccggaagactgtgtagcatttggcaagggcgagaacgccaagaagtacctccggacagacgatcgtgtcgagcgggtgcggcgtgctcacctgaacgatctcgagaacataattccctttctgggaattggactcctctactcacttagcggtccagaccctagcaccgccatcttacactttaggctttttgttggcgcacgcatttaccatactattgcttatcttacccctctgccgcagcccaacagagccctcagttttttcgtgggatatggcgttactctgtccatggcctatcgactgctgaagtctaagttatatctttag

SEQ ID NO: 230492 - DNA, 468 bp, Artificial Sequence
  Description of Artificial Sequence: Synthetic coding sequence
atggtcgacttgactcaggttatggatgatgaggtgtttatggctttcgccagctacgccacaatcattctgtccaaaatgatgctgatgagcacagccacagcattctacagactcacgagaaaagtcttcgcaaacccggaagactgcgtggctttcggaaaaggtgagaacgccaaaaaatacctccgaactgacgatcgagtggaacgagtgcgcagggctcatttgaacgatctggagaacatcattcctttcctgggtattgggttactgtattcgctgagcggccctgacccgtctactgcaattctgcattttaggctgttcgtgggggcacgcatttaccacaccattgcttacctgacgccactacctcagcccaacagagcccttagcttttttgttgggtacggtgtaacacttagcatggcttataggctgctgaaaagtaaactttatctttag

SEQ ID NO: 230493 - DNA, 468 bp, Artificial Sequence
  Description of Artificial Sequence: Synthetic coding sequence
atggtggacctaacgcaggttatggacgatgaagtcttcatggcatttgcctcctacgctactatcattctctctaagatgatgctgatgtccactgccaccgctttctaccggctgaccagaaaagtgtttgcaaatcccgaggattgtgtggcatttgggaaaggagagaacgccaagaaatatctgaggaccgatgaccgcgtggagcgcgtccgacgggcacacctcaatgatcttgagaatatcataccgtttctcggaatcggattgttatatagtctgagcggcccagacccctctactgccatcctacattttcgactgtttgttggggctcggatctaccacaccatcgcctacctgacaccgctgccccagcccaaccgggctctaagcttctttgtaggatatggcgtgaccctgtcaatggcctaccgacttctcaagagcaagctgtatctttag

SEQ ID NO: 230494 - DNA, 234 bp, Artificial Sequence
  Description of Artificial Sequence: Synthetic coding sequence
atggtcgaccttacgcaggtgatggatgatgaggtttttatggccttcgcttcctacgccacgataattctaagcaaaatgatgctgatgagcactgctactgccttctacagactcactcggaaggtcttcgccaaccccgaagattgcgtggccttcggtaagggcgagaacgccaaaaaatatctgcggaccgacgatagggtagagcgcgtgagaagggcgcatttatag

SEQ ID NO: 230495 - DNA, 129 bp, Artificial Sequence
  Description of Artificial Sequence: Synthetic coding sequence
atggtcgatctcacacaggtcatggacgatgaagtcttcatggcatttgccagttatgctaccatcatattgagcaaaatgatgttgatgtccacagccacagcattctatcgactaactaggaaatag

SEQ ID NO: 230496 - DNA, 243 bp, Artificial Sequence
  Description of Artificial Sequence: Synthetic coding sequence
atggtagacctgacgcaagtaatggatgatgaagttttcatggcttttgctagctacgctaccatcatcctttccaaaatgatgcttatgtccaccgccaccgctttttataggctcactcgaaaagtgtttgccaacccagaagactgcgtggctttcgggaagggagaaaacgcgaagaaatatctgcggactgacgatagagtggaacgagtgaggcgtgcccacctgaatgatctctag

SEQ ID NO: 230497 - DNA, 264 bp, Artificial Sequence
  Description of Artificial Sequence: Synthetic coding sequence
atggtggacctcacccaagttatggacgacgaagtcttcatggccttcgcttcctatgctaccatcattctgtctaagatgatgcttatgtcgactgccacggccttttacagactgactaggaaggtttttgcgaatcctgaggactgcgtggcctttgggaaaggggaaaacgcgaagaaatacttgaggaccgatgaccgcgtggagagggtgcgcaggattaaacagacactgtcaatttatctcgcttcctcgatttag

SEQ ID NO: 230498 - DNA, 444 bp, Artificial Sequence
  Description of Artificial Sequence: Synthetic coding sequence
atggcagggaacagcatcttactggctgctgtgtctattctgtcagcctgccagcaaagctactttgcactgcaggtggggaaagctcggctgaagtataaagtgacacccccagcagtgaccggttccccagagttcgaaagagtcttccgggctcagcagaactgcgtggagttctatcctatttttatcatcacgctgtggatggctggctggtatttcaaccaggtgtttgccacttgtctgggattggtttacatctatggaaggcatctctatttctgggggtactctgaggcggctaagaagcgaatcacagggtttaggctgtcattaggaatcctggcccttctcaccctgctgggggctctgggcattgcaaattccttcctggatgagtatttagacctgaatatagcaaagaaactccggaggcagttctag

SEQ ID NO: 230499 - DNA, 444 bp, Artificial Sequence
  Description of Artificial Sequence: Synthetic coding sequence
atggcagggaattctatcttgttagcagcagtcagtattttatcggcatgccaacagtcttactttgctctgcaggtggggaaggcgcgtctcaaatacaaggtgaccccgcctgctgtcaccgggtcccccgaattcgagcgggtgttccgtgcacagcagaactgcgtagaattctaccccatttttattattaccctttggatggctggttggtactttaatcaggtcttcgccacctgtctgggactggtgtatatctacggcagacacctttatttttgggggtactcagaggcagcaaaaaaaaggataaccggatttagactttccctgggtatcctggcgttgctgacactgctgggagccttggggattgccaattcatttctggacgagtacctggacttgaacatagctaaaaaattgagacgccagttttag

SEQ ID NO: 230500 - DNA, 234 bp, Artificial Sequence
  Description of Artificial Sequence: Synthetic coding sequence
atggcgggaaattccatcctgctcgccgcagtgtcaatcttgagcgcctgtcagcagagttacttcgcgttgcaggtaggcaaagctaggctgaagtataaggtgaccccgcctgcagtaactggcagtccagaatttgagcgggtgtttcgcgctcacttttgctatctttcaggttcaggggtgcatatctggccttcccccatcctgctgggaattttcaggtcttgctag

SEQ ID NO: 230501 - DNA, 501 bp, Artificial Sequence
  Description of Artificial Sequence: Synthetic coding sequence
atgccttggcgcggacgtagattccgactgtgtcggcgaaagatggcagtgctctccaaagaatatggtttcgtgctactaacgggggcagcaagcttcatcatggtcgcccacctggcaatcaatgtctccaaagcacgtaaaaaatataaagtggagtaccccattatgtattcaacagaccccgagaatggtcatatttttaattgtatacaacgtgcccaccaaaacacccttgaggtctatccacccttcctcttcttcctggccgtcggcggagtatatcaccccagaatcgctagtggcctggggctggcatggattgttggtagggtactgtacgcttacggttattacaccggggagccgtccaaaaggagtcgcggagctctggggtcaattgctctcctcggcttagtcgggaccaccgtgtgcagcgcatttcaacacctgggttgggtgaagagtgggcttggatccgggccaaagtgttgtcactag

SEQ ID NO: 230502 - DNA, 459 bp, Artificial Sequence
  Description of Artificial Sequence: Synthetic coding sequence
atggccgtgttgagtaaggagtatggcttcgtgctcctgacaggagccgcatcttttataatggttgcacatctcgcgattaacgtttctaaggcccgaaaaaaatataaggttgaataccctattatgtacagcaccgatccagagaacggtcacattttcaactgcatacagagggcgcatcagaatacccttgaggtgtaccccccttttctttttttcctggccgtgggaggggtgtaccacccgagaatagcgtctggccttgggttagcatggattgtggggagagtgctgtacgcttacggatactacaccggagagccctcgaagagaagcaggggcgctttaggttcaatagccttgttgggtctcgttggcacgaccgtgtgttccgcatttcagcacctggggtgggttaagtctggcctggggagcggcccaaaatgctgccattag

SEQ ID NO: 230503 - DNA, 501 bp, Artificial Sequence
  Description of Artificial Sequence: Synthetic coding sequence
atgccttggcggggacgtaggtttaggttatgccgaagaaagatggccgtcttgtccaaagagtatgggttcgtgctattgactggtgcagcttcttttattatggtagcccatctcgccattaatgtttccaaggccaggaaaaagtataaggtcgaatatcccattatgtattcaactgatccagagaacggtcacatctttaactgcatccagagagcgcatcagaacacactagaagtgtaccccccttttctgttttttctggcagttgggggagtctatcacccgcgaatcgctagtggtctcggtttggcgtggatcgtgggtagagtgctgtatgcttatgggtattacacgggagagccctccaagaggagtcgtggagccttgggaagcatcgctttattaggcttggtgggtacgacagtttgctcagccttccagcatctcggctgggttaagtctggactcggttccggtccaaaatgttgccattag

SEQ ID NO: 230504 - DNA, 501 bp, Artificial Sequence
  Description of Artificial Sequence: Synthetic coding sequence
atgccctggagaggtaggcgatttcggttatgtagacggaagatggccgtcttgtcaaaagaatatggctttgtcctgcttactggcgcagcgtcctttatcatggtggcacatctagccatcaacgtgtcaaaagccaggaaaaagtacaaagtggaatacccaattatgtactcgacagaccccgaaaacggacacatctttaattgcatccagcgggcacatcagaatacacttgaggtttaccccccatttctgttttttctcgccgtggggggtgtgtaccatccaaggatagctagtgggctaggacttgcctggatagtgggtcgagtgttgtacgcctacgggtactacaccggtgaaccatctaagcggtctcgtggcgcactcggatcaattgctctcttggggttagttggaactacagtgtgttccgcgttccagcatctgggttgggttaaatctggattgggtagcgggcctaagtgttgccactag

SEQ ID NO: 230505 - DNA, 459 bp, Artificial Sequence
  Description of Artificial Sequence: Synthetic coding sequence
atggcagtccttagcaaggaatatgggtttgtcttactgactggcgctgcatcctttataatggtggcacatctggctattaacgtgagtaaagctcggaagaagtataaagtcgagtaccctattatgtactccacagaccctgagaacggtcacatatttaactgcatccagagagcccatcagaacactctggaggtgtaccctccctttctttttttcctagctgtaggcggtgtctaccacccacggatagcatcaggcctcgggttagcctggatcgtggggagagtgctgtacgcttacggatactatacaggcgagcctagtaagcgctcaaggggcgctcttggatcaatcgccctgctgggcctggtgggtacaaccgtgtgtagcgcctttcagcatctggggtgggttaagtccggcttgggctccggtcccaaatgttgtcactag

SEQ ID NO: 230506 - DNA, 501 bp, Artificial Sequence
  Description of Artificial Sequence: Synthetic coding sequence
atgccatggcgtggacgcagattcaggttgtgccgccgtaaaatggctgtgttgtcaaaagaatatggcttcgtactcttgactggggcagcttccttcataatggtggctcatctggcaataaacgtctctaaagctagaaagaaatataaggtggagtatccaattatgtatagcacagaccctgaaaacggtcacattttcaattgcattcagcgggctcatcagaataccctcgaggtctacccacctttcctgttctttctcgccgtagggggtgtgtaccacccacgaatcgcatccggtctaggactggcatggatcgtgggaagagtgctctatgcctatgggtattacaccggggaaccctccaaaaggtctagaggggctctgggatccatcgctcttcttggtctggtgggcactaccgtgtgctccgcctttcaacacctgggatgggtaaaaagtggactcggatcaggcccaaagtgttgtcactag

SEQ ID NO: 230507 - DNA, 972 bp, Artificial Sequence
  Description of Artificial Sequence: Synthetic coding sequence
atgcccagattgactttcgcaccaaagggctggccacatcctcccacctcactccattggtggctcttccaggagctgcctacaccctcggaaaacagcatgcccccaggtctctcaacaccaaccgcaagtcaggagggggctggacccgtccctgatcccagtcagcccacgaggcggcaaatccgcctgtcatctcccgagcgacagcgattgtcttccctcaacctgacccctgatccggagatggagccgccacccaaacctcctaggagctgcagtgccctcgcaaggcatgctttggagtcctcatttgtggggtgggggctccctgtgcagagccctcaggccctggttgctatggaaaaggaggagaaggagagtccgttctctagcgaggaagaggaagaagacgtgccactggacagcgatgtggagcaggcgctccaaacgtttgcgaaaacatccggcacaatgaacaactacccaacatggcgacggacacttctcagacgcgcaaaagaggaagaaatgaaaagattttgtaaggctcagacaatccagagaaggctgaacgaaattgaagctgcgctgcgtgagctggaagctgagggggtcaagctcgagctggcactgcgtcgacaatcatcctccccagagcaacagaagaaactgtgggtgggccagctgctccaactcgtcgacaagaaaaacagcctggtggctgaggaagcagagctgatgatcacagttcaggagctgaatttggaagagaaacagtggcagctggatcaggagctgagaggatatatgaacagagaggaaaatttgaaaactgctgccgatcgccaggctgaagaccaagtcctccggaagttagtggacctggttaatcagcgagatgcgctgattaggttccaggaggagagacggctgtccgagctcgcactagggaccggcgctcaagggtag

SEQ ID NO: 230508 - DNA, 2946 bp, Artificial Sequence
  Description of Artificial Sequence: Synthetic coding sequence
atggcttcccctactagtaccaatcccgctcatgcacacttcgagagcttccttcaggcacaactgtgtcaggacgtcctaagctcttttcaggaactctgcggcgctttgggactcgagcccggagggggattgcctcagtaccacaagataaaagatcaactgaactattggtctgctaagtccttgtggactaaactggataagcgtgcaggccagccggtctaccagcaggggagggcatgcacgagcaccaaatgtctggtcgtcggggctgggccttgcggcttgcgggtggctgtcgagctggcgctgctgggcgctcgagtggttctcgtagaaaaaagaaccaagttttctaggcacaacgtcctgcacctctggccctttaccatccacgacctccgagcgctcggcgctaaaaaattttacgggcgattctgcactgggactctcgatcacatttctatacgccaacttcagctgctgctgttaaaggtggctttgctgctgggggtagagatacattggggagtgaccttcaccgggctccagccaccacccagaaagggaagcggttggcgtgcccagctccaacccaacccccctgcgcaactagccaactatgagttcgacgtgctgatttctgctgctggaggaaaattcgtgcccgaaggttttaaggtgagagaaatgcgcggaaagctggctatcgggattaccgccaactttgtgaatggtcgaaccgtggaagaaacacaggtgcccgaaatttctggtgtcgccagaatttacaatcaatccttttttcagtcactgcttaaggctacaggcatcgatttggagaatatagtctattacaaagatgatacacactacttcgtcatgaccgctaagaagcaatgcctcttgcggctgggcgtcctgcgacagccattttggcccctgggtacaggtgtagcacgtggcttcctcgctgcatttgacgcggcttggatggtcaagcgctgggccgagggagccgagtccctcgaggttttagcggagcgagaaagtctctaccaactccttagccagacctcgcctgaaaatatgcacaggaatgttgcccagtacggccttgatcctgctactcgatacccaaatctcaacctcagagccgtaactcccaatcaggtgcgagatttatacgacgtcctcgcaaaggaacccgtgcagcgtaataacgataaaacggacactggaatgccggctaccgggtccgctggaacccaagaagaacttctgcgctggtgtcaggagcagactgctggctatccgggagtgcatgtttctgacctttccagttcctgggcagacggactggccttatgcgccttggtctaccggttacagcccggactcctcgagcctagtgaacttcagggtctaggcgctttggaagccaccgcttgggcattgaaggtcgccgaaaacgagctggggatcacacccgtggtgtccgctcaggctgtcgttgccggatcagacccactcggcctgatcgcttatctgtcccactttcactcagctttcaagtccatggctcattccccagggcctgtgtctcaggctagccctgggacaagcagcgctgtactcttcttaagcaaactgcagcgtacgctgcagcggtccagagccaaagagaatgccgaagacgctggaggtaagaaactgcgtctcgagatggaggctgagacgcccagcacagaggttcctccagacccagaacccggagtaccactgacacccccaagccaacaccaggaggctggggctggagacctgtgcgccctgtgtggcgaacacctgtacgtgctggaacgactttgcgtcaacgggcattttttccatagaagttgttttagatgtcacacttgtgaggccaccttgtggccaggagggtacgaacagcatccaggcgacgggcacttttactgcttacaacatctgccacagacggaccacaaggcagagggctccgatcggggacccgaatcccctgaactgcctaccccttcagagaactccatgcctcccggactaagtactcccactgcctctcaggaaggtgcgggaccggtgcctgacccgagccagcctactcgccgacaaattcgccttagttctccagagcgacaacgactttcttctctgaacctgaccccagatcctgagatggaacctcctcccaaacctcctagatcgtgctcagctctggctcgacatgccctcgagagcagctttgtgggctggggcctgccggtgcaatcaccacaggctctcgtggccatggagaaggaagaaaaggaatcaccattttcaagtgaggaagaagaagaagacgtgcctctcgacagcgacgtcgaacaagcactccagacctttgcgaaaacctccggtactatgaacaactatcctacttggcgcagaacgttgttaagacgcgcaaaagaggaggaaatgaaacgtttttgcaaggcacaaaccattcaaagacggctgaacgagatcgaagctgctctccgggagttggaggccgagggagtcaagcttgaactggctctacgtaggcagagctcgtcccccgagcagcagaaaaaactatgggtgggccagttactccaactggttgataaaaagaactcgctggtagccgaggaggccgagctcatgataaccgtacaagagctgaacctggaggagaagcagtggcagctggaccaagaattacgcggttacatgaacagagaggaaaatctcaagaccgctgcagataggcaagccgaagaccaagtcctcaggaaactcgtggacctcgtgaaccagagagacgctcttatcagattccaagaggagaggcgcctgtctgagctggcccttggaaccggggctcagggctag

SEQ ID NO: 230509 - DNA, 3204 bp, Artificial Sequence
  Description of Artificial Sequence: Synthetic coding sequence
atggcttcccctacgtccaccaatccggcacatgctcatttcgagtccttcctccaagcccagctatgccaggatgtccttagtagcttccaggaactgtgtggcgcactgggattggaacctggtggcggtctgccacagtaccataaaattaaagatcagctcaattattggagtgccaagagtctctggacgaagctggacaagcgtgccggacagcctgtgtaccaacaaggaagagcatgtacaagcaccaaatgccttgtagttggcgctggaccatgcgggctgagggtggcagtggaactggcactgctcggcgcacgagttgtcctcgtagagaagcgcaccaagttctcccggcacaatgtcctccatttgtggccttttaccattcacgatctcagagcccttggtgcaaaaaagttctatggaagattctgcaccggaacattggaccacatttctattcggcagctgcagcttctacttctcaaggtcgctttgctcctgggtgtggaaatccactggggagtcacgttcacgggacttcagccaccccctcgcaagggtagcggctggcgcgcacagttgcagcccaatccccctgcacagcttgccaactacgagtttgacgtgttgatctccgctgccggtgggaaatttgtccccgagggttttaaagtgagagagatgcggggaaaactggctattggcattaccgccaacttcgtcaacggccgtactgttgaggaaacacaagtgccggaaatatctggagttgcccgaatttacaatcaaagtttctttcaatcgttactgaaggcaaccgggatcgatctcgagaacattgtttattataaagatgacacccactatttcgtgatgaccgccaaaaagcagtgtttgctgcggttgggggtgttgcgacaagactggcctgatactaatcggttgctgggatctgctaacgtggtgcccgaggccctccagcggtttaccagggccgcagcggacttcgccactcatggtaagttgggcaagctggaattcgcccaggacgcccatgggcagcctgacgtgtccgcctttgacttcacttccatgatgagggctgaatcctcagcgcgagtgcaggaaaagcatggggcaaggctgcttttgggcctcgttggcgattgcctggtggaacctttctggcctctgggcacaggcgtggctcgagggtttttggccgcattcgacgcagcctggatggttaagcggtgggcggagggtgcagaaagccttgaggtgctcgctgagcgagaatctctttaccagctgctgtcacaaacctcccccgagaatatgcacaggaacgtggctcaatacggtctcgatcccgctacgcgctacccaaatctcaatttgagggcggtcactcccaatcaggtccgggacctctatgacgttctggctaaggagccagtgcagaggaacaatgataagactgataccggaatgcccgcaaccggctctgcgggtactcaagaggagctcctgagatggtgtcaggagcagaccgcgggataccccggagtgcacgtgagcgatttgagcagctcttgggccgatgggttggccctgtgtgctctggtgtaccgcctgcagcctgggctgctggagccgagtgagcttcaaggtttgggggcacttgaagcaaccgcgtgggctctgaaggtggcagaaaatgaattgggaatcactccggtagtcagcgcgcaggccgttgtggccggttcggatcctctaggcctcatcgcatacctatctcattttcacagtgccttcaaaagtatggcccactcccctggacccgtcagccaagcctccccaggtacttcctcagctgtcctgttcctgtccaagctccagcggactctccagagaagtcgcgcaaaggagaatgcagaggatgccggtggtaagaagctacgtctggaaatggaggccgagactcccagtacagaagtgccgccagacccagagccaggagttcccctgacacccccaagtcagcatcaggaagcaggcgcaggtgatctgtgcgccctttgcggcgaacatctgtacgtgttagagcgcctctgcgtgaacgggcattttttccacagatcttgttttagatgccacacctgtgaagccaccctatggccaggaggctacgaacagcatcccggagacggacacttttactgcctccaacacctcccccagacggatcacaaggccgaaggaagcgatcgcggtcctgagagccccgaactgccaacaccaagcgaaaacagcatgccgcctggtctgtcaacccctacggcctcgcaggagggagctggtcccgttccagatccaagtcagccgaccagacggcaaatcagactcagtagcccagagcgtcagcggctgagctcactgaacctgacacccgatcccgagatggagccaccgcctaagcctccacgatcctgctcagctctggctcggcatgcgctggagtcatcattcgtgggatggggactgcccgtacagtctccccaggccttggtggccatggaaaaagaggaaaaggagagcccatttagcagtgaggaagaggaagaagacgtccccttggactcggacgtcgagcaggctctgcaaacatttgccaagacctcgggaactatgaataactaccccacctggaggcgaaccctcctcaggcgggctaaggaagaggaaatgaaacgcttctgtaaggctcagaccattcagaggagacttaacgagatagaggccgctctgagagaactggaagcagagggagttaagctggagcttgccctcagacgacagtccagttcacctgagcagcagaaaaagttgtgggtgggacagcttctccagctcgtggacaaaaagaattctttggtggccgaggaagctgagcttatgatcaccgtacaggaactgaacctggaagaaaaacaatggcagctcgaccaggaacttcgcggatatatgaatagagaggagaacctaaagactgcagcggacagacaggctgaagaccaggtcctgcgaaagctggtggatctggtcaatcagagggatgcactcatccgcttccaggaagagcggaggttatcagagctggccctgggcaccggtgcacagggttag

SEQ ID NO: 230510 - DNA, 3261 bp, Artificial Sequence
  Description of Artificial Sequence: Synthetic coding sequence
atgagttgcttgagccactcttctctgcccagctgttgccccccacaggaagccagcatggcaagtcctacaagcaccaatcctgcgcacgcgcacttcgaatcttttctccaggcacagctttgtcaggacgtgctgagtagcttccaagaactgtgcggggctctggggctcgagcccggaggaggcctcccccagtaccacaagattaaagaccagctcaattactggtctgccaagagcctgtggactaaattagacaagcgggctggccaacctgtgtaccagcagggacgggcatgtacttctactaagtgtctggtggttggcgctgggccttgtggacttcgggtggccgtggaattggcacttctgggtgctcgggtagtgctggtggaaaagagaacaaaatttagtagacacaacgtgctccacctgtggccttttaccattcatgatctgagagccttaggagccaaaaaattttacggcaggttttgcaccggcactctggatcacatcagtatcaggcagttgcagcttctgctgctcaaagtggctctgctcctgggcgtggaaatccattggggcgtgacattcaccggcctacagcccccacctagaaagggctcagggtggagagctcaacttcagcccaatccacccgctcaactcgccaactatgagtttgatgtgcttatctccgccgcaggaggaaaatttgtccccgaagggttcaaggtgcgtgagatgcggggtaaactggccatcggtattacagcaaacttcgttaacgggcgaactgtcgaagagacacaagtcccggagattagcggggtcgcacgaatatacaatcagtccttcttccagtccctactgaaggcaacagggatcgacctcgaaaatatagtctattacaaagatgacacacactactttgttatgacagcgaaaaaacaatgtctactgagactgggtgtgctgcggcaagactggcccgatacaaatcgactgttaggctccgccaatgtggttcccgaggctctccagaggtttacaagggccgctgcggacttcgctactcatggtaagctgggaaagctcgaatttgcccaggacgcccacgggcaacctgatgtatctgccttcgatttcacctcgatgatgcgcgctgagtcaagcgcgagggtacaagaaaaacacggcgcaaggttgctactggggctggttggtgactgcttagtagagccattctggccactggggactggcgttgccaggggtttcctggccgcatttgatgctgcttggatggtgaaaaggtgggctgaaggagcagaatcacttgaggtcctggctgagagagaatcattatatcaactactctctcagacttccccagaaaacatgcatcggaacgtggcccagtacggactcgacccggcaaccagatatcccaatctcaacctgagagccgtgacccccaaccaagtcagagacctgtacgacgtccttgccaaagagcctgtacaacggaataacgacaaaaccgatacaggaatgcccgcaactggaagcgccggaacccaagaagaactgctccgctggtgccaagaacagactgctggctacccaggagtacatgtctcagatctgtcttcctcgtgggctgatggactagccctgtgtgcgctggtttatcgactgcaaccaggacttcttgagccatccgagctccaagggttgggggcactggaagctacggcgtgggcactgaaggtggctgagaatgagctggggataactccggtggttagtgcccaggctgtggtggcagggtccgacccgctgggtctgattgcctatcttagtcacttccactccgcttttaaatcgatggcgcattcccctggaccagtctcccaggcatcacctgggacaagctctgctgtgctcttcctctccaagctgcaaagaacccttcagcggagccgggctaaggaaaacgctgaggatgccggtggcaaaaaactgagactggagatggaagctgagacaccaagtacagaggttccccctgatccggagcctggcgtacctctgacgccgccttctcagcaccaggaagctggtgctggcgatctttgtgcactgtgtggagaacatctgtatgttcttgagcgtttatgtgtgaacggccacttctttcatcgctcatgttttaggtgccacacgtgcgaagcaaccctgtggcccggaggatacgagcaacatccgggtgacggccacttctactgcctgcagcacctgccccagactgatcacaaggcagaggggagcgaccggggtcccgaatctcccgagctgccaactccatcggagaactctatgccccctggtctgagcacccccaccgcatcccaggaaggcgcagggccagtgcctgacccctcacagcctacacgtcgtcaaataaggctgagcagtcctgaaaggcagcggctgtcgtccttgaatctcactccagatccggagatggagcctccccctaagcctcctcggtcttgctctgcgctggcccgacatgcgttagagtcatcatttgtgggatggggccttcccgtacagagcccacaggcacttgtggccatggagaaagaggagaaagaatctccgttctctagtgaggaagaagaggaggacgtcccgctcgacagcgatgtggagcaggccctgcagacgttcgccaagacctccggcacaatgaataattacccaacctggaggcggacccttctgagaagggccaaagaggaggagatgaaaagattttgcaaggcacaaactatacaaagacgattaaacgagatagaagcagcactaagagaactggaggccgagggagtcaagctggaattggcattacggagacagtcatcttcccccgagcagcagaaaaagctgtgggtaggacagctgcttcagctcgtggacaaaaaaaatagcctagtagcagaggaggccgaattaatgatcaccgtccaagagcttaacttggaggaaaagcagtggcagctggaccaggagctgaggggttacatgaacagagaggaaaatctcaagactgcagctgataggcaagccgaagatcaggttcttcgaaagttagttgatcttgtgaaccagcgggatgcattgattagattccaggaggagcgcaggctgtccgaattagctctggggactggtgctcaaggatag

SEQ ID NO: 230511 - DNA, 1776 bp, Artificial Sequence
  Description of Artificial Sequence: Synthetic coding sequence
ccaaaatatgttctcccctcagaagcccaggtcgtgcccgcaaagcagttacagccacaggatagaagtagtgttccggaacattctctgctggctggcacccaggaagaactcttaagatggtgccaggaacagacagccggttaccccggtgttcatgtgtcagatctgtcatctagctgggctgatgggttagcactgtgcgctctggtctacaggctgcaacccggattgctcgagccttctgagttgcagggccttggtgccctcgaagccacagcttgggcccttaaggtggccgaaaacgagctgggcatcacgcccgttgttagcgcacaagcggtggttgccggatctgatcctcttggactgattgcttatctgtctcatttccactcagctttcaagtcgatggcccactctcctggccctgtcagccaagcttcacccggaacatcctcagctgtgctgtttctgagtaaactccaacgaactctacaaagaagccgagctaaggagaacgctgaagacgctggagggaaaaaactgaggttggaaatggaggcagaaaccccaagcacagaggtcccccctgacccggagcctggtgttcctctgacacccccaagccagcaccaggaagccggagctggtgacctctgtgctctgtgcggagaacacctctatgtgctggagagattgtgcgttaacggtcatttcttccaccggagctgcttccgctgtcacacctgcgaagctacactttggccgggagggtatgagcagcatccaggcgacgggcacttctactgtctgcagcacctcccacagacagaccacaaggccgaggggtctgataggggaccagaatcccccgagctgccaactccgagcgagaacagtatgcctccgggactaagtactcccaccgcaagccaggaaggggcaggtcctgtaccagaccccagccagcctacacgtcggcagatccggctttccagcccggaaaggcaacggctcagttctctgaaccttacccccgaccccgagatggaacccccacctaaacctccgaggtcgtgctctgcattagcacgacacgccctggaaagctcatttgtgggatggggcctccctgtgcagtccccccaggctttagtcgccatggagaaagaggaaaaggagtcgccgttttcatccgaggaggaggaagaagatgttccattagattccgacgtggagcaggcacttcagacattcgccaagacctctggcaccatgaataattatcctacgtggaggcgtacattgctaaggagggcaaaggaggaggaaatgaaacgattctgcaaagctcaaaccatccagaggcggctcaatgaaattgaagcggctcttagggagttggaagctgagggggtgaagctcgagttggcactgcgtcgacagtcatcaagtcctgagcagcagaaaaagctttgggtcggccaacttctccagctcgtagacaagaagaactctctagtggccgaggaggccgaactgatgatcacggtacaggagctgaacctcgaggagaaacaatggcaactcgaccaggagctgagaggttacatgaatcgggaggaaaacctcaagaccgctgctgatcggcaggcggaggatcaggtgttgagaaagttggtggacttagtgaatcagcgggatgcactgattagattccaagaggagcggagactgtccgagctcgcactcggcaccggggcacagggctag

SEQ ID NO: 230512 - DNA, 735 bp, Artificial Sequence
  Description of Artificial Sequence: Synthetic coding sequence
atggctagcccaacgtcaaccaatccagctcatgcccacttcgaatctttcctacaggcccagctgtgccaggatgtcttgagcagtttccaggagttatgtggcgctctcggactcgagcctggaggcggactgccccaataccacaagatcaaagatcagttgaattattggtcagccaagagcttgtggacaaagctcgataagcgcgctgggcagccagtctatcagcagggtagggcgtgcaccagcacgaagtgtctcgtggttggcgcaggcccttgtggcttgcgggtggccgtggaactcgccctactaggggctagagttgtgcttgttgagaagagaactaaattcagccgccacaacgttctgcatctgtggcccttcaccatacacgacctgcgcgctctgggggcaaaaaagttctatggaaggttttgcaccggcaccctggaccatatcagtatacgtcagctgcaactcctgctgttgaaggtcgcactgttactgggagttgaaattcattggggagtcacatttacaggactgcagccgcctcctcgtaagggttcaggatggagggctcagctgcagcccaaccctccagcccagctggcaaattatgagtttgacgtgctcatttctgcagccggaggaaaattcgtgccagaggggtttaaagtgcgggagatgagagggaagcttgcgatcggtattacagcaaatttttag

SEQ ID NO: 230513 - DNA, 3375 bp, Artificial Sequence
  Description of Artificial Sequence: Synthetic coding sequence
atgggcgagaatgaggacgagaaacaagcgcaagcaggtcaggtcttcgaaaactttgtgcaggcttcgacctgcaagggaacgctccaagcattcaacatactgaccaggcacctcgatctcgatcccttagaccaccgcaatttttactccaaattgaagtccaaagtgactacatggaaagccaaggccttgtggtacaagcttgataagagaggctcccacaaggagtataagagggggaaaagttgcaccaacactaaatgcctgatcgtggggggaggaccttgcgggctgaggaccgctatcgagctggcctaccttggcgcaaaagtcgtggtggtcgagaaacgcgactcattttctcggaacaatgttcttcacctttggccctttaccatccacgatctgaggggcctcggggcaaaaaaattttacggcaagttctgcgccggaagtatcgaccatattagcatcaggcagttgcagttgattttgttcaaagtggctttaatgctgggcgttgagatccacgtgaacgtggaattcgtaaaagtgctagaacctccagaagaccaagagaaccaaaagatcgggtggagagccgaatttcttcccaccgaccatagtctcagtgagttcgagtttgacgtgataattggcgcagatgggaggagaaataccctggagggctttcggagaaaagaatttcggggaaagcttgccatcgcaataaccgccaacttcattaaccgcaacagcacggccgaagccaaggtggaggaaataagcggggttgcctttatcttcaaccagaaattctttcaggacctgaaagaggaaacagggatcgatttagagaacatcgtctattataaggactgcactcattattttgtcatgacagcaaaaaagcagtctctgctcgataaaggtgttatcatcaatgactacatcgacactgaaatgctgttgtgtgccgaaaacgtcaaccaggacaacctcttgagctacgcaagggaagcagctgatttcgctacgaattaccagctgccttccctggatttcgcaatgaatcattacggccagccagatgtggcaatgtttgattttacctgtatgtatgcctccgagaacgccgctctagtgcgggagcgccaggcccaccaattgctagttgcacttgtaggcgactccttgctcgagcctttctggcccatgggtacaggatgcgcaaggggattcctagcagccttcgataccgcatggatggtcaagagctggaaccaaggtacccctccactcgaactcctcgccgagcgagagtcactatacaggctgcttccacagaccactcccgagaatatcaataaaaattttgagcaatacacattggatcccggaacgaggtatccgaatctgaatagccactgcgtgcgaccacaccaagtgaaacacctatatataaccaaagagttagagcattatccactcgaacgcttgggctcagtgaggaggagcgtaaacttgtcccgcaaggaatccgacatacgaccttccaaattactcacatggtgccagcagcagaccgagggctaccagcatgtaaacgtcaccgacctgaccacttcatggcgctccggcctggcactctgcgccattattcatcgttttaggcctgaactcataaactttgactctctgaatgaagatgacgccgtggaaaataaccagctcgcatttgatgtcgcagagcgcgaatttgggattcctccagtgaccaccggaaaagaaatggcaagcgcacaggaaccggataaactaagtatggtaatgtatcttagcaagttctacgagctgttccgaggtacacccttgcggccagtggactcctggcgtaagaattatggtgaaaacgcagatcttagcctcgcgaagtcaagtatttccaataactaccttaaccttacctttccacgtaagcgcacaccaagagtcgacggacagacgggtgagaacgacatgaataaaagacgcagaaagggattcactaatttagatgaacccagcaatttctctagccgctccctcgggtcaaatcaggagtgtggctctagcaaagaagggggtaaccaaaacaaggtgaaatctatggccaaccaactcctggcaaaatttgaagaaagtactcgcaacccaagtctcatgaagcaggaaaggcgggtcagcggtataggcaagccggttctttgttccagcagcggaccccctgtacactcatgctgcccaaaacctgaagaagcaacaccttctcccagtccacctctgaagcggcagtttcccagtgtagtcgtgaccggacacgttctgagggaactcaaacaagtgtcggcaggttccgagtgtctgtcaaggccatggagggcaagagctaaatccgatctgcagctcgggggtacagaaaactttgcaactctgccctctacgagacctagagcacaggcgctgtccggtgtgctctggcgcctgcagcaggtagaggagaagatattacagaagagggcccagaatctcgcaaatagggagttccacaccaagaatattaaggaaaaggcagcccacctggcttcaatgtttgggcacggcgactttccacagaacaaattgctgagcaaagggcttagccatactcaccccccaagcccccctagtcggctcccttctccagaccctgcagcctcttctagcccttcaaccgttgattcagcttcccccgcaagaaaagaaaagaagagcccttccggttttcatttccacccctcccacctgcggaccgtgcatccccagcttactgttggaaaagtgtcctcggggatcggagctgctgctgaggttctggtgaacctgtacatgaatgaccaccgccctaaagctcaggccacatcccccgatttggaaagcatgcgtaaaagtttccccctcaatctgggcggatctgacacctgttatttctgtaagaaaagagtatacgtcatggagaggctgagcgcggaaggacacttctttcatcgggagtgtttccgatgctcaatttgcgctactactctgcgcctggctgcatatacatttgattgcgatgaggggaagttctactgtaaaccccactttatccactgcaagaccaactccaaacagcggaaacgtcgggctgagttaaagcagcagagggaagaagaagctacctggcaggagcaggaggctcccagaagagacaccccgaccgagagcagctgcgctgtggcggcaatcggtacattagaagggagcccacccgtccacttctccttacccgtgctgcaccccctgttgggttag

SEQ ID NO: 230514 - DNA, 3312 bp, Artificial Sequence
  Description of Artificial Sequence: Synthetic coding sequence
atgggtgagaacgaggatgagaagcaggcccaagccggacaagtattcgaaaacttcgtgcaggcctccacatgcaagggcactttacaggcgtttaatatcctgactcgacatctggatctggatccattggaccacagaaatttctattctaagctaaagagtaaggtgaccacctggaaggcgaaggcactatggtacaaattggacaagagaggttctcacaaagaatacaagcggggaaaatcctgtaccaataccaagtgccttatcgtcggcggtggtccgtgcgggcttaggaccgccattgagctagcttatctcggggctaaggtggtggttgtggaaaagcgagattccttctccaggaataacgtcctgcatctctggccttttacaattcatgacctccggggactgggagcaaaaaagttttacggcaaattttgcgccggatcaatcgaccacatcagcatccgacagctgcagttgatcttatttaaagtggctctgatgcttggcgtggaaatccacgtgaatgtggagttcgtgaaggtattggagccacctgaggaccaggagaatcaaaaaattggctggagggcagaattcctacctactgatcattctctttcagagtttgagtttgatgtcattatcggcgcagacggacggagaaacacactggagggttttcgacggaaagagttccgcggaaagctggccatagcaattacggcgaattttatcaatcgaaatagtacagcagaggctaaggttgaggagatcagcggagtggctttcattttcaaccagaaatttttccaggatctgaaggaagagacaggcatcgacctcgaaaacattgtctattacaaagactgcacccactattttgttatgacagccaaaaaacagagtctgctagacaagggcgttattatcaatgattacattgacacagagatgctcctgtgcgccgaaaatgtgaaccaggacaacctcctgagttacgctagggaggccgcagactttgctaccaattatcagctcccgtcacttgatttcgccatgaatcactacggacaaccagatgtggctatgtttgatttcacctgtatgtacgcatccgagaatgctgctcttgtgagagaacggcaggctcatcaacttctggttgctctcgtgggagattcgcttctggagccgttttggcctatgggcacagggtgcgcccgaggattcctggcggcatttgacacggcttggatggtcaaatcttggaaccaaggcacaccaccccttgagcttctggctgagcgagagtcactctacagactgctgccccaaacgactccagagaatattaacaaaaattttgaacagtataccctggaccccggtaccagatatcccaaccttaacagccattgcgttcgtcctcatcaagtcaagcacttatacattaccaaagagttggaacactaccccctagagaggctgggcagtgtccgcaggtctgttaacctttcgagaaaagagtccgacatacgacccagcaagttactcacctggtgccagcaacaaaccgagggctaccaacatgtgaacgtgacagacctgacaacctcttggcggagcgggcttgctctttgtgctataattcacaggttcaggccagagctcatcaatttcgattctttgaatgaggatgatgccgtggaaaataatcagctggcttttgacgttgctgagcgagagtttgggataccaccggttactactggaaaagagatggcctcagcccaagaaccggataagctgagtatggttatgtacctgtcaaaattttatgagctgttccgcggtacccccctgcggccagtcgactcctggagaaagaactacggtgagaacgctgatctctccttagcaaaatctagcatatccaacaattatctcaacctcacttttcccagaaagagaaccccgagggtagacgggcagacaggtgagaacgacatgaacaaacgaagacggaaaggtttcacgaacctggatgaaccatcaaatttctctagtagaagcttgggatccaaccaggagtgtggctcatccaaagagggtggtaatcagaataaggtgaagtccatggccaatcagctcttggccaaattcgaagagagtacacggaatccatccttgatgaagcaagagcgtcgtgtgtccggcatcggaaaacccgtgctgtgcagtagtagcggcccaccagtgcatagctgttgcccgaagccagaagaagccacgccgagcccttccccacccctgaaacgccagtttcccagcgtggtggtgacaggacacgtgctgagagagcttaagcaagtctccgctggaagcgagtgtttgtcaagaccttggagagcacgagcgaaatctgacctgcagctgggcggaaccgagaacttcgcaacgcttccatcgacacgtcctcgcgcacaagcattgtccggagtgttatggcgcttgcagcaggtcgaggagaagatcctgcagaagcgcgcacaaaatctggcaaaccgcgaattccacaccaagaatatcaaagaaaaagcggcacatctggcctccatgtttggacacggggacttcccccagaacaaactcctgagcaaaggcttaagccacacacaccctccatctcctccctcaaggctcccaagcccggacccagctgcctcttcatccccaagcaccgtcgactctgcctcccctgcgagaaagctgacggtcggcaaagtgtctagtggcattggagccgctgccgaggtgctggtgaacctctacatgaacgatcatagaccaaaagcacaggccacgtcacccgacttagagtcaatgcgaaaatccttcccattgaacctggggggaagtgatacttgttatttttgcaagaagagagtctacgtcatggagaggctatcggctgaaggccatttctttcaccgggaatgttttcgatgtagcatttgcgccactacactcagacttgccgcatataccttcgattgcgacgagggaaagttttactgtaagccccattttattcactgtaagaccaactctaagcaacgcaagagaagggctgagctgaaacaacagcgtgaggaggaagccacctggcaagagcaagaggctccccgaagagatacaccaactgaatcatcttgtgccgtggctgccataggaacactggaaggtagtcctccagtgcacttttcactcccagtcctccaccctttgttgggctag

SEQ ID NO: 230515 - DNA, 2931 bp, Artificial Sequence
  Description of Artificial Sequence: Synthetic coding sequence
atgggcgagaatgaagacgagaagcaggctcaggctggccaggtttttgaaaatttcgtgcaggccagtacttgcaagggaacccttcaagcctttaatatactcacacggcacttagatttggatcccctcgaccatagaaatttctactccaagctgaagagtaaggtaacaacgtggaaagccaaggccctgtggtacaagctggataaaagaggatcgcacaaagagtataaacggggaaaatcttgtacaaacacaaagtgcctcatcgtgggaggcggaccctgtggccttagaacagccatcgaactcgcctacctcggcgcaaaagtcgtggtggtcgagaagagggacagtttctcacgcaacaacgtcctccatctctggccattcacaatccacgatctgaggggcttaggagcaaaaaaattttacgggaagttttgtgccggatctatcgatcacatatctatccgccagctccaactcatcctgtttaaggtcgcattaatgctgggggtggaaattcacgttaacgtcgaatttgtcaaggtactggaacccccagaggaccaagagaatcagaaaatcggctggagagccgaattcttgccgaccgaccacagcttgagcgaattcgagttcgacgtgattatcggcgctgacggaagacggaacaccttagaaggcttcaggcgcaaagaatttagggggaaactggccatagcaatcactgccaacttcatcaatcggaacagcacagccgaagccaaagttgaagaaatatcgggagtagcgtttatttttaaccagaagtttttccaggacttgaaagaggaaactggtatcgacctggaaaacattgtgtactacaaagattgcactcattattttgtgatgacagccaagaagcagtcactcctcgataaaggcgttattataaatgattacattgacactgagatgctactctgcgcggagaatgtcaaccaggacaacctactgtcttacgcccgagaggctgccgatttcgctacaaactatcagttgccttctctggactttgctatgaatcactacggacaacctgacgtcgctatgtttgacttcacctgtatgtacgcctctgagaacgcagctctcgtgcgggaaagacaggcccaccaacttttggtcgctctggtaggggattcgttgctcgagccattttggccaatggggacgggctgcgcgaggggtttcctcgcggcattcgacacggcatggatggtgaagtcttggaaccagggcactccgccacttgagctgctggccgaaagggaatcactgtacaggcttttaccccagaccactcccgagaacattaacaaaaatttcgagcaatatactttagaccctggaactcggtacccaaatctcaattcccactgcgtgaggccacaccaggtgaaacacctgtatattaccaaggagctcgaacactatccactggagcgactgggttccgtgcgcagaagcgtcaatctcagccgcaaagagtcggacatcagaccgagtaagctgctcacatggtgtcagcaacaaacggaggggtaccaacacgtgaacgtcaccgatctgacaacctcctggaggtctgggctggccttgtgcgctatcatacatcgttttcgccctgagttaatcaactttgattcactcaacgaggatgatgcagtggagaataatcagctcgccttcgatgtagctgagcgggagttcgggattccgcctgtaacgaccggtaaagaaatggcctccgcccaggagccagataagttgagcatggtgatgtatctctctaagttctatgaactgttccgcggtacccctctgaggcctgtggatagttggaggaaaaattatggagaaaatgcagacttgagcctggcaaaaagctccatttccaacaactatctgaacctgacattccctcgtaaacgcaccccacgcgttgacggccaaacaggtgaaaatgatatgaataagcgtcggaggaaaggatttacaaacttagacgagccatccaattttagctccaggtccctcggcagtaaccaagagtgcggctctagcaaggaaggcggaaaccagaacaaagtaaaaagcatggccaaccagttgttagccaagtttgaagaaagcactcggaacccaagcctgatgaagcaggagaaaaaaagtccctcagggttccactttcatccctctcacctgcggaccgtgcaccctcaagaatctatgcgcaagagctttccacttaatttggggggtagcgatacatgttacttctgtaaaaaacgggtttacgtaatggaacgcctgtctgccgaaggccatttttttcacagggaatgctttcggtgcagcatctgtgccacaacactcaggctggcagcatacacgttcgactgtgacgaaggtaaattttactgtaagcctcatttcatacactgtaagaccaacagcaaacaacgcaaaaggcgggcagagcttaagcagcaacgtgaggaggaagccacatggcaagagcaggaagcgccaaggagagatacaccaacggagtccagctgtgccgttgccgcaatcgggacccttgaaggaagccccccaggaatctccacctcctttttcaggaaagtacttggctggcctctgaggctccctcgggacctgtgtaattggatgcagggcctgttacaggccgctggtctgcatattagggataatgcctacaactattgctacatgtacgagctgctctcgctggggctgcctctgctttgggctttctccgaagtgttggcagccatgtatcgggaatctgaagggtccctagagtcaatctgcaactgggtgctccggtgctttcccgttaaattgaggtag

SEQ ID NO: 230516 - DNA, 363 bp, Artificial Sequence
  Description of Artificial Sequence: Synthetic coding sequence
atgggcgaaaacgaagacgagaaacaggcacaggccggacaagtgtttgagaacttcgtacaggcctccacttgtaagggcacactccaggcgtttaacatactaacgcgacatttagatctggatcctctggaccatcgcaatttctattccaagctcaaatccaaggtgactacttggaaagccaaggcgttgtggtacaaactggataagcgcggttcacacaaagagtacaaacgcggaaaatcgtgcacaaacactaagtgcctcatcgtcggcggaggtccctgcggattgagaaccgccatcgaactggcttacctgggggctaaagtggttgtggtggagaagcgagatagctag

SEQ ID NO: 230517 - DNA, 405 bp, Artificial Sequence
  Description of Artificial Sequence: Synthetic coding sequence
atgggagagaatgaagacgaaaagcaggcccaagcaggccaggtgttcgagaacttcgtccaggcaagcacatgtaagggcaccctgcaggcctttaatatcttgactagacacttggacctggaccccttggatcaccgaaatttctactccaagctcaaaagtaaagtgacaacatggaaagctaaggccttatggtataagctggataagagagggagtcacaaagagtataaacgtggcaagagctgtaccaacacgaagtgcttgatcgtgggcggaggcccatgcggactgcggactgccatcgaattggcttacctaggtgctaaggtggtggtggtggagaaaagagatagtttttcacggaacaatgttctgcatctgtggcccttcactatctag

SEQ ID NO: 230518 - DNA, 267 bp, Artificial Sequence
  Description of Artificial Sequence: Synthetic coding sequence
atgggcgaaaatgaggacgagaaacaagcccaggccggtcaagtgttcgagaattttgtccaggcctctacttgtaaggggacacttcaggcttttaacatcctgacccggcatctagacctggatccactggatcatcggaatttttatagcaagctgaaaagcaaagtcaccacctggaaggctaaagccttatggtacaaactggacaaacggggaagtcataaagaatataagagggggaaatcatgtaccaacaccaaatag

SEQ ID NO: 230519 - DNA, 12 bp, Artificial Sequence
  Description of Artificial Sequence: Synthetic coding sequence
atgggagaatag

SEQ ID NO: 230520 - DNA, 297 bp, Artificial Sequence
  Description of Artificial Sequence: Synthetic coding sequence
atgggagagaacgaggatgagaaacaagcacaggcagggcaagtattcgagaatttcgtacaggcttctacatgcaaaggcacattgcaggcgtttaacatcttgactcgacatctggatttagatccactcgatcaccggaacttctactctaaacttaagagcaaagtaactacatggaaagctaaggccctgtggtacaaacttgacaagcgcggttcacacaaagaatacaaaagagggaagagttgtactaacactaaatgtttaattgtcggaggcggaccttgcggctag

SEQ ID NO: 230521 - DNA, 267 bp, Artificial Sequence
  Description of Artificial Sequence: Synthetic coding sequence
atgggagagaacgaagatgagaagcaggcgcaagcagggcaagtgttcgagaactttgtgcaagcatcaacatgcaagggcacacttcaggcattcaacattctcactcgacatctggacctggatcccttggatcatagaaatttctactcaaagctcaagagcaaagtcaccacatggaaagctaaggcactttggtacaagctggacaaaagaggcagccacaaagaatataagcgtgggaaaagctgcacaaacaccaaatag

SEQ ID NO: 230522 - DNA, 309 bp, Artificial Sequence
  Description of Artificial Sequence: Synthetic coding sequence
atgggcgaaaatgaagatgaaaaacaggctcaagcgggacaagtgttcgaaaattttgtccaggccagcacctgtaaggggaccttgcaggcattcaatattctgacccgacatttagacctcgatcctcttgatcaccgcaacttttattcaaaattgaagagcaaggtgaccacgtggaaggccaaagctctctggtacaaactagataaacgcggatcacacaaagagtataaacgaggcaagtcttgtacgaacacaaagtgcctcattgtgggaggaggcccttgcggtctccggactgcctag

SEQ ID NO: 230523 - DNA, 2805 bp, Artificial Sequence
  Description of Artificial Sequence: Synthetic coding sequence
atgggagaaaatgaggacgagaagcaggctcaggccggtcaggtgttcgaaaacttcgtccaagccagcacttgtaagggaacgttgcaggccttcaacattctcactcggcacctggatctggacccgctggaccatcgcaacttctacagtaagctcaaatctaaggtgaccacttggaaagcaaaagccctttggtacaaacttgacaaacgcggttctcacaaagagtataaaagaggaaagagctgcactaatacgaagtgtctcatcgtggggggtggcccatgcggactgaggactgcaatcgaactcgcctacctgggagcaaaggttgtggtggtagagaaaagggacagcttttctcgtaacaatgtgctgcacctgtggccattcacaattcatgatttgcgcggactgggagctaaaaaattttacggaaagttctgtgccggtagcattgatcatatatccatcaggcagttgcagttaatacttttcaaagtagccttaatgctgggcgtcgagatacacgtaaacgtagagttcgttaaggttttagagccacctgaggaccaggaaaatcagaagatcggatggcgcgcagaatttctacctacagatcacagtctgagcgaatttgagtttgacgtgattattggcgcagacggccgacgcaatacgttggaaggcttccgacgcaaggagttcaggggaaagttagctatcgctattacagccaacttcattaacaggaatagcacagctgaggcgaaagtggaggagatttcaggtgtcgcattcatattcaatcagaaattttttcaagatcttaaggaggagacggggattgacctggaaaacattgtgtactacaaagactgcactcattatttcgttatgacagccaagaaacagtccctgcttgataaaggtgtaattattaatgactacattgatacagaaatgctgctatgcgcagagaacgtcaatcaggataacttgttaagttacgcacgcgaagcagctgacttcgcgactaattaccagctgccaagtctcgactttgctatgaatcattatggccagccagatgtcgctatgtttgactttacttgtatgtacgcctctgagaatgcagctctggtgagggaacgtcaggcccaccagctgctggtggccctggtgggcgatagtctgcttgaacccttttggcctatggggacaggatgcgccagaggctttctggcagcatttgataccgcttggatggtcaagagctggaatcagggcacacctccattggaactcctggccgagcgtgaaagtctgtatcggttgcttccccagacaaccccagagaatattaacaagaattttgaacagtataccctggatcctggtactcgatatcctaacctaaactcgcattgtgtgcggccacaccaggtaaagcacctgtacatcacaaaagaactcgagcactaccctctggagaggctggggagtgttcgcaggagcgtgaacctgtcgaggaaggagagcgacattaggccaagcaaactactgacttggtgccagcagcagaccgaaggctatcagcacgtgaatgtcactgacctgacgacaagttggcggagcggtctggctctgtgtgccatcatacaccgttttcgccctgaattaattaatttcgatagtctgaatgaggatgacgccgtggaaaataaccaactggcttttgacgtggccgagcgggagttcgggattccgccagtgacgacaggaaaggaaatggccagcgctcaggaaccagacaagctgagcatggtgatgtacctctccaagttttacgaactttttagaggaactccactccggccagtggattcttggcgaaaaaattatggtgagaacgccgatctgtcgctggcaaaaagttctatttccaataactacctaaatctcacctttccccgaaagcggacacccagagtagatgggcaaacaggcgagaatgacatgaacaaaagacggcgtaagggatttactaatctcgatgagccgagtaatttctccagtaggtcacttggcagcaaccaggagtgcgggagtagtaaggagggcggtaaccagaacaaggtgaagtccatggcaaaccagctgctcgcgaagttcgaggagagcacaagaaacccatcgctgatgaaacaggagaagaaatcaccttcaggtttccattttcatccatctcacttaagaacggtgcaccctcagctgacagttggtaaagtctcaagcggaatcggagctgccgcagaggtgctcgtgaatctctatatgaatgatcacagaccaaaagctcaggccacatcccctgatctggaaagcatgagaaagtcttttcccctgaatctaggcggatccgatacatgttatttctgtaagaagcgcgtctacgtgatggaaaggctgtccgccgaggggcacttcttccaccgagaatgcttccgttgtagcatttgtgcaaccaccctcaggctggcagcctacaccttcgattgcgacgagggtaaattttactgtaagccgcatttcattcattgcaagactaattccaaacagcgtaaacggagagccgaacttaagcaacaaagggaagaagaagcgacttggcaggaacaggaagcccctagaagggacacacctactgagtcgagctgtgcagtggcagctatcggcacacttgagggctcgccccctgtacacttttctctgcctgtgcttcatccccttctcgggtag

SEQ ID NO: 230524 - DNA, 1638 bp, Artificial Sequence
  Description of Artificial Sequence: Synthetic coding sequence
atgagatcctctcccgacctcaacagtcattgtgtgcgcccacaccaggtgaaacatctgtacatcacaaaggaacttgaacactacccccttgaacggctcggttccgtccgccgtagcgtgaacctgtcacgaaaagagtctgacattcggccttcaaagcttttaacatggtgccagcagcagaccgaggggtaccagcatgtcaacgtgacggatctcaccaccagctggcggtccggcctggccctctgtgcaattatccaccgcttccggcctgagttgattaatttcgatagcctcaatgaggatgatgctgtcgagaacaatcaactggccttcgacgtcgcggagcgcgaatttggcattcccccagtgactactgggaaggagatggcttcggctcaggaacccgacaaactgtccatggtcatgtacttatccaagttctacgagctgtttagagggacccccctgcgccctgtggactcttggagaaagaactacggagagaacgccgatctgtccctggctaaatcaagtattagtaacaattatctgaatctgacctttcctaggaagagaactccgcgtgtggatgggcaaaccggagagaatgacatgaataaacggagacggaaaggctttaccaacctcgatgagccctccaacttcagctcacgctccctggggagtaaccaggagtgcggctctagcaaagaaggcggaaatcaaaacaaagtcaagtctatggccaaccagctgctggccaagttcgaagaatccacacgtaatccatctctcatgaagcaagagaaaaaatcaccctctggattccatttccacccctcacaccttaggactgtccatccgcagctcacagttggcaaggtttcttccggtatcggcgcagctgcagaggtcctcgtcaacctctatatgaacgaccacaggcctaaagcccaggccacctctcccgacctcgagagcatgcgtaaaagcttcccactaaacttaggagggtccgatacctgctatttttgcaaaaagagagtgtacgtaatggaaagactgtcagctgaggggcatttcttccacagggagtgttttaggtgttcgatatgcgctactacactcaggttggccgcatacacgtttgattgcgatgaagggaaattctactgtaaaccacactttatccattgtaagacaaattccaagcagcgtaagagacgagccgagcttaagcagcagcgcgaggaagaagctacttggcaagaacaggaggccccacgacgcgatacccctaccgagagcagctgcgcagtggccgcaatcggcaccctggaggggtctccccctggcattagcacaagtttctttcgcaaggtgctcgggtggcctcttagactccccagggatctgtgtaactggatgcaaggactcctacaagccgcaggccttcatatccgagacaacgcctacaattattgttacatgtatgagctgctttccctggggctgccactgttatgggctttttcagaagtcttagctgcgatgtatcgcgaaagcgagggctcccttgagagtatatgcaactgggtcctgagatgtttccctgttaagctgcgatag

SEQ ID NO: 230525 - DNA, 3273 bp, Artificial Sequence
  Description of Artificial Sequence: Synthetic coding sequence
atggccaccttgctctcacaccctcaacagaggcctcctttcctgagacaagccatcaagatccgccgaagaagggtaagagatttacaggatcccccaccccagatggcccctgagattcaacctccctcccaccatttttcgccagagcagcgggcactcctatacgaggacgcgctgtacacagttctgcatagacttggtcaccctgagcctaatcatgtaactgaagcctccgaactgttgagatatttgcaggaggccttccacgtagagcccgaagaacaccagcagaccctccaacgggtgcgagagctggaaaagcctattttttgcctgaaggccactgtgaagcaagccaagggaattcttgggaaggacgtgtccggctttagcgacccatattgcctcttgggtatcgagcaaggcgttggggtgccagggggaagtccaggatctaggcaccgccaaaaggcagtagtcagacacacaattccagaggaagagacccataggacacaggtcatcacgcaaacgctcaatcctgtctgggatgagaccttcatcctggaatttgaagatatcacaaacgcttcctttcacctggatatgtgggacctggacacagtggaaagtgtacgccagaagctgggagaactcacagatctgcacggcttaagacgcattttcaaggaggctaggaaagacaagggacaggatgactttcttggtaacgtggttctgcggttacaggacctgcgctgcagggaagatcaatggtaccctctcgaacctagaaccgagacgtatccagacagaggacagtgtcacctgcaatttcagctcatccataaacgcagagccacaagcgcctcaaggtcccagccatcctacaccgtgcacctgcacctactgcagcagctggtgtcacatgaagtaacccagcacgaggcagggtctacctcatgggatggctcactgagtccacaggctgccacagtcctgtttctgcacgccactcagaaggatctttcagattttcaccagtcaatggcgcaatggctggcctacagtcgcctttaccagagtctggaatttccatcgagttgcttgcttcatccaatcacctctattgaatatcagtggatccagggtcggctgaaggccgaacaacaggaggagttagccgctagttttagcagtctgttgacctatgggttgtcactcattaggcgcttccgctccgtgtttccgctcagcgtgtctgacagcccagccagacttcagtctcttctcagagtgctggtgcaaatgtgtaaaatgaaggcattcggagagctgtgcccaaacactgcacccctgccccaacttgttacggaagcccttcaaacagggaccacagaatggttccaccttaagcagcagcaccaccagcccatggtccagggtatccctgaagcgggtaaagctctcctgggattagtacaggacgtgatcggtgacttgcaccaatgccagaggacctgggacaaaattttccacaacacccttaagattcatttattttccatggctttccgagagctccagtggctcgtagctaagcgggtccaggaccataccacagtggtaggcgatgttgtcagccccgagatgggagagtcactgtttcagctctacatatctctgaaggaactctgccagctacggatgtcgagctccgagagggacggggtgttggcacttgataattttcataggtggttccagcctgctattccttcttggctccagaagacctataatgaagcactggcccgtgtacaaagagccgtgcagatggatgaattagtcccgctcggcgaacttacaaagcacagcacttctgccgtggacctcagcacttgttttgcgcaaatttcgcacaccgctaggcagctggattggcccgatcctgaagaggcctttatgattactgttaaattcgtggaagatacctgtcgtctggctctagtctactgctctctaattaaagccagggctagagagttgtcgtctgggcagaaagaccagggccaggctgcaaacatgctgtgcgtggtggtaaacgatatggaacagctccggctcgtaattgggaagctgccagcgcaacttgcatgggaagccctagagcagagggtgggggcagtgcttgaacagggacagctacagaacacactccatgcccagttgcaaagcgccctggcagggctgggacatgagatcaggactggggttcggacccttgctgaacaactcgaggtcggaatcgccaagcatatccaaaagttggtgggagttagggagtctgtactcccggaggatgccatactccctctcatgaaattcctggaggtcgagctgtgctatatgaacacaaatctggttcaagagaattttagtagtctgctgacactgttgtggactcatactctgaccgtgcttgttgaagcagctgcatcacaacgcagctcgtcccttgccagcaacagacttaaaatagccttgcaaaatctcgaaatctgtttccacgcagaaggatgtggactcccccctaaagccttacacacagctacattccaggcccttcagcgtgatctcgaactgcaggcggcatcctcaagagaactcatacgaaaatatttttgtagccgaatccagcagcaggcagaaaccacctccgaggagcttggcgcagtgaccgtcaaagccagttaccgcgcatcagaacaaaagctaagagtcgagttattaagcgcgtcgagcctgcttcctctcgattccaatggtagttctgatccatttgtacaactaacactcgagcctaggcacgaattccccgaacttgctgctcgcgaaacccagaagcacaagaaagatctgcacccgctcttcgatgagacctttgagtttctagtaccagcagaaccctgcagaaaggcaggcgcatgtttactcctcaccgtgctggattacgacaccctaggtgccgacgaccttgaaggcgaggcatttctgcccctccgggaagtcccaggcctcagtgggtcagaggagccgggagaggtgccccagacgaggctgccattaacctatcccgctcccaacggtgacccgattctacagttgctggaaggtaggaaaggcgatagggaggcacaggtctttgtgagactcaggcgtcacagggccaaacaggcttcccagcacgccctgcggccagcgccatag

SEQ ID NO: 230526 - DNA, 2847 bp, Artificial Sequence
  Description of Artificial Sequence: Synthetic coding sequence
atggaggaaagaaagcacgaaacaatgaatccagcgcacgttctgttcgataggtttgttcaggctaccacctgcaaggggaccttgaaagccttccaagagctctgtgatcacttagagctcaaacctaaggattatagaagcttctatcataagttaaagagcaagctgaactactggaaggccaaagctctgtgggccaagctcgataaaagagggtcccataaagattacaagaaaggtaaggcttgtactaataccaagtgcctgataatcggcgctggcccatgcgggttgcgcacagcaatcgatttgtctttgctgggcgctaaggttgtggtaatcgaaaaaagagacgctttcagcaggaacaatgtgctacacctttggccattcaccattcacgatctacgtggcctcggggcaaagaagttctatggaaagttttgcgcgggtgcgatcgatcacatttccatccgccagctacagctgatacttctcaaggttgcactgatactggggatcgagatccatgtgaatgtggaatttcaagggctaatccagcccccagaggatcaggagaacgagcggattggttggcgggctctggttcaccccaagacacatcccgtttctgagtacgagtttgaagtgatcattgggggagatgggagaaggaacacattagagggattcagaaggaaagagtttcgtgggaagctagccatcgctattaccgcaaacttcattaatcgcaatacaacagctgaggcaaaagtggaagagatttcaggagttgcctttatcttcaaccagaaattcttccaggagcttagggaagccactggtatagatctggagaacattgtgtactataaagacgatacacactatttcgtgatgacagctaagaagcagtctctcctggataagggcgtgatacttcacgattatgccgatacagaacttctgctaagtcgagagaatgtggaccaagaggctctactgtcctacgccagggaggccgctgattttagcacacagcaacagcttccctccctcgactttgccatcaatcattatggtcaaccggatgtggccatgttcgattttacatgcatgtatgccagtgagaacgccgcactcgtgcgagaacaaaatgggcatcagctgctcgttgcacttgttggagattcactgctcgagcctttctggccgatgggcacagggatcgctcggggtttcctcgccgcaatggactctgcttggatggttcgaagctggtctttaggcacttcaccactggaagtcctggccgagagggaaagtatctataggcttctcccacagacaacacccgaaaacgtcagcaaaaatttcagccagtacagtatagatcccgtcacgagataccccaatattaatgtgaatttcctgagacccagccaggtgcgtcacctgtacgacaccggcgaaaccaaggacattcacttggagatggaatcactggtaaactctcgaactactcctaagctgacgcgaaatgagtccgtggcaagatctagtaagctcctcgggtggtgtcaacggcagacggacggatacgctggggttaatgttaccgatctcacaatgtcttggaaatctgggcttgcgctctgcgccatcattcaccgatataggcccgacttgattgattttgattcactcgacgagcagaacgtcgaaaagaacaaccagttggccttcgatatagcagagaaggaactggggattagtccaatcatgaccggaaaggagatggcatctgttggagaacctgacaagctctctatggttatgtacctcacacagttctatgaaatgttcaaggacagcctgccttctagcgataccctagatctaaatgcggaggagaaggctgttctgatcgcgtctactcgctcgcctatttcctttctgtcaaagctgggccagactatctcccgcaaacgaagtccaaaagataagaaggagaaggacctcgacggcgctggaaaaaggcggaaaacctcacagagtgaggaggaggaggccccaagggggcataggggagaacgccctaccctcgtctcaaccctgactgataggagaatggatgttgccgtagggaatcagaataaggttaagtatatggcaactcagctgctcgccaaatttgaagagaacgcaccagctcaaagcatcggcatcagacggcagggctctatgaagaaagaatttccacagaatctcgggggttctgatacgtgttatttctgccagaagagggtctatgtcatggaaagactgtccgccgaaggtaaattcttccaccgctcatgctttaaatgtgagtactgcgccacaactctgagactgagtgcatacgcatacgatattgaagatggaaagttctattgtaaaccacactactgctatcgcctgagcgggtacgcccagagaaaacggccagccgtggccccactgtcaggcaaggaagcgaagggccctttgcaggatggggctaccaccgacgccaatggccgagctaacgctgttgcgtcctctacagaacgcacccccggatccggggtcaatggcttggaagagccatctatagcaaagaggctgaggggaacacccgaaaggattgagctggagaactatcggctgagccttcgtcaggccgaagctcttcaagaggtgccagaagaaacacaggcggagcacaacctgtctagtgtgttagataccggcgctgaggaagacgtcgcttccaggtcggctcggcgagctgccggaaggcccccagcaactcggccttag

SEQ ID NO: 230527 - DNA, 2901 bp, Artificial Sequence
  Description of Artificial Sequence: Synthetic coding sequence
atggaggaacggaagcacgagaccatgaaccccgcacacgtcctgtttgataggttcgtgcaggctaccacatgcaaagggactctgaaggctttccaggagctttgcgaccacctcgaactgaaacccaaagattataggtctttctaccacaagctgaagtccaagctgaactactggaaggccaaagctttgtgggctaaactggacaagcggggttcgcacaaagactataaaaaggggaaagcttgtactaacacaaaatgtctgattatcggggctggaccctgtggcctcaggacagccattgacttgtctcttctaggggctaaggtggttgtcatcgagaagcgcgatgctttcagtaggaacaatgtgctccacctgtggccctttactatacacgacttaaggggacttggtgccaagaaattttatggcaagttctgcgccggagcgattgaccacatcagcattagacagttgcagttgattcttcttaaagtggctctgatcttgggcattgagattcacgttaacgtggaatttcagggactcatacagccacccgaggaccaggaaaacgagaggattggctggagagctctggtgcatcctaaaacacatccagtgagtgaatatgaattcgaggtcataatcggcggtgacgggaggaggaatactctcgaaggtttccggagaaaggaattccgcggaaaacttgccattgccatcaccgccaactttatcaatcgcaatactaccgcagaagccaaagttgaggagatttccggcgtggctttcattttcaaccagaagtttttccaggagttgagagaggcaacaggaatagacctggagaatattgtgtactataaggacgacacccactactttgtgatgaccgcgaagaagcaatccttgctagataagggggttatcctacacgactacgcggataccgaactgctgctctcacgcgagaacgtcgaccaagaggccttgctatcctacgctcgagaagccgcagacttcagcacccagcagcagctgcctagtcttgattttgcgattaaccattacggacagcccgatgtagccatgtttgactttacatgtatgtatgccagtgaaaatgcagccctcgtgagggagcagaacgggcatcagttgctggtggcgcttgtaggggattcattgcttgaacccttctggcccatgggaaccgggattgcacggggatttctggccgctatggattcggcctggatggtgcgctcttggtctctcggaacctccccactcgaagtgctcgccgagcgcgagtccatctataggctcttaccgcagaccactccagaaaacgtgtccaaaaacttctctcagtactcgatagatccagtgaccaggtatccaaacatcaacgtaaacttcttgcggccatctcaggtcagacacctctacgatacaggagagaccaaagacatccacctggaaatggaaagtctggtgaattcccgcacaacccccaaacttaccagaaacgagagcgtggccagatctagcaagctcctgggatggtgccagcgccagaccgatggctacgcaggcgtgaacgttaccgatctaacaatgtcctggaaaagcggcttggccttgtgcgctataattcaccgctacaggccagacctcatcgactttgattccctggacgagcagaacgtggaaaagaacaaccagttggcatttgatatcgcagagaaagagttagggatctccccaattatgacaggaaaagagatggccagcgtgggcgaacccgacaagctgagcatggtgatgtacctgacacaattttacgagatgttcaaggatagtttacccagtagcgatacactcgatcttaatgcagaggagaaagcagtgctcatcgcgtctacgagatcgccgatctctttcctctcaaaacttggtcaaacaattagccgcaagaggagcccaaaagataagaaggaaaaggacctagacggtgccggtaaacgccgaaaaacaagtcagtctgaagaggaagaggccccacgcggacataggggtgagagaccaaccctggtctcaactctgactgaccggagaatggatgtagcagtcggtaatcagaataaggtcaaatacatggcaacccagctgttggctaaatttgaggagaacgctcctgcccagtccatcggaatccgcaggcagggaagcatgaagaaagagttccctcaaaacctaggaggtagcgacacctgctacttctgccagaaaagggtgtacgtcatggagagactgtccgccgaaggtaaattctttcaccgtagctgctttaaatgtgaatattgcgcaactactttaaggttgtccgcctacgcatatgatatcgaagatggaaaattttattgtaagccccactactgttatcggctgagtggttatgctcagcggaagagacccgctgtggccccactgagcggaaaggaggctaagggaccgcttcaggacggggcaaccactgacgctaatgggagggccaatgctgtcgcttcatctaccgagaggactcccggaagtggagtgaacggcctagaggagccctcaatcgccaaaagactgcggggaacccctgagcgaatcgagctcgagaattaccggttaagccttaggcaggcggaagctctgcaggaagtacccgaagaaactcaggccgagcataatctgagcagtgtgctggatacgggcgcagaagaggacgtggcgtcacgagactgggtcagtccctggctccctagaatggtgagcaacagttgggcccagatgattcacccccctcagcctcccactgttctcggcagtcaaatgtag

SEQ ID NO: 230528 - DNA, 4713 bp, Artificial Sequence
  Description of Artificial Sequence: Synthetic coding sequence
atgtccgactcactgtggacggccctgagtaatttttctatgccttccttcccgggtggatcaatgttcaggcggaccaagagttgccggacatctaaccgtaaaagtctgattctcacatcaacatccccaaccctgcctcgcccacatagccctcttccaggccacctcggttccagccctttggattccccaaggaatttctcacctaatacgcctgcccacttttcttttgccagttccagaagagcagatgggagaagatggagccttgcatctctgcccagctccgggtatggaacgaataccccgtcctctaccgtgtcatcctcctgttctagtcaagaacggttacaccagctcccataccagcctacggtggacgaattgcactttctcagcaaacacttcggctccaccgaatccatcactgacgaagatggcggtagacgctcaccagctgtgagaccccgaagtcggtcactgagccctggcaggtcacccagctcatacgataatgagatcgtaatgatgaatcatgtgtacaaggaacggttccctaaagcaacagcccagatggaagaaaaattacgggacttcaccagggcttacgagccagatagtgttcttccacttgccgatggcgtgctgtcgtttattcaccaccaaatcatcgaattagcgcgagattgcctgaccaaatcacgagatggactgatcactacagtctatttctatgagttacaggagaatctcgagaagctactccaggatgcatatgagcggtcagagtcgctggaggtcgcttttgtgacccagcttgtaaagaagctgctgatcataatcagcagacccgcacgcttgttggagtgcctcgaatttaaccccgaggagttctaccacctgttagaggccgctgagggccacgcaaaggagggtcatttagtcaagacagatatcccccgttacattattcgccaactagggcttactcgagatccatttccagacgtggtgcacctggaagagcaggacagtggcggttccaataccccagagcaggacgacctgtccgaaggtcgttcctctaaagcaaagaagccacccggagagaacgattttgacaccataaagctaattagcaacggagcctatggcgcagtgtaccttgtccgccaccgtgacactaggcagagatttgctatgaaaaagattaataagcaaaacttgatcctgagaaatcagatccagcaggctttcgtggagcgcgatatcctgacttttgcagagaacccttttgtggtaggcatgttctgttccttcgaaacacgacgacacctgtgtatggtcatggagtatgttgagggaggtgactgcgcaacactgctcaagaatattggggctctgcctgtagagatggccaggatgtactttgccgagactgtgctggccctggaatacctccacaattatggaattgtccaccgggatctaaaacccgataatctgctcatcacttctatgggacatatcaagctaacagattttggactgtccaagatgggccttatgtcgctcaccacgaatctgtacgagggtcacattgagaaagacgcgagggagttcctcgacaaacaggtctgcgggacgcctgaatacatcgctcccgaggtgatccttcgccaggggtatggcaagcccgtggattggtgggcgatggggatcatactttacgaatttctcgtgggctgcgtgccctttttcggggacacccccgaagagctgtttgggcaggtaatctccgacgatattctatggcccgaaggtgacgaggctttgcccacagaggctcagctcttaatatcctctctgctccagacaaacccacttgttcggctgggtgccggaggggctttcgaagtgaaacagcactcctttttccgcgatctcgattggacaggcctgttgcggcaaaaggcagagtttattccgcatctggagagtgaggatgataccagttacttcgacacccgttctgaccgatatcaccatgtcaatagctacgacgaggacgacacaaccgaagaagaaccggtggaaattagacaatttagttcatgctcccctaggttttctaaggtctacagcagtatggagcagctgagccagcacgaacctaagacgccagtcgcagccgctgggagttcaaagcgggagcctagcacaaagggcccagaagagaaggtcgccggaaagcgggagggccttggcggtctgactcttcgagaaaaaacctggaggggtggtagccctgaaattaaaaggttcagcgcatctgaggcctcctttttggaaggagaagcctccccccctttgggcgctcggcgacgtttctcagcccttctggagccaagccgattttctgcaccccaggaggatgaagacgaagcccgtctccgtcgcccacctaggccgagcagcgatcctgcgggaagcttggacgcacgcgctcctaaggaggagacacagggagaaggcacgtctagcgccggagactctgaggccacggatagacctaggcctggcgacttatgccctccatcgaaggatggcgacgcatccgggcctagggcaactaatgacctggtgctgagaagagcaaggcaccaacaaatgtccggcgatgttgccgtcgaaaagcgaccatcgcgtaccggaggtaaggtcattaagtccgctagcgcaaccgctctttccgttatgatccccgcagtggaccctcacggctcgtccccactagcatctcctatgtctcctagatcactatcctcaaacccaagtagtcgggattccagcccttcgcgcgactacagtccagccgtgtctgggctgcgatcgcccatcaccattcagcgcagtggaaagaagtacggttttacattacgggctatcagagtgtacatgggcgacaccgatgtatattctgtccaccacatagtgtggcacgtggaggagggtggtcctgcccaggaggcagggttgtgcgccggagaccttattacgcacgtaaatggagagcccgtacacgggatggtccaccctgaagtggtcgaactgattctgaaaagtggtaataaagttgcagtgaccacgaccccattcgaaaacacgtcaatccggataggccctgctcggaggtccagctacaaggctaagatggcgaggcgaaacaaaaggcctagcgccaaagaaggtcaagaaagtaagaagagatccagcctgtttcggaaaatcacaaagcagagcaacctgctacacacttcaaggagcttatcttccttgaatcggtctcttagcagcagcgactctctaccgggatctcccactcatgggctgcctgccagaagcccaacccactcctaccgcagcaccccagatagcgcttacttaggggcatcatcccagagctcttcacctgcctcctcgacacccaacagccccgcaagcagcgcttctcatcacatacgccctagcacccttcacggattaagccccaaattgcaccggcagtaccgctcagcgagatgtaaaagcgctggtaatattcctctctcccctctagctcacacgccctctccaacgcaagccagtccccctccgctgcccggtcataccgtcggctcctcccatacaacacagagttttcctgcaaagctgcattctagtcctcctgtcgtgcgacccagacccaaatcagccgagccacccaggtcacctcttttgaaaagagtccagagcgctgaaaaactgggggcatcattgtcggctgacaagaagggagccctgcggaaacatagtctggaagtgggacacccggacttccgcaaggactttcacggtgagcttgccctacactcgctcgctgaaagtgacggggagactcccccagtggaggggctgggggcaccacggcaagtggccgtgaggcggctcgggaggcaggaatcacccctatccctgggtgcggacccattgctgcccgaaggtgcttctaggccacctgtctcttccaaagagaaggaatctcctggcggtgccgaagcctgcaccccacctcgagccacaacaccaggcggtaggaccttggagagagatgtggggtgtactcgccaccagtccgttcagaccgaagacggaactggcggaatggccagagccgtggcaaaagcagcactgtccccagtgcaggaacatgagaccgggaggaggagctcctctggtgaagctggaactcctctggtgcccatcgttgtcgaacccgctaggcctggcgctaaagccgtcgttccgcagccactgggcgctgatagcaagggccttcaggaacccgcacccttggctcccagcgtgccagaggccccacgtgggagggagcggtgggtgctggaagtagtcgaggagcgcaccaccctttctggacctcgcagtaaaccagcttccccaaagttatcccctgagccgcagaccccgtcattagcccctgcaaagtgtagcgctccatcctctgctgtcactccagtcccccctgcgtctctcctgggatctggcaccaaacctcaggtaggcttgacttctaggtgtcccgcagaagctgtcccccctgcaggactaaccaaaaagggggtctcctccccagcacctcccggtccatag

SEQ ID NO: 230529 - DNA, 2178 bp, Artificial Sequence
  Description of Artificial Sequence: Synthetic coding sequence
atgagcgactctctttggaccgcacttagcaatttctcaatgccaagttttccaggagggtctatgtttcgacgcactaaatcctgtagaacttctaacagaaaatcactcatccttactagcacatcccctacactccctcgcccacactcccccttgcccggacaccttggttcctctcccctggattcgcccagaaacttctcaccaaatacacctgctcatttcagttttgcctcttccagacgggctgacgggaggcggtggtctctcgcaagcttgcctagctcaggatacggaacaaacacaccctcctccacggtgagttcgtcgtgcagttcccaggagcgtctgcatcagctcccctaccagccgacagtggatgagttacattttcttagcaagcacttcgggagtactgagagtataacagatgaggacggcggtcgcaggtcccctgccgttagacccagaagccgcagcctgtctccagggaggagcccttcaagttacgataacgagatcgtcatgatgaatcacgtctacaaggagaggttccctaaggcaaccgcccagatggaggaaaaactgagggatttcacaagggcttacgaaccagattcagtcttaccactcgccgacggcgtcctgagctttattcaccaccaaatcattgaattagcaagagattgcctgactaagagcagagacggactgataaccaccgtctatttttacgagctgcaggagaacctggagaaacttttgcaggacgcctacgagcgatcagagtccctggaagtggcctttgtgactcagctcgtgaagaaactccttatcattatttccagaccagcgcgactgctggagtgtcttgagttcaatccggaggagttctatcacctcctagaggctgccgaagggcacgccaaggagggccaccttgtcaagaccgacattcccaggtacattatccgtcagttagggttaactcgtgacccttttccagatgtcgtacaccttgaagaacaagacagtggaggctccaatacccccgagcaggacgatttgagcgaaggccgtagtagcaaagccaagaagccacctggtgagaacgacttcgatacaattaagctgatctccaacggcgcatacggcgcagtgtatctggttagacatcgggataccaggcagcgattcgctatgaaaaaaattaacaagcagaacctgattctccggaaccaaatccagcaggcttttgtggagcgtgatattctgactttcgcagagaaccccttcgtggtgggtatgttctgcagctttgaaacccgcaggcatctgtgtatggtaatggagtacgtagagggcggagattgcgctaccctactgaagaatattggtgctctcccagtggaaatggcgcgaatgtacttcgcagaaaccgtgcttgccctggaatacctccataactacggaatcgttcatcgcgatcttaagcccgacaatctgctgatcacgtccatgggccatattaagttgacagacttcgggctgtcaaaaatgggactcatgagccttactacaaacttgtacgagggtcacatcgagaaagacgccagggagtttctggacaaacaagtatgtgggacccctgagtacattgctcccgaagtcatactgagacaaggttatggcaagcccgtagattggtgggccatgggcatcatcttgtatgaatttcttgtggggtgtgtcccattcttcggcgacaccccagaggagctattcggccaggtcatcagcgatgacattctgtggccagagggagacgaggcactacctaccgaggcacagcttctcatctcatctttgctccagaccaatcctttggtgagactgggtgcgggtggcgcttttgaggtcaagcagcactcgtttttcagggatctagactggactggactgctccgccagaaggctgagtttattccccatttggagtccgaggacgatacgagttattttgatacccgctcagatcgctatcaccatgtcaacagttatgacgaggacgatactaccgaggaggaacccgtagaaatccgacagttttctagttgttctccacggttctctaaggtgtacagcctcagaatccacatgtacacatacaagtag

SEQ ID NO: 230530 - DNA, 5396 bp, Artificial Sequence
  Description of Artificial Sequence: Synthetic coding sequence
atgaagcggtcacgctgtagagatcgcccacagccccctcccccagatcggagagaagacggcgtgcagagggccgcagagttgagccagtctctccctcctagaagaagggctccacccggacgtcagcgcctggaagaacggacaggtcctgccggacccgaagggaaggagcaggatgtggtgacaggcgtgagcccattactttttcgtaagctaagcaacccggacattttctccagtactggtaaggtcaaactgcagcgtcagctttcccaggatgactgtaagctgtggcgtgggaatctggccagcagcctgtctggaaagcagttactgccgctctcttcctccgttcattcttctgtcggacaggtgacatggcagtctagcggcgaggcctcaaacctggtgaggatgcgaaaccaaagtttaggccagtcggctccttcattgaccgcaggtctcaaagaattgtcgttgcctcgcagggggagtttctgccgcacaagcaaccgtaagtctctcatcgtgacatcctccacatcaccgacactccctaggccacacagcccgttacatggccacactggtaacagtccactggactcccctcgcaatttttcccctaacgccccagctcactttagttttgtgccggctcggaggaccgatgggcgtcgatggtctctggcatcactgcccagttctggctacggcactaacactccctcctctacggtctcttcaagctgcagctcgcaggaaaagcttcatcaactgccattccagcctaccgctgacgaactccactttctcaccaaacacttcagcacagaatccgttcctgacgaagaaggccgacagagcccagcaatgaggcccaggtccaggagcctgtcccccggaaggagccccgtgagctttgattcagagattattatgatgaatcacgtctacaaggaaagattccccaaggcgaccgcccagatggaggaaagactggccgagtttatcagttctaatacccctgatagcgtgttgccactagctgatggcgctctgagttttatccaccaccaggtcattgaaatggcacgggattgccttgacaaaagtcggagcggcctgatcacctcacagtacttctatgaactgcaggataacctggagaagcttctccaggacgcccatgagcggtccgagagttcggaagttgcttttgttatgcagcttgttaaaaaactgatgattattattgcaagacctgctaggctgctcgagtgcctggagtttgacccagaggagttctatcacttgctggaagccgcagaaggtcacgctaaggaaggacagggtattaagtgcgatattcctaggtacatcgtcagtcagttgggcttgactcgagacccactggaagaaatggcacagttaagtagttgtgactcccccgacacaccagaaaccgatgacagtattgagggccatggagcgagcctgcctagcaagaaaactcccagcgaagaggactttgaaacgattaaactcataagtaatggcgcatatggggctgtattcctggtacgtcacaagtctacacggcagaggtttgctatgaaaaagatcaataaacagaatcttattttgcgcaaccagatacagcaagcatttgtcgaacgagacattttgacctttgcagagaaccccttcgtggtgagcatgttttgcagtttcgatacaaagagacatttatgcatggtgatggaatatgtggaggggggagactgcgccaccctgctaaaaaatattggtgctttgccggtggacatggtccgactctactttgccgaaactgtgttggccctggagtatctccataattacgggatagtgcaccgagatttaaaacctgacaacctgttaattacaagtatggggcacatcaaactgactgactttggtctcagcaagatcggtctgatgtccctgaccaccaacttgtacgaaggtcacattgagaaggacgctcgagagtttttagacaagcaggtgtgtggcactccagagtacatagctcctgaagtgatcctgcgccaggggtatggcaagcccgtcgattggtgggcaatgggcataatcctgtatgaattccttgtcggctgcgtcccattctttggcgacacacccgaagaattgttcgggcaggtcatttccgacgagattgtttggccagagggagatgaagccctgccacccgacgctcaggacctgacatccaagctcctgcaccagaacccactggagaggctcggaactggctcggcatacgaagtgaagcagcatcctttcttcaccggtctcgactggactggcttactgcgccagaaggcagagttcattccccaactcgaaagcgaagacgacacgagctattttgacaccaggtcagaacgttatcaccatatggacagtgaggacgaagaagaagtgagcgaagacggctgcctggagataagacagttcagttcatgctccccgaggtttaataaggtctactcatcgatggagagattgagtctgctggaagaacgacgtactccaccacccacgaagcgcagcctttccgaagagaaggaagaccactccgatggccttgcaggactgaaagggagggataggtcctgggtgatcggctctccggaaattctgcggaaaagactctctgtgagcgaatctagccatacggagagtgattcatcacccccaatgaccgttcggcgacggtgctccggcctgctcgatgccccacggtttcctgaaggcccagaggaggcatcttctactctcagaaggcagccccaggaggggatctgggtgctgacccctccctcaggggagggcgtatcaggaccagtaaccgagcatagtggagaacaacggccaaaattggacgaggaagcagtcggccgttcttctggcagttcaccagccatggaaacacggggtcgcggaacgtcccagctggccgagggagccactgctaaggccattagcgacctggcggtaagacgggctaggcatagactgctgtcaggggattctacagaaaagcggacagctcgtcctgtcaacaaggtgatcaagtctgcatctgccacagctctgagtcttcttataccctccgagcaccacacttgctccccactggccagccctatgtctccgcactcccagtcttctaacccttccagtagggatagcagcccatccagggattttctacctgctcttggaagcatgcgccctccaattattattcacagggcaggtaagaagtacggattcaccctgcgtgctatacgcgtctatatgggcgattccgatgtgtataccgtccatcatatggtctggcacgtggaggatggaggcccagcgtccgaggccggactgagacaaggcgacctcatcacacacgttaatggagagcccgttcacggactggtccatactgaagtcgttgagctaattctgaagtccggaaataaggtagccatttcaacaacaccactggaaaacacgagcataaaggtgggtccagcaaggaaaggcagctataaagccaagatggctaggcgcagtaaaagaagtagaggaaaggacggccaggagtcacgcaagcgctcctcactgtttcggaaaattactaagcaggcctctttgctccacacgtcccgtagtctgtcaagcctcaatagatctctatcttctggcgagtctggtcccggtagtcccacccatagccactcattatcaccacggagtcccacacagggatatcgagttacgccggacgccgtacattctgttggcggaaattcctctcaatccagttccccaagttcatccgtgcctagctctcccgcagggtctgggcatacacgtccgtcatcgttacacggactcgctcctaagctccagcgccagtaccgttccccccgacgcaaatcagcaggctctatacctctctcccccctcgcccatactccctccccccctcccccaactgcctccccccaacggagcccctctccactgtctggtcacgtggcccaagccttccctaccaagctgcacctgagtcctccactgggcagacagctgagccgacctaaaagcgcagaaccacccaggtctcccctactgaagagagtccagagtgctgaaaagttggccgcagctcttgccgcttcagagaaaaaacttgccacctccaggaagcatagtcttgatctccctcacagcgaattaaaaaaggagctgcctccacgcgaagtgtcacccctggaagttgtgggggcaaggagcgtcctgtccgggaagggtgccctgccaggcaaaggagtactgcagccggctcccagccgcgcactgggcactctgcggcaggatagggctgagagacgagaaagtttacagaagcaggaagcaataagagaagtggatagtagtgaagacgacaccgaggaagggcctgagaactcccaaggtgcacaggagctctcgctcgccccacacccggaggtttcccaatcagtggcccctaaaggggctggggagagtggtgaagaggacccctttcctagcagagacccgcgaagtctcgggccaatggttccctctctgctcactggtataactctcggcccacctaggatggagtctccgtcgggtcctcacagaagactggggagtcctcaggccattgaggaggcggctagttcgagctccgccggtccgaacctcggccagtcaggcgcaaccgaccccatcccgcctgaagggtgctggaaggcccagcacttgcacactcaagcacttacagcactcagcccaagcacatcgggcttaactcctacgagcagttgcagccccccaagcagtacaagcgggaaactctcgatgtggtcctggaaaagcctgattgaggggcctgatagggctagtccatctaggaaggctacaatggctggcggactggccaatctgcaagatctcgagaatacgactccagcccagcctaagaacctgagtcctagagaacagggaaagactcagcccccaagtgctccccgactggcgcatccttcgtacgaagatcccagtcagggttggttgtgggaaagtgaatgcgcccaagctgtgaaggaagaccctgccttaagcatcacccaggtgccagacgcctccggagatagacgccaggatgtcccctgcaggggttgtcctctgacacagaagagcgagccgtcattacgcaggggacaagagccaggcggacaccagaagcatcgggacctcgccctggtcccagacgagttactgaagcagactta

SEQ ID NO: 230531 - DNA, 2379 bp, Artificial Sequence
  Description of Artificial Sequence: Synthetic coding sequence
atgttctcccccacctccgctcctgcactgttcctcaccaaggtacccttctccgccgattgcgcacttgcaacctcccctcttgccatctttctaaatcctcgcgcacatagtagccctggtacaccgtgctctagccggccactgccctggtcttgtcgcacaagcaatagaaagtccctgatcgtcaccagcagtacttccccgactctacccagaccacattccccacttcacggtcacacaggtaattctcctttggactcccctcgaaatttttctcccaacgctcctgctcatttttcatttgtgcccgctcgaagaactgacgggaggagatggagtctggcatccctcccaagctccggctatggaacaaacacaccatccagcacggtcagctcttcatgcagctcacaggagaaattgcaccagcttcccttccagcctaccgccgacgaattgcactttcttacgaagcatttctccaccgagagcgtcccagacgaagaaggtcgccagtcaccggctatgcgacccagatcccggtcactctcacccggtcgaagtcctgtgagctttgattcagaaattataatgatgaatcacgtttacaaagaacgattccctaaagctacagcgcagatggaggaacgactcgcagaattcatctcctccaacacccctgacagcgtgctccccttagcggacggcgctctctcttttatacaccatcaggtgattgaaatggcaagggactgtcttgataaatccagaagtggccttatcactagtcaatatttctatgaattgcaagataacttggagaagctgctgcaggacgcccacgaaaggtctgagtcctctgaagttgccttcgttatgcagctagtgaagaaactgatgatcatcattgctagacccgctagactgctggagtgtcttgagttcgatcctgaggagttttaccatctcttagaggccgcagaaggtcacgcgaaagaagggcagggaattaagtgcgatattccaagatacatcgtttcacagctcgggctgacccgggacccacttgaggagatggctcagctgtcttcgtgtgatagtcctgacactcccgagacagacgactccatagaaggccacggagcaagcttaccgagtaaaaagaccccttctgaagaagattttgaaaccattaagcttatttcgaacggcgcatatggtgctgtcttcttagtccgacataagagtacccgccagcgtttcgcgatgaagaaaatcaacaagcaaaacctaatcctccggaaccagattcagcaggctttcgtcgagagggatatattgaccttcgctgaaaacccattcgttgtgagcatgttctgtagtttcgacacaaagagacatctgtgtatggtgatggagtatgtggaaggcggagactgcgcgactctcctgaaaaatatcggagcccttcccgtcgacatggttagattgtacttcgcagaaaccgtgctggccttggaataccttcacaattatggaatagttcatcgggatttgaagccggacaacttgcttataacgtccatggggcacattaaattgacggattttggactgagtaaaatcgggctaatgtcgctcacaacgaacctgtatgagggccacatcgagaaggatgcccgagaatttttagataagcaggtttgcggcacacctgaatacatagcccctgaggtcatcctgaggcagggctatggaaagccagtggactggtgggcaatggggataattctgtatgaattcctggtgggatgcgtgcccttcttcggcgatacccctgaagaattatttggccaggtgatctcggacgagatcgtgtggcctgagggggacgaggccctgccacctgacgcccaagacctgacctctaagctgctgcatcagaaccccctggagcgcttgggtaccggatccgcatatgaggtgaaacagcatcctttcttcaccggattggattggaccggcctattacggcagaaggccgagttcatcccacagttagagagcgaagatgacacatcttatttcgacactcgctcagaacgctatcatcacatggatagtgaggatgaggaagaggtttccgaggatgggtgtctggaaattagacagttcagtagctgttcaccccgattcaacaaggtgtactcgagtatggaacggttaagtctcctggaggaacggaggacacctcccccaaccaagcggtccctgtcagaggaaaaggaagaccacagtgacggactggcgggactcaaaggcagagacagatcgtgggttataggctctcctgagcatcacccttctgcgtag

SEQ ID NO: 230532 - DNA, 4827 bp, Artificial Sequence
  Description of Artificial Sequence: Synthetic coding sequence
atgaagcgaagcaggtgccgggatcggccacagccaccgccacccgatcggcgagaggacggagtgcaacgggctgccgaactcagccaaagcctcccaccaagaagaagagcccctcccggtcgacagagactcgaagagcgtacagggccagccggacccgaaggtaaggagcaggacgttgttaccggcgtgagcccactgctgtttaggaagctgtcgaatccagacatattttccagtacaggcaaggtaaagcttcagcgtcagctgtcccaggacgactgcaagctatggcgtggaaatctggccagctccctttccggcaaacagctgttgcctctatccagttctgtccactctagcgtggggcaggtgacatggcagtcctctggcgaagcttcgaatttggtgaggatgaggaatcagagtctcgggcagtctgccccatccctgactgcagggctgaaagagctatctctgccaaggcgtggcagtttctgcagaacatccaaccgcaagagtttgatcgtgacctcctctaccagcccgacattgcccagaccacactcacccctacacggacacacagggaattctccattagattcccctaggaatttcagccccaatgcccctgcccactttagttttgtccctgccagacgaactgacggacgacgttggagcctggcctctcttcccagctccggctatggcaccaacactcccagttccacagtcagcagctcttgttcaagtcaggaaaaacttcaccagctgcccttccagcccacagcagacgagcttcactttctcaccaagcacttttctaccgaaagtgtcccagacgaggaaggcaggcagtccccagccatgcgaccacgatcacggtctctgtcaccaggccgatcccctgtatccttcgattcagaaatcatcatgatgaaccacgtctacaaagaaagatttcctaaggcccatgagcggagcgagtcgtctgaggtggcgttcgtaatgcagctcgtcaagaagctgatgattatcatcgctcggcctgctagactattggagtgtttagaatttgatcccgaggagttttaccatctgttagaggcagccgaaggccacgccaaggaagggcagggtatcaaatgcgatatcccgaggtatatagtcagtcaactggggttgacacgcgatcccctggaggaaatggcccaactgtcgagttgcgatagtcctgatactccagaaaccgacgacagcattgaaggccatggagcttctttgccctcaaagaaaactccatcggaggaggacttcgaaactatcaaacttattagcaatggcgcttatggagctgtgttcttagtccggcacaagtctactcgacaacggttcgcgatgaaaaaaatcaataaacagaacctgatcctccgcaaccaaatccagcaggcattcgtggagcgcgacattctaacgttcgcagagaatccatttgtggtgagtatgttttgctcgttcgacactaaacgccacctgtgcatggtgatggagtacgtggagggtggagactgcgcaaccctgctgaagaatatcggtgcactccctgtggatatggtccggctgtacttcgctgagactgttcttgcacttgaatacttgcacaattatggaattgtgcaccgcgatctgaagcctgacaacctattaattactagcatgggtcacattaagcttaccgacttcggactgagtaaaatcggtctgatgagccttactacaaatctgtatgaaggccacattgaaaaggacgccagggagttcctggacaagcaggtgtgtggaactccagaatatatcgcgcctgaagtgatcctgcgacagggctatgggaagccagttgactggtgggctatgggcatcattttgtatgagtttctcgtaggctgcgtgccgtttttcggagacacaccggaagagctcttcggccaggtgatttctgatgagatcgtgtggccagaaggggacgaggccttgccgcctgatgcgcaagatctcaccagcaagctcctccaccagaaccccctggagcggttggggacagggagcgcctatgaagtgaaacagcaccctttttttactggactggattggactggattgctgcgccaaaaggctgaattcatccctcagttagaatccgaggacgatactagctacttcgatactcgatctgagagataccatcacatggactccgaggatgaggaggaagtctccgaagacgggtgtctagagatccgacaattctcctcctgcagcccaagattcaacaaggtgtattcaagcatggagcgtctcagtttgctggaagagaggcggacaccccctcccactaagagaagcctctctgaggagaaagaggatcattcggatggattagctggactgaaaggcagagatcggagttgggtgatcggcagccccgagatacttaggaaaagactcagcgttagcgagagtagccatacggagagtgactcctcaccacccatgaccgtcagacgacggtgctccggtctcttggacgcaccgcgtttcccagagggccctgaggaagccagctccactctccgcagacagccacaggagggaatctgggtcttgacgcccccttccggggagggcgtgtcaggtccagtgaccgaacattcgggcgagcaaaggccaaaattggatgaggaggctgtggggagaagtagcggcagcagcccagcaatggagactcgtgggagaggcacaagtcaactcgccgaaggcgcaacagcaaaagctatttcagacctggctgttaggagggctagacaccgtctgctgtccggcgactctacagagaagcgtaccgctcgacccgtgaacaaggtgataaagtcagctagcgcaactgcactgtccctgttaatcccctcagagcaccatacatgcagtcctctcgcaagcccgatgagtcctcattcccagtcctcgaatcctagcagtcgggacagctctccctacggattcactttacgcgctattagagtttacatgggtgattcagacgtctatactgtgcaccatatggtctggcatgttgaggacgggggacctgccagcgaggcagggctgagacaaggcgatctcatcacacacgtaaacggggagcctgtacatgggcttgtacacacggaggtggtcgaattgattcttaaaagtgggaataaagttgccatatccacgactccactagagaatacaagcatcaaagtgggtcctgccagaaagggctcctataaggcaaagatggcaaggagatcaaagaggagtaggggaaaggacggacaggagtcaagaaagcgctctagcctgttcagaaagattactaagcaggccagccttctccataccagcagatctctgtcctccctcaatcgttcactgtcctccggggagagcgggccaggcagccccactcactcccatagtctgtctcccagatcacccacccaggggtacagggttacacccgatgccgtgcacagcgagttatctcggccaaaatccgcagagccgccacggtctcccctgttgaaacgtgtgcagtccgcagaaaaattagccgctgctctagctgcaagcgaaaagaaactggctacatcccgcaaacacagtctggacctcccacactccgagctcaagaaggagctgcctccacgagaagtctcccccctggaagttgttggagccagatcagtcctcagtggtaagggcgctcttccaggcaagggcgtgttacaacccgcaccatctcgagccctcggcactctaaggcaggatagagcagaaaggcgagagagcttgcagaagcaagaagccattagggaagtggatagctctgaggatgacaccgaggagggccctgagaattctcagggcgcacaggaattgtcacttgctcctcacccagaggtgtcacagtctgtcgcacccaagggcgcaggcgagtctggagaggaggatccttttccctctagagatcccagatccctaggaccgatggtgccctccttgctgacagggattaccctcggtccacctcgaatggagagcccaagcggccctcataggaggcttgggagcccccaagctatcgaagaggcagcaagctcttccagcgccggtccgaacttaggccagtccggcgcaactgacccaattcccccagagggctgttggaaagcccagcacctccatacccaagcattgaccgcattatccccatcaactagtgggctcacacccacctcgtcttgctcaccgccttcctccacttcaggaaagctgtcgatgtggtcttggaaatcactaatcgagggtccagatagggcgtcaccttcccgtaaagccactatggccggtggcctcgccaaccttcaggacttggagaataccactcctgcccagccgaagaacctgagcccacgcgaacaaggcaagactcagcccccatctgcccctcggctggcccaccctagctatgaggatccatcacagggatggctgtgggaatctgagtgtgcacaggcagtcaaagaagatccagcactgtcaataactcaggtacccgacgcatccggcgacagacgccaggacgtgccctgtcgtggctgtcccctcactcagaagtccgagccatccctgcgtcggggtcaagagcctggaggccaccaaaagcatcgggacctcgcgctagtgcccgatgagctcctgaagcagacatag

SEQ ID NO: 230533 - DNA, 1893 bp, Artificial Sequence
  Description of Artificial Sequence: Synthetic coding sequence
atgaggccccgatctcggagtctgtccccgggtaggtctcctgtgtccttcgattccgagattatcatgatgaaccacgtctacaaggagcggttccctaaggccaccgcacaaatggaggaaagactcgccgagttcataagcagtaacacgccagattcagtgcttccactggccgatggcgctcttagtttcattcaccaccaggtgatcgagatggccagggactgtctcgacaagagcagaagtggattgataaccagccagtacttctacgagctgcaggataaccttgagaagctccttcaggacgaatttgaccctgaggaattctaccacctgcttgaagccgctgaaggccacgcaaaggagggccaagggattaagtgcgacatccccagatacattgtgagtcagcttggcctgacgagggaccctttggaggagatggcacagctgagtagctgcgatagtccagatacgcctgaaaccgacgattcgatcgaaggccacggggcttcactgccctcaaagaaaactccctcagaagaggacttcgagaccattaagctgattagcaacggagcctacggtgcagtgtttctggtgaggcacaagagcactcggcagagattcgccatgaaaaaaatcaacaagcagaatcttatactgcggaaccagatccaacaggcatttgttgagcgggatattctgacatttgcggagaaccctttcgtcgtgtccatgttttgttcatttgatacaaagcgccacctgtgtatggtaatggaatacgtagaaggtggcgattgcgcaaccctcttgaagaacatcggcgcactgcctgtggatatggttaggctgtatttcgcggagacggtgttggctctggagtatttgcataactacggcattgtgcacagggacctgaagcctgataacttacttattaccagtatggggcacatcaagctcactgactttggtctgagcaagatagggctgatgagcttaactacaaacctgtatgaagggcatatcgaaaaagatgctcgagaattcctggacaaacaggtgtgtggaactcccgagtacattgcccctgaggtcatactgagacaaggatatgggaagccggtggactggtgggctatgggcatcattctttatgaatttctggtgggatgtgttccgtttttcggagacacccctgaagaattattcggccaggtcatttcagacgagattgtctggcctgagggcgatgaagcgcttcctcccgatgcccaggacctgactagtaaactgctgcatcagaacccattagaaaggctcggtacaggctccgcctacgaagtgaagcaacatccttttttcacgggactggactggactggacttctgcgccagaaggcagagtttatcccccagttggagtcggaggatgacactagctatttcgatacgcggtccgagcgctatcaccatatggacagtgaggacgaggaagaggtctccgaggacggatgtctcgagattcgacagttttcaagttgttcaccgagattcaacaaagtgtacagctcaatggagcggttatctttgcttgaggagagaaggactccgcctcctaccaagcggtctttgtctgaagaaaaagaagatcactctgacggccttgctgggttgaaggggcgtgaccggtcttgggttatcggttctcccgagattctcagaaagcgactcagcgtgagtgagtcgtccctgctgaaggtggctgggcgaccgtctaccttttcgcagcacttcggcacgcatccccaccaacaactgctgtcatctcagttgcatctgtgggaggcagaacacgtggtactagagatcccttactag

SEQ ID NO: 230534 - DNA, 1035 bp, Artificial Sequence
  Description of Artificial Sequence: Synthetic coding sequence
atggatgacagctcaatcctcagacggaggggcttgcagaaggagctctcgctgcccagacgtggatccttttgtcgtacaagcaacaggaaatcactcatcgtgaccagttcgaccagccctaccctccctcggcctcattcacctctgcacggccacacagggaactcgccattagactcaccacgtaacttcagccccaacgccccagcccacttttccttcgtacccgcaaggtcccacagccaccgggctgaccggaccgacgggagacgttggtcactggcctcattgccctcatccggctatggcactaacaccccgagtagtactgtttcgagctcctgttcctcacaggagaaattgcatcagttaccatttcagcccactgcggacgagctgcatttcctcaccaaacatttcagtaccgaaagtgtacctgatgaggaaggaaggcagagcccagcgatgaggcctgctcctagcagagccctcggaacactgcgacaggaccgggcagaacggagggaatccttacagaagcaggaagccatccgtgaagtggatagttccgaagatgataccgaggaaggccctgaaaatagtcagggtgcccaagagctgagcttggcaccccaccccgaggttagccaatccgtcgctccaaaaggtgccggagagtccggcgaggaagatccctttccaagcagagaccctagaagcctggggcctatggttcctagcttactaacaggaattacactcggcccacctcggatggaaagcccaagcgggcctcatcgcaggttgggctcaccacaagccatcgaggaagccgctagttcatccagtgccggaccgaacttagggcagtcaggggcaaccgaccctatccctcctgaagggtgctggaaggcccagcacctgcatacacaggcccttaccgcattgtctccctccacctctggactggcacacctcatgaggatacccgcaagggccggatatggtagcctctcagtccacaagcagtag

SEQ ID NO: 230535 - DNA, 3930 bp, Artificial Sequence
  Description of Artificial Sequence: Synthetic coding sequence
atggatgagtctagcctgcttcggaggcggggattgcagaaggagctcagtcttccccgtagaggccgtggatgtagaagtggcaacagaaagtctctcgtcgtggggactccttctccaacattgtccaggcccctttcgcccttaagcgttccaacggccggatcatccccactggactctcctcgtaatttttccgctgcttctgccctgaactttccctttgcaagacgcgcagacgggagacgctggtccttagcatccctcccatcatcgggctacgggaccaacacacctagttctacactttcatcaagttcaagctctagggaaagattgcatcaattgccttttcagcctacccccgacgaactgcattttctaagcaaacacttcagatcctcagaaaatgtcttggatgaggagggcggacggtccccccgtctgcgccctaggtcacgctctctgtcgcctggtcgcgctacagggacttttgataatgaaattgtcatgatgaaccacgtctatcgggagagatttcctaaagccacagcccaaatggaagggaggctacaggagtttctaaccgcatacgccccaggggcacgactggccttggctgacggtgtccttggttttatccaccaccagatcgtggaactggctcgggactgcctggcaaagagcggtgagaacctcgtgacatctcgatacttcctggaaatgcaggagaaattagaacggctgctgcaagacgctcatgaaagatccgattctgaggaggtcagtttcattgtccagctggtccgtaaactgctgataatcatttcacggcctgcacggttgctagaatgcctggagttcgaccccgaagaattttatcatcttttggaagctgccgagggccatgccagagagggccagggtattaagacagaccttcctcagtatataatcggacagctggggcttgccaaagatcctctcgaagagatggtcccgctatcacacctagaagaggagcagccacccgctcccgagtcaccggagagtcgggcactggttgggcagtcccgtcggaaaccctgcgaatcagactttgaaaccattaaactgatcagtaacggcgcttacggggctgtgtatctggtgagacacagggatactcgccaacgtttcgccatcaagaaaatcaataaacagaatctgattttgaggaaccagatacagcaggtttttgtcgaaagagatatcctcacctttgcagaaaatccatttgtcgtctcaatgttttgtagctttgagacccgtcggcatttgtgcatggtgatggagtacgtcgagggtggagattgcgctaccctcctgaaaaacatgggaccgcttcccgtggatatggccagactatacttcgcggaaaccgtgctcgctttggagtatttgcacaattatggcattgtgcatcgcgatttaaaaccagataatctccttatcacctctcttgggcatataaagctcaccgacttcggtttgtctaagataggactcatgtccatggctaccaatctgtatgagggtcacattgagaaagacgctcgggagtttattgataaacaggtgtgtggtactccagagtatatcgctccagaggtgatttttcgccagggatacgggaagcccgtcgactggtgggccatgggcgtcgtgctgtatgagtttctcgtggggtgtgtgcccttcttcggcgacacccccgaggaactgtttggacaagtggtctctgatgaaatcatgtggcctgagggcgacgaggcactgccggcagacgcccaggacctcatcaccagacttctgagacaatcccccttggatcgccttgggacaggtggtactcacgaggtcaagcagcatccattctttttggctctggattgggccggtctcttgaggcacaaggcagagttcgtcccgcaattagaggctgaagatgatacatcttattttgatacacgttcagaacggtatagacatcttgggtcagaggacgacgaaaccaacgatgaggagtccagtaccgaaatcccacagtttagctcttgctcacaccggttctccaaggtgtactctagcagtgagttccttgccgtgcaacccacccctacattcgcggagcgcagttttagcgaagatcgcgaagaaggttgggagaggagcgaagtggactacggacggagattatctgcagacattaggctgcggagctggacttcttctggcagcagctgtcagagcagctcatcacagccagaaaggggtccatccccatccctcttaaacactatatcacttgatactatgccaaaattcgctttttctagcgaagatgagggagtggggccaggcccagccggtcctaagcggcctgtgtttatactgggagagccagatcctccccctgccgctactccagttatgcctaaacctagcagcttatctgcggacaccgccgctctctcacatgcgcgactccggtccaacagtatcggcgcacgacattcgacaccaaggcctctcgacgctggtaggggaagaagattaggcggacccagagatcccgctccagagaagtcccgcgcttccagctcgggaggttcgggaggcggttcaggaggacgcgtacctaaaagtgccagcgtcagtgcattatctctaatcataaccgccgacgatggatcaggcggacccctgatgagccctcttagccctcggtcactgtcttcgaatccttcttcccgggacagttcaccctctagggatccaagccccgtctgcgggagcctgaggcccccaatagtgatccatagctcggggaagaagtatggcttcagcctgcgggcaatcagggtatatatgggagattccgacgtgtataccgttcaccacgtggtgtggtctgttgaggacggctctcctgcacaagaagccggactccgcgcaggggatctgattacccatattaacggtgagtcggttctcggtttggtgcatatggacgtggtcgaactgcttctaaagagtggaaacaaaatcagtctgcggactaccgctctggaaaacacaagtatcaaagtgggccctgcccgtaaaaatgtagccaagggcagaatggctcggagaagcaagaggtcccggaggcgcgaaacccaggatcgccgaaaatctctgtttaagaaaatctctaaacagacatccgtattgcacacatcccgctctttttcctctggcttgcaccactcactgtcatcaagcgagtccttaccgggatccccaacgcacagcctaagtcctagccccactacgccatgccggtccccagcccctgatgtgccagccgacaccacggctagccctccatccgcttcacctagtagctcctctcctgcctcccctgccgcagctggacacactaggccaagtagcctacacggccttgccgctaaactcggtccacctcgccctaagactgggagacgtaaaagtacaagctcaatcccaccctcaccactcgcttgccccccaatatcagcgccacctccgaggtccccaagcccactccccggacatcctcctgcaccagctcgcagtcctaggttgcgcaggggacagagtgcagacaagctgggaaccggcgagcggctggatggtgaggccggtagacgcaccaggggcccagaggccgaacttgtggttatgcggaggctccatcttagtgagaggcgcgacagctttaagaagcaggaggctgtgcaagaagtttccttcgatgaaccccaggaggaggccacggggctcccgaccagtgtgccccagatcgctgtcgagggagaggaggccgtccctgtagccctcgggccaacaggtcgcgactag

SEQ ID NO: 230536 - DNA, 2523 bp, Artificial Sequence
  Description of Artificial Sequence: Synthetic coding sequence
atggatccaaccgccggaagcaagaaagagcccggaggaggtgccgctaccgaggaaggggtcaaccggatcgccgtccctaaaccaccatcaatcgaggaattcagcatcgtgaagccgatttcacgaggagccttcggaaaagtctacctgggccagaaaggtgggaaactttatgcagtcaaagtcgtcaagaaagccgacatgatcaataagaacatgactcaccaggttcaggctgaaagggacgctctggccctatccaagtctcctttcattgtccacctctattactcgctgcagagcgctaataacgtctatctagtcatggaatacctcatcggaggagatgtcaaaagcttgctccatatctacgggtattttgatgaagaaatggccgtgaagtatattagcgaagtggcccttgcactggattacctgcacagacatgggataatccacagggacctgaagcccgacaatatgctcatcagtaatgaggggcatatcaaactgacagactttggcctttctaaggtcacgcttaatcgtgacattaacatgatggacattctgaccaccccgagcatggctaaaccgagacaggactattctcgcaccccaggccaagtgctgagtctcatttcctcactgggcttcaataccccaatagcagaaaagaatcaggaccccgctaatatcttgagtgcatgcttatccgaaactagtcaattatcacaagggttagtgtgccccatgagcgtggatcagaaagatacgaccccttatagcagtaaactgctcaaaagctgcctcgagacagtggctagcaacccaggaatgcctgtgaagtgcctgacttccaacttactgcagagcagaaaaaggctggccactagcagcgccagctcacaatcgcacaccttcattagctctgttgagtccgagtgtcacagctcaccaaagtgggagaaggactgccaggaaagcgatgaggccctcggtcccaccatgatgtcctggaacgccgttgagaaactctgcgcaaagagcgctaacgctatcgagactaaaggcttcaataagaaggatctagagctggcactgagcccgatacataactcatccgccttacccacgaccggacgcagttgcgtgaacctggctaaaaaatgcttttctggtgaagtgagctgggaggcggtcgagctggatgtgaataatattaacatggacacagacacaagccagctcggcttccaccagagtaaccagtgggccgttgacagcgggggtatcagcgaagagcacttggggaaacgcagcttgaaaagaaacttcgaactagtagattccagtccatgtaaaaagatcattcagaataaaaagacgtgcgtcgagtacaaacataatgaaatgacaaactgctacaccaatcaaaataccgggctcaccgtggaggtgcaggatctgaagttatccgtccacaagtcccagcagaatgactgtgccaataaagaaaacatcgtgaactcattcacagacaagcagcagacaccggaaaagttgcctattcctatgatcgcaaagaatctcatgtgcgaattggatgaggactgtgagaagaatagtaagagagactatctaagcagttcattcctgtgctccgatgatgaccgtgcctctaagaatatttccatgaacagtgattcctcattcccagggattagtatcatggagtcaccgctcgaatcgcagccattggatagcgaccggagcattaaggagagcagcttcgaagagtcaaatatagaggatcccctgattgtgacaccagactgccaggaaaaaacttcccccaaaggggttgagaacccagcggtgcaggaatctaaccagaaaatgctcggccctccactggaagttcttaagacactggcctctaagagaaacgcagtggcattccggtcgtttaactcccatataaatgcctctaacaattctgagcccagccgcatgaacatgacatctctggatgccatggatatcagttgcgcatactccggaagctaccctatggctatcacccccacccagaagcgtaggagttgtatgccacatcagacccctaaccaaataaagtctggcaccccctaccgcacaccaaagtcagtacgcaggggggtggccccagtggacgacgggagaatcctggggacccctgattatctcgctccggaactgctgttaggccgagcgcacgacatcccgtggccagagggggaggagaaactgagcgataatgcccagtctgccgtggaaattcttctgaccatcgacgatacaaaaagagctgggatgaaggaactgaaaaggcatccactgttctcagatgtggactgggagaatctacagcaccagaccatgccattcattcctcagccggatgacgagaccgatacaagctacttcgaagccaggaatacggcgcaacacctaacagtgtccggctttagtttgtag

SEQ ID NO: 230537 - DNA, 2640 bp, Artificial Sequence
  Description of Artificial Sequence: Synthetic coding sequence
atggatccaacagccggatccaaaaaagagccaggtggtggagccgctacagaggaaggagttaatcgcatcgcagttcctaagcctccctccattgaggagttcagcatcgtgaagccaatcagcagaggagcctttggtaaggtttacctcgggcagaaaggagggaagctgtatgctgtgaaagttgtgaaaaaagccgacatgataaataaaaatatgacgcaccaggtgcaagcagagcgggacgcgttggccctgtccaagtcaccattcattgtgcatctctactattccttgcagtccgccaacaacgtctatctggtgatggagtatcttattgggggagacgttaagtccttgcttcatatatacggctatttcgacgaagaaatggcggtaaagtatatttcagaggtcgcccttgctttggattacctgcatagacacggtatcatccacagagacctgaagcccgataatatgctgatcagtaatgaaggacacatcaaactgaccgatttcggcctgagcaaggttacactgaaccgggacatcaacatgatggacattctcactacacccagtatggcgaagcctcgccaagattattctcggacccccggacaggtgctgagtctgatctcaagcctaggatttaacactccaattgccgagaagaatcaagacccagctaatatcctatctgcttgcctctctgagaccagccaactttcccaggggcttgtttgcccaatgagcgtggaccagaaagacaccaccccatactcaagcaaacttttaaaatcttgcctggagaccgtggctagcaatcctggcatgcctgtgaagtgtctgacctccaacttgctgcaatcccgaaagcggctcgctacttctagcgcctcatcccagtctcatacgttcattagctctgtggagagcgagtgccactccagccctaaatgggagaaggactgccaggaaagtgacgaggcgctgggcccaacgatgatgagctggaacgcagtggagaaactgtgtgccaagtcagcaaacgctatcgaaactaagggattcaacaagaaagacttagagctggccctttccccaattcataattcttccgctctacccacaacaggccgtagttgtgttaatttggccaaaaagtgtttcagtggtgaagtaagctgggaagccgttgagcttgacgtgaataatatcaatatggacactgatacatcccagctcggcttccatcagtccaaccagtgggcagtcgacagcggaggaattagcgaggaacatctgggcaagcgaagccttaaaagaaacttcgaactggtagactctagcccctgcaaaaaaattattcagaataagaagacttgcgtcgaatacaaacacaacgagatgaccaactgctacactaaccaaaataccggcctcacagtggaggtccaggatctgaagctctctgtacacaaatcccagcagaatgattgtgccaataaggaaaacatcgtgaatagctttacagacaaacagcagacaccggaaaagctacctattccgatgattgcgaagaacttgatgtgcgagctggatgaggattgcgaaaagaacagtaaacgcgactacttatcaagctcattcctttgcagtgatgacgacagggcctcaaagaacatcagtatgaattccgatagcagctttccaggcattagcatcatggaaagcccactcgagagtcagcccctggactctgacagatctatcaaagaaagcagcttcgaagagtcaaacatcgaggaccccctgattgtcaccccagattgtcaggaaaagaccagtccaaaaggcgtcgagaatccggctgttcaggaatccaatcagaagatgcttgggcctcctctcgaggtattaaagacactagcctcaaaaaggaacgctgtcgccttccggtctttcaactcccatatcaacgcaagtaacaacagcgagccaagccgaatgaatatgacctcgctggatgccatggatatttcctgcgcgtactcaggtagttatccaatggccataacaccaactcaaaagcgcaggtcttgtatgcctcaccagcagactcctaatcagattaagagtggaaccccctatcggactccaaagagcgtgcgcagaggagtcgcgcctgtcgacgatgggaggatcttagggacacctgattacctggcaccagagctgctgctgggaagggcccacggacccgcagtcgattggtgggccttgggcgtttgtttatttgaattcctcacgggcatcccacccttcaacgacgagacacctcagcaggtgtttcagaacatcctcaaacgcgacatcccctggccagaaggagaagagaagctgtccgacaacgcgcaatctgccgtcgaaattttgctgactatcgatgataccaagcgcgctgggatgaaggaattgaaacgacacccactcttttcggacgtcgactgggagaatttgcagcaccaaactatgccattcattccccaaccagatgacgagactgacacttcttacttcgaagctcgcaatacggctcaacacctaacagtcagcggcttttccctctag

SEQ ID NO: 230538 - DNA, 2637 bp, Artificial Sequence
  Description of Artificial Sequence: Synthetic coding sequence
atggatcccacagctggatctaagaaggaacccggaggtggggcagccacagaagagggagtgaacagaattgctgtgccaaagcctccatccattgaggagttcagtatcgttaagcccatcagccggggtgccttcggtaaagtttatctcggacagaaaggcggaaagctgtatgcagtgaaggtcgtaaagaaagcggacatgattaataagaacatgactcatcaggtccaagcagagagggacgccctggctctgtctaaaagccccttcatagtgcacctttattatagtctgcagtcagccaataacgtgtatttggtgatggagtatctcattggcggagatgtgaagtctctgcttcacatatatggctacttcgacgaagaaatggcagtgaagtacatcagcgaggtcgcccttgccctggactatcttcatcgtcacgggattatccaccgcgatctgaagcccgacaacatgctgattagtaacgagggccatattaagttaactgacttcggtctctcaaaggtcacattgaaccgggatatcaatatgatggacatcctcaccaccccttctatggccaaacctcgccaagattacagtcgcacccccggacaggtgctcagtctgatttctagcttggggtttaataccccaatcgccgaaaagaatcaagatcctgctaatatcctgagcgcttgtttgtcggaaacatcacagctctcacagggtctggtgtgcccaatgtctgtagatcagaaagataccacgccctactctagtaagctgctcaagtcgtgcctcgagacagtggcctcgaacccagggatgcccgtgaaatgtcttacctctaacctcctgcaaagccgcaaacggcttgccacctccagcgcgtcatctcagtctcacacattcatcagctctgtggaaagcgagtgtcactccagccccaagtgggagaaggattgccaggaatccgatgaagccttgggcccaacgatgatgagctggaacgctgttgagaagctgtgtgcaaagtctgccaacgccatcgagactaaggggtttaacaaaaaggacttggagctcgccctcagtcccattcacaattcctctgccctaccaaccactgggcgatcctgcgtcaaccttgctaaaaagtgcttcagcggagaagtatcctgggaagccgtcgagcttgacgttaataacatcaatatggatacagacaccagtcagctgggcttccatcagtcaaatcagtgggccgtcgactcagggggaatctctgaagaacacctggggaaacgctccctgaagaggaactttgagcttgtggactcatccccgtgtaaaaagattatccaaaataaaaaaacctgtgtcgaatataaacacaacgaaatgacgaattgctataccaatcagaacactggactaacagtggaagtacaggacctgaagctgtccgtgcacaaatcccagcagaacgattgtgccaacaaggaaaatattgtaaattcatttacagacaagcagcagacacctgaaaagcttccaattcccatgatcgccaagaatctgatgtgcgaattagatgaagattgtgagaagaacagtaagagagattacctctcatcgtcttttctgtgctcagacgacgatcgcgctagcaaaaatatctctatgaacagcgattcttctttccccggaatatcaatcatggagtcgcctttggaatcccagcctcttgactctgatcggagcatcaaggagagcagctttgaggagagtaatatcgaggatcccttgatagttaccccagattgccaggaaaagaccagtccaaaaggcgtcgagaatccagccgtgcaggaaagcaaccagaagatgctaggacctcccctggaggtattaaagacactcgcgtccaagaggaatgctgtggcgtttcgaagcttcaacagccacattaatgcaagtaacaacagtgaaccgagtagaatgaatatgacttccctggacgcgatggatatctcgtgtgcctattcgggtagctaccctatggctattactccaacacaaaaacgtcgaagttgtatgccccaccagaccccgaatcaaatcaaatccgggactccatatcgaacaccaaaatctgtgaggcggggtgtggcacctgtcgatgacggtaggatcctggggaccccggactacctggcccctgagctgttattgggtcgggctcatggacctgcggtggattggtgggcactgggcgtgtgcctcttcgagtttctcaccggcatcccaccctttaatgacgaaaccccgcagcaagtgttccagaacatccttaaacgcgatatcccttggccggagggcgaggagaagctgtcagacaacgctcagagcgcagttgagattctgctgaccatcgatgacacaaaaagagcgggaatgaaagaattgaagagacatccactgtttagcgacgtggattgggagaacctgcagcaccagacaatgcctttcattccgcagccagatgatgaaaccgacactagctattttgaggcacggaacactgctcaacatctgaccgttagcggtttctccctctag

SEQ ID NO: 230539 - DNA, 17816 bp, Artificial Sequence
  Description of Artificial Sequence: Synthetic coding sequence
atgcaaaagggtttgctcgaccaggacaccgggcttgtgctgctggagagtcaggtgattatgtcaggactgatcgcacccgagaccggcgaaaacctgtcacttgaggaagggatcgctagaaaccttataaacccacagatgtatcagcagctgcgcgaattgcaggacgcacttgctctcatctcacgactgactgagagcaggggacccctttctgtggtggaggccatcgagaagcgcatcatcagtgagaccgtaggcctgaagatcctagaggcccatctggcgacgggtggattttcgttgtctccctctgaaaactgcatcaatttggaagaggctttccaccagggcctcataagcgcctggctgcactccgttctggagagttatctgcgtacatccaagaatctcatcgatccgaacaccgctgagaaaatcgggttgctggacctgatgcaacgctgtatcgtgcaccaggaatccgggttcaaactgctgcccgttaaacagctggctgggggaatggtttcgctgaagagcggtcgaaaggtgtctatcttcagggccgtacaagagggtctcattgatcgtcaggtcactgtgcggctgttggaggcccagctgttcgctgggggaatcgttgatccccgaaccggccatagactcaccgttgaagaggctgtaaggcacaacttaattgaccaggacatggcatgcgccatccttattagacagttacaaacaggaggaattatagacaccgtgactgggcagagactgaccattgacgaggccgtgagcaacgacttagtggccgctaagatcgccctagtcattctggagtctttgtggagttttatggggctgctctggcctgaaagcggggaaatactgcctattaccgatgccctcgaacaaggcattgtgagcacggaactagcgcataaaatactctccaacagacagcacataaaggccctcttcctgcccgcaactacagaaatcctctcctggaagaaagcgattgaaagtgggatcctcgacagggatctcgccaacaacctgaagtcaatctgcattcctgacgttatgccgcacatgcagttagctgacagcgccgagcagaatatcaatccaggcgcagccgtgctgccttgttcaaagtcccatccaaaagccaccgcgtcccagtctgagaatctgttgtttcaactgatgacacactcttacattaacgtgcagaacggtcagaggctgctgctgttggataaagaactgatggagaccctgacgtctagggatgagtaccaaactagtccgcctaaggtggtggagatcggccaccagcggcagaagacccccgaaggcttgcaggaatccgctaacgttaaaatcagcggaacattttctagcgggtggactgtcaggctgcctgagttccaattcagctcccagaataaggaatatcctgatcgggaggattgcacaactgagaaaggcaagaaaacaaccgttgaaactgaggattcctccgttgagaatcccgagcaggatctgtttgttgagcagaaagagcggaaccccaatatcgatgccctgaaagtcattaataaagtgaagcttgaggttcaaagacaattgataggcactcagagagaagatcagaccgccgttagtgtgcgggaaaatgccagtcggggacatctattaacaattccacctgctgaagccgagggtgtccccctggtggtggataaagatgttttttccgttgagacccctaaaaaggaacatcagccccttagaaacacttcctttacgtgccagaatgagcaggcccacacgctagagacggagtatatccatgacgagaccgggggatcccatatcaaacctcaaagtaaaaaactacaagtacaagttaaaaaaacacttggcatcaagctcgaactcaagtcagagaccgatggtaacgtacaccccttggataagaaagaaatgctgaagaaaactttcctggccaaggatgatcacaaagaatcacaggaagcccaaaacattgctggtggcagcatgatgatgtctgaaaagacagatgaggaagattccggcagagaaatctttctatcatgttctcacccgctcgagctgctagaggaagctactctcaatgttttatctgcgcagctcctggatgggggtatttttcacgaacagactggacagaagctcctgctgaacgaggccatttcacgcggtattgttccctctcacaccgcggtcaagctgatggagaaactgaacatgttccagggcttctttgactcacagacctgtgagtcactcacaaccgaagaagtgatcaatgaaggtttgatggatgaaaagctgctgcataacgtactgatggctgacaaggccatctcaggtgtactggacccacgaactcagactctgtgttccgtgaaagacgcagtcacggtcgggctcctggataaagaaaccgccaccagaattctggagaggcaggtggtgacaggtggaatcattgatctcaagcgcggaaaaaaagtctccgtgacgctggcttccacgctgggactggtagatgttgcagatcaacctgagctgattaatctggagaaagcatctaaggggagggatgcggagaagaccgttcgcgagcgattgattagtttgcagatggagacaactggactgattgaccccgattctaaggccccactgacagtcgtccagtcaatcgatagggggctcttggagcgcgaagaagccgtgcgtttgctgacaaagcaggtagtggacggtggtattatccaccacatctccgggatgcggctatctgtggacaatgcatttcgacatggactgatcggggaagacctcgccgaaaagttgaagagagtggagaatctcaatatccaccaaatttttaaccctgaaactaaagagaacatttctttgcctaaagcaattaagctggatcttattacatctgatctcaagcgcgagatacaggaagttcaagctttcacggggaacttcgtagatctcatctcaggacagcggcttactctggctgaggccaagaaagaaggccttctgacgaacgaggccgttctttccccaggtatgatgcacggaattgtggacccagagaattgtcgcattgttccctactccgaactggttaaaaagtgcaagatagatatagagagcggccagaggtatctggaggtgatccccttctctgatattaaggacggagtgtctgataaggtgctaactctatcccaggctatccaattggggaaagtcgatttcgcctcaaccttgaaggtcctggaagcccaagcaaacaccggcggtatcattgacactgctactgggaagagattgaccttagctagcgcccttgaggagaagctcgtggatgaaaacatggttcggattattgcctctcatcaagtgttgaacggtgggattgtggatatcttttccgaccagcgggtgaccctcgtggaggcaattgagaaacgcctgatttccccggaactagccaatatgatccagattgacagctcagaattttccgaccacagggcacagattgagaagcaggagggcatcgaggtttgcgccctccaaaacgagttccttggcaaagatatgcttattgcctgtaatcagacagctgaaatgtcatgcaacaaagtggaggagtctgaacgcctgttccaggtcgagaatcagagcgcccaggaaaaggtgaaagtgcgcgtgtccgatggcgagcaggccaagaagtccagggagatttccctgaaggagttcggatgcaaagatcagcgcaagccgaggatgagttctgacgccaaagagtttattagcattatcaacccacataatctgaaaggaaaaagtctggggcaggtttctctgacacacccctacagcgaatgcgatttcaaactgaaggaggtcgcgaggaataacatgggtaacgacaccaacgaagagcaagagaaggctgtgaccaaaattgaaataatctcccatatgaaacaaagcaccagctgcctggattcagaagagatccgcgagaaccaaggagaagtgatactggaggttcaggagacttattgtgaaacaagtgggaagctcccaagtgaacaggtgttgcaacaacctatgaacgcccgtgtgaaatccaaaagggagaaaagggaggtaattgtggaagagtcaattaggacttgtaaaccagccttcctcagcgaagagaagctgtaccaggaaactgcaattcgagacgagcacgattcacatattaagagccaaccgagagagatgacatcttcagaaaagggaaaagaagccgataccgagatgggattcagcataacgttcaagatcgaggagtccagtagtcaggtggtcccccagggcatcagcgtaaagcacttagacgccctcactctgttctcctccaagcaggcaaacgaggggaaagtgaataacctgagtctgtgtttgacacttaagccagaggagaacctgagtcgcgagatcgcctgtggggctcagtctgagcctttcccttgtatgacgccccgaccagaggggcttcactatcaggaatccgacggaaaggcccaggtgacaggccctagtcagatcagcaagacagacaaatcattccagggaacaacacgccaggagactaactaccaggactcttgggtcacatctaagaccaaagagaccaagcaccaaatctcaagcagtaatgagtgcaaagagaaatcctatcaggaggtgtcttttgatccggcaagaggcttgaagctcgaagaaataacagtctcccgcccagattcaaaagaagtgaggtatctggagttcagcgaccggaaggacctgcaccatcagggaagcaagtccgatgataaactgtgcgggactctcaagtcagagatagctactcaagagctgacaggagagaaatttctggagatggctaatccgaatgttgccggacttgaggctggttcaattgaggacatagtaacccagcgagggtcccgcgtgctgggatctttcctcccagagaaactgttcaagggcgtgtctcagaaagagaacaccggacaacagaatgcgattattagtccaactgttctggaaacctcggaagagaaaactgtatccttgactgtttgctcagcagtgaagacggaaaaaacaccacaggaaaaactccgcgagtcccccggttccgaacaaacaccatttatgacagccccagaagggaaggggaacggtggtgtcaatcctgagcccttccgcgcaacacagaacgtttttaccaggcagctatgcctcgagcacgacgagaaactggtgtcctacctctccctacttcggaacatcgaaatgaggacgaagcagattcagcccctcgaactcaaccttgccgagttgcaggacttgctttgccaggccaaagtgctggaaagggaactgaaagacctaacaactctggtctcccaggaactagagtgtgtaaaccagatcataatttctcagccccaggaagtgcctgcacagttgctgaaggctctcgagaaggacgccaaaaaccttcagaagtctctatcaagtgtgtcagacacctggaattctagactcctgcattttcaaaacgcggtggaaatcgagaagacaaaagtgttaaaccagcacacacaattagaggggaggttgcaggatcttcgagcctgggtgggcaacaagaacctgattctcaacagcaaagggtcaaactcagaaatcgacgtggactctctgaacctttgcctccagcaatatgaggatttaaagcaacccatggctgagcgcaaggcccagctggacgccctggccttcgacattcaattcttcatctcagaacatgctcaggacctgtctccccagcaaaacaggcagatgctgcgtctattaaacgaattgcaacggtcttttcaggacattctggagcagacagctgctcaagtagatgcgctgcagggtcatctgcagcagatggagcaggaggccttggtgaaaaccctgcaaaaacaacagaatacctgtcatcagcagctagaagacctgtgttcttgggtggggcaggccgagcgcgctctggcaggtcaccaggggaggaccacacagcaggatctaagtgcccttcaaaaaaaccagagcgacctgaaggacttgcaggatgacattcaaaaccgcgcaacttcctttgctacagttgttaaagatatcgaaggattcatggaagaaaatcagacaaagttaagtcccagggagttgaccgcattgcgagaaaagcttcaccaggccaaggaacaatacgaggcgctgcaggaggaaactagagtggcccaaaaggagcttgaggaggctgtgacatcggcactgcagcaggagacggaaaaaagcaaagcagccaaagaactggctgaaaataaaaaaaaaatcgatgccctgctggattgggtgacatccgtgggatcttctggagggcagctgctgactaatctacctgggatggaacagctgtccggagctagcctcgaaaaaggagcactggatacgaccgacggttacatgggggtcaatcaggccccagagaaattagataagcagtgcgaaatgatgaaggcaaggcatcaagagttattatcccaacagcagaatttcattctcgccacacagtctgctcaggctttcttagatcagcacgggcacaacctgacccctgaagagcagcagatgttgcagcagaagctgggggagctgaaggagcagtacagcactagtctggcacagtccgaagcagaactgaagcaggtacagacgctgcaagatgagttacagaagtttctgcaggaccacaaggaattcgaatcctggctcgaacgatccgagaaggagctcgagaatatgcataagggcggtagttctccagaaacactgccatcccttctcaaaagacagggcagcttttctgaggatgtgatctcacacaaaggcgatcttcgattcgttaccatttcgggtcagaaagtactagacatggagaactccttcaaggagggcaaggaaccttcagagattggtaacctggtgaaagataagctcaaggacgccaccgagcggtatactgcattgcactcaaagtgcacgcgcctgggcagccacctgaacatgctccttggacagtaccaccagttccaaaattctgctgattctctccaagcatggatgcaggcttgtgaggccaatgtggagaaactgctatcagatactgttgcctcagatcctggcgtgctacaagaacaattggccacaactaaacaattgcaagaggagttagccgagcatcaggtgcctgttgaaaagctgcagaaggtagctcgcgacatcatggagattgaaggcgaacctgccccagatcaccgacacgtacaggagactacagactcaatcctgtctcacttccagagccttagctattccctggccgagagaagttcattgctccagaaagcaattgcccagtcccagtccgtgcaggagtctctggagtctctgctgcagtcaataggcgaagtggagcagaacttagaaggtaagcaggtgtctagtttatcttctggcgtaattcaggaagctctcgctaccaatatgaagcttaagcaagatatagcccgtcagaaatctagcctcgaggctactcgtgagatggtgactagattcatggagaccgccgacagcaccaccgccgcagtgttgcagggaaagttggcagaagtttctcagcgatttgagcagttatgtctgcaacagcaggagaaggagagcagtctcaaaaaactattaccacaggccgaaatgttcgagcacctgtctggcaaactccagcagttcatggaaaataaaagtcgaatgctggcttccggcaatcagcctgatcaggacatcactcatttcttccagcagatccaagagctgaatctcgagatggaggaccagcaggaaaacctggatacactagaacacctggtcaccgagctgagctcatgcggctttgccctggatctgtgccagcaccaagatcgggtgcagaacctcaggaaggactttaccgaactccagaagacagttaaggaacgtgaaaaagatgcgtcaagctgtcaagagcaattggatgaattccgtaagttggttaggaccttccagaagtggctgaaggaaaccgaggggtcaattcctcccactgagacgtcgatgagtgccaaagagttggaaaaacagatcgagcatctcaaaagtctgctggacgattgggcctcaaagggaaccctggttgaggagatcaactgtaaaggcacgtccctagagaacctcattatggaaatcactgccccagacagccaggggaaaaccggctccattctgcccagcgtgggttcgagcgtgggcagcgtaaacggctatcatacctgcaaggatctgacagagattcagtgcgatatgagcgatgtcaacctgaaatatgagaagctggggggagtgctacacgagaggcaagaatccttacaggccattcttaatcgaatggaagaggtacacaaggaggccaactcagtgctgcagtggttagaaagtaaggaggaggtactgaaatctatggacgctatgagtagccctaccaagacggagacggtgaaagctcaggcagaatctaacaaggcctttctggccgaactggagcagaacagtccaaagattcagaaagtaaaggaagccttagctgggctgctggtaacctaccccaattcacaagaagctgagaattggaagaagatccaggaagagcttaattctcggtgggagagggcaactgaggtgaccgtggccaggcagcggcagttagaggagtcagcatcacatctggcttgctttcaggccgctgagagtcaactcagaccctggctaatggagaaagaacttatgatgggcgtacttgggcctctttccatcgaccctaatatgctgaatgcacagaagcagcaggttcaatttatgctcaaagagtttgaggcaagaagacagcagcacgaacagcttaacgaggcagcacagggtattctcacgggacctggtgatgtctccctgagtacatcgcaagtgcagaaagagttgcagtccatcaatcagaaatgggtggaactgaccgacaaattgaacagtcgctccagtcagatagatcaggccattgtcaaaagtacacagtaccaggaactgctgcaggacctctcagaaaaggtccgagccgttggccaacgactttccgtgcagtctgctatttccacacagcctgaagcagtaaagcagcagctggaagaaacctccgagatcagatctgacttagaacagttggatcacgaagtgaaggaggcccaaacactctgtgatgagctctccgtactaattggtgaacagtacctaaaagatgaactcaagaagaggctggaaacagtggccctcccacttcagggattagaggacctggcagcagaccggatcaaccggcttcaagcggcactagcctccacgcagcagttccagcaaatgttcgatgaactgagaacatggctggatgacaagcagagtcaacaggccaaaaattgccccataagtgccaaactggagcggctgcagagccagctgcaggagaacgaggagtttcagaaatcccttaatcaacactcggggtcatatgaggttatcgttgctgagggggagagtcttctgctcagcgtccctcccggtgaggagaagcggaccctccagaatcagctcgtggagctgaagaatcattgggaggagctttccaaaaagactgccgacaggcagtcccgcttaaaggattgtatgcaaaaggctcaaaagtatcagtggcatgtggaagacctggtgccttggatcgaggattgtaaggctaaaatgtccgagctgagagtcaccctggacccagtgcagctggagagcagtttactaagatcaaaggctatgctaaacgaagtcgagaaaagacggtcactcctcgagatcctcaacagcgcggctgatatactgatcaattccagtgaggccgatgaggatggcatccgggatgaaaaagctgggatcaaccagaacatggatgctgttactgaagaacttcaggctaaaacaggtagcctggaggagatgacacaacggcttcgcgagtttcaggagagtttcaagaacatcgaaaaaaaagtggagggtgcaaagcaccagcttgagatctttgacgccctggggtcccaagcatgtagcaacaagaatctagagaagctgcgcgctcaacaggaagttttgcaggccctggaacctcaagtggactatcttaggaatttcacacagggcctggttgaagacgctcccgacggttccgacgcctctcaattgctacaccaagcagaggtcgcccagcaagagttcctggaggtgaaacaaagggtcaacagcggctgcgtcatgatggaaaataaactggaaggcatagggcagtttcactgtcgagtacgtgagatgttctctcagttggcagacctcgacgatgaattggatggaatgggggctatcggacgggatacagacagtctccaatcgcagattgaggatgtgcggctgtttttgaataagatccacgtactgaaactagacatagaagcatcagaggcagaatgccgtcacatgttagaggaggagggaaccctagatctgctgggactgaagagagaactggaagctttaaacaaacaatgcgggaaactgacagagagaggaaaagcgagacaggaacagctagagcttacgcttggcagggtagaggatttttataggaagctgaagggactcaacgatgcgaccaccgccgctgaggaggcggaagctctccaatgggtggtgggcactgaagtcgagattatcaaccaacagcttgctgatttcaaaatgtttcaaaaggagcaagtggatccactacagatgaaattgcagcaggtgaacgggctgggtcaggggctgattcagtccgcgggaaaggattgtgacgttcagggcttagaacacgatatggaagaaatcaatgccaggtggaacacgcttaacaagaaagtcgctcaaaggatcgctcagctgcaggaggccttgttacattgcgggaaattccaggatgctttggaacccctcttaagctggctggctgatacagaagaactgatcgcgaatcaaaaacccccatccgccgaatataaagttgttaaagcccagatccaggaacaaaagctgctgcagcgtcttttggacgaccgcaaggcaacggtggacatgctccaggccgagggaggacggatcgcacagtcagccgagttagctgatagagaaaagatcacgggccagctcgagtcactggaatcacggtggacagagctcctgagcaaggcagctgcccgacagaagcaactggaagatatcctggttctcgccaagcagtttcacgagactgccgagcctatctcagatttcctgtccgtgaccgaaaaaaagctggcaaattccgaacctgtaggaacccagaccgctaaaattcagcaacagatcatcaggcataaagccctggaagaagatatcgaaaaccacgcgaccgatgtgcaccaggccgtgaaaatcggccagtctctcagcagcttgacaagtcccgcagagcagggcgtcctgtcagaaaaaatcgattctcttcaggccaggtattctgagattcaggatcggtgttgcaggaaagccgcactgttggatcaagccctcagcaatgcgcgtttgttcggagaagatgaagtggaagtgcttaattggttggcagaggtcgaggacaaactaagctcagtctttgtgaaggatttcaagcaagacgtcttgcaccgtcagcacgcggatcacttggctttgaatgaggaaattgtgaatcgcaaaaaaaacgtagaccaggccattaagaatggacaagcactgctcaagcagactaccggcgaggaagtgttgctgattcaggagaagctagatggcattaaaacacgatatgcagacatcaccgtgacttcctccaaggccctaaggacactcgagcaggccagacagctggctacaaaatttcagagcacatacgaagagctcacaggatggctcagggaagtggaagaagagctagccacttcaggaggccagagccccaccggtgaacaaattccccagttccaacaaaggcagaaagagctgaagaaggaggtcatggagcatcggttggtgcttgacaccgtgaacgaggtgtccagggctctgctagagctggtgccttggcgagccagagaggggctggacaaattggtgtcggatgccaacgagcagtacaagttagtgagcgacacaatcggccagcgagtcgacgaaatcgatgcagcaattcagcgctcccagcagtatgagcaggccgcagacgcagaactcgcatgggtggcagagaccaagcgaaaactgatggctctcgggccaatccggttggagcaggaccagaccactgcacagctgcaggttcagaaagccttttcgattgatatcattaggcacaaggattcgatggacgagctgttttctcatcggagtgaaatcttcgggacttgcggcgaagagcagaaaaccgtcctgcaagaaaaaacagaatcacttatccagcagtacgaggctatatctcttctgaacagcgaacgctatgcacgtctggaaagggcccaagtgctcgtcaaccagttctgggagacctatgaagaacttagcccctggattgaggagacccgggcactgatcgcccagttgccttcccccgctatagatcatgaacagttgagacagcagcaagaggaaatgcgccagcttcgggaatcaattgctgaacacaagccacatatcgacaaacttctgaaaatcgggccacagctcaaggagctgaaccccgaggagggggagatggtggaggaaaagtatcagaaagccgaaaatatgtatgcccaaattaaagaagaggtgcgtcagagggcattagcacttgatgaggccgttagtcagagcacccagatcaccgagtttcatgacaagattgagccaatgctggaaacactggagaatcttagctctaggctgcgcatgcccccattgatacctgccgaagtcgataaaattagggaatgtatctctgacaataaatccgccactgtagagttggaaaaactgcagccaagttttgaagcccttaaaagacggggagaagagttaattggaagatctcaaggggctgacaaggacctggcggctaaagagattcaagataaattagaccagatggtgttcttctgggaggatattaaggccagagcggaggaaagagagattaaatttctggacgtcttggaactcgccgagaagttctggtacgacatggctgcgctccttacaacaattaaggacacccaagacatcgtccacgatctcgagtctccaggcattgatccaagcattatcaaacagcaagtggaagcagccgaaacaattaaagaagagactgacggtttgcatgaggagctggagttcattcgaatactgggagccgacctcatcttcgcttgcggggagacagagaaacctgaggtccggaagagcatagacgagatgaataacgcctgggagaatcttaacaagacctggaaagaacgcttagaaaagctagaggacgccatgcaggccgcagtgcaataccaggatactcttcaggccatgtttgattggctggataacacggtcataaagctctgtaccatgcctccagtgggcacagatttgaacaccgtcaaagaccagttgaatgagatgaaggagttcaaagtggaggtgtatcagcaacagatcgagatggaaaagctcaaccaccagggagagctgatgctgaagaaggctaccgacgaaacggatcgtgacatcattcgcgagccgctcaccgagctgaagcacctgtgggaaaacctgggagaaaagattgcgcatcgacagcacaagctagagggcgctttacttgcgctaggacagtttcagcatgcactggaagagctgatgagctggctcactcacaccgaagaactgttggatgcccagcgaccaataagcggcgaccccaaggtcattgaagtagagttggcgaagcatcacgtgctcaagaatgatgtcttggcgcaccaggccaccgtagaaaccgtaaacaaagccggaaacgagcttctggagtcctcggccggtgacgatgcatccagcctgcgatctaggctggaagcaatgaaccagtgctgggagagtgttttgcagaagaccgaagagcgggaacagcagttgcagagcacacttcagcaggctcagggctttcactcagaaatcgaggactttctcctcgagcttacacgcatggagtctcagttgagcgcctcaaaaccaaccggcggtcttccagaaacagcccgagagcagctggatactcatatggaactgtattcgcagctcaaagctaaggaagagacctacaatcaacttctagataaaggcaggttaatgctgctgtccagagacgactccggttcaggtagtaaaacggaacaatccgtggccctgctggagcaaaaatggcatgtggtgtccagcaaaatggaggagagaaagagcaaattggaagaggccctcaacctcgccactgagttccagaactccctgcaggaattcattaattggctaactctggccgagcagtctctgaatatcgccagcccccctagtctgatcctcaatacggtattgagccaaattgaggaacacaaggtgtttgccaatgaggtgaacgcccacagagatcagattatcgagctcgaccagactggtaaccagctgaagtttctttcccagaaacaagacgtggtgttgatcaagaatctcctcgtgtccgtgcagtctcgctgggaaaaggtcgtccaacgctccattgaacgcggacggtcattagacgatgctcgcaaaagggctaagcaattccatgaggcctggaagaagctgatcgattggcttgaggatgctgagtcccacctggatagcgagctggagatctctaatgatccggataagatcaagctccagttgtccaaacacaaggaattccagaaaacattggggggaaaacaaccagtctacgataccactattcgtacaggtagggcactaaaagaaaagacactgctacccgaagactctcagaaattagacaacttcctcggagaggtccgggacaaatgggataccgtttgtggcaagtctgtggagagacagcacaagttagaagaagccctgctcttttccggacaatttatggacgcactgcaagctttagtcgactggttatataaagtggaacctcaactcgccgaagatcagcccgtccatggggacctcgaccttgttatgaacttgatggacgcccacaaggttttccagaaggaactgggaaaacgcacgggaactgttcaggttctcaaacggtccggtagagagctaatagagaactctcgggacgatacaacctgggtgaaggggcagttgcaggagctgagtacccggtgggacactgtgtgcaaactgagcgttagtaagcagtccagactggaacaagctctgaaacaggcggaagtcttccgcgacacggttcatatgttgttagagtggctgagcgaggccgagcagactctgagatttcgcggagcactacctgacgataccgaggccctgcagagtctgatcgatactcataaagaattcatgaagaaggtggaagagaagagagtagacgtcaactctgccgtggccatgggggaggtcatcctggcagtgtgtcaccccgactgcataacgacaatcaaacactggatcaccatcattcgggctagattcgaagaggttctgacctgggccaaacaacatcagcaacgcctcgagactgcgctgtcagagcttgttgcaaacgctgagttattagaggagctattggcgtggatccaatgggcggaaactactctcatacagcgggaccaggaacccattccacagaacattgacagagtcaaagcactgattgctgaacaccagacatttatggaggagatgacgaggaaacagcccgatgtagacagagtgaccaaaacttacaagcgcaagaatattgaaccgacgcatgcacccttcattgaaaagtctaggagtggaggcagaaagtctctgagtcaacccacaccacctccaatgcccatcctcagtcagtccgaagccaagaatccacgcattaatcaactgagtgcacgctggcagcaggtatggcttttagctttggagcggcagcgtaagctgaatgacgcactggacagactcgaggagctgaaggaatttgccaatttcgattttgatgtgtggaggaaaaaatacatgaggtggatgaaccacaagaagagccgggtgatggacttcttccgaagaattgacaaggatcaggacggtaagatcacaaggcaagagttcattgacggaatactggcctcaaagtttcctacaactaagctggaaatgacagccgtagccgacatattcgaccgcgatggagacggctatattgactactacgagtttgtggctgctctccatcctaacaaagacgcgtaccgcccaacaactgacgcggataaaattgaggacgaggtaacccgtcaggtggctcagtgtaagtgtgccaagcgatttcaagtggaacagatcggagaaaataagtataggttttttctaggaaatcagttcggcgactcacaacagttacgcctcgtgagaattctccggagtacggtcatggtccgagtgggaggtggatggatggctctagacgagtttctggtaaagaacgacccttgccgggctagaggaaggacaaacatagagctgagagagaagtttattctcccagagggtgcttcccaggggatgacccccttccgatctcgcggaagacggagcaaacccagttcgagggccgcaagtccaactcgaagcagctcctccgctagccagagcaatcatagttgtactagtatgccctcttcccctgctacacctgcttcgggaacaaaggtgattcctagctcaggatccaagctgaagagacccactccaacctttcactcaagtagaacgtccctggctggggacacttccaattccagcagccccgcttcaacgggcgctaagactaaccgcgctgatccgaagaagtctgctagcaggccaggctccagagccggtagccgcgcaggatctcgtgcctcatcccggagagggagcgatgcctccgacttcgatctgttggagacacagagtgcttgctccgacacttccgagtcctcagctgccggagggcaggggaatagtagaaggggcctgaacaagccctcgaaaatccccaccatgtctaagaagacaactaccgcttccccccgaacacccggaccaaagcgcta

SEQ ID NO: 230540 - DNA, 16293 bp, Artificial Sequence
  Description of Artificial Sequence: Synthetic coding sequence
atgagcagctcagacgaggagacgctgtccgaacgttcatgtcgcagcgagcggtcatgcagatctgaaagaagctaccggtcagaacgttcgggaagtctgtcaccatgtcccccaggggatactctgccctggaacctcccactccacgagcagaagaaaaggaaatcacaagattccgtactcgatccagccgagagagctgttgtgagagtggcagacgaaagggacagggtgcagaaaaagactttcaccaagtgggttaataagcatttgatgaaggtccgtaaacacatcaatgacctgtacgaagatctgagggacggtcacaacttgatctctctgcttgaggtgctcagtggcatcaagctgcctagggagaagggacggatgcgatttcatcgactgcagaacgtgcagatcgcgctcgacttccttaagcagcgccaggtcaagctggttaatattcggaatgatgatatcacagatgggaatcctaagctgaccctggggcttatttggaccataattctgcactttcagatctctgatatctacattagcggcgagtctggggatatgtcagctaaagaaaaattactactctggactcagaaagtgacagctggatataccggtatcaagtgtactaactttagcagctgctggagcgacgggaaaatgtttaatgcactgattcatagataccgtccagaccttgttgacatggagcgtgtgcagattcagtctaaccgagaaaacctcgaacaagcctttgaggtggccgaacggcttggcgtaacaaggttgctggatgctgaagatgtcgacgtgccttccccagatgagaagagcgttatcacatatgttagttctatttatgatgcctttcctaaggtgcctgagggtggagagggtatttctgcaactgaggtggatagtagatggcaggagtaccagtctagggtagatagcctaatcccttggattaagcagcacacaatcttaatgtcagataagactttccctcaaaaccctgttgagctgaaggcactgtacaatcagtacattcactttaaagagaccgagattttggctaaggagagagagaaaggcaggattgaagaattgtacaagctcctggaagtatggatcgagttcgggagaatcaagttaccgcaggggtatcatcccaacgacgtagaagaagagtggggcaaactgattatcgaaatgctggagcgcgagaaaagtttaagaccagctgtggaacgtctcgagctgttgctgcagatcgccaataagatacagaacggtgcacttaactgtgaagaaaaacttaccttggccaaaaacaccctgcaggctgatgccgctcatctcgaaagtggacagccagtccagtgtgaatctgatgttattatgtacatccaagaatgtgagggcctgatacgtcagttacaggtggacctgcagattctccgggatgagaattattaccagcttgaggaactggcgtttcgggtaatgaggctgcaggacgagcttgtaactctgcggctcgagtgcacaaacctgtaccggaagggtcactttacctctctcgagctggtcccgccatcaaccttaaccaccactcacctcaaggcagagcccctgaccaaggcaactcacagttcctccacaagctggttcaggaaacccatgacacgtgctgagttagtagcgatttccagctctgaggacgaaggcaatctcagattcgtctatgaacttctgtcatgggttgaagagatgcagatgaagttggagcgcgcagaatgggggaacgacctaccatctgtcgagctccagctggaaacacagcagcatatacatacctccgtggaagaactgggttcctctgtgaaggaagcccgactgtacgagggcaagatgtcccaaaactttcatacatcttacgccgagacattaggcaagctggagacccagtattgcaagcttaaggaaacaagttccttccgaatgaggcacctccaatcactccacaagttcgtgtctcgggctaccgccgaactgatttggctgaatgaaaaagaagaggaggaattagcttacgattggtccgataacaacagtaacatttccgctaagagaaattacttctccgagctcaccatggaactggaagagaagcaggacgtgttcagatcattgcaggacactgccgaactgctcagtttggaaaaccatccagcgaaacagaccgtcgaggcttattcagccgctgtacagtctcagctacagtggatgaaacagctctgtctgtgcgtcgagcagcacgtgaaagagaatacagcatattttcagttcttctcagacgcaagagaactcgaaagcttccttcgaaacctgcaggacagtataaagcgcaagtattcatgcgaccacaatactagcctgagccggcttgaggaccttctccaggacagcatggacgagaaagagcagcttatccaatctaagagcagcgtagcttccttggtgggcagaagcaagaccattgttcagttaaagccaagatcccctgaccatgtgttgaaaaatacaattagtgtcaaagctgtgtgcgactatcggcagattgaaatcacaatctgcaagaatgacgagtgcgtgctagaggacaactctcagcggacgaaatggaaggtgatttctcctacaggtaacgaagcaatggtaccatctgtgtgctttcttatcccaccgcctaataaggacgctattgaaatggcttctcgagtggaacagagctatcagaaagtcatggctctgtggcaccagctgcatgtcaatactaaatccctgattagctggaattacctgcggaaagatctggatctggtgcagacatggaatctggaaaagctacgttcgagcgcgcctggcgagtgtcaccagatcatgaagaatctccaggcacactacgaggattttctgcaggattctcgcgattcggtcctgttcagtgtagcagataggctacgccttgaggaagaggttgaggcctgcaaagcaaggtttcaacatttgatgaaatcaatggaaaacgaggataaggaggaaacggtcgcgaagatgtacatctccgaactcaagaacatccggctgcgcctggaggaatatgaacagagagtggtgaagcgtatccagagtctagctagctcgaggaccgatagagatgcgtggcaagacaatgctcttcggattgctgagcaggagcacacacaggaggaccttcagcagctgagatctgacctcgacgctgtcagcatgaagtgtgacagtttccttcatcagtccccatcctccagcagcgttccaactctcaggagcgagcttaatcttcttgtggagaagatggatcatgtgtatggcctgagcactgtttatctgaacaagctgaaaactgttgacgtaattgttaggtccattcaggatgcagagctcctcgtgaaaggctatgagatcaagctgtcccaggaggaggtggttttggccgacctcagtgccctggaagcacactggtccaccctgcgtcattggctgtccgacgtaaaggataaaaactccgtgttttctgtgctcgatgaagagatcgccaaagctaaagtggtcgccgagcagatgtctcgactcactcccgaacgcaaccttgatctagagagatatcaggaaaagggcagtcagttgcaggaaaggtggcaccgcgttatcgcccagttggaaattcggcagtccgaactcgaaagcatccaagaagtgcttggggactatcgggcatgccatgggacattaataaagtggattgaagagacgacggcccaacaagaaatgatgaagccaggacaagcggaagattcaagagttttaagtgaacagctgtctcagcaaactgcccttttcgccgagattgagcggaaccaaacaaagcttgatcagtgtcaaaagttctcgcagcaatattcgactattgttaaggactacgagctgcaactgatgacatataaagcattcgtcgaatcccaacagaaatcacctggaaaaagaaggcggatgctgtcgagctccgatgccataactcaggaattcatggatttacgtaccagatacacggctctggttactctgactactcagcatgtaaagtatatctcagacgctctgcggcgtttggaggaagaagaaaaagtggtcgaagaggaaaaacaggagcacgttgagaaggttaaagaactcctcggttgggtctcaacacttgcacgcaatacccagggcaaagccacctcttcagagactaaggagagcaccgacatcgaaaaagccattctggaacagcaggtactgtccgaggagcttacaacgaagaaagaacaagtgtcggaggcaataaagacaagccaaattttccttgccaagcatggccataaactgtccgagaaggaaaagaagcagatctcagagcagctgaacgcgctgaataaggcttaccatgacctgtgcgacggctccgccaatcagctgcaacagctgcagtcccagcttgcccatcagactgaacagaagacgcttcagaagcagcaaaacacctgtcatcaacagctggaggacttgtgctcatgggtgggccaagccgagagagccctcgctggtcatcagggcagaacgactcagcaggacctctcagccttacagaaaaatcagagcgacctcaaagacttgcaggacgacattcagaaccgggcaacttcctttgcgacagtagttaaagatatagagggattcatggaagaaaatcaaaccaaattgtccccaagagaattaacagccttgcgtgaaaagcttcatcaggctaaggaacagtatgaggccttacaagaagagactcgggtcgcacagaaagagctcgaagaagccgtaacttccgccttgcaacaggagaccgagaagtccaaagcagctaaggagctggctgagaacaagaagaagatagatgcactcctggattgggtcacgagtgtgggctcttcaggcggacaactgctcacaaaccttcctggcatggaacaactgagcggggcttcactcgagaagggtgccctggatacgacagatgggtatatgggggttaatcaggcccctgaaaagctggacaagcagtgcgaaatgatgaaggctagacaccaggagttattgtctcagcaacagaattttatcctggctacacagtccgctcaagcgttcttggaccagcacggccacaatctgacccccgaggagcagcagatgttgcagcagaaattgggggagttgaaggagcagtatagtacttccctggcccagtcagaggcggaacttaaacaagttcagaccttacaggatgaattgcaaaaatttctacaggaccataaggaattcgagtcctggctggagagaagtgaaaaagaactggaaaatatgcacaaagggggttcaagtcctgagaccttgccttccctactgaagcggcagggtagcttttctgaggacgtcattagccacaagggtgatctcaggttcgtgacaatatccggccagaaagtgctggacatggaaaattcttttaaagaagggaaggagccctcagaaatcgggaatctcgtgaaagacaaactgaaagatgcgacggagagatacactgccttgcattccaagtgcactagactcggctcccacttgaacatgctcctcggacagtatcaccagttccagaattcagctgactctctacaggcttggatgcaggcatgcgaggctaacgtggaaaaacttctaagtgacacagtggcaagcgaccccggagtgctccaggagcagttggctaccaccaaacagctgcaggaggagttagctgaacaccaggttccagtggaaaagttacagaaggttgctagggatattatggagatcgaaggggagccggctcccgatcacaggcatgtacaggaaaccacggactctatcctgtcacatttccagtctctcagctatagtctcgcagagcggtctagtcttttgcagaaggccattgcacaaagccagtcagttcaggaatccctggagtccttactgcagagtattggcgaagtcgaacagaatcttgagggtaaacaagtcagtagcttgtccagtggagtgatccaagaagccctggccactaatatgaaattaaagcaggatatagccaggcagaagtcctcccttgaagccactcgggagatggtcacccgttttatggaaacagctgattcaaccactgccgcagttctgcaaggcaaactggcagaagtatctcagcgatttgagcagttgtgtctgcaacaacaagagaaggagagctccttgaagaagctgctgcctcaggcagagatgttcgagcatctgtccggaaagttgcagcaattcatggagaacaagtcacggatgctggcttcaggcaaccaacctgaccaagatattactcattttttccagcagattcaggaacttaacctggagatggaggaccagcaggagaacttggatacactggagcatctagtgacagagctgtccagctgcggtttcgcactggatctctgtcaacatcaggatagagtacagaacctgcggaaggattttactgaactacaaaaaactgtgaaagagagagagaaggatgctagctcttgtcaggagcagttggacgagttccggaagctggtccggactttccagaagtggctcaaagaaaccgaagggtctattcccccaaccgagacatctatgtcagcaaaagagctcgaaaaacaaatcgagcacctcaaaagcctgctcgatgactgggctagcaaggggacactggtcgaggaaatcaattgtaagggaacttctctagagaatctcataatggagataaccgccccagacagtcaggggaaaactggtagcatcttgccttccgtgggcagcagtgtgggaagtgttaatgggtatcatacctgtaaggatctcacagagatccaatgtgatatgagtgacgttaatctcaagtacgagaaacttggcggagtgctgcacgagagacaggaaagcctgcaggccatcctgaaccgcatggaggaggtgcataaggaggcaaattcagtactacagtggcttgaatccaaagaggaggtgcttaagtccatggatgcaatgtcgtcccctacaaaaacagagacagtcaaggctcaggctgaaagtaacaaggctttcctcgcggaactggaacagaactcccctaaaatccagaaagtcaaggaagctctggctggactgctggtaacctatccaaactcgcaggaggccgagaactggaaaaagatccaggaagagctgaactctaggtgggagagagctactgaagtgaccgtggcaagacaaaggcagttggaggaatcagcatcccatctggcatgcttccaggcggcagagtcccagctcagaccctggttaatggagaaggagctcatgatgggggtcctcggaccccttagtattgaccccaatatgctgaatgcgcaaaaacaacaagttcagttcatgttgaaggagtttgaggctcgcaggcagcagcacgagcaactgaacgaggccgctcagggaatccttactggaccaggagacgtctctctcagtacgtcacaggtccagaaagagctccagtctatcaaccagaaatgggtggagctgaccgataagctgaacagccgatcttcccagatcgatcaggccatagtcaaatctacgcagtaccaagagctgttacaagatttatccgagaaggtacgtgccgtcggtcagaggctgagcgttcagagcgcgatttccacacagcccgaggccgtgaaacagcagctggaagagacctccgaaattaggagcgatttggagcaacttgaccacgaagttaaggaagcccagactttatgtgatgaactatccgtgctcatcggcgagcaatacctgaaggatgagttgaaaaagagacttgagaccgtggctcttcccctacaggggcttgaggaccttgccgctgatagaataaacaggttgcaggctgctttagcctcaactcagcagtttcaacagatgtttgacgagctgagaacatggttggatgacaaacagtcacaacaggcaaaaaattgccccataagcgccaaactcgagaggttgcagtcccagctacaggagaatgaggaattccaaaaaagcctcaaccagcactcagggtcttacgaggtgatcgtagcagagggtgagagtctactgttatctgtgcctcccggtgaggaaaagcgtacacttcaaaatcaattggttgaattaaagaatcactgggaggaactctctaaaaagacagcagacagacagtctcgcctgaaggactgcatgcagaaggctcaaaaatatcagtggcacgtggaggacttagttccctggatcgaggactgcaaggcaaagatgtccgaactgagggttactcttgaccccgtgcagttggaaagcagcctgctgagaagtaaggccatgcttaatgaagtggagaaaagacggtcccttcttgaaatattaaactcagccgcagatatcttgataaatagcagtgaagcagacgaagacggaatcagagatgagaaagcaggtataaaccagaatatggatgcggttaccgaagaactgcaggccaagactgggtcgctggaggagatgacacagaggcttagagaatttcaggaatcattcaaaaatatcgagaaaaaagtcgagggagccaaacatcagcttgaaattttcgacgccctgggtagccaggcctgctctaacaaaaacctcgaaaaactaagagcacagcaggaagtgttgcaggctcttgagcctcaggtagattaccttaggaactttactcaagggctcgttgaagatgcccctgacgggagtgacgctagtcaattgctgcatcaggctgaagtagctcagcaggagtttctggaggtgaaacagagggtgaattcaggctgtgtgatgatggaaaataaactcgaaggaataggccagttccattgtcgtgtgcgcgagatgttttcacagctcgcggacctggacgatgagctggacggtatgggagctatcgggagggatactgattccctccaatctcagattgaggacgttcgactgttcctgaataagatacatgtgcttaaactggacattgaagcatctgaggcagaatgcaggcatatgctggaagaagaagggaccctggacctattggggctcaagcgggaattagaggccctgaataagcagtgtgggaagctgactgagagaggcaaggcaaggcaggagcagttggaattgaccctcgggagagtcgaggacttctacagaaagctaaagggccttaatgacgctactaccgctgctgaagaagcagaggcccttcagtgggtggttggtacagaggtcgaaatcattaatcagcagttggctgattttaagatgtttcagaaggaacaagttgacccactccagatgaaactgcaacaggtgaatggcttgggacagggcttgatacaaagcgccggtaaggactgcgatgtgcagggactggaacatgatatggaagagatcaacgctcggtggaacacgctcaacaaaaaggtggctcaacgtatcgcacagcttcaggaggcccttctgcactgcggaaagtttcaagatgcactagaacctcttttgagttggctggctgatacagaggagttgattgccaatcagaaacctcccagtgccgagtataaagtcgtgaaggcccaaattcaggaacaaaaactgctacagaggctcttagacgataggaaggccaccgtcgacatgctgcaggcggaagggggtagaattgcacaatctgcagagctggcagatcgcgaaaaaatcacagggcagttggagtcccttgagagccggtggaccgagctattgagcaaggctgccgctcgccaaaagcaattagaagacatcctggttctggccaaacagttccacgaaaccgccgagccaatatcagactttctcagtgtgaccgaaaaaaagctggcgaatagtgagccagtcggaacccaaacagcaaaaatccagcagcagatcatccgtcataaagccttggaagaggacattgagaatcacgctaccgatgtgcaccaggccgtgaaaatcggccagtctctgtcaagcttaacatcccccgcagaacaaggagtgcttagcgagaagatagattcccttcaagccaggtactctgaaatccaggatcgatgctgtcgaaaagccgcattgttagatcaagctctgtccaatgcgagactgtttggcgaggacgaggtggaagtgcttaactggttggccgaagtggaagataaacttagcagtgtatttgtcaaggacttcaaacaggacgtgttacatcgccagcacgcggaccacctggctttaaacgaggagatcgtgaatcgcaaaaaaaatgtggatcaggctatcaagaatgggcaggctctgctgaaacagaccaccggtgaagaggtgctgctcattcaggagaaactggacggcatcaaaacgagatatgccgacattactgtgacttcctcaaaggccctcaggactctggaacaggcacgacagctggcgactaagtttcagagcacctatgaggagctcaccggctggctgagggaggtggaagaggaactggccacctctggaggacagtcacctacgggagagcaaattcctcaattccagcagcgtcaaaaagaattgaaaaaagaagtgatggaacatcgactagtgttggatacagtgaacgaagtatcaagagctctgttagagctggtcccctggcgggctagggaaggcctcgacaagctcgtgagtgatgcaaacgaacaatataagctggtgagtgataccattgggcagcgggtggatgagattgatgccgcaattcaacgctcccagcagtatgaacaggcggcagatgctgagctcgcttgggtggctgaaactaagaggaagctgatggctctgggtcctatccggctggagcaggaccagacaacggctcagcttcaggtacagaaagccttttccatcgacatcattcgccacaaggattcaatggacgagctgttcagccacagaagtgagatctttggaacctgcggagaggagcagaagaccgtactacaggaaaagaccgaaagcctgattcagcagtatgaggctatttcattgcttaatagcgaacgttatgctcgcctggaaagggctcaagtgttagttaatcagttctgggagacctatgaagagctgtctccatggatagaagagacgcgcgcacttattgcacagttgcctagccctgctatcgaccatgagcagttgaggcagcaacaggaagagatgagacagttgcgtgaatccatagcggagcacaaaccacatatcgacaagctgcttaaaattgggcctcagttgaaagaacttaatcctgaggagggggagatggtggaagagaagtaccagaaagcggaaaatatgtatgcacagattaaggaagaggtccggcaacgtgcactggccctggatgaagctgtctctcagtctactcaggtaagccagttccacgacaagatcgaacctatgctggaaacactcgaaaatcttagcagccgactgcggatgcccccactgattcccgcagaggtagacaaaatccgtgaatgtatcagtgataataagagtgcaacagtagagctggagaagcttcaacccagttttgaggcactgaaaaggcgcggtgaggagctgatcggcaggtctcagggtgctgacaaggacctcgcagcaaaggagatccaagacaagctggaccagatggtattcttttgggaggacataaaagctagggcggaggaaagggagattaagttccttgatgtcctcgagctcgcagagaaattttggtacgatatggcagctcttctaaccacgattaaggatactcaggatatcgttcatgatctggagtcgcctggcattgatccttccataatcaagcagcaggtagaggccgctgagactatcaaagaggaaactgacggcttgcatgaagaacttgagttcattaggatcctgggggctgatctgattttcgcctgcggtgaaactgagaagcccgaggtgaggaagtcaatcgatgaaatgaataacgcctgggagaatctgaataagacctggaaggaaaggctcgagaagctagaggacgcgatgcaggcagccgtccagtaccaggatacgcttcaagcaatgttcgattggctagataacaccgtgataaaactgtgcacaatgcccccagtaggaacggatttgaacactgtcaaagaccaactgaatgaaatgaaggagttcaaggtcgaggtttatcagcagcagattgagatggagaagctgaaccatcagggtgagctgatgctgaaaaaggcgaccgatgaaacagacagagatattatccgcgaacccctgaccgagttgaagcacctctgggagaatctaggtgaaaagatcgcccatagacagcacaaactcgagggggctctcctcgctctaggccagttccagcacgccttggaggaactcatgtcttggctgacgcatactgaagagctgctggacgcccagcgaccaattagcggagaccctaaagtcatagaagttgagctggcaaagcaccacgtcctgaagaacgatgttctagctcaccaggccactgtggagactgtaaataaagccggtaatgagcttcttgagagtagcgcaggggacgacgcttcaagtctgagaagccgactggaggccatgaatcagtgttgggagtccgtgctccagaagaccgaggaacgagagcagcaattgcagtcaactctccaacaagcacaggggttccacagtgagattgaagactttcttctagagcttactcgaatggagtcacagctgtccgcgtccaaacccactgggggtttgcccgaaactgctcgtgagcagcttgatacccacatggagctatattctcagctcaaggctaaagaggagacatataatcagctgctggacaaaggacgactgatgctgctgtcacgggacgattcgggttcgggatctaaaaccgaacagtccgtagcgctgttagaacagaagtggcacgttgtttcttccaagatggaagagcgtaagtctaagctggaagaggcgttgaatctggctaccgagttccagaactcgcttcaggagtttataaattggcttacactggccgaacagtccttgaacatagcatctcctcctagcctcatactcaacaccgtgctgtcacaaatcgaggaacacaaggtcttcgccaatgaggtgaatgctcacagagaccagataattgaactggatcagaccggcaatcagctgaaatttctgtcccagaaacaggatgtggtgctgatcaaaaacctgctagtttccgtgcaatctagatgggagaaggtggtgcagcgctccatcgaacggggtcgatctttggatgacgctaggaagagagcaaagcagtttcacgaagcctggaaaaagctaatcgattggcttgaagacgccgaatcgcatctggactccgaactcgaaatatctaatgatccagacaaaatcaaactgcagttatccaaacacaaagagttccagaagacactagggggaaagcaaccagtctatgatacaaccatcaggacggggagagcgcttaaggagaaaacccttttacctgaagactcccagaaactggacaattttctaggcgaggtgcgcgacaaatgggacacagtctgtggaaagagcgtggaaagacaacataagctggaggaagccctgctgttcagcggccagttcatggacgcattacaggccttggttgactggctgtacaaggtagaaccacagctcgccgaggaccagcctgtgcatggggacttggacttggtcatgaacttaatggatgcccataaggtctttcaaaaggagctggggaagcgcaccggaaccgtccaggttctcaagagatcaggacgcgagctgatcgaaaactctcgtgatgacacgacgtgggttaaaggacaactgcaggaactctccactagatgggacaccgtgtgcaagctcagcgtctctaagcagtcccgactagaacaggccctgaagcaagccgaggtgtttagggacaccgttcatatgctgcttgagtggctgtcagaagcggagcagacactgaggtttcgcggtgccctgccagacgataccgaggcccttcaatccctaatagatacgcacaaagagttcatgaaaaaggttgaggaaaaaagggtggacgtcaattctgccgttgcaatgggtgaggtgattctggccgtttgtcaccctgactgcatcactacaatcaaacactggattactatcatccgtgcaaggttcgaggaagttcttacttgggcgaaacaacatcagcagcgactggagacagccctgagcgaactggtggccaatgctgagctattggaggagctgctggcttggattcaatgggcagaaaccaccctgatccagagagaccaggaaccgatccctcagaacatcgacagagttaaagcattgatagcagagcatcaaacgttcatggaggaaatgacgcgaaaacagcccgacgtcgaccgcgtgacgaagacatacaaaagaaagaacatcgagcctacccacgcaccatttatcgagaagtcaaggtcggggggtagaaaaagcttaagccaaccaaccccacctcctatgcctattcttagtcagtctgaggccaaaaatccccgtattaaccagctgagcgcgagatggcaacaggtgtggctgcttgctctggagaggcagaggaagctgaatgatgctctggatagattggaagaactgaaagagtttgctaattttgactttgatgtatggcgtaaaaaatatatgagatggatgaaccacaagaaatcacgggtgatggatttttttaggcgcatcgacaaagatcaggacgggaagattaccaggcaagaatttattgacggcatcctggcaagcaaattccccaccactaagctcgaaatgaccgcggtagccgatatatttgatagggacggcgacggctacatagattattatgaatttgtggcggctcttcacccaaataaagacgcttaccggccaaccacagacgccgacaagatagaggatgaggtgaccaggcaggtggcgcagtgcaaatgcgccaaaaggtttcaggtggagcaaatcggcgagaataaatataggttcggagattcacagcagcttcgactcgtacggatcttaagaagcactgtgatggttagagtgggcggaggatggatggcactcgatgagttcctcgttaagaatgatccctgccgggcacgaggtcggactaatatcgaattgcgggaaaagtttattttgccggaaggtgccagtcaaggtatgaccccgttccggagccgcggacggaggtctaaaccatcctcacgagctgcctctcccactaggtccagctcaagcgcgtctcaaagtaatcactcatgcacttccatgccttcatctccggcaactcccgcatccggcactaaagtgattccatcttctggaagtaaactgaagaggcctacacctaccttccatagcagcaggacgagcttggctggcgatactagcaactcgagtagccctgcctctaccggggcaaagaccaatagagcagatccaaagaaaagtgcatcacgccctggctcacgggcagggtcccgtgccggaagtagggcatcaagccggagagggagtgatgcatccgatttcgatttgttagaaactcagagcgcctgctcagataccagcgagtcctccgcggctgggggacagggaaattcgaggagagggctaaacaagccatccaaaattcccaccatgagcaagaagaccactaccgccagccccaggacaccaggccctaagagatag

SEQ ID NO: 230541 - DNA, 16293 bp, Artificial Sequence
  Description of Artificial Sequence: Synthetic coding sequence
atgagctcaagtgacgaggaaaccctgagcgagaggagttgccgaagtgagcgaagttgtcgcagcgagcggtcttaccggagtgagcgctccggttctcttagcccatgtcccccaggagatacgctgccatggaatttgccgttgcatgagcagaaaaaacgcaagagccaggactctgtcctcgatcccgctgagcgtgccgtggtgcgggtggcagacgagagggatagggtccaaaagaagacattcaccaagtgggtgaacaaacacctgatgaaagtgcggaagcacattaatgatctgtatgaggatctcagagacgggcataatctgatatccctactggaggtgctaagtggcatcaaattgccaagggaaaagggacgcatgcggtttcaccggctgcagaacgttcagatcgccctggacttcctcaagcaacggcaagtgaaattagtgaacataaggaacgatgatattaccgacggcaacccaaagctgacactgggcctgatctggaccattattttgcatttccaaatctcggacatttatattagcggagagagcggcgatatgtcagctaaagagaagcttctcctatggactcagaaagtaaccgctggttacacgggaatcaagtgcaccaacttttcttcctgttggtcggatggaaagatgtttaacgctctgatccaccgttaccggcctgacctagtggacatggagcgcgtgcagatccaatccaatcgcgaaaacctggaacaggccttcgaagttgcggaaagattgggggtgactcgtctcctcgatgctgaggatgtcgacgtgccttcgcccgatgagaagtccgtgattacgtatgtctccagcatttatgatgcttttcccaaggtccccgaaggaggggaaggcatcagtgcaacggaggttgattcacgatggcaggaataccagtctcgggtcgacagcctgatcccctggattaagcagcacacaatcctgatgtcagacaaaacttttccccagaaccccgttgaactgaaagcactttataaccagtatatccatttcaaagagacggaaatcttggccaaagaacgcgagaaaggaaggatcgaggagctttacaagctgctcgaggtatggatcgagttcggtcgcattaaactgccccagggttaccatccaaacgatgtcgaggaagagtggggcaagctgataatagaaatgcttgaacgcgagaaatcattgcgtccagccgttgagcgcctggaactgcttctccagatcgcaaataaaatccaaaacggtgcactgaattgtgaggagaaattgaccctggcgaagaacactttacaagcagatgcagcccacttggagtcgggccagcctgtccaatgtgagtctgatgtaataatgtacatccaggagtgtgaaggtctgattcgacagcttcaggtggatctgcagattctcagggatgagaactactaccagctcgaggagctcgcttttcgggtgatgaggcttcaggatgaattggttaccctgaggctggagtgcaccaatttgtaccgcaaaggacacttcaccagcctggaacttgtgccgccaagtacactgacaaccacacacctgaaggccgagcccctcactaaggccacccatagcagtagcaccagctggtttaggaagccgatgacaagagcagaactggtagctatttcttcatccgaggacgaggggaacttaagatttgtgtacgagctgctttcctgggtggaagaaatgcagatgaagctggagcgggctgagtggggaaacgacctgcccagcgttgagctccagctcgagacacaacagcacatccacacctccgtagaggaactaggttcatctgtgaaggaggctagactatacgagggaaagatgtcgcagaattttcacacttcgtatgcggagactttgggcaaactcgaaacgcagtactgtaagctgaaagagacgtccagtttccgaatgaggcacttgcagagtcttcacaagttcgtgtccagggctacggctgagctgatttggctgaatgagaaggaggaggaagaactggcctatgattggagcgacaacaattctaatatctctgctaaacgcaattactttagcgagctgaccatggagctagaagagaaacaagacgtgtttcggtccctacaggacactgctgagctcctgtcgctcgaaaatcaccctgccaagcaaacggtggaagcttactcagccgctgtccagtcccagctgcaatggatgaaacagctttgcctatgcgtggaacaacacgtaaaggagaatacagcctattttcagtttttcagcgacgctcgcgagctggaatcctttcttaggaatttgcaggatagcatcaaaagaaagtactcctgcgaccacaatacgagcttaagcagactggaagacctactgcaggacagcatggacgaaaaggagcagttgatccaatccaaatcttcagtggcttccttggttgggaggagtaagactattgttcagcttaaacctagatctccagatcacgtgcttaaaaataccatcagcgtgaaagctgtgtgtgattacaggcagattgagatcactatctgcaaaaacgatgaatgcgtgctcgaagacaattcacaacggaccaaatggaaagtgatcagccctactggtaacgaagccatggtgcctagcgtttgtttccttatcccccctcccaataaggatgcgatcgagatggcctctcgcgtggaacagagctaccagaaagtgatggcactgtggcaccaactccacgtcaataccaagagtctgattagctggaattatttgcggaaggacttggacttggtgcagacatggaatctggagaagctgcggagctctgctcctggagaatgtcatcagattatgaaaaatctccaggcgcactacgaggatttcctgcaggactctcgggattccgttctgttcagtgtcgccgatagacttcgcctagaagaggaagttgaggcgtgcaaggccagattccagcacctgatgaaaagcatggaaaatgaagataaagaggaaaccgtggcaaaaatgtatatttcggaactgaaaaatatcaggttacgtttggaggagtacgagcaacgtgtagtcaaacgcattcagagtttagcctccagccgaacagatcgcgacgcgtggcaggataacgctttgcggattgccgaacaagaacatacccaggaggacctgcagcagcttcgctctgatctggatgctgtgagtatgaagtgtgattccttcctgcatcaaagcccctcatcaagttctgtgccaaccctccgttcagaacttaatctgctggttgaaaaaatggatcatgtttacggcttgtcaacagtctatctaaacaaattgaagacagtcgatgtcatcgtgcggtcgatccaggatgcagagcttctggtgaaagggtacgagatcaagctgagccaggaagaggttgtccttgcagatctgtcagctctcgaagcacactggtcgactttgaggcactggttgtcggatgttaaagataaaaattcagtcttttcagtgctggacgaggaaattgctaaagcaaaggtggtggcagagcagatgagccgcctgacacccgaacgtaaccttgatcttgagcgataccaggagaaaggctcccaactgcaggagaggtggcacagggttatcgcgcagcttgagatacgtcaaagcgaattggagagcatccaggaagtactgggagactatcgggcatgtcatggcacgctgatcaaatggatagaggagaccactgctcagcaagagatgatgaagccaggacaggccgaggattctcgggtgctctcagagcagctgagccagcagacagctctttttgccgaaatcgagcgtaaccagacaaaattagaccagtgtcagaagttctcccagcagtattctactatcgttaaggactacgagttacaacttatgacatacaaagcctttgttgaaagtcagcagaagagccccggaaaaaggcggaggatgctgtccagctccgacgcaataacccaggagttcatggacctaaggacccgctacactgccctggttactctgacaacacagcatgtcaaatacataagcgacgcattgcggaggctggaagaggaagaaaaggtagtcgaggaggaaaagcaggagcatgtcgagaaggtgaaagagttattagggtgggtgtcaacattggcccgtaacacccaaggtaaagcgacatccagtgagacaaaggagagtactgacatcgagaaggccattctggaacaacaagtgctttctgaggagctgactacaaaaaaagaacaggtttctgaagctatcaagacatctcaaatcttcctggcgaagcatggccacaagctgagcgagaaagaaaaaaaacaaattagtgaacagctgaacgcactgaataaagcatatcacgacctgtgtgacggtagtgccaatcaattacagcaacttcagtctcagctcgctcatcagactgagcaaaagactctccaaaaacagcaaaacacttgtcatcagcaactggaagatctgtgctcatgggtggggcaggcagagcgagccctggccggtcatcagggacgcactactcaacaagacctctcagcgttgcagaagaatcagagcgatctgaaggacctacaggacgacattcagaatagggccacctctttcgccacggtcgtcaaagatatcgaggggttcatggaagagaaccagacgaaactgagtccacgtgagctgacagcactccgagagaagcttcaccaggccaaggaacagtacgaagctttgcaagaagagaccagagttgcccagaaggagctggaagaagctgtgaccagcgcattgcaacaggaaaccgaaaagtcaaaggcggcaaaggagttagccgagaacaagaagaaaattgacgcattgcttgactgggtcaccagcgtgggatctagcggcggtcagctcctgacaaatcttcccggaatggaacaattgtctggtgcatccctggagaaaggagccctagatactactgacggttatatgggggtcaaccaggctcctgagaagctggacaagcagtgcgaaatgatgaaggctcggcaccaggagctattatcgcagcagcagaactttattctggccactcagtccgcccaggccttcctggatcagcacggacacaacctgactcctgaagaacaacagatgcttcagcagaaacttggcgagctgaaggagcaatattcaacgtcgctggcccagagtgaggccgagctgaagcaagtgcagaccctgcaggatgagctgcagaagttcctgcaggatcacaaagagttcgaaagctggctcgagcgctccgaaaaggagctagaaaatatgcacaaaggaggatcttcccctgagaccttgccctcgctccttaagcgccagggtagtttttccgaagatgtgatttctcataagggtgacctgaggttcgtgacgatcagcggccagaaggttcttgatatggagaattctttcaaagaaggaaaggaaccctccgagattgggaatttggtcaaagacaagttgaaggacgccacagagcgatacacagccctccactccaaatgtacccgactaggtagtcacctcaacatgctgctgggacagtaccaccaattccagaactcggccgattctctgcaggcctggatgcaggcttgcgaggctaatgtggagaaactgctgtcagacacagtggcctctgatcccggtgtcctacaggagcaactggcaactaccaagcagttgcaggaggaacttgctgagcatcaggtgccggtcgaaaagctgcagaaggtggcacgagatatcatggagatagagggagagcctgccccagatcatcgtcacgttcaggagaccacagactctatcctctctcatttccagagtcttagttacagccttgctgagcgcagctctctgctacagaaggccattgcccagtcccagtccgtccaggagtctctcgagtctctcctgcagagcatcggagaggtagagcaaaacctcgaaggaaaacaagtgagctcattatcgagcggtgtgatccaagaggctcttgcaactaatatgaagcttaagcaggatattgcaaggcagaaaagtagcctcgaggctactagagaaatggtaacgagatttatggaaaccgcagactctacgaccgctgctgtgctgcaggggaaacttgctgaagtgtcgcagaggtttgaacagctctgtctgcaacagcaggagaaagagagcagccttaaaaagctgctcccgcaggctgagatgttcgaacacctgtccgggaagctacagcagttcatggagaacaaaagtagaatgctggcctctggcaaccaaccggatcaggatataacccactttttccagcaaatccaggagctgaacctggagatggaggaccagcaggaaaacctggacaccctcgagcatctcgtcaccgaattgtcatcctgcggttttgctttagacctctgtcagcaccaggacagagtgcaaaatctgcgaaaggatttcacagagctgcagaaaactgtgaaggaacgggaaaaagacgccagctcatgtcaagagcagcttgatgagtttagaaagctggtgaggacctttcagaagtggctgaaagaaactgagggctccattccacctaccgagacatccatgtccgcaaaagaactggaaaaacagatcgagcatttgaaatccttgctggatgattgggccagtaaaggtactctggttgaggagatcaactgcaagggaactagcttagaaaatctgatcatggagattacagctcccgacagtcagggaaaaaccggatctattctcccgagcgtcggctcatcagtgggatcagtgaacggataccatacatgcaaagacctgactgagatacagtgtgacatgtccgacgttaacctcaaatacgagaagctgggaggagtgcttcacgaacgacaggagtccctccaggccattctcaataggatggaggaggtccataaagaagccaattccgtgcttcaatggctggaaagtaaagaagaagtgctcaaaagtatggatgccatgagctctcccaccaaaaccgaaacagtcaaggcacaggcggagtcgaataaagctttcctcgccgaattagaacagaattccccaaagatccaaaaggtcaaggaggctcttgcgggactgttggtgacctaccccaactctcaggaggctgagaattggaaaaagatccaggaggaactcaacagccggtgggaaagagctacagaggttactgtggctagacagagacagctggaagagtcagctagtcacttggcctgcttccaggctgcggaatcccagctcagaccttggctgatggaaaaggaattgatgatgggtgtcctgggaccactctctatagacccaaacatgttgaatgcccaaaagcagcaggtccagtttatgttgaaagagttcgaagctcgcagacagcaacacgaacagttaaacgaagcagcccagggtattttaacgggtccaggggatgtcagtctctccacctcccaggtccaaaaggagctgcagagcatcaaccagaagtgggtggaactgacagacaaactaaactcccggtcgtctcagatcgatcaagcaattgtgaagtcaacccaatatcaggaactgcttcaggatttaagcgagaaggttagagccgtgggtcagcggctctcagtacagtcggcaataagcacacagcccgaagctgtgaaacagcaactggaggagacaagtgagattcgctcagacttggagcagctagatcatgaagttaaggaagcgcaaacactctgtgatgagctctcagtcctgatcggggagcaatacctgaaagatgaactcaagaagaggctcgagaccgtcgccctgccccttcaaggcttagaagacttggccgctgacaggataaacaggctccaagcggctctggcatcaacacagcaattccagcagatgttcgacgagttaaggacctggttagacgacaagcagagtcagcaggcaaaaaactgtcctataagcgcaaaattggaacgtctgcaatctcaactgcaagaaaacgaagagttccagaaaagtctgaaccaacactctggaagttacgaggtgattgtcgccgagggtgaaagcctcttgctgagtgtcccaccaggggaggagaagaggacactgcagaaccaacttgtagagctcaaaaaccactgggaagagctgtctaaaaagaccgccgaccgacaaagtcgactgaaagactgtatgcagaaggcccagaaataccaatggcatgtcgaagaccttgtgccctggatcgaggattgcaaggcaaaaatgtccgaactgcgcgtgaccctcgatccagtccaactggaatcctctctgttgaggagtaaagcaatgcttaatgaggtggagaaaaggcgttcactcctcgagatccttaactcagcggctgatatcctgatcaactccagcgaggccgacgaggacggcattcgagatgagaaggctggcataaaccagaacatggacgccgtaactgaggagctgcaggctaaaaccggctcactggaagaaatgacccaacggctccgtgaatttcaggaaagctttaagaacattgagaagaaagtggagggcgcaaaacaccaactcgagatatttgacgctctcgggagccaggcgtgctctaataaaaaccttgaaaaattgagggctcaacaggaggtgctgcaggccttggagccacaggtcgactatctgcgcaactttactcaaggattggtagaagacgctccagacggatctgatgccagccaactattgcaccaagccgaggtggctcagcaggaatttctcgaagttaagcaacgagtaaactctggatgtgtaatgatggaaaacaagctggagggaattggccagtttcattgccgcgtgagggaaatgttcagtcagctggccgacttggacgatgaactggacggtatgggggctatcggcagggataccgactcactgcagtcccagatcgaggatgtgcgactgtttctgaataaaatccacgtgctcaagctggatatcgaggcatccgaagctgaatgtcgccacatgctggaggaggaaggaactctggacctgctgggacttaagcgagagctagaagccttaaataagcagtgtgggaagttaactgagcggggaaaggcccgacaggaacagcttgagctcaccctgggaagagtggaagatttttaccgtaaattaaaaggtttgaatgacgcgacaacagccgcagaagaggccgaggcactgcaatgggttgttggcaccgaggtcgaaattatcaaccagcagttggccgactttaaaatgtttcagaaggagcaggttgatcccctccagatgaaattgcaacaagtcaacggccttggccagggcctcatccagtctgcaggcaaggattgcgacgtacaggggctcgaacatgacatggaggagatcaacgcaagatggaatacgctgaacaagaaggtggctcagcggatcgcgcagttgcaggaggcattgctgcattgtggaaaatttcaggatgcgcttgagccacttctcagctggctcgccgatacagaggaactgattgctaatcagaagcctccatctgcagaatacaaagtggtcaaggcccagattcaagaacagaaactgctgcagaggcttttagacgataggaaggctactgtggacatgcttcaagcagaaggcggacgcatcgcacagtctgccgaacttgcagatagggagaaaattacaggacagctggagagtcttgagagtcgatggacagagctacttagtaaagcagctgctcgccagaaacagctcgaggacatactcgttctggccaaacagttccacgagaccgcagagccaatttctgactttcttagcgttaccgagaagaaactggcaaactctgagcctgtgggcacccagacagcaaaaattcagcagcaaatcattcggcacaaggccctggaggaagacattgagaatcacgcaacagacgtccaccaggccgtgaagatcgggcaaagcctgagtagtcttacttcaccggcagaacaaggtgtcctctctgagaagatcgatagcttacaggcaaggtattccgaaatccaggacaggtgctgcagaaaagccgctctgttggaccaagctttgtctaatgctcggctgttcggggaggacgaggtggaggtccttaactggttagcggaagtcgaagacaaacttagctccgtgtttgtcaaagatttcaagcaggacgtccttcaccgccaacatgccgatcacctggcacttaacgaagaaattgtgaataggaagaagaacgtggaccaggccatcaaaaacgggcaggctttactaaaacagactaccggcgaggaggtgctgctcatccaggaaaagctcgatggaattaaaacaaggtacgcggatattactgtgacctcatctaaagccctgcgcaccctggagcaggcgagacagttagctacaaaattccaatctacctatgaggagcttactggctggctcagagaggtcgaagaggagctggcaacctcagggggacagagccccacaggggagcagattccccagttccagcagcggcagaaggagctaaaaaaagaggtgatggaacacaggctcgtgctggataccgtgaatgaggtgtcaagggcactactcgaactcgtgccttggcgagcaagagaggggttagataaactggttagtgatgcaaacgagcaatacaagctggtctctgatacaatcggccaaagggtggatgaaattgatgccgcaattcagcgctcacaacagtacgaacaagccgctgacgctgagctggcctgggtcgctgagaccaagcgcaagctgatggctctcggacctatcaggttggagcaggatcaaactaccgcccagcttcaagtccagaaggcattcagtattgacattattcggcacaaggatagtatggacgaacttttctcacatagatccgaaatcttcgggacttgcggcgaggaacagaagacagtgctgcaggagaagaccgaatctttaatccagcagtacgaagccatcagcctgctgaattcagagagatacgctcggctggaacgcgcacaagtgttagtgaatcaattctgggaaacgtatgaggagctgagtccctggatcgaagaaaccagagccctcatagcccagttacctagccctgccatcgaccatgaacagttacgtcagcagcaggaggaaatgcggcagctacgagaatctatcgccgaacataaaccacacatcgataaactgctcaagatcggtccacagctgaaggagttgaacccggaggaaggggaaatggtcgaagagaagtatcagaaagccgaaaatatgtacgcccagatcaaggaggaggtccggcagcgtgccctggctctggatgaagccgtatcccaatctacccaaattacggagtttcatgataaaatcgagcctatgctggagactctagaaaatttatcttcacggctgagaatgcccccactgatcccagccgaagtagataaaatacgcgagtgcatatccgacaataaaagcgctaccgtcgagcttgagaagcttcaaccctcattcgaggcactcaagcgcaggggagaggaacttatcggaaggagtcagggcgcagacaaagacctcgctgcaaaagagatccaagataagctggatcagatggtctttttttgggaagacattaaagcgagagctgaggaacgtgagataaaatttctagacgtgcttgaattggctgaaaagttctggtacgacatggccgcactcttaaccactataaaggatactcaagacatcgtgcatgatctcgagtctccaggcatagatccaagcatcattaaacaacaggtggaagccgctgaaaccattaaggaggagacggatggactccacgaagaactcgaattcattcgtattctcggagctgaccttatcttcgcctgcggcgagacagaaaaaccagaagtccgcaagagcatcgacgagatgaacaatgcctgggaaaacctgaataaaacctggaaagaaagacttgaaaagctggaggatgcgatgcaggcagccgtacagtatcaagacaccctgcaggcgatgtttgactggctggataacactgtgatcaaattgtgcacaatgccacccgtgggaacggatctgaatactgtcaaggaccagctcaatgagatgaaggagtttaaagtagaagtgtaccagcagcagatcgagatggagaaactcaatcatcagggcgaactaatgctgaaaaaggctaccgacgagacagacagggacattatcagggaaccactgaccgaattgaaacatttgtgggagaatctgggagagaaaattgctcatcgacaacacaaactggagggggcactgctcgcgttgggccagtttcagcacgccctggaagagctcatgtcctggctgacccacaccgaggagctcctggacgcacaaaggcctatcagcggtgacccaaaagttatcgaggtggagctggctaagcatcatgtcttaaaaaatgacgtgttggcacaccaagccacagtggagaccgtgaacaaggctggaaatgagctgctggaaagcagtgctggtgacgatgccagttccctgagatcacgattagaggctatgaaccagtgctgggagagtgttctccagaagaccgaagagagggagcagcagctccagtctaccctgcagcaagcacagggattccacagtgagattgaggattttcttttggagttaaccagaatggaatcacaactcagcgcttcgaagcctaccgggggtttacctgaaaccgcaagggagcaacttgacacccacatggaactatattctcaactgaaggctaaggaggagacatacaatcagctccttgacaagggcaggctgatgctcctctcccgtgacgattcaggttccgggagcaagacagaacaaagcgtcgccctgctggaacaaaaatggcatgtcgtgagctccaagatggaggaacggaagtccaaacttgaggaagccctgaatctagcaacagagttccagaattctctgcaagagtttatcaactggctcaccttggctgaacaatcattgaatattgcgtcccctcctagcctgatactgaacaccgtactcagccagatcgaggagcacaaggtgtttgcaaacgaggttaacgcccacagggaccagatcattgagctggaccagaccggcaaccagcttaagtttttaagtcagaaacaggatgtggtcctgattaaaaacctgctggtgagtgtccagtctcgctgggaaaaggtggtccagcgctcaatagaacgcggaagaagcctggatgatgccaggaagagggccaagcagttccacgaagcctggaaaaagttaatcgactggctcgaggacgccgaaagccatctggacagtgagttggaaatctctaacgatccagacaagatcaagcttcagctgtccaagcacaaagagttccaaaagaccttagggggaaaacagcccgtgtacgacaccacgatccgcacggggcgtgccctgaaggagaagacccttctacctgaggattcgcaaaagctcgacaactttttgggcgaggtcagagataaatgggacaccgtatgcggtaaaagcgtggaacgccagcataagctggaggaggctctcctattctctggacaattcatggacgctcttcaggcacttgtcgattggctatataaggtcgaacctcagttggccgaggatcagcctgtgcacggcgatttagacctggtcatgaatctgatggacgcccacaaggtattccaaaaggaactcggcaagaggacaggaactgtgcaggtactaaagaggtcaggcagagagctgatcgagaatagtcgcgatgataccacctgggtcaaaggccagctgcaagagctgagcaccagatgggatactgtttgcaaactgtctgtgagcaaacagtcacgactggaacaggctttaaagcaggccgaggtattcagggacacagtccacatgcttctagaatggctttccgaggccgagcagactctgaggtttcggggagccctgccggacgacacagaagccttacaaagcctgatagacacccataaggagttcatgaagaaggtggaagaaaaaagggtggacgttaactccgcagttgccatgggtgaggtgattttggcggtctgtcaccccgattgcattacaacgatcaagcactggataactatcataagagcaaggttcgaagaggtactgacgtgggccaaacagcaccaacaaaggctcgaaaccgctcttagtgagttagtggccaacgccgaactgttggaggaactgttagcatggattcagtgggcagagactacacttatccaaagagatcaggagcccatcccccagaatattgaccgagttaaggccctgattgctgaacatcagactttcatggaggaaatgaccaggaagcagccagatgtagatcgggtcaccaagacatacaaacgaaaaaacatagaacccacccatgctcccttcattgagaaatcaagaagtggcggtcgcaaatcattgagtcagcctacacccccacctatgccaattcttagccagagcgaagccaaaaatcctaggatcaatcagctgtcggcgagatggcagcaggtttggctgctggccttagagcgtcaacgaaaactgaatgacgccctggacaggctggaagagttaaaggagttcgctaattttgactttgatgtttggagaaagaagtatatgcgatggatgaatcataagaagtcccgtgtgatggacttctttcgtagaatagataaagaccaggacggtaagataacccggcaggagttcatcgacggcatactggcttctaagtttcccacaactaagctcgagatgactgctgtggctgatatcttcgatcgagacggcgacggctacatcgactattatgagttcgtggctgcccttcaccccaacaaagacgcgtatcgtccgaccaccgacgccgacaagattgaggacgaggttactcgccaggtggcccaatgtaagtgtgccaaacggtttcaggtcgaacagatcggtgagaataaatacaggtttggggattcacagcagctgaggcttgtgcgcatcctacgttcaacagtgatggttcgagtggggggaggttggatggccctcgacgaatttcttgtcaaaaacgacccatgccgagccaggggacgcactaacatcgagctgagggagaaattcattctacctgagggggcttctcagggcatgacaccttttcgaagcaggggcagacgctccaaaccctcttcaagagctgcttccccgacgcgatcgagcagtagcgcctctcagtcgaaccacagctgtacctcgatgccttcgagccctgctacccctgcgagcggcaccaaggttattccttcatctggctccaaactaaaaaggccaactccaactttccacagtagtagaacatccctggccggtgacacctccaactcttcatcaccagcaagcactggcgctaagaccaaccgcgcagacccaaagaagagcgcctctcgtcctggtagccgggctggaagccgagccggttctcgggcttcgagtaggaggggtagtgacgcttctgattttgaccttctagaaacccagagtgcatgctctgatactagcgaaagctcagcagctggcggacagggcaactctcgaagaggacttaataaacctagtaaaatccccactatgagcaagaagactacgactgctagtccccgaactcctggcccaaaaagataa

SEQ ID NO: 230542 - DNA, 3188 bp, Artificial Sequence
  Description of Artificial Sequence: Synthetic coding sequence
atgggcaacagcctcggatgcttcaaggaaccaaaggaaagtatcgcaatacctgagaaggctccgatcagccccaagaagagggtcagatttaaaaggcggtggaggggaaaaaagattccaacacctgaggcatcacaccaggaagagacttctgagggaacgggtgttatcgaggaaacagaaacactgacaaagctgaccgagtcgttgcagaaggaggacggggtgggcggtgtggagcataccccacccgatattttgttgccaggagattcagcccctaactccagagttgtggaccgaggaatgatcgtacaggtaaaggaacgatttcaaggcgaggttcagaccgcccacctgttactcgagaatgaaagttctgtggccggaggcgtctgggacagccttgaagagggtatgaccgtgatcgcacaccttctggataatcccgcagaacggaattgcgagaagtctgtgtctcagctcgtggagttcccccgaactgctagttgttcctcccgagccgtactcctaccattgcaaggagagacagccgtggagaaggggaacatccaaaggggatttaggtcatgcgccctcccacgcacggactatcctacggacaaaggcaatcaggaacaatttagtgaagggtggtcggtggaggaaggcactaagtcggtgtccggggctccccagaccgcgtcttggatcatcgaatgctctgtatctagtctgctcctcgatcagcccggaggtcaacgtagaaccgaaccatctcacgtgggacaggtccctccacaggactctaggctgcctacctctcagtcagatctgtccattagtggcgttacggtgtctatccttccttcaagcagcgggtacggcagtgatggccctcatatacatggaattcagcccaaggataccgaacccgagaagagtagtactagcttctccgaggaggacgggacattgagcttggaggcaagccacactccttcatgggggctggaagaaatcagcgacatttacattagcggggagagcggggacatgagtgcaaaagaaaagctgctcttatggacgcaaaaagtaaccgccggatacactggaataaagtgcacaaatttctcgagctgctggtccgacggcaaaatgtttaatgccttgattcacagataccggcctgatctcgttgatatggagcgcgtccagattcagagcaaccgcgaaaacctcgagcaggccttcgaagtggctgagcgcctgggcgtgactagattgcttgatgctgaggatgtagacgttccctcaccggatgaaaaaagcgtgattacctacgtcagcagcatctatgatgcattccctaaagtccccgagggcggagagggcatcagcgctacagaggttgacagtagatggcaggagtaccagagtagagtggacagcctgatcccttggataaaacagcataccattctgatgagtgacaagacgttcccacagaatcccgtggagctcaaagctctgtataatcaatatatccatttcaaggagaccgaaatactcgctaaggagagggagaaaggaaggattgaggaattgtataagctcttggaagtgtggatcgagttcggacgcatcaagctaccccaggggtaccaccctaatgatgtggaggaagagtggggtaagctgatcatcgaaatgcttgagagagagaagtctttgaggccggcagtagagcggctcgagctgcttctgcagatcgcaaataagatccagaacggtgccttaaactgcgaagagaagctgacactggctaagaacacgcttcaggcagacgctgctcacctggagtctggccaaccagtgcagtgcgagtcagacgtgattatgtacatacaggaatgcgagggactcatccgacagctccaggtggaccttcaaatcctgcgcgatgagaactattatcaactggaggagcttgccttccgcgtgatgcgactccaggatgagctggtaacgctgaggctggaatgtaccaatttgtataggaagggacacttcacttccctcgagttggttccaccttctacgctcaccacgacccatctaaaagccgagcctctgacaaaggccacccactcttctagcacctcttggtttcgtaagccaatgacacgtgctgaattagttgcaatctcgtcaagtgaagatgaagggaaccttagattcgtgtatgagctgctctcatgggtggaagagatgcagatgaaactcgagagagcagagtggggcaacgacctccctagtgttgagctgcagctcgagacacaacaacacattcacacttcagtcgaggagctcggcagtagcgtcaaagaggctaggctttacgaaggaaagatgtcccagaattttcacacttcatacgcagagactttaggcaagctcgagactcagtactgtaaactgaaggaaacatcatcgtttcgaatgcggcatcttcagtctctccataaatttgtttccagggcgaccgcggagctcatctggcttaatgagaaagaagaagaagaactggcgtatgattggtccgataacaattctaacatttccgccaaaaggaactatttctcagagctaaccatggagctcgaagaaaagcaagatgttttcaggtcgctgcaggatacagctgagctactgtccctcgagaaccatccagctaagcagacagtcgaagcctacagcgccgctgtacagagtcagctacagtggatgaagcaactatgtctgtgtgtcgagcagcacgttaaagaaaacactgcgtactttcaattcttctccgatgccagagagctagaatcttttctcaggaacctccaagactccattaagaggaaatactcttgcgaccataacaccagtttaagtaggctggaagaccttctgcaggattctatgttccaagacgaaaaggaacaactgatccagtctaagagctccgtggcctcacttgtcggtagatcaaaaacgattgttcaacttaagccaaggtctcccgaccacgtcttaaagaacacaataagtgtgaaagcagtgtgcgactatcgccagattgaaggtagaacaatcctgtctgagggttacgggcctttggcttccgccgcttgcta

SEQ ID NO: 230543 - DNA, 22167 bp, Artificial Sequence
  Description of Artificial Sequence: Synthetic coding sequence
atgtctagctcagacgaagaaactctgtccgagcgatcttgccggtccgaaaggtcgtgccgaagcgaacgtagctatcgctctgagaggtcagggagcctgtccccctgtccacctggcgacactcttccgtggaacctgcctttacatgagcagaaaaagagaaaatcccaagatagcgtgctggatcctgctgaacgggcagtggttcgggttgctgacgaaagagacagagtgcagaaaaagaccttcacgaaatgggtgaacaaacatttaatgaaggttcgtaagcacataaacgacctctacgaagatctccgcgacggacataatctgatctccctgctggaggtgctgtctggcataaagcttcccagagagaaagggagaatgaggttccatagattacagaatgtgcagattgccttggacttcttgaagcaacgacaggtgaagctcgtaaatatccgaaacgacgatatcaccgacggaaaccccaaacttaccttgggtctgatctggaccattattctgcactttcagatctccgacatctatatatccggagaatctggggatatgtccgctaaagagaagttgctgttgtggactcaaaaggtgaccgccggttacactggaatcaaatgcacaaacttctcatcctgctggtctgacgggaagatgttcaacgcgctaatccacaggtataggcccgacttggttgatatggaaagggtgcaaattcagagcaatagggaaaacttggagcaggctttcgaagtcgccgagaggttgggcgtgacaagactgttggatgctgaggatgtcgacgtacccagcccagatgaaaaatcagtgatcacctatgtgtcatcgatttatgacgccttcccaaaggttcccgaaggaggtgaggggatcagtgccacggaggtcgactctagatggcaagagtaccaaagcagagtagattccttaataccgtggataaagcaacatacgatactgatgagcgacaagacctttcctcaaaaccctgtggagttaaaggctctttacaaccaatatatccactttaaagaaacagagatcctcgcaaaggagcgcgaaaaggggcgaatcgaagaactatataagctgctcgaagtttggattgaatttggtagaatcaaactgcctcagggataccatccaaatgatgtcgaggaggaatggggcaagctgattatcgagatgctcgaaagagagaagtccctccgacccgctgtagaacgtctggaacttctgctccagattgccaataagatacagaatggggctctcaactgtgaggagaaattaacactggccaagaacaccctgcaagctgacgccgcacatttagagtctggtcagcccgtgcagtgtgagtctgacgttatcatgtatattcaggagtgtgaaggacttatcaggcagctgcaggtcgacctccagatcttaagggacgaaaattactatcagctcgaggaactcgcttttcgcgtcatgcggctccaggatgagttggtcacactgcggctggagtgcactaacttgtaccgtaaaggccacttcacatccctggagctggtccccccaagcacgctgacaaccacccatttgaaggcggaaccgctgactaaagccacgcattcaagctctaccagctggtttcgcaaacccatgacgcgggctgagttggtggctattagttcgtcagaggatgaagggaatcttcggtttgtttacgaacttctctcttgggtggaagagatgcagatgaaattggagcgggctgagtgggggaatgatttgccatccgttgaactccaactcgagacccagcagcatattcacacttctgtggaggaacttggcagtagcgttaaggaggctagactttacgaggggaagatgtctcagaatttccacacctcatacgccgaaacactggggaagctcgaaactcaatattgtaagctgaaggagaccagtagttttcggatgaggcaccttcagtccttacataaatttgtgagccgcgcaactgccgaactcatatggttaaatgagaaagaggaagaagagctcgcgtatgactggtccgataacaacagtaacatttctgctaagcggaactatttcagcgaactaacaatggagctcgaagaaaagcaggacgtgtttaggagcctccaggacacggcagaactgctctctctggaaaatcaccccgcaaaacagacagttgaagcgtacagcgctgccgtgcagtcgcagctgcagtggatgaagcagctgtgcctttgtgttgagcagcatgttaaggagaacacagcctacttccaatttttctcagacgctagagagttagagagtttcctgcgcaacctgcaagacagcattaaacgtaagtacagttgcgatcacaacacctcattgtcccgtcttgaagacctgctacaggactccatggacgagaaagagcagctcatccaaagcaaatcaagtgtcgccagcctggtggggaggtccaaaactattgtccagctgaaaccccgatccccagaccacgtgttaaagaatacaatctcagtaaaagctgtatgtgactacaggcaaatagagatcactatatgtaagaacgacgagtgcgtactcgaagataatagccagcggactaaatggaaagtcattagcccgactggcaatgaagccatggtgcccagcgtatgcttccttattcctcccccaaacaaagacgccatagagatggcttctagggtcgagcagagttatcagaaggtcatggctctttggcatcagctgcacgttaacacgaaatctctgatttcctggaactatcttcgtaaagatcttgatctcgttcagacatggaatctggagaaactgagatcatccgccccaggcgagtgtcaccagatcatgaaaaatctacaggcccattacgaggactttctgcaggattctcgggatagcgtgctatttagcgtggctgaccgccttcggctcgaggaggaggtggaagcatgcaaggccagattccagcacctcatgaagtctatggagaacgaggataaggaggagacagtagcgaaaatgtatatctcagaacttaaaaacattagattgaggcttgaggagtatgagcagcgggtagttaaacgcatacagtcactcgcttcgagccgaaccgacagggacgcctggcaagacaacgctttgcgaatcgcagagcaggagcacacacaggaagatctacagcaattaaggagcgacttagacgccgtatcaatgaagtgcgacagtttcctccaccaatctccttcttcctcttccgtcccaactctgcgcagcgagcttaacctgcttgttgaaaagatggaccacgtgtatggactgtctaccgtgtatctcaacaaacttaaaaccgtcgatgttatcgtccgcagcatacaagacgccgagctcttagtgaagggatatgagataaaactttcacaggaggaagttgtccttgctgatctgtcagcgctggaggcccactggtccacgctgagacactggctaagcgatgttaaggataagaactccgtgtttagcgtgcttgatgaggaaattgctaaagctaaggtggtggcagaacagatgagcagactcacccctgaaaggaacctcgatctggaacggtaccaagaaaagggctcacagctccaggagcggtggcacagggtcatcgctcagcttgaaatccgacagtctgagttggagagcattcaggaagtgctgggggattacagggcttgccacggtactctgataaagtggattgaagaaacgacggcgcagcaggaaatgatgaaaccaggtcaggctgaggactcaagggtcctgtccgagcagttgtctcagcaaaccgctctgtttgctgagatagagcggaaccagacaaagctcgatcagtgccagaagttcagccagcagtattcaactatcgtaaaggattacgaattacagttaatgacgtacaaggcctttgtggagtcccagcaaaaatcccctggcaaacgacgtcgcatgctctcaagttccgacgccatcacacaggagtttatggacctcagaaccagatatacagctctcgtcactcttacgacacagcatgtaaagtatatcagcgacgctctcagaaggctagaggaagaggagaaggtggtagaggaggagaaacaagaacatgtggaaaaggtgaaagaattgctgggctgggtgagcacactggccagaaacactcagggaaaagcaacaagtagcgagactaaagagtcgacagacatcgaaaaggcaatcctggaacagcaggtgttatctgaggagctgactacaaagaaggagcaggtttcagaggccattaaaacatcacaaattttcttggccaagcacggtcacaagctcagcgagaaggagaagaagcaaatttctgagcagcttaatgccttaaacaaagcatatcacgatctctgcgacggatcagccaaccagcttcaacagctgcagtcccagttggctcatcagactgaacagaaagaatgcagagccgtcgctggtgtgatcgatctggggacagtcgagatcttccccatcttcaaggctatgcagaaagggttattggatcaggatactggcttggtgctgttggagtctcaagtaattatgtccggcctgattgcaccggaaaccggtgagaacctgagcctcgaggaaggaatcgccaggaatctgatcaatccgcagatgtaccagcagctccgtgaactccaagatgctttggcactcatatcaagattaacggagagtcgaggtccattgagcgtggtcgaagctattgagaaacggatcatctctgaaaccgtgggactgaagatactggaagcccatctggcaaccggtggttttagcctctctccctcggaaaattgtatcaatctggaggaagcctttcaccaggggcttatttctgcgtggctgcactctgtgcttgagtcatatttacgaacttccaaaaacctgatcgaccctaataccgccgaaaaaatcggcctgttggacctgatgcagaggtgtattgtgcatcaggagagcggctttaagctgctccctgtaaaacaactggcaggcggaatggttagccttaaatccgggcgaaaggtttcgatctttcgcgctgttcaggaaggcctgatagacaggcaggtgactgtaaggctccttgaggcccaactatttgcgggtggaatagtcgaccccaggacagggcatagactgaccgtggaggaagcagtgagacataacctcatcgatcaggacatggcctgtgccatcctcatcagacagctccagacagggggaattatcgatacggtgaccgggcagcggttgacaattgacgaggctgtgtccaacgacttggttgctgcgaaaattgcccttgtcatcctggagtccctgtggtcctttatggggctgctttggcctgagagcggggagattctcccaatcacagatgctctcgaacaggggattgtgtcaactgagctggcccacaagatcttgtctaatcggcagcacataaaggctctctttttacctgctacaacagagattctttcttggaagaaagctatagaaagcgggatacttgaccgcgacctggctaacaacttgaagtccatctgcatcccagacgttatgccacatatgcagttggcagattctgccgagcagaacatcaatccaggggctgccgttctcccttgttccaagagtcacccaaaggcgaccgcctcccagagcgaaaatctgctctttcaactgatgacccactcctatattaacgtccaaaatggacagcggttgcttctcctcgacaaagagctgatggagactcttacctctcgggacgaatatcagacatcccctccaaaggtcgtcgaaatcggccaccaacggcagaagactcccgaggggttgcaggaatccgccaacgttaaaatatcagggaccttctctagcggatggaccgtgcgactgcctgagttccagttctctagccaaaataaagagtatcctgatagagaggactgtaccaccgagaaaggaaaaaaaactacggtggaaacagaagattctagcgtggaaaacccggagcaggacctatttgttgagcagaaagagcgtaaccccaatatcgacgcccttaaggtgattaataaagtcaagttagaagtgcagcgccagttaattggaacccaaagggaggaccagactgccgtctctgttcgggaaaacgcctcaagaggccacctgctcaccattcccccagccgaagcggaaggtgtccccttagtggtggacaaagacgtgttctctgtagaaacacctaaaaaggagcaccaacccttgaggaatacatctttcacatgccagaatgaacaggcccacactctggaaactgagtatattcacgacgaaaccggcggtagccatattaagcctcagagcaaaaagctgcaggttcaggtgaaaaaaactctgggtatcaagttagaactgaagagcgagacggacgggaatgtgcaccctctggataagaaagagatgctgaagaagacgtttctggctaaggacgatcacaaggagtcccaggaggcccagaatatcgctggcggatccatgatgatgagtgagaaaactgacgaagaagattccggaagagagatatttctaagttgtagccacccactcgaactgttggaggaagctaccctgaatgtactcagcgcccagttacttgacggcggaatcttccacgagcagacaggacaaaagttgctgcttaatgaggctatttcacgagggatcgtaccatctcacaccgcagtcaagctgatggagaagctaaacatgttccaggggttcttcgactcccagacatgtgagagcttaaccacagaggaggtcattaatgagggcctcatggatgagaagcttttgcacaacgtgctgatggcagacaaggccatcagcggggtactggatccaagaactcagactttgtgtagcgtaaaagacgcagtgacagtggggctgctggacaaggagaccgccacgcgcattctggagcggcaggtggtgactgggggtattatcgatcttaagagaggaaaaaaggtatccgtgactcttgcttccacgcttgggctagtggacgtggcagaccagcccgagctcattaatctggagaaggccagcaagggtcgtgatgccgagaagacggtccgtgaaaggcttatttcactgcagatggaaacgacgggcctgatcgatcctgactcaaaagcacccctgacagttgtgcagtctatcgaccgcggtttactcgaacgagaggaggccgtccgactcctgacaaagcaggtcgtggacggaggcattattcatcacattagcggcatgagactgtctgtagacaatgcatttaggcatggactcatcggtgaggaccttgccgagaaactgaaacgcgtggagaacttgaatatacatcagattttcaatcccgagaccaaggagaacatctccttacctaaggcaatcaaacttgatctgatcacttctgatttaaaacgtgagatccaagaggtgcaggcctttacggggaatttcgttgacctcatctccggacaacgcttaacccttgcagaggccaaaaaggagggcctcctaacaaatgaggccgttcttagtccagggatgatgcacggaattgtggaccccgagaattgtcggattgtgccctactccgaactggtgaagaaatgtaaaatagacatcgaatcaggccagcgctacctggaggtgatccccttttccgatatcaaggacggcgtgagcgacaaggtcctgacattgagccaggcaattcagctaggcaaagttgactttgcctccacgcttaaggtgttggaggcgcaggccaacaccggtggtattatcgataccgccacaggcaagcgcttaacactggccagcgcactggaggagaaactcgtcgatgagaatatggtgaggattatcgcctcccatcaggttctcaatggagggatcgttgacatcttcagtgaccagcgggtgactctggtcgaggccatcgagaagaggttgatcagcccagagcttgccaacatgatacaaattgactcctccgagttttcagatcaccgagctcagatcgaaaaacaagaggggattgaggtttgcgccctgcaaaatgagtttttaggaaaagatatgctaatcgcatgtaatcagactgcagagatgagttgcaacaaagttgaagagtccgaaaggctattccaggtggaaaatcagtccgcccaggagaaggtgaaggttagagtgtccgacggcgagcaggcgaaaaagtctagggaaatcagcctgaaagagtttggatgcaaggaccagagaaagcccaggatgtcatcagatgccaaggaatttatcagcattatcaacccccataatttaaaggggaaatctcttgggcaagtaagtttgacacacccttactctgagtgtgacttcaagttaaaagaagtggcccgaaacaacatgggtaatgatactaacgaggagcaagagaaagccgtcactaaaattgagattatcagccatatgaaacagtccacctcctgcctggactccgaggaaatccgggaaaatcagggcgaggtaatactggaagtgcaagagacatactgcgaaacatctggcaagctgccgtctgagcaggtgctgcagcagcctatgaacgctcgcgtgaagagcaaacgggagaagagagaggtgatcgttgaggagtcaatccggacgtgcaagcctgcatttttgagtgaggaaaaactttatcaggaaactgcgataagagacgagcacgattcacatatcaaatcccagcctagggaaatgacgagtagcgagaaggggaaagaagccgacacagagatggggttttccatcacatttaagattgaggagtcctcgagccaggtggtgccacagggcattagtgttaagcatctcgatgctctgacacttttttcgtctaaacaggctaacgagggtaaagtcaacaacctgagcctgtgcctgactctgaagcctgaggaaaacctctcaagggagattgcctgtggcgcacagtccgagccgtttccatgcatgacacctcgtccagagggactgcactaccaggagtcagacggaaaggctcaggtgaccggtcccagccagatctcaaagacagacaaaagctttcagggaaccaccaggcaggagactaactaccaagatagctgggtcacatccaagactaaggagactaaacaccagatttctagctcgaatgagtgtaaagagaagagctaccaagaagtgtccttcgatcctgcaagaggactgaagctggaggagataaccgtaagccgtcccgattccaaagaagtgcgatacctggaattctccgatcgcaaggatctacaccaccagggcagtaaatctgacgacaagctttgtggcaccctgaagagcgaaattgccacacaggagttgacaggcgagaagttcttggaaatggcgaatccgaacgtggctggcctcgaggccggttcaatagaagacatcgtgacccaacggggtagccgtgtgctggggagctttttaccagaaaaacttttcaagggagtgtctcaaaaggagaataccggccagcagaatgctattatctctccaaccgtgctcgaaacttctgaggagaagactgtttccttaaccgtgtgttctgccgtaaagactgagaagactccgcaggagaagcttcgagaaagccccggttccgagcaaacaccttttatgactgctccagagggcaaggggaacggaggggtgaacccggagcccttccgcgcaacccagaatgtgttcacgagacagctctgccttgagcacgatgagaagctcgtgagctacctcagtcttctccggaacattgagatgaggactaaacaaatccagccgctcgaacttaacctggccgagctccaggaccttctgtgtcaggcaaaagtattagagcgcgagctgaaagacctgacaactctagtcagtcaggagttggagtgtgttaatcagatcatcatttcacaaccgcaggaggtaccagcacagctgctaaaggctctggagaaggacgccaaaaacctacaaaagtcactttcaagtgtaagcgatacttggaattctcgactccttcactttcagaatgcggtggagattgaaaagactaaagttttgaatcaacacacgcagctagagggcagactgcaggacctgagggcctgggtgggtaataaaaacctgatactgaatagtaaaggcagcaatagcgagatcgatgtggattctctgaacctgtgtctgcagcagtacgaggacttaaaacagcccatggcagagcgcaaggcgcaactggacgccctggcttttgatatccagtttttcatttctgagcatgcccaggacctctccccccagcagaaccgccaaatgttgaggctcctgaacgagctgcagagatcattccaggacatattggagcagactgccgctcaggtcgacgcgctgcagggacatttacaacagatggaacaggaagcccttgtaaaaacattgcaaaagcagcaaaacacatgtcaccagcagctcgaggacctgtgcagctgggtgggacaggccgagagagcattggctggccatcagggacgcacgacacagcaggatctgagtgctctgcagaagaatcaaagcgatctgaaagacctgcaagatgatatccagaaccgggcaactagctttgctactgtcgtgaaggacatcgaaggctttatggaagaaaatcaaaccaagctctcacctcgggagcttaccgccctgcgagaaaaacttcaccaagctaaagaacaatatgaggccctccaggaggaaacaagagtagcccagaaagaattagaggaagcggtcacatccgccttgcagcaggagaccgaaaagagcaaggcagctaaggagctcgcagaaaataagaagaaaatcgacgctctccttgattgggtgacctcggtggggtcctccgggggacagctcctcacaaacttaccgggaatggaacagctgtccggcgcttctctggagaaaggggctctagacactaccgatggatacatgggggttaaccaggctcccgagaagctcgacaaacaatgcgagatgatgaaagctaggcaccaggagctcttatcacagcaacaaaattttatcctcgcaacccaaagcgcacaggcctttctagatcagcacggtcataacctgacacccgaggagcagcaaatgttgcagcagaagctcggcgagttgaaggaacagtattccacctctctggcacagagcgaggcggaactgaagcaggtgcagaccctgcaggacgagctgcagaagttcttgcaagaccacaaagagttcgagtcctggcttgagcggtccgaaaaagagctcgagaacatgcataagggtgggtcttcccccgagactctaccgtccttgcttaagcgtcaggggtcttttagcgaggacgtgattagccataagggtgacctgcggtttgttaccatcagcggccagaaagtactcgatatggaaaattcattcaaggagggtaaagagccctctgaaatcggtaatcttgtgaaagacaagctgaaagatgccactgaacgatacaccgccctgcacagtaagtgcacaaggttaggatcccaccttaatatgcttttaggccagtaccatcagttccagaattctgccgattccctgcaggcctggatgcaggcatgtgaagcgaatgttgagaagcttttatccgacaccgtagcttcggatcccggagtgctccaagagcagctcgcgaccactaagcagttacaggaagaattggctgaacaccaggtccctgtcgagaaactgcagaaggtggccagggatattatggaaattgagggtgagccagctcccgatcatcggcatgtccaggaaaccactgactccatcttgtcccacttccagtccctttcatatagcctcgcagagcgatccagcctgttgcaaaaggcaattgcccaatctcaatctgtccaggaatcactagaaagcctgctgcaatctatcggcgaagtcgagcagaatctagaaggcaagcaagtgagcagcctgagtagtggggtgatccaggaagcactcgctaccaacatgaaactgaaacaggacattgccaggcagaagagctccctcgaagcaacgagagaaatggtgactcgatttatggaaactgccgattcgaccactgcagccgtgctgcagggaaaactggccgaggtatcccaacggttcgagcagttatgcttgcagcaacaagagaaagaaagttctctgaagaaattgttgccccaggccgaaatgtttgagcatctcagcggcaaactccagcagtttatggaaaacaagtccaggatgttagcaagcggcaatcagccagaccaagatataacacactttttccagcagattcaggagctgaacctggagatggaggatcagcaagagaacctggatacgttggaacatctggttaccgagttgagtagctgcggatttgctctggatctctgccagcaccaggaccgagtgcaaaatctccggaaagactttactgaactgcaaaagaccgttaaagagagagagaaggatgcttcctcctgccaagagcagctggacgagtttcgcaaactggtccggacgtttcaaaaatggttgaaggagactgaagggagtataccacccacagagacatcaatgagcgcgaaagagttggaaaaacagatcgaacatctgaagagcctgctagacgattgggcgagtaaaggaactttggtcgaagaaatcaattgcaaggggactagcctagaaaaccttattatggagataactgccccagactctcagggaaaaactgggtccatacttccttcagtgggaagttcggtgggtagcgtgaatggataccacacctgcaaggacctgacggagatacagtgcgatatgtctgacgttaacctgaagtacgagaagctgggaggtgtgcttcacgagcgtcaggaatcactgcaggcaatactgaataggatggaagaggtacataaagaggcgaattcggtgctccagtggctggagagcaaggaagaagttctaaaatcaatggacgccatgagttcccctacaaagacagagactgtcaaggcacaagccgaatctaacaaggcctttctggcagagcttgagcagaacagtccaaaaattcagaaggtaaaagaagcacttgcaggtctgctggtcacttaccccaacagccaggaggccgaaaattggaagaaaatccaggaagaattgaactccaggtgggagcgcgctactgaggttaccgtggctaggcagcgtcaactggaagaaagtgctagccaccttgcctgctttcaggcagcagaaagccagttacgaccctggctgatggagaaggaacttatgatgggcgttctgggccctctaagcattgaccccaacatgctgaacgctcagaaacaacaggtacagttcatgctcaaagagttcgaagccagaagacaacaacacgagcaactgaatgaagcagcacagggaattctcaccggacctggcgatgtgtccctctctactagccaagttcaaaaggaattacagtcaataaaccagaagtgggtggagctcaccgacaaactcaactcgagatcttcccaaatcgaccaggctattgtgaagtctacgcagtatcaagagctcctgcaggacctgtctgaaaaagttcgcgcagtgggccagcgactatcagtacaatctgccatctctactcagcctgaggcagtcaagcagcaactggaagagacatctgaaatccggagtgatttggagcagctggaccacgaagtaaaggaagctcagacactgtgcgatgagctgagtgtgctgatcggcgagcagtacctaaaggacgaacttaagaaacggctggagactgttgctctacctctccaagggcttgaggatctcgctgctgaccgtatcaatcggctgcaggctgcactggcctccacccagcagtttcagcaaatgttcgacgaacttcgaacttggttggatgacaagcaatcacagcaagccaaaaactgtcctatcagtgcaaagctcgagcgattacagagccaattgcaggagaatgaggagtttcagaagtctctcaatcaacacagcgggtcgtatgaggttatagttgccgagggagagtctttactgttgagcgttccacccggagaggagaaaagaacactgcagaatcagctagtggagttaaagaatcactgggaggagcttagcaagaagactgcagatagacagagtcggctgaaagactgtatgcagaaggcacaaaagtatcagtggcacgtggaggacctagtgccctggattgaagactgcaaagccaagatgtccgaactccgagttactctggatccggttcagctggagtccagcctactcaggagcaaagccatgctgaatgaggtggagaaacggaggtctctgttggagattttgaactctgccgcagacattctgattaactcgtccgaggctgacgaagacggaattcgtgatgaaaaagcgggtatcaaccagaacatggacgcagtgacagaggaactccaggctaaaacaggttccctggaggaaatgacacaacgactcagggagtttcaggaatcctttaaaaatattgaaaagaaggtggagggcgctaagcaccagctggagatttttgacgcgctgggctcacaagcgtgctcaaataagaacctggaaaagctccgtgctcaacaggaagtgttgcaagcccttgagccacaggtggattacctccggaatttcactcagggcctggtggaagatgcgcctgacgggagtgacgccagccaactgttgcaccaggctgaagtcgcccagcaggaatttctggaagtgaaacagagagtcaacagtggttgcgtcatgatggagaataagcttgagggaatcgggcagttccactgtagagtacgagagatgttctcacaactcgcagaccttgatgatgaattggacggcatgggcgcaattgggagagacacagactcactgcaatcacagatcgaagatgtcaggctctttctgaacaaaattcacgtgctgaaactggacatcgaggcaagcgaggcagaatgcagacatatgctcgaggaggaaggcacactggatctgcttggattaaaacgagagctcgaggccctgaacaagcagtgtggcaagttgactgagcggggaaaggccagacaggagcagcttgagctgaccctgggccgagtagaggatttctaccgcaaattgaagggcttgaatgacgccacaacggctgccgaggaagctgaggccctgcaatgggtagtggggaccgaggtcgaaatcatcaaccagcagctcgccgacttcaagatgttccaaaaagagcaggttgaccctctgcagatgaaactgcaacaggttaacggactggggcaaggactgatccagagcgccggtaaagactgtgatgtgcagggattggagcatgatatggaagaaattaacgcaagatggaacacacttaataaaaaggttgctcagcgcatagctcaactccaagaggcactgctgcactgcggtaagtttcaagacgccctcgagcccttactaagttggctggctgacaccgaggagctcattgccaaccaaaagccacccagcgccgagtacaaggtggtaaaggctcagatacaggaacagaaactactccagaggctactcgatgacagaaaggctacggtcgacatgttgcaggccgaggggggacgaatcgcacagtcagcagagcttgcggacagggagaagattaccgggcagctcgagtctctcgaatcccggtggacagagctcctgtctaaggccgctgccagacagaagcagttggaggacatcctggtgttagccaaacaatttcacgaaaccgctgagccgatatcagactttctatccgtgaccgaaaagaagctagcaaatagcgaacctgtaggaacgcagactgctaagattcaacaacagattattaggcacaaagctctgaatgaggagatagttaaccgcaaaaaaaacgtagatcaggccatcaaaaacggacaggccttgctgaagcaaactaccggagaggaggtgctgctgattcaggagaaactcgacggaatcaagacacggtatgccgacataacggtgacctcctcgaaggcccttaggactcttgaacaggctagacaactggcaacgaagtttcagtccacatatgaggaattaactgggtggctccgggaggttgaggaagaacttgcgacctccgggggtcagagtcctactggggaacagatcccgcagttccagcagcgccaaaaagagctcaaaaaggaggtcatggagcatcgcctggtgctagatactgtcaacgaagtgtcacgcgctttgctcgaactggtgccgtggcgcgcacgcgaaggcctggataaactcgttagcgatgccaacgagcaatacaagcttgtctcagacaccattggccagagggttgatgagatagatgccgcaattcagcgaagccagcaatacgagcaggcagccgacgctgaacttgcctgggtcgcagaaacgaagcggaagctgatggcattaggcccaattcgcctggagcaagaccaaacaaccgcacagttacaggttcagaaagctttctccattgatatcattagacacaaagactcaatggacgagcttttttcccatagatctgagattttcgggacttgtggggaagagcagaaaactgtgctgcaagagaagaccgagtccttaatccaacagtacgaggcaatatcactgctgaactctgaaaggtacgcaagattggagcgcgctcaagtgttggtgaaccagttttgggaaacatatgaggagctgagcccttggatagaggaaacgagagctttaatcgcccagttgccctcccctgctatagaccacgaacagttaagacaacagcaggaagagatgagacagctacgcgaatcaatcgctgagcataagcctcacattgacaagctgctgaagattggaccgcaactgaaggagctgaaccctgaggagggcgagatggtggaggaaaagtatcagaaggccgagaatatgtacgcccagatcaaagaagaggtccggcaacgagcactggccttagacgaagccgtgtcccagagtacacaaatcactgagttccatgacaagattgaacctatgctcgagaccctcgagaacctgtcctctcggttgcgcatgccacccctaatccccgcagaggttgacaagataagggagtgtatttccgacaataaatcggcgactgtcgaactggaaaagttgcagcccagctttgaagccctcaaacgtcgcggagaggagttgattggacggtcccaaggtgccgacaaggatttggcagccaaggaaatacaggacaagctcgatcaaatggtattcttttgggaggacataaaagccagagcagaagaacgagagataaagttcctggatgtcctggaattggctgagaagttctggtacgatatggccgctctgctgacaactatcaaagacacacaggatatagtgcacgatttggaatctcccggaatagacccatccattatcaaacagcaagtcgaagcagctgagaccatcaaggaagaaacggatgggcttcacgaggagttggagtttatccgcatcctgggcgcagacctcatttttgcgtgtggcgagacggagaaaccagaagtccgtaaaagtattgacgaaatgaataatgcctgggagaatttgaacaagacttggaaggagcgcttggaaaagctcgaggacgccatgcaggccgcagtccaataccaggatacactgcaggccatgtttgattggttggataacaccgtcattaaactatgcactatgccacctgtcgggaccgatctgaacaccgtgaaagatcagctgaacgagatgaaagaattcaaagtggaggtctatcagcagcagatcgagatggagaaactgaatcaccagggcgagctgatgctgaaaaaagcaacagacgaaactgacagagatattatccgggaaccccttacagagcttaagcatttgtgggaaaacctcggggaaaagattgcccatagacaacacaaactggagggtgccctgctggcgctgggtcaatttcagcatgcactggaagaactgatgtcttggctgacccacacggaggaactgcttgacgcccaacggccaatatcaggagacccaaaggtgatagaggtggagctggctaagcatcatgtcctcaaaaacgatgtgctcgctcatcaggccaccgtggaaaccgtgaataaagctggaaatgaactactagagtctagtgcaggagacgacgccagttccctgcgcagtagattggaggcgatgaatcaatgctgggagtccgtcctgcagaagacggaagaacgtgagcagcagcttcagtccacactacagcaagctcaggggtttcacagcgagatcgaagattttttactcgaactcactaggatggagtctcagctgtctgcttccaagccaacgggtggcctccctgagacagcacgggaacagttagatactcatatggaactgtattctcagctaaaggcaaaagaagaaacctacaaccagttacttgataaggggagactgatgttgctcagccgggatgacagcggaagtggatcaaaaaccgaacagtcagtggccctgcttgagcagaagtggcatgttgtgtcatctaagatggaggagcgaaaatcaaagttagaggaggctctgaacctggccactgagtttcagaatagcctccaggaattcataaactggctaactcttgcagaacagtccctgaacatcgccagcccccctagccttattctaaacacggtgttgtcccagatcgaggagcacaaggtgttcgcaaacgaagtgaacgctcacagagaccagatcatcgaactggatcaaactggtaatcagctcaagtttctctcccaaaagcaggatgtggtgctaattaagaatctgcttgtctccgtgcagtcacgatgggaaaaggtggtacagaggtccatagagcgaggaaggtcactcgacgatgcaaggaaacgggcaaagcagtttcatgaagcttggaaaaagctcatcgattggctggaagacgccgaatctcacctggactcagagctcgagatctcaaacgatcctgacaagattaagttacagttgtcgaagcataaagaattccagaagacgcttgggggaaagcaacctgtctacgacaccaccatccggaccggacgagccctaaaagagaagaccctgttacccgaggatagtcagaaattggataactttctcggggaagtgagagacaaatgggacacagtttgtggcaagtccgttgagcggcagcataaactcgaagaggcgttgctgttctcagggcagttcatggatgccttgcaggcgcttgtggactggctctataaggtggagccacagcttgcagaggaccagccggtgcacggagacctggatctcgttatgaacttaatggatgctcataaagtgttccagaaggagctgggcaagcgcaccggcacggtccaagtgcttaagcggtctggccgagaactgatcgaaaacagcagggacgatactacttgggttaaaggacagctgcaggaactgagcacacgttgggacaccgtatgcaagttaagcgtttcaaaacaatccaggttggagcaagctcttaagcaagccgaagtgtttagggatactgtccacatgctgctggagtggctgtcggaggcagagcaaaccctgaggtttagaggcgctcttccagatgacacagaggccctacaatccctcattgacactcacaaggaattcatgaagaaagttgaggagaaacgggtcgacgtcaacagtgccgtggctatgggtgaggtaattctagccgtgtgccaccccgactgcatcacaactattaagcactggattaccatcattcgggctaggtttgaggaggtgctgacctgggcaaaacagcatcaacagcgcctcgaaacagccttgagcgagctagtggccaacgccgaactgttggaagaattgcttgcttggattcagtgggctgagaccaccttgatacagcgagatcaagagcccattcctcagaatatcgatagagttaaagctctcattgcggaacaccaaaccttcatggaggaaatgactaggaagcaacccgatgtcgaccgggtaacaaaaacttataagcggaagaacatcgagcctacccacgcgccatttattgaaaagtcccgcagtggaggccgaaagtctctgtcccaacccactcccccacctatgccaattctgagccaatctgaggcaaaaaaccctaggataaatcaactgtctgcacgatggcagcaggtttggctgctcgccctagagcggcaacggaagctgaacgacgcgcttgacagactcgaggagttaaaggagttcgctaacttcgactttgatgtgtggaggaagaagtacatgagatggatgaatcacaaaaagagcagggtgatggattttttcaggcggatcgataaggatcaggatggcaagatcacacgtcaggaattcattgacgggatcttggcatccaaatttcctacaacaaaactcgagatgacggctgtcgccgatatttttgatcgagatggtgatgggtacatcgactactacgaatttgtcgcggctctccatcctaacaaagacgcttataggccgaccacagatgccgacaagatcgaggacgaggtcacgcgccaagtggctcagtgcaagtgcgctaaacgtttccaagttgagcaaatcggagaaaataaataccggttcggcgattcacagcagctgcgcctggtgcggatcctgagatccactgtcatggtcagggtcggaggcggttggatggcccttgatgaatttctggtcaaaaacgatccgtgccgcgcacggggacgcacaaatattgagctccgagagaagtttatcctgcctgaaggggctagtcagggcatgactcctttccggtcccggggtcgacgctcaaaaccatcctcccgtgccgctagtcccactcgctcttccagtagtgccagtcaaagtaatcatagttgcaccagtatgccttcaagcccagctactccggctagtggaaccaaagtgattccgtccagtggctccaaactcaaaaggcccacgcccactttccattcatccaggacttcactagccggagatacctcgaacagtagctctccagcgtcaacgggcgcaaagacgaatagggctgatcccaagaagtccgcctctcgaccaggctcgcgggcaggctcccgagcgggatccagagcaagctcacggagagggtccgatgcaagtgacttcgatctgctcgagacacaaagcgcatgcagcgatacctcagaatcttcagctgccggaggccaaggcaactcccggagaggtcttaacaaacccagtaaaatcccaaccatgagtaagaagacgactacagcctctccacgaacccctggacctaaacggtat

SEQ ID NO: 230544 - DNA, 1155 bp, Artificial Sequence
  Description of Artificial Sequence: Synthetic coding sequence
atcaccagcccctgggcaccacgcccttcctgcagcagcccatgggcaatgtcatcttctgacgaagaaacgttaagtgagagatcttgtcgctctgagaggtcatgccggtccgagagaagctaccggagcgagcggagtggttctctgagcccttgtccacctggcgacacactgccttggaatctccccctgcacgaacaaaagaaaagaaagtctcaggattccgtactggatccagctgagagagccgtcgtgcgggtggcagatgagagggatagggttcaaaaaaaaacattcactaagtgggttaacaagcatctcatgaaggtccgaaaacacatcaacgacttgtatgaagatctgagagacggccacaatttaatctctctactggaggtattgtctggcattaagctcccacgcgagaaaggacgcatgaggtttcacagactgcagaacgtgcaaattgctctggatttcttgaagcagagacaggttaagctcgtgaatatccggaacgatgacatcacagacggcaatccgaaacttacattagggcttatctggaccatcattcttcactttcagatctccgacatttatatctctggcgaatctggggacatgagcgcaaaagaaaaactccttctttggacccaaaaggtgaccgcaggatatacgggcattaagtgtactaacttctcttcttgctggagtgatggcaagatgttcaacgcgctgattcatcgttatcggccagatctggtggatatggaacgtgtccagattcagtccaaccgggagaacctggaacaggcgtttgaggtggctgaaagactaggcgtgacacggctgctcgacgctgaggacgtggatgtgccttccccagacgaaaagtcagtcataacctatgtgtcttccatctacgatgcttttcccaaggtgcccgaaggaggggaaggaatctcagccacagaggtggattctcgctggcaggagtaccagtccagggtggactcactgatcccttggatcaaacaacacactattcttatgtctgataagactttccctcagaacccagtggaactcaaagctttatacaatcagtacatacatttcaaagagaccgagattctagccaaggagtag

SEQ ID NO: 230545 - DNA, 603 bp, Artificial Sequence
  Description of Artificial Sequence: Synthetic coding sequence
atgcctcttctggattccagttatctcccacctacaatcttcatattgacacacgttctgggtgtggcgggagtgttgtactggaagcggcacgccagagggcgagcagacgagcgagatagggtgcagaaaaagacattcacgaagtgggttaataagcatcttatgaaggtgcgaaagcatatcaatgatctttatgaggaccttagggacggacataacctcatatcactcttggaagtcctgtccgggattaagctccctcgcgaaaaaggccgaatgcgattccaccgactgcagaatgttcagatcgctcttgatttcctgaagcagagacaagtaaaacttgtaaacatacggaatgacgacatcactgatgggaaccctaagctgactttagggcttatctggaccatcattctgcactttcagatcagtgacatatacatctccggagagtctggagatatgtctgccaaagaaaagctgttgctatggacccagaaggtcacggctggctatacgggtattaagtgcactaatttttcctcatgttggtcagacgggaagatgtttaatgccctcattcacaggtatcggtag

SEQ ID NO: 230546 - DNA, 15902 bp, Artificial Sequence
  Description of Artificial Sequence: Synthetic coding sequence
atgtcttcctctgacgaagagaccctgagcgaaaggtcctgcaggtctgaaagatcctgccgttccgagaggtcttaccgctccgagaggtctggttcactatccccctgtcccccaggagacaccttaccttggaatcttcccctgcacgagcagaagaaacgtaagagccaagatagtgtcctggatcctgccgagagggctgtggtgcgcgtggcagacgaacgggatcgcgttcagaagaaaacgttcacgaagtgggtcaacaagcatcttatgaaagtgcggaaacacatcaatgacctatatgaagacctcagggatgggcataatctaatatccctgttggaagtgctgtcagggataaagctcccgagagagaagggcaggatgcgattccatcgcctgcaaaacgtgcagattgcactcgacttccttaaacagcggcaggtcaagttggtcaatatccgcaatgatgatataactgacggaaacccaaaactgaccctgggtctaatctggactattattctccacttccaaatttcagatatttatatcagcggcgaaagtggtgacatgtcagcaaaggagaagctgcttttgtggactcagaaggtcacggccggatatactggaattaagtgtactaattttagctcttgttggtcagatggcaagatgttcaacgccttaatccaccgctataggccagacctggttgacatggaaagggttcagatccaatcgaaccgggaaaatctcgaacaagcgtttgaggtggccgagaggctgggcgtgacaaggctgcttgacgcggaggatgtcgatgtgcccagccccgacgagaaatcggtgatcacatacgtctctagcatttatgacgccttccctaaagtgcccgaggggggagagggcattagcgctactgaagtggactcacgctggcaggagtatcagtccagagtggactccctgatcccatggatcaaacaacatactatcctcatgtccgataagacatttccccagaacccagtggaacttaaggcgctttacaatcagtacatccattttaaggagaccgaaattctggctaaggaaagggagaaagggaggatagaggagttgtacaaactcctcgaggtctggatcgaattcggacgcatcaaactgccacagggctaccatccaaatgatgtggaggaggagtggggcaaactgattattgaaatgttggagcgagagaaaagcctccgccctgccgtagagcgtttagaactccttctgcagatcgccaacaaaattcaaaatggcgctttaaattgtgaggaaaagttgaccctcgctaagaataccctgcaagcagatgccgctcacctggagagtggtcaacctgtgcagtgcgaaagcgacgtgattatgtatatccaggagtgtgaggggctaattcggcagctgcaggttgacttacagattcttcgagatgagaactactaccagctcgaggagttggcctttagagtgatgcgcctgcaagatgagctggttactttgcgcttagaatgtactaatttataccgaaagggccatttcacgtccctagagctggtaccacccagtaccctgaccacaacacaccttaaggctgagccattaacaaaagccactcactccagctccacctcctggtttcgcaagcccatgactcgagcagagttggttgccattagttccagcgaagacgagggaaatctgcgcttcgtttacgagctgctcagttgggtcgaggaaatgcagatgaaactggagcgggctgaatggggaaacgacctgccttctgtggaactgcagttggagacccaacagcacattcatacctcagtggaagagcttgggagttctgtcaaggaggctcgcctatacgagggcaaaatgtcgcagaatttccacacgtcatacgctgaaactctgggcaagctcgaaactcaatactgcaaactaaaggaaacttcctcctttagaatgaggcacctgcagagtcttcacaagtttgtgtccagggcgacagccgagctcatttggttaaatgagaaggaggaggaggagcttgcctatgactggtccgataataactctaacatcagcgccaaaaggaactacttttccgagctcacaatggagttggaggaaaaacaggatgtttttcggtctttgcaggatacggccgaacttctgtctttggaaaatcatcccgcaaaacagactgtcgaggcatactctgcggctgtgcagtcgcagctgcagtggatgaaacaattgtgcctatgcgtcgaacagcacgtgaaagagaatactgcctactttcagtttttctccgatgccagggagcttgagagttttttgcggaacctgcaggattcaatcaagcgaaaatatagctgcgatcacaacacaagtcttagccggctagaggacctcctgcaggactccatggatgagaaagagcagctcattcaatctaagagttctgtggccagtctggtgggacgcagcaaaacaatcgtccagcttaaaccgcgatcaccggatcatgtgctgaaaaataccatctccgtgaaggccgtgtgtgattaccgccagattgagatcacaatttgcaagaacgacgagtgcgttctcgaagataactcacagaggactaagtggaaggtgataagtcctactggaaacgaggccatggtgccgagcgtgtgtttcctgatcccgcctccaaataaggacgccatcgagatggcatcgcgggtcgaacagtcctatcagaaagtgatggccctgtggcaccagctgcatgtgaatacgaagtcccttatttcgtggaattacctacgtaaagacctggacttggtccagacttggaacctggagaagcttaggagctccgccccaggagaatgccatcagatcatgaaaaacctgcaggcacattatgaggacttcctgcaagattcccgcgatagtgtgctgttttccgtggcggacaggctgcgcttagaggaagaagtggaggcttgcaaagctcgttttcagcatttgatgaaatctatggagaacgaggataaggaggagactgttgctaagatgtacatctccgaactgaagaatatccggctgcgactcgaagagtacgagcagcgtgttgttaaacggatccagtccctcgcctccagccgcacagaccgcgacgcttggcaggataacgccctgagaatcgctgaacaagagcatactcaggaggacctccaacaacttcgcagtgacttggatgctgtttccatgaagtgcgactctttcctgcaccagagcccctcatctagctctgttccgactctgcggtctgaactgaatcttttagtggagaagatggaccacgtttacggcctgtccactgtatacctgaacaagttgaagacggtagatgttatagtgcgatcgattcaggacgccgagttgctggtgaagggctatgaaatcaaactcagtcaggaggaggttgttctggccgacttatcggccttggaagcacactggtctacactaagacattggctcagtgacgtgaaggacaaaaattcagtgtttagcgttttagatgaggaaatcgccaaagctaaagtagtggccgagcagatgtctaggctgactcctgagagaaacttggatttagagcggtaccaagagaagggctctcagctgcaagagcgctggcaccgcgtgattgcacaattagagattcgacagtcagagctagagtccattcaggaggtgcttggcgactaccgagcatgtcacggtacactgatcaagtggatcgaagagacgactgctcagcaggaaatgatgaaacccggtcaggcagaagatagtcgtgtgctatctgaacaactttctcagcagacagccttgttcgccgaaatcgaacgcaaccagactaaactcgatcagtgtcagaaattttctcagcaatattccactatcgttaaggactacgagctccagctgatgacatataaggctttcgtggaaagtcaacaaaagagtccaggcaaacggcgacgaatgctcagttcaagtgacgcgatcacgcaggaattcatggacttgcgcaccaggtataccgcccttgtcacactgaccactcagcacgtgaagtatatttccgacgctctccgcagactggaggaggaggagaaagttgtcgaggaggagaagcaggagcatgtcgagaaagttaaggaactgctgggatgggtctctacattggcacgtaacacccagggtaaggccacatccagcgaaaccaaggagagcacagacattgagaaagccatccttgagcagcaggtgttaagcgaggagctcaccaccaaaaaggaacaggtcagtgaagcaatcaagacctcccagatctttctcgccaaacacggacacaaactcagtgagaaggaaaaaaagcagatctccgaacagttgaacgcgctcaataaggcctaccacgacttgtgcgatggatccgctaaccaactccaacagctccagtcccagttggcccaccagacagagcaaaaaacgctgcaaaaacaacagaacacttgccatcagcaactggaagacttgtgttcctgggttggtcaggcagagcgtgcattagctggacatcaggggcgaaccacccagcaggacctgagcgccctccagaagaatcagtcagatctgaaggatctgcaagacgatatacagaaccgggctactagcttcgctactgtggtgaaggatatcgaaggtttcatggaggagaatcagaccaagctgagccctcgagaattaactgcgctgagagaaaagctgcaccaggccaaggagcagtatgaggctcttcaggaggagacgcgggtcgcccagaaagaactggaagaagccgtgacttccgccctacaacaagagactgaaaagtcaaaagctgctaaggagttggccgaaaataagaaaaagatcgatgctctcttggattgggtgacaagcgtgggaagctccggaggtcaactgttgaccaacctccctggtatggaacagctttctggcgcttccctggagaaaggagctcttgatactaccgatggctacatgggagtaaatcaagctcctgaaaagctcgacaaacaatgcgagatgatgaaagccaggcatcaagagctgctgtcccagcagcagaacttcattctggctacacagtctgcacaagcatttctggaccagcatggtcacaatctgacaccagaagagcagcagatgctgcagcaaaaattgggtgagctgaaagaacagtactccaccagtctcgcccagtcggaggctgagttgaagcaggtacagactcttcaggacgagctgcagaaattcctgcaggaccacaaggagtttgaatcatggctggagcgcagcgaaaaagagctcgaaaacatgcacaaagggggtagctcaccagaaactctgccgtccttactgaagcggcaaggatcattctccgaagacgtcattagccacaaaggggacctcaggtttgttactattagcggccaaaaagttctggatatggagaattcattcaaggaaggaaaggaacccagtgagattgggaacctggtgaaggacaaacttaaggatgcaaccgaaaggtacaccgctcttcacagtaagtgtactaggttggggtcccatctgaatatgctccttgggcagtatcatcaatttcagaactcggcagactccctgcaggcatggatgcaggcttgcgaagctaatgtagaaaagctactgagcgacacagtcgcctctgaccccggtgttcttcaagagcagctggctacgacgaagcagctgcaggaagagctggcagagcaccaggtgcctgttgagaagctgcagaaggtcgccagagacattatggagatagaaggggaaccagctccagatcatcgacacgtccaggaaaccactgactcaatcctttctcactttcagtctctcagctactcactggctgagcggagttctctgcttcagaaagcaatagctcagagccaaagcgtacaggaatcgctggagagccttctgcagtccattggggaagttgaacaaaatctagagggcaaacaggtctcgtcactcagcagcggcgtaatacaggaggctttggccaccaacatgaagcttaagcaggatatcgcacgacagaagtcctcattggaagcaacccgcgaaatggtcacaaggttcatggaaaccgctgactcgaccactgctgctgtgctgcaaggcaaactcgctgaggtgtcacagcggtttgaacagttatgcctgcagcagcaggagaaagaatccagcctcaaaaagctcctcccccaggctgaaatgtttgaacacctgtcagggaagcttcagcagtttatggagaacaagtcccgcatgcttgcaagcggcaatcaacctgatcaagacattacgcatttcttccagcagatccaggaactgaacttggaaatggaggaccagcaagaaaaccttgacaccctcgagcacctcgtgactgagttgtcctcatgcggatttgctctggacctgtgtcaacatcaggaccgggttcagaacctgagaaaggattttaccgagttgcagaagaccgtcaaagaacgggagaaagatgctagtagctgtcaggagcagctggatgaattccgtaagctggtgaggacctttcagaagtggcttaaggaaacggaaggatcgattccaccaacagagacctccatgtcagctaaagaactagagaaacagattgaacatcttaagagtcttttagacgattgggcgtcaaagggtaccctggtggaggagatcaactgcaagggcactagtctcgagaatctgatcatggagatcacagcaccggatagtcaaggaaagactgacctgacagaaatccaatgtgacatgtccgatgtcaatttgaaatatgaaaagcttggcggagttctccacgaacgccaggagtctctgcaggccatactcaaccgcatggaggaagttcacaaagaagcaaatagtgtgctccagtggttggagagtaaagaagaagtgttgaagtccatggatgctatgagctcccccaccaagacagagaccgtcaaagcccaagccgagtcgaataaggcattcctggcagagcttgagcagaacagccccaagatccagaaagtgaaggaggcgctggccggtctgctagtgacttatccaaactcccaagaggcagaaaattggaaaaagatacaagaggagttgaacagtcgctgggaacgggctacagaggttaccgttgccagacagcggcagctcgaggagagcgcctcacacctcgcgtgtttccaggctgcagagtcacagctgcgcccttggttgatggagaaggaactcatgatgggcgtcttaggccctctcagcatagatccaaatatgctgaacgcccagaagcagcaggttcagttcatgctgaaggagttcgaggccaggaggcagcagcatgaacagctgaacgaagccgcacaagggatcctgacggggccaggcgacgtgtctctgagcactagtcaggtccagaaggagctgcagagtatcaatcagaaatgggtggaactcacagacaagctgaactccagaagttcacagatcgaccaagcgattgtaaagagtacccagtatcaagaactgctccaggatctgtccgagaaagtgcgagcagttggccagagactgtccgttcagagtgccatcagcactcagccagaggcagtgaagcagcagctcgaggagacaagtgagattagatcagacctggagcaactggatcacgaagttaaggaagctcagacactctgcgacgaactgagtgtgctcatcggcgagcagtatttaaaagatgagctgaaaaagaggctggagaccgtagccctgccactccaaggactcgaagacttggcagcagatcgaattaacaggctgcaggccgcacttgcatccacacaacagtttcaacagatgtttgatgaattacgaacatggttggatgataaacaatcgcagcaggctaaaaattgcccaatttccgccaaactcgaacgacttcaatcacaactgcaagaaaacgaggagtttcaaaaatcccttaatcagcacagcggaagctacgaggtcattgttgccgagggggaaagtcttctgttgtccgttcccccaggggaggaaaagcgtactctccagaaccagttggtggagctgaagaaccactgggaagagttgagcaagaaaaccgcggacagacagagtcggctcaaggactgcatgcagaaagcgcagaaataccagtggcacgtcgaagacctggtgccatggatagaagactgcaaggcaaagatgagcgagttgcgggtgactctcgaccccgtgcagctcgaaagttcgctacttcggtctaaagccatgctgaatgaggtagaaaagagaagaagtctcctggagatcctgaactctgccgctgatattctgatcaactcaagcgaggccgatgaggatgggattagagatgagaaagcaggcatcaatcaaaacatggacgctgttaccgaggagctgcaggctaagactggcagtcttgaggagatgacacaacggctgcgtgaattccaggaatcttttaaaaatattgaaaagaaagtcgagggtgctaagcaccagctcgagatatttgacgcactaggtagccaggcgtgtagtaacaagaacttggagaaactgcgcgcacagcaagaagtactgcaggccctagaaccccaggttgactacttaagaaacttcacccagggcctggtagaagatgctccagatggctctgacgcgtcccagctgctccaccaggccgaagtagcacagcaggaattcctggaagtgaagcaaagagtgaacagcggctgtgtgatgatggagaataaactggaagggattgggcagttccactgtcgtgtacgagagatgtttagtcaactggccgacctggacgacgaactggatgggatgggcgctattggaagagacaccgattccctccaatcccagatagaggacgtcagattgtttttgaataagatccacgtcctgaaactggatatcgaggccagtgaggccgaatgtagacatatgctggaagaagaaggtaccctggacctcttgggcctaaagcgggagcttgaggcgttgaataagcaatgtggcaagctgaccgagcgagggaaggcgagacaagagcagctcgagttgacgctcgggagagtggaggacttctacaggaaacttaaagggttgaacgatgccacaacggctgccgaagaggccgaggcactacagtgggtggtgggcaccgaagtcgaaatcatcaaccagcagcttgctgactttaaaatgttccagaaagaacaggtcgacccacttcagatgaagctccaacaggtgaacggcttgggacagggactgatccagtcagctggcaaagactgcgacgtacaagggctggaacacgacatggaagaaattaatgcacgctggaacactcttaataagaaggttgcgcagagaatagcacaactgcaggaagctttgctgcactgcggaaagttccaggatgctttggagcctctgctttcctggctggctgacacagaggaactgatcgcaaaccagaagccgccatctgcggagtataaggtggtaaaggcacagattcaagagcagaagctcctgcaacgccttttagacgacagaaaagccactgtggatatgctgcaggcagagggtggcagaattgcccaaagcgccgagctcgcggatcgtgagaaaataacgggtcagttagaatccctagaatcaagatggaccgagctcctgagcaaggctgctgcaaggcagaaacagttggaagacatcctggtgctggctaagcaattccacgagacggctgaacccataagtgattttttatctgtcacagaaaagaaactggccaattcggagcccgtgggcactcagaccgcgaagatccagcagcagattattcggcacaaagccttaaacgaggagatagttaaccgcaagaagaacgtggatcaagcgattaagaatggacaggcacttctaaaacagacgaccggcgaggaggtgctgctcattcaggaaaaactggacggcattaagactagatatgccgatatcacggtaacttcctctaaggccctgcggactctagagcaggctcgacaactggctacgaagttccagtccacttacgaagaattgaccgggtggctgagagaagtggaggaagagctagcaacatcaggaggtcaatccccaaccggcgagcagatcccgcagtttcagcagcggcaaaaagagctcaaaaaagaagtgatggagcatagactggttctggacaccgtcaacgaggtgagtcgggcactccttgagctggtaccatggcgggcacgagagggtctagacaagctagtgtccgatgccaacgagcagtacaagctggtgtctgatactatcggccagagagtggacgagattgacgctgctattcaaagatcgcagcagtatgaacaggctgcagacgccgaattggcttgggtcgccgaaaccaagcgaaaattgatggctctaggacccatacgcttagaacaagaccagacaacagcacagttgcaggttcaaaaggccttcagtatcgatattattcggcacaaagactctatggatgagcttttttctcaccggtccgagatctttggcacttgtggggaagagcagaaaactgtgctccaggagaaaaccgaatccctgattcagcaatatgaagccattagcttgcttaatagtgagcgctacgcgaggcttgaacgtgcccaggttctcgtgaatcagttttgggagacctacgaggaattgagtccttggattgaagagacgcgtgctctgatcgcccagctgccgagccccgctattgatcatgagcagctgcgacagcagcaggaagaaatgaggcaactgcgtgagagtatcgcagagcacaaaccacacatcgataaattgctgaagatcgggcctcagctgaaggagctgaatccagaagagggcgagatggttgaggagaaataccaaaaggctgaaaatatgtacgcccagatcaaagaggaagttagacagagagcgctcgccctggacgaggctgtctctcagtctactcaagtttctcagtttcatgacaagattgaaccgatgcttgaaaccctcgagaacctgtcttcccggttgcgcatgccgccattgataccagccgaggtggacaaaatcagggagtgtatctctgataacaaaagcgcaacagtagagctcgagaagctccaaccgtcatttgaggccctcaagcggagaggcgaggagttgatcggaaggagccagggagcggataaggatctggcagcgaaggagattcaggataagctagatcaaatggtttttttctgggaggatattaaggcccgagctgaggagagagaaatcaagttcctcgacgttctggaattggccgaaaaattctggtacgatatggctgccctcctcaccaccatcaaggatacccaggacatagtgcacgacctggaatcccctgggatcgacccaagcataattaagcagcaagtcgaagccgcagagacgatcaaggaggagacagatgggctgcatgaggagctggagttcattaggatcctcggagctgatcttattttcgcttgcggtgagacagagaaacccgaagtcaggaaatctattgatgaaatgaacaatgcatgggagaatctcaataaaacatggaaagagaggctggaaaagctggaggatgccatgcaggctgccgtgcagtatcaggacactctccaagccatgtttgactggctggacaacaccgttatcaagctctgtacaatgccgccagtgggaacagatctgaataccgtgaaggaccaactgaatgagatgaaagaatttaaggtggaggtataccagcagcagatcgagatggaaaaattaaaccatcaaggggaactcatgctgaaaaaagccactgatgagactgatcgcgacatcatccgtgagcctttaacggaattaaagcacctgtgggagaacctcggcgaaaagatagcccacaggcaacacaagcttgagggcgctctcttagccctgggccaattccagcatgcgctggaagaacttatgtcctggctgacgcacacggaagagttgctcgacgcacaaaggccaataagtggggatcccaaggtaatagaggtggaactggcaaaacatcacgttctgaaaaacgatgtgctggcgcaccaggccacagttgaaacggtgaataaggctggtaatgaattacttgagagttcagccggtgacgatgcatcttcccttcggagtcggctggaggctatgaaccagtgctgggagagcgtgttacagaagactgaggagagggaacagcagctccagtctactctgcagcaggcccagggttttcactctgagatcgaggatttcttgttggagctgacccggatggagtcacagctgagcgcttcaaagccaaccggcggactgcccgaaaccgccagggagcaactagatacccacatggagctttatagccagctaaaggccaaggaagaaacttataatcaactgctggacaagggtcgattgatgctgctttcacgggatgattctggatcaggatccaaaacagagcagagcgtggccctgctcgagcaaaaatggcatgtcgtgtctagcaaaatggaggaacggaagagcaagttagaggaggccctgaacctggccacggagttccagaactcgttgcaagagtttatcaactggctcactctggccgaacagtccttgaacatcgcctcaccaccgtcattgatcctgaacaccgtgctctcgcagatcgaggaacataaagtctttgccaacgaggtcaacgcccaccgggaccagattattgaactagatcagacaggcaatcagctgaagtttctcagccagaaacaggatgtggtgttgatcaagaacttgttggtctcagtccaaagtcggtgggagaaggttgtgcagaggagcatcgagcggggtaggtcactagacgatgcccgaaagagggctaaacaattccatgaagcctggaagaaactcattgattggctcgaagacgccgagtctcatctcgacagcgagctcgaaatttccaatgaccctgataaaatcaagttacagctaagtaagcataaggaattccagaaaaccttaggaggtaaacagcccgtgtatgatacaacaatccggacggggcgtgccctaaaggagaagaccctcttgccagaggattcacagaagctggacaattttctgggggaagtaagagataaatgggatacggtgtgcggaaaaagcgtagagcggcaacacaaactggaggaggccctgctcttctcagggcagtttatggatgctctgcaggcactcgtggactggctgtataaagtggagccccagctcgcagaagatcagcctgttcacggtgatctggacttagtaatgaatctcatggatgctcacaaggtcttccagaaagaacttggcaaacgcacaggaacagtgcaggtgcttaagagaagtgggagagagctaattgagaatagccgggatgataccacttgggtcaaaggccagctgcaggaactatctaccaggtgggatacagtctgcaaactgtccgtgagcaagcagagccgtctggagcaggccctcaaacaggctgaggtatttcgggacaccgtgcatatgctactcgaatggctctctgaggctgagcagaccctacggtttagaggagccttgccagacgacactgaggcgttacagtccctcatcgacacccataaggaattcatgaaaaaggtggaggaaaaacgcgttgacgtcaactcagctgtagccatgggagaagtcattctggctgtttgccatcctgactgcataactaccataaagcactggataaccatcatccgggctcggttcgaagaggtcctcacctgggcgaagcagcaccagcagcgtctggagacagcactgtcggagcttgtcgctaacgccgaattgttggaagaacttttagcatggatacagtgggccgagacaaccctgatacagagagatcaggaacctattcctcaaaacatcgacagagttaaagccctgatagctgaacatcagacgtttatggaggaaatgacccgcaagcagcccgacgtcgacagggtaacaaaaacgtacaagcggaagaatatagagccaacgcatgccccattcatcgagaagtctagatccggcggacggaagagcctctctcagcctaccccaccacccatgcctattctaagccagagtgaggcaaagaaccctaggattaaccagctgagcgcccgttggcagcaggtctggttacttgccttagaaagacagagaaagctcaatgacgccctcgaccggttggaggagctaaaagaatttgccaactttgactttgatgtttggcgcaagaagtatatgagatggatgaaccataagaagagccgcgtgatggattttttccgccgaattgacaaggaccaggacggcaagatcacaaggcaggagttcatagacggcatcctggccagtaaatttccaacgaccaagctggaaatgaccgccgtggccgacatcttcgacagagacggagatggctacattgattactacgagtttgtagccgctctacacccaaataaggatgcgtaccgtccaactaccgacgccgataaaatagaagatgaagtaacccgtcaggtggctcagtgtaaatgcgccaagcggtttcaagtggagcagatcggcgagaataagtaccggtttggagattctcaacaactgcggctggtccgaatcctgcgatccactgtgatggtgcgagtgggaggaggatggatggcgctggacgagttccttgtgaagaacgacccgtgtcgcgcaagaggtcgcacaaatatcgaactgagggagaaatttatcctgccggaaggtgcctcacagggaatgacaccattcaggtcacggggtcgccgatccaaaccatcgtccagggcagctagccccactcgctcctcgtcttccgcctcccagtctaaccactcctgcacctcaatgccttcttcccccgcaactcctgcctctggtactaaagttattcccagtagcggatctaaacttaagagacccaccccgacgttccactcctctaggaccagcctagctggcgacacgtccaacagttcgagtccagcctctacaggagcaaagacaaatagggctgaccccaaaaaatctgcctcaagacctggctcccgtgccggttcccgggcagggtctagggcttcctctcgtagggggtccgacgcctctgacttcgacttgttggaaacccagtcagcttgctccgatacctccgagtctagtgcagccggaggacagggcaacagcagaagagggctgaacaagccatctaagataccgaccatgtctaaaaagacaacgactgcttcccccagaaccccgggtcctaagcgcta

SEQ ID NO: 230547 - DNA, 1035 bp, Artificial Sequence
  Description of Artificial Sequence: Synthetic coding sequence
atgaccgcagtggcagatatttttgatcgggatggcgatggctacattgattattatgaattcgtagcagctctgcatcctaataaggatgcttatcgacccacaacagacgcggacaagatagaggacgaggtgacccgacaggtggcacaatgtaaatgcgcaaaaagatttcaggttgagcagataggggagaataagtaccggttcggcgacagccagcaactgaggctcgtcagaatactaagaagtaccgtgatggttcgggttggagggggatggatggccttggacgagtttcttgtgaagaatgacccctgccgtgctcgagggaggactaacattgaattgagagagaaatttattctccccgaaggtgcgagccagggaatgaccccattcagatctcgcggacgcaggtctaagccaagctcgagagcggcttcacctaccaggtcgagttcctccgcctctcagagcaaccattcttgcactagcatgccatcctctcccgctaccccagcttcaggtacgaagacctccctgcagttcagtcggtgttacgataagccttggctcgtgaattccaaggccggaactcctatcagagatagccacagccccgatctgcaactgccgacacccgaagtgattccaagttcaggaagtaaacttaagcgaccaacacctacgtttcatagctcacgcaccagcctcgccggagacaccagcaacagctcatcccccgctagcacaggcgctaagactaacagggctgacccaaaaaagagtgcgtcccgacctggctccagggccggatccagagccggttcacgcgcatctagccggagagggtccgatgcctccgattttgacctcctggagacccagtcagcctgctctgacacctccgagagcagtgcggcaggtggacaggggaattctcgacgagggctgaataagcccagcaaaattcctaccatgtctaagaagactactacagccagtccaagaacccctggtccaaagagatag

SEQ ID NO: 230548 - DNA, 16292 bp, Artificial Sequence
  Description of Artificial Sequence: Synthetic coding sequence
atgagctcctctgacgaagagacattatctgaaaggtcctgtcgtagcgagagatcttgtcgttctgagagaagttaccggagtgaaaggagtggaagcctgtccccatgccctcccggagacaccctcccctggaatctgccactacatgagcagaagaagcgaaagtcacaagatagtgtcctggatcctgcggaaagggctgtcgtccgggtggccgacgagagggacagggtgcagaagaagacattcacaaagtgggttaataagcacctgatgaaagtgcggaaacacatcaacgatttgtatgaggatctgcgggatggccataatttgatcagtcttctggaagtgctgtcaggaataaagctccctcgggaaaaaggtcggatgcgcttccaccgattgcagaatgtccagatcgccttggactttcttaagcaacgacaggtgaaactggtgaacatccgaaatgacgatattacagatgggaaccccaagctgaccctcgggctgatttggacgatcatccttcacttccagatctcagatatttacatttccggagaatccggggacatgagtgctaaggaaaagctcttactttggacccagaaagtgacagctggatatactggcattaaatgcacaaatttttccagctgttggtctgatggaaagatgttcaacgccttgatccaccgctacagacctgatttagtggatatggaacgggtgcagatccaaagcaatagagagaacctagaacaagccttcgaggtggcggaacgattgggcgttacgagacttctggatgccgaggacgtggacgtaccctctcctgatgaaaagtcagtcattacttacgttagctctatttacgatgcttttccaaaggtcccagagggcggagaaggcatcagcgccactgaggtagacagccgctggcaggagtaccaatctcgagtggattcactgatcccatggataaaacaacatacaatattgatgtctgacaaaaccttccctcagaacccggttgaactaaaagccctgtataatcagtacatccacttcaaggagacagagatactggcgaaggaacgggaaaagggacgtatcgaagaactgtataagctgctggaggtatggatcgaatttggccgaatcaaacttccccaggggtaccaccccaacgatgtggaagaagagtggggcaaattaattattgaaatgctcgagcgggaaaagtccctcagaccagctgtggaacggttagaactgctcttgcagatcgctaacaagattcagaacggagccctgaattgcgaggagaagctcaccctggccaagaacactctccaggctgatgctgctcatctggagtctggccagccagtacagtgcgagagcgatgtgattatgtatattcaggaatgtgagggtttgatcaggcagttacaggtagatctgcagattctgagagacgagaattattaccagttagaagaattagcctttcgtgtgatgagattgcaggacgagctcgtgaccctgcgcctggaatgcaccaacctgtacaggaaaggccactttacttctttggaactggtacctccatctactttgactaccactcatctgaaggccgaaccactgacaaaggcaactcactccagttctaccagttggttcaggaaaccaatgacaagagcagagttagtggctatcagcagttccgaggatgagggaaacctcaggtttgtctacgagctattaagctgggtggaagagatgcagatgaaactggagagagccgaatggggcaacgacctgccgtctgtggagctccagttggaaacccagcagcatatccacactagcgtcgaggagctaggaagcagcgtgaaggaggccaggctctatgaaggcaagatgagtcagaattttcacacatcttacgccgagacacttggaaaactcgagacacagtactgcaagcttaaagagacttctagcttcagaatgagacacttgcagtcactgcacaagttcgtctctcgggctacagctgaactcatttggctgaatgagaaggaagaggaggagctcgcatatgactggtcagacaacaactcgaacattagtgcaaagcgcaactactttagcgaattgacgatggaattggaagaaaaacaggacgtgttccgcagtttacaagacacagctgaactcctcagcctcgagaaccaccctgccaagcaaaccgtcgaggcctactcagccgctgtacaatctcagctgcaatggatgaagcaattatgcctttgcgtagagcagcatgtgaaagaaaatactgcgtactttcagttctttagcgatgccagagagctggaatcttttctgcgaaacctccaggatagcataaaaagaaagtattcctgtgatcataacacaagtctttctcgcctcgaggatctgctgcaggacagcatggacgaaaaagagcagctgattcagagtaaaagttcggtagcctcactggtgggcaggagcaagaccatcgttcaactcaaaccaagatcacctgaccacgtgttgaaaaacactatttctgtgaaggctgtgtgcgactatcggcagatcgagattacaatatgcaagaacgacgaatgcgtcttagaggacaattcccaacgcaccaaatggaaagtcatttcacctacaggcaatgaggccatggtcccgagtgtgtgctttctgatcccaccacccaacaaggatgctatcgagatggcctctcgagtagagcagagttatcaaaaagtcatggcactttggcatcagttgcatgtgaacacaaagtcactcattagttggaactaccttcgcaaggatctcgaccttgtccaaacctggaatctcgagaagctgcgttctagtgccccaggcgaatgccaccagatcatgaagaacttacaagcccactacgaggatttcctgcaggacagccgcgatagtgtgctgttttccgtcgcggaccgattgcgcctcgaggaagaagttgaggcgtgcaaggctcgctttcaacacctcatgaagtctatggagaacgaggataaagaagaaaccgtggccaaaatgtacatctcggagctcaagaacatcagactacgactggaggagtacgaacagagggtcgtgaagagaatccagtccctagcatcttcccgtaccgatcgcgacgcctggcaggataatgcactgagaatcgccgaacaagagcacacccaggaggatctgcagcaactgcggtctgatttggatgccgttagtatgaagtgtgactcattcctacatcagtcaccgtcctcctccagcgtcccaacactgagatccgaactgaatctacttgtcgagaagatggatcacgtttacggactgtcaacagtgtacttgaataaactcaaaacagtggacgtaattgtgcggagcatacaagacgctgaattactggtaaagggttatgagattaaactgtcccaagaggaggtggtcctggcagatctcagcgccctggaggcccattggtccacactccgccactggctatcggacgtgaaggacaaaaatagtgtgtttagcgtgctcgacgaggaaattgccaaggccaaagtggtagctgaacagatgagtagactgactcccgagcgcaacctggacctggaaaggtaccaagaaaaaggctcacaacttcaagaaaggtggcatcgcgtgatcgctcagctcgaaatccggcagtcagagctggaaagcatccaggaagttctgggtgactatcgcgcttgtcacggtacactgattaagtggattgaggagacgaccgcccagcaggaaatgatgaaacccggtcaggcagaggactcccgggtgcttagcgagcaactatcacaacaaactgcgttatttgctgagatagagcggaatcagaccaagctggatcagtgtcaaaagttttcgcagcagtattctacaatcgttaaagattatgaattgcagctgatgacctacaaggccttcgttgagagccagcagaaatcccctggtaagcggagaaggatgctgtcatccagcgatgccattacccaggaatttatggacctgcgtactcggtatacagcgttggttaccctgacgactcagcacgtcaaatacatttcggatgccctacggagattggaagaagaggagaaggtggtggaggaggagaaacaggaacacgtggagaaagtcaaagaactcttggggtgggtgtcaactctggcaagaaacactcaaggcaaagcaacctcatccgaaaccaaagagtctactgacatcgaaaaggccatactggaacagcaagtgctttcagaagaactcactaccaagaaggaacaggtgtcagaagccattaagacctcacagatctttttggccaagcatggacacaagctgtccgagaaggaaaagaagcagattagcgaacagctaaatgccttaaacaaagcttatcacgacctgtgtgacggaagtgccaaccagttgcagcaactgcagagtcagctggcacaccaaacagaacaaaagaccctgcaaaagcagcagaacacgtgccaccaacagctagaagacctctgctcttgggtgggacaggcagagagggcactggccggacaccagggacgtactacacagcaggacttgagcgctctgcaaaagaaccagagcgacctgaaggacctgcaggatgacatccagaacagggctacctctttcgcaactgtggtgaaggatattgagggctttatggaagagaaccagactaagctgagtcctcgagagctcacagctctgagagagaagttgcaccaagccaaagagcagtacgaagccctgcaggaggaaactcgggtggctcagaaggaacttgaggaggccgtgacgtccgccctgcagcaggaaactgagaagtcaaaagctgcgaaggagctagcagaaaacaagaagaaaatcgacgcattgctggactgggttaccagtgtcggcagttcaggaggccaactgttaaccaaccttccaggaatggagcaattgagcggtgcctccctggagaagggagcactcgacacgacggatgggtacatgggagttaatcaggccccagagaaactggacaaacaatgtgaaatgatgaaggcgaggcaccaggagctgttgtctcagcaacagaattttatcctggctactcaaagtgcccaggcctttctcgaccagcatggacacaatctcacccccgaagaacagcagatgctccagcagaagctcggagagctgaaggagcagtatagcacttctctggcacagtcagaggctgagctgaagcaggtgcaaactttacaggacgagttacaaaaattcctgcaggatcataaggagttcgagagctggctggagcgatccgagaaggaactagagaatatgcacaaggggggttcctccccggagactctgccctccctgttaaagcggcagggctcttttagcgaggacgtgatatcacataaaggagacctaagatttgtgaccatctcagggcagaaagtgctcgatatggagaactcattcaaggaaggaaaggagcctagcgaaattggaaatttagtgaaagacaagcttaaagatgccacagagcgatatacggctctccacagtaagtgtactagactgggttcccatctaaacatgcttctcggccagtaccatcaatttcagaattcggccgatagcctccaggcatggatgcaggcttgcgaagccaacgtggagaaactgttaagtgacaccgtggcctctgaccccggagtgctgcaagagcagctcgcaactaccaaacagctgcaggaggagctagcagagcatcaagtccccgtcgaaaaactccagaaggtggcccgtgatattatggaaatagagggcgagccagcccctgatcatcgtcatgtgcaggaaaccactgactccattctgagccacttccagagtctgagctactcactcgcggagcggtccagcctactgcagaaagccatcgcacagagtcagagtgtccaagaaagcttagagagtctgttgcagtctattggcgaagtcgagcagaatctagaggggaaacaggtgtcttcacttagctcgggtgtgatccaggaagcccttgcaaccaatatgaagcttaagcaggacatcgctcgccaaaaatcatccctcgaagctactcgcgagatggtgaccaggttcatggaaaccgctgactctacgaccgctgccgtgctccagggcaagttagctgaggtttctcagcgtttcgagcaactttgcctgcaacaacaggagaaagagagcagcctgaagaagctgctgccccaggcagaaatgtttgaacatctgagcgggaagctgcagcagtttatggagaataaatctaggatgttagcgtcaggcaatcagcctgatcaggacatcactcattttttccaacagatccaggaattgaatttagagatggaggatcagcaggagaacctcgacacactggaacaccttgtgacggaactatcctcctgtggcttcgccctggatctctgtcagcaccaggatagagttcaaaatctgcgaaaggatttcactgagctgcagaaaacggtgaaggaacgtgaaaaggacgcatcaagttgccaggagcagctcgacgaatttcggaaattggtaaggactttccagaagtggcttaaagaaacagagggtagcatcccacctacagaaacttctatgtcagccaaagaactcgagaagcagattgaacatctcaaatctctgctggacgattgggccagtaaagggacactcgtcgaggaaatcaactgcaaggggactagcctagaaaacctgatcatggagatcaccgctcccgattcgcagggcaaaaccggatccatcttgccctcggtgggctctagtgtcgggtctgtgaatggctatcatacatgtaaggatctgacagagatacagtgtgacatgtcagatgtaaacctgaaatacgagaaactgggaggagtacttcatgaacgtcaagaatcattgcaggctattctcaaccggatggaagaggtgcataaggaagctaatagcgttttgcaatggctggagtcgaaggaagaagtccttaagtccatggacgctatgagtagtcccacgaaaactgagaccgtgaaagcacaggcggagagcaataaggctttcctggcggaacttgagcaaaactcccccaaaatccagaaagttaaagaggctctggctggtctgctggtaacatatcccaactcgcaggaagccgaaaattggaagaaaattcaggaagaactgaactccaggtgggagcgggcaactgaagttacagtcgctcggcagagacagctcgaggaaagcgccagtcatctcgcctgctttcaggcggctgagtctcaacttcggccttggctgatggaaaaggagctgatgatgggcgttctgggcccattgtcaattgaccctaatatgctgaacgctcagaaacagcaggtacagtttatgttgaaggagttcgaggcacgtcgacaacagcatgaacaacttaacgaagctgcacaaggcatattaacagggcctggggacgtatctctttcaacctcacaggtgcagaaggagcttcaatcgataaaccagaaatgggtggagttgaccgataagctaaatagccgatccagtcagattgatcaggcaatagtgaagagtactcagtaccaggaactgttgcaggacctctcagaaaaggttcgagctgtcgggcagagactttccgttcaatccgctatctccacacagccagaggccgtgaaacagcagctcgaggagactagcgagatacgcagtgatttggagcagcttgaccatgaagttaaggaggcccagacattatgtgatgaactcagcgtgctgatcggcgaacagtacctcaaagatgaacttaaaaagcggctggagacggtcgccctgcccttacaaggcctggaagacctcgctgccgacaggataaatcgcctccaggccgcactggcttcaacgcaacagtttcagcagatgttcgatgagctgaggacatggcttgacgacaagcagtctcagcaggcgaagaattgccccatttccgcaaagctcgagcggctgcagtcccagcttcaggagaacgaagagttccagaaatcgctcaaccagcattctggaagttatgaggtgattgtcgccgagggtgagtccttgctgctaagtgtcccccctggcgaagagaaacgcacattgcagaaccagctggtggagctcaagaaccactgggaagagctctcaaagaaaacggcagatcggcaatctaggttaaaagactgtatgcaaaaggcacaaaaataccagtggcacgtcgaggatcttgttccctggattgaagactgtaaggccaaaatgagtgaactcagagtgacacttgacccagttcaattggaatcttccctcctgagatctaaggctatgctgaacgaggtggagaagcgtagatctctgttggagattttgaattcagctgccgacatccttatcaatagcagtgaggcagacgaggacgggattcgtgatgagaaagccggaattaatcagaacatggatgctgtcaccgaagagctgcaggcaaagacaggctctctcgaagaaatgacacaaaggctgcgcgaattccaggagtctttcaagaacatagaaaagaaggtagaaggcgctaagcatcagctggagatcttcgacgccttggggagccaagcctgttctaataagaatctggaaaaactgagggcacagcaggaggtcctccaggctctggaaccgcaggtcgactatttacgcaacttcacccaggggctggtggaggacgcccctgatggcagtgacgcctctcagttactgcatcaggccgaagttgcgcagcaagagtttcttgaggttaagcagagggtgaactctggctgcgtgatgatggagaacaaactagaaggcatcggccaatttcactgcagagtgagggagatgttctcacaactggctgacctggatgatgagttagacggcatgggggcaattggcagagatacagattctctgcaaagtcaaattgaggacgtgagactatttctgaacaagatccacgtgttgaagctggacattgaggcctcggaagctgaatgcagacatatgctcgaagaagaaggtaccctggacctcctgggtctcaaaagagaactcgaggctctgaacaaacaatgtggcaaactgactgaacggggaaaagccaggcaggaacagctggagttaaccctggggagagtcgaggatttctacagaaaactcaaggggctaaatgacgcaacaacggcagctgaagaggctgaggccctccagtgggttgtcggcacagaggtggagattattaatcaacaactggcggatttcaaaatgtttcaaaaagagcaggttgatcccttacagatgaagttacaacaggtcaacgggctgggccaaggcttgatccagagtgctggtaaagactgcgacgtacaaggcctagaacacgacatggaggagattaacgccagatggaataccctgaataagaaggtagcccagaggatcgctcagctgcaggaggccctcctccattgcggtaaatttcaagatgcgctcgagcccctgctgagttggctggcagacactgaggagctcatcgcgaatcagaagcccccatcagcagaatacaaggttgttaaggcccagattcaagagcagaagctactccaacggttgctggatgaccgtaaagctaccgtcgacatgttacaggcggagggtggcaggattgcccagtctgctgaactggcagaccgggagaagattaccggccagctggagtctctggaaagtcgctggactgaactcttaagcaaggccgcagctcgtcagaaacagctggaggatattctggtactcgccaagcaatttcacgagactgcagagcccatatctgatttcctctcagtcacagaaaagaaactagccaattctgagcctgtgggtacccaaactgccaagatacagcagcagatcataaggcataaagcactggaggaagacattgagaatcacgctaccgacgtgcaccaagcggtgaagattggccagtcattgtcaagcctgaccagtccagccgagcaaggcgtgctttccgaaaagatcgatagtctgcaggcccgatactctgagattcaggatagatgctgtagaaaggccgctcttctggaccaggccttgagcaacgcacggctttttggcgaggatgaagtggaggtgttaaactggttggcagaggtcgaagacaaactgtctagcgtgttcgtcaaagactttaagcaggatgtgctacatcggcagcacgcggatcacttggcacttaacgaggagatcgtgaacaggaaaaagaacgtcgatcaggctattaaaaacggccaggcacttttgaaacagactactggggaggaggtgttgctgattcaggaaaaattggatggaattaagactcgctacgcggacataactgtcacctcaagcaaggctcttagaacactcgaacaagctcggcagctggcgactaagttccagtccacatatgaggagcttaccgggtggctgagagaagtggaagaagaactggccacctcaggcggacagtctcctaccggagagcagattcctcagtttcagcagagacagaaagagcttaaaaaggaggtgatggaacaccggttagtcctcgatacagtgaacgaggtttcaagagccttgctggagctagtgccttggcgagcgagagagggcttggataaattagtcagcgacgcaaatgagcagtacaagctcgttagtgacaccattggacagagagtggacgaaattgacgctgctatccaacgctctcagcagtatgagcaagcagcggatgcagaactggcgtgggtggctgagactaagcgtaagctgatggcgttaggccctatccgccttgaacaggatcagacaacggcccagcttcaggtccagaaggcctttagcatcgatatcattaggcacaaggactccatggatgagttgtttagccaccgctcagagatcttcggcacctgcggagaggaacaaaagactgtgctccaagaaaaaaccgagtctcttattcagcagtacgaagcgatctccttgctcaatagtgagcgatatgctcgactagaacgtgcacaagttttagttaatcagttctgggaaacatacgaagagctcagcccatggatcgaggaaactagagctttaatcgcccagttgccctctcccgctatagaccacgagcagttaagacagcaacaagaggaaatgaggcagctgcgggaaagcatcgcggagcataagccacacatcgacaagctccttaaaatcggcccacagctgaaagaactgaatccagaagagggcgaaatggttgaggagaaataccagaaagccgaaaacatgtatgcacagattaaagaggaggtgcgccaacgggctctcgctttggatgaagcggtgagtcaatcgacacaaatcacagaatttcatgacaagatcgagcctatgctggaaaccttagagaatttaagctcccgtctgcggatgcccccactgattccagccgaggtagacaaaatccgcgagtgtatcagcgacaataaaagtgccactgttgaactggagaagctccagcctagcttcgaggcattaaaacgccgaggtgaggagctgattggacgctctcagggtgccgacaaagatctcgctgccaaggaaatccaggataaactcgatcaaatggtttttttctgggaggatatcaaggctagggccgaagagcgcgagatcaaattcctggacgtactggagttagcggagaagttttggtatgacatggcagcgttgctgactacgatcaaagacacccaggatattgtgcacgacctggaaagtccaggcatagatcccagtattattaagcagcaggtcgaggcagccgagaccataaaggaggaaaccgacgggttgcacgaggagctggaattcattagaattctgggcgctgacctgatttttgcatgcggcgaaacggaaaaacccgaagtgagaaagtctattgacgaaatgaacaacgcttgggagaatttgaataaaacatggaaagagcggctggagaaacttgaggatgccatgcaggccgcagtgcaatatcaggataccctgcaagccatgtttgattggctcgacaataccgtcatcaaattgtgcaccatgcctccagttggaaccgatctgaacacggttaaagaccaacttaacgaaatgaaagagttcaaggtggaggtataccaacaacagattgaaatggaaaaactgaatcatcagggcgagctcatgctcaagaaagcgactgatgagactgatcgcgacatcattagggaacctctgaccgaactcaaacacctctgggagaatctgggcgaaaagatcgcacatcgacagcacaagctcgagggagctctcctcgcgctggggcagtttcaacacgccctggaggagctgatgtcttggctcactcacactgaggaactgcttgatgcccagagacctatctctggcgaccccaaggtcatcgaagtggaattggccaagcaccacgtactcaagaatgacgtactcgcccaccaagcaaccgtggagacggtgaacaaagccggaaatgaacttctggagagctccgcaggagacgacgcaagctcacttaggtctaggctggaggcaatgaaccagtgttgggagtcagtgttacagaaaaccgaggaacgtgagcaacagctgcaaagcacactgcagcaagctcagggatttcattctgagatcgaagactttctcctggagctgacccgcatggagtctcaactgtctgcgagcaagcccacaggtggcctgcccgagacggccagagaacaactggacactcacatggaactgtatagtcagctgaaggcgaaagaagaaacatacaaccagctgctcgataaaggacgcctgatgctgctttcacgcgatgattctggcagcggcagtaagacagagcaaagtgtcgcactgctggaacagaagtggcacgttgttagcagcaagatggaagagagaaaatccaaactggaggaggcattgaacctggcaacggaatttcagaatagcctgcaggaattcatcaattggctgaccctggccgagcagtctctgaatatagcatctccaccctccctcattttgaataccgttctcagccagatagaggagcataaagtgttcgctaacgaagtgaacgcgcaccgggaccagataattgagctggaccagactggtaatcagctgaagtttctcagccagaagcaagatgttgtcttgatcaagaacctgctggtctccgtgcaatctagatgggagaaggttgtgcagcgctctattgagagaggtaggagtttggacgatgccaggaaacgcgctaaacagttccatgaggcctggaagaaactgattgattggcttgaagacgccgagagccatctggattcagaactggaaatctcaaatgaccccgataagataaaactccagcttagcaagcacaaggagtttcaaaagacactgggtggcaagcagcctgtgtatgacacaacgattcgcacaggccgagcactgaaagagaaaactttgctgcctgaggatagccagaaactcgacaatttcctaggggaggtgcgtgacaagtgggataccgtgtgcgggaagagcgtcgaacgacaacacaagctggaggaggccctgctttttagcgggcaatttatggatgcactgcaggccctggtggactggttatacaaggtggaaccacagttagcagaagaccagccggtacacggtgatttagacctggtgatgaaccttatggacgcccacaaggtgtttcagaaggagctcggaaagcgcaccggaacggttcaggtgttaaagaggtctggcagggaactgattgagaatagtcgagacgacaccacctgggtcaagggccagctgcaggagctgtctactcggtgggacaccgtgtgcaagctgagtgtctcaaaacagtctagactggagcaggcactgaagcaagcagaagtcttcagggatactgtgcacatgttactggagtggcttagcgaagctgaacagactctacgattcaggggcgctctgcctgacgataccgaagccctgcagtcactgattgacacccataaggaatttatgaagaaggttgaggaaaagcgggtcgacgtgaacagcgccgtagccatgggagaggtcatacttgcagtctgtcatccggattgtatcacgacaatcaaacactggatcacaattatcagggctcgattcgaggaggttctcacttgggccaagcagcatcagcagcggctggagactgcgctatcagaactggtagccaatgccgagctgcttgaggagctcctggcatggatccagtgggccgagaccacactaatccagcgtgaccaggaacccatccctcagaatattgacagggtcaaagcattgattgccgaacatcagacattcatggaggaaatgacccgtaagcaacctgatgtcgacagggtcactaagacatataaacgcaagaacatcgagcccacccatgctccattcattgaaaaaagtcgttccggcggtcgtaaaagcctgtctcagccaactccacctccaatgcctattctgagtcagtctgaagcaaagaatcctagaataaaccagctgtccgcacggtggcagcaggtttggctgctcgctctcgaaagacagcggaagctgaatgacgcgcttgaccggctggaagagctgaaggagtttgccaatttcgatttcgatgtttggaggaagaaatatatgagatggatgaaccataagaagtctagggtgatggacttcttccgccgaatcgataaagatcaggacgggaagatcacacgccaggagttcattgacggcatactcgcctctaaattccccacaacaaagttggaaatgaccgcagtggccgacatcttcgacagggacggtgatggttacatcgattattacgagtttgtggcagcccttcatcccaataaggacgcctacagaccaacgacagacgctgataaaatcgaggatgaggtgactcgccaggtggctcaatgcaaatgcgccaagcgctttcaagttgagcagattggagagaacaaataccggttcggtgactcccagcagctaaggttggtgagaattttacgcagtaccgtgatggtgagggtgggcggaggatggatggcactggatgaattcttggtcaagaacgacccttgcagggcacgcggtcgcactaacatagaacttagggagaagttcatattgcccgagggagcctcccaaggtatgaccccctttcgaagccggggtcgcaggtctaaacccagcagcagagcagcttctccaacgcggtcttctagtagcgccagccaatccaaccacagttgcacctccatgccctcttctcctgccactccagccagcgggaccaaagtaattccatcatcgggatcaaagctcaagcgacctacacccacattccactcctctagaacctctctggcaggagacacttctaactcctcctcacccgcttccaccggcgctaagaccaatagggccgatccaaaaaagagcgctagtaggcccggatctcgcgctggctccagggctggcagtcgggcttcctctagacgcggttccgatgcatctgactttgacctactcgaaacccagagcgcctgtagcgacacgtctgaatcatcagctgctggaggccagggaaattcacgccgtgggcttaacaaaccttctaagatacccactatgtccaagaagacgactaccgccagtcccagaactccgggaccaaagcggta

SEQ ID NO: 230549 - DNA, 8411 bp, Artificial Sequence
  Description of Artificial Sequence: Synthetic coding sequence
atggatggggtggctgaattcagtgaatatgtgtccgagactgtggatgtcccgtctcccttcgatctgcttgaaccaccaacctcagggggattcctcaagctatccaagccctgttgctacatattcccaggaggaaggggcgactctgccctattcgcagtgaatggatttaacattctcgtggacgggggatccgataggaagtcatgcttctggaagcttgtacgccacctggacaggatcgatagtgttctcttaactcacatcggcgcagataatctaccaggtatcaacggcctgcttcagaggaaggtggccgaactcgaggaggagcagagtcagggatcctcttcgtattcagattgggtcaaaaatctgatcagtccagagttaggagtggtgtttttcaatgtgccagagaagttgagactgcccgacgcttctagaaaagccaaacggagtattgaggaagcatgcttaactctacagcacctgaaccgtcttgggatccaggccgaacctctgtatagagtggtcagcaatacgatcgaacccctgacactgtttcataagatgggagtgggcagactggacatgtatgtgctgaacccagttaaagactccaaagagatgcagttcttgatgcagaagtgggctggcaacagtaaggcaaaaaccgggattgtgctaccaaacggcaaagaagcagagatcagcgtcccttacctaactagcattaccgcactggtggtatggttacccgcaaatcctaccgagaaaattgtacgcgtcctgttcccaggaaacgcacctcagaacaagatcctcgaaggtcttgaaaaacttaggcacctcgatttccttcggtaccctgttgccactcagaaagacctggcgagtggcgctgtgcccactaacttgaagccgtctaagattaaacaacgggctgatagtaaagagagtcttaaggccaccacaaaaaccgctgtttctaagctggccaaacgcgaggaggtggttgaggaaggagccaaagaagctcggagcgagctggcgaaagagttagctaagactgagaagaaggctaaagaatcgagcgagaaaccacccgaaaagccagccaagcccgagcgggtgaagacagagagcagtgaggctctaaaagccgagaagcgtaagttgatcaaagataaagttgggaagaagcatcttaaggagaaaataagtaagctggaggaaaagaaggacaaggagaagaaagagattaagaaagaacgcaaagagctcaagaaggatgaaggcagaaaggaggagaagaaagacgctaaaaaggaggaaaagcggaaggatactaagccagagctgaagaagatctccaagcccgacctcaaacctttcacaccagaggtgaggaaaacactatataaagctaaagtgcccggtagagtcaagattgacagatctcgagccatccgaggggagaaagagctgtccagcgaacctcaaactccacccgcacaaaaggggacggtccccctgcccaccataagtggacacagggaacttgtcctgtcatctcccgaggatcttacccaagattttgaggagatgaagcgggaggagagagcactgctcgccgagcaaagagacactgggctcggtgacaaaccctttcccttggacactgccgaggagggaccacccagtacagccattcagggcactcccccaagcgttccgggtctgggacaggaggaacacgtgatgaaggagaaagaacttgtgcccgaggtcccagaggaacagggatcaaaggatcggggacttgattccggggctgaaacggaggaagagaaagatacctgggaggagaagaagcagagggaggccgagaggcttccggacagaactgaagcacgcgaagagagcgaaccggaggtcaaagaagacgttattgagaaagctgaactcgaagagatggaggaagtccacccgagtgatgaagaggaggaagacgctacaaaggctgaaggcttttaccaaaagcatatgcaagaacctctgaaggtcactcctcgcagcagagaagccttcggtggaagggaactgggcttacaaggtaaagcacccgaaaaggagacgagcttattccttagcagtctgaccacaccagccggagccactgagcatgtgtcgtacatccaggatgagactatccctggatactcagaaacggagcagaccatctcagacgaagaaattcatgacgagcctgaagagagacctgccccaccccgatttcacactagcacatacgatctaccaggaccagaaggagctgggcctttcgaggcgtcacagcccgcagactccgccgtcccagccacttctgggaaagtatatggcaccccggagacagagctcacctaccccactaacattgttgccgcaccattagcggaggaggagcacgtgtcttccgcgacttcaatcaccgagtgcgacaagctgagcagcttcgcaacatcagtggcagaagatcaaagtgtggcatctctgactgctccccagactgaagagaccggaaagagcagtctcctgctagacactgtgacaagtatcccgagcagcagaaccgaagcaacccagggactggactacgtgccttcagcgggtactattagtccgacctccagcctcgaagaagataaaggatttaaaagccccccttgcgaagacttcagcgttactggtgaaagcgaaaagcgcggagagatcatcggcaagggcctgtctggtgaacgggctgtcgaggaggaagaggaagagacagcaaacgttgagatgtccgagaagttgtgctctcagtacggtacacccgttttctcggctccagggcacgctctgcatccaggagagcccgctctgggagaagccgaagaaagatgtctgtccccagacgacagtactgtgaaaatggcctcccctcccccttctggaccgccatctgctactcacactccgtttcatcagagtcccgtggaagaaaagagtgaaccacaagatttccaggaggcagacagttggggcgatacaaagcgcacccccggagtgggaaaagaggatgcggcagaagagaccgtcaagccgggtccagaggaaggcaccttggaaaaggaagagaaagtgcctccaccacgcagtccccaggcacaggaggctcctgtaaatattgacgaggggctgaccggctgcacaatacagctgctgccagcccaggataaagcaattgtcttcgagattatggaagccggtgagcccacaggccctattttgggtgctgaagctctgccaggaggactgcgcactttaccacaggagcctggaaagccccagaaggatgaggtcctgagataccccgaccggagcttgagtccggaggatgccgaatctttatctgtgctgtcagtaccatcccccgacacagccaatcaggaacccacaccgaaaagtccgtgcggactcacagagcagtatttgcacaaagatagatggcccgaagtcagcccggaggacacccagtcactttcgttgagcgaggaaagcccatctaaggagacctccctggacgtctcttctaagcagctgagcccggagtcactggggaccctgcaattcggggagcttaatctgggaaaagaggaaatgggtcacctgatgcaagccgaagatacaagccaccataccgcccctatgagcgtgcccgagccacacgccgctacagcctctcccccaaccgatgggactaccaggtacagcgcccagaccgacatcacagacgatagcttggatcgtaaaagcccagccagctccttcagccatagcacgcccagcggcaacggaaagtaccttccaggcgcaataacctcacccgacgaacacatcctgacccccgattcttctttctccaaatcacctgaatcattgcccggaccagctctcgaagacattgccatcaagtgggaagacaaggtgcctggtcttaaggatcgaacctctgagcagaaaaaggaacccgaacccaaggatgaagtacttcaacaaaaagataaaactctggagcataaagaagtggtggaacctaaggatactgccatttaccagaaggacgaggcccttcacgttaaaaatgaggcggtgaagcagcaggataaggccctggaacagaagggcagagatctggagcagaaggacacagccctcgagcagaaagacaaagcccttgagccgaaggacaaagatttagaggagaaggataaggctctcgaacagaaggacaaaattcctgaggagaaagacaaagcactcgaacaaaaggacaccgctctggagcagaaagataaggcgctggagccaaaggacaaggacctggaacagaaagacagggttcttgaacagaaggagaagatccccgaggaaaaagacaaagcactggatcagaaggtacgatctgtggagcataaggctcccgaagacacagtggctgagatgaaggatagagatcttgaacagaccgacaaggcgccagaacagaagcaccaggcgcaggaacagaaggacaaagtgagtgaaaaaaaagatcaggcactggagcaaaagtactgggcgcttgggcagaaagatgaggctctggaacagaacattcaagctttagaagagaatcaccagacgcaggagcaggaaagtctggtccaggaggataaaaccaggaaaccaaagatgctcgaggagaaatccccagaaaaggtgaaagcgatggaagagaagcttgaggccctgctggaaaagacaaaagcattgggtcttgaggagagcttagtacaggaaggacgtgccagggagcaggaggagaagtattggcgtggacaagacgttgtccaagagtggcaggaaacctcaccaacccgagaggagcccgctggggaacagaaagaacttgcgccagcatgggaggacacaagccccgagcaggataaccggtattggaggggtcgtgaggacgtggctctggagcaggatacctattggagggagctgagttgtgagcgcaaggtctggtttccccatgagctggacggacagggagccaggcctcattacactgaagagcgggagtcaactttcttggatgaagggcctgatgacgagcaggaagtaccactaagagagcatgctacgaggagcccatgggccagcgatttcaaagacttccaggaaagttctccgcagaaaggacttgaagtcgaacgctggttggcagagtcgcctgtcggactgccccctgaagaggaggataagctgacacggtctcctttcgaaatcatctctccacctgccagcccgcctgaaatggtgggacaacgagtgccttctgccccaggacaggaatcccctatcccagaccctaagctcatgccacatatgaagaatgagcccacgaccccctcttggctggcggacatccccccttgggtccctaaagacaggccgctgcctccagcccctctatcccccgctcccggaccgccaacccccgcacctgaatcacatacccctgcgccattttcctggggcactgccgaatacgacagcgtcgtcgcagctgtgcaagaaggcgctgccgagctggaggggggaccgtacagccctctgggtaaggactaccgaaaagctgaaggtgaacgcgaggaggagggccgagctgaggctccagataagtcctcccacagcagcaaggtgccagaggcttccaaaagtcacgctaccactgaacctgaacagacagagcctgaacagagagaacctaccccctatccagatgagcggagtttccagtatgccgacatctatgaacagatgatgttgactgggttgggtccagcatgcccaaccagagaacccccactaggggctgccggagactggcctccctgtttatcaacaaaagaggctgccgctggaagaaacacaagtgctgagaaggaactcagcagcccaatcagccctaaaagcctccagtcagatactcctacattttcctacgccgcactggcaggccctaccgtcccaccaaggcccgagcccggaccgtcaatggagccttcactgacccccccagctgtccctccaagagcccctattctgtctaaagggcctagtcctccactaaatggtaatattttgtcatgttcgccagaccgccgtagccctagtcctaaagagtctggccgtagccactgggacgatagtaccagtgatagtgagcttgaaaagggcgcacgcgaacagcccgaaaaggaggcccagtccccttcgccccctcaccctatccccatgggctcgcctaccctgtggccagaaacggaggcccatgtcagtccccctctggattcccatctcggccctgctcgcccatcactggatttccctgcatctgcgttcggattttcctcactgcagccggctcctccacagctcccaagcccagccgagcctagaagcgctccctgcggcagcctggctttcagcggagacagggctctcgctctggcacctggccctccaacacgtactaggcatgatgagtacctggaggttaccaaggccccatccttggattcctccctgccgcagcttccctcaccctcttcgcctggagctccattgctgtcaaatcttccgagacctgccagccctgccctgagcgagggttcatcttcagaggccaccaccccggttatctcatccgtagcggaacgttttagcccctccctggaagccgctgagcaggaatcgggcgagctggatcctggtatggaacctgccgcacacagcctctgggacctcaccccattgagccctgctcctcctgcgtccctggacctcgcactggcgcctgccccttctttgcccggtgatatgggggacggcattctgccctgccatttagagtgttctgaggctgctaccgagaaaccatcaccatttcaggttccctccgaagattgtgctgccaacggaccgaccgagacctccccaaaccccccagggccagccccagcgaaggcggagaatgaggaagctgccgcatgccctgcatgggaacgtggggcttggcctgaaggcgctgagcggagctccagacctgacactctgcttagccctgagcagccggtttgtcccgctggcggatcgggaggtccgccaagcagcgcctccccggaggttgaagcgggacctcaggggtgcgcgacggaacctcggcctcataggggcgaattgtcccccagtttcttgaacccccctctccctccgagcatcgacgatcgcgacttgagcaccgaggaagtgaggcttgtgggaagagggggacgtcgccgagtgggcggtcctggcactacagggggaccttgcccagtcactgacgagacacctccgacatcagccagtgactccggatcctctcaaagcgattccgacgtgccgccagaaacagaggaatgcccctccataacagccgaagcagcactcgacagcgacgaggatggcgacttcttacccgtagataaggccggaggcgtatctgggacccatcatcctcgacctggacacgaccctccacctcttccccaacccgaccctagaccgtcaccacccaggccagacgtgtgtatggcggatcccgagggactgagtagtgagagtggcagggttgagagacttcgagaaaaagaaaaagtccagggcagagtgggcagacgggcacctggaaaagcgaaacctgcctccccggcaaggaggctcgacctcaggggtaaacgatctcccacccccggaaaaggaccagccgatcgagcaagccgcgcaccaccgcgacccaggagtaccacgagccaagtcaccccagccgaggaaaaagacggacactcacccatgtcaaagggcttagtaaacggactcaaagccggtcctatggccctcagctccaagggcagctccggggctcccgtgtatgtcgacctggcctatatccctaatcattgttctggaaaaaccgcagatttggatttctttcgccgagtgagagcgagctactacgtcgtgtctggtaacgacccagccaacggtgagccaagcagagccgtgctagatgctcttttagaggggaaggcacagtggggcgaaaacctccaggtaaccctaatccccacccacgacactgaagtgaccagagagtggtaccaacaaacccatgagcagcagcaacaacttaatgtgctagttctcgcttcttcttctaccgtggtgatgcaggatgaatcttttcccgcttgcaagatagagtttta

SEQ ID NO: 230550 - DNA, 9125 bp, Artificial Sequence
  Description of Artificial Sequence: Synthetic coding sequence
atggagaccgaagctgagcccgcacggcctcatggtgttgcaatggagaccacccccggactggggttgcggtcgccaggcgctcccctcgcccagaaccccgctgaattgctgtgtgaggccggagccgcagtggcagctgccagatgggacctgcagaagcatagtctgctaatcgtaatcggcgatattggtacagagtctcagttgcgggcagtgagagctcacctggaacaaggaatattgtcttggaatatagatttatccagcttcgatttgaatcagcagcttcgcctgttcatcacccgccatcttgcccacttctcaagcgaagtaaaaggacagagaacactgtgccaccagtctgagattctggagaccatcatactcgtgaatccctccgctgacagcatctccagcgaagtccaccacctgctgtcttcatcttccgcctataagctgcttatcctgtcaggccagtcattagagcctggaggcgacctgatactacagtccggtacatattcatatgagaactttgcgcaggtgctgcataaccccgaaattagtcagttgctcagcaatcgagacccaggtatccaggccttcttgacagtgagctgtttaggtgagggcgattggagccacctgggactttcaagctctcaggaaacccttcacttgcgtctcaatcctgaaccgaccctccccactatggatggagtggccgagttcagtgaatacgttagcgagacagtggacgttccatcaccttttgacctgttagaacctcctacttccgggggatttttaaaattgagcaagccttgttgttacatattcccaggcggaagaggcgacagcgccctctttgctgttaatgggttcaatatcctggttgatgggggtagcgataggaaatcttgcttctggaagttggtacgccatctcgaccgcattgatagcgtgctgcttacgcacatcggggctgacaacttaccaggcataaacggactattgcagcgcaaagtggcggaactcgaagaggagcaaagccaaggctcatccagttattcagattgggttaaaaatctgatctctcctgaattaggcgtggtgttctttaacgtgcctgagaagctgcgactgcccgatgcctcccggaaagcaaagcgatcaattgaggaggcctgcctgacgctgcagcatttgaatcggcttggcatccaggccgagcctctttatcgtgtggtgagtaacaccattgagccattgaccttgtttcacaaaatgggagtcggaaggctggacatgtatgtactgaatcccgtgaaggattcaaaggaaatgcagtttctgatgcagaaatgggcaggcaactccaaggccaagacaggcatcgtgctgcccaacggcaaggaggcagagatctctgttccctacttgacatcgattactgccttggtggtctggcttccagccaatcccaccgagaagattgttcgggtgctttttcctggcaacgcaccacagaacaaaatcttagagggactcgagaaactcaggcacctagactttctgcgctatcctgtcgctacccaaaaagatctggcctccggcgcagtgccgactaatctcaaaccgtcaaaaattaagcagagggccgattctaaggaaagcctgaaagctaccacgaagactgccgtatccaagctggctaagcgcgaggaggtggtcgaagagggcgcaaaggaggcgagaagtgaactggcaaaagagctcgcaaaaacggagaaaaaggccaaggaatcctccgagaaacccccagagaagcctgccaaaccagaaagggtcaaaacagaatcgagcgaagcgctgaaggcagagaagcgaaagctcattaaggacaaggtggggaagaagcacctgaaggaaaagatttccaagcttgaggagaaaaaagataaagagaagaaggagatcaaaaaggaaagaaaagagcttaaaaaagacgaaggtaggaaggaggagaagaaggacgcaaagaaagaggagaagaggaaagataccaagcctgaacttaagaaaatcagcaagccagacctgaaaccattcacacccgaagtccgcaagaccctgtataaagccaaagtgcctggtcgggtcaagattgacagaagtcgcgctatacggggagagaaggagctgagtagcgagccacaaacaccgccagcccagaaggggactgtacccttgcctacaatttctggtcacagagaactagtgctgtcttctcctgaagatctcacacaggatttcgaggagatgaagcgcgaggagagagccctgctcgccgaacagcgagacaccggtctgggggataaacccttcccgttggataccgctgaggaaggccctcccagtacagccattcaaggcacacctccaagtgtcccaggcctcgggcaggaagagcatgtgatgaaagagaaagagcttgtacctgaggtccccgaggagcaggggtccaaggataggggattggactcaggagctgagaccgaggaggagaaggatacttgggaggagaagaaacagagagaagcagaaaggcttcctgatcgaaccgaggctcgggaggaatccgagcccgaggtcaaagaggatgtgatcgaaaaggccgagctcgaggagatggaggaggtccacccctcagacgaggaggaggaggatgctaccaaggcagagggcttctatcagaagcacatgcaggaacctctcaaggtcacaccgagatcccgggaagcctttggagggagagaactgggattgcaaggtaaggccccagagaaagagacatccttgttcctgagctctctgactacgccagccggagctacggagcacgtttcctatatccaagatgagaccatacccggatactcagagactgaacagaccatctcagatgaggagatacatgatgaacccgaggagcgccctgcacccccacggtttcatacaagcacctatgacttgcctgggccagagggcgctggtccctttgaggcatctcagccagcagactcagccgtgccagccacttctggaaaggtctacggcacacccgagaccgagctcacttatcctactaatatcgtcgccgcaccgttagcagaagaagagcatgtgagctcggctacctctataacagagtgcgataaactttctagcttcgctacctcagtcgccgaggaccagagcgtggcctccttaactgctccacagacagaggagacaggaaaatccagtctcctcctggatactgtgacatccattcccagttcaagaactgaggcgacccagggtctggattatgtaccgtccgctgggacaatcagcccaacttctagtctcgaggaagacaaaggatttaagagcccaccttgcgaggacttttctgtgactggggaaagcgagaagagaggggaaatcatcggaaagggactctccggtgaaagagcggttgaagaagaagaagaggaaaccgccaacgtcgagatgtcagagaaactctgtagtcagtacggcacccccgtgttttcagctccgggtcacgctttacacccaggtgagccagctctaggggaggccgaggagagatgcctgtctccagacgactctaccgtaaaaatggccagcccccctccatctgggccacccagcgccacacatacccccttccatcagtcacctgtcgaggagaaaagcgaaccacaggattttcaggaggcagactcttggggcgacaccaagagaacgcccggagtggggaaggaagatgccgctgaggaaactgttaaacccggtccagaggaaggcaccctcgaaaaagaggagaaggtcccgccaccacggtcaccccaggcacaggaggcgcctgtgaatatcgatgaggggctcaccggctgtacaattcaattgctgcccgcacaggataaggcgatcgtgttcgaaattatggaggccggtgagcctactggtcctatcctgggagccgaggccctgccaggcggattgcgaacacttccccaggaaccagggaaaccccaaaaagatgaggtcctgagataccctgataggagcctgagcccagaggacgccgagtccctttcggtgctatccgttccttctcctgatactgcaaaccaggagcctaccccaaaatcaccttgcggcctaactgagcagtatttacataaagatcgatggccggaggtgagccccgaggacactcaaagtctttccctgtctgaagaatccccctcaaaggagacctccttggatgtctcatctaaacagctatcccctgagagcctcggcactttacagtttggcgaactgaatctgggcaaagaggaaatgggacacttgatgcaggccgaagacacatcacaccatacagcccctatgagtgtgccggaaccgcacgccgcaaccgcttctccccctaccgacggtacgactagatatagcgcgcagacagacatcaccgatgattccttggacaggaagagcccagcctcatctttttcccatagcacgcctagcgggaatggaaagtacctacccggtgcaatcacctctcctgacgaacacatcctgactcccgactccagcttctctaaatcacccgaatcgctacccggaccggctctcgaagacatagccattaagtgggaggacaaggtgcctggactgaaggaccgcactagcgaacagaagaaggagccggagcctaaggacgaggtgctccagcagaaagataagacactcgaacataaggaggtggtagagccaaaagacacggctatctatcagaaggacgaagccctccatgtgaaaaatgaagccgttaagcaacaggataaagcattggaacagaagggcagggatctcgagcaaaaggatacagctttggagcagaaggacaaggcgctggaaccgaaggataaggatctggaagagaaggataaagctctggaacaaaaagacaagatccccgaggagaaagacaaggctctggagcagaaagacactgctctggagcagaaggataaggcgttagaacctaaggacaaagacctggagcagaaggatcgcgtgttggagcagaaggagaaaatccctgaagagaaggacaaggccctggatcagaaagtgcgaagtgttgagcacaaggccccagaggacacagtggccgaaatgaaggaccgcgatctcgagcagaccgataaagccccagaacagaagcaccaggcacaggagcagaaagacaaggtgtccgagaaaaaagatcaggctctggagcagaagtactgggccctggggcagaaggacgaagccttggaacagaacattcaggccctggaagagaaccaccagactcaagaacaggaatccctggtgcaagaggacaagacacgaaaaccgaagatgctcgaagaaaagtctccagagaaggtaaaagctatggaagagaagctggaagcactcctggaaaaaaccaaggctcttggcctagaggagagccttgtgcaagaaggtcgcgctagagaacaggaggaaaagtattggcgtgggcaggacgtggtacaagagtggcaagaaacgtcccctacacgggaggagcccgctggcgaacagaaggagcttgcccctgcatgggaggatacctcccccgaacaggacaacaggtactggcgcggtcgcgaggatgtggccctggagcaggatacttactggagggagctcagctgtgaaaggaaggtgtggttcccacacgaactcgatggtcagggcgctcggccacactataccgaggagcgtgagagcaccttcctcgatgagggaccagacgacgagcaagaagtgcctctgagggaacatgccacgagaagtccctgggcatcagatttcaaagattttcaggaaagctctcctcaaaaaggtctggaggtagaacgctggctggctgagagccccgttggtttgcccccagaagaggaggacaagctcactagatccccattcgaaatcatctctccacccgcatctcctcccgaaatggttggccagcgcgtgccttcagctcctggccaggaatctcccattccagacccgaaactgatgccacacatgaagaacgagccaactaccccctcatggcttgccgatatcccaccatgggtccctaaggaccgtccccttcctcccgctccactgtctcctgcacccggtcccccaacgcccgcacctgagtcgcataccccagccccattcagctggggtacagcggagtatgattctgtcgtcgcagctgtccaggagggtgcagccgaactggaaggaggtccctatagccctctgggaaaggattatagaaaggcagagggggagcgcgaggaggagggccgtgccgaagcaccggataagtcctcacatagctctaaagtccccgaggcctcaaaatcgcatgccaccaccgagccagaacagaccgagccggagcagcgagagcctactccatatcccgatgagcgcagcttccagtatgctgatatatatgagcagatgatgctaactggcttagggcctgcatgtccaacaagagagccccctctcggcgcagctggcgactggccaccttgcctgagcacaaaggaagccgctgcgggaaggaatacctctgccgagaaggagctatcttcccccatttctcctaaaagcctgcagtcagacactccaaccttcagctacgctgctctggctggccctacggttccccctcggcctgagccaggtccttcgatggaaccgagccttaccccacccgcagtacctccaagggctcctatattgtctaaaggcccttctcctcctctgaatggcaatatcctgagttgctcgcccgaccgcagatccccaagccctaaggagtccgggcgaagccactgggatgatagtactagcgattcagaactggaaaaaggagctagggagcagcctgagaaggaggctcagagcccctccccccctcatcctattccaatggggtctcctactctctggccagagacagaggcccacgtgtctccccctttagactcccacctggggccagcaagaccgagtctcgacttccctgccagcgcatttggatttagtagccttcaacccgctcctccccagctgccatccccagctgagccacggtccgcgccatgcgggtcactcgccttttccggggatagagctctagctttggcaccaggccctccgactagaactagacacgatgaataccttgaagtgactaaagctccaagccttgattcctcactgccacagctcccctccccctcgagcccgggagcgcctttgctgtcaaacctgccacggccagcaagcccagctctgagtgagggctcctccagcgaggctacaaccccggtgatttcctctgtcgctgaaaggttctcaccatccctggaggctgcagagcaagagtcaggggagctcgaccctggcatggagccggcagcccattccttgtgggacctaacaccattgtcccctgccccaccggctagcctggacctggctttggcccctgcaccgtctcttccaggtgacatgggcgacggcattctcccctgtcacttggagtgtagtgaggctgcaacggaaaagcccagccccttccaggtcccctccgaggactgcgctgcgaacggccctacagaaacatcccctaacccgccaggtccagctcctgccaaggccgaaaatgaggaggccgctgcttgccccgcttgggagcgcggagcctggccggagggcgcagagagatctagtcggccagacacactgctgtcccctgagcagcctgtctgtcccgctggcggatctggcggacctcccagttctgcatcaccggaagtggaagccggaccacaggggtgtgcaaccgaaccgaggcctcaccggggtgagcttagtcccagcttccttaacccccctcttccaccgtcaatcgacgacagagacttatctactgaggaagtgcgattggtggggcgtggagggagacggcgagtcgggggaccaggtaccactggagggccttgtcctgtaacagatgagacccccccaacatctgcctccgactcaggctccagccagagcgacagcgatgtgccacccgagaccgaggagtgccctagtattacagctgaagcagctttagatagtgatgaggatggggattttcttccagtggacaaggctggcggtgtgagtggcacacaccatccacgccctggccatgacccaccacccctgccccagcctgaccctagaccctcccccccaagacccgatgtttgtatggctgatcctgaaggactttcttctgagtcgggtagagtggagagactgcgagagaaggagaaggtgcagggtagagttggcagaagagcaccagggaaggcgaagcccgcttctccggcaagaagattggacctgaggggcaaacgatccccaacccccggaaaaggtccagctgaccgcgcttcgagagctcccccaagaccccgaagcacaacgtcccaggttacccctgcggaagagaaggacggccacagcccaatgtcgaaaggactggtcaacgggctgaaagccggacctatggcactgagctccaaaggtagtagcggagctccggtttatgtggatcttgcgtacatccctaatcactgttcaggtaagacagccgatcttgatttttttcggagagtcagagcatcctactatgttgttagtggaaatgaccccgcaaacggggagccttcccgtgccgtgctcgatgctctgttagagggcaaggcgcaatggggagagaacttacaagtgacactgatacccactcacgacaccgaggtgaccagggagtggtatcaacaaacacacgagcagcagcaacaattgaacgtgctcgtgcttgcatccagtagcactgtcgttatgcaggatgagagttttcccgcatgtaaaattgaattcta

SEQ ID NO: 230551 - DNA, 8417 bp, Artificial Sequence
  Description of Artificial Sequence: Synthetic coding sequence
atggacggcgttgccgaattctcagagtatgttagtgagaccgtggacgtgccaagtccatttgacttgctggaaccacctactagcggtggcttcctgaaactgtctaagccttgttgctatattttccccggtggccgtggcgattctgcactttttgctgttaacgggtttaacattctcgtggatggaggatcagaccgcaagtcctgcttctggaagttagttcgccatttagatagaattgatagcgtcttgttgacacatatcggggcagacaacctccccggtataaatgggcttctccagcggaaggttgccgaactggaggaggaacagtcccagggttcttcgagctactctgactgggtaaagaatctgatctctcctgagttgggcgttgtgtttttcaatgtgccagagaaactgcgactacctgatgccagccgtaaggcaaagcgatcaatcgaggaagcttgcctgacactccagcatcttaaccgcttaggaatccaggcagagcccctttaccgggttgtgtcaaataccatcgaaccgcttaccttgttccataagatgggcgtgggacggctggatatgtatgttctgaatccggtgaaggattccaaagagatgcaatttctgatgcagaaatgggcaggaaactctaaagcgaagaccggtattgtgctgccaaacggtaaggaggcggagatcagtgtcccttaccttacttcaattaccgccctcgtggtatggttacctgccaaccctacagaaaaaatagttcgagtgttgtttccgggaaatgccccacagaataagatcctggaaggcctcgagaaattacggcatctggatttcctacgatatccagttgccacgcagaaagacctggcttctggtgctgtcccaaccaacctgaaacctagcaagatcaagcagagggctgatagcaaagagagcctgaaggctaccaccaaaactgctgtgagcaaattggccaaaagggaggaggttgtagaagaaggagcaaaagaagcaagatcagagttggctaaggagctggccaagacagagaagaaggccaaagaatcaagtgagaagcctcccgagaaacctgccaagccagagcgcgtgaaaactgaatcatcagaagctttgaaggcagaaaagaggaagctgatcaaggataaagtgggaaagaagcatctaaaagaaaagatcagcaagcttgaagaaaagaaggataaagaaaaaaaggagatcaagaaggagcggaaggaattaaagaaggacgaggggagaaaggaagaaaaaaaggatgcaaaaaaagaagaaaaacggaaggatactaaaccagaactgaagaagattagtaagcctgatctgaagcctttcacccccgaggtgcgcaagacactttacaaagctaaggtccccggacgcgtgaaaatagaccgctctcgggctatcaggggtgagaaagagctgtcaagcgaaccccaaaccccacctgcccaaaaaggcactgtcccccttcctacaatctccgggcatagagagttggtcctctcgagccccgaagatctaacacaggactttgaagagatgaaaagggaggagagagccctattggctgagcagcgcgatacgggcctcggcgacaagccattccctttggatactgccgaggaggggcctccaagcacagcgatccagggtacgccaccttcggttcccggtctgggccaggaggagcatgttatgaaggagaaagagctggtgccggaagtccccgaggagcagggtagcaaggaccggggactcgacagtggggctgagacagaggaggaaaaagacacatgggaggaaaagaagcaacgggaagctgaaagactgcccgatcgcaccgaagctcgagaggaatcggagcctgaagtgaaggaagatgtcatcgaaaaggccgagctcgaagagatggaggaggtccatccatctgacgaagaagaagaggatgccactaaagccgagggattttaccagaaacatatgcaagaaccgctgaaggtgaccccccgaagccgggaggctttcggaggaagagagcttggcctgcagggcaaagccccagagaaagagaccagcctcttcttaagctccctaaccactccggctggggctacagaacatgtctcatacattcaagacgaaaccatccccggttacagtgagactgagcagacaatttcagacgaagagatccatgacgaacccgaggagcgcccagcaccaccaaggttccatacctctacatacgatttgccaggtcccgaaggcgctgggcctttcgaggcttctcagcctgccgacagtgccgtgcccgctacctctgggaaggtgtacgggacacccgagaccgagctgacctatcctactaacattgtggcagcccctctggcggaggaagagcatgtatcttccgccaccagcattacagaatgcgacaagctgtccagttttgctacatcagtggcggaggaccagtccgtcgcctctcttaccgcaccacagaccgaggaaacaggcaaaagcagtctcctgctggatacagtaaccagcattccttcctcccggacagaagcgacccagggactcgactatgttcccagtgccggaacaatctccccaacatcctctctcgaggaggataaggggttcaagagccctccttgtgaagatttttcagtgaccggagagtccgagaaaaggggggaaatcatcggcaaagggttaagcggggagagagccgtagaggaggaagaggaagagactgcaaatgtcgagatgagtgagaagttgtgctctcagtacggtactcccgtcttttctgcccctggccacgccctccaccctggtgaacctgccttgggcgaagctgaggagagatgtctgtcacccgatgactctacagtgaagatggcctcaccgcctccatctgggccaccatctgccactcacaccccttttcaccagagtccagttgaagagaaaagcgaaccacaagactttcaggaagccgatagctggggcgataccaagcggactccgggagtgggcaaagaagatgcggctgaggaaaccgtgaaacctgggccagaagagggcaccctggaaaaggaagagaaggtgccaccacccagatcccctcaagcgcaagaggcccctgtaaacatcgatgaaggcctgacagggtgtacaatccagctactcccagctcaggacaaggccatagttttcgagatcatggaagcgggagagcctaccgggcctatcttgggcgcagaggcgctaccaggcggactgagaaccctcccgcaggaacccggaaagccacagaaggacgaggtcttgcgctaccccgatcggagtcttagccctgaagacgccgaatccctgtctgtgttgagtgtgccaagcccagacaccgctaaccaggagcccaccccgaagtcgccatgtgggcttacagagcaatacttgcacaaagaccggtggccggaggtttctccagaagatacacagtcactctccctgtccgaggaaagtccctccaaagaaacatctctggatgtgtcctccaagcagttatcccctgaatctctcggcactttgcagttcggcgagctgaacctgggaaaggaggaaatgggacatttaatgcaagcagaggacacttctcatcacaccgcacctatgagcgtccctgaacctcatgcggcaacagcgagtccacctactgatgggacaacccggtatagtgcgcagactgacattaccgacgacagtttagacagaaaatcacctgcttcctccttcagccacagcacccccagcggaaatggaaagtaccttccaggagcaataacgtccccagacgagcacatactcaccccagacagttctttttctaagagccctgagagcctgcccggtcccgcactcgaggacatcgccatcaagtgggaagacaaagtccctggcctgaaagatagaacctccgagcagaagaaggaaccggagcccaaagacgaggtgttgcagcagaaggataaaacccttgagcacaaggaggtcgtggaaccgaaagacacagcgatctaccagaaagatgaggccctgcatgttaaaaacgaggccgtcaagcagcaggacaaggcccttgagcagaaagggcgtgatcttgagcagaaggacactgcactggagcagaaggacaaggctctcgaacctaaggacaaggatctggaagaaaaagacaaggccttggaacagaaggataagataccagaggaaaaagataaggcgttagaacaaaaagacaccgccctggaacagaaggataaggctctcgaacctaaggacaaggatctggaacagaaggaccgcgtcttggagcaaaaagagaaaattccagaggaaaaagataaggccctggaccagaaggtgagatccgtcgagcacaaagccccagaagataccgtggctgagatgaaggatcgtgacttggaacaaacagacaaagcccctgagcagaaacaccaggctcaggagcaaaaagacaaggtgtctgaaaagaaagaccaggccctcgaacagaagtactgggcacttggccagaaggatgaggcactagagcagaacatacaggctcttgaagagaaccaccagacgcaggagcaggaaagcctggtccaggaggataagacaaggaagcccaaaatgctagaagagaagagccccgaaaaagtcaaagccatggaagaaaagctcgaagccctgttagagaagaccaaagctctgggcctcgaagaaagtttggtccaggagggtcgggcaagggagcaggaggagaagtactggagaggacaggacgtggtccaggaatggcaggaaacctcgcccactcgcgaggaacctgcaggggagcagaaggaactggcaccggcatgggaggataccagtccagagcaggacaatcgctactggaggggcagggaggacgtcgctctggagcaggatacctattggcgggagctatcatgtgagcgaaaagtctggttcccccatgagcttgacgggcagggcgctagaccccattacacagaggaaagagaatctacgtttctggacgaaggtcccgatgatgaacaggaggtgccccttcgggagcatgcaacacgcagcccttgggccagtgattttaaggacttccaagaaagtagccctcaaaagggactggaagttgagcgttggctcgccgagtctccagtgggactgcctcctgaagaggaggacaagctaactcgcagtcccttcgaaataatctcgccccctgcctcacctcccgagatggtcggccaacgggtcccaagtgcccctgggcaggaatcaccaataccggaccccaaattaatgcctcatatgaagaatgaaccaacaactccttcctggcttgccgatatccccccatgggtcccaaaggataggcccttaccgccagccccactgagcccagcgcctggccctcctacccccgctcctgagtctcatactcctgcgccattctcctgggggactgctgaatacgacagcgtggtggcggcagtgcaggagggggcagcggaactggagggcggtccatactcccctctgggcaaggactaccgcaaagctgaaggcgagagagaggaggaggggagggccgaggcccctgacaaaagctcccacagctccaaggtgccagaggcttctaaaagtcacgcaactacagagcccgaacagacggagcctgaacagagggagcccactccttaccctgacgaaagaagcttccaatacgccgacatctacgagcaaatgatgctcacagggctgggccctgcctgtccgacacgcgaaccccctctgggtgcagctggtgattggccgccatgtctttccactaaggaagcagccgctgggaggaacacctctgccgagaaagaactgtccagccctatcagtccaaagtcgctccagagtgacaccccaactttctcctacgccgctttagccggaccgactgtgccaccacggccagagcccggtccgtccatggaacctagcctgacgccacccgcagttccgccacgcgctcccattctgtccaaaggacccagcccccctctgaatggcaacatcttatcttgctcccccgataggagaagcccttctcctaaagagagcggcagatctcattgggacgatagtacttccgattccgaattggagaaaggcgctcgggaacagcccgagaaagaggctcaatctccatcaccgcctcaccctatcccgatgggtagccctacattgtggccagaaaccgaggcccatgtctcccccccactcgacagtcaccttggacccgctcggccttcattggacttccctgccagcgccttcggattctccagtctgcagcccgcaccacctcagttgcctagtcccgctgagccacgctccgccccttgtggtagtctggcctttagtggggaccgagcccttgccctggctcctggacctccaacacggacaagacacgacgagtaccttgaggtcaccaaagccccttctcttgattcctctttaccgcagttaccgagtcctagcagccctggcgctcctttgctgtcaaacctcccgaggcctgcatctcccgcactgtctgagggaagttctagtgaagccacaacacccgtcatttcctcagtcgcagaaagattctcccctagcctcgaggctgctgagcaggagtccggggagctggatcctggaatggaaccagccgcacactctttgtgggacctgacgccgctttctcctgctccaccagcctcactagatttagctcttgccccagccccaagcctgccgggagacatgggcgacggtattctgccctgtcatttagagtgctccgaagccgcaactgagaagccatctccctttcaggtcccaagtgaggattgtgctgccaacggtcctacggagacttcgcctaacccaccaggcccagctccagccaaggctgaaaatgaagaagccgctgcctgtcccgcttgggaacgaggcgcatggccagagggggctgaaaggtcttctcggccagatacgcttctcagtcccgaacagccagtttgccccgctgggggttcagggggaccacccagctcagcatcgcctgaggtggaagcgggaccccaagggtgtgcgaccgaacctcgcccacatcgcggtgaactgtcaccctcgttccttaatccacccctgcctccctccatcgatgaccgggatctatctaccgaagaagtgcgcttagtggggagagggggaagacgccgtgtcggcggacctggaaccactggtggaccgtgtcctgtcacagatgagactcccccaacatccgcgtcagattccggctcctctcagagcgatagcgatgtgcctccagaaacagaagaatgccccagcattactgctgaggcagctttggactctgatgaggacggcgacttcctccccgtcgataaagctgggggagtcagcggaacccaccatcctagacctggacacgacccacctccactaccacaaccagatcccagaccaagcccacctcggccagacgtgtgtatggctgacccggagggattatcaagcgagtccggaagggttgagagactaagggaaaaagaaaaagtgcaaggcagggtggggaggcgagctcccggaaaagccaagccagcaagcccggcacgtaggctcgatttgaggggaaagaggagccctacgcccggtaaaggcccagctgaccgagcctcccgggcacctcctcgcccacgctctaccaccagtcaggtcacaccagcggaagaaaaagacggccactctcccatgtcaaagggactggtgaacgggttaaaggccggaccaatggcactgagctccaaaggcagttcgggggctcccgtctacgtagacttagcctacatccccaatcactgtagtggaaagacagccgatctggattttttccgcagagtgcgggcaagttattacgtggtgtccggaaatgatcctgccaatggcgagccatcgagagccgtgctggacgccctactggaagggaaggcccaatggggtgagaatcttcaggttagtgtgaccctgatccctactcatgataccgaagtgactagggagtggtaccaacagacccacgaacagcagcagcagctgaatgtactagttctagcctcttcaagtaccgtcgtgatgcaggacgagagctttccagcctgcaaaattgaattcta

SEQ ID NO: 230552 - DNA, 1884 bp, Artificial Sequence
  Description of Artificial Sequence: Synthetic coding sequence
atggacggcgtcgccgaatttagtgaatacgtgtccgagaccgtggacgttccctcaccgttcgatctgctggagcccccaacttctggcggatttcttaagctgagtaagccatgttgttacatcttccctggcggacgaggcgactccgcattgtttgcagtcaatggattcaacatcttggtagacggaggcagcgatagaaaaagttgtttctggaagctagtcagacatcttgacagaattgattcagttctactgacgcatatcggcgctgacaacttgcctggaatcaatggtctgctgcaacgcaaagttgctgagcttgaggaggaacagagtcaaggctcatcctcgtacagcgattgggttaaaaatttaatctctcctgagttgggagtagtgttttttaatgttcctgaaaagctgcgcctgcctgacgccagtaggaaagccaagaggtccattgaagaagcctgtctcactctgcagcacctcaatagacttgggattcaggcggaacctctgtatcgcgtggtctccaacacaatcgaaccgctgaccctgtttcataaaatgggagttggcaggctcgatatgtatgttctcaatccggtgaaagacagcaaagagatgcagttcctgatgcaaaagtgggcagggaattccaaggctaagaccgggatcgtgttacctaatggcaaagaagccgagatctcggttccatatttgacgtccatcactgccctcgttgtctggctgcccgcaaatcctaccgagaaaatagtgcgggtattattcccaggcaacgctccccagaataaaatcttagagggcctcgaaaagcttcggcaccttgactttttgaggtacccagtagccactcagaaagacctcgctagtggggctgttcctaccaacctcaagccaagcaagatcaagcaacgggcagatagtaaagagagcctgaaggccacaaccaaaacggctgtgtccaagctggccaagcgcgaggaggtcgtagaggagggagctaaggaggccaggtcagaacttgctaaggagctggcgaagactgagaaaaaggccaaagaaagttcagaaaaaccaccagagaagcccgctaaacctgagcgggtgaaaacagagagcagcgaggcccttaaggcggagaagagaaagctgatcaaagataaggtcgggaaaaaacatttgaaagagaaaattagcaaactcgaggaaaaaaaggacaaggagaagaaggaaatcaaaaaggaacggaaagaactgaagaaggatgaggggaggaaggaggaaaaaaaggatgctaagaaagaagaaaagcgaaaagacacgaaacctgagttgaaaaaaattagcaaaccggacttaaagcccttcactccagaggtgcgaaagacactgtataaagcaaaagtgcctggcagagtcaagattgaccggtccagggcaatcaggggcgagaaagagctctcctctgagccacagacgcctcctgcacagaaaggcacggttcccctgcccacgatctccgggcaccgcgaactagtcctgtcttcccccgaagatttaacccaggacttcgaggagatgaagagagaggaacgagcactgctggctgaacagcgagatactggcctcggtgacaagccgttccccctggacacagccgaagagggtccaccatcaacagctatccaggggacgcccccaagtgtgccaggactcggacaggaggagcacgtaatgaaagagaaagagctcgtgccggaagtgccggaggaacagggctccaaggaccgcggactggatagtggggcagaaacagaagaaaaaaaaaaaaaaaaaaagaagaagaagtag

SEQ ID NO: 230553 - DNA, 1680 bp, Artificial Sequence
  Description of Artificial Sequence: Synthetic coding sequence
atggcagacgaaagaaaagatgaggccaaagctccacattggacctcggcgccactcactgaggccagtgcccattcccatccacctgaaattaaagatcaagggggagccggagaggggctggttcgctcagctaatggatttccttatcgtgaagacgaggaaggagccttcggggagcacggcagtcaggggacttatagcaacaccaaagagaacggcatcaatggcgagctcacaagcgccgacagggagaccgctgaggaagtgagcgcgaggatagtgcaagtcgttaccgctgaggcagtggctgtgctcaagggggagcaggagaaggaggcccaacacaaggatcagacagcagccctgcctttggcagccgaagagacagctaatctgccaccctccccgccaccaagcccagcaagcgagcagacagttaccgtggaggaggcagctggcggagagagtgctctggccccatctgtttttaagcaagccaaggataaggtctcgaattcaacactctctaagatcccagcactgcagggatcgaccaaatccccgagatacagctccgcctgtccttccacaactaagagggccaccttctccgatagtctgctaatccagcccacttcagccggttctactgataggttgccttacagcaagtctggtaataaggacggcgttaccaagagccccgaaaagaggtcctcgctgcctagaccaagcagcatcctgccacccagacgaggcgtgtcaggtgaccgcgacgaaaattcattttccctcaactcaagcatctctagttcggcaaggagaacaacccgctctgaacctattaggcgcgcaggaaaaagcggaaccagcactcctaccacccctggtagtacagcgattactcccggaactcctccttcttattccagtaggacccccggaaccccagggacgccaagttaccccagaaccccacatactcccggaacccctaagagtgctattttggtaccgagtgagaaaaaagtcgcgatcatcagaacaccccctaagagccccgctacgcctaaacagctgcgactcataaaccaacccttgccagatttgaagaacgtgaagagcaagataggcagcactgataacataaaataccagccgaagggtgggcaagtccgcatactgaacaaaaaaatcgatttcagtaaggtgcaaagtcggtgtggcagcaaggacaatatcaaacacagtgctggaggcggaaacgtgcagattgttacgaaaaagatcgatctgtctcacgtgacctctaagtgcggcagtcttaaaaatattcgtcacaggcccggtggcggacgtgtgaaaattgaaagtgtaaagctggacttcaaggagaaagcccaagccaaagtaggctcccttgataatgcccaccacgtgccgggaggcggaaatgtgaagatcgattctcagaagctgaacttcagagagcatgccaaggctagagtcgaccacggggctgaaatcataacccagtcgcctgggaggagcagtgtggccagcccacggaggctgagcaatgttagctcaagcggctccatcaatctgttagaaagcccacagcttgctacccttgcagaagatgtgacagcggctttggccaaacagggcttgtag

SEQ ID NO: 230554 - DNA, 5483 bp, Artificial Sequence
  Description of Artificial Sequence: Synthetic coding sequence
atggcagatgagaggaaggatgaagccaaagctccccactggacatctgcaccccttactgaagccagcgcccactcccacccgcctgaaataaaagatcagggtggcgctggcgagggactggtcaggagtgccaacggtttcccgtaccgagaagatgaagagggcgcattcggagaacacgggagccagggcacttacagcaacactaaggaaaatgggataaacggcgagctgacatcagccgaccgggaaacagcagaagaggtgtcagccaggattgtgcaggttgtcaccgcagaggctgtcgctgttttgaaaggcgagcaggagaaggaggcccaacataaggatcagacagcggctctgccgctggccgctgaggaaaccgcaaacttaccaccttctccacctccctcacctgcctccgaacagactgtaacagtggaagaagacctcctaacggcctcgaagatggagtttcacgatcagcaggagctgaccccttctacagccgagcccagtgaccagaaggaaaaggaatcggagaaacagagtaagcctggagaggatctgaagcacgctgctctggtgagtcagccagagaccactaaaacctatcctgataaaaaagacatgcagggaacggaagaggagaaagccccactggcgctgttcgggcatactttagtcgcctcgctggaggatatgaagcagaaaacagaaccctcattagttgtcccagggattgacttaccaaaagagccccctactcccaaggaacaaaaagattggtttatcgaaatgcccactgaggctaagaaagatgagtggggactggttgccccaatttctccaggtccactgacacccatgagggagaaggatgtcttcgacgatatccctaaatgggagggtaagcagtttgactctcctatgcctagccctttccaaggaggatccttcactctgccgctagatgttatgaagaacgaaatagttacagagacctctccattcgcacccgcatttctgcaacccgacgacaagaagtcgcttcagcaaaccagtggaccggctaccgcaaaggattctttcaagatagaagaacctcatgaggctaaaccagataagatggctgaagctcccccttcagaggccatgactctgccgaaagacgcccatataccggtcgtcgaagaacacgtgatggggaaagtcctggaagaagagaaggaggcaatcaaccaggaaacagtccagcagcgagacacattcacaccaagcggccaggaacctatcctgacggagaaggagaccgagctgaagttggaggagaagacaactatcagtgataaggaagctgtgccaaaagaatcaaagccccctaagccggctgacgaggaaattgggatcatacagacatcaacagagcatacgtttagtgaacagaaagaccaagagcccactacagatatgctgaaacaggatagctttccggtgagtctcgaacaggctgttactgactctgccatgaccagtaaaactctagagaaggccatgacagaaccaagtgccctaatagagaagagttctatacaggaacttttcgagatgagagtagacgacaaagataaaatagagggtgtgggggctgccacaagcgccgagcttgacatgcccttctatgaggacaagagtggaatgtccaagtatttcgaaacctcagccctgaaggaggaggcgaccaagtccatcgagccaggaagcgactactatgagctctctgacactcgtgaatccgtgcacgagtctatagacactatgagccctatgcacaaaaacggtgacaaggaattccaaactggcaaagagagtcaaccctccccacccgctcaggaagctggttattctactcttgcgcaaagctatccaagtgatttaccggaggaaccttcctctccacaggaacggatgttcactatcgaccccaaagtgtacggagagaagcgagacctgcactccaagaacaaggacgatctgactctatctaggtccttgggtttgggcggtcgcagtgcgatagagcagcggtccatgagcatcaacctgccaatgagctgcctggatagcatcgcactcggatttaacttcggccgaggccacgacttgtcacctttggccagcgatatcctaaccaatacatcgggctctatggatgaaggtgatgattaccttccggctaccactcccgcactcgagaaggccccatgcttccccgttgagagcaaggaagaagagcagattgagaaagtgaaggccaccggtgaagaaagtacacaggccgagataagctgtgaatctccatttttggccaaggacttttacaagaatggaaccgtcatggcaccagacctgccggagatgctcgaccttgcagggacgaggagccggttggcctctgtgtccgcagatgccgaagttgcgaggaggaaaagtgtcccgtccgaaacagtggttgaagattctcggacagggctcccccctgtaaccgacgagaaccacgtgattgttaaaacagacagtcagctcgaagatttgggatattgtgtttttaacaagtacaccgtcccgttgccatcccccgtccaggactcagaaaacttatcaggcgaatcagggaccttttacgaagggaccgacgacaaagtaagacgcgatctggctacagatctcagtctgatcgaggtgaaattggccgctgccggaagagtgaaggacgagttttccgttgataaggaagcatcagcccacatctcaggggacaagtctggactatctaaggaatttgatcaagaaaagaaagctaatgatcggctggacacagtgctcgagaaatccgaggagcacgccgattctaaagagcacgctaaaaaaaccgaggaggcgggagatgaaatcgagaccttcggcctgggcgtgacgtatgaacaggccttggccaaggatctcagcatcccgaccgacgcttctagtgagaaggccgaaaaggggctgagttctgtacctgaaatcgctgaggtcgaaccatctaagaaagttgaacagggactggatttcgctgtccagggccaactggatgtaaaaatcagcgactttggccaaatggctagcgggctgaatatcgacgatagacgcgctaccgagttaaaactcgaggcaacacaagacatgacacccagctcaaaagctccgcaggaggccgatgcatttatgggcgttgagtccggccatatgaaagaggggaccaaagtctctgagactgaggtcaaagagaaagtggccaaacccgacctcgtccatcaggaggccgttgacaaagaagaaagctatgaaagctctggtgaacacgaatcccttacaatggaaagtttaaaggccgatgagggcaaaaaagagacttcccccgagagttctctgatacaggatgagatagctgtcaaattgtctgtggagattccatgtcctcccgcagtctcagaggccgacctggccaccgatgagagggcagatgtgcagatggaatttattcagggccctaaagaagaatcgaaggaaacacctgacatctccataacgccctccgatgtcgccgaaccattacatgagactatcgtgtctgaaccggcagagatccaaagtgaagaagaagaaattgaggctcagggagaatatgataagctcttatttagatctgacacgctccagataacggacctcggcgttagcggagctcgagaggagttcgtagagacctgtcctagtgagcataaaggggtcatcgagtctgtggtgaccatcgaagacgactttattaccgttgttcaaactaccactgacgagggtgaatcggggagccactccgtgcgctttgccgctctcgagcagccagaagtggaaagacgccctagcccacacgatgaagaggaattcgaagtcgaggaggcagccgaggcccaggccgagccaaaggatggctctccagaagcccctgcttcccccgagagggaagaggtggccttatcagagtataagaccgagacctacgacgactacaaagatgagaccaccattgacgactccataatggacgcagactcgctgtgggtggatacacaggacgacgaccgaagcattatgaccgagcagctcgagacaattccaaaagaggagaaagccgaaaaggaggcaaggagaagctcgctggaaaagcatcgcaaagaaaagccattcaaaactggtcgcggaagaataagtactcccgagcggaaagtggcgaagaaggagccttctactgtttctcgcgacgaggtgagaaggaagaaggccgtctataaaaaagcagaactagctaagaaaacggaagtgcaggctcattcaccgtcccgaaagtttatcctcaaacctgcaattaagtacactaggcccacccatctgagctgtgtgaaacggaagactacagcagctggtggcgagtccgcactagcaccctctgtgtttaagcaggctaaggataaggtctctgacggggtcacaaagtcaccagaaaaacgtagcagcctccctcgcccatcttcaatcctgccgcctcggcgtggagtcagcggtgaccgagacgagaatagtttctccttgaacagcagtatttcctcaagtgcaagacgcacaacccgaagcgaacccatacgacgggctggcaaaagtggtacttccacgcctaccactcctgggtccaccgccatcacccccggtactcccccatcttattcgtctcgaacccctggaacccccggaacgccatcatatcctagaactccacatacccccggaacccccaagtcagccatactggttccctcagagaagaaagtggctatcatccgtacccccccaaagagtcctgcaaccccgaagcagcttaggcttattaatcagccccttcccgaccttaaaaacgttaaaagtaagattggctccactgataatataaaataccagcctaaaggagggcaagtgcagatcgttacaaaaaagatagacctgagccatgtgacttcaaagtgtggaagtttaaaaaatattcgccaccgacccggtggagggagagttaaaatagagtccgttaaacttgacttcaaagagaaggcacaggcaaaggtcggctctttggacaatgcgcaccacgttcctggaggaggtaatgtcaagatagacagccagaaactgaattttcgagaacacgctaaagccagggtggatcacggagcagagataattactcaaagccccggacgatcatctgtcgcatctcccagaaggttatccaatgtgagcagtagcggcagtatcaatctcctggagagcccccagctcgccacgttggctgaggatgtgaccgcagcattggcaaagcaggggctgta

SEQ ID NO: 230555 - DNA, 1416 bp, Artificial Sequence
  Description of Artificial Sequence: Synthetic coding sequence
atggctgatgagaggaaagacgaggccaaagcccctcattggacctccgcgcctctgactgaggcatctgctcattctcacccgccagaaattaaggaccaaggcggtgccggagagggtttggtccggagcgccaatggctttccttatcgggaagatgaagagggcgctttcggagaacacggaagccaaggcacatacagtaataccaaagagaacgggatcaacggggaactgacctccgccgatagggagactgctgaggaagttagtgctcggatcgtccaggtggttactgccgaggccgtggctgttttgaaaggcgaacaggagaaagaggcccaacacaaggatcaaaccgcagccctgcccctggcagccgaggaaaccgctaacctccctcccagccctcctccaagtcccgcttcagagcagaccgtgaccgtggaggaagcggctggcggagagtctgccctggccccttctgtatttaagcaggctaaggacaaggtctccgatggagtgactaagagccccgagaaacgctctagcctgccccgaccgagcagcatcctacctccccgtcggggtgtgtctggcgaccgtgacgaaaactcatttagcctgaacagcagcatatcctcatccgccagacgaacaactcgcagcgaacctattcgtagggccggtaagtctggaacttctacccctacaacacctggatcaaccgccatcactcctggcacgcctccctcatactcttcaagaacacccggtacaccgggtacaccctcttacccaaggacgccacacacgccgggaactcccaaaagtgccattctggtgccgagtgagaagaaagttgccattatcagaactccacccaagtctcctgcaacccctaagcaactcaggttaatcaatcagcccttgcctgacctgaagaacgtgaagagcaagataggatcaactgacaatatcaagtaccagccaaagggaggtcaggtacagattgttaccaaaaaaattgacctgtctcacgtgacaagcaaatgtggaagtttgaaaaatattaggcaccggccagggggaggtcgcgtaaagatagagtccgtgaagctggacttcaaagagaaggcgcaggccaaggtgggcagtctcgacaatgcccaccacgtccctggagggggaaacgtgaaaattgattctcagaagctcaatttccgggaacacgcaaaggcccgtgttgatcatggtgcggaaattatcacacagtcccctggcagatcctccgtggccagcccacggcgtctgagtaatgtcagctcttctggatctattaatctgctcgagtctccgcagctggccactctagccgaggacgtgacagccgcactcgccaaacagggtctgtag

SEQ ID NO: 230556 - DNA, 321 bp, Artificial Sequence
  Description of Artificial Sequence: Synthetic coding sequence
atggcggacgaaagaaaagacgaagctaaggctcctcactggacctcagcaccccttaccgaggcctctgcacattcacaccctccagagatcaaagaccagggtggtgctggagaaggtctagtgcgctcagccaatggatttccgtatagggaggatgaagagggcgcatttggtgagcacggctcccagggcacctatagcaacaccaaggagaacggaatcaacggcgaactgaccagcgccgatcgggaaaccgccgaagaggtgtccgcccgtatcgtccaggtggtgactgctgaggccgtagcagtcctgtag

SEQ ID NO: 230557 - DNA, 1416 bp, Artificial Sequence
  Description of Artificial Sequence: Synthetic coding sequence
atggccgacgagcggaaagacgaggccaaagctccacactggacaagcgctcctctaacggaggcctctgcccactctcacccaccggagataaaggaccaaggcggtgccggtgaaggcctggtccgctcagccaacggtttcccatatcgagaggacgaggagggggcattcggagaacacgggagtcagggcacctattctaataccaaagagaatggcattaatggggaactcacttccgcggatcgggaaactgcagaggaagtcagtgcccgaatcgtgcaggtagtaaccgcggaagctgtggcggtgttaaaaggtgaacaagaaaaggaagcccagcacaaggatcagactgccgctctacctttggctgctgaggaaacggcaaacctcccccctagtcccccaccctcgcctgctagcgaacagactgttaccgtggaggaagcagcgggtggggagagcgccttggccccttccgttttcaagcaagctaaggacaaagtcagcgatggtgtgactaagagtccagagaagagatctagcctaccaagaccttctagcatcttacccccacgcagaggcgtgtccggcgatcgggacgaaaattcattttccctgaacagtagtatctcttcttccgctagacgaactacgagaagtgagccaattaggagggctggtaagtcaggtacatccacgcccactacccccggttcaaccgccataacccctggaacaccgccaagttactcaagtagaactcctggcacccccggaacaccatcctacccaagaactccccatacacccggaaccccaaagtcagcgatcctcgttccgtccgaaaagaaagtcgccatcatccggactcccccaaaatcaccagccactcctaagcagctgcgcctgataaatcagcctctgccggacctaaagaatgtgaagagcaagattggcagcactgacaatatcaagtaccagccaaaaggaggtcaagtgcagattgtcacaaaaaaaatcgatctcagccatgtcaccagtaaatgtggcagccttaaaaacattcgacacaggcccggtggaggtcgggtcaaaatcgagtctgtgaagctcgactttaaggaaaaggcccaagctaaagtcggctccctggacaacgcccaccacgtcccagggggaggcaacgtcaagattgactcccagaagctgaattttagagagcatgcaaaggccagagtagaccacggcgctgagatcattacgcagtctccagggaggagctctgtggcttctcctcgaagactgagcaacgttagttcatccggctctattaacctcctcgagtccccccagctggcaaccctcgccgaagacgtgactgccgctctagcaaaacagggcttatag

SEQ ID NO: 230558 - DNA, 5471 bp, Artificial Sequence
  Description of Artificial Sequence: Synthetic coding sequence
atggcagacgagcgtaaagatgaagcgaaggcaccccactggacttctgcccctctcaccgaggcatcagcacactcccaccctcccgagatcaaagatcaggggggagccggtgagggattggtgagatccgccaatggcttcccatacagagaagatgaagagggtgctttcggcgagcacggctctcagggaacctactcgaataccaaggagaacgggatcaacggggagctcacaagcgctgatcgggaaaccgctgaagaagtctccgcccgaattgtccaggttgtgaccgctgaggctgtcgccgttttaaagggggaacaggagaaagaagcacagcacaaggatcaaaccgcagcacttcccttggctgccgaagaaacagccaatctgcccccaagtcctcccccaagcccggctagcgagcagaccgttaccgttgaagaagcctctaagatggagttccacgatcagcaggagctgacaccatcaacagccgagcctagtgatcaaaaggaaaaagaatctgaaaagcaatcaaaaccaggagaagatttgaagcacgccgctttagtgtctcagcccgagacaacaaagacttaccccgataagaaggacatgcagggcacagaagaagagaaggctcctctcgcgctgttcggccatacactcgtcgctagcttggaggacatgaaacagaagaccgaaccatccctggtggttcctggaatcgacctcccaaaagaaccacccacaccaaaggagcagaaggattggttcatcgaaatgcccacagaggcgaagaaggatgagtgggggcttgtggcacctatttctccagggccactgacccccatgcgggagaaggacgtatttgacgacattccgaaatgggaagggaagcagtttgatagtcccatgccatcacctttccagggcggtagttttaccctaccactggatgtcatgaagaatgaaattgtgactgaaacgtccccctttgccccagcatttctgcaaccagatgataaaaaatccctgcagcagacctctgggccagccactgccaaggacagctttaaaattgaggaaccccacgaggcaaagcctgacaagatggcagaggccccaccatcggaagccatgacgcttccaaaggatgcgcatattcctgtcgtggaggagcatgttatgggcaaagtcctcgaagaagaaaaagaggctattaatcaagagaccgtgcagcagcgagacaccttcacaccttctggacaagaaccgatactaacggagaaggaaacggaactgaagctcgaggaaaagaccacaatcagcgataaggaagcagtgccaaaggaatctaaaccgccaaagcctgctgatgaggaaattggtatcattcagacatcaactgagcacaccttttctgaacagaaggaccaggagcctaccaccgatatgcttaagcaggatagctttccagtgagtctggagcaggccgtgacggattctgcaatgacttctaagaccttagaaaaagcgatgacagagccaagtgccctgatcgagaagagttccatacaggagttatttgaaatgagagttgacgataaggataaaatagagggggtcggggctgccaccagtgctgagctggatatgccgttttacgaggacaagagtgggatgagtaaatacttcgaaacaagcgccctcaaggaagaagcaacgaaatctatcgagcccggatccgactactatgaattaagcgacactagagagagtgttcatgagtctattgatacgatgtctcctatgcataagaatggagataaggagtttcagacaggaaaggagtctcagccatcaccccctgcccaagaggccggatattccacccttgctcaaagttacccttcagatttgccagaggagccctcgtctccccaggagcgtatgttcaccattgacccaaaagtgtatggggagaagagggacctgcatagcaaaaataaggatgatctgacattgtctcgctccctgggactcggcggtcgctcagcaatagagcaaaggagcatgtcgataaacctgccaatgagttgcctggatagtatcgccctgggtttcaattttgggaggggccatgacctgtctcctcttgcctccgacattttaaccaacaccagcggaagcatggatgaaggtgatgactatctacctgccactacacccgctctggagaaagcaccttgtttccctgtggaatctaaagaggaggaacagatagaaaaggtaaaagccacgggagaagaaagcacacaggcggagataagctgtgagtcaccgttccttgccaaggacttttacaagaatggtacagtcatggcacccgatctgccagagatgctggacctcgccggtactaggtcacgcctggccagtgtcagcgctgatgcggaagtggctaggcgaaaatccgttccatccgagaccgtggtggaagattccagaacgggccttccccctgtgactgacgagaatcacgttattgttaaaacagacagtcagctcgaggatttagggtactgcgtgtttaacaagtatacagtgccactcccttctcccgtccaggacagtgaaaacttgagcggtgagtcagggacattttatgaggggactgatgacaaggtgcggagagacctggccacagacctgagcctaatcgaggtcaaactcgcagcagcaggccgagtgaaggatgagtttagtgtggacaaagaggcctctgcacatatcagtggggataaaagtggactgtccaaagagttcgaccaagagaaaaaggctaacgacaggcttgataccgtacttgagaagtctgaggaacacgcagacagcaaggagcacgctaagaagacggaggaggcgggagatgagatcgaaacattcggattgggggtgacgtacgagcaggctttggcgaaggatttatcaatacccaccgacgcttcatctgagaaagccgagaagggcctctcctctgtgcccgagatagcggaagtggaaccctctaaaaaagttgagcagggcctggactttgccgttcaagggcaactggatgtgaagatctcagactttggtcagatggctagtggcctgaatattgacgaccggcgagctaccgaactgaagctggaagctacccaagacatgacgccttcctcaaaagccccacaggaggcagacgctttcatgggggtcgaatccgggcacatgaaagagggaaccaaagtgagtgagactgaggtcaaggagaaggtagccaagcctgacttagtacaccaggaggctgtcgacaaagaagaatcttacgaatcctccggcgagcacgagtcactgacgatggaatctctaaaagccgatgaagggaaaaaagagactagcccagagagttcgctcattcaggacgagatcgctgtaaagctgagtgtagagattccatgtcctccagccgtatccgaggctgacctcgctactgacgagcgcgctgacgtgcagatggaattcattcagggcccaaaagaagagtcgaaagagactccagacataagcatcactccctcagacgtggctgagccactgcacgaaacaattgtgtcagagccggctgagatacagtccgaagaggaagagatagaagcccaaggcgaatatgataaactgcttttccgctctgacactcttcagattaccgacctgggcgtatccggcgcacgggaagagtttgtggaaacatgtccctctgagcataagggtgtcattgagtccgtggtcactatcgaggacgactttatcacagtcgttcagactacaactgatgagggggaatcaggcagccactctgttagatttgctgccctggagcaacccgaagtcgagagacgccctagcccccacgatgaggaggagttcgaggtggaggaagcggcagaagcgcaggctgagccaaaggacgggagtcccgaagcccctgcctccccagagagagaggaggtcgcgctgagcgagtataaaactgaaacatacgatgactacaaagatgaaaccactatcgacgattccatcatggacgcggattcattatgggtcgatactcaggacgatgatcgatcaatcatgaccgaacagctggagaccatacctaaggaggagaaggcagagaaggaggctagacgttccagtctcgagaagcatcggaaagaaaagccattcaaaactgggaggggacgtatatccactcccgaacggaaggtcgctaaaaaggaaccctctacagtatctcgagatgaagttagacggaaaaaggcagtctacaagaaggctgaactggccaagaaaactgaggtgcaggcccatagcccgagccgaaaattcattctgaaaccagccatcaagtacacacgcccaacgcacctgtcatgtgtgaaacgaaaaacaaccgctgcgggaggggagagcgcattggccccttcagtatttaagcaggccaaggacaaggtatctgacggcgttaccaagagcccagagaagagaagttcactcccgcgacctagcagtattctaccaccacggaggggcgtgtccggcgatagggatgagaattccttttccctgaacagtagcatctcatccagtgctaggagaactaccaggtccgagcctattagacgcgctggtaaaagcggtacctctactcctaccaccccaggatcaaccgcgatcacaccgggtacaccgccatcatactcttcgagaactccaggcacaccgggtaccccctcttatcccagaacaccacacaccccaggtacccccaaatccgcaattctggtgccctccgaaaagaaggtagcaattatcaggacacccccaaaatcccctgcaactcccaaacagctgcgactcataaatcagccactgccagatctgaagaacgtgaaaagcaagatcggctccacagacaacatcaaataccaacccaaaggcggacaggtacagatcgtgacaaagaaaatcgacctgtcacacgtgacctctaaatgtgggtctttgaagaatatcaggcatcggcctggcggaggcagagtcaaaatcgaaagtgtcaaactcgatttcaaagaaaaggcgcaggctaaggtggggagtctagacaacgctcatcatgtgcctgggggaggcaatgtgaaaatcgactctcaaaagctgaattttcgcgagcacgcaaaggccagggtggaccacggggcagagatcatcacccagagtcctgggagaagcagtgtggctagcccacgacgtcttagtaacgtgtccagcagcggctctattaacctgctggagagcccccagctggcgacactggcagaggatgttactgcggcattggcaaagcaaggtctgta

SEQ ID NO: 230559 - DNA, 2664 bp, Artificial Sequence
  Description of Artificial Sequence: Synthetic coding sequence
atggagacaactggggaccagggcatagaaggaatggcctacatggacgaaaacaggaatattacatttacctgtcctcgtacaccttccgagctcattaacaaaagcagcccactggaggtcttggagtccgccgcttgtgagaagctgcccacgccaaccccacaggtggtcaaggagggagatagcttccccgatacgctcgcaaaaaacggacaggaaatcgctcctgcgcaaatatccaagagcctgatggtggacaactacactaaggatggcgtccccggtcaggaacgacctaaaggtccatcggccgtggtaccatcaacgtctaccggcggagtcgctctgcctatcaccactgccattgagacggtgaacatccacggagaccattctctcaaaaataaagccgagctggctgactctatgaagaatgaggcaggtatcgatgagggccacgtgatcggagaatccgaaagtgtccactctggagcgtctaaacactctgtcgaaaaggtaaccgagttagccaagggacacctgttacctggggtgcccgtggaagaccagagcctcccaggcgaggcgagggctttggagggctatgcagaccgaggaaatttcccggcacaccccgtgaatgaagaaaaagagactaaggaaggcagcgtggcagtgcagatcccagacttattggaagataaggctcagaagctgtccttttgcgaggatcagaacgctcaggatagaaactctaaagggtccgactcgctcaataagaaagtggatctaaccctgctgtctccaaaatcagaaaatgacaagctgaaggaaatttccctcgcttgcaagatcactgagttggagagcgtctcacttcccacaccggagattcagagcgattttctgcactctaaagtcgaagccccaccatcagaggtggccgacaccctggtgattatgacagcaagtaaaggtgtgcgcctgcctgagccaaaagacaagatattagagacccctcaaaagatgactgaaaagagcgagtccaaaacccctggggagggcaaaaaggaagataagtctcgtatggcagagcccatgaaggggtacatgagacctacaaagtctagggggctgactcctttgcttcccaagtcaactatccaggagcaggaaaggcacaagcaactgaagagcgcgggaattgcccgaccagaggaaggccgaccagtggtcagcggaaccgggaatgatatcaccacccctcctaacaaggagctgccccctagccctgagaagaagactaagcctcttgcaaccacccagccagctaaaacgagcacctccaaagcaaagactcaacctacatcgctgcccaagcagcccgctccaaccaccatcggcggtctcaataaaaagcccatgagcctggcatccgggctggttcctgccgctccgccaaagagaccagccgtggcgtctgccaggccttccatcttgccttcaaaggacgtcaagcctaagcccatcgccgacgccaaggctcccgagaagagagccagcccatcaaaacccgcatccgcccctgcatcccgctccggatccaaatccacgcaaactgttgcaaaaacgaccacagccgctgccgtggcttctaccggcccatcctcccgcagccctagcacgcttctgcctaaaaagccaaccgcaataaagacggaagggaagccggctgaggttaaaaagatgacggctaaatcagtaccagctgaccttagcaggcccaaatccacatctacatcgtctatgaaaaagacaaccacactttcgggaacagcaccagcagccggagttgtgcctagccgggttaaggccacccccatgccatcccgaccctctacgactccattcatcgacaagaaacctacctccgcaaagccgagcagcaccactcctcgtctctcccgcctggctacaaacacctccgcaccggatctcaagaacgtgaggtcaaaggtcgggtccacggagaatataaaacaccagcccggaggcggaagagccaaagtggagaagaaaactgaagctgctgcaactactaggaagcccgaaagcaatgctgtaaccaagactgctggtccaattgcatctgcgcagaaacagccagccggtaaggtgcagatcgtatccaaaaaagtttcctactcccatatccagagcaagtgcgggagcaaagataatatcaaacatgtccctggcggaggaaatgtgcagattcagaataagaaggtggatattagcaaggtgagcagtaaatgtggatccaaggcaaatataaagcataagcccggaggaggtgacgtgaaaattgaaagtcagaagcttaattttaaagaaaaggcacaggccaaagtcggtagtttggacaacgtggggcatctcccagccggtggcgcagtgaaaacagagggaggcggtagcgaagcaccgctctgcccagggccaccagccggagaagagcccgctattagcgaggcagctccggaggctggagctcccaccagcgcctcaggcctgaatggacaccccactctgtctggtgggggagaccaaagggaggcgcaaactctggactcccaaatccaagagaccagtatctag

SEQ ID NO: 230560 - DNA, 1392 bp, Artificial Sequence
  Description of Artificial Sequence: Synthetic coding sequence
atctgtgaggaacccgtcgctaagaaacgagaagaattagcgcatttttctaatagcagctctaactctggcaagaaggaactggggacagcgggactgtaccttcattctaagttggagcagatccctgaaggctcatcaaaggagaagggacaggaggacttttctgagaccaggattgactcctgttcccaggtgtgccagcggggtgaaaaacagcctggacaaactgctctcgcaggcaaaaaagagatcgaagtgaccgccacgcaatccactccatcttttcttttcgaaaagcccccacgcgatggcatagcgcgtcctgaggaagggcgaccagtcgtctccgggacgggtaatgacattacgaccccaccgaataaggaactcccacctagcccagagaaaaaaaccaagcccattgctgacgccaaagcacccgagaagagggcctctccctccaaacctgcatcggcacccgcttcccgatccggctctaaatctacgcagactgtcgccaagacaaccactgccgctgctgtggcatctactggaccatccagccggagcccctctacgctgctccctaagaagcccaccgctatcaagaccgaaggaaaacctgctgaagtgaagaagatgaccgcaaaatcagtcccagccgacctgtcccggccaaagtccacatctacctcttccatgaaaaagacaaccacattgtcaggcaccgcacctgcagctggagtggttccatccagggtgaaggcgactccgatgccgagtaggccctccacaactcccttcattgataagaagcctacgagtgccaaaccctccagcactaccccacgactgtcaagactagctactaacacgagcgcaccagatctcaagaatgtcagatctaaggtgggaagtaccgagaacattaaacatcagccaggcggaggcagagtccaaatcgtctcaaaaaaggtttcttatagtcacatccagagtaaatgtgggagcaaagataatattaaacacgtccccggaggaggcaacgtgcagatccaaaacaagaaggtggacatttctaaagtttctagtaagtgcgggagcaaggccaatataaagcacaaaccagggggtggcgatgtgaaaatcgaaagccagaagctgaactttaaggaaaaagcccaagccaaggtagggagcttagataatgtcggtcacttgcccgcaggaggcgctgttaagattgagacataccggctgacgttcagagcaaacgcgagagcacgtaccgatcacggggctgacatagtgtcacgccctccgcactttccaggcggaccgaactccggtagcagagtgcttggcccacttagccgagccgtgcactag

SEQ ID NO: 230561 - DNA, 3459 bp, Artificial Sequence
  Description of Artificial Sequence: Synthetic coding sequence
atggcagacctctctctggccgatgcccttaccgaaccttcccctgacattgagggagagattaaaagagattttattgccacattagaggcagaagctttcgatgacgtcgtgggcgagaccgttggcaaaacagattacatcccgctcttggacgtggacgagaagactgggaactctgagagcaagaaaaagccgtgtagcgagactagccagatcgaagacaccccaagcagtaaaccgacgctcctggcaaatgggggtcatggggtagagggaagtgatacaaccgggagccccaccgaatttttagaggaaaaaatggcatatcaagagtacccaaactctcagaactggcccgaagataccaatttttgtttccaacccgaacaggtggtcgacccaatccaaacagacccatttaaaatgtaccatgatgatgacctggctgacctggtcttccctagttctgctactgctgatacctcgatttttgccggacagaacgaccccttgaaagactcatacgggatgagcccctgcaatacagccgtggtgcctcaaggctggtcagttgaggctctcaactccccacacagcgagagctttgtgtcgcctgaagctgttgccgaacctccccaaccaaccgccgtgccgttagaactggcgaaagagatcgagatggcaagcgaagaaaggccgcctgcccaggctctggaaatcatgatgggcttgaagactacagacatggccccaagtaaagagacagagatggccctagccaaggacatggctctcgccactaagacggaggtggccctcgccaaagatatggagtcccctacaaagttggacgtaactctggccaaggacatgcagcccagcatggagtcagatatggcgctcgtcaaagatatggagcttcctaccgaaaaggaggttgctctggtgaaagacgtccgttggccaactgagaccgatgtgagtagcgccaaaaatgtggtcttgccaaccgagactgaagttgcccctgcgaaagacgtcacactcctgaaagagaccgaaagggcttctccaatcaagatggatttggcgccatcaaaagatatgggtccacctaaggagaacaaaaaggaaacagagagggccagtcctattaagatggacctggcaccttctaaagatatgggaccacctaaagaaaacaagatcgtgccggctaaggacctcgtgcttctgagtgaaattgaggtcgcccaggcaaatgacatcattagttctacggagattagttccgcagaaaaagtggctctcagtagcgagactgaggtggctctggctcgcgacatgaccctgcctcccgaaacaaacgtgatccttacgaaagataaggccctaccccttgaggccgaggtcgctcctgttaaagacatggctcaattaccagagactgagatcgcgcctgctaaagacgtggccccatctaccgtcaaggaggtggggcttctgaaagatatgagtcccctttccgagacagagatggcactgggcaaggacgtcacacctccacccgagacagaggtggtgcttatcaagaatgtgtgcttgccacctgaaatggaggttgcccttactgaagaccaggtgcctgctctgaagaccgaggcgcctctggccaaggatggtgtgctcaccctcgctaacaatgttacgcccgctaaggacgtcccaccactcagcgaaactgaggcaactccagtgcccatcaaggacatggaaatagcgcaaacgcagaagggtatcagtgaggactcgcacctggagtcactacaggatgttggacaaagcgccgctcctacttttatgattagccccgaaaccgtgactggcaccgggaagaaatgcagcctcccagctgaggaggattccgtgcttgaaaagttgggggaacgcaagccctgcaattcccagcccagtgaactgtcgtccgagacatctggaattgccagacctgaggagggacggcctgttgtgtcgggaaccggaaacgatattaccacgcctcccaacaaagagctgcctccttcacctgaaaagaagacaaagccattagccaccactcagcccgctaagacctcaacaagcaaagccaagacgcaaccaacatctctgccaaagcagcctgcaccaacgactattggaggactgaacaaaaaacccatgtctctcgccagcggtctggtaccggctgcaccgcctaagcggccagctgtggcgtcagcgagaccttcaatcttgccctccaaggatgttaagcctaagcctatcgcagatgccaaagctcctgaaaagagggccagcccgtccaaaccggcaagtgctccagctagcaggagtggctccaaatcgacacaaaccgtggctaagaccacaaccgccgctgctgtggcttcaaccggtccgtccagtaggtccccaagcacattgctccctaagaaacctacagctattaagacggaagggaagccagccgaagtgaaaaaaatgactgcaaaaagcgtccctgcagacctctctcgcccaaagagtacctcaactagctccatgaaaaaaactaccaccctgtccggaaccgcgcctgctgccggagtggtcccatcccgcgtgaaagcaactcctatgccgagtagaccaagcaccacacccttcatcgataaaaagccaacttctgcaaagccctcgtctacaacccccaggttgtcacggctggcgaccaatacctccgccccagatttaaagaacgttaggagcaaagtgggtagtaccgagaatattaagcaccagcccggaggaggcagggctaaagtagagaaaaaaactgaggccgcagcaacgacgagaaagcccgaaagcaacgccgttactaagactgcaggacctattgcttcagctcagaaacagccagcagggaaagttcagattgtgtctaaaaaagtctcatattctcatatccagagcaagtgtggcagtaaggacaatatcaagcacgtacctgggggtggcaatgtgcagatacaaaataagaaggtcgacatctcgaaggtttccagcaaatgtggtagcaaagctaatatcaaacacaaacctggtgggggtgacgtgaaaatcgaaagccagaaattgaacttcaaagaaaaggcacaggccaaagtgggcagtctggataacgtcggccacctgccagcgggaggcgctgtgaaaactgaaggcggtggctcagaagcaccactgtgccctgggcctcctgcaggagaggagcccgcaatcagcgaagcggcacccgaagccggtgcccctacaagtgcctcgggcctgaacggtcaccctacattaagcggcggaggagaccagagggaggcgcagaccctcgacagccagatccaggagaccagcatttag

SEQ ID NO: 230562 - DNA, 2139 bp, Artificial Sequence
  Description of Artificial Sequence: Synthetic coding sequence
atggagaccactggggatcagggcattgaaggaatggcatacatggatgaaaaccgaaatattacatttacctgccctcgaacgccatccgagttaatcaataaaagctcccctttggaagtattagaatctgccgcttgtgagaaactccccactccgaccccacaggttgtcaaagaaggtgactcctttcccgacacacttgccaagaacggccaagagattgccccagcccagatttccaaaagcctgatggtggacaactatacaaaggacggggtcccaggacaggaaaggcccaaggggccttcagccgtggtgccttccacaagcacaggaggcgtcgccctccccatcaccaccgcgattgagactgttaatattcacggagatcacagccttaagaacaaggcagaactggccgattccatgaaaaatgaggctggtatcgatgaagggcatgtcatcggtgagagcgagtccgtgcactctggggcttcaaagcatagcgtcgaaaaagttaccgagcttgcaaaaggccatctgctacctggggttcctgtcgaagatcaatcgctccccggagaggccagggccctagagggttacgcagatcggggtaacttccctgcccacccagtcaacgaagagaaagagaccaaggagggctccgtggcggtccaaattcccgatctcctcgaagataaagcgcagaaactttcattctgtgaggatcagaatgcccaggatcgcaattctaaaggtagtgacagcttgaataaaaaggtcgatctcacattactgtcccctaaatccgaaaatgacaaattgaaagaaatctctcttgcctgtaagatcaccgaactggagtccgtctctttgcctactcctgagattcaatccgatttcctccacagcaaggtggaggcaccaccttccgaggtggcggacactctcgttatcatgactgccagtaagggggtacgactgcccgagcccaaagacaagatcctggagactccccagaaaatgactgaaaagagcgaatctaagacacctggggaaggcaagaaggaagacaaatcccgtatggcggagccaatgaaagggtatatgcgacccactaaatccaggggcctgacacctctcctgcctaagtccactatacaggaacaggagcggcacaagcagctgaaatcagctggtatcgcccgaccggaggagggcaggcccgtcgtatcaggaacaggcaacgatattaccacgcctccaaacaaggagctccccccttccccagagaagaaaacgaagcctcttgccaccactcaacccgctaaaacgtccacatctaaggccaagacacaaccaacctccctcccgaaacagcctgctccgaccactatcggaggactgaacaagaaaccgatgagcttggcgtccggactagtgcctgccgcaccaccaaagcgtcctgcagtagcctcagcccgacctagtatcctgccaagtaaagatgtgaaaccaaaaccaatcgccgacgccaaggctcctgaaaagagagcctctccttccaagccagcatccgcccctgcgtctaggtctggatcgaagagcacccagactgtggctaagacaacaaccgccgctgctgtcgcaagtacaggcccttcttctaggtcgccgagcaccctcctcccgaaaaagccaacggcaatcaaaaccgaaggtaaaccagccgaagtgaagaagatgacagcgaagtctgttcccgctgacttgtccagacccaaatctacgagtacttcaagcatgaagaagaccaccaccctgagtggcaccgccccagcagcaggcgtggtcccttcgcgggttaaagcaaccccaatgccttcaagaccttccaccacacctttcattgataagaagcctactagcgcgaagccatcttccacaacaccacgactgtcacggctggcaaccaatactagtgccccagacttgaagaacgtgcgaagcaaggcaaaggtggaaaagaagaccgaagccgctgccaccaccagaaagcctgaatcaaatgcggtgacaaagactgcgggacccatcgcttctgctcagaagcagcctgcaggcaaagtgtag

SEQ ID NO: 230563 - DNA, 2436 bp, Artificial Sequence
  Description of Artificial Sequence: Synthetic coding sequence
atggccgacctgagtctcgcagacgcccttacagagccaagtcccgacatcgagggcgaaatcaagagggactttatcgctactctcgaggccgaggccttcgatgatgtcgtgggcgaaaccgtgggcaaaactgattacatcccgcttctcgatgttgacgagaaaacaggtaatagtgaatctaagaaaaagccatgtagcgagacctctcaaattgaagacacccctagtagcaagcccaccctgctcgccaatggcggacacggcgtcgagggctccgatacaaccggatcaccaaccgaatttcttgaggagaagatggcctatcaggagtacccgaactctcagaattggccagaggacaccaatttctgcttccaaccggagcaagtcgtagatcccattcagacggacccttttaagatgtatcacgacgatgatcttgcggatttagtctttcctagctctgccaccgctgacacaagtatttttgctggccaaaacgaccctctcaaagacagctacggtatgagtccgtgtaacactgccgttgtcccccaaggatggagcgtggaagccctcaatagtccccacagcgagagcttcgtgagcccagaagctgtcgcagaaccccctcagcccaccgcagttccacttgaactggcgaaggaaatcgaaatggctagcgaggagcgccctcccgcacaagcgttggaaatcatgatggggctgaagacaactgatatggcccctagcaaggagacggaaatggcacttgccaaggacatggccctggcaaccaaaaccgaggtcgctctggcaaaggatatggaaagtcctacaaagctggatgtgaccctggctaaggacatgcagccatcaatggagtctgacatggccctcgtcaaggacatggagctgccaactgaaaaagaagtggcgctggtgaaggatggggtgcggcttcccgagccgaaggacaagatcctggaaacaccgcagaaaatgacggagaaatccgaatccaagactcctggggagggcaaaaaagaagacaaatcccgtatggcagagccaatgaaagggtacatgaggccaacaaagtcccgcggactaactccactactgcctaagtcgaccatacaggaacaggaaagacataaacagcttaaatccgctggaatcgccagacccgaagaaggaaggccagtggtcagcggaacggggaatgacataacaaccccccctaacaaagaactccctccaagtcccgaaaagaagacaaagccactggctaccacccagcctgccaagacctccacgagcaaggctaaaacccagccgactagtctccccaaacagcctgcacccaccactattggtgggctcaataaaaaaccgatgagcctggccagcggattagtcccagccgcaccaccgaagagaccagcagtggccagtgcccgtccaagtattttaccttcaaaagatgtgaaaccgaagcctatcgccgatgctaaagctcccgagaagagagcatcccccagcaagcctgccagtgccccagctagccggtcgggaagcaagtcaacacagactgtggcaaaaactacgaccgctgcggcagtagctagcactggaccatcctcccggtctccctctacattactgccaaagaaacccactgcgataaagacagaagggaagcccgctgaggttaagaagatgaccgctaagtccgttccagctgacttgtctagacccaagtctacaagtactagttcgatgaagaaaactactacattgagcggaaccgctccagccgctggtgtggtgccatccagggtcaaagctactcccatgccgagcagacccagcaccaccccttttatcgataagaagcctacatctgcaaagccaagttcaaccactcccagactgtctaggcttgccacaaatacttctgcccctgacctcaagaatgtgagatctaaggtgggctcaacagagaacatcaagcatcagcctggcggtgggcgagttcaaatccagaacaaaaaagtggatatatcaaaggtgtcttctaagtgcggttctaaagctaatataaagcataagcccggtgggggagatgtgaagatcgaatcacaaaagctaaacttcaaagagaaggcacaggccaaggttggtagtctcgacaacgttgggcacctacccgctgggggagctgtgaagaccgaggggggaggctcggaggctcctctctgtccaggaccgcctgcaggcgaagaacccgctatctccgaagccgcaccggaagccggagctccaacctctgcctccggacttaatgggcacccaaccctctcagggggaggcgaccagagagaggctcagacattggattctcagattcaggaaacgtctatttag

SEQ ID NO: 230564 - DNA, 3408 bp, Artificial Sequence
  Description of Artificial Sequence: Synthetic coding sequence
atggccgacctgagcctggccgatgctctgacagagcctagccccgatatcgaaggggaaattaagagggacttcatcgccaccttagaagccgaggccttcgacgacgtggtgggcgaaaccgtgggaaaaacagattatattcccctcctggacgtcgatgagaaaactggtaactcagaatcaaagaagaagccatgtagcgagacatcccagatcgaagatacaccttctagtaagccaacattgcttgccaacggagggcatggggtggaggggtctgataccacaggaagtccaacagaatttctggaagagaaaatggcctaccaagagtaccccaactcgcagaactggcccgaagacactaacttttgctttcagcccgagcaggtcgtggaccccatacagactgatccattcaagatgtaccacgatgatgaccttgcggaccttgttttcccatctagcgccacagcagatacgagtattttcgccggacagaatgaccccctgaaggattcttatggcatgtctccttgtaacaccgcagtggtgcctcaggggtggagcgtcgaagccctgaactctcctcactctgagtcgttcgtcagtcccgaagccgtagccgagccaccccaaccaaccgcggtcccactggagctcgctaaagagatagagatggcatcagaagaacgtcctcccgcacaggccttggaaattatgatggggctcaaaacgaccgatatggccccatccaaagaaaccgaaatggcactcgccaaagacatggcgttagctaccaagactgaggttgctcttgctaaggacatggagagcccaactaaactggatgttacgctggctaaagacatgcagccctctatggagagtgacatggcgctggtgaaggacatggaactacccactgaaaaagaagtggcgctcgttaaggatgtgaggtggccaaccgaaacagatgtgagcagcgctaaaaatgttgtacttccgactgagacagaggtggcacccgctaaggacgtgacgctgctgaaagagacagaaagggcttcccctattaaaatggacctggcaccatctaaagatatggggccaccaaaggagaataagaaggagactgaacgtgctagcccgattaaaatggatcttgcaccatccaaagacatggggcctcccaaggagaacaagatcgtgccggcaaaagacttggtactcctgtctgagatcgaagtcgctcaggccaacgatattatctccagcacagagatctcaagtgccgagaaagtggcactgtcaagtgaaactgaagtggccttagctagggacatgacactaccacctgaaacaaatgtcattctgactaaggacaaggctctgcctcttgaggccgaggtggcacccgtgaaggatatggcccaattgccagaaacagaaattgcccctgctaaagacgtagctccaagcactgttaaggaggttggattgctcaaagacatgtctcccctgtctgaaacagaaatggctctgggtaaggatgtgactcctccgccagaaaccgaggtggtactcattaaaaatgtttgcctgcccccagagatggaggttgccctgactgaggaccaagtacccgcattaaagacggaggcccctttggccaaagacggagtgttaaccctcgcgaataatgtgacccccgctaaagacgtgcctcccttgtccgaaactgaggccacccccgtgcctatcaaggacatggagatcgcccaaactcagaagggaatcagcgaggattcacacctcgagagcttgcaagatgtcggccagtcagctgctccgaccttcatgatcagccctgaaactgtgactggcaccggtaaaaagtgctctttacccgcagaggaggattccgtgctcgagaagttaggagagaggaagccatgtaattctcagccttccgaactgtcaagcgagacttcaggcattgcacgacccgaggaaggcaggcccgtggtgtccgggaccggaaatgatattacgaccccaccaaacaaagagctgcctcctagccctgaaaagaaaacgaaacccctggctacgacgcagcccgctaagaccagtaccagtaaggctaaaacgcaacctacctcactcccaaaacagcctgcccctacaacaatcggcggactgaataagaagcccatgtctctggcgtccggattagtcccagctgcgccacccaaaaggcctgcagtggcttcagctcgcccttcaatcctcccaagcaaggatgtgaagccaaagcccatcgctgatgccaaagccccagaaaaaagagcttccccttctaagcccgcatccgcacctgcaagccggagcgggtccaagagtactcaaacagtggctaagacaaccactgccgcagctgtcgcatcaaccgggccttctagtagatccccttccacactgctgccgaagaaaccaaccgccatcaagaccgagggcaaacccgcagaggtgaagaagatgacggccaagtctgtgccggctgacctgtctcggcctaaatccactagcacatcctccatgaagaagacaaccaccctttctggcacagcaccagcagcaggcgtcgtgccgtctcgcgtgaaggcgactccaatgccatccaggccctctactacgcccttcattgacaaaaaaccaacctctgcaaagccaagctccacaacccccaggctgtcacgactcgctactaatacttccgcccctgatctgaaaaacgtcagatccaaagtcggatcgaccgaaaacattaagcatcaaccgggtggcggaagggctaaggttgaaaaaaaaaccgaggccgctgcaaccacaaggaaacccgaatctaatgcagtcacaaagactgcagggccaattgcttcagctcagaaacagcccgcaggcaaagtgcagatcgtttcaaagaaggtgtcgtacagtcatattcagagtaaatgtggatcaaaggataatattaaacatgtgcccggagggggtaatgtgcaaatccaaaacaaaaaggtggatatttctaaggtgagctccaagtgcggctcgaaagctaacataaagcataaaccgggaggaggcgatgttaagattgagtcacagaaactgaacttcaaggagaaggctcaggctaaggtgggctctctcgacaatgtaggacatctgccagctggcggtgccgtgaaaattgagacctaccgccttaccttccgcgcaaatgcgcgtgcgagaaccgaccacggcgctgatatcgtgtctcgccctccccatttccccggaggtcccaattccggctctcgggtgctgggtcctctttcacgggcagtccactag

SEQ ID NO: 230565 - DNA, 2487 bp, Artificial Sequence
  Description of Artificial Sequence: Synthetic coding sequence
atgagtctgtctgataagcagactgctagcctgacagcagcctacggtcagctatcaaaaggaaaaccggctgagtgcagaatggactctccaaaagagatcagtcaggcaggtttcgaatggcagcgcaccgaaggaaagttaaacgaaattggactgaacgtttcaatggatggtcaacccaaggacggtctcgttaagaacgcatcctttctggaacaaaataaactctgcttctttgagggaaagctcgacaaagaactctcaatcgagatgcaagataaggattgccaagaggcgtcggggcacctcgaatcaaggtatgtgatctctgagacctgccatccattggaagggaattcagtgcaccaaaaaacaagcgagttccatctggggctgatagaagggccagacaagaataaaacaattccagtgcaaggtaaagtggccggaaaaaacggtctggaaaccaaatcacaaagcgacctggacttcccgggagctgcggacatacccactagatacgttaaagaacaagaaacgtccgtctggaacccctcgttccatcctgtcgctcagggttcacttgggagccgggaggcaacgccaggcgaaatggagaactcgatcactccaggttgcccggtcatcggagtggtgaatgataattcagaacagctcaagtgcgagtcccctctgttagtgagtctcgcccacccggcaccaataattgaacactccccaacgaccataccccctatcaccatggtgttcactcaagagcaccttaatgccagctgtcatatacgtgatcatgataaagagctcgagaagttgtcctcaactgaggaagccgtgctgaatcaggcaccccagcagaaaaaggctgtgaggcgggcactcagcgaatgttcgcacctcagtgtgccccctgcggtgaatctggcagataagtaccccgagctccctgccagggaagagccctcttccggactgctgccgccacccagctcgcctatgccttcccccacccctggtaaattgggcgcacccgctatgaagaggtccatgacggtgggggaagaacaaactgcttcttataaactgtctccaggaaagttgcctattttaagcacaaaggagatccccccatttatctgtgaagagcctgttgccaagaagcgggaagaactggctcatttttcaaattcctccagcaatagcggtaagaaggagctgggcacggccggactgtatttacactctaagctcgaacagattcccgagggcagttcgaaggaaaagggtcaggaggacttttccgaaacacgaattgacagttgcagccaggtgtgtcagcgcggagaaaagcagccaggccagaccgcattagccggaaagaaggagattgaggtgaccgccacacagagcactccttcattcctgttcgaaaaacctccgagagacggaattgcgcgacccgaggagggacggcctgtcgtcagtggcacgggcaatgacatcaccacaccccctaacaaggagcttcctccgagccctgaaaaaaagaccaagccgattgctgacgccaaggcgccagaaaagagggcctctccgagcaagcccgcatcggccccagcaagtcgctccgggtctaaaagcacccagaccgtagcaaaaactactacggcagctgccgtcgcttccaccgggccttcctcgagatcccccagtactctgttacccaagaagcccaccgccgacctgtcaaggccaaagtctacctccaccagtagtatgaagaaaacgaccaccttgtccgggacagctcccgctgctggggtggtgccgagcagagttaaagctacacctatgccctctaggccctctactaccccttttattgacaagaaacctacttccgctaaacccagctccacgacacccaggttaagcagacttgcaacaaacacaagcgcaccggaccttaaaaacgtccgtagcaaggtgggatctacagagaatattaagcatcagccaggcggaggccgagtgcaaattgtgtcaaaaaaggtgtcttactctcacatccagtcaaaatgtgggtctaaggataacatcaagcatgtccctggtgggggtaacgtgcagatacagaataagaaggttgacatttctaaggtgagctctaagtgcggatcgaaggcaaacatcaagcacaaacccggtggcggagatgtgaaaattgagagtcagaaattaaacttcaaggagaaggctcaggcaaaggtgggaagtttagacaatgtgggccacctcccagctggcggtgccgtgaagattgagacataccgactgacatttcgagccaacgcccgagccagaactgaccatggagcggatatcgttagcaggccaccacactttcccggaggcccaaattctggatccagagtgcttggcccactcagtcgagctgtccattag

SEQ ID NO: 230566 - DNA, 6893 bp, Artificial Sequence
  Description of Artificial Sequence: Synthetic coding sequence
atggcagacctttcactggcagatgctctgaccgagccatccccagatatcgaaggcgagatcaaacgcgattttattgccacactggaggcggaggccttcgacgacgtggtgggggaaactgtgggtaaaacagactatataccactgctggacgtcgatgaaaaaacaggtaatagcgaaagcaaaaagaagccgtgttccgaaacatctcagattgaagatcttcccttgccccctcatcccgcttcattatctttccacctacccctggataccccttcttctaagccgacacttctggccaacggtgggcacggcgttgagggctctgataccacagggtcgcccaccgaattccttgaagagaagatggcatatcaggagtacccaaatagccagaactggccagaggacacgaacttctgcttccagcctgagcaggtggttgaccctattcagacagatcctttcaagatgtatcatgatgatgatctggccgatttagtgtttccatccagcgccacagccgatacttccattttcgcagggcagaatgacccactgaaggactcatatggcatgagcccctgcaataccgcggtggttcctcaggggtggagcgttgaagccctgaatagccctcatagtgagtcttttgtttctcccgaagcagtggccgaacctcctcagccaacagcggtgcctctggaacttgctaaggagattgagatggcttccgaagagagacccccagcacaggcattagagattatgatgggactgaagaccaccgatatggctccttctaaggaaactgagatggccctggctaaggacatggccctggcaacaaagactgaggttgccctggcaaaggacatggagtccccaaccaaactggacgtcactctggccaaagatatgcagccctccatggaaagtgatatggcactggtgaaggatatggagctcccaacggaaaaggaagtcgcgttagtgaaagatgtaaggtggccaacagagacggatgtatcttccgcgaagaatgtggtgctaccaacagaaaccgaagttgctccagccaaggacgttaccctgctgaaagagacggaacgggcatcccccatcaagatggacctagcaccctcaaaggatatgggacctccaaaggaaaacaaaaaggagaccgaacgggcttctcccatcaagatggatcttgctccgagtaaagatatgggaccacctaaggaaaataaaatcgtcccggctaaagatttagtgctattgtcagagatagaagtagcacaggctaacgacatcattagcagcacagagattagctccgccgagaaggtggccctgtccagcgaaaccgaggttgctttggccagggatatgacccttccaccagagaccaatgttatactgacaaaggataaggctctaccgctggaggcggaggttgcacctgtgaaagacatggcccagctcccagaaactgagattgccccagctaaggatgtagctccctccacggtgaaagaggttggtttactgaaggatatgagcccactgagtgagacagagatggcgcttgggaaagacgttaccccacccccagaaaccgaggtggtgctaataaagaatgtatgcttgcccccagagatggaggtggctctcacagaggaccaggtacctgcccttaaaaccgaggctccacttgcaaaagacggagttctgaccctcgctaataatgtaacccccgctaaagatgtgccccctctatcagaaactgaggcaacacccgtgcctattaaggacatggagattgctcaaacccagaaagggatctctgaagactcccatctcgagtcccttcaggacgtgggccagagcgccgctcctacattcatgatttcacccgaaacagtcactggaaccggaaagaagtgtagcctccccgcagaagaagactcggttctggagaagctgggtgagagaaaaccttgtaactctcagccaagcgagctttcttccgaaactagcgcaaattttatgtattgcgggacaccaccaacacaggcaaagcaagtctgcaggccctcagatcgcaggtcaacgcggccaaagcccgcaagagtgcctccagagctgcttggcggatcccccccttggaagaccctcgaccacaggctggggcactgcagcttaagcgagtcaggatgggtgagcggcagctccagctgcggcggtccagggaaccaaaggaagtccatccacgtggatagcctggaaccccagagggatctcgggcgagaagcgtgggatatagagtcaacacctatcatgatgaagaaaaagaaaaaaaaacctaaacagaagcggtacagccagccaagggcaggaggcccaagcgatgacgataacgctgacaagcctaagggccaccctttcgcagccgacacacagaaatctggtgtgctaccttcccaaccaacaaccatgggcactgagtacggcctggtttccggcgaaaatctgaagcgggaatgtttagtaaatagcagcgccgctagacttgtcgccgaaaattttgtgagtgagtccctgcgaatacccctctacccttccgaggaggctcctaagaccgcgatctcatcacagagtaaactcagggtcgaggaggaaagcaaaagcaacaaatccgttctccagaatcaagacaagaagctgctgaaacagcatgaatacaagccgcaacctgctcctcatctgaagacccctgtagacaagagtcagagcgtaggtcctctgaatctaaagggccctctggcagaagtcagcgcctacaatgtggagaccccactcgatattcggctgaaagaaggctgctcacccttcctggaccaggaagttatgggcgtggtctcaaagcccacagcggctaaagaaattccaaacctggtgcctacgctgatagcctccaatccgctggagtgtaacttgaaggagggcaataacgaaagcaagatgaccaagctccaaaatgtcaaacttaaagagttcccagagggtgcagaggaggacaaagagctgaagaaggaggctttcccaaacgaacggcaggaaataagcatattcacaagcgagcagctccaaggccaagtattagtccaggtgccaggcgtggagaacgagccgtttaagcgcatggccggtgacgggaaatcacgtaagggtcggggtagcagcggaaaaatgagaaccgattccgggaaagttaaggcgaagtccgaattaccgtttttgctggattcacaaaaagatgggagagccgtattgatccccagcgagccagtgtctaaaacggaggggatgaccacacaggacaagagtgaggaacttggactcaactcctctaaacagcccggaacaaaggcagatttgacggaggccgtggttatgggggagccaaaagaaatgacccagccaaaggtggctggcacaatgcaggctctgattcctctggaatccggatcaggtatgacccagactagcggcgtgtccacagagacgggcgacgtggtcaaggatatgggagtgaataaccagagcaaggagggcagatgcccatggaaggatcacgaggctgctccctggatttccgagaaacctaaaaaacgtggtaatgaaggtaaatctaaaaaatttaagaacaattactcaactcaacccgctagaatggagcgtaaggaagagatcttaaacccacctttcgaaggaaaagacggtgacacgggctctattccacataaaagcaaggaaataggttttactttcccaaaaatgcacgattcatctttctcacacacacctgacactcccactgttgaggccgtagaccggaagggagggaactttcaggtcaattttgtcgaactgggaaccttaggcgaaaataaaatctccaccgttaaggcctcaactgtgactgagcccccagctaaggtcaccgacgtttcttgtcaggaacagattcagggggctggatttgtgcccagcgtcgtgtccgaagaaaataaaaccgacgccgctaacagatacacggcagtggcagacaagccttccaagagatccaacgacggtaagtccaaaaaggtgaagaattccagtcctgagaagcacattttagaaaacaaaatagatgctaccaaaattcacgtgccgatggagactacaggcgatcaaggtattgagggcatggcatacatggacgagaaccgcaacatcactttcacatgcccccgaactccttccgagttgataaacaaaagttcccccttggaggttcttgagtcagctgcatgcgagaaactgcccactccaacacctcaagtcgtgaaggaaggggactcctttcccgacactctggcgaagaacggccaggaaatcgcaccggcacaaatctcaaagagcctcatggtcgacaactataccaaagacggagttcccggtcaggagcggccaaagggaccttcagcagttgtaccatcaacctctaccgggggagtggctcttcccattaccacagctattgagacagtcaacatccacggggaccatagccttaagaataaggccgaattagcagactctatgaagaacgaagcgggaatagatgagggccatgtgattggagaatccgaaagcgtgcattctggcgcttccaaacacagcgtcgagaaggtgaccgagctcgccaaaggtcacctcctcccgggagtcccagtggaagaccaatcccttccaggagaagcccgtgcgcttgaaggatacgctgaccgcggaaatttcccggcacaccctgtcaacgaggaaaaggagacaaaagagggatccgttgcggtacaaattccagacttgttggaggacaaggcacagaagctgtcattttgtgaggaccaaaacgcccaagaccgtaattcaaaaggctccgattctctgaacaagaaagtagacttaacacttctgagtcctaaaagcgagaacgacaagctaaaggagataagtctggcatgtaagatcacagaattagagagcgtgtcactccccacacccgagatccagagcgatttcctgcactccaaggtggaggcccctccatccgaagtcgcagacaccttagttattatgaccgcctcgaaaggggtccgtcttcccgagccgaaagataaaattctcgaaacgccccagaaaatgactgaaaaatcagagagcaaaactccaggagagggcaaaaaggaggataagtctagaatggccgagcccatgaaggggtacatgcggccaaccaaatcaagagggctaacccccctgctccctaagagcaccattcaagagcaagagcgacacaagcagctaaagagtgcaggcatcgctcgccctgaagaagggagacctgtggtgtctgggacaggaaacgacataaccactcctccaaataaagaactcccccctagcccagagaagaagaccaagccactggcgactacgcagccagccaaaaccagcacctccaaagccaagacacaacccacaagtctgccgaagcagcccgcacctacaaccattggcggactgaacaaaaagcccatgtctttggcgagcggattggtcccggcagcccctccaaagcgcccagctgtggcatcggcacgaccaagcatcctcccgtctaaagacgtaaagcctaagcccattgcagatgcaaaggcccctgaaaaaagagccagcccctcaaaaccagcctccgcccctgcctccagatctgggtctaagtccactcagacagtcgccaaaactaccaccgctgccgcagtcgcttcgaccgggcctagtagccgctctcctagtaccctgctgccaaagaagcccaccgccattaagacagaaggaaagccggctgaggttaagaaaatgacggctaaatctgtccctgcagacctctcccgtccaaagagcacatccacaagcagcatgaagaaaaccaccacattatctggtacagcacctgccgctggtgtcgtcccctcacgtgtgaaggccacgccaatgccttcacgcccaagcacgactccattcatagataagaagcccaccagtgcaaagccaagttcgaccacccctcggttatccaggctcgcaaccaatacatcagcccctgacttgaagaatgtaagatcgaaagtaggtagtaccgagaatattaagcaccagccaggcggagggcgagcaaaggtcgaaaagaagacggaggctgctgcaactactcgaaagcctgagtctaacgccgtcacaaaaactgccggtcccattgcctccgcccaaaagcaaccggctgggaaagtgcagatcgtgagcaaaaaggtctcatacagccacattcagtctaagtgtggctcgaaggacaacatcaaacacgtgcccggtggagggaatgtgcaaatccagaacaaaaaggttgatatctcaaaagtgtcatcaaagtgtggctctaaggccaatattaagcataaacccggagggggagatgttaagatcgaaagtcagaagctcaacttcaaagagaaagcgcaagcaaaggtcggatcactcgacaacgtcgggcatctgcccgctggtggagccgtgaagaccgagggcggaggatcagaagcaccactctgcccagggcctccagcgggagaggagccagcaatcagcgaggctgcccctgaggcaggagctccaacctcggcgtcaggcctcaatggccaccctacattgtccggaggcggagatcaacgggaggcccaaactttagattcccagattcaagagaccagtattta

SEQ ID NO: 230567 - DNA, 750 bp, Artificial Sequence
  Description of Artificial Sequence: Synthetic coding sequence
atgactgcgaagagtgtgcctgcagacttatctcgtcccaaaagtacatcaacatcttctatgaagaagactacgacgctatctggtactgcccctgcggcaggtgtagtaccgtccagagtgaaggccactccaatgccatcccggcctagcaccactccttttatcgataaaaagcccaccagtgccaagccaagttccaccacacctcgactgtccagactcgccaccaatacgagcgcacctgacctgaagaacgtgcgttcgaaggtcgggagcacagaaaatattaagcaccagcccggagggggaagagtgcagattgttagcaagaaagtcagttattcccacatccagtccaaatgcgggtccaaggataatatcaaacacgtgcccggaggcggtaacgtgcagatccagaataagaaagtcgatatctctaaagtcagttctaaatgcgggtctaaagctaacataaagcacaaacccggaggaggagacgtgaagatagaatcgcagaagttaaactttaaagaaaaagcccaagctaaggtcggcagcttagataatgttgggcacctgccagctggaggagctgtgaagatcgagacctatcgactgacattccgagccaacgcgagagcacgaacagatcacggggctgatatagtgtcccgacctccccactttcctggcggtcctaatagcgggagtagagtgttgggccctctatctcgcgctgtgcattag

SEQ ID NO: 230568 - DNA, 300 bp, Artificial Sequence
  Description of Artificial Sequence: Synthetic coding sequence
atggctgacttgtccctggccgacgcgcttacagagccgtcacccgacattgaaggcgagatcaagagagacttcatcgccactttggaagcagaagctttcgatgatgtagttggcgagacggtgggaaaaaccgattacattcctctgctggacgtggatgagaagacggggaatagtgaatcgaaaaaaaagccctgctctgaaacgtcgcagattgaagacacaccttctagcaagcctaccctgctcgcgaacggcggtcatggtgtcgaggggtctgacaccacagaagcttag

SEQ ID NO: 230569 - DNA, 2277 bp, Artificial Sequence
  Description of Artificial Sequence: Synthetic coding sequence
atggccgagcccagacaggaattcgaggttatggaggatcacgcgggaacctacgggctcggcgacagaaaagatcaggggggatacactatgcatcaagaccaggaaggagatacggatgccggtctcaaggaatcccctctgcagacccctacggaagatggcagcgaggaacctggaagtgagaccagcgacgctaaatccactccgacggcagaggatgttaccgcaccactggtcgacgaaggggctcccggtaagcaggccgcagctcagccacacactgagataccggaaggaacaactgctgaggaagccggaataggagatacgcccagtcttgaagatgaggcagccggtcatgtgactcaggaacccgagagcggaaaggttgtacaagagggattcttaagagagccaggtccacctggactgagtcaccaattgatgtccggaatgcctggcgcacctctgcttcccgaaggaccaagagaggcaaccaggcagccctcggggaccggtcccgaagacaccgaaggcggtaggcacgctcccgagctgctcaagcatcagcttctgggagacctccatcaggaaggaccaccactgaaaggagctggtggtaaggagcggcctggctctaaggaggaagtggatgaagatcgggacgttgatgaatccagcccccaagacagccctccatccaaagccagtcccgctcaggatgggaggcccccacagacagcggctagagaagccacgtccattcccggatttcccgctgaaggcgctattccacttcccgtggattttctgtccaaggtcagcaccgaaataccggctagtgagcctgatggcccaagcgtggggagagccaaagggcaagatgctcctctggagtttacatttcacgttgagataacgcctaacgtccagaaagagcaagcccatagcgaggaacacctcggccgagcagcctttcctggcgcaccgggtgagggcccagaggcacgaggtccaagtctaggagaggacacgaaggaggctgacttacctgagccgagcgaaaaacagcccgctgctgccccacgagggaagcctgtttcaagggtgcctcaacttaaggctaggatggtctccaaatccaaagacggcaccggctccgacgataagaaagctaaaacttccacgaggagtagcgccaagacactaaagaaccggccatgtctttcgcccaagcaccccacccccggaagctctgacccactgatacagccgtcttctcccgctgtctgcccagaaccaccctcctcccctaagtacgtctcatcggtgacgagcagaacgggctcctccggcgctaaagaaatgaagcttaagggggctgatggtaagaccaagatcgccacacccagaggagcggcaccgccaggccagaaaggacaggcgaacgcaacacgcatccccgcaaaaacgcctcctgctccgaagactcccccttcatctggtgaacctcccaagagtggggacaggagcggctattcctcaccgggatcgcccggaacacctggaagtcgcagcagaacacccagtcttcccacacctccaactcgtgaacccaagaaagtcgcagtggtaagaactccgcctaaatccccttctagtgctaaatcacgtctccagaccgcaccggttcctatgccggacctcaaaaacgttaagagtaagataggaagtacagagaatcttaaacatcagccagggggagggaaagtccaaatcattaacaaaaagctagatctatccaacgtgcaaagcaaatgcggtagtaaggacaacataaagcacgtgcctgggggaggaagcgtgcagattgtgtataagccggttgatctgtccaaggtcacatctaaatgcggctctcttggcaacatacaccacaagccgggaggtggccaggtggaggtgaaaagtgagaaactggattttaaggaccgagttcagagtaagataggctcactggataacataacacatgtgcccggaggcggaaacaaaaagattgaaacacacaagctcacattcagagaaaacgcgaaggcaaaaacagaccatggtgccgagatcgtctataaaagccccgtagttagtggagatacttccccacggcacttaagcaacgtctcttctacaggatccatcgatatggtggacagtcctcagctggcaacgctggcagacgaggtgtctgccagtcttgcgaaacaggggctctag

SEQ ID NO: 230570 - DNA, 1152 bp, Artificial Sequence
  Description of Artificial Sequence: Synthetic coding sequence
atggccgagccaagacaagagttcgaagtgatggaggaccacgctggaacatacgggttgggagacagaaaggaccagggaggatacactatgcaccaggatcaggaaggagataccgacgcaggcttaaaagcagaggaggccggaattggcgatacaccatcactcgaagacgaggctgctggacacgtcacacaagccagaatggtgtcaaaatcaaaagatggaaccgggagtgacgataaaaaagccaaaggagctgacggcaaaacaaagatagcgacacccagaggggctgcgccacccggacagaagggccaggcgaatgccactcgcatacctgcaaaaaccccccctgcgccaaaaactcccccttcgtccggagaaccccctaagagcggcgatcgatccggatatagctctcccggaagcccaggtacgcccggatcaagatcacgaacacccagtctgccaaccccacctactagagagcctaaaaaagtggccgtagtgagaacacctcccaagtccccttccagtgcgaagtctcggctgcaaacagcccctgtgccaatgcctgacctgaagaacgtgaaatccaagatcggctccacagaaaacttaaagcatcagccaggaggcggaaaagttcagattatcaacaaaaagctggatctttccaatgttcagtccaagtgtggttctaaagacaacatcaagcatgtcccaggtggagggtctgtgcagattgtttataaacccgttgatctgagcaaggtgaccagtaaatgtggaagcctgggcaatatacaccacaagccagggggtggccaggtggaggtaaagagcgaaaagctggatttcaaagatagagtccagagtaagataggaagccttgacaatataacccatgtaccaggaggcggaaataagaaaattgaaacacacaaattaacttttagggagaatgctaaggcgaagactgatcacggagccgaaatcgtgtacaaatccccggtggtgtctggagacacatctcctcgccatctgagtaacgtgagttccaccggcagtatcgatatggttgatagccctcagttagcaacgctggcagacgaagtctccgccagccttgccaagcagggactgtag

SEQ ID NO: 230571 - DNA, 1239 bp, Artificial Sequence
  Description of Artificial Sequence: Synthetic coding sequence
atggcagagcccagacaggaatttgaggtgatggaggaccacgccggtacatacggcctgggagatagaaaagatcaggggggttacaccatgcaccaggaccaggagggagacacagatgctggtctgaaagagagtccactacagactccaacagaagacggctctgaggagcctggctcagaaactagcgacgccaaaagtacacctacagcagaggcagaagaagcgggtatcggagatactccctcattggaggatgaggccgctggccacgtaacccaggcaagaatggtgagcaaaagtaaggatggcaccggatcagacgacaaaaaagcgaagggcgctgacggcaaaacgaagatagccacgccacgcggtgccgcacccccaggacagaaaggacaagctaacgccacacggatccctgcaaagactcctccagctccgaaaacccccccaagctccggtgagcccccaaagtcgggagaccggagcggatactccagccctggctctcccggaacacctggctcccggagtcggaccccatcgcttcctactcccccaacacgcgagcctaaaaaggtggccgtggtgcgtacccccccaaaatcaccaagcagtgctaagagcaggttgcagactgctcctgttcccatgccagacctgaaaaacgtaaaatctaaaattggttcaactgagaatctgaaacaccagcctggcggtggcaaggtccaaataatcaataagaagcttgacttaagcaacgtgcagtccaagtgtggaagcaaggataacataaaacacgtcccaggcggaggctcggtgcagatcgtctataagcctgtagacttgtctaaggtcacgagtaaatgcggctctctcggaaacattcaccacaagccaggagggggtcaagtcgaagttaagagcgagaagctcgactttaaagatcgcgtccagagtaagatcggaagtttggataatattacccatgtacccggaggtggtaataaaaaaatcgaaactcataagctcacatttcgggaaaatgcaaaggcgaaaaccgaccacggggcagagatcgtgtacaagagcccggtcgtgtcaggcgacacgagccccaggcatctgagcaatgtcagttcgaccgggtcaattgacatggtggactcgccccagttggctacacttgctgacgaagtgagtgctagcctcgccaagcaaggtttatag

SEQ ID NO: 230572 - DNA, 2331 bp, Artificial Sequence
  Description of Artificial Sequence: Synthetic coding sequence
atggctgaaccaaggcaggaatttgaagtgatggaggatcatgccggaacttacggccttggagacaggaaagatcagggagggtacactatgcatcaagaccaagaaggagacacagatgccggactcaaagaatccccactgcagacacccaccgaagatggaagtgaagagcctggcagtgagactagcgatgctaagtccactccgacagccgaggacgtgacagcgccactggtggatgagggagcccctggcaaacaggccgcagcacagccccataccgagatcccagagggcacaacagccgaggaagctggtataggcgacacaccttcattggaggatgaagctgccggacacgtaacacaggagccagagagcggaaaggtggttcaggaggggttcctacgtgaaccaggccctcccggactgtcgcaccaattgatgtctggtatgcctggggctccactgctcccggagggccctcgcgaggctacccgccagccttccggaacaggtcccgaggatacagaaggaggccgacatgccccagaactgcttaagcatcagctgctgggtgatttacaccaggaggggcctcccttgaagggggcagggggaaaagaacgcccaggatcaaaggaggaggtcgatgaagatcgagatgttgacgaaagctcaccacaagactccccaccctccaaagcatcgcccgctcaagacggtaggccacctcagacagccgctcgcgaagccacatccattccaggatttcccgcagagggagcaatcccactccctgtggatttcttgtccaaggtgtcaactgaaatcccagcatctgagcccgacggcccaagcgtcggtagggcaaaaggacaggacgcgccactcgagtttacctttcacgtcgaaattactcccaacgtccagaaggagcaggcgcacagtgaggaacatctaggcagagcggcattccctggcgctcccggtgagggaccggaagcacgcggtccaagtctcggtgaagatacaaaggaagccgacctcccagagccatccgagaagcagccagcagccgctccacggggtaaacctgtgtcaagagtgcctcagctgaaggccagaatggtctccaagtctaaagatggaaccggtagcgatgacaagaaggcaaagaccagcacgcgaagctcagcaaaaacgctgaagaaccgaccttgcctgagccctaagcaccccactcccggatcatctgatcccctcattcagccaagcagccctgcagtatgtcctgagccccctagttccccaaagtacgtgtctagcgtcacaagcagaaccggcagtagcggggctaaggagatgaagttaaaaggcgctgatgggaagacaaaaattgcaacccctcgaggggcagccccaccaggtcagaaggggcaagctaacgcaacgcggattcctgctaaaactcctcctgctcctaaaacgcctccctccagtgcaaccaaacaggtgcagcggcgtcctccaccagcagggcctcggtctgaaagaggcgagccaccgaagagtggggatcggagcggctacagctctcctggctcccctggcacccccggtagcagaagtaggacaccaagtcttccgaccccgccaaccagggagccaaaaaaggttgctgtagtgcggacccctccaaagtcaccttcatccgccaaatctcgactgcaaaccgcacccgttcccatgcctgatttgaagaacgtgaaatccaagattgggtccaccgagaatttgaagcatcagcccggaggaggcaaggtacaaattatcaataaaaaactggacctcagtaatgtccaatccaagtgcggctcgaaggataatatcaaacacgtaccagggggaggttccgtccagattgtgtataagccagtggatttaagcaaagtgactagcaagtgtggaagcctcgggaacattcaccataaacccggaggagggcaagtggaggtgaaaagcgaaaaactagatttcaaggaccgagttcagtccaagattggcagcctcgataacatcacccatgtacccggtggcggaaataaaaagattgaaacccacaagctgacctttagagaaaatgctaaagccaaaacagaccacggtgctgaaatcgtatataagtcccctgtcgtaagcggcgatacttctccaaggcatctcagcaatgttagcagcaccggctctatcgatatggtcgatagtcctcaattggcaactctggctgatgaggtctccgcaagcctggccaaacaaggactctag

SEQ ID NO: 230573 - DNA, 951 bp, Artificial Sequence
  Description of Artificial Sequence: Synthetic coding sequence
atgctgagggctctacagcaacgtaagcgtgaagccggaatcggggatactccgtcactggaagacgaagccgctgggcatgtcactcaagctcggatggttagtaaaagcaaagatggtacaggaagcgacgacaagaaagccaaaggcgcagatgggaagacaaaaatcgccaccccacgaggggctgcaccacctgggcagaaggggcaggcaaacgctacacggattcctgccaagacacctcccgctcccaaaactcccccttccagcggcgagcccccaaaatcaggagacagaagtggatactcctcaccagggagcccgggtacccctgggtctcggtctagaacaccatccctcccgacgcccccaactagggagccaaaaaaagttgccgtggtgagaactccaccaaagagccctagctctgcgaagagtaggctgcaaactgccccagtcccaatgcccgatctgaaaaacgttaagtccaagatcggtagcactgagaatcttaagcaccagccaggcggagggaaagtgcaaatcgtgtacaagcccgtggacttatccaaagtaaccagtaaatgcgggagcttagggaacatccaccataaaccgggagggggacaagttgaagttaagagcgaaaagctggatttcaaagaccgcgtgcagagcaagatcggtagcctcgataatataactcatgtccccggaggagggaacaagaaaatagagacacacaagctgacatttcgcgaaaacgccaaagcaaagacggaccacggggctgagatcgtgtataaatcgcctgtcgtgtctggcgacactagccccaggcatctgtcaaacgtgtctagcaccggctccattgatatggtggacagcccccagctggccactttagccgacgaagtctcggctagcctcgcaaaacagggcctctag

SEQ ID NO: 230574 - DNA, 1326 bp, Artificial Sequence
  Description of Artificial Sequence: Synthetic coding sequence
atggctgaaccaaggcaggagttcgaggttatggaggatcacgctggaacttatggactcggcgatagaaaggatcagggcggatacacgatgcaccaggaccaagagggagacaccgatgcaggattgaaggagagccccctgcagacaccaacagaggacggctccgaagaacccggtagtgaaacatctgacgcaaagagtacccctacagcagaggatgtgacggcgccactagtagatgagggggcaccaggaaagcaggccgctgcacagccccacaccgaaatcccagaagggactacggccgaggaggccggtatcggcgatacaccatctctcgaggacgaagcagccggacacgtgacgcaggccaggatggtgagcaagagtaaagacgggactggaagcgatgataagaaggctaagggtgcggacgggaaaacgaaaatcgccacacccaggggagcagccccaccgggtcaaaagggtcaggccaacgctacccgtattcctgccaaaacccccccagcccctaagactccgcctagctcaggcgaacctcccaagtcaggagacaggtctgggtactcttccccgggatccccaggcacaccaggaagcaggtcccgcacaccgagtcttcctaccccccctacccgcgaacctaaaaaagtcgccgtggtccggacgcctccaaaaagtccaagcagcgccaagagcaggctacaaaccgctcctgtgccaatgcccgatctgaaaaacgtgaagtccaagatcggaagcactgagaacctgaagcaccagcctggcggaggcaaagtccagatcattaacaaaaaactggacctctccaacgtccaaagcaaatgcggatctaaagacaacatcaaacatgtaccgggaggaggctctgtgcagattgtctataaacccgtggatctctccaaagttaccagcaagtgtggcagtcttggtaacatccaccataaaccaggagggggacaagtggaagtgaagtcagagaaactcgacttcaaggacagagtccagagtaagatcggaagcctcgataatattactcatgtcccgggaggcggaaacaagaagatcgagacacataagctgacgttccgggaaaatgcaaaggcaaaaaccgatcatggcgctgaaatcgtgtacaagagccccgtggtgtccggggacacatcccctcgacatctttcaaatgtgtcaagcacgggatcaattgacatggtggactccccccagcttgccacacttgcagacgaggtttctgcctcactggccaaacagggactgtag

SEQ ID NO: 230575 - DNA, 1080 bp, Artificial Sequence
  Description of Artificial Sequence: Synthetic coding sequence
atggcggagcctagacaggagtttgaagtgatggaagaccacgccggaacctacgggctaggtgaccgaaaagaccagggtgggtataccatgcaccaagatcaggagggtgatactgacgccggtctcaaggagtcacctctccagacccctaccgaggatggcagcgaggagcctggcagcgagacatccgatgctaagtcaactcctaccgctgaagctcggatggtgtcaaagtccaaggatgggaccggctcagacgataagaaagcaaaaggagcagatggtaagaccaagatagccacacccaggggggcagccccacccggacagaaaggccaggcaaatgctacacgtattcccgcaaaaactccccctgctccaaagacaccaccatccagcggtgagccacccaaatcgggtgacaggtcaggatattcctccccagggtccccaggcactcctggctctagaagtaggacccctagtctgccaacgccccctactcgcgaacccaagaaggtagccgtggtgagaaccccccctaaatccccatccagcgcaaaatcccggctccagaccgcacccgtacctatgcccgacctgaagaacgtgaaatccaagattggatctaccgaaaacctgaagcaccagccaggtgggggtaaggtccagatcgtgtacaagcctgtagatttgtccaaagtcacctcgaaatgcggtagcttgggcaacattcaccacaaacccggaggcggacaagtggaggtcaagagcgaaaaactcgacttcaaggaccgggtgcagagcaaaattgggtccctggataatatcactcacgttccaggcggtggcaataagaaaattgagactcacaagttgacatttcgtgaaaacgccaaggccaagacagatcacggcgctgagatcgtgtacaaatccccagtcgtgagcggggacaccagtccacgacatctgtcaaatgtgtcatcaacagggagcattgacatggtggattcgccacagctcgccaccctggccgacgaagtctcagcatcactcgctaaacaggggctctag

SEQ ID NO: 230576 - DNA, 2331 bp, Artificial Sequence
  Description of Artificial Sequence: Synthetic coding sequence
atggcggagcctcgacaggaattcgaggtcatggaggatcacgcgggaacctatgggctgggggatcggaaagatcaggggggttatacgatgcatcaggaccaggagggcgacacagacgccggactgaaggagagcccactgcagactcctaccgaagacggcagcgaagagcccggttctgagaccagcgacgccaaatcgacccccacagccgaagacgtcacggcccctttggtagatgagggagctccaggcaaacaggccgctgctcaaccccataccgaaattccggagggcacgaccgccgaggaggcagggatcggtgacacaccgtccctggaggacgaagcggctgggcatgtgacacaagaacctgagtctggaaaggttgtccaggaggggttcctacgggaaccgggaccgcctggtctcagtcatcagctgatgtccggaatgccaggcgctccactattacccgaaggacctagagaggccactaggcagcctagtggaactggtcccgaagacaccgaaggaggtagacacgcccctgaactgctgaaacaccagctcctgggcgatctgcatcaggaaggacctccgctgaagggagcaggtgggaaggaacgaccaggctctaaagaagaagtggatgaggatcgggacgttgatgagagttccccacaggatagccccccaagcaaggccagtccggcacaggacgggcgacccccacagactgccgctcgggaggcaaccagcattcccggtttccctgcagagggagcaattcctctgcctgtggatttcctttccaaggtgtccacagagataccggcaagtgaaccagatgggccttcggtgggccgtgccaaggggcaagatgccccattggagtttacctttcatgtggaaatcacgccaaacgtgcagaaagaacaggcccattccgaagagcatctgggtagggccgctttcccaggggctcccggtgaaggcccagaagcgagaggccctagtctgggagaagatacgaaagaggccgatctaccagagcccagcgaaaagcagcccgcagcagcaccaagaggcaagcctgtgtcccgggtccctcagttaaaggccaggatggtctccaaatcaaaagacggtacggggtccgatgataaaaaagctaagacatccactagatcaagcgcaaagaccctcaagaacaggccatgcttaagccccaagcaccctacgcccggtagctcagacccgctgatccaaccgagctcgcccgcagtgtgccctgaacctccttcttctcccaaatacgttagctctgttaccagcaggacagggagtagcggggctaaagaaatgaaattgaaaggagccgacgggaagactaaaatcgccacccctcggggtgctgcgcctccagggcagaaaggacaggctaacgccaccagaatccccgcaaaaaccccgccagcacccaagaccccacccagttctgccactaaacaagtacaacgtaggcccccacctgctgggcctagaagtgagcgaggtgagccgcctaagtccggtgacagaagcggatacagctcccccggtagccctggcacacccggtagtagaagtcggaccccctcccttcccacaccgcctacgcgcgaacctaaaaaagtagcagtggtgcggacaccccctaagtcaccttcctccgccaagagtcgccttcagactgcacctgtgcccatgcctgatttgaagaacgtgaagtctaaaataggttctaccgagaacctcaagcaccaaccgggtgggggaaaggtacagattatcaataagaagcttgacttgtctaatgtacaaagcaagtgtggctcgaaggacaacatcaaacatgtcccgggaggagggtccgtacagattgtctacaagcctgtagatttgagcaaagtcacatccaagtgtggctcccttggcaatatacatcacaagcccggagggggtcaggtggaagttaaaagcgaaaaactcgatttcaaagacagggtgcaatccaaaataggtagtcttgataacataacccacgtccctggcggtgggaacaaaaaaatcgaaacccataagctgacttttcgggagaatgcgaaagcaaagacagaccacggagccgagattgtgtataaatccccggtagtcagtggcgacacaagcccgcgacacctcagcaacgtgtcatcaacggggagcattgacatggtggacagcccccagctcgccactctggcagacgaggtctcagcatccctggccaagcagggcttatag

SEQ ID NO: 230577 - DNA, 1239 bp, Artificial Sequence
  Description of Artificial Sequence: Synthetic coding sequence
atggctgagcctcggcaagaattcgaggtaatggaggaccacgcgggaacatacggcctgggagatagaaaagaccaaggaggctataccatgcaccaagaccaagaaggagacacagatgccggacttaaagagagcccactacagacgcccaccgaggacgggtctgaggagcccggttctgagacatctgacgctaagtccaccccaacagccgaagccgaggaagctggtataggcgatactcctagtttggaagatgaggcagccggacacgttacacaggctcggatggtttccaagagtaaggatgggactggcagcgatgataagaaggcaaagggggcagacggcaaaacaaagattgccaccccacgtggcgctgccccaccagggcagaaaggacaagcgaatgccacccggatccccgcaaaaactcccccagcccctaagactcctccttcatccggggagcccccaaagtccggagatcgatccgggtatagctcaccaggctctccgggaacccctgggagccggagtcgtacccccagcctgcctacaccacccactcgggaaccgaaaaaagtcgctgtggtcaggactccccctaaatcgccttcttccgcaaaatctaggctgcagaccgcacccgtccccatgcctgatcttaagaacgtgaaaagcaagataggtagcactgaaaatcttaaacaccagcccggaggcggaaaggttcaaattatcaacaagaagctggatctaagcaatgtgcagagcaagtgtggaagtaaagataatatcaagcacgtccctggaggcggatccgtgcagatcgtttacaagcctgtggatttgtcaaaagtcaccagcaaatgtgggtcccttgggaacatacaccacaaacctgggggtggccaggttgaggtcaaatcagagaaattagactttaaggaccgagtccaatctaaaattggtagtctggacaacataacccacgtgccaggcggtgggaacaagaaaatcgagacacataagctaacattcagagaaaacgccaaggccaaaacagaccatggagccgagatcgtgtacaagtccccagtcgtgtctggcgatacatcccccagacatctgtccaatgtgtcgagcacagggtccattgatatggttgattccccccaattggctacactggccgatgaagtttccgctagcttagcaaaacagggcctgtag

SEQ ID NO: 230578 - DNA, 795 bp, Artificial Sequence
  Description of Artificial Sequence: Synthetic coding sequence
acacgcgaagcagaaggggctgatggtaagacaaaaatcgcaacacctaaaggacaggccaacgccacacggatacccgcaaaaactccaccagctcccaagaccccaccaagttccggagagcctccgaagagcggagacagatcgggttattcttctcctggctctccaggaactccaggatcacgatcgcgcactccctccctgccaacaccgcctacacgggaacctaagaaggtggctgtcgtgaggactccccctaagtcgccaagctcggctaagtcaaggcttcaaaccgctcccgtcccaatgccagaccttaaaaacgtaaagagcaagattggatctacagaaaatttgaagcatcagcctggtggcggtaaggtccagattgtttataaacccgtggacctgagcaaagtgaccagtaaatgtggctcactgggtaacatccatcacaaacctggcggagggcaggtggaagtgaagtcagaaaaactcgatttcaaagaccgtgtacagagcaagattggcagcctggataacatcacacatgttcccggaggcggtaacaagaagatcgaaactcacaagctgactttcagggaaaacgccaaagctaaaaccgaccacggtgcagagattgtgtataagtccccagttgtgagcggggacacatctcccagacacctgtctaacgtttctagcaccgggtccattgatatggtagattccccccagttggctacactggcggacgaggtgagtgcttcactcgctaaacaggggttgtag

SEQ ID NO: 230579 - DNA, 1059 bp, Artificial Sequence
  Description of Artificial Sequence: Synthetic coding sequence
atggctgaaccgaggcaagagttcgaggtgatggaagaccacgctggcacatacggactcggagacaggaaggatcagggaggttatacgatgcatcaggatcaggagggcgataccgacgctggattaaaggctgaggaagctggcatcggagataccccaagtctggaagacgaggctgcgggtcacgtcactcaggctagaatggtgtctaaatctaaagatggaacaggatctgacgataagaaagcgaaaggagccgacggaaaaaccaaaatcgccacacccagaggagcagcaccacctggacaaaaagggcaagcgaatgcaactcggatcccggcaaaaactccccctgccccaaagacgcccccttccagtggggagcctccaaaaagcggggaccggagcggctacagtagccccggttcacccggtacccccggatccaggtcccgcacaccaagtttgcctacacccccaaccagggaacccaaaaaagtggctgtcgtcaggacaccacccaaaagcccatcatccgctaaatccaggctccagaccgccccagtgccgatgccagatctgaaaaatgtgaaaagcaaaatcggctccacagaaaacctcaagcaccaaccgggaggcggtaaagttcagattgtttataagcccgtggatctctcaaaggttacttccaagtgcgggagtctgggaaatatacatcacaagccgggtggtggccaagtggaggtgaagtcagaaaaactagattttaaggaccgggtccaatcaaaaatcggcagcttagacaacataacccacgtacctgggggtggaaacaaaaagattgagacacataaactcacatttagggagaatgccaaagccaagacagatcatggtgctgaaatcgtgtataaaagtcctgtcgtgagtggtgacacttctccacggcacttgtcaaatgtatcctctactgggtccattgacatggtcgactcacctcagctggccaccctggcagatgaagtcagcgctagtttggcaaaacagggcctctag

SEQ ID NO: 230580 - DNA, 1233 bp, Artificial Sequence
  Description of Artificial Sequence: Synthetic coding sequence
atggcggagccacgacaggagttcgaagtgatggaggatcacgccggaacgtacggactgggcgaccggaaagaccagggcggatatacaatgcaccaggatcaggagggtgacacagatgcgggattaaaggagtccccactacagacgcctacagaggatggctccgaagagcccggaagcgagaccagcgacgccaaaagcactcccacagccgaggatgtgacagcgccactggtggacgagggtgcccctggaaagcaggctgctgcccagccacacacagaaattccggagggaaccactgccgaggaggctggcatcggggacaccccctctttagaagatgaagccgctgggcatgtaacgcaggcccgtatggtatcgaagagtaaggatggtactggctccgacgataagaaggctaagggggctgacggaaagaccaaaattgcaacccctagaggcgcagctcctcctgggcagaagggccaagccaatgctacgagaatccccgcaaagacacccccagctcctaaaacccctccctcgagtggcgagccccctaagagcggtgaccgatcaggctacagttcccctggcagtcccggtacaccagggagtcggtctcggaccccttcactgccaacacctcctacacgcgagccaaagaaggtcgcggtagtgagaacaccaccaaaatccccatcttccgccaaaagccgacttcagaccgcacctgttccaatgcccgatctcaagaacgtgaagtccaaaatcggctccacggagaacctaaaacatcagccaggcggagggaaagtgcaaatcgtgtataagccggtagacttatctaaagtgacgtcaaaatgtggcagtctcggaaatatacatcacaaaccaggaggcggtcaggtcgaagtgaaaagcgaaaagcttgactttaaggacagggtacagtctaaaattggtagcctggacaacattactcatgtcccagggggtggcaataaaaaaattgagactcataaactgacctttagggaaaacgccaaggctaaaacagatcacggcgcagaaattgtatacaagagcccagtagtgtctggtgacaccagccctcgtcatctctccaacgtgtcctcgaccggatcaatcgatatggtggacagtccccagctagccactctcgccgatgaggtatccgcctctctggcaaagcaaggcctctag

SEQ ID NO: 230581 - DNA, 807 bp, Artificial Sequence
  Description of Artificial Sequence: Synthetic coding sequence
atggccgtcaacgtctactccacgtcagtaacttcagataacctgagtcggcatgacatgctggcttggattaatgaaagcttgcagttgaatctcaccaagattgaacagctgtgttccggagcagcttactgtcaatttatggacatgctctttcctggcagcatagccctgaagaaggtgaaattccaggctaagctggaacacgagtacatccagaattttaaaatcttgcaggcaggattcaagagaatgggagtcgataaaatcatacctgttgataagctggtaaagggcaaattccaggataactttgaatttgtgcagtggtttaaaaagttttttgatgctaactacgatggtaaagattacgatcccgtcgccgcaagacaggggcaggagaccgcagtcgcaccgtccctggtggctcccgctttgaataagccgaagaaacctctgactagtagttccgccgcaccccagcgcccaatatcaactcagaggactgctgcagcccctaaagctggccctggcgtcgtgagaaagaaccctggggttggcaacggagacgacgaagctgccgaactgatgcagcaggttaacgtgctgaagctgacagtggaagacctagagaaggagcgagacttctacttcgggaagctccgtaatatcgaactgatctgccaggagaacgaaggggaaaacgatcccgtgcttcagaggatcgtcgacatcctttatgctactgatgaaggattcgttattccagatgagggcggtccccaggaagagcaggaggagtactag

SEQ ID NO: 230582 - DNA, 984 bp, Artificial Sequence
  Description of Artificial Sequence: Synthetic coding sequence
atgcctggcccaacacagacattgtcccctaacggcgaaaataacaatgacataatccaggataataacggcacaatcataccttttcgcaagcacactgtccgcggagagcgatcctattcatggggtatggccgtcaatgtgtattcaacaagtatcacccaggagaccatgagtcgtcatgacattattgcgtgggttaacgacattgttagtcttaactatactaaagtggaacagctgtgttcaggagcggcatattgccagttcatggacatgcttttccccggatgcatctccctcaagaaggttaaatttcaggctaaactcgagcatgaatatattcataatttcaaactgctccaggcatccttcaaaaggatgaatgtggacaaggtgattccagtggagaagcttgtcaaaggcagattccaggataatttggactttatacagtggttcaagaagttttatgacgctaattatgatggaaaagaatacgatcctgtggaagccaggcaggggcaagacgcaatccccccacctgaccctggagagcaaatatttaacttgccaaagaaatctcatcatgcgaatagtcccaccgctggcgcagccaagtctagtcctgcggctaaaccgggatcgactcctagccggccttcttcagctaagcgagctagcagtagcggatcagcctcgaaatccgataaggacttagagacccaggtcattcagctcaacgagcaggttcatagtctcaaactcgccctcgagggagtggaaaaagaacgagatttttattttggtaaactccgcgagattgagctgttatgccaggagcatggccaggagaatgatgatcttgtgcagcgcctgatggacatcctttatgcaagcgaagagcatgagggtcataccgaagaaccagaggcagaggagcaggcacacgagcagcaaccaccacagcaagaggagtactag

SEQ ID NO: 230583 - DNA, 855 bp, Artificial Sequence
  Description of Artificial Sequence: Synthetic coding sequence
atggctgtaaacgtgtattcaacatccattactcaggaaaccatgtcacgccatgacattatcgcttgggtgaatgacatcgtttcgttaaattacacaaaggtggagcagctttgcagcggggctgcctactgtcagttcatggatatgctgtttcccggttgcatttcactgaaaaaagtcaaattccaagctaagctggagcacgagtatatccacaactttaagctgcttcaggcttcattcaagcggatgaacgttgataaggtgatccctgttgaaaagctcgtgaagggacgctttcaagataatttggattttatccagtggttcaagaagttttacgatgcaaactatgatggtaaagaatacgatcctgtcgaagccagacagggccaggacgcaattccccctcccgacccaggggaacagattttcaacctgccaaagaagagccaccacgcgaatagtccaacagccggtgccgctaagagttccccagcagcaaagcctggttccaccccctcccgtcctagcagtgccaaaagagcctcctcaagtggctccgcctcaaaatctgataaggatctggagacgcaggtgatccagctcaacgagcaggttcatagcttaaagctggctctggagggagtcgagaaagaacgggatttctactttgggaagttgagagaaatcgaactgctatgccaggagcacggtcaggagaacgacgatttggtgcagaggctcatggatatactgtacgcatcggaggagcacgaggggcatacagaagaacccgaagcagaggagcaggcccatgaacagcaaccgccacagcaggaagaatactag

SEQ ID NO: 230584 - DNA, 948 bp, Artificial Sequence
  Description of Artificial Sequence: Synthetic coding sequence
atgaaacagaaccgggatcagaaatgcccagtgtctcaacgaaattcctctttccaacagccagggaggaagcccggttgtagcagctggggaatggctgtcaacgtctactctacatcaataacccaagaaaccatgagtcgccatgatattattgcatgggtgaacgatatcgtgtccctgaactacactaaggtcgaacagctgtgctctggcgctgcgtactgccaattcatggatatgctattccccggatgcatttccttaaaaaaagtcaaatttcaggcaaagcttgagcacgaatatatccacaattttaagctgttgcaggcatcttttaagcggatgaatgtcgataaggtcatcccggtggaaaagctcgtgaaagggcgtttccaggacaatctggatttcattcagtggtttaaaaaattttatgacgcaaattacgacggcaaggagtacgatcctgtggaggctagacaggggcaggatgctatacctcccccagacccaggtgaacaaatcttcaacctccctaaaaaatctcatcacgcgaatagtccaactgctggggcagctaagtcgtctcctgccgcaaaacctggtagcacaccgtcccgacccagctccgccaagagagcttccagctccggctcagccagcaaatctgacaaggacttagagacccaggttatccagctgaacgaacaggtgcattcattgaaactggccctagagggcgtagagaaagagcgggatttttatttcggtaagcttcgggagattgagctcctgtgtcaggagcacggccaggagaacgacgacttggttcagagattgatggacatcctgtatgccagcgaagagcacgaaggacatacagaggagcccgaagctgaagagcaggcccatgagcaacagcccccacagcaggaggagtactag

SEQ ID NO: 230585 - DNA, 825 bp, Artificial Sequence
  Description of Artificial Sequence: Synthetic coding sequence
atggccagaactacgactacctccagcagaattattaccggacccagcttcctctccggctccacacagtgtgctggtagcgtgcctacgggagccgcttactgtcagttcatggacatgctgtttcccggatgcattagcttaaagaaggtgaagttccaagctaaacttgagcatgagtacatccacaacttcaaactcctgcaagctagctttaagcggatgaacgtggataaagtgattccagtcgagaagctggtgaagggccgattccaggataacctggattttatacagtggtttaaaaagttctacgacgccaattacgacggcaaagaatacgaccccgtcgaggcccgacaggggcaagacgctataccccctcccgaccctggagagcagatatttaatttgcctaaaaagtcccaccacgccaactccccaaccgctggggctgccaaatcaagccctgcggcaaagcccggtagtacaccatcccgtccgtcctctgccaaaagagccagcagttcgggtagtgccagcaaatcagacaaggatctggagactcaagtgatacaactgaatgaacaggtgcatagtctgaaattagcacttgaaggcgtggaaaaagaacgggatttttacttcggaaaactgagggagattgaacttctttgtcaagaacacggtcaggaaaatgatgacttggttcagcgactgatggatattctgtacgcctcggaggaacatgagggccacacagaagaaccagaggctgaggagcaggcccatgagcagcagccgccacagcaggaggagtactag

SEQ ID NO: 230586 - DNA, 1005 bp, Artificial Sequence
  Description of Artificial Sequence: Synthetic coding sequence
atgtctgagcccattagggtgctggtgacgggggcagccggtcagatcgcgtattccctgttatactccatcggaaacggatccgtctttggaaaggatcagccgattattctggtactacttgacattacaccaatgatgggggtgctggacggggtcctgatggagctgcaggactgcgctctccctctgctgaaagatgtgatcgcaactgataaagaggacgtcgcctttaaagacttagatgttgccatactggtgggatcaatgcctcggagagaaggaatggagaggaaagacttacttaaagcaaacgtgaaaatatttaagtcccaaggggcagccctggataagtacgccaagaaatctgttaaagtcatcgtggtcggaaatccagctaatacaaactgtttgaccgccagtaagagcgctcctagtatccccaaagagaatttctcctgcctcacccggctggaccataaccgcgctaaggcacagatcgcattaaagttgggggtgacagcaaacgacgtgaagaatgtcattatctggggtaatcatagtagtacccaatacccagatgtcaatcacgccaaggttaagctgcagggcaaggaggtgggggtgtacgaagctctgaaggacgactcctggctgaaaggtgaatttgtgacaactgtgcagcagcggggagccgctgtaataaaggctcgcaagttgtctagcgccatgtccgcagcaaaggccatctgtgatcacgtgcgcgacatatggttcggtacccctgagggcgagtttgtgtcaatgggtgtgatcagtgatggaaactcttatggcgttccagatgatcttctgtactcctttcccgtggtgataaagaataaaacctggaagtttgtggaaggcttgcctattaacgatttcagtcgggaaaagatggatctcactgcaaaggagttgacggaggagaaagagagcgcgttcgaattcttatcctccgcgtag

SEQ ID NO: 230587 - DNA, 801 bp, Artificial Sequence
  Description of Artificial Sequence: Synthetic coding sequence
atggcggtgaacgtgtactcaacaagtgtcacttccgagaatctgagccgccacgacatgctggcgtgggtgaatgatagcctgcatttaaactataccaagattgagcagttgtgtagcggcgctgcttattgccagtttatggatatgctcttccccggatgtgttcatttacgcaaggtgaaattccaggcgaaattggagcacgagtatattcataatttcaaagtacttcaggctgcgtttaaaaagatgggcgtggataaaatcatcccagtggagaaactggtgaagggtaaattccaggacaacttcgagttcattcaatggttcaaaaaattcttcgacgctaattacgacggaaaggattataatcccctcttagcccgacagggacaggatgtggcgccaccccctaaccctgtgccccagcgaactagtccaacgggccctaagaacatgcagacttcaggaagactgagcaacgtggccccaccctgtattttgagaaaaaatccaccatctgcacgcaatgggggtcatgagacagacgcccagatcttggaactgaatcagcaactggtagacttgaagcttactgtcgacggactagaaaaggagcgcgacttctatttcagcaaactgagagacatagagctgatctgtcaggagcacgagagcgaaaacagccctgtgatctcaggcatcataggtatcctgtacgctacggaagaaggatttgcccctcccgaggacgacgaaatcgaagagcatcagcaggaggatcaggacgagtattag

SEQ ID NO: 230588 - DNA, 801 bp, Artificial Sequence
  Description of Artificial Sequence: Synthetic coding sequence
atggccgtaaacgtctattcaacctctgtgacctcagagaatctctctcgccatgacatgctggcatgggtcaacgacagtctccatctaaactatacaaaaatcgagcagctttgctcgggtgctgcttactgccagttcatggacatgctttttccaggatgcgttcatctccgcaaggtcaaatttcaggctaaactcgagcacgaatacatacacaatttcaaagtcttgcaggcagcgttcaagaaaatgggcgtggacaagatcattccagtggagaagcttgtgaaagggaagtttcaagataatttcgaatttattcaatggttcaaaaagttcttcgatgccaattacgacggcaaagattataatcccttactggcacggcagggccaagatgtcgcaccgcctccaaacccagtccctcaaaggactagtccaacaggtcccaaaaatatgcagacgagcggtcgcttgtccaacgtggctcctccttgtatactcagaaagaacccaccttccgctaggaacggcggtcatgagactgatgcccagatcctggaactgaaccaacaactggtggacttaaagctgactgtggacggactcgaaaaggagcgcgacttctattttagcaagctgagagatattgagctgatttgccaggagcatgagtctgaaaattcccctgttatctcaggtatcattggtatactttacgcgacagaggagggattcgcacctccagaggatgatgaaattgaggaacaccagcaagaggaccaggatgagtactag

SEQ ID NO: 230589 - DNA, 657 bp, Artificial Sequence
  Description of Artificial Sequence: Synthetic coding sequence
atggccgtcaacgtttatagcactagtgtgacctcagaaaacctctcccgccacgatatgctggcctgggtgaacgactcccttcatttaaattacactaagattgagcagctgtgctccggagcggcatattgccagttcatggacatgttatttcccggatgtgtgcacttacgaaaagtcaaattccaagccaaattagagcacgagtacattcacaattttaaggtgctccaggcagccttcaagaagatgggcgtagataaaataatcccagtcgagaagcttgtgaaggggaagtttcaggacaattttgagtttatccagtggtttaagaagttttttgacgccaattacgacggaaaggactataaccccctcctagcacggcaggggcaggatgtggcaccccctcccaaccccggagaccaaatttttaacaagtccaagaagctgattggcaccgctgtgccacagcgcaccagccctaccggtccaaagaacatgcagacaagcggtaggttgtccaatgttgcccctccctgtatcttacgaaagaatccccctagcgctaggaacggcggacatgagacagacgcacagatattggaactaaatcagcaactggtcgatctgaagctgaccgttgacggatag

SEQ ID NO: 230590 - DNA, 2004 bp, Artificial Sequence
  Description of Artificial Sequence: Synthetic coding sequence
atggaaaccctcgagtctgagctgacatgccctatctgtctggaattgttcgaggacccacttttgctgccttgcgctcacagcctgtgtttcaattgtgcacatcgaattttagtatcccattgtgccaccaatgagagtgtcgaatccataactgccttccagtgcccgacttgcaggcatgtcataacattgtcccagaggggacttgacggactaaagaggaacgtaaccctccaaaatatcatcgaccggtttcaaaaagcatccgtgagtggacctaacagcccaagcgaaacgcgcagagagcgcgctttcgacgctaatacaatgacaagtgccgagaaggtcctttgtcagttctgcgaccaggatcctgcccaggacgccgttaagacatgcgtgacatgtgaagtgtcatattgcgacgagtgcctcaaggctacacatcccaacaagaaaccttttacaggtcataggttgatcgaacccatacctgatagccacattagaggtttaatgtgccttgaacacgaagacgaaaaggtcaacatgtattgcgtaacggacgatcagctcatctgcgcactctgcaaattggtgggtagacacagagatcatcaagtcgctgcgctcagcgagcgatacgacaagctgaaacagaacctggaatctaatctgaccaaccttattaagcgaaacaccgaactggaaacactgttggctaagctgatacagacttgccagcatgtggaggtgaacgcttcccggcaagaggccaagctcacagaagagtgtgacctacttattgagattattcagcagcgcaggcaaatcatagggactaaaatcaaagagggcaaagttatgagactgcggaagctggcacagcagatagccaattgtaaacaatgtattgagcggtctgcctctctcatttctcaggcagagcacagtctcaaagaaaacgaccatgcccgattccttcagacggccaagaatattacagaaagagtgtccatggctaccgcgtcgtctcaggttctcatccctgagatcaatctgaacgacacctttgacacctttgccttggatttcagccgcgagaaaaagctgctcgaatgcttagactacctcaccgctccgaatccccctaccatccgagaggagctgtgcactgcatcatacgacactatcaccgtgcattggacctcagatgatgagttttcagtggtaagctatgagcttcagtacacgatctttactggccaagccaacgttgtgtccctgtgtaacagtgccgatagctggatgatagtgccgaacattaaacagaaccattacacggtgcatgggcttcagtccggcaccaaatatatttttatggtgaaagccatcaatcaagcgggatccaggtcttcagagcctgggaagttaaaaaccaacagtcagccattcaaactggatcctaagtcagcacaccgcaaattgaaggtgtcccatgataatctgacggtcgagagggacgaaagctctagcaagaaatcacatacacctgagagatttacctcccaagggagttatggggtcgcaggaaatgtgttcatcgacagcggacggcactactgggaagtggtgatctccgggtcaacgtggtacgctattggattggcttacaagtcggcccctaaacacgaatggatcggcaaaaactctgctagctgggcgctgtgtagatgcaataacaactgggtggtccgtcacaatagtaaagaaatccccattgaacctgcccctcatttacgtcgagtcggaatactcttagactacgataacggctccatcgccttctacgatgccctgaatagcatccacctgtacacttttgatgtggcgttcgcacagccggtttgccctacctttactgtgtggaacaagtgtctgaccattataaccggtctacctattccggaccaccttgactgcaccgagcagttgccgtag

SEQ ID NO: 230591 - DNA, 2004 bp, Artificial Sequence
  Description of Artificial Sequence: Synthetic coding sequence
atggagactctggagtccgagctaacttgtccaatttgcctggaactgttcgaggatcctctgctgctgccgtgcgcacacagtctgtgtttcaactgtgcgcaccggattctcgtgtcccactgcgcgacgaacgaatcggtggaaagcattaccgcctttcagtgtccaacttgccgacacgttattactctcagccagagaggtctagatgggcttaaacgaaacgtaaccctccagaatattattgatcgcttccagaaggcctccgtttccgggccaaacagccccagtgaaactaggagagaacgtgctttcgatgctaacactatgacaagtgctgaaaaggtactctgccagttttgtgaccaggaccccgcacaagacgccgtgaagacgtgcgtcacgtgtgaggtctcctattgcgacgaatgtctcaaagctacacacccaaataagaagcccttcactgggcaccgtttgatcgagcctatccccgactctcacatccgtggcctcatgtgtctcgagcatgaagacgaaaaagtaaacatgtactgcgtaacagacgatcagttgatctgtgcactctgcaaacttgtgggtagacatcgggaccatcaagtggcggcacttagcgaacgctatgataagctgaaacagaatctggaaagcaatcttaccaacttaataaaacgcaatactgagctcgaaactctcctggcaaaactgattcaaacctgccagcacgtagaagtaaacgcatcgagacaggaagcgaaacttacagaagagtgtgatcttctgatcgagataatccagcagaggcggcagatcattggtacaaaaatcaaagaggggaaagtaatgcggctgcgtaagctggcgcagcaaatcgccaactgcaagcaatgtattgaaaggtctgcttccctgatatcgcaagcagagcactctttaaaagagaatgaccacgccagattcctccaaacggctaaaaacattaccgaacgggtgtctatggccacggcttctagtcaggttcttatccccgaaatcaatctaaacgatactttcgatacttttgcgttagacttcagccgggaaaaaaagctgctagaatgtctggactacttaaccgctcctaacccccctacaattcgtgaagaattgtgcactgcctcttatgacaccatcacagtgcattggacaagcgacgacgagttctctgtagtaagctatgagttgcagtacaccatctttactggccaggccaacgttgtgtctttgtgcaattccgccgactcttggatgatagtgcccaacatcaagcagaatcattacactgttcacgggttacagagcggcactaagtatattttcatggtaaaggcaataaatcaggccggttctagatcgtcagagccagggaagctaaagacgaattcacaaccgtttaagctagacccaaaaagcgcccacagaaagctcaaggtgtcacacgacaacctgaccgtcgagcgcgatgagagctcttcaaaaaaatcccatacccctgagcgatttaccagtcaagggtcatatggggtggccggaaatgtgttcatagactctggtcggcattattgggaggtcgtcatctccggatcgacgtggtacgctatcgggctggcctataaatctgcacccaagcatgaatggataggaaaaaattcggcaagttgggcactttgtcgctgcaataacaattgggtggtcagacacaacagcaaggagattcctatcgaacccgctccgcatttaagacgagtgggtatacttctcgactacgacaatggttcaatcgccttttacgacgccctgaactccatccatctgtacaccttcgatgtggcattcgcccagcctgtttgtccaaccttcactgtatggaacaagtgcttgaccataatcacaggactacctattcccgaccatctcgactgtaccgagcaactcccatag

SEQ ID NO: 230592 - DNA, 2004 bp, Artificial Sequence
  Description of Artificial Sequence: Synthetic coding sequence
atggaaacgctggagtcagaactcacatgtcctatttgtttggagctgtttgaagaccccctgctattaccttgcgcccactcactttgtttcaattgcgctcaccgaattctggtgtcccactgtgcaacgaacgagtccgtggagtccataaccgccttccagtgccccacctgtcggcatgtcataacattaagccagagaggcctggacggcctcaagcgaaacgttaccctgcagaacataatcgatcgttttcagaaagcctcagtgtctgggccaaattcgccctcagaaactcgccgagaacgcgcattcgatgcaaatactatgaccagcgccgagaaagtcctgtgtcaattctgtgatcaagaccccgctcaggatgccgtcaagacatgtgtgacttgcgaggtaagctactgtgatgaatgtttgaaggctacccaccccaacaagaagccgtttacaggtcacaggctgatagaacctatccctgactctcacattcgcggactcatgtgtctagagcacgaggacgaaaaagtgaacatgtattgcgttacggacgaccagctgatttgtgcattgtgcaaacttgtcggacggcacagggatcaccaagtggccgcactctccgaacgctacgataagctaaagcagaatcttgagagcaatctcacgaacctgataaaacgaaataccgagttagagacgcttttggctaagctgattcaaacttgtcagcatgtggaggtgaacgcctctcgccaagaagccaaactgacagaagagtgtgacctgttaatcgagattatacagcaacggagacagattatagggacaaaaattaaggaaggaaaggttatgagactgagaaaactggctcagcagattgcaaactgtaaacaatgtattgaacggtctgccagtctcatatcccaggcagagcacagccttaaagagaacgaccacgctcggttcttacagacagcaaagaacatcacagagagagtctcaatggctacggcatcgtcccaggttcttataccggagatcaacttaaacgatacatttgatacctttgccttggattttagcagggaaaagaagctgctagagtgtttagactacctgaccgcacctaacccccctacaatccgggaagagttatgcacggcttcttatgacactatcacagtgcactggacaagtgatgatgaatttagcgtagtatcttacgagctgcaatacacaatatttacaggacaggcaaacgtggtgtctctctgtaacagtgcagatagctggatgatcgtcccgaacattaagcagaaccactacacagtacacgggttacagtccggcacaaagtacatctttatggtaaaagccatcaaccaggccggatctagatcgtccgagcctggcaaattgaagacaaattcacagcccttcaaactcgatcccaagagtgcccaccgcaagcttaaagtgtcgcatgacaatctgactgtggagcgcgacgagagctcctccaaaaagtcccatactcccgagcgcttcactagccagggtagctacggcgtcgctgggaatgtgttcatcgacagcggtcgacattactgggaagtggttatctcaggcagcacgtggtacgctatcgggctggcctataaaagcgctccaaaacacgagtggatcggaaagaactccgcttcttgggccctctgtcggtgcaacaataactgggtggttcggcacaactctaaggagattcccatagagccagcccctcatctcagacgggtcggcatcctcctagactacgataatggttccatcgctttctacgacgccctgaactccattcatctctacacctttgacgtagcgtttgcccagcccgtctgtccaacatttaccgtgtggaataagtgtctcaccattattaccggactgccaatcccggatcatctggattgcaccgagcaactgccatag

SEQ ID NO: 230593 - DNA, 1659 bp, Artificial Sequence
  Description of Artificial Sequence: Synthetic coding sequence
atggagactctggagtccgaacttacttgccccatctgtttagagctgttcgaagatcctctcctgctgccctgcgcacacagcctgtgcttcaactgcgcacacaggattctggtctcccactgcgccactaacgagagcgtggagtccatcaccgcctttcagtgtcccacatgccgccacgtaattacactttcacagagaggcctggacgggttgaaacgaaacgtgaccctgcagaacattatcgatagattccagaaagcttccgttagtggcccaaatagcccctcagagactcggagggagcgcgcatttgacgcaaacacgatgacaagcgccgagaaggtgctgtgccaattttgcgatcaggaccctgcccaggatgccgtgaagacctgcgtcacatgtgaagtgagctattgcgatgaatgtctaaaagcgactcatcctaacaaaaaaccgtttacaggccatcgcttaatagaacccattcctgattctcacatccgtggcctgatgtgcttagagcacgaggacgagaaggtcaacatgtattgcgttacagatgatcagctgatctgtgccctctgcaaactcgtgggtaggcaccgggaccaccaggtcgctgccctgtcagaaagatacgataagctaaagcaaaacctggagtcaaatttaactaatctcatcaagcgcaacaccgagctcgaaaccctgttggccaagctgatccagacctgccagcatgtcgaggtgaacgcctcacgccaggaggcaaaactgaccgaggaatgtgaccttctgatagaaatcattcaacagcgccgacagattatagggaccaagattaaggagggaaaagtgatgcggcttaggaagttggcccagcagatagccaactgtaaacagtgcatcgagagatcagctagcttgatcagtcaggcagagcactccctaaaggagaatgatcatgctcgattcctccaaaccgcgaagaatattactgaacgggtgtccatggccactgcttctagccaagtgctgatccccgagattaatttgaatgataccttcgacacctttgccctggacttctcaagagaaaagaagcttttagaatgccttgactatctgaccgctcctaatccacccaccatacgcgaagaattatgcactgcttcttatgacaccatcactgtgcactggaccagtgatgatgaattttctgtcgtgtcctatgaactgcagtacactatcttcacaggtcaggctaatgtcgtgtccctgtgcaattctgcagattcatggatgatcgtccccaatataaagcaaaatcactataccgtgcacggtttgcaaagcgggactaaatacatttttatggtcaaagcgatcaatcaggcaggttcaaggtctagtgaacctggcaagcttaagacaaactctcaaccctttaagctagaccccaaatccgcacacagaaaattgaaagtgtcccacgacaatctgaccgtggagcgagatgaatcaagtagcaaaaaatcgcacaccccggaaaggtttactagccaagggtcatatggggtagccggaaacgtgttcatcgactctggtagacactattgggaggtcgtcattagtgggagcacatggtag

SEQ ID NO: 230594 - DNA, 2004 bp, Artificial Sequence
  Description of Artificial Sequence: Synthetic coding sequence
atggaaaccttggagtcggaactgacatgcccaatctgccttgaactattcgaagacccactgcttctgccttgcgctcatagcctgtgctttaactgtgcccaccgtatcctggtgagccattgtgccacaaatgagtccgtggaaagtataaccgcctttcagtgccccacctgcagacatgtgattacactttcccagcggggtctagacggcctgaaacgcaatgtgaccctgcagaatatcattgataggttccagaaagcttccgtgagcgggcctaattcaccttccgagacccgcagggagagggcatttgacgctaacaccatgacaagcgccgagaaggtcctttgtcagttttgtgatcaggaccccgctcaggacgccgtgaagacctgcgtgacctgtgaggtgtcatactgcgatgagtgtctgaaagcgactcatcccaataaaaaacctttcaccgggcatcggttgatagagcctatccctgatagtcatataagaggattaatgtgtctcgagcacgaggacgagaaagtcaacatgtattgcgtgaccgacgaccagctcatctgcgctctgtgtaagctggttggcagacaccgagaccatcaggttgccgcactgtccgaaagatacgataaactcaaacagaatcttgagagtaatctgaccaatctgatcaagagaaatactgaactagaaactctcctggccaagctcatacagacctgtcagcacgtggaggtcaacgcaagccgccaggaagctaagttgaccgaagagtgtgatttgttgatcgagattatccagcagaggcggcagatcatcgggaccaagataaaggaaggcaaagtcatgcggttgcgtaagctggcccagcaaattgcgaactgtaaacagtgtatcgaaagatctgcatcactgattagccaggctgaacactctcttaaggagaacgatcatgctagattcctccagactgctaagaatatcaccgagcgggtgtctatggccaccgcatctagccaggtgctcatacccgaaataaatctgaatgacacttttgatacgtttgccctcgatttttctcgagaaaagaagctgttggaatgtctggattatttgacagcccctaatcctccaaccatccgggaagagctgtgcaccgccagctatgataccatcactgtgcactggaccagtgacgacgagttcagcgttgtgagttatgaattgcaatatactattttcacagggcaggctaatgtcgtatccctttgtaactcagccgattcgtggatgatcgtgcctaatatcaagcaaaaccactacaccgtgcacggattgcagtcaggcaccaaatacatttttatggtcaaagccattaaccaggccggatcacgcagctctgagccaggcaaactgaaaacaaactctcagccatttaaactcgacccaaagtcggctcatcgcaagttgaaggtgagccatgacaatctgaccgtggagagagacgaaagttctagtaaaaaaagccacacccccgaacgattcacatctcaggggtcttacggcgtggctggaaatgtcttcatcgatagtggacggcactactgggaggtcgtcatatcgggatccacatggtatgcaatcggccttgcatacaaaagcgccccaaagcacgaatggattggtaagaactcggcctcatgggcactatgtagatgcaataataactgggtagtgagacacaattcaaaagagatccccatcgaaccagcccctcaccttcgaagggtggggatcctcctggattacgacaatggtagcatcgccttttatgacgccttgaatagcattcacctttacacttttgatgtcgcattcgcacaaccagtgtgtccgacctttaccgtgtggaacaaatgcttgaccatcatcacaggtctgccgataccagatcacctagattgtacagagcagctgccttag

SEQ ID NO: 230595 - DNA, 2004 bp, Artificial Sequence
  Description of Artificial Sequence: Synthetic coding sequence
atggaaaccttggagtccgaattaacttgtccaatatgcctggaactcttcgaggatccattgctgctcccatgcgcacatagtctctgtttcaactgtgcacaccgcattcttgtaagtcactgcgccaccaacgaatctgtggaatctatcacagcatttcagtgtccaacgtgcagacatgtcattactctgagtcagcgcggtctcgacggcctcaagcgcaatgtgactctgcaaaacattattgacagatttcaaaaagcatcagtgtctggaccgaacagcccttcggagacacggagagagagggcctttgacgccaacaccatgacgtctgccgagaaagtgctttgtcagttttgcgatcaggatcctgcccaggacgcagtcaagacttgtgtgacctgcgaggtgagttactgtgatgaatgtctcaaagccacacatcccaacaaaaagccattcacaggccatagattgatcgaacccatcccagactctcacatcagaggcttgatgtgcctggaacatgaggacgagaaggtgaacatgtactgcgtgaccgacgaccagctgatctgtgctttgtgcaagctggtcggcagacaccgggaccaccaggtggccgcactgtccgagagatacgacaaactgaagcagaatctcgaatctaatctcacaaatctcatcaagcgaaacacagagctggagactctgctggccaaactgatccaaacctgccaacacgttgaagtgaacgcctcgcggcaggaggccaagcttactgaggaatgcgatctgctgatcgaaatcatccaacaaaggaggcagataattggcacaaagattaaggaagggaaagttatgaggctcaggaaattggcccagcaaatagccaactgcaagcagtgtattgaaaggtccgcaagcctgatttctcaggctgagcacagcctgaaggaaaatgaccacgccaggtttctacagaccgctaagaatataactgagagggtctctatggcgacggcttcaagccaagtcctgattccagagattaatctgaatgatacctttgatactttcgcgctggacttttctcgtgagaaaaaacttctggagtgcctcgattaccttactgctcccaatcctcctaccatcagggaagagctctgtacagcctcatatgatactatcaccgtgcactggactagcgacgatgaattctccgtggtctcctacgagctccaatataccatcttcactggacaggccaacgttgtgtcattgtgcaactcagcagactcttggatgatcgtccccaacatcaaacagaatcattatacagtccacgggttacagagcggcacaaagtacatcttcatggtcaaagctattaaccaggcgggatctcgctcaagcgagccaggcaagctgaagaccaactcccaaccatttaagctcgatcctaaatcagcacatagaaagctgaaggtgtctcatgacaacctgaccgtggagagggacgagagctccagcaagaagagccacactcccgaaagattcacatctcagggaagctacggcgtggctgggaacgtttttatagattccgggagacactactgggaagtcgtgatctcaggatccacctggtacgccatcggcttagcatacaaatcagccccaaagcacgagtggattggcaagaacagtgcatcctgggccctttgccggtgtaacaataattgggtggtacgccacaattccaaggagattcctattgaacccgcacctcatctcagacgagtcgggatcctgttagactatgacaatgggtctatcgcattctacgatgcactgaattcaattcatttgtatacgttcgatgtggccttcgcccagcccgtgtgccctaccttcaccgtatggaacaaatgtcttacgataatcacagggctgcccattccagaccacctggactgtacggaacagctgccatag

SEQ ID NO: 230596 - DNA, 1452 bp, Artificial Sequence
  Description of Artificial Sequence: Synthetic coding sequence
atggaaactctggagtccgagttaacctgccctatctgtctagagctctttgaagatcctctccttttgccttgcgcccattccctgtgctttaactgtgcccacaggatcctggtgtcccactgcgccacaaacgaatcagttgagagtattacagccttccagtgtcctacttgtagacatgtcattacactcagtcagcggggtctggatgggctgaagcgcaatgtgacccttcagaacattatcgaccgctttcaaaaagccagcgtctccggacctaattccccgtcagagaccagacgtgagcgagcattcgatgcgaacaccatgaccagcgcagagaaagtcctatgtcagttctgtgatcaggaccccgcacaggatgctgtgaaaacctgcgtgacctgcgaagtgagctattgcgacgaatgcctgaaagccacgcatcctaacaagaagccgtttactggacacaggctcatcgagcctattcctgacagccacattcgcggacttatgtgcctggagcacgaagacgagaaggtgaatatgtactgcgtaactgatgaccagctcatctgcgcgttgtgcaaactcgtaggtcgccaccgcgatcatcaggtcgcagctctgagtgaacgatatgataagcttaaacagaatctagaatccaatcttaccaacctgattaagaggaataccgagctggaaactctgctggcaaaattgattcagacatgccagcatgtggaggtgaatgcgtccagacaggaggccaagctgaccgaggaatgcgacctgctgattgagatcatccaacagaggaggcaaatcattggcacaaagattaaagagggcaaggtgatgagactaagaaagttagcccagcagatcgcgaactgtaaacagtgtatagaacgctctgcttccctcatatcacaagccgagcactccctcaaagaaaacgatcacgccaggtttctgcaaaccgcaaaaaacatcaccgaacgagtgtcaatggcgacagcgtcatctcaggtgctgattccggagattaacttgaatgatacttttgacacgttcgcgctcgactttagccgggagaagaaactgctcgaatgtctcgactacttgactgctcccaacccacccactattagagaagaactttgcacagccagctatgacacaattacagtgcactggaccagcgatgacgagttttctgtggttagctacgagcttcaatatacgatcttcacagggcaggccaacgtagtatcactatgtaacagcgccgattcatggatgatcgtgcccaatatcaagcaaaaccactacaccgtgcacgggctgcagagtggaactaaatacatattcatggtcaaagccatcaaccaggccggatctaggtcatcagagccaggcaaattaaagacaaactcctag

SEQ ID NO: 230597 - DNA, 594 bp, Artificial Sequence
  Description of Artificial Sequence: Synthetic coding sequence
atggagacccttgagtccgagctgacatgcccaatctgtcttgagttgttcgaagatccattgttgctaccttgcgcacatagcttgtgcttcaactgcgcccaccgcatcttggtgtctcactgcgcaacgaatgagagtgtcgagtctatcaccgccttccaatgtccaacatgtcggcacgtaataactctctcacagcggggactcgacggccttaaacgcaatgtaaccttgcagaatatcatcgatagattccagaaagcgtccgtcagcggtcccaattctccctctgagacgaggcgtgaacgggcattcgatgccaatactatgacctcggctgagaaggtcctttgtcagttctgcgatcaggaccccgcacaggacgctgtcaagacatgcgttacctgtgaggtgtcatactgtgatgagtgcctaaaagcaacccaccctaacaagaagccgttcacaggtcatcgcctgatagaacccattcccgactcacacattcggggtttaatgtgtcttgaacacgaggatgaaaaagtgaatatgtattgcgtcactgatgatcagttgatttgcgcactgtag

SEQ ID NO: 230598 - DNA, 2004 bp, Artificial Sequence
  Description of Artificial Sequence: Synthetic coding sequence
atggagacactcgagtctgagcttacttgtcccatctgtcttgagctgtttgaggatcctttgttgttgccctgtgcccattccctctgcttcaattgtgcccaccggatactggtatctcattgtgccaccaacgaatccgtggagtctattacagcattccagtgccctacctgccggcacgtcattaccctgagccaacgtggtctggacggcctcaagcgaaatgtcaccttacagaatattattgaccgttttcagaaagcttccgtgtccggtccgaacagccctagtgaaacgagaagggaaagggcatttgacgctaatacgatgacgagtgccgagaaggtcctctgccagttctgcgatcaggaccccgcacaggatgctgtgaagacttgcgtaacctgtgaagtttcctattgtgacgagtgcctcaaggcgacacatcccaacaagaagccattcacaggtcaccggctcatcgaacctattccggactcccatatacggggactgatgtgcctggaacacgaggacgagaaggtcaatatgtattgtgttaccgacgaccagctgatctgtgcactgtgtaagctcgtcggacgtcatagggaccatcaggtggccgcactgtctgagcgatatgacaaattaaagcagaatctcgaaagcaatctgacaaatcttataaaaaggaacactgagctcgagactctgctggcgaaactcatccagacatgtcagcatgtggaagtcaacgcttcaagacaggaggcaaagctgaccgaggagtgcgatctgctcatcgagattatccagcagagaagacaaatcatcggcaccaaaatcaaggagggaaaggtgatgcggctcagaaagcttgctcagcaaattgctaactgcaagcagtgcattgaacgcagtgccagcctcatttctcaggccgaacacagtctcaaagagaatgatcatgccagattccttcagactgccaaaaacattacggaaagggtctccatggccactgcttctagtcaggtgctcattccagagatcaatcttaacgatacattcgatacatttgcgctggacttcagccgggagaagaaactgctggagtgtctggattacctcaccgctcctaatcctcctacaatcagagaagagctgtgtaccgcctcctacgacacgatcacagtgcattggacctccgacgatgagtttagcgtggtcagttacgagctgcaatacacaatctttaccgggcaggccaatgtggtgtccctgtgcaacagtgctgattcctggatgattgtgccaaatattaagcagaaccattacacagttcatgggttacagtccggtactaagtatatcttcatggttaaagccataaaccaggctgggtcgcgttcttcggagcccggtaagcttaagacaaattcccaaccgttcaaattggaccccaagagtgctcacagaaaactgaaagtgagccatgacaacctgaccgtagagcgtgacgagtcatcatccaaaaagtcgcacacacctgaacggttcacttcacagggtagttacggagtggctggcaacgtctttatcgactctggacgacattattgggaagtggtgatatccggaagcacatggtacgccatcggattagcctacaaatccgctcctaagcacgagtggattggaaaaaactccgcctcgtgggccctgtgcaggtgtaacaataactgggtcgtgaggcacaactcaaaagaaatccctattgaaccagctccacacctgcgcagagtagggatactcctagattacgacaatggtagcatcgcgttttacgacgccctgaattctatacatctgtatacgttcgacgttgccttcgcacagcctgtgtgtcccacatttacagtctggaacaaatgcctgacgattattacaggcctgcctatacccgaccatctggactgcacagagcagctgccatag

SEQ ID NO: 230599 - DNA, 1854 bp, Artificial Sequence
  Description of Artificial Sequence: Synthetic coding sequence
atggagactctagaatcggaactgacatgccctatttgcctagaactgtttgaagatcccctactgttgccatgtgctcacagtctgtgtttcaattgcgcccaccggattctggtttcgcactgcgctactaatgagtccgtcgaaagcattacggccttccaatgtcccacttgtagacacgttattacactgtcacagcgcggactcgacggactgaaaaggaatgtgactctgcagaatatcattgatcgattccaaaaagcttccgtttcagggcctaactcaccaagcgaaacatcagcagagaaggtgctgtgccagttctgtgaccaggatccagcccaggatgcagtgaagacttgcgtaacgtgcgaggtctcatactgtgacgagtgtctgaaagctacgcatcccaacaagaagccctttaccggtcatcgccttattgagccaatcccagatagtcatatcagggggctgatgtgcctggagcatgaagacgagaagcagaacctggaaagcaatctgacaaatcttataaagcggaacacggagttagaaacactcctggccaagctgatccagacgtgccagcacgtagaggtgaacgctagcaggcaggaagctaagctgacggaagagtgtgacctgttgatcgagatcatccagcagcgcagacagattattgggaccaagatcaaggaagggaaggttatgaggctgaggaagctggcacaacagatcgcaaactgcaagcagtgcatcgagcggtccgcctccttgatttcccaggcagaacattcgctcaaggaaaacgatcatgcaagatttttgcaaacggcaaagaacatcaccgagcgggtgtcaatggccacagctagtagccaggtcttgatcccagaaatcaacttgaacgacaccttcgatacatttgcattagatttctcccgagagaaaaaactgctcgagtgcctggactacttgaccgcccctaaccccccaacaattcgtgaggagctgtgtaccgcatcctacgacaccattaccgtacattggacctcagatgacgaattctccgtggtttcttacgaattgcagtacacaatcttcactgggcaggccaacgtcgtgagtttgtgcaactctgccgattcctggatgattgtccctaacattaaacagaaccattataccgtccacggactgcaaagcgggaccaaatacattttcatggtgaaggctatcaaccaagctggcagcagatctagcgagcctgggaagttgaagacaaatagccagcctttcaaacttgacccgaagtctgcacacaggaagctcaaagtgtctcacgataacttaacagtggaacgcgacgaatcaagttctaagaagtcacacacacccgaacgcttcaccagtcaaggatcctatggtgtggctgggaacgtttttattgacagtggccgtcattattgggaagtcgttatttctgggtctacttggtacgcaattgggctggcctacaaatccgccccaaaacacgaatggatcggaaagaacagcgcatcatgggccctgtgtcggtgtaataacaactgggtggttaggcataactctaaggaaattccgatcgagcctgccccacaccttcggagggttggcatcctgctggactatgataacggctccattgcgttttacgacgcactgaatagcattcacctttacacatttgacgtggcttttgcccagcctgtgtgtccaactttcaccgtgtggaacaaatgcttaacgattattaccgggttgccgatcccggatcatttggactgtaccgagcaactcccatag

SEQ ID NO: 230600 - DNA, 2208 bp, Artificial Sequence
  Description of Artificial Sequence: Synthetic coding sequence
atgggcgaaagtcccgctagtgtggtgttgaacgcgtctgggggacttttttcactgaagatggagactcttgagtctgagctcacctgccctatttgcctggaactgttcgaggatcctcttttactaccttgcgcacattccctttgctttagttgcgcccaccgtatactggtcagctcgtgcagctccggagaatccattgaacccatcactgcatttcagtgtcctacctgccggtacgttatctccctaaaccatcgaggcctggacggcctgaagcggaacgtgacactccagaatataatcgatcgatttcagaaagccagcgtttccggcccaaacagtcccagtgagagccggcgtgagcgcacataccgccctaccaccgcaatgagctctgaaagaatcgcctgccagttctgcgagcaagatccccctcgggacgcagttaagacatgtataacatgcgaagttagttactgtgaccggtgtctccgggctactcacccaaacaaaaagccatttacctcccaccggttggtagagccagtgcccgacactcacctgaggggcataacctgtctggatcacgagaacgaaaaagtgaatatgtattgtgtgagcgacgaccagctgatttgcgcactctgtaaactggtcggacgtcatagagatcaccaggtcgctagtctgaatgacagatttgagaagcttaaacaaaccctggaaatgaacctgacgaatctggttaagagaaactccgaactggagaatcagatggcaaaactcattcagatttgtcaacaggtggaagtgaacaccgcaatgcatgaggccaagcttatggaggaatgcgacgaactggtggaaataattcagcagcgtaagcagatgattgccgtgaaaataaaagaaaccaaggtcatgaaactaaggaagctggcccaacaagttgctaattgccgccagtgtctcgagcggtcaaccgtgctgatcaaccaggctgagcacatcttgaaagagaacgatcaggctcggttcctgcagagtgccaaaaacattgcagagagggttgccatggccacagcctccagccaggtacttatcccagatattaactttaatgacgcttttgagaactttgccttggacttctcccgagaaaagaagctgctcgagggccttgattatctgaccgcccctaacccgccaagcattcgagaggaactgtgcactgcttctcacgacactattaccgttcactggatcagcgatgacgagttttcaatcagttcctatgagctgcagtacacaattttcacgggccaggccaactttattagcaagtcttggtgtagctggggcctgtggcctgaaatacggaagtgtaaagaagccgtgtcttgctccagacttgctggagctcccaggggcctctacaactcggttgactcctggatgatcgtccctaatatcaagcagaaccactacactgtgcacgggcttcagtctggcacacgctacattttcatcgttaaggccattaatcaagccggttcaagaaactcagagcctacccgtctgaagactaactcccagccctttaaattggatcccaagatgacacataaaaaactcaagattagcaatgacgggttgcagatggaaaaggacgagtccagtctcaaaaaaagccatactccagaaaggttttctggaaccgggtgctacggcgctgcgggaaatatcttcatagactctggctgtcactactgggaggtggtcatgggaagctccacttggtacgccattgggattgcatacaaaagcgctcccaaaaacgagtggattggcaagaacgcctccagttgggtattcagcagatgtaactcaaactttgttgtcaggcacaacaataaggagatgctggtggatgttcctccccatctcaagagactgggggtcttgttggactacgataataacatgttgtcgttctacgacccagctaattcactccacctccacaccttcgatgtgactttcatcctaccagtgtgtcctaccttcactatttggaataagtctttaatgattctcagcggtttacccgctcccgattttatcgactatccggagagacaggaatgtaactgtagaccacaggaatccccttatgtcagtggtatgaagacctgtcattag

SEQ ID NO: 230601 - DNA, 2118 bp, Artificial Sequence
  Description of Artificial Sequence: Synthetic coding sequence
atgggggagagccccgcatctgttgtgttaaacgcatcaggcggtctgttctctttaaaaatggagaccttagaaagcgaactgacatgtcccatctgtttagagctatttgaagacccattactgctgccatgtgcacactcattgtgcttttcatgtgctcatcgcatactcgtctctagctgtagtagtggagagagcattgaaccaatcacagcctttcaatgtcctacatgccgctacgtgataagcctgaatcaccggggactggatggccttaaacgcaacgtgactttgcaaaatatcattgaccgcttccagaaggcctcagtgagtggccctaactcacccagtgaatccagacgcgagcggacttatcgccctaccaccgccatgtcctccgagcgcatagcctgtcaattctgcgaacaggatcctcctagagacgccgtaaaaacctgtataacctgcgaagtttcttactgcgaccggtgcttacgcgcaacccatccgaacaagaagccttttacttctcataggctggtggagcctgtcccagacacacatcttcgcggtattacttgtttggatcacgaaaatgagaaggtaaatatgtattgtgtgtcggatgatcagcttatctgtgcgttgtgtaaattagttgggcgtcaccgggatcatcaggtagcctctttgaatgaccggttcgagaagctgaagcagactctcgagatgaatctgactaaccttgtgaagaggaattcagagcttgagaaccagatggccaagctgatacagatctgccagcaggtcgaagtaaacacagccatgcacgaggctaagctgatggaggaatgcgatgagcttgtggaaatcatccagcagagaaagcagatgattgcggtcaaaattaaagagaccaaagtgatgaaacttcgaaagctggctcaacaagtcgctaattgtaggcagtgtttggagcggagtacggtgcttattaaccaagctgagcacatcctgaaggaaaacgaccaagcgaggtttctgcagagcgcgaagaatattgctgaaagagtggccatggctaccgcttccagtcaggtcctgatcccagatattaatttcaacgatgcattcgaaaacttcgcacttgacttttctcgggagaaaaagctcctggaaggacttgactatctcaccgcacctaacccacccagcattagggaggagctgtgcactgccagtcacgataccatcaccgtgcactggatcagcgatgacgaattcagcatcagttcttacgagttgcagtacacgatctttactggacaggcaaattttatctcattatacaacagcgtggatagctggatgatagtgccgaatataaagcagaaccattacactgtccacggcctgcagagtgggaccagatacatttttatcgtgaaggctatcaatcaagccggatccaggaacagcgagccaacaagactgaaaacaaacagtcagcccttcaaactcgacccgaagatgacacacaagaagctgaaaatttctaatgacggcttgcagatggaaaaagatgagtcttcattgaaaaaaagtcacactccagagaggtttagcggcacaggatgctacggggcagcagggaatatttttattgattcaggttgccactattgggaggtggttatggggagctctacgtggtacgccatcggcatcgcctataagtcggctcccaagaacgagtggatcggcaagaatgcctcttcgtgggtgtttagtaggtgtaactcgaattttgtggttagacataacaataaagagatgcttgtcgacgtccctccccacttgaaacgtctgggcgtccttctggattatgacaataatatgctatctttttatgacccagcaaactcacttcacctgcacacttttgacgtgacgtttattctccccgtctgcccaacgtttacgatctggaataaaagtctcatgatactttctgggctacctgccccagattttatcgactaccctgaacgacaggaatgcaactgccgccctcaagaaagcccctacgtctccgggatgaaaacctgtcattag

SEQ ID NO: 230602 - DNA, 660 bp, Artificial Sequence
  Description of Artificial Sequence: Synthetic coding sequence
atggagacactggaatccgaactcacttgccctatttgtctggaactcttcgaggatcccctccttctcccctgcgcccactctctctgctttagctgcgctcatcgaatactggttagctcatgctcttccggcgaatcaattgaaccgattaccgctttccaatgtccaacttgtcggtacgttatcagcctgaaccataggggcctcgatggactgaagcgcaacgttactctgcagaacatcattgatagattccagaaggccagcgttagcgggccaaactccccctccgagtcacgacgggaaagaacctatcggcctacgactgccatgtcctcggaacgaatcgcctgtcaattttgtgaacaggaccctccgagggatgccgttaagacctgcatcacatgcgaagtcagttattgcgacagatgcctaagagccacacacccaaacaagaaaccctttaccagtcaccggttagtcgagcctgtgcccgatacacatctgagagggatcacgtgcctggatcatgagaacgaaaaggtgaatatgtactgcgtaagcgacgaccaactgatctgcgccctgtgcaagctggtcggacggcatcgtgatcatcaagtggccagtttaaatgaccggttcgaaaaactgtag

SEQ ID NO: 230603 - DNA, 1407 bp, Artificial Sequence
  Description of Artificial Sequence: Synthetic coding sequence
atggaaccccagccaggcggtgcacgcagctgtcgaagaggcgctccgggaggtgcatgtgagcttggccctgctgccgaagccgctcctatgagcttggccatccatagcacaacgggaacccgatatgacctggctgtgccccctgacgagaccgttgagggccttcggaaacgactttcgcagcggctgaaagttcctaaggagaggctcgccttgctccataaggacacccggttgagcagcggcaagctgcaggagtttggggtgggagacgggtctaagctgaccctcgttccaacggtagaagcgggactgatgtctcaagcctcgcgcccagagcagtccgtgatgcaggccctcgagagtctgacagagacgcaggtatctgatttcttatccgggaggagccccttgactctagccctgagagtcggagaccacatgatgttcgtgcagctgcagctcgccgctcagcacgctcccctccaacatcgacacgtgctcgccgctgctgccgcagccgcagccgcacgaggagatccctctattgcctctcccgtctcctccccatgccgtcccgtctcctcagccgctcgcgtgccaccagtgcccacatcaccttccccggcttcaccatcccccattaccgccggatcatttcgtagccacgccgcaagcacgacttgccctgagcagatggactgttctcctacagcgtcatcatccgcgagccctggcgcttcaacgacctctacccccggtgccagtccggcacccagaagtcggaagccaggcgcagtgatcgaatcatttgtgaatcatgcccctggcgtattcagtgggaccttttctggtacgcttcacccaaattgtcaggatagtagcggacggccacgcagggatattggcaccattctgcagattctgaatgacctactgagcgccactcgccactaccaaggcatgccgcctagcctggcacaactaaggtgtcacgcccaatgctcccccgcttccccagccccagacctggctcccagaacaacatcgtgcgagaagcttaccgccgctccatcagccagcctcctgcagggccagagtcagatccgaatgtgcaagcctccaggagatcggctgcggcagactgaaaatcgagccacacgttgtaaggtggagcgacttcagctcctgctgcagcagaaacgcttgagaagaaaagctagaagagatgcccgagggccttaccattggtccccgtcccggaaggccggacggtctgatagcagcagctcaggtgggggagggagcccttccgaggcatcagggctgggactggactttgaagattctgtgtggaagccagaggttaaccccgacattaaaagcgagtttgtggtggcatag

SEQ ID NO: 230604 - DNA, 771 bp, Artificial Sequence
  Description of Artificial Sequence: Synthetic coding sequence
atgggggagccaagcagagaggaatataagattcaaagcttcgatgccgagacccaacaattgctgaagacagctctgaaggtggcgtgttttgagaccgaggatggagaatatagcgtttgccagcggtcatacagtaactgtagtcggctcatgcccagtcggtgtaatacgcaatatcgagatcccggtgccgtcgatctagaaaaggtggctaacgtgatcgtggatcattccttacaggactgtgtattttcaaaggaagcaggacgaatgtgctatgcaattattcaggccgagagcaaacaggcaggccagagtgtattcaggcgcggtttacttaaccggctccagcaagagtaccaagccagggagcagctacgcgctcgctccctgcagggttgggtctgttacgtgacttttatctgcaatatcttcgactatctgcgcgttaataacatgcccatgatggccctcgtcaaccccgtctatgattgtctcttccgcctggcacagccagacagtttgtctaaggaggaggaggtggactgcctggtgcttcagctccaccgagtcggtgagcagctagaaaagatgaatggtcagaggatggatgagctgtttgtgctgataagagatggattcctgctgcctaccggattgtcctccctggctcagctactacttcttgagattatcgaatttagggccgcaggctggaaaacaacacctgcagcgcataagtactattactcagaggtgagcgactag

SEQ ID NO: 230605 - DNA, 669 bp, Artificial Sequence
  Description of Artificial Sequence: Synthetic coding sequence
atgggcgagccttctcgagaagaatataaaattcagtctttcgacgccgaaacacagcaactcctgaagacagcactcaaggatcctggcgcagttgacctcgagaaagtggctaatgtgatcgtggaccacagcctgcaggactgcgttttttccaaggaagccggtcgtatgtgttatgccattatacaggccgaatccaagcaggcaggacaaagtgtgtttcgccgtggactgcttaatcggctccagcaagagtaccaagcgagagagcaactgagggcccgatcattacagggatgggtctgctacgtgactttcatctgcaatatattcgactatttaagggtgaacaacatgccgatgatggccctggtcaaccccgtatatgactgtctgtttcgtttggcccaacctgatagcctatctaaggaggaggaggttgattgtctggttctgcagttgcacagggtaggggaacagctggagaagatgaatggccaacggatggatgagttatttgttctgatccgtgatggttttttattgccgacagggttatcttcgttggctcagctcctactgctcgagatcatcgagtttagagccgctggatggaagacaacgcctgccgctcataaatactactactccgaagtgagcgactag

SEQ ID NO: 230606 - DNA, 792 bp, Artificial Sequence
  Description of Artificial Sequence: Synthetic coding sequence
atgggtgagccaagccgggaggaatataagattcaatccttcgacgccgaaactcagcagctcctcaagaccgctctcaaggccccttcactcgagtgtacagtggcgtgcttcgaaactgaggacggcgagtactctgtgtgccagcggagctacagcaattgttctcggctgatgccctcacggtgtaacacccagtaccgggacccaggcgctgtggacctagaaaaggtggcaaatgtcattgtggaccactctctgcaggactgtgtgttttcaaaagaggcaggtagaatgtgttatgctattattcaggccgaaagcaagcaagcaggtcaaagcgtttttcggcgtggactcctaaatcgcctgcaacaggagtaccaggctcgcgaacagctgcgggctcggtccttacagggttgggtgtgttacgtcacatttatctgcaacatattcgactacctacgcgtgaataacatgcctatgatggccttagtgaaccccgtgtacgattgcctgttcagactggcacagccggatagccttagtaaggaagaggaggtcgactgtctcgtcctgcagctacaccgagtgggagagcagctggagaagatgaatggccagcggatggacgagctcttcgtcttaatacgggatggcttccttttgccaaccggtttgtcctctctggcccagctgctactcctggagatcattgagtttcgggctgcaggatggaagactacccccgctgctcacaagtactactactctgaggtgagtgactag

SEQ ID NO: 230607 - DNA, 1164 bp, Artificial Sequence
  Description of Artificial Sequence: Synthetic coding sequence
atgccgaggccaagattgctggctgcactgtgcggagctctcctctgtgccccttcacttttggttgccctggacatatgctctaaaaatccctgtcacaatgggggactgtgtgaggaaatcagtcaggaagttcggggagatgtctttcctagctacacttgcacctgcctcaagggctatgctggcaatcactgtgaaacgaagtgtgttgagcccctcgggctggaaaatggaaatatcgccaattcccagatcgccgcaagcagcgtgcgagtcacattccttggcttgcagcattgggttcccgagcttgctaggctgaatagagcaggtatggtcaacgcctggacaccatccagcaatgatgataacccctggattcaggttaatctgctgcgacggatgtgggttacaggcgtcgtcacccaaggagcttcacgtttggcctcccatgagtatctcaaggccttcaaggttgcctactcactgaacggccacgagttcgattttattcatgatgtgaacaaaaagcataaggaattcgtggggaactggaataaaaatgctgtccacgtcaaccttttcgagactccagtggaagcgcaatatgtcaggctttatccaactagttgtcatacagcttgcacacttagatttgaacttctcggctgtgagctgaatgggtgcgcgaaccccctcggcttgaaaaacaatagcattccggataagcaaatcacagcctcaagctcctacaagacatggggtctgcatttgttctcttggaatcctagttatgccaggttggataaacaggggaatttcaacgcttgggttgcagggtcctatgggaacgaccaatggctgcaagtcgatctgggtagcagcaaggaggtcaccgggattataacacaaggggcacgcaattttggcagtgtgcagttcgtggcctcatacaaagtcgcatatagtaacgattcagctaactggacggagtaccaagacccacgcacaggtagtagtaagatctttcctgggaactgggataaccatagccataagaaaaacctgtttgaaacccccatcttagctcggtacgtgagaatattgccagtggcatggcacaacagaatcgcactccggctggaattactaggctgctag

SEQ ID NO: 230608 - DNA, 1140 bp, Artificial Sequence
  Description of Artificial Sequence: Synthetic coding sequence
atgtggcctttcccagagggcggtaatacgattccgattctgcacactgacatctgcagtaaaaacccctgccataatgggggactctgcgaagagatctcccaggaggttcggggtgacgtgttcccctcctatacctgcacctgtctgaagggctatgccggaaatcactgtgaaactaagtgtgttgaacccctgggactggagaatgggaacattgcgaattctcagatagccgcaagcagcgtgcgtgtgactttccttggccttcagcactgggtccccgagctggccaggctgaaccgagctgggatggtaaacgcctggacaccatcatccaacgacgacaacccctggatacaggtgaatttactgcggaggatgtgggtaaccggcgtagttacacagggggcttccagactggcttctcacgaatatctcaaagcattcaaagtagcgtactctttaaacggccacgaattcgattttatacacgacgtgaacaaaaagcacaaggaatttgttggaaactggaataagaacgctgtacatgtgaatctgtttgagacacctgtagaggcccaatacgtgaggctataccccacgtcatgtcacactgcctgcaccctcagatttgagctcctgggttgtgagctgaacggctgtgcgaatcccctgggcttgaagaataacagcatccccgataagcagatcaccgcctcatcatcttacaagacttggggcctgcacctattctcttggaaccctagttatgcacgcctggataagcagggcaattttaatgcttgggtggctggctcttatggaaatgaccagtggctccaggtggatctggggagcagcaaggaggtcacagggataatcacccagggcgctcgcaattttggatcagtgcaattcgtcgcgtcttataaagtggcttattccaatgactctgcaaactggaccgaataccaagatcccagaactgggagcagtaaaatctttcccggaaattgggataaccactcccacaaaaagaacctgtttgagactcccatcctggcccgatacgtgcgaatcctgccggttgcatggcataaccgaattgcacttcggctggaactgttgggctgttag

SEQ ID NO: 230609 - DNA, 1008 bp, Artificial Sequence
  Description of Artificial Sequence: Synthetic coding sequence
atgccacgacctagattactagcagcactatgcggggctctgctgtgcgctccaagcctgctggtggcactcgatatctgtagtaagaacccatgtcataacggcggactatgtgaggagatcagtcaggaagtgcggggagatgtgttcccttcttatacatgcacttgtctcaaaggatacgctggaaaccactgcgagaccaaatgcgtcgagcctttaggtctggagaacggaaatatcgcaaatagccagatcgccgcatccagcgtccgcgtgacctttcttgggctacagcattgggtcccagaactggccaggctgaaccgggcaggtatggtaaacgcgtggactcccagcagcaacgacgacaatccatggatccaagtcaatctgctcagaaggatgtgggtgaccggagtggttacacagggcgcttcacggttggcctcccacgaatatctaaaggccttcaaggtggcttactccctgaatggtcacgaattcgattttattcatgatgtcaacaaaaaacacaaggagttcgtgggaaactggaataagaatgcggtgcacgtgaatcttttcgaaaccccagtggaggcgcagtacgtgcgcctgtacccgacctcctgccataccgcctgcactctccgattcgagctactggggtgcgaactgaatggttgcgccaaccctctcggtctgaaaaacaatagcattcccgataaacagattaccgcctccagctcatacaagacgtggggtttgcatctgttttcttggaatccgtcatacgcccgattggacaaacagggaaattttaatgcttgggtagcaggctcctatggtaatgaccagtggttgcagatatttcctggcaattgggataaccattcccacaaaaagaatctgttcgaaacacctatcctggcaaggtacgtgagaattctgccagtggcatggcacaacagaattgctctgaggcttgaactgctgggctgctag

SEQ ID NO: 230610 - DNA, 1929 bp, Artificial Sequence
  Description of Artificial Sequence: Synthetic coding sequence
atgccctgcggagaagactggctgagtcaccccctggggatagtgcagggcttcttcgctcagaacggggtgaaccccgattgggagaagaaggtgattgagtatttcaaggagaaactgaaagagaataacgctccaaagtgggtgcccagtctcaatgaagtgccattgcactacctcaaaccaaatagtttcgttaaattccgctgtatgatacaggatatgttcgatcccgagttctatatgggcgtttatgagaccgttaaccagaacacaaaagcgcatgtcctacactttggcaagtatcgagacgtcgcagaatgcggtcctcagcaggaactggatctcaacagcccccgtaacacaacgctggaacgacagaccttttattgcgtgcctgtgccgggtgagtccacctgggttaaggaggcctacgtgaatgctaaccaggccagagtcagtccgagcacctcctatactccttcacggcataagagaagctacgaagacgacgatgacatggatttgcagcctaacaagcagaaggatcagcatgcaggagccagacaggctgggtcggtggggggtttgcaatggtgtggagagccgaagagactggaaaccgaggcatcgacaggacagcagctgaatagtctaaatctgtctagcccttttgacctcaactttccgttgccaggtgagaaaggacctgcctgtcttgtgaaggtttacgaagattgggactgctttaaagtgaacgatatccttgagctctacggaatcctatctgtcgaccccgtgctcagcatcctcaataacgacgaaagagacgcatcagccctgctggaccccatggaatgcactgatactgcagaagaacagagagtgcactccccacccgcttccctcgtccccagaattcatgtcattctcgcgcaaaagctgcagcacatcaaccctctgctgccggcatgcctgaacaaagaagagtcgaagacatgtaagtttgtttccagcttcatgtccgaattatctcctgtccgggcagaattattgggctttctgacccatgcacttttgggcgactcattagctgccgagtacttaatcctgcacctgatttcaacggtatatactagacgggacgtgctcccactgggcaagtttaccgtgaatctctcaggttgcccacgaaactcaacctttaccgagcacctttacaggattatccagcatcttgtgcctgcgagctttaggctccagatgaccatcgagaacatgaaccacctcaagttcatccctcataaggattatactgctaatcggctcgtgtcaggccttttgcaattgccgtccaataccagtttagttattgatgagacgcttctggaacagggccaacttgacactcctggtgttcacaacgttactgcactctctaatcttattacatggcagaaagttgattatgactttagctaccaccagatggagttcccatgtaatattaatgtgttcattacttccgagggtcgctccctgctgccggcagactgtcagattcacctgcagcctcagctgatacccccaaacatggaagagtatatgaactctttattatcagccgtgctgccgagcgttctaaataaattccgaatttacctgacactgctaaggttcctggagtacagcatttctgacgagatcaccaaagctgtggaggatgattttgtcgagatgaggaaaaacgacccacagagcattacggcagacgacctgcaccagcttttggtcgtcgcccgttgtctgtccttgagcgccggtcagacaaccctgagcagggaacggtggctgcgggcaaagcagctggagagcctcaggaggacgcgtcttcaacagcagaagtgcgtaaacggaaacgagctttag

SEQ ID NO: 230611 - DNA, 1923 bp, Artificial Sequence
  Description of Artificial Sequence: Synthetic coding sequence
atgccatgcggggaggattggttgtcccaccctctgggaattgtacaaggtttcttcgcccaaaatggcgttaaccccgactgggaaaagaaagtgatagagtactttaaggaaaagctgaaggagaacaacgcccctaaatgggtgccctcgcttaacgaagttcctctgcattacttaaaaccaaattcatttgtgaagttcagatgtatgattcaagacatgttcgatcccgaattttatatgggagtctatgaaaccgttaaccagaataccaaagcacatgtgctgcacttcggaaaataccgcgatgttgctgagtgtggtcctcaacaggagctggacctgaactctcctcggaacactactttggagcgccagaccttttactgcgtacccgttcccggagagtctacttgggtgaaggaagcttatgtgaatgcaaatcaggctagagtttcaccgtcaacctcatacacgccctccagacacaagcgctcttacgaagacgatgatgatatggatctccagccaaataagcaaaaggatcagcacgcaggtgctcgccaggccggatcagtgggtggattgcagtggtgcggagagccaaagcggctggagacagaagcctcaaccggacagcaattgaattctctcaacctatcttcacccttcgacctcaattttccgctccccggagagaaggggccagcctgccttgtaaaggtgtacgaagattgggattgcttcaaggtgaacgatattctcgaactttacgggatactgagtgtggatcccgttctctccattttgaataatgacgagagggatgcttcagctctattggacccgatggagtgtactgatacagctgaagagcaacgagtccacagcccccctgcctctctggtgccgagaattcatgttatcctcgcccaaaagctccagcatatcaatccactcctgccggcttgcctgaataaggaagagagtaaaacttttgtgtcttcgtttatgagcgaactgtcacctgtccgggcagaactcctggggttccttactcacgcattgcttggagattcactggccgctgaatatcttattctgcacttaatctcaaccgtgtacacacgcagagacgtcctgccactagggaaatttacagttaatctatccgggtgcccacggaactctacatttacagaacatctctatcgaataattcaacatctcgtgccggcatcttttcgactgcagatgactatcgagaacatgaatcatcttaagttcatcccccataaagattacacagcgaaccgactagtgagtggcctgctgcagctgcccagtaacacttccctcgttatagatgagacgcttttagaacaaggacagctggacaccccgggtgtccacaatgtgaccgcactttccaatctgatcacatggcagaaagttgactacgatttctcttaccaccagatggaatttccatgcaacatcaacgtatttataacatctgaaggccgtagcctattgcccgcagactgtcaaatccatttgcagccccagctcattccccctaatatggaagagtacatgaacagtttactctctgctgtgctgccatccgtcttgaacaagttccggatttacctgaccctgctaagatttctcgagtatagcatcagtgacgaaattactaaagccgttgaggacgacttcgtggaaatgaggaagaacgacccacaatctataactgccgacgatttgcatcagttactcgtggtcgctcgatgtctcagtctgtcagcaggccagacaactctgtccagagagagatggttgcgggctaaacagctcgagtctctccgcagaaccagactccagcagcaaaagtgcgtcaatggcaatgagctttag

SEQ ID NO: 230612 - DNA, 2628 bp, Artificial Sequence
  Description of Artificial Sequence: Synthetic coding sequence
atggacgaggaggaagacaatctttcattgctcacagccttgctcgaagagaacgagtccgctcttgactgcaatagcgaagaaaacaattttctgacgcgcgagaatggcgagcccgacgcctttgatgaactgttcgatgctgatggggatggagagtcttataccgaggaagcagacgacggagagacaggcgagacaagggacgagaaagaaaacctcgcgaccctcttcggggacatggaggatctgacagacgaggaggaggtgcctgcatcccagagtacagaaaaccgggtcctgcccgctcccgcacccagaagagagaagactaatgaagagctccaggaggaactgagaaacctgcaggagcagatgaaggccttacaagaacaattgaaagtcacgactatcaaacaaactgcctctcccgcacggctccagaaaagcccggtggagaaatcaccaagacctccactgaaagaacgacgggttcagcggatacaggagagcacttgcttttcggccgagttagacgtcccagccctgcccagaacaaaaagggtcgccaggacccccaaagcatcacctccggatccgaaaagtagttcctcccgaatgacctctgccccaagccagcccctccagacaatctccaggaataagccgtctggcatcacaagaggccagatcgtcggcactcccggatcttctggcgaaactacgcagcccatatgcgtggaggctttctcagggcttcggctgagacgtccgagggtgtcctccaccgaaatgaacaaaaaaatgacaggacgcaaactgattagattgtctcagataaaggagaagatggcacgggaaaaattagaggagatcgactgggtgacatttggagtgatcctgaagaaggtgacccctcagtcagtgaactccggaaagacctttagcatatggaagctgaacgatctgagagacctgacccagtgtgtctcactgtttttgttcggagaagtgcacaaggccctgtggaagaccgagcagggaaccgttgtcggtattttgaacgccaacccaatgaagcctaaggatggctcggaagaagtttgtctgtcaattgaccacccccaaaaagtcctcatcatgggtgaggcactcgatttggggacctgcaaggccaaaaagaagaatggagaaccttgcacacagacagtgaacctcagagattgcgaatactgccagtaccatgtccaagcccagtacaagaaactgtccgctaagagagccgacctgcagagcaccttttccggaggtagaataccaaagaaattcgcgcgaagaggtacctcattgaaagagcggctgtgtcaggatgggttctactatggaggggtcagttccgcgtcttacgctgcctctattgctgccgctgtcgccccaaaaaaaaaaatccagacgactcttagtaacctcgtggtcaagggcacaaacctcatcatccaggagactcgccagaagctcggaattcctcagaagagcttgtcctgcagtgaagagttcaaggaactgatggacctaccaacttgcggtgctcggaacttgaaacagcaccttgccaaggctactgcatctggtatcatgggcagccccaaacccgctattaagtctattagtgcatccgccctgctgaagcagcagaagcagagaatgctcgagatgcgaagaagaaagtccgaggaaatccagaaacggttcctccaatctagctcagaggtcgagagccccgcagtcccttccagcagccggcagcctccagcacagccccctaggaccgggagcgagtttcccagactcgagggcgctcccgcaacaatgactccaaaacttgggaggggtgtcctcgaaggcgatgatgtcctgttctacgatgagtctccacctcctcggcctaaattgagcgctcttgccgaggccaaaaaactcgcagctataactaaattgcgggctaaggggcaggtcctgactaagacaaaccccaatagcataaaaaagaaacagaaggacccacaagatattttggaagtaaaggagagggtcgaaaagaatacaatgttcagctcgcaagccgaggacgagcttgagcctgccaggaaaaaaagaagagagcagctggcctacctcgagtccgaggaatttcagaagatactgaaggccaaatctaaacataccggcatcttaaaggaggcggaggcagagatgcaggaaagatacttcgaacccctcgttaagaaggaacagatggaagagaagatgcgaaatattcgtgaggtaaaatgtagagttgtcacttgtaagacctgtgcgtacacacatttcaaactgctggagacctgtgttagtgagcagcacgagtatcactggcacgatggcgttaaaagattcttcaaatgcccctgcggcaaccgtagcatctcccttgatcgactgccaaataaacactgcagtaattgcggactttacaagtgggaaagggatggcatgttgaaagagaaaactggccctaagatcggaggtgaaactctgttacctcggggagaggagcacgccaagttcctgaatagtctgaagtag

SEQ ID NO: 230613 - DNA, 2568 bp, Artificial Sequence
  Description of Artificial Sequence: Synthetic coding sequence
atggacgaagaagaagataatctgtctctgctgacggccctactggaggagaacgagtctgcccttgactgcaattctgaagaaaataattttctgactagagaaaacggcgagcctgatgctttcgacgaactgtttgatgccgacggtgacggagagtcgtacaccgaagaggccgacgacggcgagacgggagagactcgcgacgagaaagagaacctggctacgctgttcggcgacatggaggaccttaccgacgaggaggaagtgcccgcaagtcaatcaacggaaaatagggtgctcccagccccagcgcctcggagggagaagacaaacgaggaactgcaggaggagctcagaaatttgcaagaacagatgaaagccctccaagagcagctgaaggtaactactatcaaacagacagcgagccccgctaggttacaaaaaagccctgagaagtcccccaggccgccactgaaagagagaagggtgcaacgcattcaggagtctacatgcttctccgctgagttagacgtgcccgctttgccacggaccaagagagtcgctagaacccctaaggcaagtccacctgacccaaaaagcagcagtagtaggatgacaagtgctccttcccaaccactccaaactatcagccgcaacaagccatccggcattacaaggggccagatcgtcggcactcccggtagcagcggggaaacaacccaacctatctgtgtagaggcattcagtggactgcgactgcggagacccagggttagtagtaccgaaatgaacaagaagatgaccgggaggaagttaatacgtctctcccagattaaggaaaagatggcacgcgagaaattggaggagatcgactgggtcaccttcggggtcatcctgaagaaggtgacaccgcagagcgtcaactccggaaaaacattttccatctggaaacttaatgatctcagggacctgacgcagtgcgtatcattgttcctttttggcgaagttcacaaagcactgtggaagacagaacagggaacagtagtagggattctgaacgcgaacccaatgaagcccaaagacggaagtgaggaagtgtgtctgtctatagaccacccccagaaagtgctgattatgggggaagcactggaccttggcacttgcaaggcaaagaaaaaaaacggagaaccatgcacacagacggtgaacctgcgcgattgtgagtattgtcaataccacgtgcaggcccagtacaagaaactgagcgcaaagcgtgctgacctccagagcactttcagtggcggtcggatccctaaaaaatttgctaggcggggtacctcgcttaaggaacgattatgccaggatggcttttactatggaggtgtatcctcagcctcgtacgcggcaagcatagccgcagccgtcgccccaaagaaaaagatacagactacgctcagcaacctcgtggtgaaggggaccaatttaatcattcaggagacccgtcagaagctgggaatcccccagaagtcgctatcatgttctgaggagtttaaagaactgatggatttgcctacctgcggagcaagaaacctcaagcagcatttggctaaggctacggcttctggaatcatgggctctccgaagcccgcaatcaagagtataagcgctagcgcgctcctgaaacagcaaaagcagcgcatgctggaaatgcgccgaagaaagtccgaagaaattcagaaacggtttctgcagagttcttctgaggttgagagtccagctgtacctagtagctcgcggcagccacccgctcagccacctcgcactggttccgaatttccgaggcttgagggggcaccagctacaatgacacctaaacttggccgaggagtgctggagggcgatgatgtcctgttctacgacgagtcccccccacctcggcctaagctcagcgcactagccgaggccaagaaattggcagccattaccaagctgagagccaaggggcaggtgttgaccaagactaatcctaactcgataaaaaaaaaacagaaggatccacaggatatcctggaggtcaaagagcgcgtcgagaagaacaccatgttttccagtcaagctgaggatgagctggagccagccagaaaaaagaggcgtgagcagctggcttacctcgagtctgaagagttccagaaaatactcaaagcaaaatctaagcacacaggcatcttgaaagaggccgaggcagagatgcaagagcggtattttgagccccttgttaagaaagaacagatggaagagaaaatgcgcaacattagggaggttaagtgcagagtggtaacgtgtaaaacatgtgcctacacgcacttcaagctgctcgaaacatgcgtgagtgagcagcacgagtatcattggcacgatggcgtgaaaagatttttcaaatgtccatgcggcaaccgcagcatatcactggatcggttgcctaataaacattgcagcaactgtggtctctacaagtgggagcgcgatggaatgttgaaggtgtgtcacctgcgtacaaatttctag

SEQ ID NO: 230614 - DNA, 2625 bp, Artificial Sequence
  Description of Artificial Sequence: Synthetic coding sequence
atggatgaagaagaggacaatctctccctgctaaccgcgcttctcgaggagaatgagtctgccttggactgcaacagcgaggagaacaattttctgactagagagaatggcgagcctgacgcctttgatgaactgtttgatgctgacggagatggagaatcgtatacggaggaagcggacgatggggagacgggtgaaacccgtgatgagaaggagaacctcgcaacactgtttggggacatggaagatctgacagatgaagaggaggtgcccgctagtcagtcaactgaaaacagagtgctgccagccccagccccacggcgagagaagacaaatgaggagttacaggaagagctcagaaatctgcaggagcagatgaaagccctccaggagcaactaaaggtgaccactatcaagcaaacagcctctccagctcggctgcaaaaaagccccgagaaaagcccacgcccacccctcaaggagcgccgagtccagagaattcaagagtccacctgcttctcggcagagcttgatgtcccggcactccccagaactaagcgggttgccaggacaccgaaggcctcaccaccagaccctaagtcatcgtcctcaaggatgacgtccgctccatcccaacccttgcagacaatcagccggaacaagccttctgggatcactcgcggacaaattgtaggtacacccggttcttcgggagagactacacagcccatctgcgtggaagccttctcgggtttgaggctgcgtcgcccacgggtcagttctaccgagatgaataaaaagatgactgggaggaagcttatccggctgagccaaatcaaggaaaagatggccagggaaaagttggaagagattgattgggtcacatttggggtcatcttaaagaaggtgaccccgcaaagtgtgaattcgggcaaaaccttcagtatttggaaattaaatgacctcagagacttgacacagtgcgtgtctctcttcttatttggtgaggtccacaaggcactctggaaaaccgagcaaggcactgtggtaggcattctcaacgccaaccccatgaagcctaaggacggctccgaggaagtttgcttaagcatcgaccaccctcagaaggtgctcatcatgggggaggccctcgacctgggaacatgcaaggcaaaaaaaaaaaacggtgagccgtgcacccagacagtaaatctgcgagattgcgagtattgccaatatcatgttcaggcccaatataagaagctgagcgccaaacgggctgaccttcagtccaccttctctggaggcagaatccccaagaagtttgctagaaggggaacctctttgaaagaacgcctatgccaagacggattttactacggaggagtgtcatcagcatcttacgccgcatctattgctgccgctgtcgcccctaaaaaaaagatccagacaaccctgtccaatctggtggtgaagggcactaacctcataatccaagagacacggcaaaagctggggattccacagaagtcattatcttgttccgaagagttcaaggagttaatggacctgcccacttgtggagcaaggaaccttaaacagcacttagctaaagcaactgcgagcggaataatggggtcccccaagcctgccataaaaagtatctccgctagcgccctcctgaagcagcagaagcagcgtatgctggaaatgcggagaaggaagtctgaggaaatccagaagaggttccttcagtctagttctgaagttgagtcccctgccgtgccaagctcttcaaggcagcctcccgcacagccaccacgcactggctcggagttccccagactagagggagcaccggctactatgactcccaagctggggcgtggtgtcctggagggagacgacgtgctcttctatgacgaatctcccccacctcgtcctaagctaagtgcactggcagaagccaaaaagttggcagctatcactaagctgagagccaagggtcaggtgctgacaaaaactaacccaaactcaataaaaaaaaaacagaaggacccacaagatattctcgaggtgaaagaacgggtggagaaaaatacaatgtttagctctcaggctgaagacgaactggagcccgcaagaaaaaagaggagagaacagctcgcttacttagaatccgaggagttccagaagattttgaaggccaagtccaagcatactgggatcctgaaagaggcagaggccgaaatgcaggaacgttacttcgaacccctggtgaaaaaagaacagatggaggagaagatgaggaacatcagagaagtcaaatgtcgggtcgtgacctgtaagacctgtgcctacacacactttaagctgctagagacatgtgtgagcgagcagcacgagtatcattggcacgatggcgtgaagcgtttcttcaagtgcccctgtggtaaccggagcataagtctggaccggctgccaaataagcattgtagcaattgcggcttgtacaaatgggagcgagacggaatgctgaaggagaaaaccggtcctaagattggtggcgagaccttgcttccccgtggagaggaacatgccaagtttctgaattccctgaaatag

SEQ ID NO: 230615 - DNA, 2628 bp, Artificial Sequence
  Description of Artificial Sequence: Synthetic coding sequence
atggacgaagaggaggacaacctgtctttactgacagccctgcttgaggaaaacgaatctgccctggactgcaactctgaggaaaataactttctgactcgtgagaacggggaacccgacgcttttgacgagctgttcgacgccgacggagatggcgagtcttatacagaagaagccgacgatggtgaaacgggagagactcgggatgaaaaagagaacctggccacattatttggcgatatggaggatctgaccgatgaagaggaggttcctgcgtcacagagcaccgagaacagagtgttacccgcacccgctcccaggagggaaaagacgaacgaagaactgcaggaggagctccggaacctgcaggaacagatgaaggcgttgcaggagcagctgaaggttacgactataaaacagaccgcctctccagcacggctgcagaagtcccctgtcgagaaaagtcccagacctccactcaaagagcgcagggtccagagaatccaagaatctacatgcttctccgccgaactcgacgtgccggcacttcctcgcaccaaaagagtggctaggactccaaaagcttctccgccagaccccaagagctcctcatcgcgaatgacttctgctccttcacagccattgcagaccatctctagaaacaagccatccggcattacccgtggtcagatagtgggcactcccggatcatccggcgagaccacacaacccatctgtgttgaggcattttcgggtctccgactgcggaggcctcgcgtttcaagcaccgagatgaacaagaagatgaccggaaggaaactgattcggctgtctcagatcaaagagaagatggctcgcgagaagctggaagaaatagattgggtgacctttggggtgatcctcaagaaagtgacaccccaatctgtgaattcagggaaaaccttcagcatttggaagctgaatgacctcagagacctgacccaatgtgtgagcctgttcctgtttggcgaggtacacaaggcactctggaagactgagcagggtaccgtggtcggcatcctgaacgctaacccgatgaaacctaaggacggtagcgaggaagtctgtctctctatcgatcatccccagaaagtgctcatcatgggcgaggccctcgatctcggcacctgcaaggccaagaaaaagaacggcgaaccgtgcactcagaccgtgaatttgagagactgtgaatactgtcagtatcacgtgcaggcacagtacaagaaattatccgctaaacgggcagacctccagtcaactttctccgggggacgtatacctaagaagttcgctaggcgcggtacttcattgaaagagcggctgtgtcaggatggtttctattacggaggagtgagtagcgcctcatatgcggctagcattgccgcagcggtggcaccaaaaaagaagatccagacaacgctgtctaacttagtggttaaaggcacaaatttgatcatacaggaaaccaggcaaaagctcgggatccctcagaagtcactctcatgctccgaggaattcaaggagctgatggacttgccgacctgtggcgcacggaatctgaagcagcatctggccaaggcgacagcctccggcataatgggcagcccaaaaccggcaatcaagagtatctccgcctctgcattgctcaagcagcaaaaacaacgcatgctggagatgcgtagaagaaagagcgaggagatccagaaacggtttcttcagtcctcctcagaagtcgaatccccggctgtgccttcctcaagcagacagcctccagcgcagccaccacgcaccgggtctgaatttccgcgacttgagggtgcacccgctaccatgacccctaaacttggcagaggcgtgctagaaggtgacgatgtcttgttctacgatgagtctcccccacccagacccaagttgagcgctcttgccgaagcaaagaagcttgccgctattacgaagttacgggctaagggtcaggtgttgacgaaaacaaaccccaacagcataaagaagaagcagaaagaccctcaggatattctagaagttaaggagagagtggagaagaacactatgttcagctcacaggccgaagatgaacttgagccggcacggaaaaaacgacgagaacagcttgcttatctggaatcagaggagtttcagaaaattctgaaagctaagagtaagcatacgggaatcctgaaagaggccgaggccgaaatgcaagagcggtattttgaacccctggtgaagaaggagcagatggaggagaagatgcgaaacatacgggaagttaaatgccgagttgtgacctgtaagacatgcgcttacacacattttaaattacttgagacctgcgtgtctgagcagcacgaataccattggcatgacggcgtcaagcgtttcttcaagtgtccctgtgggaatcggagtatcagcctcgaccgcttgcctaataaacactgtagcaactgtgggctttataagtgggagcgtgatggcatgcttaaagagaagaccgggcctaagattggtggcgaaacgttgctgcccaggggcgaggagcatgctaaattcctaaactctctgaagtag

SEQ ID NO: 230616 - DNA, 2466 bp, Artificial Sequence
  Description of Artificial Sequence: Synthetic coding sequence
atggatctggctgcagcagcagagcccggagcaggctcacaacatctggaggtgcgcgacgaggttgctgaaaagtgtcagaagctctttcttgacttcctggaggagtttcaatcatctgatggagagattaagtaccttcaacttgccgaagagttaatccgaccagagaggaacactctcgtggtttctttcgtcgatctggaacaatttaatcagcagctcagtactaccatacaagaggagttctaccgtgtgtacccatatctgtgccgtgctcttaagactttcgtcaaggataggaaggaaattccccttgcaaaggatttctatgtagctttccaggatttacccactagacacaaaattcgagaactgacaagctctagaatcggcttactaacccgtatctccgggcaggtcgtgcgtactcaccccgtgcatccggaactagtctctggtacatttctttgtctggattgtcagaccgtgatacgcgatgtagagcaacaatttaaatatacacagccaaatatatgtcgcaaccctgtatgtgctaacaggcggcgtttcctgttagatactaacaagtctagatttgtagacttccagaaagtgagaatccaggaaactcaggccgagctaccaagagggtccatacccagaagcttagaggtaattttgcgcgcagaggctgtcgaaagtgcccaagcgggtgataagtgtgactttaccggaactctgatagtcgtgcccgatgtttcaaagttgtccactccaggtgctcgggctgagactaactcccgggtttccggagttgacggctatgaaacggaagggattcggggactacgcgcactgggcgtgcgggacctgagctatcggctcgtgttcctggcttgttgcgtcgctcccacaaatccacgttttggcggaaaggaactgagggacgaggagcagacagccgagtctatcaagaaccaaatgactgttaaagagtgggagaaggtcttcgagatgtcccaggacaagaacttataccacaacctctgtacgtccctgtttccaactatccatgggaatgacgaggtgaagcgaggcgtcctcctgatgctgttcggtggagtcccaaagaccactggagagggaacctccctgaggggggatattaatgtgtgcatcgtgggcgacccatccaccgccaaaagccaattcctcaaacatgtagaggaattctccccgcgagcagtatacactagtggcaaagcaagctcagccgcagggctcactgctgccgtcgtgagggacgaagagagtcatgaattcgttattgaagctggcgcattgatgttggctgacaacggagtttgctgcatcgatgaattcgacaagatggacgttagggatcaggtggctatccacgaagccatggagcagcagacaatctccatcaccaaagcaggcgtgaaggccacgctcaacgcgaggacaagcattcttgccgctgcaaatccaatcagtgggcattatgataggtctaagtcacttaagcagaacatcaatctgagcgctcccatcatgtctcgcttcgatctcttctttatcctcgtggacgagtgtaacgaggtgaccgactatgcaatcgcacggcgtatcgttgatttgcacagtcgaattgaggaatccattgaccgtgtgtactcactggatgacatacgaagataccttctgttcgcgagacagtttaagccaaagatttcaaaagagagcgaagacttcattgtagagcaatacaagcaccttcggcaacgtgacgggagcggcgtgactaagtcgagctggcgcatcaccgtgcgacaattggagagcatgatccgtctaagcgaggctatggctcgcatgcactgctgcgacgaagtgcagcctaagcacgtgaaggaggcgtttaggcttctgaacaagtctatcattagagtcgaaacccccgatgtcaatctggatcaggaggaagaaattcagatggaggtggatgaaggtgctggtggtatcaacggccacgctgatagccctgcacctgttaacgggatcaacggttacaatgaggacataaaccaggaaagcgctcctaaggctagtctcagactcgggttctcagagtactgtcgcatatctaatcttattgtgctccacctccgaaaagtggaagaggaagaggacgagagcgcccttaagcgctccgagctggtgaactggtatctaaaggaaattgagtctgagatcgacagtgaagaagagctgataaacaagaagagaattatagaaaaggtaatccatagactcacgcactacgaccacgttctgatcgagcttacccaggcaggcttgaaagggtctacagaaggaagtgaatcatatgaagaggacccctatctcgtcgttaatccaaactacctgcttgaagactag

SEQ ID NO: 230617 - DNA, 2160 bp, Artificial Sequence
  Description of Artificial Sequence: Synthetic coding sequence
atggccctgaaagactatgcactggagaaggaaaaggtgaaaaagttcctgcaggagttctaccaggacgacgaattgggtaagaaacagttcaagtacggcaatcagctggtgagattggcccatcgagaacaggtggccctgtatgtggatctggacgatgtggccgaagatgacccggagctggttgactctatttgcgagaatgctagacgttatgctaaactcttcgctgacgctgtgcaagagcttttgcctcaatacaaagagagggaagtggttaataaggacgtactggacgtgtatatcgagcaccggctcatgatggaacagcggtcaagagaccctgggatggtaaggagtccccagaatcaatatcctgcagagctcatgcgcaggttcgaattatactttcaggggccttccagtaataaaccacgcgttatccgcgaggtgcgagcagattcggtcggaaaactggtgactgtccgcggaattgtgacaagagtgagcgaggtgaagccgaaaatggtcgtcgcgacttatacctgcgatcaatgtggagcagaaacataccagccaatccagtccccaacatttatgcctctgataatgtgtcctagccaggaatgccagacgaaccgcagcggcggtcgcctttacttgcagaccagggggtccaggtttattaagtttcaggaaatgaaaatgcaggaacactctgatcaggtcccagtcggcaacatcccccgatcaattactgtgctcgtggagggcgaaaacactcgaattgcgcagcccggagaccacgtctctgtgaccggtatcttcttaccgattctgaggaccggctttaggcaggtcgtgcaaggactgctgagtgagacttacctcgaagcccaccggatagtgaagatgaataagtctgaagacgatgagtctggagccggagaacttacgagggaagagctgcggcagatagccgaagaggatttctacgagaagctggccgcttcaatcgctccggaaatctacggccacgaggacgtaaagaaagctttactgttgttacttgtggggggtgtggaccagtcccccaggggcatgaagattcgcggaaacattaatatatgtctgatgggcgatcccggagtggccaaatcccagcttttatcatatatcgatcgccttgctccacgatcccagtatacaactggacgaggctcttccggagttggcttgaccgcagcagttttgcgcgattctgtgagcggggagctcacattagaggggggagctctcgttctggccgatcagggcgtgtgctgtatagacgagtttgataagatggccgaagcggaccggaccgcgatccatgaggtgatggagcagcaaacgatctcaatcgcaaaagccggtatacttaccactctcaacgcacgctgtagtatcctggccgctgccaatcccgcttatggaagatataatccaaggagaagcttggagcagaacattcagctaccagctgccctactgtcccggtttgatctcctgtggcttatacaggaccgcccagatcgcgacaacgatctcaggctggcccaacacattacctatgttcatcagcactctagacagcccccaagccaattcgagcctttagacatgaaattgatgcgtagatatattgccatgtgcagggagaaacagcctatggtgccggaatctctcgctgattatataaccgccgcttacgtagaaatgcgtagggaggcatgggcatccaaagatgccacatatacaagtgcgagaactctgttggcaatcctgcggctttcaactgccctcgccagactcagaatggtcgatgtcgtcgagaaggaggacgtgaacgaagccattcgcttgatggagatgtctaaggattcactgctcggagataaaggccagaccgcccgtactcagcggccagcagatgtgatttttgcaacagtgcgagagcttgttagcggaggcaggagcgtgcgcttttcagaagccgaacagcgctgtgtgagcaggggattcacaccagcacagtttcaggccgctctcgatgaatacgaagaattgaatgtctggcaggtgaatgcttctcgaactcgcattacctttgtctag

SEQ ID NO: 230618 - DNA, 1170 bp, Artificial Sequence
  Description of Artificial Sequence: Synthetic coding sequence
atggccctgaaggactacgcattggagaaagagaaggtcaagaaatttctgcaagagttttatcaggatgacgagctgggaaagaagcagtttaagtacgggaaccagctggttaggcttgctcacagggagcaggttgccctttatgtagaccttgatgacgttgcagaggacgatcccgaactggtggacagcatttgtgagaatgctagacggtacgctaagctgttcgcagacgccgtgcaggaactcttaccgcaatacaaggagagggaggtggtgaataaggatgtgctggatgtgtatatagagcatcgcctaatgatggaacagcggagccgcgacccgggaatggtccggtcacctcaaaaccagtatcccgcagaattgatgcgtcgctttgagctctattttcagggacctagctcgaacaaacctagggtgattcgggaggtgcgggcagacagtgttgggaagctagtaactgttcggggaatcgtcacaagagtgtccgaagtgaaaccgaaaatggtagtggcaacctacacatgtgaccaatgtggcgctgaaacctaccagccaatccagtcccccacctttatgcctcttatcatgtgccctagccaggagtgccagaccaataggagcggcggacggttgtatctccagacacgaggctcccgatttataaagtttcaggagatgaagatgcaagagcactccgaccaagtacccgtaggtaatatcccaagatcaatcaccgtattggtcgaaggcgaaaacactagaatcgcccagccgggagatcacgtgtccgtgacaggcattttcctccctatcctgcgtactgggttcaggcaagtggtgcagggactgctgtcagagacctacctcgaagcgcaccgtattgtgaagatgaacaaatccgaagacgacgagagtggggcaggtgaactgaccagagaagagcttaggcagattgcggacgttatcttcgctactgtgcgcgagctggttagtggtggccgtagcgttcgattctccgaagcggagcagcgctgcgtgagtcgcggttttacacccgctcagtttcaggctgccctggacgagtatgaggaactcaatgtgtggcaagtgaatgcatccaggacacgtattacctttgtatag

SEQ ID NO: 230619 - DNA, 1632 bp, Artificial Sequence
  Description of Artificial Sequence: Synthetic coding sequence
atggtagtggcgacgtacacctgtgatcagtgtggagctgaaacctaccagcctatccagagcccaaccttcatgcctctcatcatgtgcccctcccaggagtgtcaaacaaacagaagcggtgggcgactgtatctccagactcgcggatcccggttcatcaaatttcaagagatgaaaatgcaggagcattcagatcaagttcccgtcggaaatataccaaggagcatcacagtccttgtggagggcgagaacaccagaattgcacaaccaggggatcatgtgtcagttacagggattttcctgcctatactgcggaccgggtttcgtcaggtcgttcagggcctgcttagtgaaacctacctcgaggcacaccggattgtgaagatgaacaagtccgaggacgacgagagtggagcgggagagctcactcgagaagaattgaggcagatcgcagaggaggacttttatgagaagctcgccgcatcaattgcacctgaaatatatggtcatgaggatgtaaagaaggccttgttactgctgttggtgggtggagtcgaccaatctccacgagggatgaagatccggggtaacatcaacatctgtctcatgggggaccctggagtcgccaagtcccaattgctgtcgtatatagatagactggcgcctcggtcacagtataccacggggagaggatctagcggtgttgggctgactgctgctgtgctgagagattctgtctccggtgagttgacactagaaggcggagcactggttctcgccgatcagggcgtctgctgtattgatgaattcgataagatggcagaggcagatcgtactgccattcatgaggttatggaacagcagacgatctccatagcgaaggcagggattctgacaacactgaacgctcgctgctcaattctggccgcagcaaaccctgcgtacgggcgttacaaccccaggagatcattagaacagaacattcagctgccggctgcgctcttgtccagattcgatctgctgtggctcattcaagacaggcccgaccgggacaacgacctacggctggcccagcacattacctacgtccaccagcacagtaggcagccaccctcccagttcgagcctctggacatgaagctaatgcgacggtacatcgcaatgtgcagggagaaacagccgatggtccccgagagcttggcggactacattaccgcggcttacgtggaaatgagaagagaggcttgggcctctaaggatgctacatatacctcggctcggactttactggccatcttaagattgagcaccgctctggccagactgcgcatggtggatgtagtggagaaagaggatgtgaacgaagctattagactcatggagatgtctaaggactccctcctgggggacaagggccaaaccgccaggactcaacggccagccgatgtaatctttgcgaccgttcgcgagcttgtgtctggaggcagaagcgttagattttcagaagccgagcaacgctgcgtctctaggggctttacaccggctcagtttcaagcggctctcgacgagtacgaggagctcaacgtgtggcaagtcaatgcttcaagaactcgtatcaccttcgtgtag

SEQ ID NO: 230620 - DNA, 1839 bp, Artificial Sequence
  Description of Artificial Sequence: Synthetic coding sequence
atgatggagcagcgatccagggatccagggatggtgcgctcccctcagaatcagtatcctgccgagctgatgaggcgtttcgagctttacttccagggcccttcctcaaacaagcctcgcgttatacgtgaagtgagggccgattcggtgggcaaactcgtgaccgtaagagggatcgtgactagggtctccgaggttaaacccaaaatggtggtggccacatatacatgcgatcagtgtggcgctgaaacataccagcccatccagtcacccaccttcatgccactgattatgtgcccctcccaagagtgccagacgaaccgttccggtggaagactttacctgcagaccaggggcagcaggttcatcaaattccaggagatgaagatgcaagagcattcagaccaggtgccggtgggaaatattcctagatccattaccgtgctcgttgagggagagaacacacgcattgcccagccaggggaccacgtatctgtgacaggcatctttctaccaatactgaggactggttttcgtcaagtggtgcagggtttgctcagcgaaacctacctggaggcgcacaggatcgtgaaaatgaacaagagtgaggacgacgagtctggcgctggggagctaacccgggaggagctgcggcagattgctgaagaggacttctacgaaaaactggcggcatcaatcgcacccgagatttacggtcatgaggacgtgaaaaaagccctgttactcctgctggtaggcggagtggatcagtccccacgaggtatgaagatccggggaaatatcaatatttgcctcatgggagacccaggagtggcgaaatctcagttattgagttatatcgatagattagcgccaagatcccagtacactacaggaagaggctcttcaggagtcggtctaaccgccgctgtgctccgcgatagcgttagcggcgaactaaccttggagggcggtgctctcgtgttggctgaccaaggagtgtgctgtatcgatgagtttgataaaatggcagaagcagaccgcacagccattcacgaggttatggagcaacagacaatctccatagctaaggcgggtatcctcaccactctgaacgctcggtgttccatcctggccgcagcaaaccccgcttacggcagatacaacccacgcaggtcgctcgagcagaatatccaactcccagctgcactcctttcccgctttgatctcctatggctgatacaggacaggcctgacagggataacgatctacgtcttgcccagcatataacgtacgttcaccagcactctcggcagcctccctctcagtttgagcccctggacatgaaactgatgcgcaggtacattgcaatgtgccgcgagaaacagccaatggtgcctgaatctctagcagattacattactgccgcttacgttgagatgagacgcgaggcatgggcaagtaaagatgccacctacactagcgctaggaccctgctagccatcctgagactctcaaccgccttggccaggctgcgaatggttgatgtcgtggaaaaagaagatgtgaatgaggctatccgcctgatggagatgtcaaaagatagtctcctgggcgataagggccagactgcccgaacacaacgcccagccgacgtgatctttgctactgttagggaattggtgtccggcggacggtccgtcagattctcagaggccgagcagagatgtgtgtcacgaggatttacccctgcccagtttcaggcagccctggacgaatacgaggagctcaacgtttggcaggtgaacgcctctcgcacaaggataacctttgtgtag

SEQ ID NO: 230621 - DNA, 1971 bp, Artificial Sequence
  Description of Artificial Sequence: Synthetic coding sequence
atgacacctagttggtggacgcagtttgtccggatgcccggagctacaaggagttcccttctgatgccatactataaggaacgagaggtcgtgaacaaggacgtccttgacgtttacatagagcacaggcttatgatggagcaaaggagcagagatcctggaatggtaagatcacctcagaatcagtaccctgccgagctgatgcggagatttgagttgtactttcagggtccatcctccaataaaccacgggtgatccgggaggtccgagcggatagcgtgggtaaattagttacagtgcgcggaatcgtgacccgagtgagtgaagtcaagccgaagatggtggttgctacgtacacttgtgatcaatgcggggctgagacttaccagccaatccagtccccaacctttatgccactgatcatgtgccctagtcaggaatgccagaccaaccgatcgggtggccgtttatacctgcagacaaggggaagcagattcatcaaatttcaggaaatgaagatgcaggagcattctgaccaggtgcccgtgggcaatattccacgctctatcaccgtgctggttgagggtgagaacacccgcatcgcccaaccaggcgatcatgtctcggttactggaattttccttcccattctgaggacaggttttaggcaggtggtacaaggcctgctaagtgagacctacttggaggctcaccggatcgtcaaaatgaacaagtctgaagacgatgaatctggcgcaggagaacttaccagggaagaattacgtcagatcgccgaagaagatttttatgaaaagctggccgctagtatcgcccctgagatttatgggcacgaggacgtgaagaaggctctcctgctgctgctcgtggggggagtagatcaatctccccgagggatgaaaatcagaggcaacattaacatttgtctaatgggggaccccggagtggctaagagccaactgctgagctatatagatcgcttggctcctcgctcgcagtacaccacaggcagaggttcctccggtgtcgggcttacagctgccgtcctgagggacagcgtcagtggagaactcactctggagggaggggcactagtcctcgcagaccagggtgtctgctgcatcgacgaattcgacaagatggctgaggccgatcggactgcaatacacgaggtcatggaacagcagactatctccattgccaaggcaggaatactgaccactctgaacgctagatgctccatcttggcagccgcaaacccagcatatggcagatacaatcctaggcggagcctcgaacagaacatccagctgccggctgccctgctgtcacgattcgacttgctgtggcttattcaggaccgaccagacagggataatgatttacgactggcacaacacatcacctatgtacatcaacactcccgtcagcccccatcacagttcgaaccgttggacatgaaactgatgcgcaggtatatcgccatgtgcagagagaagcagcccatggtgccggagagcctggctgactatattaccgccgcttatgtggaaatgcgcagggaggcctgggcatccaaagatgccacgtacactagtgctcggacattactggctattctgcgcctcagtacagcactggccaggctgagaatggtagatgttgtggagaaggaggatgtcaatgaggccattcggctgatggaaatgagcaaggacagtttgttgggagacaaggggcaaactgcacgcacccagaggcccgctgacgtgattttcgccacggtgagagagctcgtgagcggaggaaggtccgttcggttctcagaggccgagcagaggtgtgtttctcgcggttttacaccagcccagtttcaagcagcattggatgaatatgaagagcttaacgtttggcaagtcaatgcgtcaaggacccgcattacattcgtttag

SEQ ID NO: 230622 - DNA, 2475 bp, Artificial Sequence
  Description of Artificial Sequence: Synthetic coding sequence
atgaacggcgaatatcggggacgcggtttcgggcgtggccgatttcagtcctggaaaagaggccgagggggtggcaactttagcggaaaatggcgcgagagagagcatcgaccagatctgagcaagacaaccggcaagcggacctccgaacagacacctcaatttctcctgtcaacaaagaccccccagtccatgcaatccactctggatcgctttatcccttacaaggggtggaagttatatttctccgaagtttatagtgactcgagcccccttattgagaaaatccaagcctttgaaaagttctttacaaggcacatcgatctgtacgacaaagatgaaattgagcgtaaaggctctattttggtcgacttcaaagagcttaccgaaggcggagaagtgaccaatctcatcccagatattgccacggaacttcgggatgcgcctgagaagaccctggcatgtatgggcctcgccattcatcaagtcctcacaaaggacttggaaagacatgcagcagagctccaggcccaggaaggtctctcaaacgacggcgagaccatggtcaacgtcccccatattcatgcccgagtttataattatgagcctctgacacaactgaagaacgtaagagcaaactattacggcaagtacattgcccttagaggcacagttgtgcgggtcagcaacatcaagccactctgtactaagatggcctttctgtgcgccgcttgcggggagatccagtcatttcccttacctgacgggaaatacagcctgcctacaaagtgccccgtgccagtgtgcagagggcgatccttcaccgccttgaggagctcaccgctgacagttaccatggactggcaatctatcaagatccaggagctgatgagtgatgatcagcgggaagctgggaggataccgagaacaatcgaatgcgaactggtacatgacctcgtggattcatgtgtgcccggtgatacagtgaccatcacaggcattgtgaaggtgtccaatgcagaagaagcgaactctatatccaattcgaagggccagaaaacgaagagttctgaggatggctgtaagcatggcatgctgatggaattttcactgaaggacctttatgcaattcaagaaattcaggctgaagaaaatctctttaaattaattgtcaacagtctctgcccagtgatatttggccatgaactcgtgaaggctggcctagcgctggccctctttggaggctcacagaagtatgcagatgataagaatcggatccccattagaggcgatccccatatcctggtcgtgggagacccaggactgggtaagagccagatgctgcaagccgcatgcaacgtggctcctcgaggggtgtatgtgtgtggtaatactaccacaacttccgggctaaccgtcaccctgtctaaggattcctctagtggcgacttcgccctcgaagcaggtgccctggtactgggagaccaggggatctgcggcatcgacgagttcgacaaaatgggtaatcagcatcaggctctgctggaagcaatggagcaacagagtatctctcttgccaaagccggagttgtgtgcagcctgccagccaggacgtcaatcatagcagctgccaacccagtgggtggccactacaataaggccaaaacggtatccgagaacttgaagatggggtccgccctgctgtccagatttgacctcgtgttcattctgctggacaccccaaatgaacaccatgatcatctgcttagcgaacatgtaattgctattagagctggcaagcagagaaccattagctccgctacagttgctaggatgaatagccaagactctaacacctccgtactggaagtggtcagcgagaagcccctcagcgagcgtctgaaggtggtgcctggcgagacgattgatcccatacctcaccagctgttgaggaagtacattggctatgcccgacagtatgtctatccacggttaagcaccgaggccgcacgtgtgttgcaggacttctacctggagctgagaaagcagagccagagactcaattcttctccaatcacgacgcggcaactggagagcctgattcggttaacagaagcgagggcgagactcgaactacgtgaagaggcgaccaaggaggatgcggaggacatcgtcgagatcatgaaatacagcatgctggggacttacagcgatgagtttggcaacctcgatttcgagcggagtcagcacggtagcgggatgagtaatcggtccacagcaaagaggtttatctccgctttaaataatgtcgcggagcgaacatacaacaatatcttccagtttcaccagctccggcagattgccaaagagttaaatattcaggtcgccgattttgagaacttcattggctccttgaatgaccaaggctaccttctcaagaaaggcccaaaggtctaccagctgcagacaatgtag

SEQ ID NO: 230623 - DNA, 2382 bp, Artificial Sequence
  Description of Artificial Sequence: Synthetic coding sequence
atgaacggcgagtaccggggacgtgggttcggaaggggcaggttccagtcatggaaacggggaaggggagggggaaacttctctggcaagtggcgggaaagggagcatagacccgacttgtccaagacaaccggtaagcgcaccagtgagcaaactcctcagttcctgctgagtaccaagactccacagtctatgcagtcaaccttagacagattcattccgtacaagggttggaaactctacttctcggaagtgtatagtgacagcagtcccctgattgaaaagatccaggcctttgaaaagttcttcacccggcacattgatctgtacgacaaggatgaaatagagcgcaaaggcagcatattggtcgattttaaagaattgactgaggggggtgaagtgacgaatctgatcccagatatcgcaacagagttgagagacgcccctgaaaagacactggcctgcatgggcctcgcaattcatcaagtgttaactaaagatcttgagcgtcacgcggctgagttgcaggctcaggagggcctttctaatgatggggagacgatggtgaacgtccctcacatacacgctagggtatacaactacgagcctctcacccagttgaaaaatgtgcgcgcaaattattacggaaagtacattgccctgcggggaaccgtagtacgggttagcaatataaaaccactatgtaccaagatggcattcctttgtgctgcctgtggagagatacagtctttccccttgccagacggaaagtactccctgcctactaaatgtccagtgccagtatgtagggggaggtctttcaccgcactgaggagctcaccgctcactgtgacaatggactggcagtctattaaaatccaggagctgatgtccgatgaccagcgtgaggcaggcagaataccacgaacgatcgagtgcgaactggtccacgatctggttgactcctgtgtgccaggcgacacggtgaccattacaggcatcgtgaaagtttccaatgcagaggaaggaagcagaaataagaacgacaagtgcatgtttctgctttacatcgaggcaaattcaatttccaattcgaagggccagaagacaaagtcgtcagaggacggatgcaaacacgggatgctaatggaattcagcttgaaggatctgtatgccatacaggaaatccaggccgaagagaaccttttcaaactaatcgtgaacagcctgtgcccagttatatttgggcatgaggccgcatgtaatgtcgccccacggggagtgtacgtgtgtgggaacaccacaacaacctctggcctgaccgtgaccctgtcgaaagacagctctagcggcgattttgccctggaggccggtgctctggtcctaggggatcaaggcatttgcggcattgatgagttcgacaaaatgggaaaccagcaccaggcactcctagaggctatggagcagcagtctatctccctagctaaggccggagtcgtatgcagtctgcctgctcggacttctattatcgccgcagcaaatccagtcggaggccattacaataaggcaaaaactgtgagcgaaaatctgaaaatggggtctgctttactgagtaggtttgatttagtctttatactgctggacacacccaatgagcaccatgaccaccttctgagtgagcacgttatcgccatccgcgcaggcaagcagcgcacaattagttcggccactgtggccagaatgaatagtcaggattcaaatacaagtgttttagaggtcgtctccgaaaagcccctgagcgagaggctcaaggtggttcctggtgaaaccattgatcccattccccatcagctgctgcggaaatatatcggctatgccaggcagtacgtgtaccccagactttccacggaggcggcacgcgtgctccaggatttttatttagaactccgtaaacagagccagcggcttaactcttcacctatcacgacgcgtcaactggagagcctgattaggctgaccgaggctcgggctagactagagctccgagaggaagcaacaaaggaagatgctgaagacatcgtcgaaattatgaaatacagtatgcttggcacatatagcgatgagttcggcaacctcgacttcgaaagatcacagcatggttcaggtatgtccaatagatccaccgccaagcgctttatatcggctctaaacaatgtagctgagcgcacctacaataatatctttcagtttcaccagttgcgccaaatagccaaggaactgaatattcaggtggctgactttgaaaattttattggcagtttaaatgatcagggatacctacttaaaaagggtccgaaggtgtaccagctgcagactatgtag

SEQ ID NO: 230624 - DNA, 2643 bp, Artificial Sequence
  Description of Artificial Sequence: Synthetic coding sequence
atgaacggtgaatataggggacgtgggtttggcagaggacggttccaatcctggaagcggggtcggggaggaggaaatttcagcggaaagtggagggagcgggagcaccggccagatctgtcaaagaccactggcaaaaggacctcggaacagacgccccagttcctgctgtccaccaagactcctcaaagcatgcagtcaactctcgaccgctttattccatacaagggttggaagctgtacttcagtgaggtgtattctgattcaagcccactcatcgagaaaattcaggccttcgaaaaattcttcacgcggcacatcgacctatacgacaaagatgagattgagcgaaaggggagtatcctggtggattttaaagagctgaccgaaggcggagaggtgacaaacctgattccagacattgctacggagctgcgcgatgctccagaaaagacgctggcttgcatgggcctggctattcaccaggttctgacaaaggacctagagaggcacgccgcagagcttcaggcccaggagggcttgtccaatgacggcgagactatggttaatgtaccccacatccacgccagggtgtacaattatgagcccctgacccagctcaagaatgtgagggctaattattatggaaaatatatcgcacttcggggtaccgtggtgagggtgtctaacatcaagcccctgtgtacaaaaatggcctttctgtgtgccgcatgcggcgagatccagtcctttcctctgcccgacggtaaatattccttaccgaccaagtgccctgtccctgtgtgccggggaaggtcttttacagctctccgctcaagccccttaacggtcaccatggactggcagtcaattaaaatacaagagttaatgtccgatgaccagagggaggccggtcgcatacccagaacaatcgagtgtgagctcgtgcacgacctcgtggactcctgtgtgcctggagatacagtgactattacagggatcgtgaaggtttcaaacgccgaggagggaagcaggaataaaaacgacaaatgcatgttcctgctctacattgaggccaactctatctcgaactcaaaaggccagaagactaaatcttcagaagatgggtgcaagcatgggatgcttatggaatttagtctcaaagatctctacgccatccaggagattcaagctgaggagaacctcttcaagttgatcgtcaaatggtcacttgccctttcccctcggctcgagtattcaggggctatatccgcccattgtaacctgcacctgccatcgtcaaactcctcgcccaccagcgcctgccgcgtcgccggtactactggcatgcgccatcaaacccagctcttactgcttgtgaaagctggactcgcacttgccctttttggaggtagtcaaaaatacgctgacgacaagaaccgcattcctatccgaggggacccacatattctggtcgtgggcgatcccggactcggaaagagccaaatgctacaggccgcttgcaatgtcgccccaaggggcgtgtacgtatgcggaaatacaactaccaccagtggactcaccgttaccttgagcaaagatagcagctcaggcgatttcgccctggaggcaggagccctcgtgctgggtgaccagggaatttgcggaatagacgaatttgacaaaatgggaaaccagcaccaggcactgctcgaggcgatggaacagcagtcgatctctctggccaaggccggagtagtgtgttctttacccgctcgcactagcatcattgccgcagctaaccctgttggaggccattacaacaaggctaaaacggtgtcagaaaaccttaaaatgggctccgcacttttaagtcgcttcgacctggtgttcatcttgctggacactcccaacgagcatcacgaccacctcttgtctgagcacgtgatcgccatccgggcaggcaagcagagaacaattagctcagcaactgtggcaagaatgaactctcaggattctaacacatccgtgcttgaggttgtgtcagaaaagcccctgagcgaaagactcaaggtggtgcccggagagaccattgatccaattcctcaccagttgctacgaaagtatatagggtacgcccgacagtatgtttatcccaggctgtctaccgaggcagctcgcgtactccaggacttttaccttgaactgcggaaacaatcgcaacgcctgaactcatctcccattaccacccggcagctagaatcgctgataaggctgaccgaagccagggccaggcttgaattacgggaggaagcaacaaaggaagatgctgaggatattgtggaaattatgaagtacagtatgctggggacatactcagacgagttcggcaaccttgactttgagcgtagccaacacggatcagggatgtctaacaggtccacagcaaaacgctttatcagcgccctgaacaatgttgccgaacgtacctacaacaatatttttcaattccaccagctgcgccagatcgccaaggagctcaacattcaagttgcagactttgaaaacttcataggtagcctgaacgaccaaggttatctgctcaagaaaggcccaaaagtctaccagcttcaaaccatgtag

SEQ ID NO: 230625 - DNA, 2523 bp, Artificial Sequence
  Description of Artificial Sequence: Synthetic coding sequence
atgaacggagaatacagggggaggggttttggaaggggacgtttccagtcctggaagcgaggacggggaggcggtaatttctcaggcaaatggagagaaagggagcatcggccagatctcagcaagacaaccggaaagcgcacatcagaacagactccccagttccttctcagcactaaaactcctcaatccatgcagtctacacttgatagattcattccctacaaggggtggaagctgtactttagcgaagtgtatagtgacagcagccccctgatcgagaaaatacaagcgtttgagaaattttttacgcggcacatcgacctgtatgacaaagacgagattgaaaggaagggcagcattttggtagatttcaaagagctaacagaggggggagaagtcacgaatttgatccccgacatcgcaacagaactcagagacgcccctgagaaaaccttagcttgcatggggctggcaatccaccaggtcctgacaaaagacctagagcggcacgccgctgaactgcaggcccaggagggcctgtcaaatgacggggagaccatggtgaatgtgcctcacattcacgcacgagtgtacaattacgaaccgctcacgcagctgaagaacgttcgggctaactactacggcaagtatatagccctgcgcggaaccgtagtccgcgtctccaatataaaacccttatgcacgaagatggctttcctgtgcgcagcctgtggggaaatccagtcatttccactgcctgacgggaagtattccctaccaaccaagtgccccgttccagtgtgtaggggacgcagctttactgcgctgcgatcgtcacccctcaccgtaacaatggattggcaaagcattaagatccaagagctgatgtccgacgatcagcgtgaggccggaagaattccaaggaccatcgagtgtgagctggtccatgaccttgttgattcttgtgtgcccggtgacacagtgaccatcactgggattgtcaaagtatccaatgcagaggagggctcgcggaataaaaatgacaaatgtatgttcttgctgtacatcgaagcaaatagtataagcaactcgaaaggacaaaaaactaaatcctccgaggacgggtgtaaacatggaatgctcatggaattcagcctaaaagacctttacgcaatccaggaaatccaggccgaagaaaacttatttaaattaatagtgaactccttgtgccctgtgatatttgggcacgaattggtgaaagccggactcgccttagcactctttgggggatcacagaagtacgctgatgataaaaataggattcctatacggggagatcctcatatcctagttgttggggaccctgggctcggcaagtctcagatgctgcaggccgcttgcaacgtcgcgcctcgcggagtatacgtttgtggcaatacgaccaccacaagtggcctcacagttactctgtctaaggactcctcctcgggcgatttcgctctagaagcgggtgcactcgtgctgggcgaccagggcatctgcggcattgatgagttcgataagatgggcaatcagcaccaggccttgcttgaagctatggagcagcaaagtatctccctggccaaggcaggagtcgtctgttccctgcctgcgcgaacctctattattgctgccgcaaatcctgtagggggacactataacaaagccaaaacagtgtcagaaaatttaaagatgggctccgcgctgctgtctcggtttgatttagtcttcatcctcctagacactcctaacgaacatcatgatcatctgctctcagagcatgtaatcgccataagggcaggcaagcaaagaacaattagttcagccacagttgccagaatgaatagccaggattcgaatacatcagtgttggaggtggtgagtgagaagccactcagcgagagactcaaggtggtccccggagagactattgacccgatccctcaccagttattacgaaagtacatcggctatgcgcgacagtatgtctacccacgcctctccacagaagccgcacgagtgttacaggacttttatctcgagctgcggaagcaaagccaaaggttgaatagtagtcctatcaccactagacagctcgaatctctgatccggctgaccgaagcacgtgcccgactggaacttagagaggaggctaccaaagaggacgccgaggatatagtggagatcatgaaatattcgatgcttggcacatattccgacgagtttggcaatctagactttgaaaggtcccagcatggtagcggtatgagtaatcggtccacagcgaagcgattcatcagtgcacttaataacgtggctgagaggacctacaataatatcttccagttccatcaactcagacagatcgccaaagaactgaatatccaggtggcggatttcgaaaatttcataggctcccttaatgatcagggatacctgctgaagaagggccctaaagtatatcaattgcagactatgtag

SEQ ID NO: 230626 - DNA, 612 bp, Artificial Sequence
  Description of Artificial Sequence: Synthetic coding sequence
atgaatggggaataccgcggacggggattcggcagagggaggtttcagtcttggaaacgaggacggggaggtgggaatttctcaggtaagtggagagaaagggaacatcggcctgatctgagtaaaaccaccggtaaaagaacgtctgagcagaccccacagtttctcttaagtactaaaaccccacagtctatgcagtcaaccctcgaccggtttattccctataagggctggaaattgtacttttcggaggtgtactcagatagtagcccgttaattgaaaagatacaggcattcgagaaattcttcactaggcatatcgatctctatgataaggatgaaatcgaacgtaaggggagcattctcgttgacttcaaagagcttactgagggcggagaggttacaaatttgattcctgatatcgccaccgagctgcgagatgcgcctgaaaagactctggcctgtatgggactggctattcaccaggttctcacaaaggacctggaacgtcacgcggctgaacttcaggctcaggagggactgtccaatgatggcgagacaatggtcaacgtgcctcatatacatttcttgaagaagaagaagaagatctag

SEQ ID NO: 230627 - DNA, 1329 bp, Artificial Sequence
  Description of Artificial Sequence: Synthetic coding sequence
atggagaattggtccaaggacattacgcattcttatctggaacaggaaactacgggcattaacaagtctactcaacctgatgagcagctcactatgaactcagagaagtccatgcatcgcaagagtacagaactggtcaacgagatcacatgcgaaaacaccgagtggcccggacagcggtctactaatttccagattatctccagttaccctgatgatgagtccgtgtattgtaccacagaaaagtacaatgtgatggaacaccggcacaacgacatgcactatgagtgcatgaccccctgtcaagtgaccagtgactctgataaggagaaaacaattgcgtttctcctgaaggagttggatatcctccggacctccaacaaaaagctgcagcaaaaactggctaaagaggataaagagcagcgaaagctgaaattcaagttggaactgcaagaaaaagagacggaggctaagattgccgagaagaccgccgctctcgtcgaggaggtgtactttgcccagaaggaaagagatgaggccgtgatgtctcgcctccagctggcgatcgaggagagggatgaagcaattgcaagggcgaagcatatggagatgagcctgaaagtactggagaacattaatcctgaagagaacgatatgaccttacaggaactgctaaatcgcatcaacaatgcagacacaggaatagcgatccaaaagaacggagcaatcatagtcgacagaatctataagacaaaagaatgcaaaatgcgtattaccgccgaggagatgtcggcgttgatcgaagagcgcgatgccgcattgtccaagtgtaaaagattggagcaggagctgcaccacgtgaaggagcagaatcagacatcagccaataacatgaggcacttaaccgcagagaataatcaagaacgtgctctaaaggctaagctcctgagtatgcagcaggccagagaaaccgcagtgcagcagtataaaaagctggaggaagagatccagacccttagggtgtattactcgctccataaatcactttcgcaagaggagaacttgaaggaccaatttaattacacactctctacctacgaagaagctctgaaaaaccgggaaaatatcgtgtccattacacagcaacagaacgaagaactggcgacccagctgcagcaggccctcacagaacgcgctaacatggaacttcaactccagcacgcacgagaagccagtcaggtcgccaatgagaaagtccaaaagctggagcggctggtcgacgtactacggaagaaagtcgggacaggcactatgagaaccgtgatctag

SEQ ID NO: 230628 - DNA, 1329 bp, Artificial Sequence
  Description of Artificial Sequence: Synthetic coding sequence
atggagaactggagtaaggatattacacatagctatctggagcaggagacaaccggcatcaataagagtacacagccggacgaacagctgactatgaatagcgaaaaaagcatgcataggaaatctacggaattagtaaatgaaataacatgtgagaatactgagtggccgggtcaacggtccaccaatttccagatcatctcatcctaccccgacgacgaatcggtttactgtacaactgaaaaatacaacgtaatggaacaccgccataatgatatgcactatgagtgcatgacgccatgtcaggtaacaagcgattccgacaaagagaagaccattgcattcctgcttaaagagcttgacatacttcggacatcgaacaaaaagctgcagcagaagttagccaaggaggataaagagcagagaaagctgaagttcaaactagaactgcaggaaaaggaaaccgaagcaaagatcgcggaaaagaccgctgctctggtggaggaggtgtatttcgctcagaaggagcgggatgaagcggtcatgagccgtctgcagcttgcaattgaagagcgcgacgaagccatagccagggccaagcatatggaaatgagcctgaaggtgctggaaaatattaaccccgaagagaacgacatgacactgcaggaactgcttaatcgaatcaacaatgcagataccggcattgccatccagaagaatggggctattatcgtcgaccgcatttacaagacaaaggagtgtaaaatgcggatcacagcagaggaaatgtctgcgctgatcgaagaaagagacgctgcattgtctaaatgcaaacgactggaacaggaactccaccatgtgaaggagcagaaccagaccagtgctaataacatgaggcatcttactgctgagaacaaccaggagagggcactgaaagccaagctgctgtctatgcagcaagctagggaaacagctgttcagcagtataagaaactcgaggaggagattcagactctccgtgtgtattatagtctccacaaaagcctgtctcaggaggaaaacctgaaggatcagttcaactacacactgtccacatacgaggaagcgctgaagaacagagaaaacattgtgagcattacccaacagcagaatgaggaactcgcgactcaactgcagcaggctcttactgagagagcaaacatggaattacaactgcaacacgctagagaggcttcccaagtggcaaatgaaaaggtgcagaagctggaacggctagttgatgtgctgagaaagaaggtgggcaccgggaccatgcgaaccgtaatttag

SEQ ID NO: 230629 - DNA, 786 bp, Artificial Sequence
  Description of Artificial Sequence: Synthetic coding sequence
atgagcagactgcagctcgccattgaggagcgggatgaggccatcgccagggccaaacacatggagatgagtctgaaggtcttggaaaatattaatcccgaagagaacgacatgactcttcaggaacttttgaacaggatcaacaacgccgataccggaatcgcaatccagaaaaacggcgctatcatcgtggaccgcatttacaaaacaaaggaatgcaagatgcgcatcaccgcagaagaaatgtctgcccttatcgaagagcgggacgccgcattgtctaaatgtaaaaggctcgaacaggaattacaccatgtcaaggaacaaaaccagacgtccgctaataacatgcggcaccttacagctgagaataaccaggagagggccctaaaggcaaagctcctatctatgcagcaggccagggagacagccgtccagcagtataaaaaactggaagaagaaattcagactctacgagtgtattactccctgcacaaaagtctgtctcaggaggagaacctcaaggatcaattcaattacaccctaagtacctatgaagaggctctcaagaatcgcgaaaatatcgtatctattacacagcagcaaaacgaggagctcgcgacccagcttcagcaggccttgacagagcgcgcaaatatggaactgcagttgcagcacgcacgggaagctagtcaggtagcaaatgaaaaggtccagaagttggagcgactggttgacgtgctcagaaagaaagtcggcacaggcacgatgcgaaccgtcatttag

SEQ ID NO: 230630 - DNA, 1329 bp, Artificial Sequence
  Description of Artificial Sequence: Synthetic coding sequence
atggagaattggagtaaagacatcacccactcctacctcgagcaggagactaccggaataaacaaaagcacgcagccagatgaacagctcacaatgaattctgagaagagcatgcatcgcaagtccacagagctggttaacgagataacttgcgagaatactgaatggcccggacaaaggagtaccaattttcagatcatctcttcctaccccgacgatgaaagcgtctactgtactactgaaaagtacaatgtgatggagcatcggcataacgatatgcattacgagtgcatgactccctgccaggtcacctctgactcagataaagagaagacgatcgctttccttttgaaagagctcgatattcttcggacctccaataagaagcttcaacaaaagctggccaaggaagacaaggagcagaggaaactcaagtttaaattagagctgcaggaaaaagaaaccgaagccaagatcgccgaaaagactgcagccttggtggaggaagtgtatttcgcccagaaggagcgcgatgaggcagtgatgagcagacttcagcttgccatcgaggaacgggatgaggccattgcgagggctaagcacatggaaatgtcgctgaaagtgttggaaaacattaacccagaagagaacgacatgactctgcaggagctgctgaaccggattaacaatgctgacaccggaattgccatacagaagaacggggcaattattgttgacagaatttataagactaaggagtgtaagatgagaattaccgcagaggaaatgtctgccttgatagaggaaagggatgccgctttgtctaaatgtaaacggcttgaacaggagctgcaccacgtgaaagaacagaaccagacctccgcaaacaacatgaggcacctcactgccgaaaataatcaggagcgtgcactgaaggctaagttgttaagtatgcagcaagccagggagacagcggtgcagcagtataaaaagctcgaggaagagatccagacactccgcgtatactatagcctacacaagtctttaagccaagaagagaacctgaaggatcagtttaactatactctctcaacctacgaggaagctttgaaaaatagggagaatatagtttcaattacccagcagcagaatgaagagctggcaacacagctgcaacaggcgttaaccgaacgggctaatatggagttacaactgcagcacgccagagaggctagccaggtggccaatgagaaagtgcagaagctggaacgcctggtcgatgtgctgcggaagaaagtaggaacaggaactatgcgaactgtgatttag

SEQ ID NO: 230631 - DNA, 1275 bp, Artificial Sequence
  Description of Artificial Sequence: Synthetic coding sequence
atgaacagtgagaaatctatgcacagaaaatccacagagttggtgaatgagattacgtgcgagaacaccgaatggccagggcagaggtctaccaacttccagatcatctcctcatatcccgatgacgaatccgtttactgcaccacagagaagtataatgtcatggagcatagacacaacgacatgcattatgaatgtatgaccccatgccaggtaaccagtgacagtgacaaggagaagaccattgctttcctcctgaaggagctcgatatcctgcgaacctccaataaaaaactccaacagaagctggccaaggaagacaaagagcagaggaaactgaaattcaagttggaattgcaggaaaaagaaaccgaagccaaaatcgccgagaagacggccgcactggtggaagaagtctacttcgctcagaaggaacgggatgaagctgtgatgtcacggctccagcttgctatagaggagcgggatgaggccatcgccagagcgaaacatatggaaatgtcactgaaagtgttagagaacatcaatcccgaggagaacgatatgaccctacaggaattgcttaatcggattaataatgcagataccggcattgccatacaaaaaaacggggctattatcgttgataggatctacaaaaccaaggagtgcaagatgcgtatcaccgcggaagaaatgtctgcgcttatcgaggaacgggatgctgccctctcgaagtgtaagagattggagcaagagctccaccacgtcaaggaacagaatcagacctcggcaaacaacatgcgccacctcacagccgagaataaccaggagagagccttgaaagctaagttgcttagcatgcagcaagccagggagacagccgtccagcaatataagaaacttgaagaggagatacagacattgagagtgtactattcgctgcacaaatccctgtctcaggaagagaacttaaaggatcagtttaattatactttaagcacatacgaagaagcgctgaagaaccgggaaaacattgtgtctataactcagcaacagaacgaagagctggccacacagctgcagcaggccctgaccgagagggcaaatatggagctgcaacttcagcatgcacgcgaagcttctcaggtggccaatgaaaaagtgcaaaaatctcagattcagatttattttatccccaataaaaaggatgagcgagagaagtttctgatggacaaaaggcgcaaaattgtggctcactcaaagcagaacagttag

SEQ ID NO: 230632 - DNA, 315 bp, Artificial Sequence
  Description of Artificial Sequence: Synthetic coding sequence
atggagaattggtcaaaagatattacccacagttatctggaacaagagactactggaataaataaatcaactcagcctgacgaacagttgaccatgaattcagaaaaatctatgcatcgaaagtccactgagctggtgaacgagataacgtgcgaaaatactgagtggcccggacagcgatcaaccaatttccaaatcatatccagctaccccgatgacgagagcgtctattgcaccaccgagaaatataatgtgatggagcaccgccacaatgacatgcattacgagtgcatgacaccatgccaagtcacatag

SEQ ID NO: 230633 - DNA, 387 bp, Artificial Sequence
  Description of Artificial Sequence: Synthetic coding sequence
atggaaaactggtccaaagatatcacacactcttatctagagcaggagactactgggataaacaagagcacacaaccagatgagcagctgacaatgaactccgaaaagtcaatgcataggaaatccaccgaactggtgaatgaaattacatgcgagaacactgaatggccaggacaaagaagtaccaatttccagattatttccagctaccccgacgacgaaagcgtttattgcactactgagaaatacaatgtgatggaacatcgacacaatgacatgcattacgagtgcatgacgccctgtcaggtgacttctgactctgacaaggaaaaaactatcgccttcttactgaaagagctggacatactcagaacatccaataaatag

SEQ ID NO: 230634 - DNA, 3912 bp, Artificial Sequence
  Description of Artificial Sequence: Synthetic coding sequence
atgggcgatcctgcacctgctcgtagtttagacgatatcgatctgagtgccctgagggatccggctggtattttcgaacttgttgaggtggttggcaacggcacatacgggcaagtttataaaggcaggcatgtgaagacgggccagctcgccgcaattaaggtgatggacgtgactgaagacgaagaagaggaaattaagcaggaaatcaatatgttgaaaaagtatagccatcaccggaatatcgcaacctactatggagcctttatcaaaaaatccccaccaggaaatgatgaccagctgtggctagtgatggagttttgcggggctggaagcgtgaccgatttagtcaagaacacaaaaggaaacgcactgaaagaagactgcatcgcttacatttgtcgcgaaattttgaggggcttggcccatctccacgcacataaggtcatacacagggacattaagggtcagaatgtgctgctcaccgagaatgcggaggtgaagctagttgattttggggtttcagcacagctggatagaaccgtgggcaggcgcaatacatttataggcaccccttattggatggctccggaggttattgcttgcgacgaaaatcccgatgccacatatgactatcggtctgacatttggtccctcggtatcacagcaatcgagatggccgagggtgcccctcctctgtgcgacatgcaccctatgcgagcactgttcctgatcccacggaacccgccaccaaggctaaagtccaaaaaatggtccaaaaagttcattgactttatagacacctgcctgattaagacttacttgtcccgcccacccactgagcagctgctgaagtttccctttattcgcgaccagccaaccgaacgccaggtgcggatccagctcaaggatcatatcgaccgcagtcggaagaaacgtggtgagaaggaggaaactgagtatgagtactccggatccgaagaagaagatgattcacacggagaggaaggcgaaccgtcttccatcatgaacgttcctggggagagcaccctaagacgcgaattcctgcggttacagcaggaaaacaaatctaactccgaagcactcaagcagcagcaacagctacagcagcaacaacagagagatccggaggctcatatcaaacatttgttgcaccagcgccagcgcaggattgaagagcagaaagaggaacgtcggagggtagaagagcagcagcgcagagaaagagaacaacggaagcttcaggaaaaggagcagcagaggaggctggaggacatgcaggctctgcggcgtgaagaggagaggagacaggcggagcgtgaacaggaatacaagcgcaagcagttggaagaacagaggcagtcggagaggctgcagcgacagctgcaacaagagcacgcctacctcaagtcgctgcaacagcagcagcagcagcaacagttgcagaaacagcagcagcaacagctattgcctggtgataggaagcctttgtatcattacggaagaggaatgaatcccgctgacaaaccagcatgggctagggaggtagaggagagaacaaggatgaataaacaacagaattctccacttgctaaatcaaaacctgggtcgacaggtcccgaaccgcctatcccccaagcatccccaggccctcccggaccactaagccagactccccctatgcagcgcccagtcgagccacaggaaggcccacacaaaagtcttgtggcccatcgtgtacctctgaagccgtatgctgccccagttccacgtagccagtccctgcaggaccagcctacccgcaacctcgcggcatttccagcctcacacgaccctgaccccgctatccccgctccaactgcaacaccctctgcccgtggcgcagtgatcaggcagaatagcgatccaacatcagaagggccaggcccttctcctaatcctccagcctgggtgcgacctgacaacgaggcccctcctaaggtgccgcagcgcacttccagcatcgcaacagccctgaatacgagtggcgcaggagggagtaggccagcacaggctgttagagctagcaaccctgatctaagacggagcgacccaggctgggaacggtcagattccgttctccccgcttcacatgggcatttaccccaggccggatcgctcgagaggaaccgcgtcggagtttcatctaaacccgactccagtcctgtgctttctccgggaaacaaggctaaaccagatgaccatagatctcgacccggacgccctgccagctataaacgggcaattggtgaggattttgtgttgctcaaggagagaacactggatgaggcaccacgacctcctaagaaggctatggattacagttcaagctccgaagaggtggagtcctcagaagatgacgaagaggagggcgagggaggacctgcagaaggatcccgcgacacaccgggaggcagatcagatggcgacaccgactcagtgtccacgatggtggttcatgacgtcgaagaaataacagggacacagcccccttacggtgggggtacaatggtagtgcagaggaccccagaggaagaaagaaatctgcttcatgctgatagcaatggctacaccaatctccctgacgtggtccaaccaagtcactcccccacagagaacagcaagggtcaaagccctccttccaaagatggaagcggcgattatcaatcgagaggactggtaaaggctcctgggaagagcagttttacaatgttcgtggacctaggcatctaccagcccggtggatctggcgattctatccctattacagccctcgtgggtggggagggcacccgtttagaccaattgcaatacgacgtgaggaaaggaagtgtagttaacgtcaatccaacaaacacccgggcacatagtgagaccccagaaattcgcaaatacaagaagcggtttaacagtgaaattttgtgtgcggcactttggggagtcaacctgctagtcggaactgagaatgggctgatgttactcgaccgctctgggcaggggaaggtttatggcctgatcggtaggcgaaggtttcagcaaatggatgtgctcgaagggttgaacctactgattaccatctctggtaaaaggaacaaactgcgggtctactacttgtcctggctgcgaaataagatactgcataacgatccagaagtcgaaaaaaagcaagggtggaccaccgtgggggacatggaaggatgtggacattatcgcgtcgtaaagtacgagagaattaaattcttggttatcgcactgaagagttccgtggaagtatacgcctgggctccaaaaccataccacaaatttatggcgttcaagtcatttgcggacttgcctcaccggccattacttgttgatttaacagtggaggagggacagcgcctgaaagtcatctacggctccagcgcgggtttccacgccgttgacgtcgactcaggcaattcttatgacatctacatacctgtgcacattcagagtcagatcacacctcacgccatcatctttctccccaacactgacgggatggagatgttgctctgctacgaggacgaaggcgtctatgtgaatacgtatggccgtattattaaggatgtggtgctccagtggggcgaaatgccgactagcgttgcgtacatctgttccaaccagatcatgggatggggagagaaggcgatcgaaattcggagtgtcgaaactggccaccttgatggtgtcttcatgcacaaaagagcccagcggctcaaattcctgtgtgagcgtaatgacaaagtcttctttgcctcggtacgaagcggagggtcttcacaggtttacttcatgacattgaaccgcaattgcattatgaactggtag

SEQ ID NO: 230635 - DNA, 3999 bp, Artificial Sequence
  Description of Artificial Sequence: Synthetic coding sequence
atgggcgacccggctcccgctcgctcactggacgatatcgacttgagtgcactacgcgatcccgctggaatctttgagctggtggaggtggtggggaacggaacatacggccaggtctacaaaggacgacacgtgaagacggggcagcttgccgctataaaggtgatggatgtgacagaggacgaggaggaagagatcaaacaagaaatcaatatgcttaaaaaatatagccatcaccgaaacattgccacatattacggggcatttatcaagaaaagccctccaggcaatgacgaccaactctggctcgtgatggaattttgtggtgcgggtagcgtcaccgacctggtgaaaaacactaaaggaaacgctctgaaagaggactgcattgcatatatttgtcgcgagatcctgcggggtctcgcacatttgcatgcccacaaagtcatccatagggacattaagggccagaatgtcctattgacagagaatgccgaagtaaagcttgtcgatttcggcgtttccgcacagctggacaggacagttggtcggagaaacacttttatcggaacaccttattggatggctcccgaggtgatcgcatgtgatgaaaacccagatgcgacctatgactaccggtctgacatctggtcactgggaatcaccgctatcgagatggctgagggtgccccacctctctgcgatatgcatccaatgagggctctgtttctcatacctcgcaatcccccacctcggctgaagagcaagaaatggagtaaaaagtttatcgacttcatcgacacctgtctgataaaaacttacttgtctcggccacctactgagcagctcctgaaattcccctttatccgggaccaacctactgaacgtcaggttaggatccagctgaaagaccacattgaccgctcacggaagaaacggggagaaaaagaggagaccgagtacgaatacagcgggagtgaagaggaagatgattcgcatggcgaggagggggaaccttcctctatcatgaatgtccctggcgagagtaccctgcggagagaatttctccggctccagcaggagaacaaatccaacagcgaagcactgaagcagcagcagcaacttcagcagcagcaacagcgggaccctgaggcgcacatcaaacacttgcttcatcagcggcaacgacggatcgaggagcagaaagaggagcggcgaagagtcgaagagcaacagagacgcgagagggagcagagaaagctgcaggagaaggagcagcagcggagattggaagacatgcaagcactgcggagagaggaagagaggagacaggcagaacgggagcaggagtacaagaggaagcagctagaggaacagcgccagtcggaacgcctccagaggcagctccagcaggagcacgcctacctgaaatcactgcaacaacagcaacagcagcagcagctgcagaagcagcagcagcaacagttgctacctggcgaccgcaaaccgctttaccactatggccgaggaatgaatccggcagataagccagcctgggcaagggaggtggaggagcgcaccaggatgaataagcagcagaattctcccttggctaagtctaagcccggttcgaccggcccagagccccctattccccaggcgagtcccggaccacccggacctctatctcagacaccaccgatgcagagaccagtcgagccccaagagggaccacacaagtctctggttgcccaccgcgttccattaaaaccctatgcagccccagtgccccgatctcaatctctccaagaccagccgactagaaatcttgccgcattcccagcctcccacgatcctgatcccgctatcccagcacccaccgcaactccgtctgctaggggagctgtgatcagacagaattcggaccctacaagcgagggtccgggtccaagtcccaatccaccggcttgggttagaccagacaatgaggctccaccgaaggttccccaacggacctcctctattgcaaccgccttaaacacctccggcgcaggaggctcccgacctgcccaggccgtgcgggcaagacctaggagtaacagtgcatggcagatctatctgcagcgccgagctgagcggggtaccccaaagcctcccggtcctccagctcagcccccaggacccccaaatgcatcctctaaccccgatctgagacgctcagaccctggctgggagagatccgactctgtgctgcccgcttcccatggacatttacctcaggccggtagcctggaaagaaatcgggtaggcgtgtcatctaaacctgactcatccccagtgctatcacctggcaacaaagcaaagcccgatgatcacagatcacggcctggaagacccgcagacttcgtcctgctaaaggagagaacactcgacgaggctcccagacccccaaaaaaagccatggactattcctccagcagtgaagaggtagagagcagtgaagatgatgaagaagagggggagggtggtcctgctgagggcagccgcgacaccccagggggaagatcagacggcgacactgacagtgtgtcgaccatggtggtacatgacgtggaggagataacaggcacacaaccaccctatggaggcggaactatggtggttcaacgcaccccggaggaagaacggaacttactccacgcagattctaacggctacaccaaccttcccgacgtcgtgcagccaagtcactcacctactgagaacagtaagggtcagtctcctcccagtaaagatggaagcggcgactatcaatctcggggtttggtaaaggcacctgggaagtccagcttcaccatgtttgtcgacctaggaatttatcagcctggaggctctggcgactccatccctatcacagccctggtgggtggtgaaggcaccagactcgaccagctgcaatacgacgttcggaagggcagcgtcgtcaacgtgaaccctactaatacacgcgcacatagcgaaacgcctgaaataagaaaatataagaaacggtttaactctgagatcctgtgtgcagccttatggggagtgaaccttctcgtcggaacggagaacggcttgatgctactggaccggtctggtcaaggaaaagtgtacggcctgattgggagaagacggtttcagcagatggatgtccttgagggactaaatcttctgattactattagtggaaagcggaataagctgcgggtgtactatctcagttggcttagaaataaaatcctacacaatgaccccgaggtagaaaagaagcagggctggactacagtcggcgatatggagggatgcgggcattacagggtggtcaaatatgagcggattaagttcctcgtcatcgctctcaaatctagcgtggaagtgtatgcctgggctcccaagccttatcataaatttatggcctttaaaagtttcgccgatcttcctcatagacctttactggtcgatctgaccgtggaagagggtcaacggctcaaagtgatttacggctcatctgccggatttcatgccgttgatgtagactctgggaactcttatgatatatatattcctgtgcatattcagagtcagatcacaccacacgccattatcttcctgcctaacacagatggaatggaaatgctgttatgctatgaagatgagggtgtctacgtgaacacctacggaagaatcataaaggatgtggtcctgcagtggggagaaatgcccactagcgtggcctacatctgctctaaccagattatgggatggggtgagaaggctatcgaaatccgcagcgtggaaacgggacacctagatggggtctttatgcacaaacgtgctcagaggttaaaattcctctgcgagagaaacgacaaggtcttttttgcctccgtcaggtccggagggtcttcccaggtttattttatgacactgaaccgaaactgtattatgaactggtag

SEQ ID NO: 230636 - DNA, 3939 bp, Artificial Sequence
  Description of Artificial Sequence: Synthetic coding sequence
atgggggatcccgctcctgccagatcactggatgacattgatctctctgccctgagggatcccgcagggatctttgagctagttgaagttgtgggaaatggcacgtacggacaggtatataaaggcaggcacgtgaagaccggccagttggccgcaatcaaggtgatggacgtaacggaggatgaagaggaggaaatcaagcaggaaatcaacatgctcaaaaagtacagccaccacagaaacattgccacctactatggcgctttcatcaagaagtccccaccgggaaacgacgaccagctgtggctggttatggaattttgtggggctgggtctgttacagatctcgtcaaaaacaccaaaggcaacgccttaaaggaagactgcatcgcctacatatgccgagagatcttgagaggactggcccatctgcatgcacacaaggtgatccatcgcgacatcaagggccagaatgttctactaaccgaaaacgctgaagtgaagctggtcgattttggggtaagtgcccagctcgatcgcacggtcggtcgtcgcaacaccttcataggcacaccttactggatggcacccgaggtcatcgcctgtgatgagaaccccgatgccacctacgattatcggtctgatatctggagtctaggaatcactgccattgaaatggccgaaggagcacctcctctatgcgatatgcacccaatgcgagccctgtttctgatcccccgtaaccccccaccacgtttgaagagcaagaagtggtctaaaaaatttatcgacttcattgatacgtgtctgatcaagacctatctcagcagaccccctacggagcagctcctgaagtttccttttatccgggaccagcctacggaacgccaggttcgaatccaacttaaggatcatatagacagatcacgtaagaagagaggggagaaagaggagacggaatatgagtactctggctccgaggaggaagacgactcccatggtgaggaaggtgagcctagctctatcatgaatgttcccggtgaatcaacactgaggcgcgaattcctgagactccagcaggagaacaaatcaaatagcgaagccctaaagcagcagcaacagcttcagcagcagcagcagagagatccagaggcacacatcaaacacctcttgcaccagcggcaacgaaggatagaagaacaaaaggaagagcggagaagggttgaggagcagcagcggagagagagggaacaaaggaagctgcaggaaaaagagcagcagagacgccttgaagatatgcaagcactgcggcgtgaagaagaaaggcggcaggctgaaagagaacaagaatataagagaaaacagctggaggaacagagacagagcgagcggctacagagacagctgcaacaggagcatgcatacctgaagtctctgcaacagcaacagcagcagcaacagctgcagaagcaacaacagcagcaattactgcccggagacaggaagccactgtaccattatggcagaggcatgaaccctgcggacaagcctgcctgggcccgtgaggttgaggaacgaacccggatgaacaagcagcaaaactcacctttagctaaatccaagccagggagcacaggacccgaacccccaattcctcaggcttcccccggtccccctggacctctgtcacaaactccacccatgcaacgccctgtggaacctcaggaaggccctcacaagagtcttcaggaccagcctactcgcaacctggctgcatttcccgcttcccatgaccctgatccagccataccggcaccaaccgctactccgagcgcacgtggggcagttatacgtcagaactcagatcctacgtctgagggcccagggccttccccaaacccaccagcttgggttagaccagacaacgaggcgcctcccaaggtaccacaacggacctcctcaatcgcgacagcactgaatactagtggtgctgggggatctaggcccgctcaagctgttcgcgcacgcccaaggtctaatagcgcttggcaaatatatctgcagaggcgggcagaaaggggtacaccaaaaccgcctgggccacctgcacagcctcctggccctcccaacgcatcctctaatcccgacctgcggagaagcgaccccggttgggaacgaagtgatagtgtattgccggcttctcatggtcatctgccacaggccggatctctcgagcggaaccgcgtcggtgtttcaagcaagccagactcttcacctgtactttctccgggtaataaagcgaagcccgacgatcaccggagccgccctggtcgccctgctgactttgttctgctgaaggagaggacactggacgaagcaccaaggccgcctaaaaaagccatggattatagctcaagctctgaggaagtagagtcttctgaggacgatgaagaggaaggtgagggcggacctgcagagggaagccgagacactcctggcggacgcagcgacggtgacaccgattcagtgagcacaatggtggttcacgacgtggaagagatcacaggcacccagccaccctacggcggtggaaccatggtggtacagcgtaccccagaggaggagaggaacctgttacacgccgactctaatggatatactaacttaccagacgtggtccaaccgtcacacagcccgaccgagaactccaaagggcagtccccccctagcaaagacgggagtggagactatcagtcccggggactcgtcaaagcaccagggaagtcctcttttacaatgttcgtggatctcggaatctaccagccaggtggctctggagacagcatccctattacagccttagtcggcggagagggcactaggctggaccagctgcagtacgatgttcgaaaaggatcagtggttaatgtgaatcccacaaataccagggcacacagcgagacaccggagatcaggaaatataaaaagaggtttaactctgaaattctatgcgcagctctctggggtgtgaatctcctggtggggaccgagaatggactgatgctcctggacagaagtggccagggcaaagtgtacggccttatagggcgtagaaggtttcagcagatggatgtgctggaaggactcaacctccttattaccatttcaggcaagcgcaacaagctgagggtgtactatctctcctggctgagaaacaagatcctgcataatgatcccgaagtcgagaaaaagcagggctggacgacagtgggtgatatggagggctgcggccattatcgggtggtgaagtatgagcgcatcaagtttttggtgatcgcactgaagtcctctgtcgaggtttatgcatgggcacccaagccctatcacaaattcatggcattcaaatccttcgcagatctgcctcatcggcctctgctagttgacttgacagttgaagaggggcagcggctcaaagtcatctacggcagttcagccggttttcatgcagttgacgtagatagcggtaactcctatgatatatacatcccagtgcatatccaaagccagataaccccccatgcaattatattcttgcctaatacagatggaatggaaatgctgctgtgttatgaggacgagggcgtatacgttaacacctacggcagaataatcaaagatgtggtgctgcagtggggtgaaatgcctacatctgtcgcatacatctgctcaaatcagatcatgggctggggagagaaagcgatcgagatccgctcagttgagactgggcacctcgatggggtttttatgcacaagcgcgcacagaggttgaaatttctgtgtgagcggaatgacaaggtcttcttcgcctccgtgcggtccggaggatcatctcaggtctattttatgaccctgaatagaaattgtattatgaactggtag

SEQ ID NO: 230637 - DNA, 879 bp, Artificial Sequence
  Description of Artificial Sequence: Synthetic coding sequence
atgttgctcgaccggagtgggcagggaaaagtctacggactgatcggtcggcgtagatttcagcagatggacgtgcttgaggggctcaacctactgatcaccatatctggaaagcgtaataagttgcgtgtgtactatttgagttggctacgcaataaaattctgcataatgatcctgaagtggaaaaaaagcagggctggactactgtgggcgatatggaaggctgcgggcactacagagtcgtaaagtacgaaagaatcaagtttttggtgattgcgctgaagtcatcagtggaagtatatgcttgggcgccaaagccctatcacaaattcatggcattcaagtcctttgccgatctgccccacaggcccttactggtggacctcacagtggaggaaggccagagactgaaagtgatctatgggagtagcgcagggtttcacgccgtcgacgttgacagcggaaactcttatgacatctatatcccagtgcatatccaaagtcaaatcacaccccacgctattattttcctgcctaatacagatggcatggaaatgctcctatgctatgaggatgagggtgtctatgtgaacacatatggacgtataatcaaggatgtcgtgctgcagtggggggagatgcccacgtccgtggcttacatttgttctaaccagattatgggctggggagagaaggccatcgagattcggtctgtggagactggacaccttgacggcgtgttcatgcacaaaagggcccagaggctaaaattcctgtgtgaacggaacgacaaggtcttctttgccagtgtgaggtctggtggctccagtcaagtgtattttatgacactgaacagaaactgtatcatgaattggtag

SEQ ID NO: 230638 - DNA, 336 bp, Artificial Sequence
  Description of Artificial Sequence: Synthetic coding sequence
atgggggaccccgctccagcacgctccctggacgacatcgacctcagtgctttgcgagcactgtggttccagtttttttatcactctggttcttctctggaatcgcccggtatgctgaatggtcctttccagcatcggaatagtcggatcatgactcaccgctccgcggagaagaccctgctaggcagtctgtctttgtggcggtggagcgcaatggagccgacagaccggtgtacgagagtcgggatgagtcgaagaggcagttggctgccaagcagaagttggatgagcagacggacacgtagaaagcgtagtaaccggagatctacgtgctag

SEQ ID NO: 230639 - DNA, 1014 bp, Artificial Sequence
  Description of Artificial Sequence: Synthetic coding sequence
atgggcgctgccggatcttcggccctcgcgaggttcgtgctattggctcagagcaggcccggttggctcggcgttgcagcgctgggtctcacagccgtggcccttggggctgtggcatggcggagagcatggcctactaggcgcaggagactcctccagcaggttggtactgtcgcacaattatggatttatcctgtaaaatcctgcaagggcgttcccgtctcagaagctgaatgtacagcgatgggcttgagatcaggaaacttaagggaccgtttttggctggtgataaatcaggagggaaatatggtaacggcaagacaggagccaagactcgtgctaatctcattaacctgtgacggagacactctaacgttgagtgcagcctacaccaaggacctgctactgccaatcaaaactccaacaacgaacgcagtacataagtgcagagtgcacggattagagattgaaggcagagattgcggagaagcgacagctcagtggattacatcttttttaaagagtcagccatatcgcctcgttcactttgaaccccatatgcgccctaggcgccctcaccagattgcagatctatttagaccaaaagaccagattgcatatagtgacacatcccctttcctcatattgtcagaagcttctttggcagatttgaacagtcgtctggagaaaaaggtgaaagccacgaatttcaggcctaacatcgttatcagtggctgcgacgtctatgcagaggacagctgggacgaactgctcataggcgatgtagagttgaagagggtgatggcttgctcccgttgcatactcacaacagttgatcccgatacgggggtgatgtccagaaaggaaccactggagacactcaagtcctatcgccagtgcgatcctagtgaacgaaagctctatggtaagtcccctctgttcgggcagtatttcgtgcttgagaacccgggtacaatcaaagtaggtgacccggtgtacctgctaggacagtag

SEQ ID NO: 230640 - DNA, 774 bp, Artificial Sequence
  Description of Artificial Sequence: Synthetic coding sequence
atgggagcctccagcagcagcgccttagcgagacttgggctgccggcaaggccatggccacgttggctgggcgtcgcggcattgggtctggccgctgtggctctggggacagtcgcttggaggcgggcatggcccagaaggcgcaggagactgcagcaagtgggaacagtggccaagttgtggatctacccagtgaagtcatgcaagggcgtgcctgtttctgaagcagaatgcaccgccatgggtctgcgctctggcaacctgagggacaggttttggctggtgatcaaggaggatgggcatatggtaactgccaggcaggaacctcggcttgttttgatctctattatctatgagaacaattgcttgatatttagagcccctgatatggaccagctggtgttaccctcaaagcagccatctagcaacaaactgcataattgtcgcatcttcggcctcgacattaagggcagggactgcggcaatgaggctgccaaatggttcacgaactttctgaagaccgaggcttacagattagttcagtttgaaaccaacatgaaagggaggaccagcaggaagctgctgccaactctcgaccaaaacttccaagttgcctatcccgactattgtccactcctcattatgactgatgcctctctggtcgacctgaataccagaatggaaaaaaagatgaagatggaaaatttccgaccgaacatcgtcgtgacaggttgcgacgcgttcgaagaggcttctgccacccggcgagactag

SEQ ID NO: 230641 - DNA, 1008 bp, Artificial Sequence
  Description of Artificial Sequence: Synthetic coding sequence
atgggtgcttcctccagtagtgcactggctcggttaggattgccggcaagaccttggccaagatggctgggcgtcgcagctctcggcttagccgcagtagcattgggcacagtagcctggaggagggcttggcctcgacggcgaaggcggcttcaacaggtcggtacagtggccaagctttggatttaccccgtaaagtcctgcaagggggtgccagtgtccgaagctgagtgtaccgcgatggggttacgctcagggaatctccgtgacaggttctggctggttattaaagaagacgggcacatggtgaccgcccgtcaggagccgcgactggtgctgatatccatcatctatgaaaataactgcttgatttttagggcacctgacatggatcagctggttctcccatccaagcaaccctctagtaataagctgcacaactgtcggatttttgggttggatatcaaaggcagggattgtgggaatgaagctgccaagtggtttaccaattttctcaagacagaggcgtacaggctcgtgcaatttgagaccaatatgaagggtcgcacctcaagaaagcttctccctacacttgaccaaaacttccaagtggcctaccctgactattgcccactgttaatcatgacagacgcctctctggtagatttgaacacccgtatggaaaagaaaatgaaaatggagaacttccggcctaatatcgtggtcaccggatgtgacgcttttgaagaagacacttgggacgaactgttgataggctctgttgaagtgaaaaaagtgatggcttgtcctcggtgcatcctaactacagtggaccccgataccggagtcatcgatagaaagcagccactggacactctgaagagctacaggctgtgtgatcccagcgagcgagagttgtacaaactgtcacccttattcggcatttactactccgtggaaaagataggatcactgagggtgggtgaccctgtgtatcggatggtctag

SEQ ID NO: 230642 - DNA, 519 bp, Artificial Sequence
  Description of Artificial Sequence: Synthetic coding sequence
ggacacatggtgactgcgagacaagagcccaggttggtactcatctccatcatttacgaaaataactgcctaatcttccgggcaccagatatggatcagctggtgctgccctccaagcagccctcgagtaacaagctgcacaattgccgcattttcggattggatataaaaggtagggactgcggcaatgaggccgctaaatggttcacaaatttcctgaaaaccgaggcttatcgacttgtccagtttgagactaacatgaagggcaggactagtcgtaagctcttgcctaccttagaccagaatttccaagtggcttatcccgactattgccctctcttgatcatgacggatgcctcgctggtagatctgaatacccgtatggagaagaaaatgaagatggagaattttaggcccaatattgtggttacaggatgcgatgctttcgaggaggatacctgggacgagctcctgatcggcagtgttgaggtgaagaaggtcatggcgtgcccgaggtag

SEQ ID NO: 230643 - DNA, 447 bp, Artificial Sequence
  Description of Artificial Sequence: Synthetic coding sequence
atgcccttcgccgaggacaaaacctataagtacatctgtagaaacttcagcaacttttgtaatgtggacgtcgtggaaatcctgccctatctgccttgccttactgctagagaccaggacaggctgagggcaacttgtacactctccgggaacagagatactctttggcatttgtttaatactctgcagctcccaacttgggcaggcgaggaaacccccggaggacagtcctccggcagagggctggatttctccagtctcacttccggagcagtttggctgtggcagatgtctgacttctggagctgtttctccacttggacagtttcgatctggttaattctgcactgggtgttactgagattaaacttacaagtgttcgctaaatgtctggcccagagcaagtggccactgctactgccatccctctcatgcccaacgtggtag

SEQ ID NO: 230644 - DNA, 375 bp, Artificial Sequence
  Description of Artificial Sequence: Synthetic coding sequence
atgccttttgccgaggataagacgtacaagtatatatgtcgcaatttctcaaatttttgcaatgttgatgtcgtcgagatcttaccgtacctgccttgtctgactgcacgcgaccaagacagactgcgggcaacatgtaccttgagtgggaacagagacacactctggcacctgttcaacaccctgcagcggaggcccggatgggtagaatattttatcgcagcgctgcgaggctgcgaattagtggatctcgccgacgaggttgccagcgtgtatcagagctatcagccacagttcagagcctctccagctgatgcccagccacaatctcacccaaaagagtcaagatggtggccgcctggtgtattactatag

SEQ ID NO: 230645 - DNA, 1200 bp, Artificial Sequence
  Description of Artificial Sequence: Synthetic coding sequence
atgcctgttcaggagacccaggctcctgaatcccccggtgagaactctgaacaggccctgcagaccctgtccccacgtgctattccacggaatcccgacggcggtccgctggaatcctcgagcgatctcgcggctctctctcctctcactagctcaggacaccaggagcaggacaccgaactgggctctacccacacagccggtgcgactagtagtctcacgccgtctagaggcccagtttcccctagcgtgtcttttcaacccttggcacgatcgactcccagagcctcccggctgcctggtcctactgggagcgtcgtgtcaacaggaactagcttctcttcaagctctcccggtctagcctctgccggagcagctgagggtaaacagggtgcagaatccgaccaggctgaaccaattatctgctcttcaggggctgaagcccctgctaactcgctgccttctaaggtcccgaccacattaatgcctgtgaatacagtagctcttaaggtcccggcaaatccagccagcgtctcaactgttccctctaagcttcctacctcttcaaagccaccaggagccgtaccttcgaatgctctgacaaacccagccccttccaaacttcctatcaatagtacaagagctggtatggttccaagtaaagtgcctacctctatggttctcaccaaggtgtcagcttcaaccgtgcctaccgacggtagcagcaggaatgaggagactcctgcggctccgacccctgctggcgcaacaggaggctcgtccgcatggttagactcaagctctgaaaaccgtggtctgggcagtgagctgtctaagcccggtgtcttggcctctcaggttgactccccgttttcaggttgctttgaggacctggcaatttccgctagcacctcccttggaatgggcccatgtcatggtccggaagaaaatgagtacaaaagtgagggaacattcggaattcacgtggctgagaacccaagcatccagctgctggagggcaatcctgggcctcctgctgaccccgatggcggacccagaccccaggctgatagaaagttccaagaaagggaagtgccctgccacaggccaagccctggcgctttgtggctccaggtggccgtgacaggagtgctagttgtcacgcttttggtcgttctctacagacgaaggttgcactag

SEQ ID NO: 230646 - DNA, 1623 bp, Artificial Sequence
  Description of Artificial Sequence: Synthetic coding sequence
atgccattcgccgaggataagacctataagtatatctgccgtaatttctcaaatttctgtaacgtggatgtggtggagattctaccctatctgccctgtctgacagccagagatcaggatcgccttagagctacctgcaccctcagtgggaacagggatactctttggcatcttttcaatacattgcaaagaagacccggatgggttgaatatttcattgctgccctgagaggctgcgagttagtggacctggcggacgaggtggcaagcgtttatcagtcctaccaacccagaacatctgatagaccacctgatccactggaaccacccagtctgccagctgaacgaccagggccaccaacccccgcagctgctcactccattccgtacaactcttgccgagaaaaggagccttcgtaccctatgccggtgcaggaaacacaagcgccagaatcacccggagagaattctgagcaggcactgcaaactctcagcccaagggctatccctcgcaacccagatggaggacctttagagagctcaagtgacttggccgcactgagtcctctcacatcaagtggccaccaagagcaggatacggagctgggctccacccatacggccggtgctacgtcatccctcactcctagcagggggccagtttccccaagcgtttcctttcagccgctcgctagatctacacctcgtgccagccgactgcctggtcctacagggtccgtcgtgtctactggtaccagcttctctagttcaagtcctggccttgcttccgccggtgcagctgaggggaagcagggagctgaatccgaccaggcagagcctataatttgcagcagcggcgctgaagcacccgctaactccctcccttctaaggtcccaactactttaatgcccgtaaatacagtcgcattgaaggttccagctaatcccgcttccgtgtcaacagtgcccagtaaattgcccacctcttcaaaacccccaggcgctgtgccatctaatgctctgaccaaccctgcacctagcaagttgcccatcaactctactcgggctggaatggtcccctcaaaggtgccaactagcatggtgctgaccaaagtctcagcttccacggtaccaacggacggctcctctaggaatgaggagacacctgcggcacccacaccagccggagccacaggtgggtcatccgcctggcttgacagctcttccgaaaaccggggtcttgggtccgagctaagtaagccaggtgtcttggcttcccaggtcgactccccatttagcggttgttttgaagacttagccattagcgcctccactagcctcggaatgggcccatgtcatgggccagaggaaaatgagtacaaatcagaagggaccttcggaatccacgtggcagagaaccccagtatccaattgcttgagggtaatccgggaccccctgccgatcccgatggaggaccgcgtccacaggcggaccggaagtttcaggagcgggaagtgccatgccaccgtccctctcctggtgctttgtggctccaggtggctgtaactggggttctagtagtgacactattagtggtgctgtaccggagacgcctgcattag

SEQ ID NO: 230647 - DNA, 993 bp, Artificial Sequence
  Description of Artificial Sequence: Synthetic coding sequence
atggccgcagccgcaggtcggagtctgctgttactgcttagctctcgcggaggtgggggtggcggtgccggtggctgtggcgctttaaccgcgggttgtttccctggcctgggtgtgagccggcacagacagcagcagcaccaccggaccgtgcaccagcgtatagcctcgtggcagaatctaggtgctgtctactgctcaacagtcgtcccatcagacgatgtaacagtggtgtaccagaacgggctaccggttatcagtgttaggctacccagcaggcgggaaagatgccagttcactctaaagccaatttccgactctgtgggcgtgttcctacggcaactgcaggaagaagatcggggtattgatcgtgttgccatctactctccggatggcgtacgggtcgccgcttccaccgggatagatttattgctgctggatgatttcaagctcgtcatcaatgacctgacatatcacgtgcggccaccaaaaagagtcgagatgggtttttgtcatgtggggcagaacggtttcgaacttctgacaagttcttaccttcctgcaagtgctagccagtctgccgagatcatcgcagtacggattgagatctcccgcaaggccgaaaagaggactacactggtactctggggtgggcttgcgtatatggctactcaattcggtatactggctcgtttgacctggtgggagtactcttgggacatcatggagcctgtcacttatttcataacctacggctcagcaatggctatgtatgcatactttgtcatgaccagacaagagtacgtttacccagaagccagggatcgtcagtacctcctttttttccacaaaggagcaaagaaatctcgttttgacctcgagaagtataaccagctgaaagatgctatagcccaggcagaaatggatctcaaacgtctcagggacccacttcaggtgcacctcccactgagacagatcggcgaaaaggattag

SEQ ID NO: 230648 - DNA, 1056 bp, Artificial Sequence
  Description of Artificial Sequence: Synthetic coding sequence
atggccgctgctgcaggacggtcgctgctcctgttgctgagttcacgcggaggcggtggcggaggagccggaggttgtggcgcacttaccgcgggatgtttcccaggtctcggcgtctcacgtcacaggcaacaacagcaccatcgaaccgttcaccagcggatcgcctcttggcaaaacctgggcgctgtctactgttccaccgttgtgccgtctgacgacgtcacggtggtttatcagaatggcctgcctgtgatctccgtcagactgcctagtcggcgagaacggtgccagtttacgctgaagcccatcagtgattccgtgggggtgtttctgagacaactccaggaggaggaccggggaatcgatcgggtcgctatttattctcctgatggagtgcgtgtggctgcctccactggtatcgatttgctgttgctcgatgacttcaaattagtgattaatgatctgacgtaccacgttaggccacctaaaagggatctcctctctcatgaaaacgctgctactctgaatgatgtgaagacactggtccagcaattgtataccactttgtgcattgagcagcaccagctgaacaaagaacgcgaactgatcgaaaggctcgaggacctcaaagagcagctcgcacccctagaaaaggtgagaatcgaaatctctcgtaaggcagaaaagagaacaacgctggtgctgtggggaggcctggcttacatggccacccagtttgggatcctggcaaggctcacttggtgggaatatagttgggacataatggaacccgtcacctactttataacctatggatcggctatggcaatgtacgcctactttgtgatgactcgccaggagtacgtttatcccgaagcccgagatcgacaatatcttttgtttttccacaaaggtgcaaagaaatctcggttcgatctcgaaaaatacaatcagctgaaggacgctattgcccaggctgaaatggacctgaagcgcttgagagaccctctgcaggtccatctgccactgaggcagatcggagagaaggactag

SEQ ID NO: 230649 - DNA, 909 bp, Artificial Sequence
  Description of Artificial Sequence: Synthetic coding sequence
atggtgcatcagagaattgctagctggcagaatctgggtgctgtctactgttcgacggtcgtgccttccgacgatgtcaccgtcgtgtaccagaatggtctccctgtgatttctgtcagactgcctagccgtcgcgagcgatgtcagttcacattgaaacctataagcgacagtgtgggcgtgttcctgaggcaactgcaggaagaggacagaggtattgatcgggtggccatctacagccccgacggtgtcagggtcgcagcttccaccgggatcgacctgctgctattggacgatttcaagcttgtcataaacgacttaacctaccacgttcgaccccctaagagagacctgttaagtcacgagaacgcagctaccctcaatgacgtgaagaccttggtccaacaactgtacacaaccctctgcattgagcaacatcaactgaataaggaaagagaacttatagagaggctggaagacttaaaagagcagttggctcccctagagaaagtgagaattgagatttcaagaaaagcagagaaaagaactactctggttctctggggaggtctggcgtatatggcaacacagtttggcatattggctaggctgacctggtgggagtactcttgggacattatggagccagtgacatacttcataacttatgggtcagcgatggcaatgtacgcttatttcgtgatgacccggcaggaatacgtgtatcccgaggcacgggatcgccagtatcttctgtttttccataagggggctaagaaaagcagattcgacctcgaaaaatacaatcagcttaaggacgcaatcgcacaggccgagatggatcttaagcgcctaagggatcctctgcaagttcacttgccgctgcggcagatcggcgaaaaagactag

SEQ ID NO: 230650 - DNA, 912 bp, Artificial Sequence
  Description of Artificial Sequence: Synthetic coding sequence
atggcggacgctgcaagccaggtcctgctgggatcagggttgactattctgtcccagccgttgatgtatgttaaagttcttatccaagtgggatatgaaccacttcctcccaccatcgggcgaaatatctttggccgacaggtgtgccagctcccgggattgtttagctatgcccagcacatagctagcatcgacgggagacgcggactttttaccggactgacccccaggctgtgcagtggagtgctcggcacggttgttcatggcaaagtccttcagcattatcaggaatccgataaaggtgaagagctgggcccaggtaatgtccaaaaggaggtgtcctcctcatttgatcacgtgattaaggagaccacgcgcgagatgattgctcgaagcgccgctacactgataactcaccccttccatgtgattacgctgagatccatggtgcagttcattggtcgagaaagcaagtattgtggactgtgcgactcaatcattactatttatcgcgaggaggggattttgggcttttttgccggtctggtgccgagattgcttggcgacatactgagtctctggctgtgcaatagtctcgcttatctggtaaatacatatgcccttgattctggagtgtcgactatgaacgaaatgaaatcctatagccaggccgttaccggatttttcgcctctatgctgacatacccgttcgtgctcgtttcaaacctgatggcggttaacaactgcgggctagccggtgggtgtccaccctatagcccaatatatacctcctggatagactgctggtgtatgctgcagaaagaaggcaatatgagcagggggaactccctctttttcaggaaggttcccttcggtaagacctactgctgtgatcttaagatgctcatctag

SEQ ID NO: 230651 - DNA, 468 bp, Artificial Sequence
  Description of Artificial Sequence: Synthetic coding sequence
atggttcagttcatcggcagagagagtaaatattgcggcctatgtgacagcattattacaatctatcgtgaggagggaatactgggctttttcgccggactggtcccacgcctcctaggggacatcctttccttgtggctgtgcaattctctcgcttacctggtgaatacctatgccctggactccggcgttagtaccatgaatgagatgaaaagctacagtcaggccgtaactggctttttcgcttctatgctgacgtatcctttcgtgctggtttcaaacctgatggcggttaataactgtggattggcgggaggctgtcctccatactcccctatttatacctcttggatcgactgctggtgtatgcttcaaaaagagggcaatatgagtcggggtaattccttattcttcagaaaagtcccattcggaaaaacgtactgctgcgacctgaaaatgttgatctag

SEQ ID NO: 230652 - DNA, 360 bp, Artificial Sequence
  Description of Artificial Sequence: Synthetic coding sequence
atggtgttacccctgccctggctgagtagataccacttcctacgactattgctcccatcttggagcctggccccacaaggctctcatggttgttgctcacagaacccaaaagcatctatggaggaacagacctcttccagaggtaatggcaagatgactagcccaccgagagggcctggtacgcatcgtacagcagagttggcacgcgcagaagaattgttggagcagcaactagagctgtaccaggcgctgttggagggtcaggagggggcttgggaggcacaagccctggtgctgaaaatacagaaacttaaagagcagatgcgcagacaccaggagtctttaggtgggggagcctag

SEQ ID NO: 230653 - DNA, 360 bp, Artificial Sequence
  Description of Artificial Sequence: Synthetic coding sequence
atggtgctgcccctgccctggttatctcggtatcatttcctacggctgctcctgcccagctggtcactggcgccacagggatcacacggctgttgctcccagaacccaaaggcaagtatggaagagcagactaactcaagaggaaatggcaaaatgaccagtcctcctcggggacctggtacacacagaactgctgagctcgccagggcagaagaactccttgaacagcagctggaattatatcaagccttattagaggggcaggagggtgcttgggaagctcaggctctggtcttaaagattcagaagctcaaagagcaaatgcgaagacaccaggaaagcctcggagggggtgcctag

SEQ ID NO: 230654 - DNA, 360 bp, Artificial Sequence
  Description of Artificial Sequence: Synthetic coding sequence
atggtactccccttaccatggctgtccagataccatttcctccgattgctcctgcccagttggagcttggctccacaggggagccacggctgctgcagccaaaaccccaaagcgtccatggaggagcaaactaatagcaggggcaatggcaagatgacatcgccgcctagaggtccaggtacccaccgtacagcggagcttgccagagctgaggagctactggagcagcaacttgagctgtaccaagccttgctggaggggcaagagggcgcatgggaggcccaagccttggttcttaagattcagaaactaaaagagcagatgcggcgacaccaggaatccctgggaggaggagcgtag

SEQ ID NO: 230655 - DNA, 360 bp, Artificial Sequence
  Description of Artificial Sequence: Synthetic coding sequence
atggtcttgccactgccctggctctccaggtatcactttttaagacttcttcttccgtcctggagtctcgctccccagggaagccacgggtgttgctctcagaaccctaaagcgtccatggaggagcaaacgtcatccaggggaaacggaaaaatgaccagcccaccacgtggaccaggaacgcaccgcacggccgagcttgccagggctgaggaattactagaacagcagctggaactctatcaggccctccttgagggacaggagggcgcttgggaggctcaggccctggtgttgaaaattcaaaagcttaaggagcagatgcgacgccaccaagagagtctgggcggtggtgcatag

SEQ ID NO: 230656 - DNA, 360 bp, Artificial Sequence
  Description of Artificial Sequence: Synthetic coding sequence
atggtattgccactcccatggctttctcgttaccacttcctgaggcttttgctgccttcctggagtcttgcccctcaggggagtcacggatgttgctcccagaaccccaaagcaagcatggaagaacaaacgagtagccggggaaacggaaaaatgacttccccacccaggggcccaggcacacatcgcacggcagaactcgcacgtgccgaggagctgctcgagcaacagctggaactttaccaggccctcctggagggacaggaaggcgcttgggaggctcaggcactcgtgcttaagatccagaagctcaaggagcagatgagaagacaccaagagtcgttagggggaggggcatag

SEQ ID NO: 230657 - DNA, 360 bp, Artificial Sequence
  Description of Artificial Sequence: Synthetic coding sequence
atggtgctccccctgccgtggctgtcacggtaccattttttaaggctcctgctgccctcttggtccttagctccccagggatcacatggctgttgctcccagaatccaaaggcttctatggaaaagcaaacaaactctcggggaaacggcaagatgacgagtccccctcgagggcctgggactcacaggaccgccgaacttgccagggctgaggagctcctggaacaacaacttgagctctatcaagctttactggagggccaagaaggcgcttgggaggcgcaggccttggtcctgaaaattcagaagttgaaagaacagatgcggagacaccaggagtcccttgggggtggtgcctag

SEQ ID NO: 230658 - DNA, 360 bp, Artificial Sequence
  Description of Artificial Sequence: Synthetic coding sequence
atggtgctacccctgccttggctgagtcgttaccatttcttgagactcttgctgccctcatggagtcttgctccacaaggatctcacggatgctgctctcagaaccccaaggcttcaatggaagaacagacaaatagtcgcggtaacggcaagatgacaagccccccacggggacctggtacccatcgaacagcagagttagccagggctgaagaattgctagagcagcagctagaattgtatcaggcccttcttgaggggcaggagggcgcttgggaggcgcaggctctcgtcctgaagattcagaagctgaaggagcaaatgcggcgacatcaggagtcgcttggcggaggcgcatag

SEQ ID NO: 230659 - DNA, 360 bp, Artificial Sequence
  Description of Artificial Sequence: Synthetic coding sequence
atggtgctcccccttccctggctgtctaggtaccattttctgcggctgttactgcccagctggagcctagcaccacagggctcccacggttgttgtagccagaaccccaaagcaagcatggaggagcagactaacagtcgagggaacgggaaaatgacctccccgcctcgcggtccaggcacccaccgcacagccgagctggcgagggcggaggaactgctcgagcagcaactggagctgtaccaggctctgttggaaggacaggaaggggcatgggaagcgcaggcccttgttctgaagattcagaagttgaaggagcagatgaggcgtcaccaggagagcctggggggtggggcttag

SEQ ID NO: 230660 - DNA, 1059 bp, Artificial Sequence
  Description of Artificial Sequence: Synthetic coding sequence
atggagagcggcggaaggccatccctctgtcagtttattcttctgggtaccacatcagtcgtaaccgctgctctctattctgtctacagacagaaagctcgagtgtctcaagaacttaagggcgctaagaaagtacaccttggggaggatttaaaaagcattttaagcgaggctccaggaaaatgcgtgccctacgccgtgatagaaggcgctgttcggagtgttaaagagacccttaattctcagttcgttgagaattgtaagggggtgatacagagactcacacttcaggaacataagatggtgtggaacagaacaacccatttgtggaatgattgtagtaaaataatacaccagagaacaaatacagttccattcgatctggtgcctcatgaagatggagtggatgtggctgtgcgtgtgttgaaaccactggacagtgtcgacctgggtctggagaccgtctatgagaaattccatccctcaatccagtcttttacagatgttattggacactacataagcggtgaacgccctaaaggaatccaggagaccgaggagatgcttaaggttggcgcaaccctcaccggagtaggcgaacttgtactggataacaactccgtcagattgcagccaccgaaacaaggaatgcaatactacctgtcgtctcaggattttgacagtctgttgcagaggcaggaatcgtccgtgcgcctgtggaaagtcttggcacttgtgttcggattcgctacctgcgcaacattgttttttattctcagaaagcagtacctgcagcgtcaagagagactcaggctcaagcaaatgcaggaggagttccaggagcatgaagcacaactgctgagcagggcaaaaccggaggatagagagtccctaaagtccgcttgcgtcgtatgtctgagctcctttaagagttgtgttttcctggagtgtggccacgtttgttcctgtaccgagtgttaccgcgcactgcctgagcctaagaagtgccctatctgccgacaggcaataacccgggtcatccccttgtacaattcctag

SEQ ID NO: 230661 - DNA, 2142 bp, Artificial Sequence
  Description of Artificial Sequence: Synthetic coding sequence
atgctgtgtgtgggacgccttggagggcttggcgcaagggcagctgctctgccaccacgcagggctggccgaggcagccttgaagccggtattagggcacggagagtgtcaactagctggtccccagttggggcagccttcaacgtaaaaccgcagggatctcggcttgatctgttcggtgagcgaaggggtctattcggggttcctgagctctcggctccagaggggtttcacattgcccaggaaaaggccctccggaagaccgaactcctggtggacagagcctgttcaacacccccaggcccacagaccgttctgattttcgacgaactctcagattccttgtgtcgcgtagcagacctagctgacttcgtgaaaatcgcgcatcctgagcccgcattccgcgaggccgcagaagaggcatgccgctcgattgggaccatggtggagaaacttaataccaatgtcgatctgtatcagagtcttcaaaagctactggccgacaagaagcttgttgatagcctggatcccgaaaccagacgagtggccgagctcttcatgttcgacttcgagattagcgggatccatctggataaggaaaaaagaaagagggcagtcgatctcaacgtcaaaatcctggacctgagttccacattccttatgggaacgaattttcccaacaagatagaaaagcacctgttacccgagcatattaggaggaacttcacaagcgccggagatcatattataatagatgggctgcatgccgagagtccggacgatctcgttagggaagcggcatataaaatttttctataccctaatgctggacagctgaagtgtcttgaggagctgctgtcctcacgtgatctgctcgccaagctggtcgggtattcaaccttctctcaccgcgctctgcagggtactattgccaaaaatcccgaaaccgtcatgcagttcctggaaaagttgagtgataagctgagcgaacggaccctcaaggattttgaaatgattcgcggtatgaaaatgaaactcaacccacagaatagtgaagtcatgccgtgggatcctccttactacagcggagtcattagggcagaaagatacaatattgaaccgtccctctactgcccattctttagcctgggagcctgtatggagggtctcaacatcctgttgaacagactcttgggtatctcactatatgctgagcaaccggctaaaggtgaggtatggtctgaagacgtccgcaagctggccgttgttcatgagtccgagggactactggggtatatctactgtgatttctttcagagggccgataagccccaccaagactgccactttacaatccggggaggcagactaaaagaggacggagactaccagttgcccgtggtggtactgatgctgaatctgcctcgaagcagcaggtccagcccgacactgctgactcccagtatgatggaaaacctcttccacgagatgggacacgctatgcattcaatgttgggacgtaccaggtatcagcacgttactggaactaggtgtcctaccgacttcgcagaggtgccctccattctgatggaatacttcgctaatgattacagggttgtgaaccagtttgctagacactaccagacaggacaaccactaccaaagaacatggtctctcggttgtgcgaaagcaaaaaagtgtgtgccgctgcagatatgcagttgcaggtgttctacgctaccttggaccaaatataccacgggaaacaccccttaagaaattctacaaccgacatcttgaaggagactcaggagaagttttacgggctgccttacgttcccaatacagcgtggcagttacgctttagtcacctagtaggatatggagctcgttactacagttaccttatgtctcgagcagtggcttcaatggtttggaaggaatgtttcctacaggatccttttaaccgtgccgcaggcgagcggtaccgcagggaaatgctggctcacgggggtggtagagagcccatgttgatggtggaaggcatgctccagaagtgtccatctgtggacgattttgtgtctgctcttgtgagcgacttggatcttgatttcgagactttcctgatggatagtgaatag

SEQ ID NO: 230662 - DNA, 1353 bp, Artificial Sequence
  Description of Artificial Sequence: Synthetic coding sequence
atgagcgccatccaggccgcatggccttccgggactgaatgcatagccaagtacaacttccacggaacagccgaacaggatctccccttctgcaaaggggacgtgttgaccatagtcgcggtcactaaggacccaaattggtataaagccaagaataaagtgggacgtgaaggcattatccctgctaactacgttcagaaaagggagggagtgaaggcgggtactaagctgtctctcatgccttggtttcacggtaaaatcactcgagagcaggcggaaagactgttgtatccacccgagaccggtctttttctcgtgcgggagagtaccaattatcctggcgattacacactgtgtgtgagttgcgacggtaaggtggaacactataggatcatgtaccacgctagcaagttatctatagatgaggaggtgtacttcgagaacctgatgcaattggttgagcactatacctcagatgccgacggcctgtgcacacgtctgatcaaacccaaagttatggaggggacagttgccgctcaggacgagttttaccggtccggatgggctttgaacatgaaggagctgaagttgctgcagacgatcggcaaaggcgaatttggcgacgtgatgttaggcgattacaggggcaacaaagttgcagtcaagtgcattaagaacgatgccactgcccaggcttttctcgccgaagcctcagtcatgacccagctccgtcatagcaacctggtacagcttctgggtgtgatcgtcgaggaaaaaggaggcctttatatcgtgaccgaatacatggccaaggggagcctagtggactatttaaggtctagaggcaggagtgtgcttgggggagactgtctcttgaaattctccctagacgtttgcgaggccatggagtacttagagggaaacaacttcgttcatagggatttggcagcaaggaatgtgctggtgagcgaggataatgtggcaaaggtgtccgactttgggttaactaaggaggcaagttccactcaagacaccggcaagctcccggtgaagtggacagccccagaggcccttagggagaagaagttcagcacaaagtctgatgtatggtcctttgggattctgctgtgggagatttactcctttgggagagttccctacccgaggatacccttgaaagatgtcgtcccgagggtggaaaaaggctacaagatggatgctcctgatggttgccctcccgcagtttacgaagtcatgaagaattgttggcatttggatgccgcaatgcggccaagcttcctgcaactgagggagcaactggaacacataaagacgcatgaattgcacctgtag

SEQ ID NO: 230663 - DNA, 1170 bp, Artificial Sequence
  Description of Artificial Sequence: Synthetic coding sequence
atgcgtgtgcttgtaaggcggtgctggggaccaccactcgcacatggagcccgtcggggaagaccctcgccccagtggagggccctggcaagactcggctgggaggactgtcgggattccagggtgcgcgagaagcctccctggcgagtgctgttcttcggaaccgaccagttcgcgcgtgaggccctgcgcgcactacacgcagctagggaaaacaaggaggaggaactgatagataaactagaagtggtgacaatgcctagcccttctcctaaaggtcttcccgttaaacagtacgccgtgcagtctcagctgcctgtgtacgagtggccagacgttgggtctggcgagtacgatgtgggtgtcgttgcctcttttgggaggttactcaatgaggccttaatcttgaagttcccttacggaattctgaacgttcacccaagctgcctgccgagatggcgagggccagcacctgtcattcacacggtccttcatggcgacaccgtcacaggagtaactattatgcagatacggcctaagcggtttgacgtgggacccatcttgaagcaggagacagtgcctgtccctcctaaaagcacagcaaaagagctggaggccgtgttgtcccgtctcggagcaaatatgctgatcagtgtccttaaaaacctgcccgagagtttaagtaatggccgtcagcagcccatggagggcgctacatatgctcccaaaatcagcgccggtacctcatgcatcaagtgggaggagcagacatctgagcagatattccgcctgtaccgggcaattggaaatatcataccactgcagaccttgtggatggcaaataccatcaaactgctggatctggtggaagtcaacagttccgttctggccgacccgaagctgacaggacaggctttgattccaggcagcgtgatctaccacaaacagtctcagatacttctcgtgtactgcaaggatggttggattggtgtcagaagcgtaatgctgaaaaagagtctaacggccactgacttttataacggctacctccacccatggtaccagaagaactctcaggcgcagcccagtcagtgccgcttccagacactgcgcttgcccactaagaaaaagcagaaaaagactgtggcaatgcagcagtgcatcgaatag

SEQ ID NO: 230664 - DNA, 1749 bp, Artificial Sequence
  Description of Artificial Sequence: Synthetic coding sequence
atggccgtccctggtgttggcctgctgacccgcttgaacctgtgtgcacggagacgcacgcgggtgcaaagaccgatcgtgaggctgctctcatgtcccggaaccgtggcgaaggatcttcgcagagacgagcagcccagcggatctgtggagaccggattcgaagacaaaattcctaagcggcgattttccgagatgcagaatgagcgccgagaacaggcccagcgcacagttctaatccactgtcccgagaagatctccgaaaacaaatttctgaaatatctatctcagttcggaccaattaacaaccacttcttttacgaatccttcggtctgtacgcggtcgtggaattctgccagaaagaatcaattggatctctgcagaacggaacccacaccccctctactgccatggaaactgccattccatttagatctcgtttcttcaatctgaagctaaaaaaccaaacctcagaacggtcccgcgttagatcgtctaatcagctgcctagatcaaacaagcaattgtttgaactcttatgctacgcagagtcaatagatgaccaattgaacacgttgctcaaggagtttcagttgacggaggagaacactaaactccgctacctcacttgctctcttattgaggatatggccgctgcatacttcccagattgtatcgtgcgcccttttggatcatcggtcaatacatttgggaagcttggctgcgatctcgacatgttcctcgacttagatgaaactcggaatttatctgcccacaaaatttctggtaatttcctgatggagtttcaggtgaagaacgttccttcagaaagaattgccacccagaaaatcttgtctgtgctgggggaatgtctggaccatttcgggcctgggtgcgtgggcgtgcagaaaatattgaatgcacgctgcccattggtgagattcagccaccaggccagcggattccagtgcgacctcaccactaataatcgtatagcgctgaccagctccgagctgctatatatctatggagcactagattctagggtcagggctcttgtgttttccgtcaggtgctgggccagggcgcactccttaacctcttcaatacccggagcttggattacaaatttttccctcacaatgatggttattttcttcctgcagcggcgtagcccccctatcctgccgacactggactctcttaaaacgctagctgacgccgaagacaaatgtgtcatcgagggcaacaattgtacattcgtgcgcgacctctccaggatcaagccctcccagaacaccgaaactctggaactgctgctcaaggagttcttcgagtattttgggaattttgcctttgataagaactccatcaatattcggcagggtagagaacaaaataaacccgattccagcccactgtatatccagaacccgttcgagacatctctgaatatctcgaaaaatgtcagtcagtcacagctccagaagttcgtagatttagcaagagagtccgcctggatcctgcagcaggaagacactgacagacctagtatttcaagcaatcgcccatggggacttgtctccctgctactcccatctgctcccaatcgaaagagttttaccaagaagaagtcaaacaagtttgccatagaaacagtgaaaaaccttctggagtctctgaaaggtaacagaacggaaaatttcacaaagacgtcagggaaaaggaccataagtactcagacttag

SEQ ID NO: 230665 - DNA, 2139 bp, Artificial Sequence
  Description of Artificial Sequence: Synthetic coding sequence
atggcttgggcaaagaaggtgggcggtcgggctggacagggaagatctctgtcacgatgtgatccaattattctcgaccccgagtggctgtacggccctcctgaaggcgagggagggccagagggggtggggggagaaacccgagcgagtattcatcctcccctgcggacaggcaggcaccatcaaaaagtcaaccataacattaggggccctgaaggctcagccaaagacgctgcacctggcggaggcggtcatcaccaggctgggccagggcaaagaggggatgaggatggagctctacagcacctgtgcggcggtgggggaggagtcggagtgagcgtgggcagaggcacgggcactagtgtggctgccgagcatccatccctccaggtaaaattgctggaactacaagagctggtcctgcgcctggcaggtgatcacaatgaaggccacggtaaattcctggcggctgcccagaatccagcagacgaccccgctccgggagcccctgcaccccaggaattgggtgcggcagataagcagggtggattcgaagacaagatccccaaacgacgcttctcagaaatgcagaacgaacgtcgcgagcaggctcagcgcacagtgctcatacactgtcctgaaaaaatatctgaaaataaattcctgaagtacctcagccagttcggcccaatcaataaccacttcttctatgagtcgtttgggctttatgcagtggtagaattttgccagaaagagagcatcgggtccctacagaatggcacccataccccctcgacagcaatggaaaccgctatccctttcagatctaggttctttaatctaaagctcaagaatcagacgagcgagaggagccgcgtacgtagttctaaccagctgccccgtagcaataaacaactttttgagctgctctgttatgcggagagtattgatgatcagcttaacaccctgttgaaggaatttcagctcacggaagagaacacaaagctgcgatacctgacctgtagcctgattgaagatatggccgctgcatacttccccgattgcatcgtgaggccattcgggagcagcgtaaacacctttgggaagctgggctgcgatctagatatgttcctggatctggacgaaacacgaaacctgtctgctcataagatttctggcaactttcttatggagttccaggttaaaaacgtaccttctgagaggatcgcaacccagaaaatcctaagtgtcctgggtgagtgtctggatcatttcggacccggatgtgtgggcgtgcagaaaatcctcaacgccagatgccctctcgttcgatttagtcatcaagcctcgggattccaatgtgatctgaccacaaacaaccgaatcgccctgacctcaagcgaattgctgtacatctacggggcactggatagtagggtcagagctctagtgtttagcgtcaggtgttgggctcgtgcgcatagcctcaccagtagtattcccggtgcttggatcacaaacttcagcctgaccatgatggttatattctttctccagcgcagaagcccaccaatcttgcccactctcgacagtctgaaaaccctggccgatgccgaagacaagtgtgttattgagggaaataattgtacatttgtgcgggaccttagtcggatcaagcccagccagaacaccgagacactggaacttctgctcaaggaatttttcgagtacttcgggaacttcgcattcgataaaaattcaattaacattcggcagggaagggaacaaaataaacccgacagtagcccactttacattcaaaatcccttcgaaacatctctgaatatttccaagaatgtctcacaaagtcagttgcagaagttcgtcgatctcgccagggaatcggcctggattctgcagcaggaagacacggaccggccaagtatcagtagcaaccgcccatggggacttgtgagcctcctgctcccatccgccccaaaccgaaaatcgttcacaaagaagaagtctaacaagttcgctatcgaaactgtgaagaacctcctggaatccctgaagggaaaccggactgagaacttcacaaaaacatctggaaagcgaacaataagcacacaaacctag

SEQ ID NO: 230666 - DNA, 660 bp, Artificial Sequence
  Description of Artificial Sequence: Synthetic coding sequence
atgcaaaatgagcgcagggagcaggctcaaaggaccgttctcattcattgtcctgagaaaattagcgagaacaaattcctcaagtatcttagccagttcggcccaattaataaccattttttttatgagtcctttgggctgtatgcggttgtggaattttgtcagaaggaatcgattggatctctgcaaaacgggacccacaccccctcaacggcaatggaaacagctatcccattccgaagtcgttttttcaacctcaaactcaagaaccagacttcggagcgcagtagagtgcgatccagtaatcaattaccaaggagtaacaagcagctcttcgagctcttatgttatgcagaatccattgacgatcagttaaacacattacttaaagagttccagctgactgaggagaatacaaagttaagatatctgacgtgcagcctgattgaggacatggctgccgcatacttcccagattgcatagtgcgcccttttgggtcaagcgtgaacacttttgggaagttgggttgcgaccttgacatgtttctggatttggacgagaccaggaacctgtccgctcacaagattagtggtaactttctcatggaattccaggtcaaaaacgtccccagcgaacggatcgctacacagaaaatctag

SEQ ID NO: 230667 - DNA, 453 bp, Artificial Sequence
  Description of Artificial Sequence: Synthetic coding sequence
gatcttaggcgggacgagcaacccagcggaagtgtcgagaccggttttgaagacaagattcctaaacggagattttccgaaatgcagaacgagaggcgcgagcaggcccagcggacagtactgatacattgccccgagaagatttctgagaacaaattcctgaaatacctctctcagtttggtccaatcaacaatcacttcttttatgaaagttttggtctgtatgccgtggtggagttttgtcagaaagagagcatcgggtctctccagaatggcacccatacacccagcaccgctatggagaccgcaatcccatttcgatccaggtttttcaaccttaagctgaaaaaccagactagcgagcggagcagggtgaggagcagcaaccagctgcccaggtccaacaagcagctcttcgaattgctgtgttacgctgagagtgtgagcttctag

SEQ ID NO: 230668 - DNA, 309 bp, Artificial Sequence
  Description of Artificial Sequence: Synthetic coding sequence
atgttcctgaccgcacttctgtggaggggacgcattcccggtaggcagtggatcggcaagcaccgcagacctcggtttgtttccctgcgagcaaaacagaacatgattcgacggctggaaatcgaagccgagaaccattactggctctcaatgccatatatgacccgcgagcaggaacgcggacatgccgcagtgcgcagaagagaagcctttgaagcgatcaaggccgcagccactagcaaatttcctccccatagatttattgcggatcagttagatcaccttaatgtaactaagaagtggtcatag

SEQ ID NO: 230669 - DNA, 978 bp, Artificial Sequence
  Description of Artificial Sequence: Synthetic coding sequence
atggctgcagctgtgaggtgtatgggcagggcgcttatacaccatcagagacacagtctgagtaagatggtgtaccaaaccagcttgtgttcatgtagcgtaaatattcgagtgccaaacaggcatttcgccgcagccactaagtctgccaaaaagactaagaagggcgctaaggaaaaaactcctgatgagaaaaaagatgaaatagagaaaatcaaggcctacccgtacatggaaggggaacctgaagatgacgtttaccttaaacgcttgtatccccgtcagatttatgaagtggagaaggctgtgcatctgctgaagaagttccagatccttgattttacgtcccctaaacagtcagtctacctcgatctcactctggatatggcattgggaaaaaagaagaatgttgagcccttcacaagcgtcctgagtctgccctaccctttcgccagtgagattaataaggtggccgtgttcacagagaatgcttctgaagtgaagattgccgaggaaaatggagccgctttcgcgggaggtacatctttgattcagaagatctgggacgacgaaatagtcgcagatttctacgtggccgtgcccgagatcatgcccgaattgaaccgtctgagaaagaagttgaataagaagtaccctaagctgagcaggaacagcatcggccgtgatatacctaaaatgttggagctgtttaaaaatggacacgagatcaaagtcgatgaagaacgcgaaaattttctgcaaaccaagatagctaccctcgacatgagtagcgaccagatcgcggcaaacctgcaggcagttatcaacgaggtgtgtcgccatcgcccactcaacctcggaccttttgtggtgagggccttcctacgttcctcaacctcagaggggctgcttctgaagatcgaccctttactgccaaaggaggtgaagaacgaagaatccgagaaggaagatgcttag

SEQ ID NO: 230670 - DNA, 909 bp, Artificial Sequence
  Description of Artificial Sequence: Synthetic coding sequence
atggtatatcagacaagcctgtgttcatgcagtgtgaatatcagagtgcccaaccgccattttgcagcggctacaaagagtgccaaaaagactaagaagggggctaaggagaagacaccagacgaaaaaaaagacgaaatagagaaaatcaaggcctacccatatatggagggagagcctgaggatgacgtctatctgaagaggctctacccaaggcaaatttatgaggttgagaaagcagtccacctgcttaaaaagttccagatactcgattttacttctccaaaacagtctgtgtacctggacctcacacttgacatggccctgggcaagaagaagaacgtcgaaccgttcaccagcgtgttgagcctgccctacccttttgcctccgaaataaataaggtggccgtgttcacagagaacgcctcagaagtgaaaatcgccgaggagaacggggcagcctttgccggtggcactagtttaatccagaagatttgggacgatgagatcgtggccgatttctacgtagccgtacctgaaattatgcctgagcttaatcgtctgcgcaagaaactgaataaaaaatatcccaaactgtccaggaattctatcggcagggacatcccgaagatgctggaactgttcaaaaatggccacgagataaaagtggatgaggagagggaaaatttccttcagaccaaaattgccaccttggatatgtccagcgaccaaattgcagccaatcttcaggcagttatcaatgaggtctgcaggcacagacccctgaacctgggcccattcgttgttagagctttccttaggtccagcacgtccgaagggctcctgctgaaaattgatccgctcctgccaaaggaaatcaagagtcagcctaaaaagaaaaaaaactag

SEQ ID NO: 230671 - DNA, 816 bp, Artificial Sequence
  Description of Artificial Sequence: Synthetic coding sequence
atgatcagcgctcattgcaacctccacttgcctgggtccagtgacagtcccgcttctgcttcacaggtggccggtatcaccggaaggttgcctacgctccagactgtacgctatggcagcaaagccgtcacgagacaccgcagagtcatgcactttcaaagacaaaagcttatggctgttactgagtatatccccccaaaacccgctattcacccatcttgcttacccagccctccttccccacctcaagaagagataggacttatccggctactgaggagggagatcgccgcagtatttcaggataataggatgatagccgtctgtcaaaacgttgctttgtcagccgaagacaaattgttgatgaggcaccaacttagaaagcataagatactgatgaaggtgttccctaaccaggtcctgaaaccctttctagaagattctaaatatcagaatctgctaccgctcttcgtgggccataatatgttgctggtgtccgaggaacccaaggttaaggaaatggtgcggattctaaggaccgtcccattcctgccgttgttaggaggttgtattgatgataccatcctcagcaggcagggatttattaactattctaaactccctagtttacccctcgtccagggcgagctggtcggtggactcacatgtctgacagctcagacgcactctttactgcagcaccagcctctgcaattgaccacactccttgatcagtatattagagaacaacgggaaaaggacagcgtgatgtctgccaatggtaagcctgatcccgacactgtgcccgacagctag

SEQ ID NO: 230672 - DNA, 786 bp, Artificial Sequence
  Description of Artificial Sequence: Synthetic coding sequence
atggctgcagctgttgccggtatgctcaggggcggtctcctgcctcaggcaggcaggctccccaccctgcagactgtgcgttatggctcaaaggcggttaccaggcaccggagagttatgcactttcagaggcaaaagttgatggccgtcacggaatatatcccccctaaacctgccatacatccatcatgccttccttcccctcccagtcctccccaggaggagatcggtctgatccggttgctgcggagagagatcgccgctgtgttccaggataaccgcatgatcgcagtctgtcagaatgtcgccctttcagcagaggacaagttactgatgaggcaccagttgagaaagcataagatactaatgaaggttttcccaaatcaggtcctgaaaccctttttagaggattcaaaatatcagaacttattacccctttttgtaggacacaacatgttactagtcagcgaggaaccgaaagtgaaggaaatggtgcgcattctccggaccgttccattcctccccctgctcgggggatgcatcgacgacactatcttgtcccgacaagggttcatcaactacagcaagttgccttcattaccgctggtgcagggggagctcgtgggtggcctgacctgtctcacggcccaaactcactcactgttgcagcaccagcctttgcagctgacaaccctgctggaccagtatattagagagcagagagagaaggactccgttatgtctgccaatgggaagccagacccggatacagtccctgactcctag

SEQ ID NO: 230673 - DNA, 816 bp, Artificial Sequence
  Description of Artificial Sequence: Synthetic coding sequence
atgatcagcgctcactgtaatctccatttaccgggatcctctgacagtcctgcatcagctagccaggtcgctggcattactggcaggctcccaacactccagactgtccggtacgggtcaaaggcggtcacgcgtcaccgcagggtaatgcactttcagcgccagaagttaatggcagtaactgagtatattccacccaagccagcaattcacccctcatgcttgccgtctccacccagcccaccgcaggaagagataggccttatcagactgcttaggagggaaatcgcggcagtctttcaggataatcggatgatcgcggtgtgccaaaacgtcgccctatcggcagaagacaaattgttgatgcgccaccagctccgtaagcacaaaattttaatgaaggtctttcctaatcaagtgctgaaaccttttctggaggacagtaagtaccagaatttactcccactgtttgtggggcacaatatgcttttggtgtctgaggagcctaaggtcaaagaaatggtgcgaatcctgcggacagtcccctttctaccactcctggggggttgcatagatgatacaatcctaagcaggcagggcttcatcaattattcaaagctgccatccctgcctttagtccagggcgagctggtcggaggactgacctgccttacagctcagacacatagcctgcttcagcaccagcccttacagcttacaactctcctggaccaatacattcgggagcagagggagaaagactccgtcatgagcgccaacggtaaacccgacccggatactgtgcctgatagttag

SEQ ID NO: 230674 - DNA, 579 bp, Artificial Sequence
  Description of Artificial Sequence: Synthetic coding sequence
atgtccaaactggggagagctgcaaggggactgcgcaagcctgaagtcggaggcgtcattcgtgccatcgtgagggctggcctggcaatgcccggtccacccctaggtcccgtgctggggcaacgaggagtgagtataaatcaattctgtaaagagtttaatgaaagaaccaaggacatcaaagaaggcatcccgctgccaaccaagatcctggttaagccagaccggacttttgaaattaagatcggccagccaaccgtgtcatacttccttaaggccgctgcaggaattgagaaaggcgctcgccaaactggaaaggaagttgctggccttgtaacattgaagcatgtgtatgaaatagcgaggatcaaggcacaagatgaagcattcgcactgcaagatgttccgcttagttccgttgtgcgcagcatcatcgggtctgccaggagtttgggcatccgtgtggtcaaggacttgtctagtgaggagctcgctgctttccagaaggagcgagctatatttcttgccgcacagaaggaggctgacctggcagcccaggaggaggcagcgaagaagtag

SEQ ID NO: 230675 - DNA, 546 bp, Artificial Sequence
  Description of Artificial Sequence: Synthetic coding sequence
atgtccaaacttggcagggctgctagggggctacggaagccggaagtgggcggagtgatccgcgctattgtgcgagcaggactggcgatgcccggaccgcctctgggccctgttttagggcaacgcggtgtgagcatcaatcagttttgtaaagagttcaacgaaaggaccaaggatattaaagagggaatccctctgccgactaagatactagttaagcccgatcgaacctttgagatcaaaatcggtcaacccacggtgagttattttcttaaggccgctgctgggatcgaaaaaggggcacgtcaaaccgggaaagaggtggctggcctcgtgacattgaagcatgtgtacgagattgctagaattaaagcccaagatgaggcgttcgcgctacaagatgtgcccctgtcatcagtggtgcggtccatcattgggagtgcgcgaagccttgggattcgcgtcgtgaaggaacgctgctcggcaaatgttttgcggaatgggaagattagcatgaaggatcctagtgggcgaagctcagtgtag

SEQ ID NO: 230676 - DNA, 501 bp, Artificial Sequence
  Description of Artificial Sequence: Synthetic coding sequence
atgagcaagttggggagagccgctcggggactgcggaagcctgagcgcggagtgagtataaatcagttttgcaaggagtttaacgagcgtacaaaagacatcaaggaaggaattccgcttcctacaaagattttggtgaagcccgaccggacgttcgaaattaaaattggccagcccaccgtgtcgtactttttaaaagctgctgcgggaatcgaaaaaggggcaaggcagactgggaaggaggtggcaggactggtgaccttaaagcatgtgtacgagatcgcgcgaatcaaagcacaggacgaggcattcgccctccaggacgttccactcagctctgtcgttcgttccattattggatccgctaggtctctcggcattcgggtagttaaagaccttagttctgaggagctggcagcttttcagaaagaacgtgcgatcttcctggcggctcagaaagaggccgacctggccgctcaagaggaagccgcaaagaagtag

SEQ ID NO: 230677 - DNA, 891 bp, Artificial Sequence
  Description of Artificial Sequence: Synthetic coding sequence
atggccgcagaagcaagggtgtcaaggtggtactttggtgggctcgcttcctgtggtgcagcgtgctgtacacaccctctggatctcctcaaggttcaccttcagacccagcaggaagtaaaactgcgcatgaccgggatggcattgagagtcgtaaggactgacggaatattggccctgtactccgggctctctgcctctttgtgccgacaaatgacttactcccttacacgcttcgccatctatgaaacggtgagagatagggtcgccaaaggttcccagggcccactgcccttccacgagaaggtcctgctgggatccgtttccggcctcgcgggagggttcgtgggcacgcctgccgacctcgtcaacgtgaggatgcaaaatgacgtcaaattaccccagggacagaggcgaaactacgcgcatgctttagatggcctttatagagtagcaagggaagaaggcctccgcagattgttttcaggggcaactatggcaagcagtcggggagcccttgtgactgtgggacagctatcttgctacgatcaggcaaagcagctcgttctgtctactggatacctgagcgacaacatcttcacccactttgtggcctcctttatcgccgcagctggcgacgagcccccaccgcaaggtgggtgcgccacatttctgtgccagcccttagatgttctcaagacacgactgatgaactctaagggtgagtaccaaggggtttttcattgcgcggtcgaaaccgctaagttgggcccactcgcattctataaagggttggtgcccgctggaatcagattaataccccacactgtgctgaccttcgtctttcttgagcagctcagaaagaacttcgggattaaagtcccgtcctag

SEQ ID NO: 230678 - DNA, 537 bp, Artificial Sequence
  Description of Artificial Sequence: Synthetic coding sequence
atgctgcctgctgctgcacggccactctggggcccttgcttggggctgagagccgctgcctttagacttgcccgaaggcaagttccatgcgtgtgcgccgtgcggcacatgaggagcagtggccaccagcgctgcgaggcactggctggtgcgcctcttgacaatgccccaaaggaatatccccctaagatccagcaactcgtgcaggatatcgcttcactgactctgctggagatctctgacttaaatgagctacttaaaaagaccttgaagattcaggatgtcggtctggtccccatggggggtgtcatgagtggcgctgttccggctgccgctgcacaggaggcggtagaagaagacatcccgatcgctaaggagcggacacacttcacagtgaggctgaccgaagccaaaccagtcgataaagtaaaacttataaaagagattaaaaattatattaaagccagcacgtcttccaggcagagaagctggtggagcccctgtccaggcaaccagagccaatgccgacagtcatag

SEQ ID NO: 230679 - DNA, 597 bp, Artificial Sequence
  Description of Artificial Sequence: Synthetic coding sequence
atgctgcctgccgctgccagaccgctttggggtccttgcctcgggcttcgtgccgcagcattcaggttagcacggagacaggttccttgcgtctgtgctgtccggcatatgcgcagcagcggccaccaacggtgcgaggctctggccggagcacctctggacaacgctcccaaagagtaccctccaaagatccagcagctcgtgcaggatatcgccagcctgaccttgttggaaatctcagatctgaacgagctgctgaagaagaccctgaagatccaggatgtgggattggtgcccatgggaggcgtgatgtctggggcagtccccgcagccgcagcgcaggaggctgtggaagaagacattcctattgccaaggaacggacacacttcaccgtccgacttacagaagccaagccagttgacaaggtgaaactgatcaaagagatcaaaaattacatacaaggcatcaatctggtgcaggcaaaaaagttggtggagagcctgccccaggagatcaaggctaatgtggctaaggcagaggcagagaagatcaaagccgcactggaggctgttggcggtacggtcgtcctcgagtag

SEQ ID NO: 230680 - DNA, 864 bp, Artificial Sequence
  Description of Artificial Sequence: Synthetic coding sequence
atggcagccgaggcacgcgtgagccggtggtacttcgggggtctcgcgtcctgcggggctgcttgctgcacacaccctctggatcttctgaaagtccatttgcagacacagcaggaggtaaagctgaggatgactggcatggctctgcgcgtggtccggaccgacggtatcctcgctctctattcagggctgtcagcctctctgtgtaggcaaatgacttactcactcactagattcgcgatctatgaaaccgttcgggatcgcgtcgcgaagggctctcaaggaccgctgcccttccatgaaaaagtcctgctgggaagcgtgtctggactcgcaggcggtttcgttggcaccccagccgacttagtgaatgttaggatgcagaacgacgtcaaactgcctcaggggcagaggaggaattatgcccatgccctggatggcctttatagggtggctagagaagagggcctacgcaggcttttttccggggcaacaatggctagcagtaggggagcactggttaccgtaggccagctttcatgctacgatcaggccaagcagctggtgctctccaccggatacctgagcgacaacatttttactcacttcgtggcctccttcatcgccggaggatgcgcaacattcctgtgccagccactcgacgttcttaaaacaaggctgatgaattcgaaaggcgaataccaaggtgtgtttcattgcgctgttgagacggctaagctaggcccactggcattttataaagggctggtcccagccggaatcaggttgatcccgcataccgtcctgacatttgtgtttctggaacagctccggaaaaactttgggatcaaagtaccttcgtag

SEQ ID NO: 230681 - DNA, 1329 bp, Artificial Sequence
  Description of Artificial Sequence: Synthetic coding sequence
atgctgccagctgcagcccgtcctctctggggaccttgtctgggcctgagggccgctgcgttcagactggcaagacgccaagtgccttgtgtgtgtgctgtacggcatatgaggtcctctgggcaccaaaggtgcgaagctctcgctggcgcaccgctggataacgcacccaaagaatatcctccaaaaatccaacaattggtccaggacatagccagcttgacactgctggagatctccgatttgaacgagctcctgaagaaaaccctaaagatccaagacgttggtctcgtgcctatggggggagtcatgagcggggcagtgccagccgctgccgctcaggaggcagtggaagaggacatcccaatagcaaaggagagaacacactttactgtgcgccttacagaagccaagccagtagacaaagtgaagctaatcaaggaaattaaaaactatatccaggggatcaacctggtacaggctaaaaaacttgttgagagtctcccacaagaaattaaggccaacgtggctaaggcagaggcagaaaagattaaggccgcactcgaagccacccaacaggaagtgaaactccggatgacaggaatggccctcagggtcgtgcgcactgacggcattttggcactgtacagcggcctgtcagcatcactttgtcggcagatgacctattcacttacccggtttgccatctacgaaactgtgcgggatagggtggccaagggaagccagggaccactgccgtttcacgaaaaagtgctactgggctccgtgtcaggtttggctggtggattcgttggtacgcccgctgatctcgtgaatgtgcgcatgcaaaatgatgttaaactgccacaagggcagaggcgcaactacgcccatgctcttgatggcctctatcgggtcgcaagagaagaaggccttcgccgactcttcagcggcgctactatggcatcttcgaggggtgcactcgttaccgtaggccagctgagttgctatgatcaggccaaacaactagtgctctcaacaggctacctgtccgacaatatcttcacacactttgtcgcaagcttcatcgcgggagggtgcgccacatttctgtgccagccactggatgtgctaaagacacgcctcatgaacagtaagggagaataccagggagtgttccattgcgcagtggagaccgcaaagcttggccctcttgcattctataaaggtctggtcccagcgggaatccgcctgattccccacaccgtgctgacttttgtattcttggagcagctccgcaagaatttcggaattaaagttcctagttag

SEQ ID NO: 230682 - DNA, 735 bp, Artificial Sequence
  Description of Artificial Sequence: Synthetic coding sequence
atgaccggcatggccttgcgggtggtgaggactgacggtattctggccctctattccggacttagcgctagcctttgcagacagatgacgtattcattgacccgttttgccatctacgagaccgtcagagaccgagtcgccaagggctcccagggccctttgccgtttcacgaaaaagttctcctggggtctgtgagcggacttgctggaggctttgtgggaaccccagccgatctggtcaacgtgaggatgcaaaacgacgtcaaactgccccaaggacagcggcgaaattatgctcatgccctggatggcctgtacagggtggctcgggaagagggcttgcggaggctgtttagcggagctaccatggcgagttccagaggagccctcgttacagttggacagctgagctgctacgatcaggctaagcaattggtgcttagtactggatacctgagtgacaatatcttcacgcatttcgtagcttctttcattgccggaggatgcgccacttttctgtgtcagcctctagacgttttgaaaacaaggctgatgaactcaaagggagaataccagggggtcttccactgtgccgtagaaactgccaagttgggacctctggcgttctataaggggctcgtgccagctggaatccggctgatcccacatacagtgctgacatttgtattcctggaacagttgcggaagaacttcgggatcaaggtgccctcctag

SEQ ID NO: 230683 - DNA, 438 bp, Artificial Sequence
  Description of Artificial Sequence: Synthetic coding sequence
atggcatttttcacaggactgtggggaccctttacatgcgtctcgagggtgttatcccaccattgtttttcaaccacagggtccctatccgcaattcagaagatgaccagggtacgagtcgtagataactccgcgcttggtaattctccttaccatagagcgccaaggtgcatccatgtgtacaaaaagaatggcgttggcaaagtgggggaccagatcctcttggctatcaaggggcagaagaaaaaggccctgatagttggccattgtatgcccggacctcggatgacccccaggtttgattcaaacaacgtagtactgattgaagacaacggtaatcccgtcggtacccggatcaaaacccctattccaacctcacttagaaaacgggagggggagtactccaaggttttggcaattgcccagaactttgtctag

SEQ ID NO: 230684 - DNA, 891 bp, Artificial Sequence
  Description of Artificial Sequence: Synthetic coding sequence
atggcaggcccactgcaggggggaggcgctcgcgcactggacctgcttcgaggcctgcctagagtcagcctagccaatctgaagcccaaccctgggtctaagaaaccagaaagacgcccacggggaaggcggagaggacggaaatgcgggagggggcacaaaggcgaaaggcaacgagggacacggccacggttaggcttcgaagggggtcagacaccgttctatattagaattcctaaatatggcttcaacgaggggcacagcttccgacggcagtacaagcctctttccctcaatcgccttcaatatctgatcgacctcggccgagtcgacccttctcagcccattgacttaacgcagctggtgaacggcaggggcgtgactatccagcccttgaaacgtgactacggggttcaattagtggaggagggcgcagatacgttcacggcaaaggtgaacattgaagtgcagcttgcgtcagagctggctatcgcggctatcgagaagaacggcggagtcgtgactacggccttctatgaccctcgctccctagacatcgtttgcaagccagtgcccttttttttgagagggcagcccatccccaagaggatgctcccccctgaggagctagtgccttattataccgacgccaagaatcgcggttatctggccgaccccgcaaagttcccagaagcacgactggagctcgccagaaaatacggatacatcctgcccgatattacaaaggatgagctgttcaaaatgctatgtacccgtaaagatccgaggcagatcttttttggactggcacctggttgggtggtcaatatggctgacaagaagatcctgaagccgactgatgaaaacttgcttaaatattacacaagctag

SEQ ID NO: 230685 - DNA, 756 bp, Artificial Sequence
  Description of Artificial Sequence: Synthetic coding sequence
atgtggcgactgctggccagagcttccgcacccctattgcgcgtccctctgtctgactcctgggctttacttcccgcttctgcaggggttaagactttgctgcccgtcccatccttcgaggacgtgagtattcccgagaagcccaaattacgtttcatcgaacgggctcctctggttcctaaagttagacgggagccaaagaacttgagcgacatacgcggaccttctacagaagcgactgagttcaccgagggcaatttcgccattctggcactaggaggaggctacctccactggggacattttgagatgatgcgcttaacaatcaacagatcgatggatccaaagaacatgttcgctatttggcgggtgccggcacctttcaagcccatcacccgcaagagcgttgggcaccgaatgggagggggaaaaggggctatagaccattatgtcactcccgtgaaggcgggacgtctggtcgttgaaatgggcggaagatgcgagttcgaggaggtgcagggctttctggatcaggtagcgcataagttgccctttgccgctaaagccgtgtcccggggtaccctagagaagatgcgcaaagaccaggaggaaagagaacggaacaaccaaaatccatggacgttcgagcggattgctaccgccaacatgctgggtattagaaaagtgctctcaccctatgatctgacccataaggggaagtactggggcaagttctacatgcctaagcgtgtgtag

SEQ ID NO: 230686 - DNA, 528 bp, Artificial Sequence
  Description of Artificial Sequence: Synthetic coding sequence
atgaggttgtcagtagccgctgctatatcccacgggagagtatttcgccgaatggggctgggacctgaaagccgcattcacctcctgcggaacctgcttaccggcctcgtgcgccatgagcggatcgaagccccatgggctcgcgttgatgagatgcggggatacgccgagaaactgatagactacggcaaactcggcgacactaacgagagagctatgcgcatggcggacttttggcttactgagaaggacctaattcccaaactatttcaggtgttggcccctcgatacaaagaccagaccggaggctatacaaggatgttacagatcccaaatcgatcacttgatagggctaaaatggctgtcattgaatataagggcaactgtctaccgcctctgccccttccgcgacgggacagccatttaactctcttgaatcagttactgcaggggttgagacaggatctgcggcagagccaggaagcatcaaaccactcaagccatacagcacaaacccccggtatctag

SEQ ID NO: 230687 - DNA, 543 bp, Artificial Sequence
  Description of Artificial Sequence: Synthetic coding sequence
atggctctgcgctcgaggttctggggactgttttcagtgtgtcgaaatcctggatgtaggtttgcagctctttctaccagtagtgaacctgccgcaaagcctgaggtggaccccgtcgagaacgaggcagtggcccctgagttcactaatcggaacccgagaaatttagagctgctgagcgttgccagaaaagaacgtggttggcggactgtgttcccttcacgagagttctggcaccggctgagggtaatcagaactcaacatcatgtcgaagccctggtcgagcatcagaacggcaaagtggtggtgtccgcctccaccagagagtgggccattaagaagcacctttactcaacccggaatgtagtcgcgtgcgaaagcattggtagggtgctggcccaaagatgcctggaagctggcataaattttatggtttatcaacccaccccctgggaagcagcctctgactcaatgaagaggttgcagtctgcgatgaccgaaggcggtgttgtgctgcgggaaccacaaaggatctatgagtag

SEQ ID NO: 230688 - DNA, 879 bp, Artificial Sequence
  Description of Artificial Sequence: Synthetic coding sequence
atggctgcctgcatcgcggcaggacattgggccgctatgggactgggtagatctttccaggctgctcggacgctgctgccaccgccagcttctattgcctgcagagtacacgcaggtcctgttcggcagcaatcaaccgggccaagcgaacctggggctttccagccccctcctaagcctgtcattgtggacaagcatcggccagtcgagcctgaacggaggttcttgtccccagaatttatcccgagacggggtagaacggacccattgaaatttcagattgaaaggaaagacatgcttgagcgacgaaaggttctacatattcctgaattctacgtagggagcattcttcgtgtcactaccgctgacccttacgcaagcggcaaaatcagccagtttctcggtatttgcattcagagaagcggaagaggacttggcgctacctttatattgagaaacgtgatcgagggccagggtgttgaaatctgcttcgagctctataacccacgcgtgcaggagatccaggtagttaaactggagaaacgcctggacgactctttactgtatcttcgcgatgccctgcccgaatatagcacatttgatgtgaacatgaaacccgtagtgcaagaaccgaaccagaaggtcccagtgaatgagctgaaggtcaagatgaagcctaaaccctggagcaaaagatgggaaagacccaatttcaatattaaggggatccgatttgacctgtgcctgacagagcagcagatgaaagaagcacaaaagtggaaccagccatggttagagttcgatatgatgcgggaatatgacaccagtaagatcgaggccgcaatttggaaagaaattgaagcgtccaagagaagctag

SEQ ID NO: 230689 - DNA, 879 bp, Artificial Sequence
  Description of Artificial Sequence: Synthetic coding sequence
atggcagcatgcattgctgcaggccactgggccgctatggggcttgggagatcattccaggctgcccgtactctattacctcctcctgcatcaatcgcttgcagggttcacgccggtcctgtgagacagcagtctactggtccaagcgagcctggcgcttttcagcctcccccaaaacctgtgattgtggacaaacaccgacctgtcgaacctgagcgtcggttcctttctcctgagtttataccgagaagaggccgtaccgaccctctgaaattccagatcgagcggaaggatatgttagagcggcgaaaggtattacatatcccggagttttacgtcggttcaattttgagggtgacgactgcggatccctatgcttcagggaagatttcccaattcctcggcatctgtatacagagaagtgggcgtggattaggggcaacatttattctcagaaatgttatcgaagggcaaggtgtggaaatctgctttgagttgtataaccccagagtgcaggaaatccaggtcgttaaacttgagaaacggctagatgattctctgctttacttaagagacgctctgcccgaatactctacattcgatgtgaacatgaaaccggtagtgcaggagcctaaccagaaagttcctgtgaatgagctgaaagttaagatgaagccaaagccctggtctaaacgatgggagcggccaaactttaatataaagggtattagattcgatctgtgcctcaccgaacagcagatgaaggaagcccagaaatggaaccaaccgtggctggaatttgacatgatgcgggaatatgacaccagtaagattgaggccgctatttggaaggagatcgaggcttcaaagcgatcctag

SEQ ID NO: 230690 - DNA, 240 bp, Artificial Sequence
  Description of Artificial Sequence: Synthetic coding sequence
aaagtgccagtcaacgaacttaaagtgaaaatgaaacccaaaccatggtcgaaacgatgggagaggcctaacttcaatatcaagggcattcgattcgacttgtgcctcaccgaacagcagatgaaggaggctcaaaaatggaatcagccctggctggaatttgatatgatgcgggaatatgatacatctaagatcgaagccgcaatatggaaggaaatcgaagccagcaagcgaagttag

SEQ ID NO: 230691 - DNA, 918 bp, Artificial Sequence
  Description of Artificial Sequence: Synthetic coding sequence
atggccctctgtgcccttaccagggcactgcgaagccttaatcttgcaccccctaccgtcgcggctccagcgccttctctgtttccagccgcacagatgatgaataacgggctgctacagcagccttctgccctgatgcttctcccttgccgcccagttctgaccagcgtggcgctcaatgctaacttcgtgagctggaagtctcgcacaaagtacactataacaccagtgaaaatgaggaagagcgggggtcgcgaccataccggtagaattcgagtgcacggtatcgggggtggtcacaaacaacgctaccgcatgatcgactttctgcgattccgccctgaggagactaaatccggacctttcgaagagaaggtaatacaagtaagatatgatccttgcaggtcagccgatatcgcattagtggcaggtggctcgcgaaagcgctggattatcgccactgagaacatgcaggccggagatacgatcttgaactcaaaccatattggcaggatggctgttgcagctagggagggtgacgcccacccccttggagcccttccagtgggaaccctcattaacaacgtagaaagtgaacccggtcgcggtgctcaatacatccgggctgccggtacctgcggagtcctcctcaggaaggtgaacgggacggccattattcagctcccttctaaaagacagatgcaggtacttgagacctgtgtagctactgtgggcagagtttctaatgtggaccacaacaagagggtgattgggaaagccggtcggaatcggtggctggggaaacggcctaacagcggcagatggcatcgaaagggcggttgggccggaaggaaaattagaccgctccccccaatgaaaagctacgtgaagctgccttcagcttcagcgcagagctag

SEQ ID NO: 230692 - DNA, 450 bp, Artificial Sequence
  Description of Artificial Sequence: Synthetic coding sequence
atggtgtttctcacagcccagctgtggctccgaaatagggtgactgaccggtactttaggatccaagaggtcctaaaacacgctcgtcactttcgaggtagaaagaacaggtgctaccgcctggctgtgcggactgtgatccgcgcatttgtgaagtgcactaaggccagatacctgaagaagaagaacatgcggactttgtggattaatagaataaccgccgcttcacaagagcacggattgaagtatcccgcattgatcggtaacttggttaaatgtcaggtggagctgaataggaaagtgctggcagaccttgctatttacgagcctaagaccttcaagtccttggctgctctggccagtagacggcgacacgagggttttgccgctgccctgggcgatggtaaggagcctgaaggcatcttcagtcgggtcgtgcagtatcactag

SEQ ID NO: 230693 - DNA, 618 bp, Artificial Sequence
  Description of Artificial Sequence: Synthetic coding sequence
atggccgcaagttccctgaccgtgacactcggtaggctggcctcagcctgcagtcactccattctgcggccaagcggaccaggggctgccagtctttggtcagcatctcggagatttaacagtcagagtacctcttacctaccgggttatgtgcctaagacatcactctcatctccgccatggcccgaggtggtcttacccgatcccgtagaagagactcggcaccacgccgaagtcgttaaaaaagttaacgaaatgatcgtgacgggacaatacgggagactttttgctgtggttcacttcgcctccaggcagtggaaggtcacttctgaggatttgatactgatcggcaacgagctcgatttggcctgtggcgaacgaatcagactggagaaagtcttgctcgtgggcgctgacaatttcaccctgctgggcaaaccactcctcggtaaggaccttgttagagtggaggcaacagtgattgagaagacagagagctggccgaggatcatcatgaggttcaggaagcgtaagaattttaaaaagaagaggatcgtaacgacccctcagacagtgttgagaattaactcaatcgagatagccccatgtcttctgtag

SEQ ID NO: 230694 - DNA, 843 bp, Artificial Sequence
  Description of Artificial Sequence: Synthetic coding sequence
atggcagcatcatcgctgacagtgactctgggccgtcttgcctcagcttgctcacacagtatactccgcccatctggacctggcgctgcatctctttggtccgcgtctcgtcgatttaattcacagtccacctcatacctgcctggatacgtgcctaagacgtcgctgagcagtcctccatggcccgaggtcgtattgcctgacccagtcgaagagacacgccatcacgccgaagtagtaaagaaagtaaacgagatgatcgtgaccggtcagtatgggaggttgttcgcggtggtgcatttcgcgagcaggcagtggaaagtgacgtctgaagacctgattctgatcggcaacgaactagacttggcttgtggtgaacggattcgtctagaaaaggtgctgctggtgggcgctgacaattttactctgttaggcaaacccttactgggaaaagacctcgttcgcgtggaagccacagtcatagagaagacagagtcctggcccagaatcatcatgcgctttagaaaacgtaaaaactttaagaaaaaacggagcaagctggagaaggtgccactcggccctgttgccagatgctggttgcctcgacgtatgcgaactgaaggagtagggcacgtgggcctgggaactggctcacccggtagatcgcagcctgggtgccactgtcctcttgctaccttgatcctcgagggggcaccacgcggtagcagtctggcccctctcctgctgcacgctccgagggtgacacctcctcggtcgccttctccaccaaggtccgctcgggatcctactagcctgccgttctcctccactcttcgcgcatag

SEQ ID NO: 230695 - DNA, 363 bp, Artificial Sequence
  Description of Artificial Sequence: Synthetic coding sequence
atgatcgtgacgggacagtacgggcgtctgtttgctgtcgtgcattttgcttctcgacagtggaaagtaacttctgaagatttgatactcattggaaacgagctggaccttgcttgcggggagagaatacggctggagaaagttttactggtgggcgctgataacttcaccttgctcggcaaacctctcttaggaaaggatcttgtgagagtagaagccactgtaattgaaaaaactgaaagttggcccaggatcattatgcgctttaggaaacgcaaaaactttaagaaaaagcgcatcgtgactacaccacagaccgtgttacggatcaattccattgagatcgccccatgcctgttatag

SEQ ID NO: 230696 - DNA, 381 bp, Artificial Sequence
  Description of Artificial Sequence: Synthetic coding sequence
atgtggtaccttgccaagctcatcagaggaatgagcatcgatcaggcacttgcgcagctggagtttaatgacaaaaagggcgcaaagattatcaaagaagtgctgctggaagctcaggacatggccgtgcgtgatcacaatgtcgagtttaggagcaacctgtacatcgctgagtcgacgtctggcagaggccagtgcctcaagagaatccggtatcatggccgagggaggtttggtatcatggaaaaagtgtactgtcactactttgtaaagctcgtcgaaggacctccaccccctcctgagccaccgaaaacagctgttgcgcacgcaaaggagtatatccagcagctacggagccgtaccatcgtgcacactctatag

SEQ ID NO: 230697 - DNA, 699 bp, Artificial Sequence
  Description of Artificial Sequence: Synthetic coding sequence
atggccgcagcagtcctgggccaactgggaaaggatttcctggttgtaaaaaggcagaaaggagttgagatggagtcggagctgacggcctgcgtggatgtcgcaggcgctctgtggatccacaatttgaggagccgtggcaagttggccttgggcgtcctgccgcagtcctacattcacacgtcagcgagtctggacatcagcaggaagtgggaaaagaaaaacaaaattgtctacccccctcagcttccaggcgagcctcggcgtcctgctgagatttatcattgtaggcgacaaattaagtactccaaggacaagatgtggtaccttgctaaacttatcaggggcatgagtatcgaccaggcgctggctcagctggagttcaacgataagaaaggcgctaaaattatcaaggaagtcctactggaggctcaagacatggctgtgagggaccataacgtggagtttagatccaacctttacatcgccgaaagcacctcagggagaggccaatgcttaaagcggattcggtaccacggccgaggaaggttcggcatcatggaaaaggtttattgccactattttgtgaaactagtggagggccctccccctcctccagagccccctaaaaccgccgtggcccacgcgaaggagtacatacaacagctccgcagcaggacaattgtgcatacactgtag

SEQ ID NO: 230698 - DNA, 639 bp, Artificial Sequence
  Description of Artificial Sequence: Synthetic coding sequence
atggctgctgctgttctagggcaactgggcgcactttggattcacaacttgcgatcccgagggaagctcgcgctgggactgctatcattccattcggtgctgccacagtcatatatccacacttccgcttccctggatatctctagaaaatgggagaagaagaacaagatcgtctatccaccacaactgcctggagaaccccgtagacctgcagaaatttaccattgcagacgtcagatcaaatacagcaaggacaaaatgtggtatttggctaagttgatacggggtatgtccatcgatcaagctttggcccagctggaatttaacgacaagaaaggcgcaaagatcatcaaggaggtgctgttagaggcccaggacatggctgtgagggaccacaacgtcgagttccgctccaacctgtatattgccgaatcaacatcaggaagaggccaatgcctcaaacggatcagatatcatggccgaggacgcttcgggatcatggaaaaggtttattgccattacttcgtcaagctggtggagggtccaccaccacctcccgagcctccaaagacagcggtcgcccatgcaaaggagtatatccagcagctgcgctcacgcacaatcgtacacacgctgtag

SEQ ID NO: 230699 - DNA, 621 bp, Artificial Sequence
  Description of Artificial Sequence: Synthetic coding sequence
atggcggctgccgttttgggacagctcggcgctctttggatccataacctgcgatcccgaggcaaattggctctgggagttctgccccagtcatacatccatacttctgctagcctggatatcagtcggaaatgggagaagaagaacaaaatcgtgtatccaccccagctgcccggtgagcccaggcgtccggctgaaatatatcactgtcgtcgtcagatcaaatactctaaggataagatgtggtatctggcgaaactgatccgcggaatgagcattgatcaggcccttgcacagctggaattcaatgataagaagggagccaaaattatcaaggaggtcctactggaggcccaggacatggctgtgcgggatcataatgtggaatttcgcagcaatttatacatcgccgagagcacctccggcagggggcagtgtctgaaacgtattaggtatcatggccgaggcaggtttggcattatggagaaagtatactgccactactttgtcaagttagtggaaggcccaccaccacctcccgagccaccaaagacagccgtggcgcacgcgaaggaatacatccagcagttaagatcgagaacaatcgtgcacaccctgtag

SEQ ID NO: 230700 - DNA, 462 bp, Artificial Sequence
  Description of Artificial Sequence: Synthetic coding sequence
atggcaaggaatgtggtataccctctgtatcgcctaggcggaccccagctaagggtttttaggaccaacttttttattcagcttgttagacctggtgtggcccagcccgaagacaccgtgcagttcagaatccccatggaaatgactagggtggacctgagaaactatctggagggtatttataatgtgcccgtggcagcagtccgaactcgggtacaacacgggtcgaataaaagacgagaccatcggaacgtgagaataaaaaagccagactacaaagtagcctatgttcagttagctcacggtcagactttcacctttccagacttgttccctgaaaaggacgagagcccagaagggagtgccgctgacgatctctatagcatgctggaggaggagcgccagcagagacagtccagcgatcctaggcgcggaggagtgccctcatggtttggactgtag

SEQ ID NO: 230701 - DNA, 462 bp, Artificial Sequence
  Description of Artificial Sequence: Synthetic coding sequence
atggccagaaacgttgtctacccactgtatcgcttggggggtcctcagttaagagtcttccgcaccaacttctttatccagctcgtgcgaccaggagtggcccagcctgaggacactgtgcagttccggatccccatggaaatgactagagtggacctgcggaactaccttgaaggtatctataacgtgcccgttgccgcagtaagaacccgagttcagcacggtagcaataagcgaagagatcaccgcaacgtccgcattaagaagcccgattacaaagtagcatacgtacagttggctcatggtcaaacttttacatttccagatctgttccccgaaaaagacgagagcccagagggctctgctgcggacgacttgtatagcatgctcgaagaggagaggcagcagcgccagtcgagcgacccgaggagaggcggtgttcccagctggttcgggctgtag

SEQ ID NO: 230702 - DNA, 651 bp, Artificial Sequence
  Description of Artificial Sequence: Synthetic coding sequence
atgcgactctcagctctcttggccctcgccagtaaggtgaccctcccgccacactacagatatgggatgtcccctcctggatccgtcgccgataagcgtaagaacccaccgtggattcgtcggaggcctgtagtggtggagcctattagcgacgaagattggtacttgttctgtggagatacagtggagatcttggagggaaaggacgcaggaaaacaggggaaggtcgtccaagttatccggcaacggaattgggtggtggtgggtgggctgaacacacactacaggtatattggaaagactatggattacagggggacgatgattccatctgaggcccctcttttacaccgccaggtcaagctcgttgatccaatggatagaaagcccaccgaaattgaatggcgatttaccgaggcaggagaaagggtgcgcgtgtccacccgaagcggtcgcatcattccgaagcctgagttcccaagggcagatggtatcgttcccgaaacctggatagacggcccaaaggatacaagcgtggaggatgccctggaaaggacatacgtgccatgcctgaagacgctgcaggaagaagtgatggaggcgatgggtatcaaggaaacaaggaaatacaagaaggtgtattggtattag

SEQ ID NO: 230703 - DNA, 651 bp, Artificial Sequence
  Description of Artificial Sequence: Synthetic coding sequence
atgaggctgagtgcactgttagctttggccagtaaagtgaccctccccccacactacaggtatggcatgtcgccacctgggagtgtcgcggacaagcgaaagaaccccccatggattagacgcaggcccgtcgttgttgagcctatctcggacgaagactggtatcttttctgcggcgacaccgtggaaatcctcgagggcaaagatgcgggtaaacaggggaaggtggtgcaggtcatccggcagaggaactgggttgtggtgggagggttgaatacccactatcgctacattggaaagaccatggactatcggggaacaatgatccccagcgaagcaccattactgcatcggcaggtaaagttagtggatccgatggataggaaacccactgaaattgagtggagatttactgaggcaggggaaagagtccgcgtgtccacaagaagcgggagaattattcctaagccagagttccctcgcgcagatggaatcgtccctgaaacctggattgatggacccaaggacacttccgttgaggacgccctcgagagaacttacgttccatgcttgaagactctgcaggaggaggtcatggaagcaatgggaattaaggaaacacgcaaatacaagaaggtgtattggtattag

SEQ ID NO: 230704 - DNA, 300 bp, Artificial Sequence
  Description of Artificial Sequence: Synthetic coding sequence
atgcgtctctccgccctgctggcccttgcatccaaagtcaccctgcctccccattaccggtatggtatgtcacctccaggttccgtcgctgacaagcgcaagaatcccccatggattaggcggcgacccgtcgtggttgagccaatctctgatgaggactggtacctgttctgtggggacacagtggagattctggaggggaaggacgccggaaagcaagggaaggtggtgcaggtcatacggcagcgtaattgggtagttgtgggtgggcttaacactcattataggtatatcggctag

SEQ ID NO: 230705 - DNA, 207 bp, Artificial Sequence
  Description of Artificial Sequence: Synthetic coding sequence
atgcggctctctgccctcctggctctggccagcaaagtgactctgccacctcactatcggtatgggatgtcccccccaggctcagtagccgacaagagaaagaatcctccgtggattcggagaagacccgttgtggttgagcccatctccgatgaagactggtatttattttgtggcgacaccgtcgagatactggagggtaagtag

SEQ ID NO: 230706 - DNA, 522 bp, Artificial Sequence
  Description of Artificial Sequence: Synthetic coding sequence
atgagattaagcgcacttctggccttagcctccaaggttaccctgcctccgcactacagatacggcatgtcacctcccggatctgtggctgataagcgcaagaatcctccatggattcgtagacggcctgtggtagtggagccaataagcgacgaggactggtatctgttttgtggggacaccgtggaaatcctggagggcaaagatgctgggaaacagggaaaagtcgtacaggttattagacagagaaactgggtcgtggtgggcggactgaacacccattatcgctacatagggaagacaatggactacagaggtactatgatcccctctgaagcgcctctgctgcatcggcaggtaaagctggtagatcctatggacagaaaacctactgagatcgagtggagatttaccgaggcaggcgagagggttagggtgtccactaggagtggacggatcattccaaaacccgagtttcccagagcagacggcattgtacccgaaacatggattgacggatag

SEQ ID NO: 230707 - DNA, 4395 bp, Artificial Sequence
  Description of Artificial Sequence: Synthetic coding sequence
atgttctccttcgtggatctgcggctcctcctcttactggccgctacggcattgctaacccacggccaagaagagggacaggttgagggacaggacgaagacataccccctataacctgtgttcagaacggccttagataccacgaccgtgatgtgtggaaaccagagccctgtagaatctgcgtctgtgataatgggaaggtgttatgtgatgacgtgatttgtgatgaaactaaaaattgccccggagccgaggttcccgagggcgagtgctgcccggtctgccctgacggctctgagtcacctactgaccaggagactaccggagtagagggcccaaaaggggacaccgggcctaggggcccaagaggcccagctggccctcccggtcgggacggcataccaggacagccaggccttcctggccctcctggccctccagggcctcctggccctccagggctgggcggaaactttgcccctcaactcagctacggctatgacgaaaagtcaaccggcggtatcagtgttcccggtcctatgggcccatctggcccacggggtctccccggaccacctggggcacctgggcctcaggggttccagggacctccaggcgaacctggtgaacctggcgcatccggacccatgggcccaaggggtccccctggacctcccggtaaaaacggagatgatggtgaagctgggaagccaggacgaccaggagagcgcggtccacccggaccacagggagccagaggactgccaggaacggctgggctccccggaatgaaggggcaccggggttttagcggtctggatggggctaaaggcgacgccggaccggcaggtcctaagggggagcccggatcacccggtgagaacggtgctcccggacagatgggaccccgtgggctccctggcgaaagaggtcgcccaggcgctcccggacctgccggagctcggggaaacgacggggctacaggcgcagcgggtccccctggacctaccggtcccgctggccctcccggattccctggggctgttggcgcaaagggggaggcagggcctcaaggtccaagaggctccgagggccctcagggcgtgcgcggtgagccgggaccccctggaccggctggggctgccggacccgctgggaaccccggagcagatggccaacccggagccaagggcgctaacggggctccgggtattgctggcgctcctggcttccccggtgctagagggccaagcggtccacaggggcctggaggtcctcccggtccaaaagggaacagcggcgaacctggagcgccaggctcaaaaggcgatacgggtgccaaaggggaacctggacctgtcggggtgcaaggtcctcccggaccggcaggcgaggaaggcaagcggggagcgaggggcgaacccggacccaccggcctgcctggccctccaggagagcggggaggtccaggctcccggggatttcccggagcggatggcgtggccggacccaagggacctgccggagaaagaggcagcccgggaccagccggtccaaaggggtccccaggagaggctggcagacctggggaagctggcctgccaggtgccaaaggtctcacagggagccctgggtctcccggtccggatgggaagactggcccaccagggcctgccggacaggacgggcgtcccggtccgcctggacccccaggagcccgtggacaggctggcgtaatgggatttcctggccctaaaggtgctgcgggagaaccaggcaaggccggagagcggggtgtcccgggtcctccaggagccgtcggacccgcaggaaaagacggagaggccggagctcagggccctcccggtccagctggtccagccggagagcggggagagcagggacctgcagggagtccagggttccagggactaccaggtccggcagggcctccgggagaggcaggaaagccaggagagcaaggtgtccccggtgacctcggagcaccagggccttccggagctaggggggagaggggctttcctggagaaagaggagtgcagggaccccctggtccagcgggaccaagaggcgcaaatggcgcaccagggaatgatggggcaaagggcgatgccggtgcacccggtgccccaggtagccagggggctcctggcctacaggggatgcccggagagcgcggtgccgctggactgcccggacctaagggggatcgtggagacgctgggcctaaaggcgcagacggctctcctggcaaggacggcgtgagaggcctgacaggccctattggccctcccggaccagccggtgccccaggggataagggcgagtcaggcccatcaggcccagctggacccacgggggctagaggagcccctggggataggggggagcctgggccacccggacctgccggttttgcagggcctccgggagccgatgggcagcccggagcgaagggagaacctggcgatgcaggcgctaagggagacgcgggacctccaggacccgcaggaccagccggaccaccaggcccaatcggaaacgtgggcgcacccggtgccaagggcgcacggggaagtgcagggcctcccggagccaccgggttccctggagccgcaggaagagtgggtccccctggcccttcaggcaacgctggccctcccggaccccctggtcccgctggcaaagagggcggtaagggcccacgcggagagactgggcctgctggaaggccaggcgaggtggggcctccaggccctcccggtcctgctggagagaaagggagccctggggctgatggccctgcaggggctccaggaaccccaggccctcaggggatcgccggtcaacggggagtggtcggcctgccgggacagagaggggaaagaggatttccaggcctaccaggcccaagcggcgaaccgggtaagcaaggccctagcggggcttctggagaaagaggacccccaggacccatgggccctcccggactggcagggccacccggtgaaagcggcagagaaggagcccctggcgctgagggctcacctggcagagacggatctcccggagcaaagggcgatagaggagaaactggcccagccggacccccaggagcccctggcgctccaggcgctccaggccctgtgggaccagcgggaaaatcaggcgatagaggcgagactggccctgctggacccacggggcctgtagggccagtgggagcaaggggtccagctggccctcaagggcctaggggggacaagggcgagaccggcgagcagggagatcgcggaatcaaaggccatcggggattctcgggacttcaggggcctcctgggcctccaggaagtcccggtgaacaagggcctagtggggcaagtgggccagctggtcctcgtggaccccctggatccgccggagctcccggaaaggacggtctcaatggattacccggtcctatcggaccgcctggtccgagaggccgaactggcgatgccggaccggtcggcccaccaggccctccgggacctcctggaccccctggcccaccatccgccggttttgactttagttttctgcctcagcctccccaggagaaggcccatgacgggggtcgctattaccgagctgatgacgcaaacgtggtccgcgacagggatctcgaagtagataccactctgaagagcctgtcccagcagattgagaacatccgaagtccagaaggaagtcggaagaatcccgctcggacgtgtcgtgatctgaagatgtgccatagtgattggaagagtggggagtactggattgatcccaatcagggctgtaaccttgatgcaattaaggtcttttgtaatatggaaaccggcgagacctgtgtctatccaacccagccatcagtggctcagaaaaattggtacatcagtaaaaatcctaaagataaaaggcatgtttggtttggagagtccatgactgatgggtttcagttcgagtatgggggtcaaggctccgatcccgcagatgtggctatccagctgacattcctgaggctgatgagcaccgaggctagtcagaatatcacataccactgcaagaacagtgtagcctacatggatcaacaaacgggcaacctgaaaaaggccctgctcctccagggctccaacgaaatagagatccgcgcagagggaaatagccggtttacctacagtgtcaccgtggacggttgcacttcccacactggagcctggggcaagacagtgatcgaatataaaacaacaaaaacaagccggctgcctataatcgatgtagcaccccttgacgtgggtgcccctgaccaggagttcggattcgacgtggggccagtctgttttctgtag

SEQ ID NO: 230708 - DNA, 285 bp, Artificial Sequence
  Description of Artificial Sequence: Synthetic coding sequence
atggcatctgtggtcttggccctgaggaccagaactgccgtgactagcctgctctcccccacccctgcgaccgcactggcggtgcggtacgcctctaaaaagtcaggaggctcatctaagaacttgggtggcaagtcaagcgggagacgccaggggataaagaagatggagggccattacgtacacgcaggcaacatcatcgccacacagcgtcactttcgctggcaccccggtgcccacgtaagctgttcggtggccgctcctttatttccctttctggggtag

SEQ ID NO: 230709 - DNA, 282 bp, Artificial Sequence
  Description of Artificial Sequence: Synthetic coding sequence
atggaagggcactatgtgcatgctgggaacattatcgcaacgcaacgtcattttagatggcacccgggagcacacgtgggtgttggcaaaaataaatgtctttatgctcttgaggaaggaatcgttcggtacacaaaggaggtatacgttcctcatccgagaaacacagaagctgtggacctcattacaaggctcccaaagggggcagttctgtacaagaccttcgtccacgtggtgcctgcaaaacctgaaggcacttttaagctggtggccatgctgtag

SEQ ID NO: 230710 - DNA, 282 bp, Artificial Sequence
  Description of Artificial Sequence: Synthetic coding sequence
atggagggccactatgtgcatgccggtaatatcattgccactcagcgccacttccggtggcacccaggagcccacgtgggtgtgggcaagaacaaatgcctatacgctctggaggaggggatcgtgaggtacaccaaagaagtgtacgttcctcatccacgcaacacggaagctgttgacctgattacccgattgcccaagggagcagtattatacaagaccttcgtgcacgttgtacccgctaaacccgaaggtacctttaaacttgtcgcaatgctttag

SEQ ID NO: 230711 - DNA, 771 bp, Artificial Sequence
  Description of Artificial Sequence: Synthetic coding sequence
atgcccctccataagtaccctgtttggttatggaagaggcttcaactgcgtgaaggcatctgcagcagactgcccggtcattatctccgcagcctggaggaggagcggacgcctacccccgttcactaccggcctcacggggctaaattcaagattaatcccaaaaatggacagagggagcgtgtggaagacgtgcccatccccatatactttccccctgagtcccaaaggggtctgtggggtggcgaaggttggattttgggacagatctacgctaacaacgataagctcagtaaacgtcttaagaaagtgtggaaaccccagctgttcgaacgcgagttttattcagagatcctcgacaagaagtttaccgtgactgtgacaatgcgaaccttggacctcatcgacgaggcttatggactggacttttatattttaaaaacccccaaggaagatttgtgctccaaattcgggatggatcttaagagaggaatgcttctccgtctagctagacaggatcctcaattgcatcctgaagaccccgagcgacgcgctgcaatttatgacaaatataaggaattcgccatacctgaagaggaggccgagtgggtcggtctcacactggaagaagcaatcgaaaagcagcggttgctcgaggaaaaagaccccgtccctctgttcaaaatctatgttgcggagctgattcaacagctccagcagcaggccctgagtgagcccgctgtggtccagaagagggcttcgggacagtag

SEQ ID NO: 230712 - DNA, 771 bp, Artificial Sequence
  Description of Artificial Sequence: Synthetic coding sequence
atgccactgcataagtatcctgtctggctgtggaaaaggcttcagcttcgagagggaatttgttctcgcctgcctggacattacctgaggagtttggaggaagaaaggaccccaactccggtgcactaccgccctcatggagcaaaatttaagatcaaccccaagaatgggcagcgagagagagtagaagatgtgccaatccctatctactttccccctgagagtcagcggggtctgtggggtggcgagggctggattctaggccagatatatgctaataacgacaagctgtcaaagaggctcaagaaggtatggaaaccccaactctttgaacgggaattctactctgagatcttagataaaaagttcacagtcacagtgacaatgcgcacacttgatctgatcgatgaagcctacggtctcgacttctacatcctgaagaccccgaaggaggacttatgtagcaaattcggaatggacctgaaaagaggcatgctgcttaggttggcacggcaggatccacagcttcatcctgaagatcccgaaagacgcgcagccatctatgacaagtataaggaatttgcaattcccgaggaggaggccgaatgggtaggtctgactctggaagaagccattgaaaagcaacgcctcttagaggagaaagatcctgtgccactgtttaagatctatgtcgcagaactcatccagcagcttcaacagcaggcgctcagtgagcctgccgttgttcaaaaaagagcaagcggtcagtag

SEQ ID NO: 230713 - DNA, 771 bp, Artificial Sequence
  Description of Artificial Sequence: Synthetic coding sequence
atgccacttcacaagtaccccgtctggctgtggaagagactgcagctgcgcgaagggatctgttctagactgcctgggcactacctgaggagtctggaagaggagagaaccccaacacccgtacactacaggcctcacggtgctaagttcaagataaatcctaagaacggacaaagggaaagagttgaagatgtcccaattccaatctattttccgcctgagtcacagcgaggactatgggggggagaaggttggattctggggcagatctacgccaacaatgacaagctgagcaaacgtctgaagaaggtttggaaaccacaactgttcgaaagagagttctatagcgagatcctcgataagaaatttacggtgacagtaacaatgaggacactggacttgatcgatgaagcatatgggctggacttctacatactcaaggcttcaggcgaagatctctgttccaagttcggtatggatctgaaaagaggaatgctcctgcgtttagccagacaggaccctcagttacaccccgaggacccggagcgacgtgccgcaatttatgataaatacaaggagttcgctatccctgaagaggaagccgagtgggttgggctgacactcgaggaagccatcgaaaaacagcgattgctggaggagaaagaccccgtccccctgttcaagatttacgtggcagagctgatccaacagttacaacagcaagccctgagtgaacccgctgtcgtccagaagcgggcaagcggtcaatag

SEQ ID NO: 230714 - DNA, 771 bp, Artificial Sequence
  Description of Artificial Sequence: Synthetic coding sequence
atgcctttacacaagtacccagtctggctgtggaagcggctgcaacttagggaaggcatctgttctcggctgcccggacattacctcaggtcacttgaagaagaaagaacacccacaccagtccactatcggcctcatggagctaaattcaaaatcaaccccaagaatggccaacgggaacgtgttgaggacgtcccaatcccaatctacttccccccagagtcacagagaggtctctggggcggagaagggtggattctgggtcagatctacgccaataatgataagcttagtaaaaggctcaagaaggtttggaaaccacagctcttcgagagggaattttattctgagattctggacaagaaattcaccgtaacggtgactatgagaactctcgacctcatcgacgaagcttacggattggatttttacattctgaaagcttccggcgaagatctctgctcaaaatttggcatggacctgaagaggggcatgctgctcaggctggctaggcaggacccgcagctccacccagaggacccagaacggcgagccgctatctatgataagtacaaggagtttgccattcccgaggaggaggctgagtgggttgggctgaccctggaggaggccatcgagaagcagagactgcttgaggagaaggacccagtacctctgtttaaaatttacgtagctgagctgatacagcagcttcagcagcaggcgctgtcggaacccgctgtggtacagaaaagggccagtggtcagtag

SEQ ID NO: 230715 - DNA, 147 bp, Artificial Sequence
  Description of Artificial Sequence: Synthetic coding sequence
atgagcagagctggcggaagaggagaacagtctaggtggggtagacgagccgagctgagaggcctcggtcgtcctgaggcacctctacgtctgggaccggatgtctgtggctctgtcccatgtgcaaggggcgctgggtccgaatag

SEQ ID NO: 230716 - DNA, 723 bp, Artificial Sequence
  Description of Artificial Sequence: Synthetic coding sequence
atgccactgcataaatacccagtttggctctggaagaggctccaactgagagaaggcatctgctcccgactgccagggcactatcttaggtctttagaagaggagcggacgcccacacccgtccactatcgaccgcacggcgcaaagtttaaaataaatcctaagaatggtcagagagagcgcgtcgaagacgtaccaatccccatatattttccacctgaatctcagaggggtctgtggggaggagagggttggatcttaggccagatctacgcaaacaacgataaactgagcaagcgcttaaaaaaggtatggaagcctcagctcttcgagcgggaattctactctgagatactcgataaaaaatttacagtgaccgtgacgatgcgtacgcttgatcttatcgatgaagcatacgggttggatttttatatcttaaagaccccaaaggaggatctgtgttccaagtttggcatggatctgaaacgtggaatgctgttaaggcttgccaggcaggacccccagctgcaccccgaggatcccgaacgtcgggctgcaatatatgataagtacaaggagtttgccattcccgaagaagaagctgaatgggtgggtctcaccctagaagaggccatcgagaaacagagactccttgaggaaaaagatcccgttcccttatttaagatttacgtggctgaactgattcagcaactgcagcagtag

SEQ ID NO: 230717 - DNA, 657 bp, Artificial Sequence
  Description of Artificial Sequence: Synthetic coding sequence
atgccgttacataagtatcccgtgtggctgtggaaacgcttgcagctgcgggaggggatctgctctcgactgcccggacactatctcaggtctttggaagaggaacggaccccgaccccggtccactaccggccacatggagccaagttcaaaatcaatccgaagaacggccagcgtgaacgtgttgaagatgtcccaatccctatctatttcccccctgagtcccagagaggcctgtggggtggagagggctggatccttggtcagatatatgcaaataacgataagctgtctaaacgcctgaagaaagtgtggaagcctcagctttttgagagagaattctactctgagatcctggataagaagtttaccgtgacagtgacaatgcgcactcttgaccttattgatgaagcatatggactcgatttttacattttaaagacacccaaggaggacttgtgcagcaaatttggtatggatctcaagaggggaatgctgttgcgactggccaggcaagatccacagctccacccagaagaccccgagaggcgggcagcaatctacgataagtacaaggagttcgcaatacctgaggaggaggccgaatgggtgggtttaacgttggaggaggctatcgaaaagcagcgcttgctctag

SEQ ID NO: 230718 - DNA, 585 bp, Artificial Sequence
  Description of Artificial Sequence: Synthetic coding sequence
atgcccttacacaaataccctgtctggttatggaagcggctgcagctgagggaaggcatctgtagtcgtctacctgggcattatctgcgttctctggaggaagagcgaacccctacacctgtccactacaggccccacggcgcaaagttcaagatcaaccccaagaatggtcaacgcgagagggtcgaggatgtgccaattcccatctatttccctcccgagagccagcggggactttggggcggagagggttggatcctaggacagatctacgcaaacaacgataagctgagtaaacgtctgaaaaaggtgtggaaaccgcagctcttcgagcgtgagttttattcagaaatcttagataaaaagtttactgtgactgtgactatgcggactctggacctgatcgatgaggcctacggcttggacttctacatacttaagaccccgaaagaggatctgtgctccaagtttggaatggacttaaaaagggggatgctgctgagacttgccaggcaagatccacagctgcatcccgaagaccctgaaagacgagccgcaatatacgacaaatataaggaattctag

SEQ ID NO: 230719 - DNA, 1047 bp, Artificial Sequence
  Description of Artificial Sequence: Synthetic coding sequence
atgccgggttggaggctactcacccaagtgggggcacaggtgctcggcaggctgggcgacgggctgggggctgccctggggcctggaaaccggactcatatatggctgttcgtgagagggttgcatggaaagtccgggacctggtgggatgaacatctgagcgaagagaatgtgccattcataaagcaattggtgtccgatgaagacaaagcccagttggcctcaaagctgtgccccctcaaagatgaaccctggccaattcatccgtgggagccgggaagcttcagagtgggtctcatcgcactaaaactggggatgatgccattatggacgaaggatggccaaaagcacgtggtgacactgctgcaggtgcaggattgtcacgtgctgaagtacaccagcaaagaaaattgcaacggcaaaatggccaccctcagtgtgggcggaaagacagtgtcccgcttccgcaaagctacatctatcctcgagttttacagagagctggggctgccaccaaaacaaactgtaaaaatcttcaacataacagataatgccgctatcaagcctgggacgccactctacgctgcacactttcgtcctggccaatacgttgacgttactgccaagacaattggaaagggcttccagggcgtcatgaagcgttggggattcaaggggcaaccagccactcatgggcagaccaagacgcacagacgccctggtgcagtagcaaccggagacattgggagggtttggccagggaccaagatgcccggtaagatgggaaacatttatcgcaccgagtatgggttaaaggtgtggcggatcaataccaaacacaatatcatctacgtaaacggttcagttcccggtcataaaaactgtcttgttaaggtgaaggacagtaagctgcctgcttataaagatttagggaagaatttgccatttcctacctactttccagacggcgacgaggaagaacttccagaagacctatacgatgagaatgtgtgtcagcccggtgctcctagtataacctttgcttag

SEQ ID NO: 230720 - DNA, 1128 bp, Artificial Sequence
  Description of Artificial Sequence: Synthetic coding sequence
atgccgggatggcgtcttctcacacaggtcggagcccaggtgcttggcaggctgggagacggcctgggcgcagcactagggcctggaaaccgagttaccacaaattccctcaatgttagtttgatccggagaaatgttgggtcagaggagaaggtaggggacctgaagaagcgcactcacatttggctctttgttagaggcttgcatgggaagagcggcacatggtgggatgagcacctgagcgaggagaatgtacccttcattaagcagttggtgagcgacgaggataaagctcagttggccagtaagctttgcccactgaaagacgagccttggcccatccacccttgggagcctggatcctttcgagtcggcttaattgccctgaaactgggcatgatgccactgtggaccaaggatggacaaaagcatgtggttaccctcttgcaagtccaagattgccacgttttgaagtatacatcaaaggagaactgtaacggtaagatggcaaccttgagcgtcggcggaaagacagtatctaggttccgcaaggcaacgtctatccttgagttctaccgggagctcggattgccccctaaacagactgtaaagatcttcaacattacagacaatgccgctattaagcctgggacccctttgtacgctgcccatttcaggccagggcagtatgttgatgtgaccgctaagacaatcggaaagggctttcagggtgtgatgaaacgatgggggttcaagggacagccagctacacacgggcagactaagacccacaggcgccctggagcagttgccaccggggacatcgggcgagtgtggccagggaccaagatgcctggaaagatgggaaacatctatcgcaccgaatacggccttaaagtctggcggatcaacacaaaacacaatatcatctacgtgaacggcagtgttccgggtcataagaactgcctcgtcaaggtcaaagatagcaaacttcccgcttacaaggatctggggaagaacctccccttccccacttactttcccgatggtgacgaagaggaattgccagaggacctgtacgatgaaaacgtctgtcagccaggcgcaccaagtatcacgtttgcttag

SEQ ID NO: 230721 - DNA, 1092 bp, Artificial Sequence
  Description of Artificial Sequence: Synthetic coding sequence
tagttttttccttcgcaacgggcttccgccggagaccgctctggcggacattgtgagaactttcctacggccaccgcctccacctggaggtggcgaggagattcactgaaggccgagcggcagggagcaaggaaatctacacacatttggcttttcgtgaggggcctacatggcaagtctggaacgtggtgggacgagcacctgtcagaggaaaacgtgccttttatcaagcagctggtgtcagatgaagacaaggcacaactcgcttcaaagttgtgcccactgaaagatgagccctggccaattcatccgtgggagcctggctcttttcgagtaggccttattgccctcaaactcggcatgatgcctctttggaccaaagatggtcaaaagcatgtggtgactctgcttcaggtccaggactgtcacgtcctgaaatacacctctaaggaaaactgtaatggcaagatggccaccttgtcagtgggaggaaagaccgtgtcccgctttaggaaggctactagcatcctcgagttctatcgcgagctgggattgcctcccaaacaaaccgtgaagattttcaacattactgacaacgccgctattaagccgggaacgccactctacgcagcacatttccgacccggacaatacgtggacgtgactgcaaaaacaattggcaaaggctttcagggcgtgatgaagcggtggggttttaaaggtcagccagctactcatggacaaacgaagacccacagaaggcctggcgcagtggccactggcgacatcggacgcgtatggcccggaactaagatgcctggcaaaatgggaaatatctacagaaccgagtacgggcttaaagtgtggcgcatcaatacaaagcataatattatctacgtgaacgggtctgttcctggccacaagaattgtctggtgaaggtgaaagatagcaaattacctgcttataaggatctggggaaaaatctgcctttcccaacgtatttcccggatggggatgaagaagagctgccagaagacctctatgacgagaacgtatgccagcctggggctcccagcattactttcgcctag

SEQ ID NO: 230722 - DNA, 486 bp, Artificial Sequence
  Description of Artificial Sequence: Synthetic coding sequence
atggcaggcatcctgcgactcgttgtccagtggccaccgggacggctccagacagtgacaaagggggttgagagtctgatctgcacggattggataagacataagttcaccagaagtcgtatacctgagaaggtgttccaggcgtccccagaagaccacgagaaatatgggggagacccacagaacccacacaagctgcacatcgtcactagaatcaaatccacaagacgaagaccttactgggaaaaggatatcatcaagatgctaggactagaaaaggcacacactccacaggtgcacaagaatatcccgagtgtgaacgccaagctcaaggtggtcaagcacctaataaggattaaaccactgaaactgcctcagggcctgcccgctgaggagaatatgagcaacacttgccttaaatcaaccggtgagctggttgtccagtggcatctcaagccagtcgagcaaaaggcacacgagagctag

SEQ ID NO: 230723 - DNA, 486 bp, Artificial Sequence
  Description of Artificial Sequence: Synthetic coding sequence
atggccggtatcctccgactcgtcgttcagtggccacccggacgcctgcaaaccgttactaagggggtcgagtcacttatttgtactgattggattaggcataagtttacaagatcaaggattccagagaaggtttttcaggcatcgccggaggaccacgagaagtatggtggggatccgcagaatccgcacaagctgcatatagtgactagaattaaaagcacccggagaaggccctattgggaaaaggatattatcaagatgctcggcctggagaaggctcacacaccccaagtgcataagaatatcccctccgtgaacgctaaactgaaggtcgtcaagcatctgattaggatcaagcctctaaagctcccccaaggcttgcccgctgaagagaacatgagcaacacatgtctgaaatccacgggggagctggtggtccagtggcacttaaagccagtagaacaaaaggctcatgagtcctag

SEQ ID NO: 230724 - DNA, 705 bp, Artificial Sequence
  Description of Artificial Sequence: Synthetic coding sequence
atggccgagagaggttactccttcagtctaaccacgttctcccctagcggaaaactggttcagattgagtacgccctcgctgctgtcgccggtggcgcaccgagcgtgggcatcaaggcggcaaatggagtcgtactagcaactgagaagaagcagaagtccattctctatgatgagcgctctgtgcacaaggtcgagcccattaccaagcatatcggactagtgtacagtggaatggggccagattacagggtgcttgtacatagagcccgaaagttggcccagcaatactacctcgtgtatcaggagcctattcccaccgcccaactcgtccagcgggtcgccagcgtgatgcaggagtacacacagtctggaggtgtccggccattcggggtgagcttgctgatttgcggctggaatgaagggcgaccttacctgtttcaatcggacccgagtggagcatattttgcgtggaaagcaactgctatgggcaagaattatgttaacgggaagacgttcttagagaagcgctacaatgaggaccttgaattggaggatgccatccatacagccatactgactctcaaagaaagtttcgaaggacagatgaccgaggataacatcgaggtcgggatctgcaatgaagcaggatttaggcgactgaccccaaccgaggtgaaggattatcttgcagctatcgcatag

SEQ ID NO: 230725 - DNA, 324 bp, Artificial Sequence
  Description of Artificial Sequence: Synthetic coding sequence
atggcattagccatgcttgttctggtcgtatctccttggtccgctgctaggggggtgctcaggaattactgggagagacttctcagaaagctgccacaatctagaccaggctttccctcgccaccttggggcccagccctggcagtccagggaccagccatgttcactgaacctgctaatgatacatccggatccaaagagaatagctctctgttggactcaatcttttggatggcagccccaaaaaacaggcggaccatcgaggttaacaggtgtcgccgaaggaacccgcaaaaactgatcaaagtcaaagtgatgcattag

SEQ ID NO: 230726 - DNA, 279 bp, Artificial Sequence
  Description of Artificial Sequence: Synthetic coding sequence
atggccgtcttggccggatcactgttaggtccaacctccagatccgcagcgttactggggggtcgctggctgcagcctagagcctggctcggctttcctgatgcctgggggctcccgacccctcaacaggccagagggaaggctcgaggcaacgagtatcagccttcgaatattaagagaaagaacaaacatggttgggtaaggcgtcttagtaccccagctggggtgcaggttatcctccgaagaatgctcaagggacgcaagagcctgtcgcactag

SEQ ID NO: 230727 - DNA, 513 bp, Artificial Sequence
  Description of Artificial Sequence: Synthetic coding sequence
atggcagcttctgcatttgcaggggcagtaagggcagccagcggcatccttagaccgctgaatatactggcttcgagcacctaccgcaactgcgtgaagaacgcttcacttatcagcgcactgtccaccggtcgctttagccacatccagaccccggttgtgtcaagcaccccccgtttgacgaccagcgaaaggaaccttacatgtggccacacttccgtcatcttgaaccggatggctccagtgcttccttcagtgttaaagttgcccgttcgcagcctgacctatttctctgccagaaaaggcaagagaaaaaccgttaaagcagtgatagaccgcttcctgcgtctgcattgcggcctgtgggtgaggagaaaagccggatacaaaaaaaaactgtggaagaagacccccgcaaggaaaaaaaggttacgggaattcgtgttttgtaataagacacagagtaaactcctggataaaatgaccacatctttctggaagaggaggaattag

SEQ ID NO: 230728 - DNA, 567 bp, Artificial Sequence
  Description of Artificial Sequence: Synthetic coding sequence
atggctgcgtccgcctttgctggcgctgtgagagccgctagcggaatactccgacccctgaacatcctggcctcaagcacctataggaactgtgtaaaaaacgcttccctgataagcgccctgtcgacagggcgattttcccacatacaaacccccgtggtgagcagtactcctaggctgacaacctcagagcgcaatctgacctgtgggcatacctcagtgattctaaatcgaatggctccggtgctgccttcagtccttaagctccccgttaggtctctgacttacttttctgctagaaagggcaaaaggaagaccgtgaaagccgtcattgatagattcctgcgtctgcattgcgggctgtgggtgcggagaaaagccggttataaaaaaaaactgtggaagaagactcccgctcggaagaagcggctgagagagttcgtgttttgcaacaagacacagagtaaattgcttgataagatgaccacatccttttggaaaagacgcaattggtacgtagatgacccttaccagaagtaccacgacaggacgaatctgaaggtctag

SEQ ID NO: 230729 - DNA, 312 bp, Artificial Sequence
  Description of Artificial Sequence: Synthetic coding sequence
atggccaacctcttcatccgaaagatggttaatccactgctgtacctgtctagacacacagtgaaaccacgtgccctcagcacctttcttttcgggtccatcagaggcgcagctcccgttgccgttgagcctggagccgcagtgagaagccttctgagtcccggtctccttccccacctcctgcccgcactaggatttaagaataaaactgtcctgaaaaaacgctgtaaggactgctatctcgtcaaaaggaggggtcggtggtacgtgtactgtaagacacaccctcgacacaaacagaggcaaatgtag

SEQ ID NO: 230730 - DNA, 312 bp, Artificial Sequence
  Description of Artificial Sequence: Synthetic coding sequence
atggcaaacctatttattcggaagatggtcaaccctttgctgtacttgtcccgccacaccgtgaaaccgcgtgcgcttagtactttccttttcgggagcatcagaggcgctgcccctgttgcggtcgaaccgggtgctgctgttagatcactcctgagtccgggactgctacctcacctgctgccagcactcggtttcaagaacaagacggtactcaaaaagcgctgcaaggattgctacttggtgaaacgacggggtcggtggtatgtatattgtaagacccaccctcggcacaagcaaaggcagatgtag

SEQ ID NO: 230731 - DNA, 312 bp, Artificial Sequence
  Description of Artificial Sequence: Synthetic coding sequence
atggctaacctttttatcaggaaaatggtcaaccctcttctttatttatctaggcacactgttaaaccccgagccctctccacatttctttttggcagcattagaggggctgcccctgtcgctgtcgagccaggagcagcagtgcggagcctgctgtccccaggactgctcccgcacctccttccggctctgggcttcaagaataaaacggtgttgaaaaaacgatgtaaggactgctatcttgtgaaaaggcgaggacgctggtatgtatactgtaagacgcatcctcgccacaaacagcgccagatgtag

SEQ ID NO: 230732 - DNA, 312 bp, Artificial Sequence
  Description of Artificial Sequence: Synthetic coding sequence
atggcgaatctgtttattcgcaagatggttaatcctttactctacctgagtcgccacactgtgaagcccagggccttaagcacgttcctcttcggcagtatcagaggggctgctccagtggccgtggagccaggggcagcggtccgctcactactaagcccaggcctattgccccacctcctgccggctttggggtttaagaataagactgtgctgaagaaaagatgcaaagattgctaccttgtcaaacgtagagggagatggtatgtgtattgtaaaacccaccctcggcacaaacaaagacaaatgtag

SEQ ID NO: 230733 - DNA, 1251 bp, Artificial Sequence
  Description of Artificial Sequence: Synthetic coding sequence
atgcactttgttccctggctggctcggcctatcttccctccctgggataggggctacaaggatcctcgattctataggagtccacccttacatgaacacccactgtataaggaccaggcttgctatatatttcaccaccgatgcagattattggaaggcgtgaaacaggcgctctggttgaccaagacgaaactgatcgaagggttgccagagaaagtgctgtcgctggtcgacgatccgagaaaccacattgaaaatcaggatgagtgtgtattgaatgtcatcagtcatgctaggctgtggcagaccaccgaggagatccctaagcgcgagacatactgccccgtgatagtagataacctaattcagctgtgtaagtctcagattcttaaacatccctctttggctagacggatatgcgtacaaaacagtactttttccgctacctggaacagggagtccctacttctgcaggtgcggggaagtggaggcgcaagattgtcgacaaaagaccccctaccaactatcgcatcacgcgaggagatcgaagctaccaagaaccacgtgcttgaaaccttttatcctattagcccaattattgacctgcacgagtgcaatatctatgacgtcaaaaacgatacggggtttcaagaaggatatccctacccatacccccacacgctctacctactggataaggccaatcttcgaccccatcggcttcagccggaccaactgagagcgaagatgattttatttgcatttggcagtgcgcttgctcaggccagactcctgtatggcaacgacgccaaagttttagagcagcccgtcgtggtgcagtcggtagggaccgacgggagagtctttcatttcctcgtcttccagctgaacactactgatctggactgcaacgagggggtaaagaacctggcctgggtcgattcggatcagctcctttatcagcatttttggtgcctgcctgtgatcaaaaagcgtgttgtcgttaccggcccttgctttagtaaatctcaaatgtctacctcttttgttctcactccttcattcaatgccggagaggaggtaatgcagcgcaaccttcgagcaagtgcctccctcccaccttcaaccggctcgccagccagcgaactagtgaaagagcaggagcacgccgcaggacgagttctgcgcagggtgatgcttgactctgagacacctcgcgaagaactccctgctgccgatttttggaagtag

SEQ ID NO: 230734 - DNA, 879 bp, Artificial Sequence
  Description of Artificial Sequence: Synthetic coding sequence
atgagcggagcttgcgctccacggggatcaagatccctgctgccttggatcggatgtacaaggagcctggactggagcccctctccattgcgaggccgttgcacctcctgtcccggatggagagggcgatcctttcgccctggaacagccgctacgcgtacacaggggtcgacggccagaccactgtttacaagtatccggtgtaccaagactaggccagctatctcgtttaccactgtcgccgcatttagtaggtcactcctcctgcaagtaagggggtccggtggggcaagactgtcaaccaaggatccactgccaacaatagccagcagagaggagatcgaagcaacaaagaaccacgtgctggagacgttctaccccatctcgccaattatcgacctgcatgaatgcaacatttatgatgtgaaaaatgataccggttttcaggaagggtacccctacccctacccccacactctctatctactggacaaagcaaacctgcgtccacaccgccttcagcctgaccaactacgagcaaagatgatactgttcgcttttggctctgctttggctcaggcaaggctgttatatggaaacgacgctaaagtacttgaacagcccgtagtagtgcaatccgtagggacagacggcagagtgtttcacttcctggtgtttcaactgaatacgacggacttggactgcaacgagggtgttaagaacctggcctgggttgattccgatcagctgctctaccagcatttttggtgtctccccgttataaagaaaagagttgttgtggaaccggttggccctgtgggatttaagccagagactttccgtaaatttctggccctgtacctccatggcgcagcctag

SEQ ID NO: 230735 - DNA, 1272 bp, Artificial Sequence
  Description of Artificial Sequence: Synthetic coding sequence
atggctttagcatccggcccagccaggcgagccttagcagggagcggtcagcttggactgggcggtttcggcgcacccaggagaggcgcatacgaatggggggtgcggagtacgagaaagtcggaacccccaccccttgatcgggtttacgagattccaggactggagccgatcaccttcgccggtaaaatgcacttcgttccctggcttgctagaccaatctttcccccttgggaccggggttacaaagacccccgtttttatagaagcccccctctgcatgaacacccactgtacaaagaccaggcttgttatattttccaccacagatgccgactgctggagggagtgaagcaggccttatggctgacaaaaacaaagctgatcgagggacttccggagaaggtcctttcactagtcgacgaccctaggaatcacatcgagaatcaggatgaatgtgttcttaacgtgatatctcatgcaaggttgtggcagaccacggaagagatccccaaacgggaaacctattgccctgtgatagtggacaaccttatccagctttgtaagtctcaaatccttaaacatccaagcttggccagaagaatatgcgtccagaactcgaccttttccgccacgtggaatcgggagagcctcctcttacaagtgaggggtagcggtggagccaggttgtctactaaagatccacttcccacaatcgccagtcgggaagagattgaagcaaccaagaatcatgttctcgaaactttctaccctattagccccatcatcgatctccacgagtgcaatatctatgatgtcaagaatgatacagggttccaagagggttacccttacccctacccacacactctgtacctgctcgataaggccaatttgaggcctcacagactgcagccagatcagctgcgagcaaaaatgatcctgttcgcctttggatccgccctggcgcaggccagactgctatatgggaacgacgcaaaagtcttggaacagcctgtcgtggtgcaatccgtcgggactgatggacgagtgttccattttctggttttccagctgaacacaactgatctggactgcaatgagggcgttaaaaacctcgcctgggtggacagcgatcagctactataccagcatttttggtgtctgcccgtcatcaagaaacgggtggtggtggagcctgtggggcctgtgggcttcaagcccgagactttccggaagttcctcgccctgtatttgcacggcgctgcgtag

SEQ ID NO: 230736 - DNA, 795 bp, Artificial Sequence
  Description of Artificial Sequence: Synthetic coding sequence
tagtctctgttgttacaggtgcgaggctcaggaggcgcaagattgagtactaaggatccactccccaccattgcctcacgagaggagattgaggcaaccaagaaccatgtgcttgaaacgttttacccaatatccccaattatcgatttacatgaatgtaacatctacgacgtcaagaatgataccggcttccaggagggttacccgtacccttatccacatactctgtatttattggataaagcaaacctgcgacctcacaggttgcagcctgatcagctgcgggcaaagatgatccttttcgcttttggcagcgccttagcccaggccaggcttctgtatgggaatgatgcgaaggtccttgagcagcccgtagtggttcagtcagtggggaccgacggaagagtctttcattttctggtctttcagctcaacacgaccgatctggactgcaacgagggggtcaagaacctggcatgggtggactctgaccagctcttataccaacacttttggtgtctccccgttattaaaaagcgcgtggtagtgacagggccttgcttttccaagagccagatgagcacaagcttcgttctgacccccagttttaatgcaggggaggaagtcatgcagagaaatctgcgggcttcagcgtctctgcctccctcgactggatcacccgcaagtgaactggtcaaagagcaagagcatgccgctgggcgtgtgctaaggcgggtgatgctggatagcgagactcctagagaagaactcccagcagccgatttttggaagtag

SEQ ID NO: 230737 - DNA, 1143 bp, Artificial Sequence
  Description of Artificial Sequence: Synthetic coding sequence
atggcagctccttggtggagagcagccctgtgtgagtgcaggaggtggcgcggtttcagtacatcagccgttctgggccgaaggacgcctcccctggggcctatgccaaactcagatatcgatttgagcaacctagagcggctggaaaagtacaggtcatttgaccgctaccgacgtcgagccgagcaggaggcacaggcccctcattggtggcgcacataccgggagtactttggcgaaaagaccgaccccaaagagaagatagatatcggcctacccccaccaaaagtcagccggactcagcaactactggagcgtaagcaggctatccaggaactccgagccaacgtggaggaggagagagccgcacgcctgcggaccgcgtctgttcccttggacgccgttcgcgctgagtgggaaaggacctgtggtccttaccataaacagagactggctgagtattatgggctttatcgtgacctgtttcatggtgccacattcgtgccccgtgtcccactgcatgttgcctacgccgtgggagaggacgacttgatgccagtgtactgtggcaacgaggtgaccccaacggaggctgcacaggcccctgaggtgacatatgaagctgaggaagggtctttatggacgctgttgctgacctccctcgacggccacctgctcgagcctgatgccgaatacctccattggttacttacaaacattcccggtaacagggtcgcagaaggccaggttacatgcccctatttaccacctttccctgccaggggaagtggaatccaccgcctagccttcttgctgttcaagcaggatcagcccatagatttcagtgaagatgcacgaccatccccgtgttaccagctggctcagagaactttcagaacatttgacttttataaaaagcaccaggaaactatgacacccgctggcttgagttttttccagtgcagatgggacgactccgtaacctatatctttcaccagctgttagatatgagggagccggttttcgaattcgttaggccgccaccctatcatccaaagcaaaagcgctttccacaccgacagcctctgcgctacctggaccgctatcgggatagccatgaaccaacctacgggatatattag

SEQ ID NO: 230738 - DNA, 591 bp, Artificial Sequence
  Description of Artificial Sequence: Synthetic coding sequence
atgcccgtttattgcggaaacgaggtcactcccacagaggctgcccaggccccagaagtgacttatgaggcggaagaagggtcattgtggacactgctgctcacttccctagacggacatctgctggagccagatgccgagtatctacactggctcttgacaaatattcctgggaatagagtagctgagggacaggttacatgtccctatttgccgccatttcccgcaaggggctctggaattcatagactcgccttcctcctgtttaagcaggatcagcctatagactttagcgaggatgctagaccgtctccatgttaccagctggcacaacggacatttcgaacctttgacttctacaagaaacatcaggagactatgaccccagccggtctttcattctttcagtgtcgatgggacgatagcgtcacatacatttttcaccagctcctggatatgagggaacctgtctttgaatttgtacgccctcccccttatcatcctaagcaaaagcgatttccccatcgccagccgctcagatatctggacaggtatcgggatagtcatgagccaacgtatggcatttattag

SEQ ID NO: 230739 - DNA, 1062 bp, Artificial Sequence
  Description of Artificial Sequence: Synthetic coding sequence
atggaagccttggccatgggttcccgagcattgaggttatggctcgtagccccaggtggcggtataaaatggcgcttcattgccacgtcatccgcctcccaactcagtccaactgagcttactgagatgcgtaatgatctgttcaataaagagaaggcacggcagctttcgctgactccgcgaacggaaaagattgaggtgaagcacgtgggcaagacggaccccggaaccgtgtttgtgatgaataagaacattagtactccctactcatgtgccatgcacctgtctgagtggtattgtagaaagtccattctcgccctggtcgatggacagccatgggatatgtacaagccattgaccaagtcttgcgagatcaagtttcttacattcaaggattgtgacccaggcgaagtaaataaagcgtactggcgaagctgcgcaatgatgatgggatgcgttattgagagggctttcaaagacgagtatatggtaaacctagtgcgggctcccgaggtgccggtgatttccggcgcattctgttacgatgtcgtgctggacagcaagctagacgagtggatgccaactaaggaaaacctcagatcattcactaaggacgctcacgcgttgatctacaaagacttaccctttgaaacattagaggtcgaggccaaagtggctctggagatattccagcatagcaagtacaaggtcgattttatcgaggaaaaggcttctcagaatcccgagagaatcgttaaattgcacagaataggagatttcattgacgtctccgagggacccttgataccaagaacctccatctgcttccaatacgaggtgtcggccgttcacaacttgcagccaacccaacccagcttgattcggaggttccagggcgtaagcctccccgtgcatttgagagctcactttacgatctgggacaaactactagaacgtagccgcaaaatgaccccctttcctatcctgctgctgtttacaacccagagttttttcactacatcacctgaatcctatctgctccacggtaccgttagcgagtag

SEQ ID NO: 230740 - DNA, 1017 bp, Artificial Sequence
  Description of Artificial Sequence: Synthetic coding sequence
atggaggcccttgcgatgggttctagggctctgagactctggttggtggcccctggcggaggaataaaatggagattcattgccacatcgtccgcgtctcagctgtctcctaccgagctcaccgaaatgcgcaatgacctgttcaacaaagaaaaggcccgtcagttgagcctgacgcccagaactgagaagatcgaggtgaagcacgttggcaaaacggatccagggaccgtctttgtaatgaacaagaatattagcacaccctactcctgcgctatgcacctgtctgagtggtactgtcggaagtccatcctcgctctggtggatggccaaccttgggacatgtataaacccttgactaagtcgtgcgaaatcaagttcctgaccttcaaggactgcgacccaggcgaagtcaacaaggcctactggagatcatgtgctatgatgatgggctgtgtgattgagagagcattcaaggacgaatacatggttaacctcgtcagggcacctgaggtcccagtgatctctggtgcgttttgctacgatgttgtactcgacagtaagctagacgaatggatgcccacaaaagaaaatttgcggagcttcaccaaagacgcccacgcattaatttacaaggacctcccatttgagacactagaagtcgaggccaaggtcgctttggaaatctttcagcactccaaatataaggtcgactttatcgaagaaaaagcttcacagaatccggagcggattgtaaaactgcatcgcataggggacttcatagacgtttcagaggggccattgatcccgcgtacgagcatctgtttccagtatgaggtgtcagccgtgcacaatttacaaccgactcagcccagtctgatccgaagattccagggggtttctctgcctgtccacctgcgagctcattttactatctgggataagctcctggaacggagtcggaagatggttactgaagaccagtcgaaggctacagaagaatgcaccagcacctag

SEQ ID NO: 230741 - DNA, 936 bp, Artificial Sequence
  Description of Artificial Sequence: Synthetic coding sequence
atgttgcaatttgtgagggctggcgcacgggcatggttgaggccgactggctcccagggcctgtcctccctagctgaagaggctgccagagctacagagaatcccgaacaggtggcctccgaggggctgccagagcccgtcctgcgcaaagtggaactgccagtacccacccatcgcagaccagtgcaggcttgggtggaatcacttcgcggattcgagcaggaaagggtgggtctggctgacctgcatccggacgtatttgccaccgcacctcgattggacatcctgcatcaagtcgcaatgtggcagaagaactttaaacggatctcttacgcaaagacaaaaaccagggccgaggttagaggcggaggtcgaaaaccatggccacaaaaagggacaggacgggctcgccacggaagcatacgaagccctctgtggaggggcggtggcgtggctcatggcccacgcggaccaactagctactattatatgctccccatgaaggtacgtgctcttggtttaaaagtcgccctgacagtgaagctcgcacaggacgacctccatattatggacagtttagagcttcccacaggagacccacaatacctcacagaactggcccactatcggagatggggagactccgtgctcttggtggacctgacgcacgaggagatgccccagtccattgtggaagctacctcccgcctcaaaaccttcaaccttatccccgctgtgggcctgaacgttcattctatgctcaaacaccagacactggtactcaccctgcctaccgtagcattcctcgaggacaagttgttatggcaggattctaggtatcggccattgtaccctttcagcttgccttatagcgactttccccgacctctgcctcatgcaacgcagggtcctgcggcaacaccctaccactgttag

SEQ ID NO: 230742 - DNA, 936 bp, Artificial Sequence
  Description of Artificial Sequence: Synthetic coding sequence
atgctgcagttcgtgcgagccggagccagggcatggttacggcctacaggctctcagggcctctcctcgctggccgaagaagccgctcgcgcaacagaaaacccagaacaggtggctagcgaggggttacctgaacccgttctgcggaaggtagagctgcctgtgccaacacataggaggcctgtccaggcatgggtggaaagtctccgaggattcgaacaggagcgggtgggtctcgcagatctgcatcccgacgtatttgcgaccgcacctagactggatattctccaccaggtggcgatgtggcagaaaaactttaagagaatctcttatgccaaaactaagactcgggctgaagtcagggggggaggcaggaagccttggccccagaaggggacaggaagagcccgacacgggagtatccggtcccccctgtggcgcggtggaggtgttgctcacggtcctagaggaccaacatcctactattacatgcttccaatgaaagtcagggcccttggcttgaaagtcgccctgaccgttaagctggcccaagatgacctgcatatcatggatagtttagaactcccaactggagaccctcagtatctaaccgagctggcccattacaggagatggggcgattcagtgctgcttgtcgatctgacccatgaagagatgcctcagagcattgtagaagctacgtcccggttgaaaaccttcaatctcatccctgcggtcgggctgaatgtgcattcaatgcttaagcatcaaacacttgtgctgaccctccccacagtagcgttccttgaggacaagcttttgtggcaagacagtcgctaccgtcccctgtatcctttttcactcccttattccgatttcccgaggccactcccccacgccactcaaggccctgctgcgactccctaccactgttag

SEQ ID NO: 230743 - DNA, 792 bp, Artificial Sequence
  Description of Artificial Sequence: Synthetic coding sequence
atgctgcaatttgtccgggctggagctcgcgcttggctgcggcctaccggatcacagggactttcctccctcgcagaggaggcagcaagagctactgaaaatcctgaacaggtagccagtgaaggtttgcctgaaccagtattgcgaaaggtagaattgccagtgcccactcatcggaggcctgtgcaggcatgggtggaatccctccgcggattcgaacaggaacgtgttggtctggccgatctccacccagacgtcttcgccactgcacccagattagatatcttacatcaagtcgccatgtggcagaagaactttaaacggataagctacgcaaagactaaaacccgggcagaggtgcggggtggcggtagaaagccctggccacaaaaagggacaggaagagctaggcatggtagtatccggagtccgctctggcggggagggggtgtggcacacgggcctcggggacctaccagctattactatatgcttcctatgaaggtgcgcgcattaggcctgaaagtcgctcttacggtaaaactcgctcaagacgacctgcacattatggattcacttgagctgccaaccggtgacccccagtacctgacggaattggctcactatcgtcgttggggggactctgtgctgctcgtggacctcacccacgaggagatgcctcaatccatcgtggaagccacgagtcgccttaaaaccttcaacctgattcctgctgtcggcgagcagcgagcccaggctcctagagtgaggatgtgtaggctccgttgttag

SEQ ID NO: 230744 - DNA, 792 bp, Artificial Sequence
  Description of Artificial Sequence: Synthetic coding sequence
atgctgcagttcgtgcgcgcaggcgcaagagcctggctgagaccgacgggttctcagggactgtccagcctggcagaggaggcagctcgtgctacggaaaacccagaacaggtggccagtgaaggcctgcccgaacctgtgcttagaaaagtagaacttcccgttcccacgcatagacgtcccgttcaagcatgggttgagagtctgcgcggatttgagcaggagcgggttgggctggctgatctacacccggatgtgttcgcaaccgccccaaggctcgatattctgcaccaggtggctatgtggcagaagaatttcaaaaggattagctacgcgaagacaaagaccagagccgaagtccgcggtggaggacggaaaccatggccccagaaaggaacaggccgtgctcggcacggttctataagatctccactttggagaggaggcggtgttgcacatggacctcgtgggccaacttcctactactatatgttgccaatgaaggtgagagcactcggtctaaaggtcgcactgactgtcaagcttgcgcaggacgacctgcatatcatggactcgcttgaactgccgacgggcgatccacagtacctcaccgagttggcccactacagaaggtggggggatagtgttctattggtcgacctgactcatgaggagatgccgcagagcatcgtcgaggctacatcgcggttaaagacttttaatctgattcctgctgtgggcgagcagcgagcgcaggcaccaagagtccgcatgtgccgcctgaggtgctag

SEQ ID NO: 230745 - DNA, 414 bp, Artificial Sequence
  Description of Artificial Sequence: Synthetic coding sequence
atgggggtgttggcggctgccgcaaggtgcctagtcaggggagccgaccgaatgagcaaatggaccagtaagaggggtcccaggtccttccgtggaaggaaagggagaggagcgaaagggattggcttcctgactagtgggtggaggtttgtgcaaattaaagagatggtgcccgagttcgtggtccctgatcttactggcttcaaactaaagccctatgtctcctacctcgcccctgagagcgaggagactccactcacggccgctcagctcttctctgaagcagtcgccccagccatcgagaaagacttcaaggacggaactttcgaccccgacaatctggaaaagtacggatttgaacctacccaggagggcaagctttttcagctgtatccaagaaattttttaaggtag

SEQ ID NO: 230746 - DNA, 429 bp, Artificial Sequence
  Description of Artificial Sequence: Synthetic coding sequence
atgggagacgtgaaggagaattacctagagaccttcatcagttcccctaagttcgggaggacctgtgctgatggtgcgctttattgcgtgtgccacaagtccacctacagccctctgcctgacgactacaactgtaatgtggagctggcattaacttcagacggcaggaccattgtatgttaccacccaagtgtggatatcccatatgagcacacaaaacctattcccaggccggaccccgtacacaacaacgaggaaacgcatgaccaggtcttgaagacccggctggaagagaaagtggagcatctcgaggagggacctatgatcgagcaactgtctaaaatgttttttaccacgaaacatcgctggtatcctcatgggagatatcacagatgccgcaagaacctgaacccccctaaggaccggtag

SEQ ID NO: 230747 - DNA, 429 bp, Artificial Sequence
  Description of Artificial Sequence: Synthetic coding sequence
atggcggtggcagccgtaaaatgggtgatgagtaagagaacaatccttaaacaccttttccccgtccaaaacggggctttgtattgtgtatgccataagtccacatattcgcccctcccggacgactacaattgtaatgtcgagttggctctcactagcgatgggagaaccatcgtatgctatcacccaagcgtcgacattccatatgagcatactaaacctatccctcgcccagaccctgtgcataacaacgaggagactcacgaccaggttctgaaaactagacttgaagagaaggtcgaacacctggaggaggggcctatgatagaacagttgagtaagatgttctttaccactaagcaccggtggtatccgcacggccgataccacagatgtcgaaagaatctgaaccctcctaaagatcgatag

SEQ ID NO: 230748 - DNA, 429 bp, Artificial Sequence
  Description of Artificial Sequence: Synthetic coding sequence
atggctgtagctgcagtcaaatgggtcatgtccaagagaaccatccttaaacacctgttcccagttcagaacggagcattatactgcgtgtgtcacaagagcacctattcacctctaccggatgactataattgtaatgtcgagctggccctcacatccgacggtcggactatagtctgctaccatccttctgttgacatcccctatgaacatactaaacccattcctagaccggatcccgttcacaataatgaagaaacccacgatcaggtcttaaagacacgcctcgaagagaaggtggaacacctcgaggagggccctatgattgagcagctgtcgaagatgttcttcaccaccaagcaccggtggtatccacacggtcggtaccatagatgtaggaaaaacctgaaccctcccaaagatcgctag

SEQ ID NO: 230749 - DNA, 429 bp, Artificial Sequence
  Description of Artificial Sequence: Synthetic coding sequence
atggcagtcgccgctgtcaagtgggtgatgtctaaaaggacaattctgaagcacctcttcccagtccagaatggagctttatactgtgtttgtcataaatccacgtatagccccctgccggatgattacaactgtaacgtggaattggcccttacctctgacggcagaaccatcgtgtgttaccaccctagcgtggatattccttacgagcatactaagccaatccctcgacctgatcctgtccataataatgaggagacacacgaccaggtgctgaaaacaagactggaagagaaggtggagcatctcgaagaaggcccaatgatcgagcagctctcaaagatgttctttacaacaaagcaccgctggtatccacatgggcgatatcatcgttgccgtaaaaatctcaatccacccaaggaccggtag

SEQ ID NO: 230750 - DNA, 609 bp, Artificial Sequence
  Description of Artificial Sequence: Synthetic coding sequence
atgaccgccagaggaaccccctcgaggttcctcgcgagcgtactgcacaacggcctgggaaggtatgtacagcagcttcagaggcttagcttttctgtctcacgcgatggagcctctagtaggggcgctcgcgaattcgtcgagcgcgaggtcattgactttgcccgtcgcaatccaggcgtagtcatttacgtcaactccagaccctgttgcgtgccccgtgtcgttgcagagtatctgaacggcgcagtgcgggaagaaagtatccactgcaagagcgtcgaggagatatccacgctggttcaaaaactcgcagatcagtctggtctggatgttataaggatcagaaagccatttcacacagataacccatcaatccaggggcagtggcatccatttactaataagccaaccactttccgcggtctccgacccagggaagtgcaggaccctgcccctgctcaagatactgggctgaggctgagcgcggtcgccccacagatattgctgccagggtggcccgatcctataagcgtccagagctccgatctaccttggggcaatacacattaccgtccagaacctctgagctcaactacctggctgtag

SEQ ID NO: 230751 - DNA, 648 bp, Artificial Sequence
  Description of Artificial Sequence: Synthetic coding sequence
atgacagccagagggacacctagtaggttcctggcatccgtgttacataacgggctggggagatacgttcagcagcttcagcgcctttctttttccgtttcgagagacggagcctctagtaggggggctagggagtttgttgagcgggaggtcattgacttcgccagaagaaacccaggcgtcgttatatatgtgaactcacgtccgtgttgcgttccccgtgtcgtcgccgaatatcttaatggggcagtacgcgaagagtcaatacactgtaagagtgtggaggagatcagtaccctggttcaaaagctggctgatcagagtggcctcgatgttattcgtatccgtaagccattccacacagataatccctccattcaggggcagtggcatcctttcactaataaaccaaccactttccggggacttaggccacgtgaggtgcaggacccagcaccagcccaagacacaggtctgaggctgagtgccgtggctcctcagatccttctccccggatggcctgaccccccagatctcccaaccgtcgacccaatatcttcatccctaacaagtgccccagctccgatgctgtccgcggtgtcatgtctcccaatcgttcctgcactcactactgtgtgttccgcctag

SEQ ID NO: 230752 - DNA, 480 bp, Artificial Sequence
  Description of Artificial Sequence: Synthetic coding sequence
atgacagcccgtggcacccccagtcggtttcttgcttcggtgctgcataacggtctcggccgttatgtccaacagcttcaaagactctccttctcggtgtcaagggacggggcatcctctcgcggtgctcgcgagtttgtagagagagaggttatagattttgccagacgaaaccccggagtggtgatctacgttaattcaaggccttgttgcgtgcctagagttgtagccgagtaccttaacggagccgtgagagaggagtctattcattgtaagagcgtggaagaaatttctacgctggtgcagaagctcgccgatcagagtgggctggatgtgattagaatcagaaagccatttcatacagataatccatccattcaggggcagtggcacccctttacaaataagcctactacatttagagggctacgcccacgggaggttcaggatcctgcccctgcccaggtacaggctcaatag

SEQ ID NO: 230753 - DNA, 708 bp, Artificial Sequence
  Description of Artificial Sequence: Synthetic coding sequence
atgacagctcggggaactccaagccgtttcctggcttccgtgttgcacaatggcctgggtcggtacgtccagcagctgcagaggttgtcgttttcagtgagccgagacggcgcatccagtaggggagccagggagtttgtggaacgtgaagtgattgacttcgcaagacggaatcctggcgtggtcatttacgtgaactctagaccgtgttgtgtgccccgtgtcgtagcggagtatctcaacggagctgtgcgggaggagagcattcattgcaagtccgtcgaggaaatctccaccctggtgcagaaactcgctgatcagagcgggctcgacgtgatcagaatacggaaacctttccatacagataatccctccatacaggggcaatggcacccattcaccaacaagcctaccacctttagaggactcagacccagggaggtgcaggatcctgctccagctcaagatgccgcagaattcctgggagagggcgcaggtccctgctggtactccatcgtcgctctcccacagaagcacatagccattgcaattcaccctccccagccagcaggccagtgccatcaggccatcggccactggcccgaaaccgtctgttcctgcacggcggaccctcccgcacggctggccaggcctaatattagctccgtcattcggtcttccctaggaaagtatcctctgccgtcttag

SEQ ID NO: 230754 - DNA, 495 bp, Artificial Sequence
  Description of Artificial Sequence: Synthetic coding sequence
atgaccgcccgaggcaccccctcaagattcctagcctcggttttgcataacggcttggggaggtatgtccagcaacttcagcgcctgagcttttcagtgtctcgcgatggtgcctcatccaggggtgcacgcgaattcgtggaaagagaagtaatagacttcgcccgaaggaacccaggggtggtgatctacgtgaacagtcgaccctgttgcgtgcccagggtggtggctgaatatctgaatggagccgtgagagaggagagtattcactgcaaatctgtcgaggagatatctactctggtccaaaagttagcggaccagtctggcctggacgtgatcaggatccgcaaacctttccataccgacaacccgtcaatacagggtcagtggcatccatttacaaataaacctaccacttttaggggactccggcctagagaagtccaagacccggctccagcacagtgcctactgctaggagcggtgaccctgtag

SEQ ID NO: 230755 - DNA, 480 bp, Artificial Sequence
  Description of Artificial Sequence: Synthetic coding sequence
atgaccgctaggggaacgccaagcagatttttggcgtctgttttacacaacgggctgggtcgctacgtgcagcagctgcagcggctgagcttcagcgtttcccgagatggtgcctcttccaggggggctagggagtttgtggaacgggaagtgatagacttcgccagacgaaatcccggagtggtgatttacgtcaacagtcgcccatgctgcgtgccacgcgttgtggccgagtacctgaatggggcagttcgcgaagaatcgatacattgcaaaagtgttgaggagattagtaccctggtccagaaactggccgatcaatctggcctagacgtcatcaggatccgaaagccattccacacagacaaccctagtatccaggggcagtggcaccctttcacaaataaacccactaccttccgcggactgaggccaagggaagtgcaggatcctgcacctgcacaggtgcaggctcagtag

SEQ ID NO: 230756 - DNA, 555 bp, Artificial Sequence
  Description of Artificial Sequence: Synthetic coding sequence
atgactgcacgcggaaccccatctcggtttctggcatcagtcttgcataatgggcttggacgctatgttcagcagctgcagcgattaagcttttcagttagccgagacggggcttcttcacggggtgcccgagagtttgttgagcgcgaggtcattgattttgctcgcaggaacccaggcgtggtgatctatgtcaactcgcgcccatgctgtgttcccagagtggtagctgagtaccttaacggcgcagttcgcgaggagtcaatccattgtaaaagcgtggaggagatttcaactctcgtacaaaaacttgcagatcaatcaggcctcgacgtcatacggatccggaagccttttcacactgacaacccctccattcagggccagtggcacccatttacaaacaagccaaccacattccggggtttacgcccacgggaagtgcaggatcctgctcccgcacaggacacgggactgaggttatccgcagtggccccacagatattgctacccggttggccggatccaacgagggctactagagctactcgctag

SEQ ID NO: 230757 - DNA, 786 bp, Artificial Sequence
  Description of Artificial Sequence: Synthetic coding sequence
atgacagcaagaggaactcccagcagattcctcgctagcgtgcttcacaacggcctggggaggtatgttcagcagctgcagaggctgtctttcagtgttagtcgtgacggcgcaagctcacgcggagctagggaattcgtggaaagagaagtcattgacttcgcacggcgaaaccccggtgttgtcatctatgtaaattctcgcccttgctgtgtgcccagagtggttgctgaatacttgaatggggcagtgcgggaagagtctattcattgtaagagtgtggaggaaatctccaccctggttcagaagctcgccgatcaatccggtttggacgtgattcgtattcggaaaccatttcacactgataatcctagtatccagggccagtggcacccctttaccaacaaacctactacatttcggggtctccgacctagagaggtccaggaccccgcaccggcacaagacgcagccgaattcctgggcgaaggggctggcccttgttggtattccattgtcgccttacctcagaaacacatcgctatagctatccaccccccacagcccgctggacaatgccaccaggcaataggacactggcccgaaaccgtgtgttcatgcactgccgacccaccggctaggctggcgagacctacgagacctccgcatagtgggtcctacctcatcctgattgatttgtgctccagcccgtacgctgttcggtcctttttacctcctgactgcccctgcacagatcattgtgtcctcagtgttaaggcagcgtag

SEQ ID NO: 230758 - DNA, 510 bp, Artificial Sequence
  Description of Artificial Sequence: Synthetic coding sequence
tgaggaacgccgtctcgctttttggcttctgtcctgcataatggactggggcgttatgtccagcagcttcagaggttatctttttccgtcagcagagatggagcttcttcccggggtgcacgggagttcgtcgagcgcgaggtaatagatttcgcacggcgtaatccgggagtggttatatatgtgaactcccggccttgctgtgtacccagggtggtcgccgagtacttaaatggagccgtgagagaagaatcaattcattgcaagagtgtggaggagatctctacattggttcaaaagctagccgatcagagcggactggatgtgattagaattcgcaagccctttcacacagataacccatctatccagggccagtggcacccttttaccaataagcccactacattcagggggctccgccctagagaggttcaagatccggctccagcacaggacgccgctgaattcctaggggaaggggcaggcccttgttggaccctggcctag

SEQ ID NO: 230759 - DNA, 999 bp, Artificial Sequence
  Description of Artificial Sequence: Synthetic coding sequence
atggcaagcgggctggtgaggttactccagcagggacatcgctgtctgctggcccctgtggcaccaaagttggtccctccagttagaggcgtgaaaaaggggttccgcgctgcttttcgatttcagaaagaattggaacggcagagattgttgcgctgccccccaccccctgtccggagatccgagaagccaaactgggactaccatgccgaaattcaggctttcggacaccggctgcaggagaattttagtctagatctgctcaaaacagcgttcgttaattcatgctacatcaaaagcgaagaagcaaagcgtcagcagctgggcatcgagaaggaggccgttctgttgaacttaaaatcaaaccaagagctgagcgagcagggcacctccttctctcagacatgcttaactcagttcctcgaggacgaatatccggatatgcccactgagggcattaagaatctggtggactttttaacaggggaggaagtagtctgtcacgtggctcgcaatctggcggttgagcagctgaccctgtctgaagaattccctgtgccaccagctgtactgcagcagaccttctttgccgttataggagcactgctgcagtcctctggccctgagcgcactgccttattcattcgggatttcttgattactcagatgaccggtaaggagctctttgaaatgtggaagattatcaaccctatggggcttctcgtggaagagctgaaaaagaggaacgtgtctgcacccgagagccgtctcaccagacagtcagggggaacaaccgcgttgcccctgtattttgtgggtttatattgtgataagaagctaatcgctgaaggacctggggagaccgtcctcgttgctgaagaagaggccgctcgagtggctttaaggaagctgtatggtttcactgagaaccgtagaccatggaactactctaaacctaaagagactcttcgcgcagaaaaatcaattactgcctcatag

SEQ ID NO: 230760 - DNA, 921 bp, Artificial Sequence
  Description of Artificial Sequence: Synthetic coding sequence
atggctgcccctattccgcagggtttttcatgtctgtccaggttccttggctggtggtttaggcaacccgtcttggtcacccaatcggctgccatcgtcccggttagaacaaagaagaggttcacccccccaatatatcagccaaagtttaaaaccgagaaggagttcatgcagcacgctcgcaaagccggactggttatcccgcctgagaagagcgatcgcagcatccacctggcctgtactgcaggaatattcgacgcatatgtgccaccagagggcgacgccagaattagcagtctcagcaaagaaggcctcattgaaagaactgagcgaatgaagaaaaccatggcctctcaagtaagtatccggaggattaaagattacgatgctaatttcaaaatcaaggactttcccgagaaggcgaaagatatatttatcgaggcccacctgtgcctcaacaattccgatcacgatcggttacacacgctggtgacagagcattgttttccagacatgacctgggatatcaagtataagaccgtacgatggagttttgtggagtccctggaaccaagccacgtcgtccaggtaagatgcagcagcatgatgaaccagggaaacgtttacggccagataaccgtcaggatgcatacacggcagactctcgccatttatgataggtttggtcggcttatgtacggacaagaggacgtcccaaaagatgttcttgaatacgtcgtgttcgagaaacaattgactaacccctatggaagttggaggatgcacacaaagatagtgccaccctgggcaccgcctaaacagccaattttgaaaaccgtgatgatcccaggaccccaactgaagccagaagaggagtacgaagaagcccagggtgaagcccaaaagccccaactcgcctag

SEQ ID NO: 230761 - DNA, 693 bp, Artificial Sequence
  Description of Artificial Sequence: Synthetic coding sequence
atggctgctgcagggctggcactactgtgtcgaagggtaagctctgcattaaagtccagccggagcctaatcactccccaggttcccgcttgcacaggcttgttgcataccaccctgtcccgtaaagggttagaggaattcttcgacgaccccaaaaattggggccaagagaaagtgaagtctggagcagcttggacttgtcagcagctgcgcaacaagagtaatgaagacctccataaactgtggtacgtgctcctgaaagagcgaaatatgctgctgacactggagcaggaagctaaaaggcaaagattgcccatgccatctcctgaacgtctagacaaagtcgtggactctatggacgccctggacaaagttgtccaggaacgtgaagatgctctacgattgttacagacaggtcaggagagagctagacccggagcatggcgtagggacatcttcgggaggatcatctggcataagttcaaacagtgggtcataccctggcacctgaacaagaggtataataggaaaagatttttcgccttgccatatgttgaccattttcttagacttgaaagggagaagcgcgcacgaatcaaggccagaaaagagaacctggaacgcaaaaaggctaaaatattgttgaagaagtttccacacctggccgaagcccaaaagtcaagtctggtgtag

SEQ ID NO: 230762 - DNA, 423 bp, Artificial Sequence
  Description of Artificial Sequence: Synthetic coding sequence
atgttgctgactctggaacaggaggctaaacgacaaagacttcccatgccctcacccgagagactcgataaggtcgtggatagtatggatgccttggataaagtggttcaggagcgagaggacgccctgcggctactgcagacagggcaggagcgggcacggcctggagcctggcgtagagatattttcggcaggatcatatggcataagttcaagcagtgggtcatcccctggcacctcaataaaaggtataacagaaaacgattctttgcgcttccttatgtagatcatttcctgcgcctcgagcgagaaaagcgcgcaagaatcaaagcaagaaaagaaaatctggaaaggaagaaggctaaaatcctgctgaagaagtttcctcacctggccgaagcgcaaaagtccagcctggtctag

SEQ ID NO: 230763 - DNA, 753 bp, Artificial Sequence
  Description of Artificial Sequence: Synthetic coding sequence
atggcggcagctggactcgctctgctttgcagaagagtcagtagtgcactaaagtcgagtagaagcctgattaccccacaggtccctgcttgtactggcttcttcctttccctactacctaagagcacgcccaacgtaacgtcttttcaccagtatcgcttactgcatactactctaagtaggaagggactcgaggaattttttgatgaccccaagaattggggtcaggaaaaagtgaagagtggggcagcctggacatgtcagcagctacgcaacaagtccaacgaagacctgcacaagctgtggtacgtgttgctgaaagaacggaacatgctactgaccttggaacaggaggccaagaggcaaagactcccaatgcccagcccagaaaggttggataaagtagtagacagcatggacgccctcgataaagtggttcaggagcgagaagacgccctccggctgctgcaaacaggacaagagcgagcgagacccggagcatggaggcgggatatctttgggaggattatctggcacaagttcaaacagtgggttattccttggcacctgaataaaagatacaaccgaaagcggttcttcgctctcccgtatgtggaccactttcttcgtttagagagggaaaagagagcgagaatcaaagcccgaaaagaaaatctggaacgtaaaaaagcaaagatactcctgaaaaagtttccgcatttggccgaggcgcagaagagctccttggtctag

SEQ ID NO: 230764 - DNA, 639 bp, Artificial Sequence
  Description of Artificial Sequence: Synthetic coding sequence
atgagcggaaccctcgagaaagtattgtgcctcagaaacaacaccatttttaagcaagccttcagcctattgcggtttagaacaagcggggaaaaacctatttatagcgtagggggaattctcttatccattagtcggccatataaaacgaagcccactcacggaattggaaagtataagcacttgatcaaagccgaagaacccaagaagaagaagggaaaagtggaggtgagagccatcaaccttgggacggactacgaatacggagtgctgaatatacacctgaccgcatatgatatgacacttgcagaaagttatgcacagtacgttcataacctgtgtaactctttatccattaaagtggaagagtcttacgctatgcctactaagaccattgaggtgctgcagttgcaggaccagggctccaagatgctgctagactccgtgctgaccacccatgaacgggttgtccagataagcggcctgagtgctacatttgccgagatctttctggagattatccagtcctcccttccagaaggtgttagactctctgttaaggaacacacagaggaggatttcaaaggacgattcaaagcccgacccgagctggaggagctgctagccaaactgaagtag

SEQ ID NO: 230765 - DNA, 585 bp, Artificial Sequence
  Description of Artificial Sequence: Synthetic coding sequence
atgggactgagtagctgcagaaaaacaagtagcggtctgccgctgatactgcattatgggggaatcttgctgagtattagccgaccctacaaaacgaagcctacccacgggattggcaaatataaacacctgatcaaggccgaggagcccaaaaagaagaagggaaaggtggaagtgcgtgccatcaatctagggacggattatgaatacggagtgctcaatatacacctaaccgcctacgacatgaccctggcagagtcctatgctcagtacgttcataacctctgtaactccctgtctattaaagtcgaggaatcttatgcgatgccaacaaaaacgatcgaggtgttacaacttcaggatcagggatccaagatgctgctggattccgtgcttaccactcatgagcgggtggtacagattagtggtcttagcgccacattcgctgaaatcttcttagaaattattcaatctagcttacccgaaggagtgcggctgtctgttaaggagcacaccgaggaggattttaaggggaggtttaaagcccgtccggagcttgaggagttgctcgccaagctcaagtag

SEQ ID NO: 230766 - DNA, 501 bp, Artificial Sequence
  Description of Artificial Sequence: Synthetic coding sequence
atggcagcaactatgttccgcgcaacgctgcgcggatggagaacgggggtgcagagagggtgcgggctccgactgctgagtcaaacccagggacctcctgactacccacgcttcgtggaaagtgttgacgagtaccaatttgtggagcgcctgttgcctgccactcggatccccgatcctcctaagcacgaacattacccgacaccatcaggctggcagccccctagggaccctccacccaacctgccatacttcgtccggaggtcgcgtatgcacaacatacccgtgtataaggacatcacccacggtaatcggcagatgacagtgattcgtaaggtggagggtgatatttgggcgctccagaaagatgtcgaagatttcttgtcacctctcctcgggaaaaccccagttacacaggttaacgaggtgacagggacactgagaatcaagggatacttcgaccaggaactgaaagcctggctactcgagaaaggattctag

SEQ ID NO: 230767 - DNA, 501 bp, Artificial Sequence
  Description of Artificial Sequence: Synthetic coding sequence
atggccgcaaccatgtttcgggcaacactccggggttggcgcacaggcgtgcagagaggctgcggacttcgactgttgtcacaaacccaaggtccaccggactacccccgatttgtggaatccgtcgacgagtatcagttcgttgagcggctgctgcccgcaacaagaattccagatccaccaaagcacgaacactaccccaccccctctggatggcaaccacctcgcgatcctccccctaatctgccatacttcgtgcgacggtctagaatgcataatatccccgtgtacaaggacatcacccacggaaatagacagatgactgtgataagaaaggtggagggagatatatgggctctgcagaaagacgttgaggacttcctgtccccactgttgggcaaaacccccgtgactcaggttaatgaggtgacaggaacgctgcgaattaaagggtatttcgatcaggagttaaaagcctggctgctggagaaaggcttttag

SEQ ID NO: 230768 - DNA, 477 bp, Artificial Sequence
  Description of Artificial Sequence: Synthetic coding sequence
atggcagctcgctccgtctccggcattacccgtagggtttttatgtggacggttagcggaaccccatgtcgagaattttggtctaggttccggaaggaaaaggaaccagtggtagtggagacagtcgaagagaagaaggagccgattctcgtgtgcccgccactgaggtcaagagcatacaccccacccgaggacctccagtcccggcttgaatcttatgttaaggaggtgttcggctcaagcttacccagtaattggcaagatatttccctggaagattcccgcttgaagtttaacctgctcgctcatctagcagatgacctgggccatgtcgtgccaaacagcagactccatcagatgtgcagggtgagggatgtactcgacttttataatgtccctatacaggataggtcaaagtttgatgagctcagcgccagcaacctcccgcctaatttaaagatcacctggagctattag

SEQ ID NO: 230769 - DNA, 408 bp, Artificial Sequence
  Description of Artificial Sequence: Synthetic coding sequence
atggcggctcgctccgtaagcggaattaccaggcgcgtttttatgtggactgtgtccggcactccttgtagggagttctggagcaggtttcgaaaggagaaggagcccgtggtagtagaaacagttgaagaaaagaaagagccaatactggtgtgcccgcctttgcgatcacgagcatatactccacccgaagatcttcagagtcggctggagagctatgtgaaggaggtgttcgggtcatccctcccttccaactggcaggacatcagcctggaggactctcggcttaagttcaacctccttgcccaccttgccgacgacctggggcacgtggtacctaatagtcgactgcatcagatgtgcagggggtactcattcgaagagggcaaaatccagctagggatttag

SEQ ID NO: 230770 - DNA, 1146 bp, Artificial Sequence
  Description of Artificial Sequence: Synthetic coding sequence
atggcttctccgtcacttgagcggcctgaaaagggggctggtaaaagcgagttcaggaaccagaaacctaagcccgagaatcaggacgagagcgaattgttgacagtgccggatgggtggaaagagccagcctttagcaaagaggacaatccaagaggccttctggaagagtcctctttcgcaaccctctttcctaaataccgcgaggcctatctgaaggaatgctggcccctggtccagaaggctctaaacgagcaccatgttaatgcaacgctggacctcatagaaggttccatgaccgtctgcacgaccaaaaagacctttgatccatatattattattcgcgctagagatctcataaagctgctggctaggagcgtcagcttcgaacaggctgtccgaatactgcaggatgacgtggcgtgtgatataataaaaatcgggtcactggtccgtaacaaggagagattcgtcaaacgccgtcagagactgattggcccaaaggggagtacacttaaagcattggagcttcttacaaactgttatatcatggtgcagggcaacacagtgtccgccataggccctttttcgggcttaaaagaagtgagaaaggtggtgctggacactatgaaaaacatacaccccatttacaatataaagtctctgatgatcaaacgggagcttgcaaaggacagtgagctgcggtcacagagttgggagcggtttctacctcagtttaagcacaagaatgtcaataaacgtaaagagcctaagaaaaagacagttaaaaaagaatatactccatttccaccacctcagcctgaaagccaaatcgataaggagttggccagtggtgagtacttcctgaaggccaaccagaagaagcggcagaaaatggaggccattaaagcgaagcaggctgaggccatttccaagcgccaggaggagcgcaacaaagcattcataccacccaaagagaaaccgatcgtcaagcctaaggaggctagtactgagaccaaaatcgatgtggctagtattaaagaaaaggtgaaaaaggccaagaataagaaactcggagcgctcaccgctgaagaaatcgccttaaagatggaggccgatgaaaaaaagaagaaaaaaaagaagtag

SEQ ID NO: 230771 - DNA, 372 bp, Artificial Sequence
  Description of Artificial Sequence: Synthetic coding sequence
atggccgcacttgggacagtgctgttcacgggcgtgaggaggctgcattgttccgtcgccgcttgggctgggggtcagtggaggctacagcaagggttggcagccaatcctagcggttatggtccgctaacggagttgcctgattggagctacgccgatggccgaccagcacctccaatgaaaggccagcttaggcggaaagcagaaagggaaacctttgcaaggagggtggtgctcctttcacaggagatggatgcaggtcttcaggcctggcagttgcgccagcagaagttacaggaggagcagcgcaaacaggagaatgcccttaagccgaagggagcaagtctgaaaagccctttgccatcccagtag

SEQ ID NO: 230772 - DNA, 369 bp, Artificial Sequence
  Description of Artificial Sequence: Synthetic coding sequence
atggccgcactcggaaccgttctgttttctgtgaggcgcctgcactgcagtgtagccgcttgggctggcggtcagtggaggctccagcagggcctcgccgcaaatcccagcggttacggccctctgactgagttaccagattggagctacgccgacggacgacccgctccaccgatgaaaggacaactcagacggaaagcagaaagggaaaccttcgcccgaagagtagtattgctcagccaggagatggatgccggtctccaggcatggcagctgcgtcaacagaagttacaggaagaacagcgtaaacaggagaacgcgctgaagcccaaaggcgcatctctgaaatctccattgcctagccagtag

SEQ ID NO: 230773 - DNA, 264 bp, Artificial Sequence
  Description of Artificial Sequence: Synthetic coding sequence
atggctgcattagggaccgtcctttttaccggcgtgagacgtctgcactgcagcgttgccgcttgggccggtggccagtggcggttgcagcagggactggctgccaacccttccgggtacgggcctttgacagagctccctgattggtcttacgccgaaacatcttgtactgccgtgactggcaacggtcgttggatcacttcaatggccgcacaggctgctgaagtagccggaagaaccaaggaagccggtaagtgttcctag

SEQ ID NO: 230774 - DNA, 195 bp, Artificial Sequence
  Description of Artificial Sequence: Synthetic coding sequence
atgaaggggcaattacgccgaaaggcagagcgggagacattcgccaggcgggtcgtgctcctgtcgcaggaaatggatgcgggactccaggcctggcagctgaggcagcagaaacttcaggaggaacagcgaaaacaggaaaatgcactgaagcctaagggagcttctctcaaatctcctctaccctctcaatag

SEQ ID NO: 230775 - DNA, 195 bp, Artificial Sequence
  Description of Artificial Sequence: Synthetic coding sequence
atgaagggacaactccgccgtaaggcagaacgcgaaaccttcgcaaggcgtgtggtcctcttgtctcaggaaatggacgccggactgcaagcctggcaactcagacaacaaaagttgcaggaagagcagaggaagcaggagaatgctcttaaacccaaaggggcatcactgaagagcccgctgccctcccagtag

SEQ ID NO: 230776 - DNA, 195 bp, Artificial Sequence
  Description of Artificial Sequence: Synthetic coding sequence
atgaaaggccagttgcgcaggaaggccgagcgagagactttcgctaggagagtagtcttactgtcgcaagaaatggacgccggtctccaggcatggcagttaaggcagcaaaagctccaggaagaacagcgaaagcaggagaacgctttgaaaccaaaaggagcaagtctgaagagcccgcttcctagtcagtag

SEQ ID NO: 230777 - DNA, 339 bp, Artificial Sequence
  Description of Artificial Sequence: Synthetic coding sequence
atggccgctgctttggcccgactaggtctcaggccagttaagcaggtgcgcgtccaattctgtcccttcgaaaagaacgtggagtccaccagaacatttttgcagaccgtctccagtgagaaggtacgaagtaccaatctgaactgctcagtgattgcagacgttcgccacgatggatcagagccgtgtgtggacgtgctgttcggggatggacatcggctgataatgagaggtgcacacctgaccgctctcgaaatgttgacggccttcgcctcgcatataagagcgagagacgctgctggttctggtgataagcctggcgctgatacagggagatag

SEQ ID NO: 230778 - DNA, 417 bp, Artificial Sequence
  Description of Artificial Sequence: Synthetic coding sequence
atggcaactaaaagactgtttggcgcaacaagaacctgggcagggtggggcgcttgggaacttctgaaccccgctaccagtggacggctgctagctcgggattacgccaagaaacccgtaatgaagggcgctaagagcggcaagggggcagtcacttcagaagcactgaaagatcctgatgtatgtaccgaccccgtgcagttaacaacctacgccatgggtgtaaacatttacaaggaagggcaagatgttccgctaaagcccgacgccgagtaccccgagtggctcttcgagatgaatctgggaccgccaaagactctcgaggagctggaccctgagagccgggagtactggcgccgactcaggaagcagaatatctggaggcataatcgattgtccaaaaacaagcggctctag

SEQ ID NO: 230779 - DNA, 387 bp, Artificial Sequence
  Description of Artificial Sequence: Synthetic coding sequence
atggctgccgtgggctcactgctcggccgattaaggcagtctacagtgaaggccactggccctgcgcttcggaggttacatacgagcagctggagagccgattccagccgagccagtctcacacgagtccaccgccaagcctatgctcggctatacccagtgctcctagttaagcaggacggttcaacaatccatatccggtacagagaacctaggcgaatgctcgccatgcctatcgacctggatactctgtctccagaagagcgacgcgcaagactgaggaagcgggaagcccagctgcagagccgaaaagagtatgaacaggagttgagcgacgatcttcacgtggaaaggtatagacagttctggacacgcacgaaaaaatag

SEQ ID NO: 230780 - DNA, 387 bp, Artificial Sequence
  Description of Artificial Sequence: Synthetic coding sequence
atggccgctgtgggatccctgctgggacggctgcggcaaagcaccgtaaaagcaaccgggccagccctcaggagactacacacatcgtcatggcgagccgacagctccagggcatcactgacaagggtgcatcggcaggcctacgcacgcctgtaccctgttctgctcgtcaaacaggatggttctacaattcacattcgttacagggaacctcgaaggatgctcgcaatgccaatcgacctggatacgctttcccccgaagaacggcgagccagacttcgcaaaagagaggcccagctgcagtcaagaaaggaatatgaacaagaactgtcagatgatttgcacgttgaacggtaccgacagttttggacaagaacgaagaagtag

SEQ ID NO: 230781 - DNA, 387 bp, Artificial Sequence
  Description of Artificial Sequence: Synthetic coding sequence
atggcagctgtgggtagcctccttgggcgattaaggcagtctactgtgaaggcaaccggacctgctttacggcgactccatacttcatcctggcgcgcagactccagtagagcgagtttgaccagagtgcaccggcaggcctatgctaggctatacccggtgcttctggtgaaacaggacgggagtaccatccacattaggtatcgggaaccacgtagaatgttagccatgcccattgatttggataccttgtctcctgaggagcgacgagcccgactgcgcaagcgcgaggcacagttacaaagtcgcaaagaatacgagcaagaactcagtgacgacttgcatgtggagagataccgccagttctggacacggactaaaaagtag

SEQ ID NO: 230782 - DNA, 387 bp, Artificial Sequence
  Description of Artificial Sequence: Synthetic coding sequence
atggccgctgtgggcagccttttaggtaggctacgccagtcaacagtgaaagcaaccggcccagcacttcgaaggctccatacatccagctggcgcgctgatagctccagagcatctctcaccagggtgcacaggcaagcatacgccaggctgtacccggtccttctggttaagcaggacggtagcaccattcacatacggtatagggaacctcggcgtatgcttgcaatgcctatcgatctggacactctgtcacctgaagagcgtcgagctagactgaggaagcgggaagcgcagctccaaagcaggaaagaatacgagcaggagctgagcgacgacctgcatgtcgagcggtaccgccaattctggacacgtactaagaagtag

SEQ ID NO: 230783 - DNA, 495 bp, Artificial Sequence
  Description of Artificial Sequence: Synthetic coding sequence
atggccgcagtgggctcacttcttgggctggctgcatcctcttggctggggggacagaacgcaagtgaccattcattgtggctgcttcgaaagcccaggggcagctcttgccctggaaccggtcaccagttgtgtagacttagacaatctacggtcaaagcaacgggtcccgctctgcggaggctccacacgtcatcttggcgggcagattctagtagagcctccctgacaagagtccaccggcaggcgtatgctagattgtaccctgtgctgctggtgaagcaagatggcagcaccattcacatcagataccgagaacctcgaagaatgctcgccatgccaattgaccttgatacgctatctcccgaagagcgcagagccagactgaggaagcgggaggcacagctccagagtaggaaagagtacgagcaagaactcagtgacgatttgcacgtagaaagataccgtcaattctggacaaggacaaaaaagtag

SEQ ID NO: 230784 - DNA, 378 bp, Artificial Sequence
  Description of Artificial Sequence: Synthetic coding sequence
atggcagcggttggatctctactgggacagtccaccgtcaaggctaccggtcctgcactcagaaggctgcacacatcaagctggcgggcagatagctcacgcgctagcttgacacgcgttcacagacaggcttacgccagactgtaccccgtccttctggtgaaacaggatgggtccactattcatattaggtacagagaaccccgacgcatgctggccatgccgattgaccttgacaccctgagcccagaagagaggagggcaaggttgaggaaacgcgaggctcagctgcagagtagaaaagagtacgaacaggagctgtccgacgatctacatgtggagcggtacaggcagttctggactagaaccaaaaaatag

SEQ ID NO: 230785 - DNA, 387 bp, Artificial Sequence
  Description of Artificial Sequence: Synthetic coding sequence
atggcagctgtggggtcattgcttggaagactcagacagtctaccgtgaaggcaactggcccagccctgagacggcttcatacctcgtcctggcgtgccgactccagtagggcttctttgacacgcgtccaccgacaagcctatgcacggctgtatcccgtcctgttagtaaagcaggacggatccacaattcatatccgttatagggagccacgccgtatgctcgcgatgcctatcgatctggacactcttagccccgaggaacgtagagcgcgactgaggaaaagggaagcgcagctccagagtcgaaaagagtatgaacaggagctgagcgacgacctccacgtggaaagataccgtcagttttggacccgaacgaagaaatag

SEQ ID NO: 230786 - DNA, 387 bp, Artificial Sequence
  Description of Artificial Sequence: Synthetic coding sequence
atggcggcagtaggatccctcctggggagactcagacagtccaccgtgaaagctaccggcccagctctccgcagactccatacgtccagctggagggccgattcgagtagggccagtctgacccgtgtccatcgccaggcctacgcccgtctttacccagtactgctcgtgaaacaggacggctcgacaatacacatccgttaccgcgaacctcggagaatgctcgctatgcctatcgacctggacaccctgtctcccgaagaacgacgggcaagactacgcaaacgcgaggcccagctgcagtcacggaaggagtatgaacaggaactgagcgatgacctccacgttgaacggtaccgacaattttggactcggacaaaaaagtag

SEQ ID NO: 230787 - DNA, 387 bp, Artificial Sequence
  Description of Artificial Sequence: Synthetic coding sequence
atggccgctgtcggatcacttcttggcagattaaggcaaagcaccgtcaaagccaccggccctgcacttcgccgactccatactagctcttggagagctgacagcagcagagctagcctgacaagagttcacaggcaagcctatgccaggctgtatccggtactcttggtaaaacaggacggctctaccattcacatacgctatcgggaacccagacgtatgttagccatgccgatagacctcgacactctaagccctgaggagcggagggccagactccggaagcgcgaggcacagctccagtctcgaaaagagtacgagcaggagctgagcgacgacttgcacgttgagcggtacagacagttctggaccaggaccaagaaatag

SEQ ID NO: 230788 - DNA, 387 bp, Artificial Sequence
  Description of Artificial Sequence: Synthetic coding sequence
atggccgctgtcgggagtttgctgggacggctgagacagagcactgtgaaggctactgggcctgccctgagacgacttcatacctcctcatggagggccgattctagcagagcgtccctgactagagtacatcgtcaagcttacgcgaggctctaccctgtgctgcttgttaagcaggatggcagcactattcacattcggtatcgcgaacctcgcaggatgctagccatgcccattgacctggacactctcagcccagaggaacgtcgagcgaggctcagaaagcgggaagcccagcttcaaagccggaaggagtacgagcaggagcttagcgatgatctccatgtcgagaggtaccgccaattttggacccgcactaaaaaatag

SEQ ID NO: 230789 - DNA, 495 bp, Artificial Sequence
  Description of Artificial Sequence: Synthetic coding sequence
atggctgccgtcgggagtctgcttggattagcggcaagctcctggctgggagggcagaacgcctcagatcattctctctggctgctccggaaacctcgcggaagcagctgtcccggtacaggccatcagctgtgtaggcttcgacagagtaccgttaaagccacgggacccgctctaagacgcctgcacaccagctcatggagagctgactcttctcgggcttccctgaccagagtccataggcaggcgtatgccagactttaccctgtcctgctggtgaagcaagacggcagtacaattcacattagataccgcgagcctcgcagaatgttagccatgcctatcgatttggacacactgagtcccgaggaaaggcgagccagactgaggaagcgagaagcacaactgcagtcccggaaggagtacgaacaggagctctcagacgacttgcatgtggagaggtatcgacagttttggacccgaaccaagaaatag

SEQ ID NO: 230790 - DNA, 387 bp, Artificial Sequence
  Description of Artificial Sequence: Synthetic coding sequence
atggcggctgtaggaagcctgctagggcgtcttcggcaatctacggttaaggctactgggcctgccttacggaggttgcacaccagctcttggcgcgctgacagctccagggctagcctgacccgggtgcaccgtcaagcctatgctcggctataccctgtgctcctcgtcaagcaggatggcagcacaatccacatccggtatcgcgaacctaggcgcatgctcgctatgcctattgacctggacaccctgtcacccgaagagagacgagcgaggttgcggaaaagagaagcccaactgcaaagccgaaaggagtatgagcaagagcttagtgacgatttacatgttgaacgataccgacagttctggacacgtactaagaagtag

SEQ ID NO: 230791 - DNA, 387 bp, Artificial Sequence
  Description of Artificial Sequence: Synthetic coding sequence
atggccgcagtgggcagcctccttggcagactacgccagagcacagtcaaagccactgggcctgccctccgtaggctgcatacctccagttggcgtgccgactcatctcgcgcatccctaactcgggtgcataggcaagcatatgctaggctataccccgtgctgctcgtgaagcaggacggctctacaattcatattcgatatagggagcctcgccgaatgttggctatgcccatagatctggacacactttctcctgaagagagacgggcacgcctgagaaaacgggaggcccaactgcaaagtcgaaaagaatacgagcaagagctctcagatgatctgcatgtggagcgctaccggcagttctggactcgtactaaaaagtag

SEQ ID NO: 230792 - DNA, 387 bp, Artificial Sequence
  Description of Artificial Sequence: Synthetic coding sequence
atggctgcggtgggaagcttactaggcagacttcggcagtctaccgttaaagctaccggccctgccctgcggcgattacatacatcaagttggcgtgctgattctagcagggcatctctgacgcgggtgcacaggcaagcctacgcgagattatatcccgtactgctggtgaaacaagatggcagcaccatccatatccggtaccgcgaaccaaggcgcatgctggcaatgcccattgaccttgacactctcagccctgaagaacgccgtgctcggctgaggaagcgagaagctcagctacagtccaggaaggaatacgagcaggagctatccgatgatctgcatgtggaaagatataggcagttctggacgcgaactaagaaatag

SEQ ID NO: 230793 - DNA, 387 bp, Artificial Sequence
  Description of Artificial Sequence: Synthetic coding sequence
atggctgccgtcgggagtttgttaggcaggctgcgccagtcaactgttaaagctacaggaccggcactaaggaggctccacacttccagttggcgggcagatagctccagagccagcctgactcgcgtccatagacaggcctatgcacggctgtaccccgtactgctggtgaagcaagatggcagtacaatccatattaggtaccgagagccacgcaggatgctggcaatgccgatcgacttggacacgttgagcccggaagagcggagggctcggctccggaagagagaagcccagcttcagtctcgcaaggagtacgagcaggaactgtcggacgatttgcacgttgagcggtaccgccaattttggactaggactaaaaaatag

SEQ ID NO: 230794 - DNA, 387 bp, Artificial Sequence
  Description of Artificial Sequence: Synthetic coding sequence
atggcggctgtcggcagcctgctgggaaggctcagacagagcaccgtgaaagctactggtcctgccttaagacgcctgcatacttctagctggagggcagactccagcagagcgtcactgaccagagtgcaccgccaggcgtatgcacgcctgtaccctgtgctgttagttaaacaggacggttcaacaattcatattcggtatagagagccccgtaggatgcttgccatgcctatagatttagatacactgagccccgaggagagacgcgctcgtctccggaaacgcgaagcccagctccaatctaggaaagagtatgagcaggagttgtcagacgacttgcacgtagagaggtatcgccagttttggactaggactaaaaagtag

SEQ ID NO: 230795 - DNA, 387 bp, Artificial Sequence
  Description of Artificial Sequence: Synthetic coding sequence
atggctgctgtgggttccctgttgggccgtctgcggcagagcactgtcaaagccactggcccagctctgcgcagactgcatacatcctcatggcgggctgatagtagccgcgcaagcctcacccgtgtgcaccgtcaggcctacgcccgactgtatcccgtactgctggtcaagcaggacggatctactattcatattaggtacagggagcccaggaggatgctggccatgccgattgaccttgatacactcagccccgaagagcgccgagcacgcctgcggaaaagagaagctcagcttcaaagccgaaaagagtatgagcaggaactgagcgatgatttacatgtcgagcgttacaggcagttctggactagaactaagaaatag

SEQ ID NO: 230796 - DNA, 387 bp, Artificial Sequence
  Description of Artificial Sequence: Synthetic coding sequence
atggcagcagtgggctctctgctcgggaggctgcggcagtcaactgtaaaggctactggtcccgctcttcgccgattgcacacctcctcttggagagctgacagctcgcgggcttccttgacgagggtacaccgtcaggcctatgctagactttacccggtgctgcttgtgaaacaagacgggtcaactatccatatccgttaccgtgagccccgtcgtatgcttgcaatgcccatcgacctggacacactttctcccgaggaacgaagagcacgccttagaaagcgggaggcacagctgcagtcccgcaaggaatacgagcaggagctgagcgatgacctgcacgttgagcgctataggcagttttggacgcgaacaaagaagtag

SEQ ID NO: 230797 - DNA, 387 bp, Artificial Sequence
  Description of Artificial Sequence: Synthetic coding sequence
atggctgctgtcggctcccttttgggaaggctgagacagtcgaccgttaaagctactggaccagctttgagaaggttgcacacgtcttcatggagagcggattctagtcgcgctagcttgacccgagtccatagacaagcctacgccaggctgtacccagtgctactagtcaagcaggacggtagtacaatccacatcagataccgagaacccagacgcatgctggccatgcccattgacctcgacactctctctcccgaagagagacgggcacggcttcgcaagcgtgaagcacagttacagtcccgtaaggagtacgagcaggaattaagcgacgacctacatgtggaaaggtatcggcaattctggacccgcactaaaaagtag

SEQ ID NO: 230798 - DNA, 387 bp, Artificial Sequence
  Description of Artificial Sequence: Synthetic coding sequence
atggccgcagtgggctctttactcggcaggctgagacaatccaccgtaaaggcgactggccctgccttgcgaagactgcacacctccagctggcgcgctgatagcagtagagcatcactgacacgggttcacaggcaggcttacgccaggctgtaccccgtgctcctggtcaagcaagatgggtccacaatccacatccgatatcgagaaccacggaggatgctggctatgcctatcgatttagataccctttcacccgaggagcggagggccagactcaggaaaagggaggcgcaactgcaatcccggaaagagtatgagcaggaacttagcgatgatcttcacgtggaacgttatagacagttttggacacggacaaaaaaatag

SEQ ID NO: 230799 - DNA, 495 bp, Artificial Sequence
  Description of Artificial Sequence: Synthetic coding sequence
atggccgctgtcgggtctttgctcggacttgccgcatcttcgtggctgggtgggcagaatgcctcagatcatagcctgtggctactcagaaaacccaggggttcgagctgtcccggaaccggccatcagttatgtcggctgaggcagtccactgtgaaggcaactggccctgctctgcgaaggctacatacatcctcatggagggcagacagtagtagggctagtcttacccgggtccaccggcaggcctatgccaggctgtaccccgtactgctggtgaagcaggacgggtctacaatccatattcgatatagagaacccaggcgcatgctcgctatgcccatcgacctggacacgctctcacccgaagaaagacgagccagactccgcaagagggaggcccaactgcagagtcggaaggagtatgaacaggagctgtcagatgacttacacgtggagagatacaggcagttttggactcgcacaaagaagtag

SEQ ID NO: 230800 - DNA, 231 bp, Artificial Sequence
  Description of Artificial Sequence: Synthetic coding sequence
atggctgctgtcgggtcgcttctcggtaggcttcgccagagtactgttaaagccaccgggcctgcattgcgaaggctccacacttctagttggagggccgactcttctcgtgcaagcctgactcgtgtgcataggcaggcctacgcaaggctctacccagtgctgcttgtcaagcaggatgggtctactattcacatcaggtacagagaaccacggagaatgctagcttag

SEQ ID NO: 230801 - DNA, 702 bp, Artificial Sequence
  Description of Artificial Sequence: Synthetic coding sequence
atggctgcgccagtcgttactgccccaggcagagcattgctgcgcgctggtgcaggccgactgcttaggggcggagtacaagaactccttagaccgcgtcacgaggggaacgcgccagacctcgcctgcaatttttctctgagtcagaaccggggaaccgtcatcgtcgagcgctggtggaaagtcccgctggccggtgaaggtaggaaaccaaggctgcatcgacgtcatagagtatacaaactggtggaggataccaagcaccggcctaaagaaaacttagaactcatcctcacacagagcgtcgaaaatgtgggcgtacggggagatctggtgagcgttaaaaagagcctgggcagaaaccggctcctgccccaggggcttgcagtatacgcctcccccgaaaacaagaaactgttcgaagaagagaaacttctgcgacaggaggggaagttggaaaaaatacagaccaaggcgggagaggcgctgggagttgtcgttgctccacacactctgaaacttcctgaggaacccataaccagatggggggaatactggtgtgaggtcactgtaaatggactggacactgttagggtgcccatgagcgtggtcaacttcgagaagccaaaaacaaagcgctacaaatactggctggctcaacaggcagccaaggcgatggcaccaaccagcccccagatctag

SEQ ID NO: 230802 - DNA, 804 bp, Artificial Sequence
  Description of Artificial Sequence: Synthetic coding sequence
atggcagcccctgtggtcacagcacctggaagggccctactgcgtgctggggcaggcagacttctccggggaggagtccaggagttactcagaccacgccatgagggaaatgcccctgacctggcgtgtaatttctccttgagccaaaatcgaggcaccgtgattgtcgaacggtggtggaaggtgccgctggccggagagggcagaaaaccccgactacaccgaaggcaccgtgtgtacaagctggtcgaggatacaaagcatagaccaaaggaaaacctcgaactgatcctgacacagtctgtggagaacgttggtgtgagaggtgacctggtctcggttaaaaagagcctgggtcgcaaccgcctgttgccacagggcctagctgtttacgcatccccagagaacaaaaagttgttcgaagaggagaaactgcttagacaagaaggcaaactggagaagatacagaccaaggcaggagaagccacagtcaaatttttgaaatcttgcagattagaggtgggaatgaaaaataacgtcaagtgggagctcaatccagagatcgttgccaggcacttctttaagaacttgggtgtcgtggtagcgcctcacacattgaagttgccggaagagcctatcacacggtggggagaatactggtgtgaggtcacagtcaatgggctggataccgtccgggtacctatgtccgtcgtaaatttcgagaaaccaaagacaaagaggtacaagtactggttggcccagcaggcggcaaaggcgatggccccaacatcaccccagatatag

SEQ ID NO: 230803 - DNA, 606 bp, Artificial Sequence
  Description of Artificial Sequence: Synthetic coding sequence
atggctgccaggacagcttttggagcagtgtgcaggcgcctgtggcagggactggggaacttcagcgtgaatacgagtaaaggcaacaccgcaaaaaacggcggtctcctgttaagtaccaatatgaagtgggtgcagttctctaatctgcacgtagacgttcctaaagacttgactaagcctgttgtgacaattagcgatgaacctgatatcctgtacaaaaggctttctgtgctcgtgaagggacacgacaaagcagtactggatagttatgagtactttgccgtcctcgccgctaaagagctgggcatatcaataaaagtccacgaaccccctagaaaaattgaacggttcactctcttgcaaagcgtacatatttataagaaacacagggttcagtacgagatgcgcaccctctaccgctgcctggagctggaacacctgactggatctactgccgacgtataccttgagtatatacagcgaaatcttccagagggtgtggctatggaggtgacaaagacccaactggaacagcttcctgagcacattaaggagccaatttgggagacactctccgaagagaaggaagagagcaaaagttag

SEQ ID NO: 230804 - DNA, 585 bp, Artificial Sequence
  Description of Artificial Sequence: Synthetic coding sequence
atgcaggctgtgcggaacgccggttcgaggttccttaggagttggacatggccacagacagcaggcagagtggtcgccaggactcctgctggaaccatctgcactggggcacggcagctgcaggacgcagccgctaagcagaaggttgaacagaatgcggcaccatcccatactaagttcagcatctatccccctattccaggagaggagagctctctgcggtgggccggaaagaagtttgaagaaatacctatagcacacatcaaagcctcgcacaacaacacccaaatccaagttgtgtcagctagtaacgagccattagcatttgcaagctgtggcaccgaaggattcaggaacgccaaaaagggcactggtatcgccgcacaaaccgctgggatcgcagctgccgcacgggctaaacaaaagggagtgattcacatccgagtcgtggtgaaaggtctgggacccggtagattatcggccatgcatgggctaatcatgggaggactggaggtgattagcatcactgataacactcccataccccataacggctgccgcccaagaaaagcaagaaagctgtag

SEQ ID NO: 230805 - DNA, 486 bp, Artificial Sequence
  Description of Artificial Sequence: Synthetic coding sequence
atgcaggccgttcgaaacgccggatcacggttcctcagaagttggacatggccgcagactgccggacgtgtcgtggcccgaactccagcgggtaccatttgcactggcgctcggcagctgcaggatgcagcagccaagcaaaaggttgaacagaatgcagccccatctcacacaaaatttagtacacaaatccaggtggtcagcgcgagtaacgagcccctggccttcgcttcgtgtggaacagaggggtttcggaacgccaagaaaggcaccggcatagcagcacaaacagcaggtatcgcggcagcggctagggcaaagcagaagggagtgattcacatccgggtggtggtcaagggcctcggcccaggtagacttagcgccatgcatggcctgattatgggaggcctggaggtgatttcaattacggataatacccctatccctcacaacggatgcagaccacgaaaagcgaggaaattgtag

SEQ ID NO: 230806 - DNA, 417 bp, Artificial Sequence
  Description of Artificial Sequence: Synthetic coding sequence
atgagctggagcggcctgttgcatggacttaacacatcattaacatgcgggcctgctctcgtgccacgactgtgggcgacctgctcaatggccactcttaatcagatgcatagactgggaccccctaaacggccaccacggaaactgggacccaccgagggcagaccacagctaaaaggagtcgtgctgtgtacgttcacccggaaacccaaaaagcccaacagcgccaaccggaaatgctgcagagtgcgactgtctacgggcagagaggcagtgtgttttattccaggggaaggtcacacgctgcaggaacatcagatcgtgttagtagaggggggacgaacacaagacctgccgggtgtgaaactgacggtggtgagaggcaagtacgactgtggtcatgtgcaaaaaaaatag

SEQ ID NO: 230807 - DNA, 417 bp, Artificial Sequence
  Description of Artificial Sequence: Synthetic coding sequence
atgtcctggtccggactactgcacggtctaaatacgtccttgacctgtggcccagccctcgtgccaaggctgtgggcaacatgtagcatggccaccctgaaccaaatgcatcggctcggtccacctaagagacctccccgtaagctaggacctactgaggggagaccgcaacttaaaggagtggttctctgcacttttactcgcaaacctaaaaaacctaacagtgctaatcggaaatgttgcagagtccggctgagcacggggagagaggccgtttgctttatcccaggagagggccacactctccaagagcaccagatagtgctcgtcgaaggaggtcgtacacaggacctacccggagttaagctgaccgtcgtgcgcggaaagtatgattgcggccacgtacagaagaagtag

SEQ ID NO: 230808 - DNA, 417 bp, Artificial Sequence
  Description of Artificial Sequence: Synthetic coding sequence
atgtcttggagcggacttcttcacggcctgaatacctccttaacatgcggccctgccctggtccctcgcctctgggcaacttgtagcatggccactctcaaccaaatgcaccggttggggccacctaagcgtcccccacgcaaacttgggccaacagagggccgacctcaactaaagggcgtcgtgctctgtacatttactcgcaaaccgaagaagccaaacagcgccaaccggaagtgttgtagagtgcggctcagtacaggccgtgaagctgtctgttttattcccggtgaaggccacacccttcaagaacatcagatcgtcttggtcgaggggggacgcacgcaggatctgccaggtgtgaaactgactgtggtgaggggtaagtacgattgtggacacgtacagaagaagtag

SEQ ID NO: 230809 - DNA, 387 bp, Artificial Sequence
  Description of Artificial Sequence: Synthetic coding sequence
atggctgccttcatgctcggcagcctcctgaggacctttaaacagatggtaccttcctctgcatcaggacaggtgcgatctcactatgtagactggaggatgtggagagatgtgaagagacgcaagatggcctatgagtatgccgatgaaaggctgcggattaattcactacgtaagaataccattctaccaaagatcctacaggatgtggcagatgaggagattgccgctctccctcgggacagctgtccagttcgcattaggaaccggtgcgtgatgacttctaggcccagaggtgtgaagcggaggtggaggttgagtaggattgtgtttcgccacctggcagaccacggccagttaagcggcatccagagagccacttggtag

SEQ ID NO: 230810 - DNA, 774 bp, Artificial Sequence
  Description of Artificial Sequence: Synthetic coding sequence
atgctgcgggtcgcctggagaacactatccctcatcagaacgagggcagtgactcaggtgcttgtccccggattgcctgggggtgggtcagccaagttccctttcaatcagtggggcctgcagcctcgtagcctcttgttacaagcagctcggggatatgtagtacggaagccagctcagagcaggttagacgatgacccccctccatctacccttctgaaggactatcagaatgtgccaggaattgagaaggtcgatgacgtcgtgaagagactgctgagcctcgagatggcgaataagaaggaaatgcttaagatcaagcaagaacagtttatgaagaagatcgtggctaatcccgaggacacacgatctttagaggccaggattatcgccctgagtgtgaaaataaggagctatgaggaacatctggagaagcatcggaaagataaggcacataagaggtacctgttgatgtccatcgatcaacgaaaaaaaatgttgaagaacctccgcaataccaattacgacgtgtttgagaagatttgctggggccttggaatcgagtacacctttcctccgctgtattacaggcgtgctcacagaagatttgtcaccaaaaaggctctctgcattagagtgttccaagagacccagaagctgaagaagcggaggagagctctgaaggccgcagccgcagctcagaagcaagctaaaaggaggaacccagactctcccgctaaggcgattcctaaaactctgaaagattctcagtag

SEQ ID NO: 230811 - DNA, 300 bp, Artificial Sequence
  Description of Artificial Sequence: Synthetic coding sequence
atggttcacctgaccactctgctctgtaaggcctataggggaggacacctgaccattcgcctagctctgggcggatgcacgaacagacccttttacaggatcgttgctgcccataataaatgcccacgtgacgggaggtttgttgagcagctcggttcgtacgaccctctgcctaattcccatggggagaaattagtagctctcaacttagaccgcattaggcattggattggctgtggggctcatcttagtaaacctatggagaagctgctcgggctcaaatacagccacgtgttttag

SEQ ID NO: 230812 - DNA, 414 bp, Artificial Sequence
  Description of Artificial Sequence: Synthetic coding sequence
atggtgcacctcactaccctgctgtgcaaagcgtaccggggagggcacctgaccattaggctggctctcgggggatgcaccaatagacctttctataggatcgtagctgctcataataaatgcccacgggacgggagattcgtggagcagctggggtcttatgatcccctgcctaactcacatggggaaaagctcgttgccctgaacctcgatcggatccgccactggatcggctgcggcgcacacttaagcaagcctatggaaaagctgctaggcctggccggattcttccctctccatccgatgatgattaccaacgcagagcggcttcgacgtaagcgcgctcgggaggtgttgctcgcttctcagaaaactgacgccgaggcaactgatactgaggccacagaaacctag

SEQ ID NO: 230813 - DNA, 372 bp, Artificial Sequence
  Description of Artificial Sequence: Synthetic coding sequence
atggtgcatttaacaactctcctctgcaaagcctatcgcggtggccacctgaccatacggctggcactgggtgggtgtactaatagacctttctatcggattgtagctgctcataataagtgcccacgagatggtagattcgtcgaacagctaggctcgtacgatcctttgcctaactcacacggggaaaagttagttgcattgaacctcgaccggattcgacactggatcggttgtggggcacacctgtcaaaaccaatggaaaagctcctgggaaagacggatgccagatttcctgagcagggcgaggagaggcctgaacaacatcactttccagaggatttagcaccagctcgcggaaggggcctgtag

SEQ ID NO: 230814 - DNA, 393 bp, Artificial Sequence
  Description of Artificial Sequence: Synthetic coding sequence
atgtcagtggtgagatcctctgtccacgctcggtggatcgtggggaaagttatcgggacgaagatgcagaaaacggccaaggtcagagtgacaagactcgttttggatccatacctcctgaagtattttaataagcggaagacctattttgctcacgacgcgttgcagcaatgcactgtcggagatatagttctcctcagagctctacctgttccacgggcaaaacacgtgaaacacgagttggcagaaattgtcttcaaagtgggcaaggtgatcgatccagtgaccggaaagccttgtgcgggaaccacatacctggagtcaccgctgtcttctgagactacacaactgtctaagaaccttgaggagctcaacatttcatccgcccagtag

SEQ ID NO: 230815 - DNA, 390 bp, Artificial Sequence
  Description of Artificial Sequence: Synthetic coding sequence
atgtcagttgttcggagttccgtgcacgcacgctggatcgtcggaaaagtgattggaacgaagatgcaaaagaccgctaaagtacgagtcactcgcctcgtgctggacccttacctactgaaatatttcaacaaacggaagacctatttcgcacacgacgccttgcagcagtgtactgtgggggacatagttctgttgagagctttgcccgtccctagggcgaagcacgtaaagcacgaactcgctgagattgtgtttaaggtcggcaaagtaatagacccagtgaccgggaagccctgtgccggtacaacctacctggagagccctctttcttctgaaacaacccagttgagcaagaatctggaagaactgaatatctcctctgcttag

SEQ ID NO: 230816 - DNA, 384 bp, Artificial Sequence
  Description of Artificial Sequence: Synthetic coding sequence
atggcagccctcaaagcgctggtctcagggtgcggacgactcctgcggggactccttgccggacctgccgctaccagttggagccgcctccccgcacgcggttttagggaggttgtcgagacccaggaggggaagaccacaattatcgaaggcagaattactgccacaccaaaggaatctccgaacccaccaaacccctcaggacagtgccccatttgccgctggaatcttaagcataaatacaattacgatgatgtgctccttctgtcccagtttataaggccccacggcggaatgctcccacggaaaatcaccgggctctgccaagaggagcatcgcaagatcgaggagtgcgtaaagatggcccatagggccggaacctag

SEQ ID NO: 230817 - DNA, 813 bp, Artificial Sequence
  Description of Artificial Sequence: Synthetic coding sequence
atggccgctttgaaggctctcgtcagtggatgtgggagactcttacgaggcctcctggcgggacccgcagctactagctggtccaggctgccagcgcgaggttttagggaagttgtggaaacacaagaagggaaaacaaccataatagagggacgtatcactgccactcccaaggagtccccaaaccctcccaacccttccgggcaatgcccgatctgccgctggaacctcaagcataaatataactatgacgatgtcctgttgctttcacagtttatcagacctcatggtggaatgctgcctcgaaagatcacaggcttatgccaggaagaacaccgaaaaatcgaggagtgcgtcaaaatggctcatagggctggcagaaggccctggggaccacgcggagctgagggctgtagacatagccttccaacccaactgccccacgtaagtgctccgccagggcgaaaggtggacatccggtccgtgaattacacgcatcatcctatgcccaccttcccattgccatgggctttccccctagcccctagcgagctgcaaagagagctgcaacgtcttagcccattaccaagacactcaggtctgttgccgaaccaccgcccaagactccctgaaggtgttgtgcctaagagtaaacctcagcttaatagatatttgactaggtgggctcctggcagcgtcaaacctatttacaaaaagggccctcgttggaatcgagtgagaatgcctgtcggctcaccattgctccgcgacaacgtgtgctactcacgcactccatggaaactataccattag

SEQ ID NO: 230818 - DNA, 591 bp, Artificial Sequence
  Description of Artificial Sequence: Synthetic coding sequence
atggctgccctcaaggccctcgttagcggttgtggtcgactcctccggggactgcttgccggacctgctgctacctcttggtctaggctgccagcaaggggttttcgagaggtcgtcgaaacacaagaaggaaaaactaccattatagagggccgtataaccgccacccctaaggagagcccgaaccctcctaatccaagtgggcaatgcccaatctgcagatggaatttaaagcataagtataattacgatgacgtattactacttagccagtttattaggcctcatggaggaatgttaccccgtaaaatcactgggctgtgtcaagaggagcatagaaaaatcgaagaatgcgtgaagatggcacacagagcgggacttcttccgaatcatcggcctcggctgcctgaaggggtggtcccgaagagcaaacctcaactaaaccgttacctgactaggtgggcccctggaagtgtgaagcctatctataagaaaggtcctcgctggaaccgtgtgcgcatgcctgtagggtctccacttctgcgggataatgtgtgctattcgcggactccctggaagctgtatcactag

SEQ ID NO: 230819 - DNA, 795 bp, Artificial Sequence
  Description of Artificial Sequence: Synthetic coding sequence
atggccgctttaaaggccctcgtgagcgggtgtggaagactcctccgtggactgctcgctggacccgcagcaactagctggagtcgactgcctgcaagaggcttccgtgaggtcgtggaaacccaggaggggaaaacaacaatcatagaaggacgcatcaccgccaccccaaaggaatcacctaatccccctaacccctccggccagtgcccaatatgccgttggaatctgaaacataaatataattatgacgatgttctgttacttagtcagtttatccggccacacggtggcatgttaccaaggaaaatcaccggcctatgccaggaagagcaccgcaagatcgaggagtgcgtcaagatggcacaccgcgcagggcgtcggccatggggccctaggggggctgaaggctgtcgccattccctgccaactcaattgccacatgtgagtgcccctcctggcagaaaggtggatattcgatcggtcaattatactcaccatcctatgcctactttccctctcccttgggcattcccattggccccaagcgagttgcaaagagagttgcagaggctgtcgcctctgcccagacattctggcctcctgccgaatcaccgccctcggctgcccgaaggtgtggtgccaaaatcaaagccccaactgaatcgctatcttacaagatgggccccaggaagtgttaagcccatttacaagaagggacccaggtggaaccgtgtgagaatgcccgtcggaagccccctgctgagagacaatgtatgttattcaagaacttag

SEQ ID NO: 230820 - DNA, 777 bp, Artificial Sequence
  Description of Artificial Sequence: Synthetic coding sequence
atggccgcttccgtgctgaacacggttttaagacggttgccaatgctttccctttttcggggatcacaccgggtgcaggtgcctttacagaccctgtgtacaaaggcgccatctgaagaagactctttatcgtcagttccgatttcaccctataaggatgagccctggaagtatctcgagagtgaggaataccaggaaagatacggctcacgcccagtgtgggcagactatcggaggaatcacaagggcggagtgcccccacagcgaacaagaaaaacatgcattaggcgaaacaaagtggtggggaatccctgcccaatatgcagagaccacaaactgcacgtggactttcgaaacgtgaagctgttggaacagttcgtatgtgcgcatacgggcatcattttttacgcaccctacacgggtgtgtgtgttaagcagcataaaagactgacccaggcaattcagaaggccagggatcatggattgttgatctaccacatcccacaagtggaaccacgggatctggacttctcgacgtcccatggagccgtctcagccacgcctccagcaccaaccttagtcagtggagatccctggtacccatggtacaattggaagcaacctcccgagcgggaactgagcagacttaggcgcctgtaccaagggcaccttcaggaggaaagtggcccaccacccgagagcatgcctaaaatgccgcctcgcacacccgctgaagcttcgtctactggtcaaactggcccacagtcggccctctag

SEQ ID NO: 230821 - DNA, 777 bp, Artificial Sequence
  Description of Artificial Sequence: Synthetic coding sequence
atggctgcatcagtgctcaataccgtgctgaggcgtctgcctatgctgtccctgttccgagggagtcatagagtgcaagtccccttacagactttgtgcacaaaggcgccaagcgaggaggattccctgtcttcagtgcctatcagcccatacaaagatgagccctggaaatacctggagtccgaagagtatcaagagaggtacggatctcgccctgtgtgggcagactaccgaagaaaccataaaggaggggtaccaccacagaggacaaggaagacctgtattagacgaaacaaggtcgttgggaacccatgccctatctgtagggatcacaaactccacgtagatttccgcaacgtgaaactactcgagcagttcgtgtgcgcccacactggtatcatattctatgccccttatactggagtgtgcgtgaagcagcacaaacgcttgactcaggcgatacagaaggcccgtgatcacggactgctaatctaccatattccacaggtggagccccgtgacttagatttcagcacaagccatggcgcagttagcgccacacctccagccccaacattggtttccggcgacccgtggtatccgtggtacaattggaaacaacctcctgaacgtgagttatctcgcctcagacggctttaccagggccacctacaggaagagagcggccctccacctgagagcatgccaaaaatgccaccgcgaacacctgccgaagctagctccacgggacagactggccctcagagcgccctgtag

SEQ ID NO: 230822 - DNA, 648 bp, Artificial Sequence
  Description of Artificial Sequence: Synthetic coding sequence
atggcggcatccgtgctcaacaccgtgctgagaaggctgcccatgttatctctcttcaggggcagccatagggtccaggtcccactgcaaacattgtgcaccaaagcgcctagcgaggaggatagtttgtcctctgtgcccatttcaccctacaaagacgagccttggaaatacctggagtcagaggaatatcaggaacgttacggaagtcggcctgtctgggctgactacaggcgaaatcacaaaggcggtgtgccccctcagcggacccgaaagacgtgcattaatgtaaagctgcttgagcagtttgtctgcgcacacaccgggattattttctacgcgccttataccgggctgttgatctatcacatccctcaggttgagcccagggacctagacttttctacgtcacatggcgcagtgagcgctaccccacctgcacctaccctcgtgagcggagacccatggtatccttggtacaattggaaacaaccccctgaacgggaactgtcgaggctgcgccgtctttaccaaggacatctgcaggaggaatcggggcctccaccggagagcatgccaaaaatgccccctcgaactcccgcagaagcctcatccacagggcagaccgggcctcaaagcgccctgtag

SEQ ID NO: 230823 - DNA, 648 bp, Artificial Sequence
  Description of Artificial Sequence: Synthetic coding sequence
atggctgcgtcagttcttaacacagtcctgcgtcgcctgccaatgctgagccttttccggggatcacacagggtacaggttcctttgcagacgctgtgtactaaagctcctagcgaggaagacagcctaagcagcgtgcccatctctccgtataaagacgaaccttggaagtacttagaatccgaagagtatcaagaacgctacggctcccgcccagtgtgggctgattatagaaggaaccacaaaggaggagtccccccacagaggaccagaaagacctgcattaatgtgaagttattggagcaatttgtatgtgcccacacaggtatcatcttttacgcaccatacaccgggctgctgatttatcacatcccacaggtggaaccacgggacctcgatttctcaactagccacggggctgtgtctgccacccctccagcacccactctcgtctctggtgacccctggtatccctggtataattggaagcaacctcccgagcgcgaattatctagactgcgcaggttataccagggccaccttcaggaggaatccgggcctcctccggagagcatgcccaagatgccccctcgaaccccagccgaggcgtcctccactggtcagactggaccgcagagcgctctgtag

SEQ ID NO: 230824 - DNA, 777 bp, Artificial Sequence
  Description of Artificial Sequence: Synthetic coding sequence
atggcagcttcggtgttaaataccgtcctccggagactccctatgctgtctctctttcggggatcccacagagttcaagtgcctctgcagaccttgtgcacaaaggcaccaagtgaggaagactcactgtcatcagtgccaatctctccctacaaagacgagccgtggaaatacttagagagcgaggaataccaggaacggtatggttctaggccggtatgggctgattaccggcgtaaccataaaggaggtgtgcctcctcagagaacacgcaagacctgtattagacgcaataaggtggtgggaaatccctgcccaatctgtcgagatcacaagcttcacgtagactttaggaacgtgaaactgctagaacagtttgtgtgtgctcacaccggaataatcttttacgcaccgtacaccggcgtttgtgttaagcagcacaagagactgactcaggccattcagaaagccagagatcatggtctgctcatctaccacattcctcaggtggagcccagggatctggacttcagcacgtcccacggggctgtcagtgccactccacccgcacccaccttagtatccggcgacccttggtacccttggtataactggaagcaaccacccgagagggagcttagcagattgagacggctctaccagggccacctgcaggaagaaagcggcccacccccagaatccatgccaaagatgcccccacggacacccgcagaagcaagtagcacggggcagaccggccctcagagcgcgctgtag

SEQ ID NO: 230825 - DNA, 648 bp, Artificial Sequence
  Description of Artificial Sequence: Synthetic coding sequence
atggctgcaagtgtcctcaacacagtgttgcgcagactgcccatgctgagcttattccgaggcagtcacagggtgcaagtgccacttcagactctctgtaccaaagccccatccgaagaagacagcctgagctcagtccccatatcaccctacaaggacgagccatggaaatatctggaatccgaggagtaccaggagaggtacggatcccgcccagtgtgggctgattacagacgcaatcacaaaggcggtgtcccaccccagcgaacccggaagacgtgtatcaacgttaagctgttggagcaattcgtttgcgcacacactggaatcatcttctacgcaccgtacaccggactgttaatctaccatatcccccaggtagagccccgagacttggacttttccacttcacatggcgcagtgagcgctacaccgcctgctcctactctcgtgtctggagacccgtggtacccttggtacaattggaagcagcctcccgagagagaattatcccgtctgcggagactctatcaggggcacctccaggaggaaagtggtcccccacctgagtctatgcccaagatgccgcctcggactcccgctgaggcttcgtcaacaggccagactgggccacagtcagccctgtag

SEQ ID NO: 230826 - DNA, 648 bp, Artificial Sequence
  Description of Artificial Sequence: Synthetic coding sequence
atggctgcgagtgtactgaataccgtcttgcggagactgccgatgctttctctcttccggggtagtcaccgcgtgcaggtgccactgcagactttatgtacaaaagctccatctgaagaggatagtttaagtagcgttcctatcagtccctacaaggatgagccctggaagtatctggaatcagaagaataccaggaaagatatggatcacgacccgtttgggcggattaccgacggaaccataaagggggagtgcccccacaacgaacccgcaaaacctgcataaacgtgaaactgttggagcagtttgtgtgcgctcataccgggatcatcttttacgccccttataccggactgctcatataccacatcccccaggttgagccacgggacctcgacttcagcactagccacggagccgtgagtgccacacctccagcaccaacactggtgagcggtgacccatggtatccttggtacaattggaaacagcctccagaaagggagctttctagacttcgaaggttataccaggggcacctccaggaagagtctgggcctcctcccgaaagtatgcccaaaatgcctccacgtaccccggctgaagcctcctccaccggacagacagggcctcagtcagcactgtag

SEQ ID NO: 230827 - DNA, 777 bp, Artificial Sequence
  Description of Artificial Sequence: Synthetic coding sequence
atggcagccagcgtgctgaatacagttttacggaggctgccgatgctctcgctttttcgcggatcacacagggtccaagtgccactacaaactttgtgcaccaaggcacccagtgaagaagattctctctcttccgtcccaattagtccttataaagatgaaccatggaaatacctggaaagtgaggagtaccaggaacggtatggaagtcggccagtctgggcagattaccgaaggaaccacaagggtggtgtgcctcctcaacgtacccgcaaaacatgtataaggcgcaacaaagttgtgggaaacccttgccctatttgtcgcgaccataagctgcacgtggacttccgcaacgtgaaactgttagagcagttcgtctgcgcgcacaccggcattattttttacgccccttacaccggcgtctgcgtaaagcagcataagcgcctgacccaggccatccagaaagccagagatcacggactcctcatttaccatatcccccaagtagagccgagggatctcgacttcagcacttctcacggagcggtgtccgctactccgccagccccaactcttgtctctggggatccctggtacccatggtataattggaagcaacccccagagagagaactctctcgactaaggagactctatcaggggcatttacaggaggaatcggggccaccgcctgagtcaatgccaaaaatgcccccacggacccccgctgaggcctctagtactgggcaaacaggtcctcagtccgcactgtag

SEQ ID NO: 230828 - DNA, 648 bp, Artificial Sequence
  Description of Artificial Sequence: Synthetic coding sequence
atggcagcctccgtgttgaacaccgtgctgcgacggttgcctatgctgtctctcttccggggaagccatagggtgcaggtgccgctgcaaaccctttgcactaaggcaccctccgaggaggattccctgtcctcggtgccaattagcccgtataaggatgagccgtggaagtatctcgaatccgaggagtatcaggagcgctatggtagccgccctgtgtgggcggactatcggaggaaccataaaggcggagtgccccctcaacggacgcgaaaaacatgcatcaacgtcaagctccttgagcaattcgtttgcgctcacaccggcattatcttctatgctccatacacaggccttcttatataccacatcccccaggttgaacctagagatctggatttctctacgagtcacggcgctgtatccgctactcctccggcacctactctggtatccggtgatccctggtacccttggtacaactggaaacagcccccagaacgcgaattatcgcgcctgcgacgtttgtatcaaggacacttacaggaagaaagtggccctccccctgagagcatgccgaaaatgccaccccgtactccggctgaggctagttccactgggcaaacaggccctcagtctgctctgtag

SEQ ID NO: 230829 - DNA, 777 bp, Artificial Sequence
  Description of Artificial Sequence: Synthetic coding sequence
atggccgcttctgtcttgaataccgtgctgcgtcgactgcctatgctctcattgttcagaggtagtcaccgcgtccaggtgcccctgcagactctgtgtacaaaggccccatccgaagaggattccctgtcaagtgtgcctattagtccatacaaggatgagccctggaagtacctcgagagcgaggaatatcaggagagatacggatccaggcccgtctgggccgactacagaaggaaccataaaggtggggtgcctccccagagaacccgaaaaacctgcatacgtaggaacaaggtggttggaaacccctgtcctatttgcagagatcacaagctccacgtggattttaggaatgtcaagctgttggagcagtttgtgtgcgcccacaccgggatcatattttacgctccttacacaggggtgtgtgtgaagcagcacaagcggttgactcaagctatccagaaagcccgagatcacggcctgctgatctatcatattccacaagtggaaccacgcgacttggacttctcgacttcccatggcgcagtctcagcaactcctcctgctccaaccctggtgagcggcgatccctggtatccatggtacaactggaagcagcctccagaaagagagctgtctagactcaggagattatatcaagggcatttgcaggaagaaagcggccctcccccagaatccatgcccaagatgccaccaagaactccggcagaggcatcatccacgggtcagactggacctcagtcagccttgtag

SEQ ID NO: 230830 - DNA, 648 bp, Artificial Sequence
  Description of Artificial Sequence: Synthetic coding sequence
atggccgcaagtgtgctgaataccgtgctgaggaggttgccaatgctgtccctgttccgcggtagccaccgggtgcaagttcctttgcaaacactgtgcactaaagcaccaagcgaagaagatagtctctcctccgtcccgattagtccctacaaggacgaaccctggaagtacctagagagtgaggagtatcaggagaggtatggaagccgtccagtctgggccgattacaggaggaatcataaggggggagtgcccccacaaaggactaggaaaacttgtatcaatgtgaaactgctggaacagttcgtctgtgcccacaccggcattatattctacgccccttatactggcctgctgatttaccacataccccaggttgaaccgagagatcttgacttctccaccagccacggcgctgtttctgctaccccaccagcaccaacacttgtgtctggtgatccttggtacccgtggtataattggaaacagcctcctgagcgcgagctttcaaggctcagaagactttatcagggtcatctgcaagaggaaagcgggcctccccctgagtctatgcctaaaatgcctccacgtacgccggctgaagcctcatcaacaggccagacgggtccacaatctgcgctgtag

SEQ ID NO: 230831 - DNA, 648 bp, Artificial Sequence
  Description of Artificial Sequence: Synthetic coding sequence
atggcagcctcagtgttgaacaccgtcttgcgtcgcctacctatgttatcgctgttcagagggtcccaccgggtgcaggtgcctctccaaactctgtgcaccaaggctccatccgaggaggattccttaagcagcgtgccaatttccccttacaaggacgagccttggaagtatttggaatcagaggagtaccaggagcgttatgggagtcggcctgtttgggctgactacaggcgcaaccacaaagggggagtacccccacaaagaacccgcaagacgtgcatcaacgttaagctcctcgagcaattcgtttgcgcacataccggcataatattttacgctccctacacgggccttctcatatatcatataccacaggtggagccaagagacctggatttcagcacatcgcacggtgcagtaagcgctacgccacccgcacccacactggtcagcggtgacccctggtacccctggtacaattggaaacaaccacctgagcgagaactgtctaggttgagacgtttgtatcaggggcatctacaagaagaaagcggaccacctcctgagagcatgcctaagatgccccctagaacaccagcagaagcgagtagtaccggacagactgggccacagagtgctctgtag

SEQ ID NO: 230832 - DNA, 777 bp, Artificial Sequence
  Description of Artificial Sequence: Synthetic coding sequence
atggcagcctcagtgctgaatactgtgctccggaggcttccaatgctgtctttattcagaggatcacacagggtgcaggtgccactgcaaacactttgcaccaaggcgcctagtgaagaggactccctcagctccgtgccgatttcaccttacaaagacgagccatggaagtacttggagtccgaggagtatcaggagaggtatggatctcgtcccgtctgggcagactatcgtcggaaccataagggcggtgttcctccacaaagaacccgcaaaacctgcatcaggcgtaataaggttgtgggcaatccttgccccatatgccgagaccacaaacttcacgtggatttccgaaatgtgaaactacttgagcagtttgtgtgtgctcacactgggatcatcttctacgctccctatacaggagtgtgcgttaaacagcacaaaagactgactcaggccattcagaaggctagagaccacggactgctgatttaccatatcccacaggtagaaccacgagacctggatttcagtacctcacacggcgcagtcagtgctacacctcccgctcccaccctagtttctggcgatccatggtacccctggtacaattggaagcagcctccagagagagagctcagccgcctccgaaggttgtaccagggacatttacaggaagagtcgggacccccaccagagagcatgcctaagatgccgccacggaccccggcagaagcttcttctacagggcagacaggccctcaatctgcgctgtag

SEQ ID NO: 230833 - DNA, 777 bp, Artificial Sequence
  Description of Artificial Sequence: Synthetic coding sequence
atggcggcaagcgtgctgaataccgtgcttagaagactgccgatgctaagcctctttcgcggttcccacagggtccaagttcctctccagactctctgcaccaaggccccatcagaggaggacagtctaagcagcgtgcccatctctccctacaaagacgaaccatggaagtacctcgagagtgaggaatatcaagagagatacggatctcgtccggtgtgggccgactatagaaggaaccataagggcggtgtccctccgcagcgcactcggaaaacttgtattcgacggaacaaagtggtgggtaacccatgtcccatctgccgggaccataagctacacgtggactttcggaatgtcaagctgctggagcaattcgtatgtgcccatacaggaatcatattctacgccccttacacaggggtctgcgttaaacagcacaaaagactgacgcaagcaattcagaaggctagggatcacggactgctaatttaccacatcccacaagtcgaaccacgggatttagatttcagtaccagccacggcgcagtctctgctactccacccgcacccacactggtttccggcgacccatggtatccatggtacaattggaaacagccccctgaacgtgagctcagccgactccgtagactataccagggtcaccttcaagaggagtctggcccacccccagagtctatgccaaagatgcctccgcgaacgcccgctgaagcctccagcacaggtcagaccggcccacagtccgccctgtag

SEQ ID NO: 230834 - DNA, 366 bp, Artificial Sequence
  Description of Artificial Sequence: Synthetic coding sequence
atggcggctagtgtgttgaataccgtccttagacggctgccgatgttgagcttattccggggttctcacagggtgcaagtacctctccaaaccctgtgtacaaaagcgccaagcgaagaagactcactgagtagtgtgccaatatccccgtacaaagatgaaccctggaagtatctggaatctgaggaataccaggagagatatggctcacgaccagtatgggctgactataggcgcaaccacaaagggggagtgccaccacaaaggacaagaaaaacctgcatcaggcggaacaaagtggttgggaatccatgcccgatttgtagggatcacaaactgcacgtggacttccgcgagtccgtgtag

SEQ ID NO: 230835 - DNA, 366 bp, Artificial Sequence
  Description of Artificial Sequence: Synthetic coding sequence
atggcggcaagcgtgctgaatacggtcttgagaaggcttcccatgctcagcttgtttcggggaagccaccgagtgcaggtccctttgcaaacgctgtgtactaaggcccctagcgaggaggactctctctcaagcgtccctataagcccatataaagacgaaccatggaaatacttggagtctgaagagtaccaggagcggtacgggagtcgccctgtttgggctgattacaggcgaaaccacaaaggaggtgttccaccccaacggactcggaaaacctgtattagacggaacaaggtggtgggcaacccgtgtcctatttgcagggatcacaagttgcacgtggattttcgcgaatccgtatag

SEQ ID NO: 230836 - DNA, 366 bp, Artificial Sequence
  Description of Artificial Sequence: Synthetic coding sequence
atggccgctagcgtcctgaatacggtgctgcgcagactgccaatgctgagcctgttcagggggtctcacagagtacaagtgccactgcagacactatgtaccaaggcccctagcgaggaggacagtctcagctctgtgccaattagtccatacaaagacgaaccatggaaatatcttgagagtgaggagtatcaggagaggtacggttccagacctgtttgggccgattacaggagaaaccacaagggcggagtccctccacagcgaacaagaaagacctgtattcgcaggaataaagttgtaggaaacccctgccccatctgtagagatcacaagctacatgtcgactttcgagagagcgtgtag

SEQ ID NO: 230837 - DNA, 366 bp, Artificial Sequence
  Description of Artificial Sequence: Synthetic coding sequence
atggccgcaagtgtactaaacaccgtactgaggaggctgccaatgctcagcctattccgaggcagtcatagagtgcaggtgcctctccagacactttgtactaaagctcctagcgaggaagacagcctgtcttcagtgcccatttccccatacaaagacgagccatggaagtatctggaaagtgaagagtaccaggagcggtatggcagccggccagtatgggccgactatcgcaggaaccacaaaggaggagtaccccctcagcgcaccagaaagacctgcattaggcgcaacaaggtggtcggcaacccctgtccaatctgtcgtgatcataaactgcacgttgacttccgcgagtctgtctag

SEQ ID NO: 230838 - DNA, 366 bp, Artificial Sequence
  Description of Artificial Sequence: Synthetic coding sequence
atggccgcaagcgtacttaatacggtgctgcggagattgcctatgctgtccttattcagaggcagccacagggtgcaggtgccccttcagaccctgtgcacaaaagcaccgtcagaggaagacagcctgagtagtgtgccaattagcccctataaagatgagccttggaaatatctggaaagtgaggagtatcaggaacgatatggctctcgcccagtatgggctgattatcgtcgaaatcacaaaggtggtgtgccaccccagaggacacgaaagacatgtatccggagaaacaaggtggtcggcaatccgtgtccgatctgtcgggaccacaagctgcacgtagatttccgagaatccgtctag

SEQ ID NO: 230839 - DNA, 366 bp, Artificial Sequence
  Description of Artificial Sequence: Synthetic coding sequence
atggccgcaagtgtcttgaatactgtcctcaggcggctgcctatgctctctttgtttcgtggctcacaccgcgtgcaggtgcctcttcagactttatgcaccaaggccccttctgaggaagactccctgagctcggtgcccatctcaccctacaaagatgaaccctggaagtacctggagagcgaagagtatcaggagcggtacggctctaggcctgtatgggcagattaccggagaaaccataaaggcggtgttcctcctcagcgcacccggaaaacctgcatccggcgtaacaaggttgtcgggaacccctgtcctatttgtcgcgaccataagctgcacgtggacttccgagaaagcgtatag

SEQ ID NO: 230840 - DNA, 366 bp, Artificial Sequence
  Description of Artificial Sequence: Synthetic coding sequence
atggctgcatcagtcctgaatactgtactacgaaggcttccgatgctgtccctgttcagggggtcccatagagttcaggtgcccctccagaccctgtgcaccaaagctccttccgaggaagacagcctttctagcgtgccaatttccccttataaagacgagccatggaagtacctagaatcagaagagtatcaggagcggtatggcagccgacctgtctgggctgattacagacgtaaccacaaggggggtgtcccccctcagaggacacgcaagacctgcatcaggcgaaacaaagttgtgggcaacccctgccccatttgtagggaccacaaactccacgtggattttagagagtccgtgtag

SEQ ID NO: 230841 - DNA, 429 bp, Artificial Sequence
  Description of Artificial Sequence: Synthetic coding sequence
atggcggctgtggtggcagtgtgcggcggactagggcgtaagaagcttacccatctggtgaccgcagccgtaagtctgactcaccccggaacacacaccgtcctgtggaggagaggatgtagccagcaggtgtcctcgaatgaggacctgccaatatcgatggagaacccatacaaagagccgcttaaaaagtgtatcctttgcggcaagcatgtggattacaagaacgtgcagctactgagccagtttgtgagtcccttcaccggatgtatttacggacggcacattaccgggctgtgtggaaagaaacaaaaagagatcaccaaggccattaaacgcgctcaaatcatgggtttcatgcccgtgacatacaaagatcctgcctacctgaaagatcctaaagtgtgtaacatcaggtatcgggaatag

SEQ ID NO: 230842 - DNA, 345 bp, Artificial Sequence
  Description of Artificial Sequence: Synthetic coding sequence
atggcagctgtagtcgctgtctgcggaggccttggacgcaagaaactgacacatctcgtcacagccgcagttagtctcacccatcctggcacccacaccgtcctatggaggaggggatgctctcagcaggtctctagcaatgaggatttgctgctgtctcagtttgtcagcccttttacagggtgtatttacggtagacatatcaccggcttatgtggtaaaaagcagaaagaaattactaaggccatcaagcgggctcaaataatgggtttcatgcctgtgacttacaaggatccagcctatttgaaagatccaaaggtatgtaacatcagatatcgcgaatag

SEQ ID NO: 230843 - DNA, 891 bp, Artificial Sequence
  Description of Artificial Sequence: Synthetic coding sequence
atggctacatcatccgctgccttgccacgaatccttggtgccggagcacgagctccaagtagatggttaggtttcctggggaaggctacacccagacctgccagaccctccagacggactctggggagtgctactgccctcatgatacgcgagagcgaagactcaacagactttaacgataaaatattgaatgagccactgaagcactcagatttcttcaatgtcaaggagctgttttcagtaaggtctttattcgatgcacgcgtgcacctgggtcataaggctgggtgccgccatcgcttcatggagccctacattttcggctcacggttggatcacgatataatcgacctcgaacagaccgccacccatctccagctcgcccttaattttacagcacacatggcttatagaaagggcattatcttatttatctctcggaaccggcaattctcctatctgatcgaaaatatggccagggattgtggcgaatatgcacacacccgttatttcagaggcggtatgctcacaaacgcccgtttgctgtttgggccaactgttcgccttcccgatctgataatttttctgcatactcttaacaatatcttcgagccacacgttgctgtccgtgatgccgctaagatgaacatccctactgtgggaatcgtcgacacaaattgtaacccttgcctaataacctatccagttcccggaaacgacgatagtcctctcgccgtacatctgtactgcaggctcttccagacagccattactagagccaaggaaaagagacagcaggttgaggccctgtaccgtctccagggacagaaggagcctggggatcagggacccgcacacccccctggggcagatatgtctcactctttgtag

SEQ ID NO: 230844 - DNA, 891 bp, Artificial Sequence
  Description of Artificial Sequence: Synthetic coding sequence
atggccacttcctctgccgctttgcccagaatacttggtgccggagccagagccccttcccgctggctggggttcctcggaaaggctacacccagaccagccaggcctagcaggaggactctcggaagcgccaccgcgcttatgattcgggaatcagaggatagcacggacttcaatgacaaaattttgaacgagccactgaaacacagcgactttttcaatgttaaagagctctttagcgtacggtcgctctttgatgctcgggtgcatctaggacacaaagctgggtgccggcaccgctttatggagccttacatcttcggctcccggcttgaccacgacatcattgatctcgagcagaccgctacgcatctgcaactagcactcaacttcacagcacacatggcctaccgaaagggtatcatcctatttatctcgcgtaaccgccagttttcatatttgattgagaacatggccagggattgtggcgaatatgcacacactagatactttagagggggaatgcttacaaatgctagactgctcttcgggcctaccgttcgactgcctgacctgatcatctttcttcacaccttaaacaacatatttgaaccccacgtggctgtccgggacgcggcaaagatgaatatccccaccgtcggcatagtggatactaattgtaatccttgcctcatcacctacccagtacctgggaacgacgactctcccctcgctgtgcacctgtattgtaggctgttccagacagctataacgcgcgcaaaagaaaagaggcagcaggttgaggctctctatcgcctgcaaggccaaaaggaacctggcgatcagggccctgcccatccacctggagccgatatgagccattcactctag

SEQ ID NO: 230845 - DNA, 813 bp, Artificial Sequence
  Description of Artificial Sequence: Synthetic coding sequence
cgccgtggacctctgggtatgcggtggggggcaggggtcgtgcactcagggttgggtgctagaacttctatctactttcctccgggagcgagagcgccttccaggtggctgggatttttaggcaaggctacccctcggcctgcacgcccttctcggaggactcttggcagtgccactgccctgatgataagggagagtgaagattcaacagattttaacgacaaaattctgaacgagcctttgaaacacagtgactttttcaacgttaaggaactcttttcagtaagatctctgtttgacgctagagtgcatctgggacataaggcaggatgccgtcataggtttatggaaccatatattttcggcagccgcttagaccatgatattatcgacctggagcagacagctacccacctgcagctcgcactgaactttaccgctcacatggcctatcggaagggcatcatcttgttcatttctcgtaaccgacagttttcctacctcattgagaatatggcacgagactgcggggaatacgcacatactcggtacttcaggggcggtatgttgaccaacgcgaggctgttgttcgggcctacagtccgtttgccagacctcatcattttccttcacacgctgaataacatttttgagccacacgtggcagtgcgggatgcagcaaagatgaacattccaaccgttggcattgtagacacaaattgtaacccttgcctcattacatatccagtccccggtaacgatgattctccactggcagtgcacctctattgtagactatttcagacagcatag

SEQ ID NO: 230846 - DNA, 264 bp, Artificial Sequence
  Description of Artificial Sequence: Synthetic coding sequence
atggcaaaacatcttaagtttatcgcgaggacagtgatggtgcaagagggcaatgtggagtctgcctatagaaccctcaacagaatactcactatggacggactgattgaggacatcaaacataggcgctactacgaaaagccatgtaggcggaggcagagagagtcttacgagcggtgccgtagaatttataacatggaaatggccagaaagattaatttcctcatgaggaagaatcgggctgacccttggcaaggatgctag

SEQ ID NO: 230847 - DNA, 264 bp, Artificial Sequence
  Description of Artificial Sequence: Synthetic coding sequence
atggccaagcatttgaagtttatcgccaggacagtaatggtacaggagggtaatgtggaatctgcctacagaacacttaatcgcatcctgacgatggatggacttattgaagacatcaagcatcgccgatattacgagaaaccctgcaggcgcaggcagagggagagttacgaacgctgtcggagaatttacaacatggaaatggctagaaaaattaattttctcatgagaaaaaacagagccgacccgtggcagggatgctag

SEQ ID NO: 230848 - DNA, 1083 bp, Artificial Sequence
  Description of Artificial Sequence: Synthetic coding sequence
atggccccattgggcacaaccgtgttgttgtggtccctgctgcgctcaagcccaggcgttgagcgagtgtgtttccgagcacgcatccaaccgtggcatggaggactcctgcagcccctgccgtgctcgtttgaaatggggctaccccgtcggagattttctagcgaggccgcagaatcaggaagtcccgaaacaaagaagcctacctttatggatgaagaagtgcaatcgattttgactaaaatgaccgggctcaacctccagaagacattcaaaccggcaattcaggaactcaaaccccctacctacaaactgatgactcaagcacagctggaggaagccaccaggcaggcggtcgaggcagcaaaggtgcgactgaaaatgccgcctgtcctggaggaaagggtcccgatcaacgatgtcctggctgaagacaagatcctcgaggggactgaaactaccaagtatgtttttacagacatttcttatagcatccctcacagggagcgctttatcgtggtcagggagcctagcggcaccttacggaaggcttcatgggaagagagagataggatgattcaggtctatttccccaaggaaggcagaaaaatcttgaccccgatcatattcaaagaagaaaacctccgcaccatgtattctcaggaccgccacgtagatgtgttaaatctgtgcttcgctcagttcgaacctgactccacggaatacatcaaggtccaccataaaacttacgaagatatcgataaaagaggcaagtatgatttgctgagaagcacccgttattttggcggtatggtgtggtatttcgtaaataacaaaaagatcgacggtctactgatcgatcagattcagcgtgaccttattgacgacgccaccaatctcgtgcagctgtatcacgtcctgcatccggatggacaatccgcccagggtgctaaagaccaggctgccgaggggatcaatctgattaaggtcttcgccaagacagaagctcaaaagggcgcatacattgagttgaccctgcagacgtatcaagaggccctcagtcgccactcggccgcaagttag

SEQ ID NO: 230849 - DNA, 1080 bp, Artificial Sequence
  Description of Artificial Sequence: Synthetic coding sequence
atggctcctcttggcactactgtgctgctttggtcactcttgaggtcctcccctggagtagagcgcgtctgcttcagggccagaattcagccatggcacgggggactgctacagcccctgccatgctccttcgagatgggactgcctcgtaggaggttctccagcgaggccgaatccggcagccccgaaaccaaaaagcctacttttatggatgaggaggttcaaagtattttgacaaagatgacgggactaaatctgcagaaaaccttcaaaccagcaatccaggagttgaagccccctacctataagctcatgacacaggcccagctggaggaggccacgcggcaagcagtggaggctgccaaggttcgactgaagatgcctcccgttctggaggaacgcgtgccaatcaacgatgtgttggctgaggataagattctcgaaggaacagagaccaccaagtatgttttcacagacatttcgtatagtatcccacacagagaaaggttcattgtggtccgcgaaccctcaggcactcttaggaaagcttcttgggaggagcgggaccggatgattcaggtgtactttcccaaagaagggaggaagattctgacgcccattatctttaaagaagagaacctgcgtaccatgtactcccaggatagacacgtggatgtgctaaatctatgtttcgcccagttcgagccagacagtaccgaatatatcaaagtacaccacaaaacttacgaggacattgacaagcggggaaaatatgacctgcttcgctctacccgatacttcggtgggatggtgtggtacttcgtgaataataaaaaaattgacggactcctgattgaccagatacaacgggacttgattgatgacgccacgaatctcgtccagctctatcacgtcctgcatcccgacggtcagtccgctcagggagccaaagaccaggctgccgagggcataaatctgataaaggtttttgccaaaacggaagcccaaaaaggtgcatatattgaactgactctgcagacctaccaggaggccctctcccgccatagcgccgcaagctag

SEQ ID NO: 230850 - DNA, 960 bp, Artificial Sequence
  Description of Artificial Sequence: Synthetic coding sequence
atgtccagaaacgagaccgagcaccggtacctcggcacgcacttcggagccgagtcaggttccccagaaaccaagaaacccacttttatggacgaagaggtccagtcaatcctcacaaaaatgacgggcctcaatctgcagaaaacgtttaaaccagcgatccaggagctgaaacccccaacctacaagctgatgacccaggcgcagctggaggaggcaaccaggcaggctgtggaggcagctaaagttcggttaaagatgcctcctgtgcttgaggagcgcgtaccaattaacgatgtgcttgctgaggacaagatactggaaggcactgagaccactaagtacgtcttcactgacattagctattcgattccccatagggaacgttttattgtggtgagagagccgtctggaaccctccgaaaagcaagctgggaggagcgagaccgtatgatccaagtgtattttcctaaggaggggcgaaagattttgacgcctatcatcttcaaggaggaaaatctacgcaccatgtactcccaggaccgccacgtcgacgtgcttaacctctgcttcgcgcagtttgaacccgattctactgagtatatcaaagttcaccacaaaacatatgaagatatcgacaaacgcggtaagtatgacttattgcgatctacccgctatttcggcggaatggtctggtacttcgtgaacaataaaaaaatcgatggacttctcatcgatcagatccaaagagacctgatcgatgacgctaccaacctcgtgcaattgtatcacgttttgcaccccgacggccaatcagcacagggcgcaaaagaccaggccgctgaggggattaatcttataaaggtcttcgccaagacagaggcccaaaaaggagcatatatagagctgacgttacaaacttaccaggaggcactgagccgccactccgccgctagctag

SEQ ID NO: 230851 - DNA, 1083 bp, Artificial Sequence
  Description of Artificial Sequence: Synthetic coding sequence
atggccccactgggcacaacagtcttgctttggtcactgctaagatcgtccccaggtgtggagagggtgtgcttccgggcaagaatccaaccctggcatggcggactcctgcagcctctcccatgcagctttgagatggggttacctcgcagaagattttcaagcgaggccgctgagagtggctctccggagactaaaaaaccaactttcatggatgaggaagtccagtcgatcctgacaaagatgacaggccttaatctacagaagacatttaaaccagccatccaagaattgaagcctcccacatataagctaatgactcaggcgcagttagaggaagcaactagacaggctgtggaggctgccaaagtgagactgaaaatgcccccagtgctggaagaaagggtgccgatcaacgacgtgcttgcagaggacaagatacttgaaggtacagaaactacaaagtacgtattcaccgacattagctacagcataccacaccgcgaaaggttcatcgtggtgcgcgaaccatctgggactctccggaaggcatcatgggaagaacgggaccggatgattcaggtgtattttcccaaggaaggtcgcaaaattctgactcctatcatattcaaagaagagaatttgcgcacgatgtactcccaggaccgccatgtcgacgtacttaacttgtgcttcgcccagttcgaacccgactctactgaatacattaaggtgcatcacaagacctatgaagacatcgacaagcgcggtaaatacgatttgcttagaagtacaaggtacttcggcggaatggtctggtattttgtgaataacaaaaaaatcgatggtcttctgatcgaccagattcaaagagacctcatagacgatgccaccaacttagtgcagctgtatcacgtcctgcatcccgacggccaaagcgcacaaggggctaaggaccaggccgctgaagggatcaacctgattaaggtttttgctaaaaccgaggcacagaagggagcatacatagaactgacactgcaaacttaccaggaggctctaagtcgtcactccgccgcaagttag

SEQ ID NO: 230852 - DNA, 507 bp, Artificial Sequence
  Description of Artificial Sequence: Synthetic coding sequence
atggctcccctcgggacaacagtgctgttatggagcctcctgagaagctcccccggtgtggagagagtgtgcttcagagctagaatccagccttggcacggcggattgctgcaaccgctcccctgctcattcgaaatgggtttacccagaagaaggttttcttccgaagccgaatccggctctcccgagactaaaaaaccaactttcatggacgaggaagttcagagtatcttgacaaaaatgactggcctgaatctacaaaaaacgtttaaacctgccatacaggagctgaagcccccaacatacaagttaatgacccaagcgcaacttgaagaggcgacccgtcaggctgtggaagctgccaaggtccgtctcaagatgccaccagtattggaggaaagagtgcccattaatgatgttctggctgaggacaagattctggagggaactgagaccaccaagtatgtttttacagacatcagctacagcatcccccatcgttgttag

SEQ ID NO: 230853 - DNA, 573 bp, Artificial Sequence
  Description of Artificial Sequence: Synthetic coding sequence
atggcagggtcaagactggagacagtgggctccatcttctcccgcactcgagacctagttcgcgcaggggtgctcaaagagaaacctctttggtttgatgtctacgatgcattcccccctcttcgcgagccggtgttccagcgccctcgagtgagatacggcaaggctaaagcccctattcaggatatctggtatcacgaggatagaataagagccaagttttatagtgtctatggatcagggcagagagcgttcgacttatttaatcctaattttaaaagtacctgtcaaagattcgtcgagaagtataccgagttgcagaaactgggggaaaccgatgaggagaaattattcgtggagactggcaaagctctactagcagagggtgtcatactcagaagagtgggcgaagcgagaactcagcacggagggtctcacgtgtcgcgcaagtctgaacatctcagcgttagaccccagacggcccttgaagaaaacgagacacagaaggaggtgcctcaggaccaacatctggaagcccctgctgaccaatcgaaaggattgctccccccatag

SEQ ID NO: 230854 - DNA, 504 bp, Artificial Sequence
  Description of Artificial Sequence: Synthetic coding sequence
atggcggcaagcgtctgttctggacttctgggccctcgagtgctgtcatggtcacgtgagcttccttgcgcctggcgcgcactccacacatcccctgtgtgcgccaaaaatagagcagcacgagtgagagtcagtaagggggacaaacccgtgacatacgaggaggctcatgcaccccattatatcgcccaccgtaagggttggctcagcctgcatacagggaacttagatggagaggatcacgctgccgaaaggacagtggaggacgtatttctgaggaagtttatgtggggaaccttccccggttgtctcgcagatcaattggtgctgaagagacgcggtaaccagctggagatatgcgctgtagttctgagacagctgtctccccacaagtattacttcttggtcggttatagcgagacgctcctctcctatttctacaagtgccctgttcggctccatctccagaccgtgccgagtaaagtggtgtataagtatctatag

SEQ ID NO: 230855 - DNA, 522 bp, Artificial Sequence
  Description of Artificial Sequence: Synthetic coding sequence
atgcctatgaagggccgttttcccatcagaagaactttacagtatctgtctcagggcaatgttgtgtttaaggactctgtgaaagtgatgaccgttaattataacacccacggtgaactcggagagggcgcacggaaattcgtgtttttcaacatcccacagatccagtacaaaaacccgtgggtccagatcatgatgtttaaaaatatgaccccttcccccttcctcaggttctacttggactcaggcgaacaagtactggtggacgtcgaaaccaagtctaacaaggagattatggagcatatacgcaagattttgggcaaaaatgaggagacccttagggaggaggaagaggaaaagaaacagttgtcacacccagcaaattttggtcctcgaaaatactgtctgcgtgaatgcatttgcgaagtggagggtcaggttccttgtccatctttggtccccctgcctaaggagatgagaggaaagtacaaagctgccctgaaagccgacgctcaagactag

SEQ ID NO: 230856 - DNA, 333 bp, Artificial Sequence
  Description of Artificial Sequence: Synthetic coding sequence
atgcctatgaaaggacggttccctataaggcggacactacaatacttaagccagggtaacgtcgtatttaaggactccgtgaaagtgatgactgtaaattacaatactcatggggaactgggggaaggcgcacgaaaatttgttttctttaatataccccagatccagtataaaaatccttgggtgcaaattatgatgttcaagaacatgactcctagtccgtttttgcggttttatctcgatagtggcgagcaggttttggttgatgtggagaccaagtctaataaggagattatggagcatataagaaagatcctgggcaagaacgaatag

SEQ ID NO: 230857 - DNA, 390 bp, Artificial Sequence
  Description of Artificial Sequence: Synthetic coding sequence
atgcctatgaagggcaggttccctattagaaggactttgcaatacttgagtcaaggcaacgtggtctttaaggactcagtgaaagtgatgactgtgaattacaacacacatggagagctaggcgaaggcgcaaggaaatttgtattctttaacattccgcagatccaatacaagaatccctgggtccagattatgatgtttaagaatatgacaccgtccccattcctgcgcttctacctgggaaagccttcaggcaaaagaagaaggcgcaagtcttctttcctgacacagccgacttcagctctggagagcaccgcatgtgggtctgctagcgtgaagtggaaaggcaggtgccccgctcccgcatggtgtcactatcccaggcggtag

SEQ ID NO: 230858 - DNA, 333 bp, Artificial Sequence
  Description of Artificial Sequence: Synthetic coding sequence
atgccaatgaaggggagatttccaatcagacgcactctccagtatctgagccagggaaacgtggtattcaaggactccgtcaaggttatgaccgtgaactacaacacccacggcgagctgggtgagggtgcacgaaagttcgtgttcttcaacatcccacagatccagtacaagaacccatgggtgcagattatgatgttcaaaaatatgaccccttctcctttcctccgcttttaccttgactctggggagcaggtgttggtagacgttgagactaaatccaataaagagataatggagcacatcaggaaaatccttgggaaaaatgaatag

SEQ ID NO: 230859 - DNA, 438 bp, Artificial Sequence
  Description of Artificial Sequence: Synthetic coding sequence
atgcccatgaaaggaaggtttccaatccggagaaccttgcaatatctgtcccagggtaacgtggtattcaaagattcagtaaaggtgatgactgtgaactataatactcacggtgagctcggcgaaggggcacggaagttcgtcttcttcaacattccacagatccagtacaagaatccttgggtgcagatcatgatgttcaagaatatgacccccagtcccttcctgaggttctatctcgacagcggcgaacaagtcctggttgatgtggaaacgaagagtaataaagaaatcatggagcacatccgcaaaatactcgggaaaaatgagcattacctcgccgctccaagcaaaccggtgtcatctgctgtggttccggtcactcaggaggccgaggccggagggagccttgaacctcgccgacttaggttggaatag

SEQ ID NO: 230860 - DNA, 618 bp, Artificial Sequence
  Description of Artificial Sequence: Synthetic coding sequence
atgttgagagcactctctcgtttgggcgctggcacaccatgcagacccagagcccctctagtacttcccgctcgcggtaggaaaacaagacatgatcccctagctaaatccaagatcgaacgtgtcaacatgccccctgctgtcgaccccgcagagttcttcgtgcttatggaacgataccagcactacaggcagaccgtgagagctctgaggatggagtttgtgagcgaagtgcagcggaaggttcatgaagctcgggctggagtgctggcggagcggaaagccctcaaggacgctgcggaacatcgggaattgatggcgtggaaccaggccgagaaccgcaggctccatgagctcaggatagctcgcctgcggcaagaggagcgggagcaggagcaacggcaagccctcgaacaggccaggaaagccgaggaggtgcaggcttgggcccagagaaaggaacgggaggtcctgcagctacaggaagaagttaagaacttcatcacacgggaaaaccttgaggccagggtagaggctgctctcgattcccggaagaactacaattgggctatcactagggaaggtctcgtagtccgaccacagcggagagacagttag

SEQ ID NO: 230861 - DNA, 1245 bp, Artificial Sequence
  Description of Artificial Sequence: Synthetic coding sequence
atggccgcatcgattgttcgcagaggcatgttactcgcaagacaagttgtacttccacagctgtccccagcaggaaagagataccttctttccagcgcgtatgtcgactctcacaagtgggaagcacgtgagaaggaacattactgccttgccgacctggcgagcctgatggacaaaaccttcgagaggaagctacccgtgagtagcttgacgatttcaaggctcattgacaacatctctagtcgcgaagagattgatcatgccgaatattacctgtataaattcaggcacagtccgaattgttggtatttgcgcaactggaccatccacacgtggatcaggcagtgccttaaatatgacgcccaggataaggccctgtacacgttggtaaataaggtgcaatatggaatcttccctgacaactttaccttcaatcttctgatggactcattcattaagaaagagaactacaaggacgctttgtctgtggtgtttgaagtaatgatgcaagaggcttttgaagtgccaagcacacagctgctgtcactgtatgtgttgttccactgccttgccaagaagacagacttcagctgggaagaggagcgcaattttggtgcgtcgctcctacttccgggactcaagcagaaaaatagcgtggggttcagcagccagctgtacggctatgcgctgctggggaaggtggaattgcaacaggggcttcgcgctgtttaccataatatgcccctgatttggaagccaggctacttagaccgtgccctgcaggtaatggagaaggtggcagctagtccggaggatattaagctttgccgagaggcgctagacgtcctaggggctgtcttaaaggctctgacctccgcagacggcgcaagcgaggaacaatctcaaaatgacgaggacaatcagggcagcgaaaagttagtggagcaactggatatagaagagaccgagcagtctaaactcccacaatacctggagcgctttaaggctctgcacagcaaacttcaggcactgggaaagatcgaatcggaggggttactgtccctgaccacacagctcgtgaaggaaaaactcagcacgtgtgaagctgaagatatagccacctatgaacaaaaccttcagcagtggcacctcgatctcgttcagctaatccaacgagagcagcagcagcgcgagcaggcgaagcaggagtatcaggcccaaaaggcagccaaggcatctgcctag

SEQ ID NO: 230862 - DNA, 1077 bp, Artificial Sequence
  Description of Artificial Sequence: Synthetic coding sequence
atggacaagaccttcgaaagaaaactgcccgtatcttcactcactatctcaaggctaatcgataatattagctccagagaagagattgaccatgctgagtactacctctacaaattcaggcactctccaaattgctggtacctacgcaactggaccattcacacttggattcgccaatgcttgaagtacgatgcacaggacaaggccttgtacacactggtcaacaaggtccagtatggcatctttcccgacaattttacattcaatctgctaatggactcttttatcaaaaaagagaactacaaggacgccctcagtgttgtgtttgaagtgatgatgcaggaggcttttgaagtgccttccactcagttactgtccctgtacgtgcttttccactgtctggcgaagaagaccgacttttcgtgggaagaggaacggaacttcggggcatcgctgctgttacctggtctcaagcagaagaacagtgtgggcttcagttctcagctgtacggctacgctctgctgggtaaggtggaactgcagcaggggctccgagctgtgtaccataacatgccattaatttggaaacctggctatctcgatcgggctcttcaggtgatggaaaaggtcgccgcatctcctgaagatataaagctgtgtagagaggcccttgatgtgctgggtgcggtgctgaaggccctcaccagcgccgatggcgctagtgaggagcagtcacagaatgatgaagacaaccagggatctgagaagttagtggagcagctcgatattgaagagacagagcaatcaaagcttccacagtacctggaacgttttaaggcactccattcgaagctgcaggccctgggcaagattgagtctgaggggttgctgtctttaactactcagctggttaaggaaaagctgagcacctgcgaggctgaggacatcgcaacttatgagcagaatttgcaacaatggcacctcgacctggtacagctgatccagcgagaacaacagcaacgcgagcaagcaaagcaagaatatcaagcccagaaagccgctaaggcctctgcctag

SEQ ID NO: 230863 - DNA, 1287 bp, Artificial Sequence
  Description of Artificial Sequence: Synthetic coding sequence
atggcagcctcaattgtaagaagaggtatgctgctggcaaggcaagtggtcctgccccagttgtctcccgcaggaaaaaggtaccttcttagcagtgcatacgtggattcccacaaatgggaagcaagagagaaggaacattattgtctggcagacttggcttccctaatggacaagacctttgagcggaaattgcctgtgtcatcactgaccatttccagattgatagataacatcagttcgcgagaagaaattgatcatgctgaatattatctttataaaaaaggggagtgctcaagctcaaacccacaaaattactccagatttagacattctcccaattgctggtaccttcgcaactggactattcacacttggatccggcaatgtcttaaatacgacgcacaggataaggccttgtacactctggtcaacaaagtacagtacgggattttccctgataactttaccttcaacttactgatggattcctttattaaaaaagagaactataaggatgcccttagtgtggttttcgaagttatgatgcaggaggccttcgaggtgccgagcacgcagctcctgagtttgtacgtcttattccattgcttggcaaagaaaacagatttcagctgggaagaggaaagaaatttcggtgcgagcttactacttcctgggctgaagcagaagaattcggtcgggttcagttcccagctttatgggtatgcgctgcttgggaaggttgagctccagcagggtctgcgtgccgtctatcacaacatgcctctgatctggaagcccggttatcttgatagggcattgcaggttatggaaaaagttgcggcatcgccggaggatatcaagctgtgtcgggaggccctagacgtgcttggtgcagtgctgaaggctctgacctccgccgacggggcatctgaagagcagtcacagaacgacgaggataaccagggctccgaaaaactggtggaacagcttgacatcgaggagaccgaacagtctaagctgccccagtatttggaaagatttaaggccctgcattcaaaacttcaggccctcggtaaaatcgagtctgagggcctcctcagcctcaccacccagctggtcaaagaaaaactcagtacgtgcgaagctgaggatatagcgacctacgaacagaacctgcaacaatggcatctcgatctggtccagttgattcagagagagcagcagcagcgggagcaagcaaagcaggagtaccaggctcagaaggcggcaaaagcaagtgcctag

SEQ ID NO: 230864 - DNA, 564 bp, Artificial Sequence
  Description of Artificial Sequence: Synthetic coding sequence
atggccgcactgtgtagaacccgggcagttgctgccgaatcccatttcctgcgcgttttcctatttttccggccattccgcggagtgggaacagagtcaggcagtgaatccggtagcagtaatgccaaagaacccaaaacaagagcgggaggctttgcaagcgccctggagagacacagcgagttactgcagaaggtcgagccactgcaaaagggttcacccaagaatgtggaatcattcgcgagtatgctccgccactctcccctcacgcagatgggtcccgcaaaagacaaactcgtaattggacgaatattccacatcgtggagaatgatctctacatcgacttcgggggaaaatttcactgcgtgtgccgcagacccgaagttgacggagagaaatatcaaaaagggactagagtgcgcctcagacttttggatcttgaactaaccagtcggtttctcggcgctacaactgacacaaccgtgctggaggccaatgctgtgctgttaggtatccaggaatcaaaggactcgcgctctaaagaggagcaccacgaaaagtag

SEQ ID NO: 230865 - DNA, 1320 bp, Artificial Sequence
  Description of Artificial Sequence: Synthetic coding sequence
atggccgcagcacgctgttggcgcccacttctccggggtccaagactctctctgcacactgcagccaacgccgcagccacagcaaccgagactacctgccaggacgtagccgcaacacccgttgcaaggtacccacctattgtagcttcaatgactgcagatagtaaggcggctaggctcagaaggatcgagcggtggcaagctaccgtccatgcggcagagtcagtcgacgagaaactcagaatcctgaccaaaatgcagttcatgaaatacatggtgtatccccagaccttcgcgttgaacgcggatagatggtaccaatattttacaaagacagtattcctcagcggcctgccccctcctcctgcggaacctgagcccgagcccgagcccgaaccggagcctgcactggatcttgccgctcttcgtgccgtcgcctgcgattgtctcctccaggagcacttttatttgaggaggcggagacgggtgcacaggtatgaagaaagcgaagtcatctccctccctttccttgaccagctcgtcagcacacttgttggattgttgagcccccacaacccagccctggcagctgcggctttggattatcgatgcccagtacacttctactgggtgagaggcgaggaaattatcccacggggtcatcgtcgtgggaggatagacgatctcagataccagatcgacgacaagccgaataaccagattcgcatctccaagcagttggccgaatttgtgccacttgattatagcgtgcccatagagatccccaccatcaaatgcaaacctgacaagttgcccctttttaaacggcaatacgaaaatcatatattcgtcggcagcaagaccgcggatccctgctgttacggtcacacacagttccatctccttcctgacaagctccgtagggaacgcttattgagacagaactgtgccgaccaaatcgaagtggtctttcgggctaatgcgatagcaagtctgttcgcctggaccggagcccaggccatgtaccaaggtttttggtccgaggcagatgtgacaagaccatttgtttcccaagccgtgataaccgatggtaaatatttttctttcttttgctaccaactcaacacgctggcattgacaactcaggccgaccagaataacccgcgaaagaatatatgttggggaactcagagcaaacccctgtacgagactatcgaggataacgatgtgaagggatttaacgatgacgtattactgcaaatcgttcatttcctcctgaacagacccaaagaggagaagtcacagctgctagagaactag

SEQ ID NO: 230866 - DNA, 1188 bp, Artificial Sequence
  Description of Artificial Sequence: Synthetic coding sequence
atgtttccaagggtaagcaccttcctgccactgcgcccactcagccggcaccctttgtcttctggaagccccgaaacctccgccgctgctattatgcttcttaccgtaagacacggaacagttcggtacaggtcctctgcattgctggcacggacaaagaataatatccaaaggtatttcggcacgaacagcgtgatctgtagtaagaaagacaaacagagtgtgcggaccgaggagacatctaaagaaacatccgagtcccaggattccgagaaagaaaacaccaagaaggatcttcttggaatcataaagggaatgaaggtggaattgtctacagttaacgtccggactaccaagcctcccaaacgaagacctctgaaaagtctggaagccaccttaggtcgtttgagacgcgcaacagaatacgcaccgaagaagagaatcgagccactctcaccagagttggttgctgctgcctcagctgtcgccgacagtttgccatttgacaaacaaaccacaaaatctgaactgttgagtcagctccagcagcacgaggaggaaagcagagcccagagagatgcaaaacgccctaagatctccttttctaatatcatctccgacatgaaggtggctcgctctgcaactgccagggttcgctcaagacctgaactgcggatccagtttgacgaagggtacgacaactatccaggacaggaaaagaccgacgacttgaaaaaaaggaaaaacatcttcacaggaaagaggctcaacattttcgacatgatggcagtgactaaggaagctcctgaaaccgacaccagcccttctctctgggacgtggagttcgctaagcaactggcaacagtcaatgagcaaccactccagaacggcttcgaagaattgatccagtggacaaaagagggaaagctgtgggaatttcccatcaataatgaggccggtttcgatgacgacggaagcgagtttcacgagcatatcttcctggagaagcacctcgagtctttcccaaagcagggtccaatcagacacttcatggaactggtgacctgcggcctctctaagaatccctatctgtccgttaaacagaaggtcgagcacatcgagtggttccgtaattacttcaatgagaagaaagatatattgaaagaatccaacatccagttcaactag

SEQ ID NO: 230867 - DNA, 321 bp, Artificial Sequence
  Description of Artificial Sequence: Synthetic coding sequence
atgtcgtccttgtccgaatatgcgtttaggatgtcgcgccttagcgctcgcctattcggcgaggtgacaagacccacaaatagcaaatctatgaaggttgtgaaactgtttagcgagctgcctctggcaaagaaaaaagagacctatgattggtacccaaaccaccatacctatgccgaactgatgcagacgttgagattccttggcctgtatcgagatgaacaccaggatttcatggatgagcaaaaaagactcaaaaagttgcggggaaaagaaaaacctaaaaagggcgaagggaagcgggcagcaaaacgcaagtag

SEQ ID NO: 230868 - DNA, 321 bp, Artificial Sequence
  Description of Artificial Sequence: Synthetic coding sequence
atgagctcattgtccgagtacgcatttaggatgagtagactgtccgcgaggctcttcggggaggtcacacggcctaccaactcaaaatcaatgaaggttgtgaagctgtttagcgagctcccactggcaaagaagaaggaaacctacgactggtaccccaatcaccacacctacgcagagttgatgcagactctgagatttctcggcctgtatcgggatgaacaccaagattttatggatgagcagaaacgtttaaaaaaactacgcggaaaggagaagcccaaaaagggggaagggaaacgagccgctaaaagaaagtag

SEQ ID NO: 230869 - DNA, 321 bp, Artificial Sequence
  Description of Artificial Sequence: Synthetic coding sequence
atgagctctttgtccgagtacgcatttcggatgtcccgcctctccgctcggctatttggcgaggtgaccaggcctaccaattctaagagcatgaaagttgtgaagttgttcagcgaattaccgttagctaaaaagaaggagacctacgactggtacccaaaccaccatacctatgcggagcttatgcagacactccggtttctgggactatatagggacgaacaccaggatttcatggatgagcagaagcgattaaagaaattgcgcggaaaggaaaaaccaaagaagggagaaggtaagagggcagcaaaacgaaagtag

SEQ ID NO: 230870 - DNA, 321 bp, Artificial Sequence
  Description of Artificial Sequence: Synthetic coding sequence
atgagcagtctgtccgaatacgcgttcaggatgagtaggctgagcgcccgtctatttggggaggtcactcggcctacgaacagtaaatccatgaaggtggtcaagctttttagtgagctacccctggccaaaaaaaaagagacgtacgactggtatccaaaccaccatacctacgcagagttaatgcaaacactgcgctttcttggtttgtatcgtgatgagcatcaagacttcatggatgaacagaagcgactgaagaagctaagaggcaaggagaagcctaagaaaggggaggggaaaagggctgccaagcggaagtag

SEQ ID NO: 230871 - DNA, 339 bp, Artificial Sequence
  Description of Artificial Sequence: Synthetic coding sequence
atgtccagtctgtcagaatacgccttccggatgtctcgcttgtccgcacgactgttcggagaggtgactcgacccacgaatagcaagagcatgaaggttgtaaaactctttagtgagctccccctggcgaagaaaaaggaaacttacgactggtatccaaaccaccatacctatgccgaattgatgcaaacgttgaggttcctgggactgtatagagacgagcatcaggacttcatggacgaacagaagcggctcaaaaagctgcgcggaaaagaaaagccgaagaaaggggaaggcaaacgggctgctaagcgtaaaaaaaagaaaaagaagcgatag

SEQ ID NO: 230872 - DNA, 678 bp, Artificial Sequence
  Description of Artificial Sequence: Synthetic coding sequence
atggccaggaagaaggtccgccctcgcctgattgctgaactggcaaggcgcgttagagccttgagggagcagctgaacagacctcgggattcccagctttacgcagtggactacgagactctgacccgcccatttagtgggagaagacttcctgtgcgtgcctgggctgacgtgaggagggagagccgactgctgcagctgctcggtcgactaccccttttcggactaggtcgtctggttacgcgaaagagttggctttggcaacacgatgaaccctgctactggagactgacaagagtgcggccagattatactgcacagaacctggatcacggcaaagcatggggaatcctcaccttcaaagacgcaagtttttcctcctctggcaaaacagagagcgaagcaagggagattgaacacgtgatgtaccacgactggaggctggtgcccaagcatgaggaggaagcttttacagcctttacccccgctcctgaggattccttggctagcgtgccatatccgcctctgctccgggctatgattattgccgagagacagaagaatggagacacatcgactgaggagccgatgttgaacgtgcagcgcattcgcatggaaccctgggattatcctgccaagcaggaggacaaagggcgtgcgaagggaaccccggtgtag

SEQ ID NO: 230873 - DNA, 657 bp, Artificial Sequence
  Description of Artificial Sequence: Synthetic coding sequence
atggcacggaaaaaagtccgtcctaggctgatagctgagctcgcgcgtagggttcgggctttaagggagcagctaaatagaccacgagatagccaactttatgccgttgactacgaaaccctgacccgccctttcagtggcaggaggctgcccgtgcgtgcatgggctgatgtgagacgcgaatcgcggctacttcaactgctcgggcgactgcccctctttggcctcggaagattggtgaccaggaaatcttggctgtggcagcatgacgagccatgttactggaggctgacaagggtgaggcccgattataccgcacagaatctggatcacgggaaagcatggggtattctaacgtttaaaggcaaaaccgagtcagaggccagagagatcgagcacgttatgtatcacgattggcgcttggtgccaaagcacgaggaggaggcctttaccgcgtttacccccgctcctgaagactcactggcatccgttccctaccctcccttgttacgggctatgataattgccgaacggcagaagaacggcgacacgagcacggaagagccaatgctgaacgtacaacgcatcaggatggagccatgggattatcccgctaagcaggaggacaaaggtcgagccaaagggacccccgtgtag

SEQ ID NO: 230874 - DNA, 972 bp, Artificial Sequence
  Description of Artificial Sequence: Synthetic coding sequence
atggctgctgcagcattaccagcctggctgtcactgcagagtcgtgcaaggaccttgagggccttcagcacagccgtgtacagtgccacccctgtgcccactccttcattgcccgaacgaacaccgggtaatgaacggccacctcggcgtaaggcattgccccctagaactgagaagatggctgtggatcaggactggcccagtgtctaccctgtggcggcacctttcaaaccatctgccgtccccctccccgtacgcatggggtatccggttaagaaaggggtcccaatggctaaggagggcaacctggaattactcaagatccccaactttttgcacctaacgcccgtggccatcaagaagcactgcgaggcactcaaggatttttgcaccgaatggcccgctgccctggactcggatgagaaatgtgaaaagcacttcccaatcgaaatagattctaccgactacgtcagcagcggcccaagcgtccgcaacccccgagcacgggtggtcgtgctcagggttaaactaagcagcctgaatctggatgatcacgccaagaagaaactaatcaaacttgtaggggaaagatactgtaaaaccactgacgtactaacgattaagacagatagatgccccctgaggcgccaaaactatgactacgctgtgtacttactgacagtgctataccacgagagttggaacacagaagagtgggaaaaatctaaaaccgaggccgacatggaggagtatatctgggagaactccagcagcgagaggaatatcctggaaactctgctacagatgaaggcagctgagaaaaacatggaaatcaacaaagaagaactgttgggcactaaagaaatagaagagtataagaagagtgtcgttagtctgaaaaacgaagaggagaacgagaatagcatttcccaatataaggagagcgtgaaacgccttctaaacgtgacttag

SEQ ID NO: 230875 - DNA, 864 bp, Artificial Sequence
  Description of Artificial Sequence: Synthetic coding sequence
atggctgccgctgccttacccgcttggctcagcctgcagtctagggcacgaacactgcgagcattcagcactgcagtgtacagcgcgactcctgtccctaccccttccctgccagaacgcacacctggtaatgagcgtcctccaaggaggaaggccctgcccccaaggaccgagaagatggcagtggaccaagattggcctagcgtgtaccctgtcgccgctccattcaagccctccgccgtccctctgcccgtacggatgggatatccagtcaaaaaaggcgtccctatggcaaaggagggcaacctggaattactgaaaattcctaacttccttcacttgacaccagtggctatcaaaaagcattgtgaggctctcaaggacttttgtacggaatggcccgctgctttggactccgacgagaaatgcgaaaagcacttcccaatcgaaatcgacagtacagattatgtctcttctggacctagcgtgcgcaaccccagggcgagagttgtagtgttacgcagatgtcccctccgacggcaaaattatgactacgctgtttatttgcttaccgtactgtaccatgagtcatggaacactgaagaatgggaaaaaagtaagaccgaagctgacatggaagaatacatctgggaaaatagtagcagtgaacgcaacattctcgagacattgcttcagatgaaggccgctgagaagaatatggagataaataaagaggaactgctaggcaccaaagagatcgaggagtacaagaaatctgttgtctccttgaaaaatgaagaagagaacgagaacagcatttctcagtacaaggagtctgtaaagaggttactgaatgtgacctag

SEQ ID NO: 230876 - DNA, 585 bp, Artificial Sequence
  Description of Artificial Sequence: Synthetic coding sequence
atggcagccgcagccctgcccgcttggctgtctctgcaaagccgcgctcggacactgcgggcattctccacggccgtgtatagtgccacgcctgttcccacaccgtctcttcccgagcggaccccaggcaacgaacgaccacctcgccgaaaagccctgcctcctcgcacggagaagatggccgtggatcaggattggccatccgtttacccagtcgccgctccgttcaaaccttcggccgtcccgctgcccgtgagaatgggatacccagtcaaaaagggcgtgccaatggccaaggagggtaacctcgagttgttgaaaattcccaacttcctgcacctgactccggttgcaatcaagaagcactgcgaggctttaaaagacttttgtactgaatggccggctgcccttgattccgatgagaaatgtgagaagcatttccccatcgagatagattccaccgactacgtgagctcaggtccatccgttagaaaccccagggccagggtcgtggtattaagggtgccgtttaaggaagcagagctccggctgtgcagcgtctcgaccaatagcgtgatcccttag

SEQ ID NO: 230877 - DNA, 312 bp, Artificial Sequence
  Description of Artificial Sequence: Synthetic coding sequence
atgatgggcagcaaaatggccagcgcatctagagtagtacaagtggttaaaccccacacccctttaattcgtttcccagaccgcagggacaacccaaaaccaaatgtctctgaggctcttcgctcagctggacttccctctcacagctccgtgatcagccagcacagcaagggctccaaatcccctgacttactcatgtaccaagggcctcccgatacggccgaaattatcaagacactacctcagaagtaccggagaaagttagtaagccaggaagagatggagtttattcaacgaggaggacccgaatag

SEQ ID NO: 230878 - DNA, 1293 bp, Artificial Sequence
  Description of Artificial Sequence: Synthetic coding sequence
atggcgacagccgttcgggctgtcgggtgtctgccagtgttatgctcaggcacagctgggcatctactcggacgacagtgcagcctgaacacgctcccagctgccagcattttggcttggaagtcggtgctggggaatggacatttatcctcgctcggcacccgggacacacatccctatgcctccctgtcccgagcactgcagacccagtgttgcatctcctctccctctcatcttatgtcgcagcagtatcggccttattcatttttcacgaagctgaccgctgacgagctgtggaagggagccctggccgagacaggggcaggagccaagaagggccgaggaaaacgaactaagaagaagaaacggaaggacctcaacagaggacagattatcggagaaggcagatatgggtttctctggcccggacttaatgtgcccttgatgaaaaatggagccgtgcagaccattgcccagcgaagcaaagaggagcaggagaaagtggaggccgacatgattcagcaacgtgaggagtgggaccggaaaaagaagatgaaggtgaaacgagagaggggttggagtgggaacagctggggcggtatttccctcggccctccagacccgggaccatgcggcgagacttacgaagactttgacacaagaattctggaggttcgcaacgtgttcaccatgactgctaaagagggacgcaaaaaatccataagggtgctggtcgccgttggtaacggtaagggggcagccggattctccatcgggaaggctaccgaccgtatggatgctttccgtaaggctaagaatcgggcagtgcaccacctacattacatcgaacgctacgaagaccacactatcttccatgacattagccttcggttcaagcgcacccatattaagatgaaaaaacagcccaaaggttatggattaaggtgtcatagggcaattatcacaatctgccgcctgatcgggatcaaggacatgtacgcaaaggtgtctggaagcattaacatgctgtccctgacacagggacttttcagagggctaagccgccaggaaacccatcaacagttagccgacaagaaaggtctgcatgtcgttgaaattagggaggaatgcggacccctccctattgttgtggcctcccccaggggtccactccggaaagatcccgagcccgaggacgaagtccccgatgttaaactcgactgggaggacgtgaaaaccgcacagggtatgaagagatccgtatggtctaacctgaagagggccgcaacatag

SEQ ID NO: 230879 - DNA, 378 bp, Artificial Sequence
  Description of Artificial Sequence: Synthetic coding sequence
atgccaaggtacgaactggccctgatcctgaaggcgatgcagaggcccgagactgccgctacactcaagaggaccatcgaggctctcatggatcgtggggctattgttagggatctggagaacctgggcgagagagctctcccttatcgcatctccgcacacagccagcagcataatagaggtggttactttttagtggatttctatgcgcctacagccgcagtagagtctatggtagagcacttgtccagagatatcgacgtgatcagaggcaacattgtgaagcatcccttgacccaggagctgaaggagtgcgagggcatcgtccctgtcccactggctgagaaactctattctacaaagaaacgcaagaagtag

SEQ ID NO: 230880 - DNA, 729 bp, Artificial Sequence
  Description of Artificial Sequence: Synthetic coding sequence
atggccgctcctgctgtgaaagtggctcgcggttggagcggtctggccctgggtgtccgcagggcggtgctgcaactcccgggactaacccaggttagatggagcaggtactctccagaatttaaggatcccctgattgacaaagaatactaccgaaaaccagtggaggagctaactgaggaggagaagtatgtgcgggaactgaagaaaactcaactgatcaaggccgctcctgccggaaagacaagctctgtgttcgaagatccagtgatatcaaagttcacaaacatgatgatgattggaggtaataaggtactcgccaggagcttaatgatccagaccttggaggccgtcaaaagaaaacagtttgaaaagtatcacgccgcaagtgccgaggaacaggctacaatcgagcggaacccctatacaatcttccaccaagccctgaagaattgcgagcccatgatcggcttggtgcctatccttaaggggggtagattctaccaggttccagttcccctacccgatcggaggcgccgtttcctggcaatgaagtggatgattaccgagtgccgcgacaagaaacaccagagaacactaatgcccgagaaattatcccacaagctgctcgaagcgttccacaatcagggcccagtcatcaagcgcaagcatgaccttcataagatggccgaggccaaccgcgcactggcccattatcggtggtggtag

SEQ ID NO: 230881 - DNA, 1191 bp, Artificial Sequence
  Description of Artificial Sequence: Synthetic coding sequence
atggctgccccttgcgtgtcatacggcggagccgtgagctatcgtctgcttctctggggtcgcggaagcctcgcacggaagcaaggcctgtggaagacggcggctcctgaactgcagactaacgtgagatcgcaaatactgagactgaggcacactgcctttgttataccaaagaagaacgtgcccacctccaagcgggaaacctacacagaggattttatcaagaagcagattgaagaattcaatatcggaaaacggcacttagcaaacatgatgggagaagaccctgaaacattcacccaggaggacatagaccgcgcaatcgcctatttgtttcctagcggtctttttgaaaagcgcgctaggcctgtgatgaaacaccctgagcagatttttccccgacaacgcgcaatacagtggggcgaagatggtaggcccttccattatcttttttacacgggaaagcaaagctattacagccttatgcatgacgtatatgggatgctattaaacctcgaaaaacatcagtctcacctgcaggcaaaaagcctgctccctgagaagacggtgactagagacgttattggaagtagatggctgatcaaagaggagctggaggagatgcttgtggaaaaactgtccgacctggactacatgcaatttatacgcctcctcgaaaagcttctcacttctcagtgtggagctgctgaggaagagttcgtgcagaggttccggaggtcagttaccctggagtctaagaagcagctcattgagcccgtgcaatatgacgagcagggcatggcattcagcaaaagtgaagggaagcgtaaaaccgcaaaggcggaggcaatagtgtacaagcatggcagcgggaggattaaagtaaacggaatcgattatcagttgtactttccgataacacaggatcgagagcaactgatgtttcccttccacttcgtcgatcgcttaggaaagcacgacgtgacttgtacggtgtcagggggaggccgatccgcgcaggcaggcgctattcgactcgcaatggccaaggccctatgcagcttcgttactgaagacgaggtggaatggatgcgacaggcagggctccttacaacagaccctagggttagggagaggaagaaaccagggcaagagggcgctcgtcgcaagttcacatggaaaaaaaggtag

SEQ ID NO: 230882 - DNA, 1122 bp, Artificial Sequence
  Description of Artificial Sequence: Synthetic coding sequence
atgtgggtctgctctaccctctggagggttaggaccccagctcggcagtggagaggcctgcttcctgcctccggatgccatgggcctgccgcttccagctacagcgcttcagcggaacccgctcgcgttagggctctggtatatggccaccacggcgacccagcgaaggtagtcgagctgaaaaacctggaacttgccgctgtccgcggttcagatgtgcgcgttaagatgctcgccgcacctatcaacccctcagacatcaacatgatacagggcaactatggcttccttcctgaactccccgcagttggagggaacgagggagtggcgcaggttgttgcagtaggctccaatgtgaccggcctgaaacctggcgactgggtgattccagctaacgctggattaggcacatggagaaccgaggccgtgttctccgaagaggccctcattcaggtcccttcggacatcccgctgcagagcgccgcaacactgggcgtgaacccctgtaccgcctataggatgttaatggatttcgaacagctgcagcccggtgatagcgtgattcagaacgcctccaactccggtgtcggtcaagcagttatccagattgccgctgccttggggctgcggacaatcaacgttgtgcgggataggccagacatccagaagctcagtgatcgcctgaagtccctgggcgcagagcacgtgatcactgaagaggagcttcgccgacctgagatgaagaacttctttaaagacatgccccagcctagattggcactcaattgtgtgggcggtaaaagcagtacagaacttctgcgacagctcgcgaggggcggaaccatggtgacttacggcggtatggcaaagcagcccgtggtggcttctgttagtctgctgatattcaaagatctcaaactgagaggcttctggctgagtcaatggaaaaaggaccatagccccgaccagtttaaggagctgatactcacgctgtgtgacctgatacgcagaggccaattaacagctccagcttgttctcaggttccactgcaggattatcagtcagctttggaggctagtatgaagcccttcattagcagcaagcagatccttactatgtag

SEQ ID NO: 230883 - DNA, 894 bp, Artificial Sequence
  Description of Artificial Sequence: Synthetic coding sequence
atgctggctgcccctatcaatcctagtgacatcaatatgattcaaggcaactatggcttcttgcctgaacttcctgcggtgggaggcaatgaaggagtggcccaagtggttgcagtcggctctaacgttacaggattgaagcccggtgactgggtgatcccagctaatgccggtctggggacctggaggactgaggccgtcttctcagaggaagcattgatccaagtgccttccgacattcccctccaatctgcagcaacgctgggggtgaacccctgcaccgcttaccgcatgctgatggattttgaacagttgcagcccggtgacagcgtgattcagaatgcatctaattcaggcgtgggacaggctgtgattcagatcgctgctgcacttggcctgaggaccattaatgtcgttcgtgaccggccagatatccagaagttgagcgaccggttgaaatccctgggtgcggaacacgttatcacagaggaggaactgagaagacctgaaatgaaaaacttcttcaaggacatgcctcaacctaggctagccctcaactgtgttggcggaaagtcctctaccgagttactaaggcagctggcaagggggggaactatggtgacttacggaggcatggctaaacagcccgtagttgcctccgtctcgttacttatcttcaaggacctaaagctccgaggtttctggctaagccagtggaaaaaggaccacagcccggaccagttcaaggagctcatcctgacactgtgcgatttaataaggagggggcaactaactgcccctgcctgcagtcaggtgcctctccaggattatcagagcgcgcttgaagcttcgatgaaaccctttatttcttcaaagcaaatcctcacaatgtag

SEQ ID NO: 230884 - DNA, 789 bp, Artificial Sequence
  Description of Artificial Sequence: Synthetic coding sequence
atgattcagggtaactatgggtttctacctgaactgcccgcagtgggcggtaacgagggcgtggcccaggtggttgcagtcggaagtaatgtgactggccttaaacctggcgactgggttattcccgctaacgctggactgggtacatggagaacagaagccgtgttcagtgaggaagcactgatccaggtcccaagcgacatccctctacaatccgccgctaccctcggggtgaatccatgtacagcctaccggatgttaatggactttgagcagctccagcctggagattctgtaatccaaaacgcttctaactccggcgtcggtcaggccgtgatacagatcgcagccgctctggggttgcgcaccatcaacgtcgtcagggatcgccctgatattcagaaactaagcgaccggctcaagtctttaggagccgagcatgtaattacggaggaggagctgagaaggccagagatgaaaaattttttcaaaatcaggaaactccgattaaggaaagaagagatgctaaatcagaatcacatcgtgtacaagggtagccgcgaatcagagctggcctccgtttccccgaactctaaacccttgaatttgccagaacctccgcctcacaacatgccacggcacgcccctgctaccgcctgtagccagctttgttggtgggaaaagctgcaccgggctgccgcagcagtgtccgcatggagaaaccatggcaatctgtggggagatggacaagccgcacgcagaagcctttgcgaacccgcacatttctag

SEQ ID NO: 230885 - DNA, 570 bp, Artificial Sequence
  Description of Artificial Sequence: Synthetic coding sequence
gccactctgggcgtaaatccctgcacggcataccgaatgctgatggattttgaacagctgcagcccggtgattccgtgatccagaatgccagtaacagtggggtgggtcaagcagtaattcagatagccgctgctctcggccttcggaccatcaacgtcgtgagggacaggcctgacatccagaagctgtctgacaggctgaagtctctcggcgcagagcacgtgattacagaagaggagcttcgacggccagaaatgaagaactttttcaagattcggaaactgcgccttaggaaggaagagatgctgaatcaaaaccacattgtgtataaggggtctagagaatctgaacttgcgtcggtatcgccaaattcaaagccactcaacctgccagagccgcctccacacaacatgccaaggcacgcacctgcaaccgcctgctctcaactgtgctggtgggaaaaactccaccgagcagccgcagcagtgagtgcctggcggaaccatggtaacttgtggggggatgggcaagctgctaggcgcagcctgtgtgaacccgctcatttctag

SEQ ID NO: 230886 - DNA, 1200 bp, Artificial Sequence
  Description of Artificial Sequence: Synthetic coding sequence
atgcagtctctttctctgggtcaaacatcaatttcaaagggattgaattaccttaccataatggctcccggaaatctctggcatatgaggaacaactttctttttgggagtagatgctggatgactagattttcagccgaaaacattttcaaatctgtgagcttccgtctatttggcgtgaagtgtcacaatactgactcggagcccctcaaaaatgaagatcttctgaagaacttgctcactatgggcgtcgatatcgatatggccagaaaacgacagcccggagtgtttcataggatgatcacaaatgaacaagatctaaaaatgttcctgctctctaagggggctagcaaagaagtgatcgcgtccatcatttcccgttatccacgggctatcaccaggactcctgagaatcttagtaaacggtgggatctgtggcgcaagatcgttacttcagatctcgaaattgttaacatcctagaacggagccccgaatccttcttcaggagtaacaataatctgaatctcgaaaacaatattaaatttctgtactccgttgggttgaccaggaaatgcctctgccgattattgacaaatgccccaaggactttttcaaactctttagatctgaacaaacagatggtagaattcctgcaggcagccggactttccctgggccataacgacccagctgatttcgtgaggaaaatcatctttaaaaacccttttattctgatccagtctacaaaacgcgtgaaggcgaatatagagtttttgcgatctaccttcaatttaaactctgaggaactcctagtcctgatatgcggcccaggcgctgagattctggacctatccaatgactatgccaggcgatcctatgcaaatattaaggagaagttattctcactagggtgcacagaagaggaggtccagaagtttgtgttgtcttacccagatgtcatttttctcgccgagaaaaaatttaacgacaagattgattgcctcatggaggagaatatttcaatcagtcaaattattgagaatccacgggttctggactcctcaatctctactctgaagagccgaatcaaggagctcgtgaacgctggatgcaacttgagtacgctgaacatcactctgctgtcgtggagcaaaaaacgctacgaagcaaagctgaaaaagctttctcgctttgcatag

SEQ ID NO: 230887 - DNA, 477 bp, Artificial Sequence
  Description of Artificial Sequence: Synthetic coding sequence
atgcagtcactttcattgggccagacgtctatcagtaagggcctgaactaccttacaattatggctccaggcaacttatggcatatgagaaacaattttctcttcggaagcagatgctggatgacccggttttctgccgaaaacatcttcaaatctgtaagcttcaggctgtttggcgttaagtgtcacaacacagattctgagccactaaaaaacgaggatctgctcaagaatctgttgactatgggcgtggatattgatatggcccgtaagagacaaccgggtgtgttccataggatgatcacgaatgagcaagacttgaagatgtttctactatccaagggtgcatcaaaagaggttatagctagcattatctccaggtaccctagagcaattacgcgcacccctgagaacctatccaagagatgggatctctggcgcaagattgtcacatcagacctggagatcgtgaactag

SEQ ID NO: 230888 - DNA, 2184 bp, Artificial Sequence
  Description of Artificial Sequence: Synthetic coding sequence
atgaaccaaaaactcctgaaactcgaaaacctgctgcgatttcataccatttacagacagttgcacagcctgtgtcaacggagggcacttagacagtggcgccacggattcagctcagcctaccctgtgtggaccgcccagctgtgcgcgtggccttggcctaccgacgtcctgacaggggcagccttgagccagtaccgcctgctggtcactaagaaagaagaaggcccatggaaatcccagttgtcaagtactaagtctaagaaggtggtggaagtgtggattggcatgaccatcgaggaattggcccgtgctatggagaagaatactgattatgtttatgaggctttgctgaacactgatattgacatcgattctttggaagcagactctcacctcgacgaggtgtggatcaaagaggtgattaccaaagctggaatgaagctgaagtggagtaagttgaagcaggacaaggtgcgtaaaaacaaggacgccgtcaggagaccccaggctgaccccgcacttcttacaccaagatccccagtggttaccattatgggccatgtcgatcacggcaagacaactctactcgataagtttcgcaaaactcaggtggctgcagtggagaccggcggaattacacagcacattggagcgtttctggttagcctgcctagcggggagaagattacttttctggatacccccggtcacgctgcatttagcgcaatgagagcacgcggagctcaagtcaccgacatagtggttttggtcgtcgctgccgacgatggggttatgaagcaaactgtggaatctatccaacatgccaaagacgctcaggttcccattattcttgccgtgaacaagtgcgacaaagctgaggccgaccctgagaaagttaaaaaggagttgctcgcttatgacgtggtgtgcgaagactacgggggtgatgtgcaggccgtgcctgtctctgccctcacgggagacaatttgatggccctggccgaagcaaccgttgccctcgccgaaatgctggaattgaaagccgatccaaatgggcctgtggaaggaacagtgatcgaatcctttaccgataaaggcaggggcctggtcacaaccgctattatccagcgaggtactctgagaaaaggaagtgtgctggtggccggaaagtgctgggccaaagtgagacttatgtttgacgaaaatggaaagactattgacgaggcgtatccatccatgccagtgggtatcactgggtggcgcgatcttccatccgcgggtgaagagatactggaagtcgagagtgaacccagagcaagagaggttgtcgattggcgaaagtacgagcaggagcaagagaagggtcaggaggacttaaaaattatcgaggagaagcgcaaggagcataaggaagcccatcagaaggccagggagaaatacggccacctgctctggaagaaacgaagcattcttcgttttctcgaaagaaaagaacagatccctctgaagcccaaagagaaaagggagcgcgacagtaacgtgttgagtgtaatcatcaaaggggacgtcgacgggagcgtagaagctatactgaacattatagacacatacgatgccagccacgagtgtgaactggagctggtgcactttggagttggcgacgtctcagccaacgacgtgaacttggccgagactttcgatggggtgatatacggcttcaacgtgaatgcgggtaatgttattcagcagagtgcggcaaagaaaggagtcaaaattaagttgcataagatcatctatcggctggtggaggacttacaggaggagttatcctcacggctcccttgtgctgtagaagaacatccagtgggtgaagcttctatcctggctacctttagtgtgaccgaaggaaaaaagaaggtcccggttgctggctgtagggtccagaaagggcaattggagaaacagaaaaagtttaagctgactcgcaatggccatgtgatttggaaaggatccctgacaagcctgaagcaccataaggatgatattagcattgtcaaaactgggatggattgcgggttatccttagacgaggacaatatggaattccaggttggggaccgcattgtgtgttatgaagaaaaacagattcaagcgaagacttcctgggacccaggtttttag

SEQ ID NO: 230889 - DNA, 219 bp, Artificial Sequence
  Description of Artificial Sequence: Synthetic coding sequence
atgaatcaaaagttgctgaaattggagaatctgctccggtttcatacaatctaccgtcaattacactctctctgtcagcggcgtgctttaagacagtggcgacatgggttctcctcagcctaccccgtgtggaccgcgcagctgtgtgcttggccatggcccacggacgtcctgacaggagccgctctatcccagtatcggctattagtgacaaaatag

SEQ ID NO: 230890 - DNA, 2184 bp, Artificial Sequence
  Description of Artificial Sequence: Synthetic coding sequence
atgaaccagaagctgctgaaattagagaacctcctgaggtttcacactatctatagacagctccacagcctgtgccagagacgggctttaagacagtggaggcacggattctcttcggcataccctgtctggacagctcagctgtgtgcctggccctggccaacggatgtcttaaccggggcagctctgtcccagtacaggctgctggtgacaaagaaggaggaggggccttggaaaagtcaactgtccagtaccaagagcaagaaggtggttgaggtatggataggtatgaccatcgaagaattagccagagccatggaaaaaaacaccgactatgtgtacgaagccttactgaatacggatattgacattgatagcctcgaggccgattctcacctggacgaagtttggatcaaggaagtaataacaaaagccggtatgaagctgaagtggtctaaactgaagcaggacaaggtaaggaagaacaaagatgccgtgaggcggcctcaggctgatccagccttacttactcccaggtcacccgtcgtgacaatcatgggccacgttgaccatgggaagacgactctcctcgacaagtttcggaagacccaggtggccgctgttgagaccggaggaattactcaacatatcggtgctttcctggtatcactcccgtccggcgagaaaataacattcctcgatacaccgggtcatgcagccttctccgctatgcgtgcccgaggggcacaggtgaccgatattgtcgtgctggttgtggctgctgacgacggtgtgatgaagcagactgtggagagtatccagcatgccaaagatgcccaggttccaattatcctggccgtcaacaagtgtgacaaggctgaggccgatcccgagaaagttaagaaagagctgctcgcctatgacgtggtttgtgaggattacggcggagatgtgcaggccgtgcctgttagtgcactgacaggggataatcttatggccctggccgaggcgaccgtcgctctggccgagatgctggaattgaaagctgaccctaatggcccagtcgaaggaacagtgattgagagttttactgacaagggacgtggattggtgacaactgcaatcatccagcgcggtaccttgagaaaaggtagcgtactggtcgctgggaagtgttgggcaaaggttagactgatgtttgacgagaacggaaagactatcgatgaagcctatccatccatgccagtcgggattacagggtggcgcgatctgcctagtgcaggcgaagaaattctggaagtcgagtctgaacctcgcgcacgcgaggtcgtggactggaggaaatacgagcaggaacaggaaaagggccaggaggatctgaaaattattgaagaaaagagaaaggagcataaagaagcacatcaaaaagcaagggagaaatacgggcacctactttggaagaaaaggtccatcctacgattcttagaacgcaaagaacagatccccctgaagccaaaggaaaaacgggagcgtgacagtaacgtgctctcggtaattattaaaggcgacgttgacgggtctgttgaagcaatcctcaatataatcgacacttacgacgcttctcacgaatgtgagcttgagttggtgcatttcggagtcggcgatgtgagcgcaaatgatgtgaatctggccgaaacatttgacggtgtgatctacggtttcaacgtgaacgccggaaatgttattcagcaatccgccgcaaaaaaaggtgttaagattaaactgcataagatcatttaccgtctggtggaagaccttcaggaggagttgagctcgagactcccttgtgcggtggaagaacaccccgtcggcgaggcgagcattctcgctactttttctgtgaccgaaggcaaaaagaaagtccccgttgccggatgcagagttcagaagggccagctggagaaacagaaaaaatttaaattaacccgcaacggccacgtgatctggaaaggcagtctcacctccttgaagcatcacaaagatgacatttcaatcgtgaagactggcatggactgcggactgtctctcgatgaggacaacatggagtttcaggtaggggacaggatcgtgtgctatgaagaaaagcagattcaggccaagacaagctgggacccaggcttctag

SEQ ID NO: 230891 - DNA, 2184 bp, Artificial Sequence
  Description of Artificial Sequence: Synthetic coding sequence
atgaaccagaagctgcttaaactcgagaatctactacgctttcacaccatctatagacaattgcactccctctgtcagcggagggcgctgcgacagtggcggcacgggttcagctcagcatacccagtctggaccgctcagttgtgcgcttggccatggccaaccgacgtactaacgggagccgcactgagccagtacaggctgctcgtgactaaaaaagaagagggaccctggaagtcccagctgagcagcaccaagagtaaaaaggttgtcgaggtttggatcggcatgactattgaggagctcgctcgagctatggagaaaaatacagactatgtttacgaagcactcctcaatacagacatcgatatcgatagtttagaggcagactcacatctggacgaggtatggattaaggaggttataaccaaggcgggtatgaaattgaagtggtccaagttaaagcaagacaaagttagaaagaacaaggacgctgttcgaaggcctcaagcagatccagccctactgacccccaggagcccggtggtgaccattatgggacatgtggatcacggaaaaactacgttgctcgataaattccgaaagactcaagtcgctgcagtggagaccggcggaatcactcagcacatcggggcattcctggtgagtttgccttctggagaaaaaataacgttcctggatactccaggccacgccgctttttccgccatgcgcgcaagaggagcccaagtgaccgacatcgtggtcctcgtggtggccgcagatgacggtgtgatgaagcaaactgttgaatcaattcagcacgcaaaggacgcccaggtgcccattattctggcggttaataaatgcgacaaggcagaggccgatcccgaaaaagtaaagaaagagctcctggcctacgacgtggtatgcgaggattacggaggcgatgttcaggctgtccctgtaagcgccctcacgggggacaacctgatggccctggctgaggcgaccgtggctctggctgagatgctggaacttaaagccgatcctaacggccctgttgagggcactgtgatagagtcgtttacagacaagggcagaggcttggtcacaaccgccataattcaaaggggcactctgagaaaagggagcgtactggtggccggaaaatgttgggctaaagtgaggttgatgtttgatgaaaacggaaagacaatagatgaggcctacccaagcatgcctgtgggaatcaccggatggcgcgatctcccatccgccggagaagaaatcctcgaagtggagagtgagcccagagcaagggaggtcgtggattggcggaagtatgaacaggagcaggagaagggccaggaggaccttaaaatcattgaagaaaagcgaaaagaacacaaagaagctcatcagaaggctagagaaaagtatggccacctcctgtggaagaagcgaagtatcctcaggttcctggaaaggaaggagcagatccccctgaagccgaaagaaaagcgggagagagatagcaacgttctgtcagtcataataaaaggagacgttgacggcagcgtggaagcaatcctcaatattatcgacacctatgacgcctcccatgagtgcgaactggagcttgtgcacttcggcgttggcgacgtgtccgccaacgacgtgaaccttgccgaaactttcgatggcgtgatctatggattcaatgtgaatgcgggtaacgttattcaacagtcagccgcaaaaaaaggagtaaaaatcaagctccacaaaattatttatcgactggttgaggatctgcaggaggagctaagcagtcgtctgccttgtgctgtcgaggaacacccggtgggggaagcttctattctggcgaccttcagcgtaactgagggcaagaagaaggtccctgttgctggatgtcgcgtgcaaaaagggcagctggaaaaacagaaaaaattcaagttgacccgcaacgggcatgttatttggaaaggttccttgactagcctcaaacaccataaagatgatatcagtattgtaaaaacaggaatggactgcggactctctctggacgaagacaatatggagtttcaagtgggtgaccgaattgtgtgttatgaggaaaaacagatacaagctaaaacttcatgggatccagggttctag

SEQ ID NO: 230892 - DNA, 213 bp, Artificial Sequence
  Description of Artificial Sequence: Synthetic coding sequence
atgaaccagaagttactgaaactagagaatttgcttcgcttccacacaatttacaggcagctacactctctgtgtcaacgcagagccttacgccagtggcgccatgggttctcgtcagcatatcctgtttggacagctcaattatgcgcttggccatggcccaccgacgtgttgaccggcgcagccttgtctcagtacaggctgctggtatag

SEQ ID NO: 230893 - DNA, 24 bp, Artificial Sequence
  Description of Artificial Sequence: Synthetic coding sequence
atgaatcaaaaactcctcaagtag

SEQ ID NO: 230894 - DNA, 33 bp, Artificial Sequence
  Description of Artificial Sequence: Synthetic coding sequence
atgaaccagaaattactgaagttagaaaattag

SEQ ID NO: 230895 - DNA, 81 bp, Artificial Sequence
  Description of Artificial Sequence: Synthetic coding sequence
atgaaccaaaagctgcttaagttggagaaccttctgagattccacacaatttatcgtcagctgcattcactctgccaatag

SEQ ID NO: 230896 - DNA, 216 bp, Artificial Sequence
  Description of Artificial Sequence: Synthetic coding sequence
atgaaccagaagttgctgaaattggagaacctgttgagatttcacacgatttatagacagctgcactccctgtgccagaggcgagcactgcggcagtggcgacacggcttttcaagtgcttaccctgtgtggactgcacagctatgtgcgtggccttggcccacggacgtgcttacgggcgcagctctgagtcagtacaggcttttagtcacgtag

SEQ ID NO: 230897 - DNA, 1398 bp, Artificial Sequence
  Description of Artificial Sequence: Synthetic coding sequence
atgaaccagaagctcctcaagttggagaacctcctacgctttcacacgatctaccgtcaactccactccctgtgtcagagaagggctcttagacagtggcgccatggcttctctagcgcgtatcccgtgtggacagcacaactgtgcgcctggccctggcccaccgatgtgttgacgggcgctgctctgtcacaatatagattactcgtaaccaagaaggaggagggaccttggaaaagccagttatcttctacgaagtctaagaaggtagtggaggtctggataggtatgactatcgaggagttggcccgagccatggaaaaaaacactgactatgtctacgaagctttgctgaatactgacatagacatcgacagtttggaagctgattcccacttagacgaagtgtggattaaagaggttattacaaaggctggaatgaaactgaaatggtccaaactgaagcaagacaaagtccgaaagaacaaagacgctgtgaggcgccctcaggcggatcccgctctgcttacacccaggtcacccgtggtaactattatgggccacgtcgaccacggcaagaccacattgttagacaagtttcgcaagacacaggtggccgctgtcgagaccggcggtattacacagcacattggtgcatttttggtgtctctccccagtggcgaaaagattaccttcctggacactccagggcatgcagcgttctcagcgatgagggcgcgtggcgctcaagtgacagatatagtcgtgcttgtcgttgccgctgatgatggagttatgaaacagactgtcgaaagtatacagcacgctaaagacgcacaggtgccaattattctggccgtcaacaagtgcgacaaggccgaagccgatccagaaaaggtaaagaaggagcttctggcttacgatgtggtgtgcgaggattacgggggtgatgtgcaagccgttcctgtttctgcgctcacaggggataacctcatggccctggcggaggccactgtggccttagccgagatgctggagctaaaggcagatcctaatggtcctgtagaaggaacagtgatcgagtctttcactgacaagggcagaggcttggtcaccactgcgataatacaacgaggaacactccgtaaaggatctgtacttgtcgccggaaaatgttgggccaaagtgagactgatgtttgacgagaatggaaaaacaatcgatgaggcataccccagcatgcctgttggaatcaccgggtggagagatttaccttcggccggtgaggagattctggaagtggaaagtgaaccgcgagcgcgagaggtcgtcgactggcggaaatatgagcaagagcaagagaagggtcaggaagacctcaagaaggaaaaaaactag

SEQ ID NO: 230898 - DNA, 456 bp, Artificial Sequence
  Description of Artificial Sequence: Synthetic coding sequence
atgaaccgtcatctctgcgtatggttatttcgccatccatcgttaaacggttatctgcagtgtcatatacagctgcacagtcaccagtttcgacagattcacctggatactagacttcaagtgtttcgccagaatcggaattgcatactgcacctcctgagcaagaactggtcgcggaggtattgccatcaggacaccaaaatgttgtggaagcataaggctctgcagaagtacatggagaacctatccaaggaataccagacgctcgagcagtgtctccagcacatcccagtgaatgaggaaaacagacgctctctgaatagaaggcatgctgaactggcccctctcgctgcaatctaccaggagatccaggaaacagaacaagccatcgaggagcttgaatcgatgtgcaagaaaactgagagctgcagtgttgctcaggccggtatgcagtag

SEQ ID NO: 230899 - DNA, 1338 bp, Artificial Sequence
  Description of Artificial Sequence: Synthetic coding sequence
atgaaccgtcatctatgcgtctggctgttccgccatccaagcttaaacggatacctccagtgtcatatccagttgcacagtcaccagtttcgccagatacatttagataccaggctgcaggtctttaggcagaaccggaactgtattttacatctgctgtcgaaaaattggtcacggagatattgccaccaggataccaagatgctctggaagcacaaggctctacagaaatacatggagaacctgtccaaggagtatcagacactagagcaatgtctccagcatattccagtgaacgaagaaaaccgaagatccctcaaccgtcgccatgcagagttagcacccttagcagccatctatcaagagatacaggagactgagcaggccatcgaagagttagaatccatgtgcaaatccctcaataagcaggacgagaaacaactgcaggagctcgctcttgaggaaagacaaacaatcgaccagaagataaacatgctgtacaacgaactcttccaatcgcttgtacctaaggagaagtacgacaagaacgacgtgatcttagaggttaccgccggaagaacgacggggggagatatttgccaacagtttacacgcgagatattcgacatgtaccagaactattcgtgttataaacactggcagtttgaacttctaaattacacacctgctgactacggtggactacaccacgcagcagcacgcatcagcggcgacggggtttacaaacatctgaaatacgaggggggtattcacagagtccagagaatcccggaagtgggcctgtcttcacggatgcaaagaattcacaccggaacaatgagtgtaatagtcttgccccagcctgacgaggtcgacgtaaagctcgaccctaaggacctgagaatcgacacattcagagcaaaaggcgctggtggtcagcatgtaaacaagaccgactctgccgtccgattggtgcacatccccacaggcttggtggtggagtgtcagcaggagcggtcgcaaattaagaataaggagatagctttccgagtgctgcgggcacgtctctaccaacaaatcatagagaaggataaacgtcagcaacaatctgcacggaaactgcaggttgggacccgcgctcagtccgagcgcatcaggacctacaattttactcaggaccgagtttcagatcatcgaatcgcgtacgaggtaagggacataaaggagttcctctgcggaggcaagggcctcgatcagctcattcagaggttactgcagagcgctgatgaggaggccatcgctgagcttctggacgaacacttgaaatccgctaagtag

SEQ ID NO: 230900 - DNA, 1338 bp, Artificial Sequence
  Description of Artificial Sequence: Synthetic coding sequence
atgaatagacacctgtgtgtatggctatttcgacacccttcactcaatggatatttgcagtgccatattcaactacattcccatcaattccgccaaatccacctcgataccagactgcaggtgttccggcagaacagaaactgcattctgcacctgctgagtaagaattggagccgaaggtattgtcatcaggacacgaaaatgctgtggaaacataaggctttgcagaagtacatggagaacctgtccaaggagtaccagaccctggaacagtgcctgcagcatattcctgtgaacgaagaaaacagacgttccctcaatcgccgacatgcggaactcgcgccactggctgctatatatcaagaaatccaagaaacagagcaagccattgaagaactcgagtcaatgtgtaagtcactgaataagcaggacgagaaacagctgcaggagctggcactcgaggaacgccagactatcgaccagaaaatcaacatgctctacaacgagctgttccagtcgctagtccctaaagagaagtatgataagaacgatgtgatcctggaggtgaccgccggtcgaactacggggggagatatatgccaacagttcacacgtgagatcttcgatatgtatcagaactactcctgttacaagcattggcaattcgagttgttgaattatacccccgcagactatggaggcttgcaccacgctgcagcaaggattagcggcgacggagtctataagcacctcaagtacgaagggggaatccatcgggttcagcgtattccagaggttggcctttctagccgcatgcaacgcattcataccggtaccatgtcggtgattgtgctgccccagcctgatgaggtggacgtgaagctggaccctaaggacctgcggatcgatacctttagagccaaaggcgcaggagggcagcacgtgaacaagactgattcagctgtgcgtctagtccatatacccacagggttagttgtggaatgccagcaggaacggagccagataaaaaacaaagagattgcattccgagtcttacgggcacgactttaccagcaaatcattgagaaagacaagcgccaacagcagtccgcaaggaagctgcaagttggtacccgcgcacaatcggagcgcatcaggacatacaatttcacacaagacagggtgtccgaccaccggatcgcctatgaggtccgcgacattaaggaatttctgtgcgggggaaaagggctagatcaactcatccaaagactgttgcagagcgctgacgaagaggccattgcagagctccttgacgaacaccttaagtcggccaagtag

SEQ ID NO: 230901 - DNA, 1407 bp, Artificial Sequence
  Description of Artificial Sequence: Synthetic coding sequence
atgggcaacggagaggtggtccttttttcagacgccgagatgaaccgacacctgtgcgtgtggctctttaggcacccgagcctaaacggatacctgcagtgccatatccagctgcattcccatcagttccgccagatccacctggatactcggctgcaggttttcaggcagaaccgaaattgtatcttgcacttgctgagtaagaactggagcagacgctactgtcatcaggatactaaaatgctatggaaacataaggccctgcagaaatacatggaaaacctgtcgaaggaataccagacactcgaacagtgccttcaacacatcccagtcaacgaagaaaaccgcaggagcctcaaccggaggcacgccgagctggccccactggcagctatctatcaggagatccaggagaccgagcaggctatagaggagctggagagcatgtgtaagtctctaaacaagcaggacgagaagcaacttcaagagctggccctcgaggagcggcaaaccattgaccagaagattaatatgctgtacaacgagctatttcagtccttagtgcctaaggagaagtacgacaaaaacgatgttatcctcgaagtaaccgctggcagaaccaccggcggtgacatatgccagcagttcacgagggagatcttcgacatgtaccagaactactcttgttacaagcattggcagtttgaactactgaactacacgccggcagattacgggggactgcaccacgccgcagctcgaatctcaggagacggcgtgtacaagcatctgaagtacgagggaggcatccacagagtacagcgaattcccgaagtaggactgagttctcggatgcaaaggattcacacaggcaccatgtctgtgattgtattgccccagccggacgaagtggatgttaagctggaccctaaagacctgcggattgacacctttcgcgcaaaaggcgcaggagggcagcacgttaataaaacggacagcgcagttagactggtccacataccgaccgggttggtggtggaatgtcaacaggaacggtctcagattaaaaacaaggagatagccttccgggtcctgagggccagattgtaccaacagatcatcgaaaaagacaagagacaacagcagtccgccaggaaactgcaggtgggcactagagcacaatccgaaaggatccgcacctataactttacccaagatcgcgtctctgatcaccgaatagcttacgaggttcgcgatatcaaggctcagagccatagtaccggcggtagcagggatccagcccattctacgttcctctctctagatagcgtgcggtcccccggaattctgatcatgacctcttcggtgcggaatttttatgtggtcggcagagcgtggatatcctag

SEQ ID NO: 230902 - DNA, 2274 bp, Artificial Sequence
  Description of Artificial Sequence: Synthetic coding sequence
atgtcgctgctgttttccaggtgcaactctatcgtgacagttaaaaaaaataagcgccacatggcggaggttaatgcctcccccctgaagcactttgtcaccgccaaaaaaaaaataaatggcatctttgaacagttaggcgcttatatccaggagagcgccacctttctggaagatacctaccgaaacgccgagttggatcccgtcacaacggaggaacaggtgctggacgtgaaaggctatctctcaaaagtccgtggcataagcgaggtcttagcacggaggcacatgaaagtggcgttctttgggcgaacctctaacggcaaatcaactgtcattaatgctatgctttgggacaaggtactccctagcggaataggacacaccaccaattgcttcctgcgggtagaagggactgacggccacgaagcgttcctgctcactgaaggctcggaggaaaaacggagcgccaagacagttaatcaacttgctcacgccctacaccaggacaagcagctccatgcaggatcccttgtctctgtcatgtggcccaatagtaaatgtcctttactcaaagatgatttagtgctcatggattctcctgggatcgatgtgacaacagaactggatagctggatcgataagttttgtctggacgccgacgttttcgtgctcgtcgccaactccgaatcaaccttaatgcaaacagaaaagcattttttccacaaagtgagtgagaggttatcgagacccaacatcttcatcctgaataatcgttgggacgccagtgcaagtgaaccggagtacatggaagaagttcgtcgtcagcatatggagaggtgtacatcatttctagtcgatgagttgggagtggtggacaggagtcaggctggggataggatttttttcgtgagtgctaaggaggtgctcaacgctcgtatccagaaagcccagggcatgcctgaaggcggaggagcactcgctgagggattccaagttcggatgtttgagttccagaacttcgagaggcggttcgaggagtgcataagtcagagcgctgtgaaaaccaaattcgaacaacataccgtccgtgcaaaacagatcgctgaggctgtgcggcttattatggactccctgcacatggccgctcgggagcagcaggtgtattgtgaggaaatgagagaggagaggcaggatagactgaagtttatcgacaaacagctggagctgcttgcacaggactataaactaaggatcaagcaaataaccgaggaagtcgaacggcaagtttcaacggctatggccgaggagattcggcgtctgtctgtgctggttgatgactatcagatggacttccatccatcccccgttgtgctcaaggtttataagaatgagttacaccgccacatagaagaaggtctgggacgcaacatgagcgaccgatgctcaacagccatcacaaacagcctccagactatgcagcaagatatgatcgatggcctgaaaccactactccctgtgagcgttcgaagccaaattgacatgctagtgccgcgacaatgcttctccttaaattatgatcttaattgcgacaagctgtgtgccgacttccaggaagacatcgagttccacttctctctgggatggacaatgcttgtgaatcggtttctgggccctaagaacagccgacgggctctgatgggatacaatgatcaggtgcagagaccgatccctttgactcctgctaatccttccatgccacccctgccacagggcagccttacacaggaggaatttatggtgagcatggtaactgggctggcctccttgaccagccggacaagcatgggaatacttgtggtgggaggggtggtgtggaaagctgttgggtggcgacttatcgcgctttcattcgggctctatggccttctgtatgtatatgaacggttaacctggactacaaaggctaaggagcgtgcctttaaaagacaattcgtagagcatgcttccgaaaagcttcagttggttattagctacaccggatcaaactgctcacaccaagtacagcaagagctctcaggcacgttcgcccacctgtgccagcaggtggacgtcactcgcgagaacctggagcaggaaatagcagccatgaataaaaagattgaagttttggacagcctgcagtccaaggctaaactgttgaggaacaaggcgggttggctggactccgagttaaacatgtttacacaccagtatctgcagccgtcaaggtag

SEQ ID NO: 230903 - DNA, 1311 bp, Artificial Sequence
  Description of Artificial Sequence: Synthetic coding sequence
atgcacccgcatcttagcactttatctctccctcgccgtagatccatggctttcctatcttcgtggggggctctggccgaggggttccaggttcgaatgttcgagtttcagaactttgagcggcgattcgaggagtgtatctcccagtcagctgtgaaaacaaaattcgagcagcacaccgttagggcaaaacaaattgcggaggccgtcaggctgatcatggactctctccacatggccgctcgcgagcagcaagtctactgcgaagaaatgagggaggagcggcaggacagactgaagttcatcgacaaacaacttgagcttctggcccaggactacaaactccgaatcaaacagattaccgaagaagtggaacgccaggtgagcactgccatggccgaggagattcgacggctgagcgtcctggtcgacgattatcaaatggatttccaccctagtcccgtagtactcaaggtgtacaagaatgagttgcacagacacatagaagaaggtctgggtcggaatatgtccgatcggtgtagcacagccatcacaaactcactgcagacaatgcagcaggatatgattgatggactcaagccgttgttgccagtgtccgtgcgttcccagatcgacatgctcgtccctagacagtgtttctccctgaattatgatctcaattgcgacaagctctgtgccgattttcaagaagacattgaatttcacttctcgctggggtggaccatgctagtaaacaggtttcttggaccaaagaactcacgaagagctctgatgggttataacgaccaggtccaaaggcccatcccattaacgcccgcaaacccctctatgccacctctgcctcaaggaagcctcacccaggaagagtttatggtatccatggtgactgggttggccagcctgacaagccgcacgagtatggggattcttgtggtcgggggagtcgtttggaaggctgtaggctggaggttgatcgctcttagctttggtctgtatggactgctctacgtatacgagaggctcacgtggaccacaaaagcaaaagagagagcctttaaaaggcagttcgttgagcacgcctccgaaaaattacagctggtgatcagctacacaggcagcaactgcagccaccaggtgcagcaagagctgagtgggacctttgctcatctttgtcagcaggtggatggcgaaaccttaagcgagcggagtatggctaaatccaccctcatgttgcttaccttactcttcttatgctcgttcgctggagcccaggacgttctaacccaatag

SEQ ID NO: 230904 - DNA, 297 bp, Artificial Sequence
  Description of Artificial Sequence: Synthetic coding sequence
atgtccttattgttcagccgctgcaacagtattgtgactgtgaaaaagaataaacgccacatggcggaagtcaacgcctcccccctgaagcatttcgtcaccgccaagaagaaaatcaatggaatcttcgaacagctgggggcttacatccaggaatcagctactttcctggaggacacctaccggaatgcagagttggaccctgtgacaacggaggagcaagtgctggacgtaaagggatacctctccaaggtacggggaatatccgaggttctggccagaaggcatatgaagtag

SEQ ID NO: 230905 - DNA, 2274 bp, Artificial Sequence
  Description of Artificial Sequence: Synthetic coding sequence
atgtcattgctgttcagtcggtgcaatagtatcgtcaccgtgaaaaagaataagcgccacatggcagaagtaaatgctagtccactcaagcattttgttacagccaaaaaaaaaatcaatggtatctttgaacagctgggcgcttacatacaggagtccgccacatttctggaagatacctatagaaatgcagaactggacccggtcaccaccgaggagcaagttctagatgtcaagggctatttgtcaaaagttaggggcatttccgaggtcctcgctcgccgacatatgaaagtagccttctttggtaggacaagtaatggaaaatctacagtgataaatgcaatgttgtgggataaggtgctgccttccgggatcgggcacaccaccaactgtttcttacgagttgaagggacggacggacatgaggcctttcttttaactgaaggatccgaggagaagaggtctgctaagaccgtgaaccaactggctcacgcgttgcatcaggataagcaattgcacgccggtagtctggtctctgtgatgtggccaaattccaagtgccccctcctcaaggatgaccttgtcttaatggactcgcccggtatcgacgtgaccaccgagctcgattcgtggatcgataagttctgtttggatgctgacgtgtttgtcctcgtcgcaaactcagagagtacccttatgcaaaccgagaagcatttttttcataaagtcagtgagaggctctcacgcccaaacatattcatcttgaacaatagatgggacgccagtgcaagtgaacccgaatatatggaggaggtcaggagacagcacatggaacggtgcacctcattcttagttgacgagctgggcgtggttgatcgctcccaggcgggtgaccggatcttttttgtatcagcgaaagaagtcttaaacgccaggattcaaaaagcacagggcatgcccgagggaggcggagctctagctgagggcttccaggtacggatgtttgaatttcagaacttcgaacgaagatttgaggaatgcatctcacaaagtgccgtaaaaactaagtttgagcagcataccgtgagggccaaacagatcgcagaggctgtgaggctgataatggattccctccacatggccgctcgcgaacagcaagtgtactgcgaggaaatgcgcgaagagaggcaggaccgcctgaagtttatcgacaaacagctggaactgctcgcacaggactataagctgaggattaagcaaatcaccgaggaggttgaacggcaggtgtctactgccatggctgaggagattaggcgactgagtgtccttgtggacgactaccaaatggacttccatccaagccctgtggtcttaaaggtctataagaatgagttgcaccgacacatcgaagaggggctgggccgtaatatgtccgacaggtgttcaactgccatcacaaacagccttcagaccatgcagcaagatatgattgatgggctgaaaccacttctccctgtctcagtgcgttcccagatagatatgctggtgcccagacagtgcttttccctcaactacgacctgaactgcgataaactgtgtgctgatttccaggaagacatcgagttccacttctccctcggttggacgatgcttgtgaacaggtttctcgggccaaaaaattctcggagagcgttaatgggctataacgaccaagtccaacgacccattcccttaactccagctaacccctccatgcctccactccctcagggctcccttactcaggaggaattcatggtctctatggtgaccgggctggcaagcttgacaagccgaacatcaatgggcatcctggtggtgggcggtgttgtctggaaggccgtcggctggcggctcattgccctcagcttcggtctgtatggactgctgtacgtgtacgagcgtctgacctggactacgaaagcaaaggaaagagctttcaagagacagtttgtggaacatgcatctgagaagctgcagctggtgattagctatacaggcagcaactgcagccatcaggtccagcaagagctgagcgggaccttcgcacacctgtgtcaacaagttgatgtgacacgggagaacttggaacaagaaatcgcagcaatgaataaaaaaatcgaagtgctggactcgcttcaatcaaaggcaaagctcttgaggaacaaggcagggtggctagactctgagctgaatatgttcacccaccagtatctgcaaccaagtcggtag

SEQ ID NO: 230906 - DNA, 1395 bp, Artificial Sequence
  Description of Artificial Sequence: Synthetic coding sequence
atgtctctgcacttcctgtattattgctcagagcctaccctagatgtcaaaatcgccttctgtcaggggtttgataagcaggtcgacgtgagttacattgctaaacactataatatgtccaagtctaaggtagataatcagttctattcagttgaagttggggactctacctttactgtattgaaaagataccagaatctcaagcccattggcagcggggctcaggggatcgtgtgcgcagcttatgatgctgtgcttgataggaacgtcgcgattaagaaactttctagaccgtttcagaatcagacacacgccaaaagagcatacagagagcttgtgttgatgaagtgtgtcaaccacaaaaacattatcagcctgcttaacgtcttcacgccccaaaaaacactcgaagagttccaggatgtgtacttagtgatggagctgatggatgcgaacctgtgtcaagtaatccagatggaactggatcacgagcgcatgtcttacctcctgtaccagatgctgtgcggcatcaaacatttgcacagcgccggaattatccaccgggacctcaagcctagcaacatcgtggtgaagagcgattgtacacttaagattctggactttggactggcacgcactgccggtacatcttttatgatgacaccgtacgtggttaccagatactaccgggctcccgaggtgatactgggcatgggatacaaggagaacgtggatatctggtcggtaggctgtatcatgggggagatggtgaggcataagatattgttccccggaagggactacatcgaccagtggaacaaagtaatcgaacagttaggaactccgtgcccggaatttatgaaaaagctccagccgaccgtgcgtaattacgtggagaacagaccaaagtacgctggcctcacgtttccaaaactgtttcctgacagcctctttccagccgatagcgagcataacaagctaaaggcgtcccaggcaagagatctgttgtccaaaatgctagtcattgatcccgctaagcggatttcagttgacgacgcgctgcagcatccctacatcaacgtgtggtacgacccagccgaggtggaggcacctccgcctcagatttacgataagcagctggacgaacgggagcataccatcgaagagtggaaggagctgatatataaagaggttatgaactctgaagagaaaaccaaaaacggggtcgttaagggccaaccctctcccagcggcgctgccgtcaattcctcagaaagcctgccgcctagctccagcgtgaatgatatctcttccatgtccacagaccagacactcgccagtgatacggactctagtctagaagcctctgctggaccactcggatgttgccggtag

SEQ ID NO: 230907 - DNA, 1269 bp, Artificial Sequence
  Description of Artificial Sequence: Synthetic coding sequence
atgtctctccactttctctattattgctccgagcccaccctcgacgtcaaaattgcattttgtcagggtttcgataaacaggtggacgttagttatatcgccaaacattacaatatgtcgaagtcaaaggttgataaccagttctactccgtggaggtgggagatagcacctttaccgtgctgaaacgataccagaatctgaaaccaattggctccggcgctcagggaatcgtgtgtgcagcctatgacgcagtgttagataggaacgttgctatcaagaagttgtcccggcctttccagaaccagactcacgcaaaacgggcatatcgcgaactggtgctgatgaaatgtgtgaaccacaaaaatatcatctccctgctgaatgtgtttactccacagaagactctagaggaattccaggacgtgtatttggtgatggagttaatggacgctaacctctgccaggtgatccagatggagctggaccatgaacggatgtcctatctgctgtaccagatgctgtgcgggataaagcatctgcacagcgctggcatcattcatcgggacctcaagccttccaatatagtcgtgaaaagtgattgtactctaaaaatccttgattttggcctcgctagaactgcagggacctcctttatgatgacaccctacgttgtaacacgctattatagagcccctgaagtaattctcggaatgggatataaggaaaacgtggacatttggtccgtcggatgcattatgggggaaatggtccgccacaaaattcttttccccggacgggactatatagatcaatggaacaaggtgattgagcaactgggcactccatgtcctgaattcatgaagaagttacagccaacggtgagaaactacgtggagaaccggcctaagtacgcgggattaacattccccaaactattccccgattcattattccctgctgactctgagcacaataaactgaaagcctctcaggctagggatctgttgagtaaaatgctggtgatcgaccctgccaagagaatttctgtcgacgatgccctgcaacacccatacatcaatgtgtggtatgatccagccgaggtggaggctcctccacctcagatatacgacaaacagctggatgagagagaacatacaatcgaagaatggaaggagcttatttacaaagaggtgatgaactctgaagagaagaccaagaacggggtcgtcaagggacagccttccccgtctgcccaggtccagcagtag

SEQ ID NO: 230908 - DNA, 960 bp, Artificial Sequence
  Description of Artificial Sequence: Synthetic coding sequence
atggaactgatggacgcaaacctctgtcaggtcatccagatggagctagaccacgaaagaatgtcctacctactgtaccagatgctgtgcggaatcaagcacctgcactcggcaggtattatccatcgggacctgaagccctctaacatagtggtgaagtctgattgtaccctcaagatcttagattttggccttgccagaacagccggaacttccttcatgatgacgccctacgttgttaccagatactaccgggcacccgaagtcatcctggggatgggatataaagagaatgtggatatctggtccgtgggatgtattatgggcgagatggtgcgccacaaaatcctgtttccagggagggattacatcgaccagtggaataaggttatcgaacagctgggaacgccttgccccgagttcatgaagaaactgcagcccaccgtgcgtaattatgtggagaatagaccaaagtacgcgggtttaacattccctaaattattccccgactcacttttccctgcagattctgagcacaacaaattaaaagccagtcaggctcgagacttattgagcaagatgcttgtcatcgaccccgctaagcgtatttcagtggacgacgccctccagcacccatatataaatgtctggtatgatcccgctgaggtggaggctcctccaccccagatctatgacaagcagttggacgagcgcgaacacacaattgaagagtggaaggagctgatatacaaagaggtgatgaacagtgaggaaaaaactaagaacggtgtggtgaagggacaaccgtccccctccggagcagctgtgaattctagtgaaagcctacccccaagttcctcagtcaatgacatctcttccatgagcacagaccagactttagcaagcgataccgatagctcgttggaggccagtgccggaccgctgggatgctgcagatag

SEQ ID NO: 230909 - DNA, 834 bp, Artificial Sequence
  Description of Artificial Sequence: Synthetic coding sequence
atggaattgatggacgcaaacctctgtcaagtgatccagatggagctggatcacgaaaggatgtcttacttgttgtatcagatgttgtgcggtatcaaacacctgcactcagctggcattatccaccgcgatcttaaacccagcaacattgtcgtcaagtccgactgcaccctgaagatcctggatttcggattggctcgaactgctggaacctcctttatgatgaccccttatgtggtgaccaggtattatcgagctcccgaagtaatcctcggaatgggctacaaagaaaatgttgatatctggagcgtgggctgcattatgggggagatggttcgccacaagattcttttccccggaagagattacatagaccaatggaacaaagtcatcgaacagttagggactccctgcccggagtttatgaaaaaattgcagccaacagtgcggaattacgtggaaaatcggccaaaatatgccggattaacatttccaaaactctttcctgacagcctgttccccgctgactctgagcataataagctcaaggcctcccaggctcgagatctcttatctaagatgctggtgattgacccggctaagagaatctccgtagacgacgccctacagcacccttatataaatgtatggtacgatccggctgaagtggaagctccaccaccacagatctacgacaagcagctggatgaacgagagcatactatcgaggagtggaaagagctcatttacaaggaggtcatgaactctgaggagaagaccaagaacggagtcgtgaagggacaacctagcccttccgcgcaagtgcagcaatag

SEQ ID NO: 230910 - DNA, 1269 bp, Artificial Sequence
  Description of Artificial Sequence: Synthetic coding sequence
atgagcctgcatttcctgtattactgcagcgaaccaacactggatgtgaagatagcattctgtcaggggttcgataagcaggttgatgtaagttacattgccaaacattataacatgtcaaaatctaaagtggacaatcagttctactctgtggaggtgggtgacagtacattcaccgtgcttaaaaggtaccagaacctgaagcccatcggtagcggagcacaaggcatcgtgtgcgctgcctatgatgcagttctcgatagaaacgtggcaatcaagaagctgtccagaccctttcagaaccaaacacatgccaagcgggcttacagggaactggtcctgatgaaatgcgtcaaccataagaatattataagccttctgaatgtgtttactcctcagaaaacacttgaggaattccaggacgtatacctggtgatggagctgatggacgcgaatttgtgtcaggtaatccagatggagctggaccatgagcgcatgagctacctgctttaccaaatgctctgcggcatcaagcatctgcatagcgctgggataatccaccgtgatttaaagccgagcaacatagtcgtgaaatccgattgtaccctcaagattttggactttgggctcgctcggacggcgggtaccagcttcatgatgaccccatatgtcgtgactaggtattacagagcccctgaggtaatccttggcatgggatacaaggaaaatgtggacatatggtcggtaggctgtatcatgggagagatggtgcggcataaaattctgttccctggcagagattatattgaccagtggaataaggtgatcgagcagcttggaacaccatgtccggaattcatgaaaaaactccagcctaccgttcggaactacgtagagaaccggccaaagtatgccggactgacattccctaagctgtttcctgacagcctcttcccagcagattcggagcacaataagctgaaggcgtcacaagctcgggatttgctctccaaaatgctggtcattgaccctgcgaaacgaatctctgtcgacgacgctctgcagcacccgtatatcaacgtatggtacgatccagccgaagtcgaagcccctcccccacagatttatgacaaacaactggacgaaagggagcataccatcgaagagtggaaagaactgatctacaaggaggtgatgaattccgaggagaagacaaagaacggggttgttaaaggacagccttcccctagtgcccaggtccaacagtag

SEQ ID NO: 230911 - DNA, 1281 bp, Artificial Sequence
  Description of Artificial Sequence: Synthetic coding sequence
atgagcaaatcaaaagtcgataatcagttttacagtgttgaagtgggagactccacgtttactgtactcaagagataccagaaccttaaacctattggaagtggggctcagggtatcgtgtgcgctgcctatgacgccgttctcgataggaatgtggctatcaaaaagctctccaggccctttcagaatcagactcatgctaagagagcctacagagaactggtcctgatgaagtgcgttaaccataagaacattatctccctacttaatgtctttacgccccagaagaccttagaagaattccaagacgtgtatctggttatggagctgatggacgccaatctatgccaagtgattcagatggagctggatcatgagcgtatgtcgtatctgctgtaccagatgctttgcggcattaagcacctgcatagtgccggaatcattcatagagacctaaaacccagtaatattgttgtaaagagcgattgtacactgaaaatccttgactttggcctggccagaacagccggaaccagcttcatgatgaccccctacgtggtgactaggtactaccgggcacctgaagtcattctgggcatgggatacaaggagaacgttgatatctggagcgttgggtgtataatgggcgaaatggtcaggcacaagattctgtttcccggacgtgactatatcgaccagtggaacaaagtcattgagcaactgggtaccccatgcccagagttcatgaagaagctccagcccactgtgcgaaactacgtggaaaatcgcccaaagtacgcgggtctgacttttccaaagctgtttccagactccttgttcccggctgactctgagcataataaactgaaagctagtcaagcgagggatctgttgagcaagatgctggtgatcgatccggctaagcgaatctcagtagatgacgccctccaacacccctatatcaatgtgtggtacgatcccgcagaggttgaggctcctcctccccaaatttatgacaagcaactggatgagcgtgaacacacgattgaagagtggaaagagctgatttataaggaagtcatgaacagcgaagaaaagactaaaaacggtgtggtgaaagggcagccatctcccagtggcgctgctgtgaacagctccgaaagcctgcccccatcatcatctgtcaacgacatctcttccatgtcaaccgaccagacacttgcctcagacacagattcctcactcgaagccagtgccggtcccttgggctgttgccggtag

SEQ ID NO: 230912 - DNA, 1281 bp, Artificial Sequence
  Description of Artificial Sequence: Synthetic coding sequence
atgagcaagtccaaggttgacaaccagttctactctgtggaagttggcgattcaacctttacggtactgaaaaggtaccaaaaccttaagcctattggtagtggcgctcaagggatagtctgcgccgcatatgatgctgtgttggacaggaatgttgccatcaagaagctgagtcgacccttccagaaccaaacacacgcaaagcgggcttaccgcgagctggtcctcatgaagtgcgtgaatcacaagaacattataagccttcttaacgtcttcacaccccagaaaacattggaggaatttcaagacgtgtacttggtcatggaactcatggacgcaaacttgtgtcaagtaattcagatggagcttgatcacgagcggatgtcgtacctgctatatcagatgctgtgtgggatcaagcacctgcatagtgccggtattattcaccgtgacctgaagcccagcaatattgtggtaaagagcgattgcacactaaagatcctggatttcggcctggctagaacagctgggacctccttcatgatgactccctacgttgtcacccggtactatagagctcccgaggttatcttaggtatgggctataaagaaaacgtggatatctggtccgtgggatgtattatgggagagatggttcggcacaagatcctgtttccaggtcgcgactacatcgatcaatggaacaaggtgatagagcagctaggtacgccatgtccagagtttatgaagaagttgcaaccaactgttcggaactatgtggagaaccgacctaaatacgccggtttaactttccccaaactcttcccggattcactgtttcccgctgacagcgagcacaataagctgaaggcgtcacaagctcgcgatctgctgagcaagatgctcgtgatcgacccggcaaagcgaataagcgttgatgatgctctccaacacccctacattaatgtttggtatgaccctgctgaagtcgaggcgcctccccctcagatctatgacaaacagcttgacgaaagagaacacactatcgaggagtggaaagagctgatctacaaagaagtcatgaactctgaggagaagactaagaacggcgtggtgaaaggccagccgtcacccagtggcgctgcagtgaacagttctgaatcattacccccatcgtccagcgtcaacgatatctcttcaatgtcaacagaccagacgcttgcttcagacaccgactcatctctggaggctagcgctgggcctctgggatgttgccgttag

SEQ ID NO: 230913 - DNA, 960 bp, Artificial Sequence
  Description of Artificial Sequence: Synthetic coding sequence
atggagttgatggacgcaaacttgtgccaagtcatccagatggagctcgaccacgagaggatgtcctacctgctgtaccagatgttgtgtggtatcaaacacctacattcggctggcatcattcacagagacttgaaaccgtcaaacattgtggtgaagagcgattgcaccctcaagatcctagatttcggtctggctagaaccgccggtactagctttatgatgacaccatacgtggtcacaaggtattacagagcacctgaggtcatactggggatgggttataaggagaacgtggatatgtggtctgtggggtgcattatgggagaaatgattaagggcgcagtgttgttccctgggacagaccatatcgaccagtggaacaaggtcatcgaacagctcggcactccttgtcctgagttcatgaagaaacttcaacctacagtgcgaaactacgtggaaaatcggccaaaatacgccggactcactttccccaagctgttcccggatagcctgttcccggctgactccgagcacaataaacttaaagcttcacaagccagggatctgctgtccaagatgctggtgatcgaccctgctaagcgcatctccgtcgacgacgccctgcagcatccgtatattaatgtgtggtatgaccctgccgaggtcgaagcgccaccaccacagatctacgataagcaacttgacgaaagagaacatactatagaagagtggaaggaactgatttataaggaggtaatgaactccgaagagaaaaccaaaaacggagttgtgaaaggacagccatcacctagcggcgcagcggtgaactcatctgaaagccttccgcctagtagctctgtcaacgatataagcagtatgagcacagaccagacactcgcctcagacaccgatagctctctggaagctagcgctggccctctggggtgctgccgctag

SEQ ID NO: 230914 - DNA, 102 bp, Artificial Sequence
  Description of Artificial Sequence: Synthetic coding sequence
atgtctaagtctaaggtggataatcagttttatagtgtggaggtcggcgatagcaccttcaccgtgctgaagcggtaccaaaatctaaagccaattggctag

SEQ ID NO: 230915 - DNA, 156 bp, Artificial Sequence
  Description of Artificial Sequence: Synthetic coding sequence
atgagtctccattttctgtattattgctcagaaccgacactggatgtgaaaatcgctttctgccagggcttcgataagcaggtggacgtcagttatatcgcaaagcattacaatatgtcaaaaagcaaggtggacaaccagttctacagtgtgtag

SEQ ID NO: 230916 - DNA, 276 bp, Artificial Sequence
  Description of Artificial Sequence: Synthetic coding sequence
atgtcactgcacttcctgtattattgtagtgagccgactcttgacgtcaagattgccttctgtcaggggtttgacaagcaggtggacgtgtcctatatcgcaaagcactacaacatgtccaagagcaaagtggataatcaattctatagtgtggaggtcggagactctaccttcaccgttttaaaaagataccagaaccttaagcccatcgggtcaggtgctcaggggattgtgtgcgccgcatatgatgccgtgctggacagaaatgtggcttag

SEQ ID NO: 230917 - DNA, 225 bp, Artificial Sequence
  Description of Artificial Sequence: Synthetic coding sequence
atgagtaaatctaaggtggacaatcaattctactccgtggaagtgggcgattctactttcaccgttctcaaacgataccagaatctgaaacccatcgggtccggcgcacaggggattgtttgcgctgcctatgacgccgtgctggaccggaatgtggccatcaaaaagctgagccgtccttttcaaaaccagacgcacgccaagcgagcttatagggagctgtag

SEQ ID NO: 230918 - DNA, 366 bp, Artificial Sequence
  Description of Artificial Sequence: Synthetic coding sequence
atgagtctacacttcctgtattactgtagcgagcccacattagatgttaaaatcgcgttctgtcagggattcgataaacaggtggacgtatcatacattgcaaagcactataacatgtctaagagtaaagtggataaccagttttactccgtcgaagtgggagattccaccttcacagtgctgaaacgttatcaaaatctgaagcccatcggaagcggggcacagggaatcgtttgcgccgcttatgacgccgtgttggatcgaaatgtggcaataaaaaaacttagccggcctttccagaaccagacccacgctaagagggcctacagggagttagtgctgatgaagtgcgtgaatcataaatag

SEQ ID NO: 230919 - DNA, 354 bp, Artificial Sequence
  Description of Artificial Sequence: Synthetic coding sequence
atgtcccttcattttctttactactgcagcgaacccacactcgacgttaagatagcgttctgccagggatttgacaaacaggtcgacgtctcttatatagccaagcattataacatgtctaaaagcaaagtggataatcaattttactcggttgaagtaggcgattcaacttttaccgtcttgaagcggtatcagaacctgaaaccaatcgggtcaggtgcccagggcatcgtctgcgctgcttatgacgcagttctcgatcgaaacgtcgcgatcaaaaagctctcaagaccttttcagaatcagactcacgccaaacgcgcttatagagagcttgtactgatgaaatgctag

SEQ ID NO: 230920 - DNA, 426 bp, Artificial Sequence
  Description of Artificial Sequence: Synthetic coding sequence
atgtcattacactttctgtattactgttccgagcccacactagacgtgaaaattgccttctgccaaggattcgataaacaggtggatgtttcctacattgccaagcactataatatgagtaagagtaaggtcgataatcagttctatagcgtcgaggtgggagatagcacatttactgtcctaaaacgatatcagaaccttaagcccattgggagcggagcccagggcattgtgtgtgccgcttacgacgccgttcttgacagaaacgtggccatcaagaaactttcgcggccatttcaaaaccaaacacatgcaaagcgggcttacagagaactggtgctgatgaagtgcgtgaatcataagaatatcatttctctactcaatgtgttcaccccacaaaaaacactggaggaatttcaagactag

SEQ ID NO: 230921 - DNA, 255 bp, Artificial Sequence
  Description of Artificial Sequence: Synthetic coding sequence
atgagcaaatccaaggtagacaatcagttttatagcgttgaggtgggtgattctacattcacggtactgaaacgttatcaaaatctgaagcccatcggatcaggcgctcaaggcatcgtttgtgctgcatacgacgcagtcctagacaggaacgtggcgattaaaaagctgagtcggccatttcagaaccagacccatgcgaaacgtgcctacagggaactcgtgctgatgaaatgcgttaatcataaaaactag

SEQ ID NO: 230922 - DNA, 159 bp, Artificial Sequence
  Description of Artificial Sequence: Synthetic coding sequence
atgagcaagagtaaggtggacaaccagttttatagcgttgaagtgggcgactcaacgttcacggtgctcaaacggtaccagaatctaaagcccatcggcagtggcgctcagggcatagtctgtgctgcctatgatgccgtcctcgatcggaatgtgtag

SEQ ID NO: 230923 - DNA, 147 bp, Artificial Sequence
  Description of Artificial Sequence: Synthetic coding sequence
atgagcttacacttcctctactattgctctgagccgacactggatgttaaaatagcgttttgtcaggggttcgataaacaagtggacgtttcctacatcgctaaacattataacatgtccaagtcaaaagtcgacaaccagttctag

SEQ ID NO: 230924 - DNA, 1008 bp, Artificial Sequence
  Description of Artificial Sequence: Synthetic coding sequence
tgaaatgtggcgataaaaaaactaagccgcccattccagaaccagacacatgccaaaagggcatatcgggagcttgtcctaatgaagtgcgtgaatcacaagaatatcatctctctgttgaacgtgttcacaccccaaaagactctggaggagtttcaggacgtctacctcgtcatggaattaatggacgctaatctgtgccaggtgatacagatggaacttgaccacgagcggatgtcatatctcctgtaccaaatgctgtgcggaataaagcatctgcactcagcgggaattatccatagggacttgaaacccagtaacattgtcgtaaagagcgattgtactctgaagatactagactttggcctggcaagaaccgccggaacaagctttatgatgaccccctatgtggtcactcgatattatcgggcacccgaagtaattctggggatgggctataaggaaaatgtggacatgtggagcgttggatgtatcatgggagagatgattaaaggagccgtcttgttcccaggaaccgaccatatcgatcagtggaacaaagtgatcgaacaactgggtaccccctgccctgaattcatgaagaagctgcagcctactgttagaaactacgtggaaaatcgaccgaagtatgctggtctgaccttccccaagttgtttccagattcgttgttccctgccgattctgaacataataagttgaaagcatctcaggctagggatctgctgagcaagatgcttgttatcgatccagcaaagcgaattagtgtggacgacgctctgcaacatccatatataaacgtctggtatgaccccgcagaggtagaggcccctcctccccaaatttacgataagcagctcgacgagagagagcacacaatagaggagtggaaagagctgatctacaaagaggttatgaatagtgaagaaaagaccaaaaacggcgttgtgaaagggcagcctagcccttcggcccaggtacaacagtag

SEQ ID NO: 230925 - DNA, 1764 bp, Artificial Sequence
  Description of Artificial Sequence: Synthetic coding sequence
atggcggaaaagggcgactgtattgccagcgtttacggctacgatttaggtggccgattcgtggattttcaaccactcggcttcggtgtaaatggcttggttctgtccgctgtggatagccgcgcatgtagaaaagtggctgtgaagaagatcgcccttagcgatgccaggagcatgaagcacgctctgcgagaaatcaagattatccggaggttggaccatgataacattgtgaaagtatatgaagtgctcggtcctaagggtaccgatcttcagggcgagttgtttaagtttagcgtggcctacatcgttcaggagtatatggagaccgatctggctagactgctcgaacaaggcactttggctgaagagcacgctaagctattcatgtatcagctgctgcgcggattaaaatacattcatagcgccaacgtgctgcaccgagatttaaaacccgcaaatatcttcattagcacggaggacttagtcctcaagattggagatttcggactcgctaggattgtggaccaacattattcacataagggttatctgtctgaggggctggtcaccaagtggtatcgctcccctcgtctgctcctctcgcccaacaattacacaaaagcaatagacatgtgggctgcgggatgcatactagccgaaatgctgacgggacgaatgctgttcgccggagcacacgaactggagcaaatgcagcttatattggagacaatccccgtgatccgtgaagaggacaaagatgagctgctcagggtgatgccctcttttgtgagctccacctgggaagtgaagagacccctgcgcaagctactgccagaggtgaactcagaggcaattgattttctcgagaaaatcttgaccttcaatccaatggatcgacttaccgctgagatgggccttcaacatccctacatgtcaccttattcttgtccagaggacgagcccacaagtcaacacccttttagaatcgaagatgagatagatgatatcgtcctgatggcagctaatcagtctcagctctctaattgggatacttgtagttctaggtatcctgtcagcctgtcatccgacctcgagtggagacccgataggtgtcaggatgcaagtgaagtacagcgcgaccccagggcagggtccgctcctctcgcagaggatgttcaggtggaccctaggaaggattcccatagctctagcgaacggtttctggaacaatcacatagcagtatggaacgggctttcgaggcagactacggaagaagctgtgactacaaagtcggtagtccttcctacctggacaaattactttggcgtgataataagccgcaccactacagcgagccaaagctgattcttgatctcagtcattggaaacaggcggctggggcaccgcctaccgccacgggcctcgccgatacaggggctagggaagatgagcccgcaagcctcttcctcgagatcgctcagtgggtaaaatcaactcagggcggacctgagcacgccagcccacccgcagacgatcccgaacgtagactgtccgcgagccctcccggacgcccagctcctgtggatggaggtgcgagtccccaattcgacctggatgtcttcatctcccgggcactgaagctgtgtaccaaaccagaagatctccctgataataagcttggcgatctgaatggagcctgcatccctgagcatccaggagatctagtgcaaaccgaggcattttccaaagaacgatggtag

SEQ ID NO: 230926 - DNA, 1131 bp, Artificial Sequence
  Description of Artificial Sequence: Synthetic coding sequence
atgtgggcagccggttgcattctggctgagatgcttacggggagaatgcttttcgcaggtgcccatgaactggagcagatgcagctcattcttgaaactatccccgtgattagagaggaagataaagacgagctacttagggtcatgccctcttttgtctcctcaacatgggaggtaaaacggcctctgagaaaactactccccgaagtcaatagcgaggccattgattttctggaaaaaattctcacctttaacccaatggacaggctcaccgccgagatgggtcttcagcacccgtatatgtctccctattcctgcccggaagacgaacctacatcccagcaccctttcagaatcgaggatgaaatcgatgatatcgtgttaatggcagctaaccagagccaactgtctaattgggacacatgctcttctagatatccagtttctctctcttctgacctggagtggaggccagatcgctgccaggatgcatcagaggtgcaacgcgaccccagggccggttcagcccctctcgcggaggacgtgcaggttgaccccagaaaagactcccattcctcttccgagagattcctggaacaaagccactccagtatggagcgggctttcgaagctgattacggcagatcctgcgactataaagtgggctctccgtcctacctggacaaactgctttggcgggataacaaacctcatcactattctgagcccaaactcattctcgatctctcacactggaaacaggcagctggcgctccacccactgccacggggttggccgacactggtgcccgagaggacgagccggcttccttatttctcgaaattgcccagtgggtgaagtccacacagggcggaccagaacacgcaagccctcctgctgacgatccagagagacgtctgtccgcatctcctcctggacgccctgccccagtcgacggcggagcaagcccacagttcgatctggacgtctttatttcaagagccttgaaactttgcactaagcctgaggatttgcctgacaacaaattgggggatctgaacggagcctgcattcccgagcaccctggggatctagtccagactgaggccttttctaaggagcgttggtag

SEQ ID NO: 230927 - DNA, 2034 bp, Artificial Sequence
  Description of Artificial Sequence: Synthetic coding sequence
atggagtctgacctgcaccagattatacactcatcacagccgctcacactggagcatgtccgatatttcctctaccaactcctgcgcggactgaagtacatgcactcagctcaggtgatccacagagatctgaagccatctaaccttctcgttaatgagaattgtgaactgaaaatcggagactttgggatggctaggggcctctgcactagccctgccgagcaccagtattttatgactgagtacgtagcaacgagatggtacagggccccagagcttatgctgagtcttcacgagtacacacaggccattgatctgtggagcgtgggatgcatctttggggagatgttagccaggcgtcaacttttccctggaaagaattatgtgcaccaactgcagcttattatgatggtgctgggcacccccagtccagcagttattcaggcagtgggagccgaaagggtgcgcgcttacatacaaagcttgcctcctcgacagcctgtgccctgggagaccgtttaccccggagccgaccgccaggctttatctttgttgggcagaatgttgcgctttgaaccgagcgccaggatctcggcggctgctgcgctgagacacccctttttggcaaagtaccacgatcccgacgacgaaccagattgcgctcctccattcgactttgcgtttgaccgggaggccttgaccagagaacgcatcaaagaagcgattgttgccgagatcgaggactttcatgctagaagagagggtatccggcagcagattcgatttcagcccagcctgcagcccgttgctagtgaacccggatgcccagatgtcgagatgcccagtccttgggctccatccggcgattgcgcaatggagtctccccctcccgcacccccaccttgtccaggcccagctcccgatacgatagacctcacactgcaaccaccccctccagtgtccgagcctgccccacccaagaaagatggcgctatctctgataacaccaaagctgccctgaaggctgcgttgctcaagtctctcaggagcagactccgcgatggcccttctgccccacttgaggcgccagagccaaggaagccagtgactgcccaggagaggcagagagagagagaggagaaacgacggcgacgacaggaacgagccaaagagagggagaagaggcggcaggagcgggaacgaaaagaacgaggagccggtgcttctggcggaccctcaacagaccctttggccggattggtgctctccgataacgataggtccctgctggagaggtggacaaggatggcaagacctgccgctccagccttaaccagtgtacctgcaccggcacccgctcctacccccacccccactccagtacagccaacctcacccccacccggtcccgtggcacagcctacaggtccccaacctcaaagtgctggatctactagcggaccagtgccgcagcctgcatgtcctcccccagggccagcaccacaccctacaggcccacctgggccaattccagtgccggcaccaccacagattgccacatcaacgagcttgttggcggctcagagcctcgtacctccgccaggcctgcctggctcttctacccccggagtgcttccctattttcctccgggactacctcctcccgatgccggaggcgcaccacagtcttccatgtcagagtctcccgacgttaatctggtcacacagcagctgagcaaaagccaggttgaggacccactcccacccgtgttctccggtactccaaagggcagcggtgccggatatggcgtaggcttcgacttggaagagtttttaaatcaaagcttcgatatgggcgtcgccgacgggccacaggacggccaggctgattcagcatccttaagtgccagcctgctcgctgattggcttgagggccatggcatgaatccggcagacatcgagagtctgcagcgcgaaatacagatggattcgcccatgctgcttgcagacctgccagatctgcaggatccatag

SEQ ID NO: 230928 - DNA, 2451 bp, Artificial Sequence
  Description of Artificial Sequence: Synthetic coding sequence
atggctgaacctctgaaggaggaggatggggaagacggatctgcggagccccctggcccagtgaaagcggagccagcacataccgccgctagtgtggccgctaagaatctcgctctcctgaaggcgaggtcatttgacgtgaccttcgatgtgggggacgagtatgagattatagagaccatcgggaacggggcatacggcgtcgtgtcaagcgctcggaggcgactgaccggacaacaggtggctatcaagaagattccaaacgcgtttgatgttgtaacaaacgcgaaaaggacactgagagagcttaaaatactgaagcactttaagcacgacaatatcatcgctattaaagatattttgcgacccaccgtaccgtatggcgagttcaagtcagtgtatgtggtcctggaccttatggaatccgatctgcatcagatcatccattcttcccaacctttaactttagagcatgtacgatactttttgtatcagttgttacgtggactgaaatacatgcattctgctcaggtcatacaccgggaccttaaaccttccaacctgctcgttaacgagaactgcgaacttaagattggcgactttggcatggccaggggtctgtgcacctcacctgccgagcaccagtatttcatgaccgagtatgtggccacccgatggtacagagctcccgagctgatgttgagtttgcatgagtacacacaagccattgacctgtggtccgttggatgcatctttggagaaatgctggcccgaagacagcttttcccgggaaagaactatgtgcatcagttacagctgattatgatggtcctgggcacaccttctcccgctgtcattcaggctgtgggggctgaaagagtgcgggcatatatccagagccttccccctcgacaaccggtgccatgggagacagtatatcctggcgctgatagacaggctttatccctgctcggacgcatgctgaggtttgaaccctcagcgaggatcagcgcggctgccgctctccggcatccatttctagctaagtaccacgatccagatgatgagcctgactgtgcccctccgttcgactttgctttcgaccgcgaggccctgacccgagagcggatcaaggaagcgattgtcgccgaaatagaagattttcatgccagacgcgagggcataaggcaacagattaggttccagccttcccttcagcccgtggcgagtgagccagggtgtcctgatgtcgagatgcccagcccctgggcgccttcaggggattgtgctatggagagccctcctcccgcacccccaccttgtccagggcctgcccctgacaccatcgacttgacactgcagccccctcctccagtctccgaaccagcccctcctaagaaagatggcgcaatctctgataatacaaaggccgcactgaaggctgctcttctgaagtctctaaggagtaggttgcgagatggtccttctgctcctctcgaggctcccgaacctaggaaacctgtaacagcacaggaacggcaaagagagcgggaagaaaagaggcgcaggaggcaggagagggctaaggagcgcgagaaacgacgccaggaacgggaacgaaaagagagaggtgccggagcctccgggggtcccagcactgatccactggcgggactggttctgtcagacaacgatcggagtctacttgagcggtggactagaatggcccgacccgcagccccagcccttacttctgtacccgcaccagctccagccccaacccccaccccgaccccagtgcaacctacgtccccacccccaggacccgtcgcccagccaaccgggcctcagccacagagcgctggcagtacctctggccctgtaccccagcctgcatgcccaccccctggacctgcgccacacccgaccggtcccccaggacctattcccgtgccggctcctccgcagattgcaacaagcacctccctgctcgccgctcagagcctggttccccctccgggactgcccggatcatccaccccgggtgtcttaccatatttccctcccggtctgccacccccagatgccggaggcgctccccagtccagtatgtctgagtctccagatgtgaatctagttacgcagcagctgtcaaagagccaagtcgaggatcctcttcccccagtgttttcgggtacccctaaggggtccggagcgggttatggagttggattcgacctggaagaatttctgaaccaatcatttgacatgggggtagcagatgggccacaggacggccaggctgactccgcttccctctctgcatcccttcttgctgattggctggaggggcatggcatgaatccagcagatatcgagagcctgcagcgtgagatacagatggactcccccatgcttttggcagacttgcccgatttgcaggacccatag

SEQ ID NO: 230929 - DNA, 2451 bp, Artificial Sequence
  Description of Artificial Sequence: Synthetic coding sequence
atggctgagccactcaaggaagaagacggcgaggatgggtctgcggaacccccaggcccagtaaaagccgaaccagctcatacggcggcatcagtagccgcaaagaatttggcgcttctgaaggccaggtccttcgacgtgacctttgacgttggggatgaatacgagatcattgaaacgattgggaacggggcttacggtgtggtcagttctgctcgcagacgcctgaccggacagcaggttgccatcaaaaaaatccccaacgctttcgatgtcgttaccaatgcaaaacgtaccctgcgggagttaaagattctcaagcactttaaacacgataatatcatagctattaaggatatcctgaggccaacagtcccctacggcgagtttaaaagcgtgtatgtggttcttgatttgatggagtcagatctccatcaaatcattcactccagtcagccccttactctggaacatgtacgctatttcttataccagttgctgagaggtctcaagtacatgcattcagcccaggtcattcatcgggaccttaagccttcaaacttgctggtgaacgagaactgtgaactcaaaatcggcgacttcggtatggctagggggctttgcacttcccctgctgaacatcaatactttatgaccgaatacgtggcgacaagatggtatcgcgctcctgaactgatgctttcactacacgaatacacacaggctatcgatctctggagcgttggatgcatcttcggggagatgctggcccgacgacagcttttccctggcaagaattacgttcaccaattgcaactgataatgatggtgttgggcacaccatcccccgcagtgatacaagctgtgggtgccgaacgggttcgtgcatatattcaaagcttacccccaagacaacccgtaccctgggagacagtatatccaggagccgataggcaggctcttagcttgctgggcaggatgctgcgtttcgagccctctgcacgaataagtgcggctgccgctctgaggcacccgttcctggccaagtatcatgaccccgacgacgagcctgactgcgctccaccttttgacttcgcctttgatcgggaggctttgacgcgagaacgcattaaggaagctattgtggccgagatagaggactttcatgcccgacgggagggcatccgccaacaaatcagatttcagcctagcctgcagccagtggccagcgaaccagggtgtcctgacgtcgagatgccctcaccatgggccccatccggcgactgcgctatggagtccccaccgcctgcaccacccccttgtcctggacccgctcccgatacgatcgacttaactttacagccacctccccctgtttccgaacccgcacctcccaaaaaagatggggcaatctcggacaacacaaaagccgcactgaaggccgctctgcttaagagcctgagaagcagactgcgggatggaccctccgcacccctagaggcccctgagccgcgaaaacctgtcacagcgcaagagcgtcagagggagcgggaagaaaaaagacgacggaggcaagagcgggctaaagagcgagaaaagaggcgtcaggaacgagagaggaaagagcgaggtgctggagcctcagggggaccgtcaacggatcctctggccggattggtgttatccgacaacgatcgttctctgcttgagagatggactcggatggctcggccagctgcacccgctctgactagtgtacctgcgccagctcccgctcccactcccacgcctacgcctgttcagccaacgtccccccctcctggtcctgttgctcagccaacagggccacagccacagtcggcaggatcaacaagcgggcctgtcccccagcctgcctgtcccccacccggtccggctcctcacccaactgggcctcctggaccaattccagtgccagctccccctcaaattgcaacctctacttcattgctggccgctcagtctctagtccctcccccaggactccctgggagctccactcctggggtgctgccctacttccctcccggactcccgccaccagacgcagggggagcgccacagagttctatgtctgaaagccccgatgtgaacctggtcactcaacagctgtctaaaagtcaagtagaggacccactcccaccagtgtttagcggcaccccaaagggcagcggggctggttacggcgtcggctttgaccttgaggaatttctgaatcagagcttcgacatgggcgtggccgacggcccacaagacggccaggccgatagcgccagtctgtcagccagtctgctggccgactggctggagggacacgggatgaacccggcagatatagagtcgctccaaagggagatccagatggattcccctatgctccttgcagacctgcctgacctgcaggatccgtag

SEQ ID NO: 230930 - DNA, 2451 bp, Artificial Sequence
  Description of Artificial Sequence: Synthetic coding sequence
atggctgaaccattaaaagaggaggatggcgaagacggatctgcagaaccacctggtcccgttaaggctgagcctgcacataccgccgcttctgtcgcggctaaaaatctggctttgctcaaggctcggtccttcgacgtgaccttcgatgttggcgatgagtatgagatcatcgagaccatcggtaacggtgcttacggcgtggtgagcagcgcgaggcggagattaacgggccagcaagtggcaatcaaaaagattccgaacgccttcgacgtagtcacaaatgcaaagcgcacactgagggagttaaaaatcctgaagcatttcaaacatgataatattattgccatcaaggatatcttgcgcccaacagtgccctatggagaatttaagtccgtgtacgtcgtcttagatcttatggaatcagacctgcatcaaatcatccattcatcacagccgcttaccctcgagcacgttaggtacttcctctaccaactacttcgcggactaaagtacatgcactccgcacaagtcatccatagagacctcaaaccatccaatctgctagtcaacgagaactgcgagctgaaaatcggtgactttggaatggctagaggcctgtgcaccagtccggcagaacaccagtatttcatgacggagtatgttgccacccgctggtaccgggctccggaacttatgctgtctctgcacgaatatacacaggcaatagatctgtggagtgtcgggtgcatattcggagaaatgcttgcacgcagacagcttttcccgggaaaaaactacgtccaccaactgcagctgataatgatggtcctgggcactccctcccccgcagtgattcaggcagtgggcgctgaacgagtgcgcgcttatatacagtctctgccacccagacaaccggttccttgggaaactgtataccctggagctgataggcaggcactgtccctgctcggcaggatgctgcgctttgaaccatccgcgcgaatatccgcagcggcagcactgcgacacccgtttctagcgaagtatcatgatcccgacgatgaaccagactgcgcacccccatttgattttgcatttgaccgggaagcactgacacgggaaaggatcaaggaggcaattgtggccgagatcgaggacttccacgccagaagggaaggtatccgacagcaaattcgctttcagccttccctacagcctgtcgctagcgagcccggatgcccggatgtcgagatgccttctccttgggcaccaagcggggactgcgcaatggaaagtcccccacccgctccaccgccttgtcccggacccgctcctgacacgatcgacctaaccctgcagccaccgcctccagtttccgagcccgcacctcccaaaaaagatggcgctatatctgacaatacaaaggctgcactgaaagctgctttactgaagtcccttcgctcccgcttgcgggacggccctagcgcgcctctcgaggcccctgaaccccgaaaaccggtcactgctcaggaacgccagagggagcgggaagaaaagagacggagacggcaggaacgggcaaaggaacgagagaaacgccgacaagaaagagagcgtaaggagcgtggcgctggtgcctctggtgggccatcgacagaccctttggcaggcctggtactctctgacaacgatagatcactcctcgagcgatggactcggatggctcggcctgcagcccctgccctcacatctgtgccagctccagcccctgctcccactccaactccaacacccgtccaaccaaccagccccccacccggaccagtagcccaaccaacgggtccccagcctcagtccgccggatcgacttctggtccagtgccccagccggcttgcccacccccaggcccagcaccccatccaaccggccctccgggacccattcctgttcccgcacctccgcaaatagcaactagcacatcactactggccgctcagtcattggtaccccctcccggactgcctgggtcatcaacccccggtgtgctgccatactttccaccaggccttcccccaccagacgcaggcggagccccacagagttcaatgtccgagtcccctgatgttaacctcgtcacccagcagttaagcaaatctcaggtcgaagatcctcttccccctgttttctccggtactcctaagggctctggagcagggtatggggtggggttcgatctcgaggagttcctgaaccagtcctttgatatgggtgttgcagacgggccacaggacggccaggctgacagcgcatctctgtctgcttcgctgctagctgactggttggaaggccatgggatgaaccctgcagatatcgaatcacttcagcgggaaatccaaatggactcaccaatgcttttggctgacctgcctgaccttcaggacccgtag

SEQ ID NO: 230931 - DNA, 726 bp, Artificial Sequence
  Description of Artificial Sequence: Synthetic coding sequence
atggccgagccgttgaaagaggaagacggtgaggacggtagcgccgagccgccaggtcccgtcaaagcagagcccgctcacaccgccgcttccgtggccgctaagaacctcgctctccttaaagcccgatcatttgatgtgacatttgacgtgggagatgaatatgagatcattgagactatagggaacggggcatacggagttgtgtcctccgccaggcggcgacttacaggccagcaggtggctattaagaagattcctaatgccttcgacgtggtcactaacgcaaaacgcacactgagggaactgaagatcttaaaacacttcaagcacgacaatataatagccatcaaagacatactcaggcccacagttccgtacggcgaattcaagagtgtttacgtagtgctagatctgatggaatccgacctgcaccagatcatccactcctctcagcctctcaccttagaacacgtgagatattttttgtaccagctgctccgcggactgaaatatatgcatagtgctcaggtgatccatcgggatctgaaaccttcgaacttgcttgtgaatgagaattgtgaactgaagataggcgacttcggaatggctcgcggactatgtacgtcgcccgctgaacatcaatacttcatgaccgagtatgtggccactcggtggtatcgagcccctgaactcatgctcagtctccatgaatacactcagtag

SEQ ID NO: 230932 - DNA, 2136 bp, Artificial Sequence
  Description of Artificial Sequence: Synthetic coding sequence
atggcagagcgggagtccggtggcctggggggtggcgcagcttccccacctgccgctagcccattcttgggactccatatcgcctcaccaccgaattttaggctgacccatgacatctccctggaggaattcgaagacgaggacttgtcagaaattacagacgaatgcgggatcagtctacagtgcaaagataccctgagtttgcggcctcccagagcgggactcctcagcgctggcggaggaggagccggtagcagactgcaggccgagatgcttcagatggacctcattgatgctactggggataccccaggagcagaagacgatgaggaggacgacgatgaagaaagagctgccaggagacctggagccggtccacctaaggcggagtcaggtcaagagcccgcttcccggggacaggggcagagtcagggccaatcgcaaggtccgggatcgggagatacttacaggccgaaacggcctaccaccctgaatctctttccccaggtccctcggtcacaggacacgctcaataacaattctctgggtaaaaaacactcgtggcaggaccgagtcagtcgaagctcaagtcctcttaaaactggggagcaaactccaccccacgaacacatctgtctgagcgatgagctgcctcctcagtctggcccagctccgacgacagatcgcggaactagtaccgacagcccctgtcgcaggagcactgcaacccagatggcccctccaggaggtcctcctgcagccccaccagggggacggggtcacagtcatcgtgaccgcatacattatcaggcagacgtgagattggaggcaacagaggaaatttacttaacgccagttcaacgtcctcccgacgccgctgaacccacctctgcattcttgccacccactgagtcaaggatgtctgtctcatccgaccctgaccccgcagcatacccgtcaactgctggtcgaccccatccatctattagtgaagaggaagagggttttgattgcttgagctctcctgaaagagcagagcccccaggcggaggatggcgcggttctctgggggagcctcctccccctccccgtgcctcactcagcagcgacaccagcgctctgagttatgactccgtcaaatataccctggtggtggacgaacatgcccagctcgagctcgtgagcctgaggccttgctttggcgactactcagatgaatcggactccgcaacagtctatgataattgcgctagtgtctcttctccttacgaatcggccatcggggaagaatacgaggaggcacctcggccacaacctccagcttgcttatctgaggatagtactccagacgagcctgacgtgcacttcagtaaaaaattcctaaacgtttttatgtctggcaggagtagatccagctccgctgagtcattcggtctcttttcctgtattatcaatggagaggagcaggaacaaacacaccgtgcaatcttcagattcgtgcccaggcacgaagatgaactggaactcgaagtcgacgacccccttttggtcgagctacaggccgaggattattggtatgaggcttacaacatgcgcaccggcgctaggggagtctttcctgcgtactacgccatagaggtaacaaaggaacctgagcatatggcggctttggccaagaattccgactgggtcgaccagtttcgggtgaaattcctgggatccgtgcaagtgccatatcacaaaggaaatgacgttctctgcgcggcaatgcagaagattgctaccactagaagactgacggtgcactttaatcccccatcttcctgcgtcctcgaaatttccgtccgaggggttaagatcggagtgaaggctgatgactcccaggaggctaaaggaaataagtgttctcatttctttcagctcaagaacatctccttctgcgggtatcaccctaagaataataaatactttggctttatcaccaaacaccccgcagaccatcggttcgcatgtcacgtgttcgtgagcgaagactctactaaggccctcgccgagagcgtcggtagggcttttcagcagttttacaaacagtttgtggaatacacctgtccaaccgaggatatttatcttgaatag

SEQ ID NO: 230933 - DNA, 1797 bp, Artificial Sequence
  Description of Artificial Sequence: Synthetic coding sequence
atgttgcctgacttccctagtccatccacgtgggctcctggactactgctgccatcagggccagcactgctatccccaagtgtgttgcaagattcactgtctctcggccgatccgagcagccccacccgatatgtagcttccaggacgactttcaagagttcgagatgatagatgataatgaggaagaagatgacgaagatgaggaagaggaggaggaggaggaggagggtgacggggaaggtcaggaaggaggggatcccggtagcgaggctcctgcgcctggaccactgataccatctcccagtgttgaagagcctcataagcaccgaccgaccacactccggctgacaacactcggtgcccaggacagccaggatccagaagcagctgccggacctgggggagtggagctggtggatatggagactcttaatcctactagagacacaataactcccctgtgggccgctccaggtagggctgcaaggccagggagagcatgctccgcagcctgcagtgaggaggaggatgaggaagacgacgaggaagaagaagacgctgaggactccgccggtagcccagggggtagagggactggcccaagcgcgccaagggatgccagcctcgtctatgatgcagttaaatatacattggtagtggacgagcacacacagctggagctcgtttccctacgtaggtgcgcgggacttggacatgactcagaagaggattccggtggagaggcaagcgaggaggaagccggagcagcactcctcggcggaggacaggtgagcggagacactagtcccgactcaccagaccttacttttagcaagaaatttctgaacgtcttcgttaattctacgtcaaggtccagctccacagagtcatttggtctgtttagctgtttggtcaacggcgaagaaagagaacagacacaccgggctgtttttcgatttatacctaggcatccggacgaactagagctcgacgtggacgacccagtcctggtcgaggcagaagaggatgacttttggtttcggggtttcaacatgcggaccggcgagcggggtgtctttcccgctttttacgcccatgccgtgcctggccctgctaaagacttgttagggtcaaaaaggagcccctgctgggttgagagattcgatgttcaattccttgggagtgttgaggtgccgtgccatcagggcaacggcatcctctgcgccgcaatgcagaagatcgccaccgccagaaagcttacagtgcaccttagacctcctgcgagctgtgaccttgaaatatctctacggggtgttaagctgtctctgagtggcggagggccagaatttcagagatgctcccactttttccagatgaaaaacatcagcttttgtggatgtcaccccagaaacagctgcgaagcaccacagggggctgcctttcagtgggaacgcggtgttgacagaaaaagggtgctccagacgcgtggaaatgtgcaaccacacctgggcgctggccagggggcagctttgaatagagcaacggagggatcctctacaggctctgagaaaggagaatggacgcctctggttatcatggagttgacacaaagcgtgaattcctgttatttcggtttcatcaccaagcacccattgctgtctcgattcgcgtgccacgttttcgtgtcgcaggaaagtatgcggcctgtggcacagtcagtggggagggcctttctggagtattaccaggaacatctcgcttacgcatgcccaaccgaggatatctaccttgaatag

SEQ ID NO: 230934 - DNA, 2472 bp, Artificial Sequence
  Description of Artificial Sequence: Synthetic coding sequence
atggccgatcgagccgagatgttttctctgagcacattccacagcctctcaccgccaggttgcagaccccctcaggacatctcattggaagagttcgatgatgaggacctgagcgaaatcacagacgactgcggactgggcctcagttacgactcagaccattgcgagaaagactctttgagtctcggacgctcagagcagccccatcccatttgcagctttcaagacgacttccaggaattcgaaatgatcgacgacaacgaggaggaagatgacgaagacgaggaagaagaggaagaggaggaagaaggtgatggcgagggacaagagggcggagaccctggatctgaggcacccgcacccggtcctctcatccctagcccctcagtggaggaaccacacaaacatagaccaacaaccctccggctcacaacactgggcgcacaggacagtcttaacaacaacgggggttttgacctggttcgcccagcctcttggcaagaaactgcgttatgttcccccgctcccgaggctctcagagaactgccgggaccactccccgctactgacactggccctggcggtgctcaatccccagtgagacccggttgtgattgtgaaggaaacaggccagccgagccaccagccccaggaggaacaagtcctagctccgatcctggcatagaggccgacttgcgatctcggtcgagcggtgggaggggcggacgcaggagtagtcaggagctgtcttcacccggatcagactctgaggacgccggtgggagattggggagaatgattagttctattagtgaaactgaacttgagttgtcaagcgatgggggatcctctagttccggcaggtcaagtcacctgacaaatagtatcgaagaagcaagctccccggcatcagaaccagagccccctagagaaccgcctcgccgaccggcattccttcccgttgggccagatgatactaattcggaatatgagagcggatccgagtccgagccggacctcagtgaggatgcagattcgccttggctactgtcaaaccttgtgagtcgaatgatctcagaggggtcaagtcccatcaggtgtcccggacagtgtctatctcctgctccgaggccacccggtgaacctgtgagccctgctggaggtgcagctcaggattctcaagaccctgaagctgcggctgggccaggcggagtcgagctggttgatatggagactctctgtgcaccacccccaccagcccctgctgccccacggccaggcccagcacaaccaggaccatgcttgttcctgtccaaccctacgcgggataccattacccccctatgggcagcacctggaagggccgcacggccaggaagggcttgcagcgcagcttgtagcgaggaagaagacgaggaggatgacgaggaagaagaggatgctgaggattctgccggttcaccaggcggtcggggtactggtccctcagccccacgagacgcatcactagtttacgatgcagttaaatatacactcgtcgtggatgagcatacacagctggaattggtgagtttaaggagatgcgctggtctcggacacgattccgaagaggatagcggtggcgaggctagcgaagaggaggccggtgctgccctgctcgggggtggccaagtctcgggggacactagcccagattctcccgacctgaccttcagcaagaaattcttgaatgtgtttgtcaactcaacttctcggtcttcatcaacagaaagctttggtttattctcctgtctagtcaacggagaggaacgggagcagacacatcgggcagtgtttagattcatccccagacaccccgatgagctagagcttgatgttgacgatcccgtactggtcgaagcggaggaggatgatttctggtttcgcggattcaatatgagaacaggtgagagaggtgttttccctgcattctatgcccacgcggtgcctggcccagcgaaagatttgttgggctccaagagatctccatgctgggtagaaaggttcgacgtacagtttctgggcagtgtggaggtgccctgtcatcagggaaacggcatattgtgcgctgcaatgcagaagatcgcgactgcccgtaagctgaccgttcacttgaggccacccgctagctgcgacctagaaattagcctcaggggtgtgaaactcagtctgtcagggggaggaccagaattccagcggtgttcccatttcttccagatgaagaacatttctttctgcggctgccaccccagaaactcctgctattttgggtttataactaagcatcctctgctgagccgctttgcgtgtcatgtcttcgttagtcaggaatcgatgcgcccagttgcccagagcgtcggtagggcctttctcgaatactaccaggaacatctggcatacgcttgtcccacagaagatatatatctggaatag

SEQ ID NO: 230935 - DNA, 1335 bp, Artificial Sequence
  Description of Artificial Sequence: Synthetic coding sequence
atggctgacagagctgagatgttttctctgagcacttttcattccctgagccctccaggttgtcggccaccacaggacataagcctggaggaattcgacgatgaggacctgtccgaaatcacagacgactgtggattaggcctcagctacgacagcgatcattgtgagaaagactccctgagcctgggtcgtagcgagcagcctcatccaatttgcagcttccaggacgatttccaggaatttgagatgatagacgacaatgaggaggaggaagatgaggaggatgacgaagaagaggaagatgcagaggactccgccggatctcctggcggacggggaaccggaccgagcgccccacgagacgctagcttggtttatgatgcagttaagtatacactcgttgtggacgaacatactcagctggaattggtcagccttcgtcgctgcgcaggactggggcacgacagtgaagaggacagcggaggggaggcctctgaggaggaggcgggtgctgcgctcctggggggaggccaagtgtccggcgataccagtccagactctcccgacctgaccttttccaaaaaatttttgaacgtcttcgtgaactccacaagtagaagctcttccaccgagagtttcggacttttcagctgtctcgtgaacggagaggaaagggaacagacccaccgggcagtgtttcggtttatcccaagacatcctgacgaattggagctggacgtagacgaccctgttctggttgaggccgaagaagatgatttttggttccgcggattcaatatgaggacaggggagcggggagtgttccccgcattctacgctcatgcggtgcctggccctgctaaggatcttttggggtcgaagaggagtccttgctgggtggagaggttcgatgtgcaattcctcggcagcgtagaagtgccctgtcaccagggtaacgggatactgtgtgccgctatgcagaaaatcgccaccgcccgtaaactgacggtccacttacgcccacctgcatcttgtgacctggagattagtttgaggggggttaagctgagtctgagtggcggtggaccagagtttcaacggtgctctcattttttccaaatgaagaatatctccttttgtgggtgtcacccacgaaacagctgttatttcggcttcattaccaaacacccactgctctcccgattcgcttgtcacgtgtttgtaagccaggagagtatgcgcccagtggcacagtccgtgggacgcgctttcctcgaatactaccaggagcacctggcctacgcctgtccaactgaagacatctatctggagtag

SEQ ID NO: 230936 - DNA, 1677 bp, Artificial Sequence
  Description of Artificial Sequence: Synthetic coding sequence
atgatatccagtatctcagaaacagaattggagctatctagcgacggaggctcctcctcctcaggcaggagcagccacctcaccaacagtatcgaggaagctagttcaccggctagtgaaccagaaccaccccgagaacctcctaggagaccagcatttctgcctgtgggtccagacgacacaaacagtgaatacgaaagtgggtctgagtcagaacccgacctttcagaagatgcagatagtccctggctcctctcaaacctagtgtcaagaatgatttctgagggtagcagcccaatccggtgtccaggacaatgcctgtccccagccccacgccctccgggtgagccagtgtctcccgcagggggtgcggctcaagattcccaggaccccgaagcagccgcaggacctggaggcgtcgagcttgtggacatggaaaccctgtgcgctcccccacctcctgcccctgcggctccacggcctggccctgcccaacctgggccatgtctgttcctctccaacccaacccgtgataccatcacaccattatgggccgctccaggccgtgccgcaaggcctggacgggcttgtagcgctgcatgtagcgaggaggaagatgaggaggatgacgaagaagaagaagatgcagaagactcagctggatcacccggaggtcgtgggacaggtccatcggcccctagggacgcctcactggtgtatgacgcagtaaaatacactctggtcgtcgatgagcacacccagctagaactggttagcttgcgtagatgtgctggcctcggacacgactcggaggaagatagcggtggcgaggctagcgaggaggaagcgggagcggctctcctgggagggggacaagtgagcggggatacttcccccgattcccctgatctcaccttctctaagaaattcctcaacgtcttcgtcaactcgacctcacgaagtagtagcacggagagcttcggactgttttcttgtctggtgaatggtgaagagagggaacagacccatcgcgctgtatttcggttcattccgaggcatccagatgagctcgagttggatgtggatgacccagttttagtggaggctgaggaagacgacttttggttccgcggattcaacatgagaacaggcgaacggggagtatttcctgcgttttacgcccatgccgtaccaggccctgccaaggacctgctggggtccaaacggtccccatgctgggtggagagatttgatgttcaatttcttggaagtgtggaggtgccctgccaccaggggaatggtattctctgtgccgctatgcagaaaatcgctactgcccgtaaactgaccgtccatctgagacctcccgcatcttgcgaccttgaaatcagtcttagaggcgtgaaattgtccctgtccggtggtggcccagaattccagaggtgctcacacttctttcagatgaaaaacatctctttctgtggctgccatcccaggaacagttgttatttcggctttattactaagcaccctctgctcagcagatttgcctgtcatgttttcgtcagccaagagtctatgcgcccagtggcgcagagtgtgggaagagcgttcctcgagtattatcaagaacatctggcctacgcgtgccctactgaagacatctacctcgaatag

SEQ ID NO: 230937 - DNA, 1677 bp, Artificial Sequence
  Description of Artificial Sequence: Synthetic coding sequence
atgataagcagcatcagcgagaccgaactggagttgagctccgacgggggatccagcagtagtggccgaagtagtcacctgacaaactctatcgaagaagcctccagccctgctagcgagcccgagccaccacgcgagccccctaggagaccagccttcctgcccgtcggccctgatgatacgaacagcgaatatgaatctggaagcgagagcgaacctgatctgagcgaagacgcggactctccatggctgctctctaatcttgtgagtagaatgataagtgagggaagcagcccaatcagatgccctggccaatgcctaagccctgctccccgtcccccaggtgagccagtgagccccgcaggcggagctgcacaggactcccaggaccccgaggcggcagcaggcccaggtggggtagagttggttgacatggagaccctctgtgcccctcccccaccagctcctgcagctcctcggcctggtccagcccaaccgggaccctgcttgttcctgtccaatcctactagagacactatcacccctttgtgggccgctccaggccgagcagccagacctgggagggcatgctccgcggcttgctcagaggaggaggacgaggaggacgatgaggaagaggaggacgccgaggattcagcaggaagccctggcggtcggggaactggacccagcgcccctagggacgcgtctttggtatacgatgcggtcaagtacactctggtagttgatgagcatacccagctggaacttgtgagcctgcggcgttgtgcagggctgggtcacgactccgaggaggattccggcggtgaggccagtgaagaggaagcaggggcagccctactggggggtggccaggtcagcggggacacctcccccgatagccccgatctgactttttccaagaaattcctcaacgtgttcgtcaacagcacctcacgttcttcctctactgagtccttcggtctgttctcctgtttggtgaatggggaggaacgcgagcagactcaccgggctgtctttcggtttattcctagacaccctgatgagctggagctggatgtcgacgacccagtcctggttgaggctgaggaagacgatttttggttcagaggcttcaatatgcgaaccggggagagaggggttttccccgcattctatgctcatgcagtacccggaccggcaaaggacctgctaggttctaagcgaagcccatgctgggtcgaacgattcgatgtccagtttctcggaagtgtggaagttccttgccaccaagggaatggaatcctctgcgcggctatgcagaaaatagcaactgcgagaaagttgactgtgcacctccgtcctcctgcatcttgcgacctggaaatctcgctgagaggtgtgaaattatccctctctgggggaggccctgaattccagaggtgctcccacttttttcaaatgaaaaatatatctttttgcggatgtcaccccagaaactcctgctatttcggcttcatcactaagcatccattgctctcaaggtttgcatgtcatgtgtttgtaagccaggagagtatgcggccagtagcccagtcagtcggtagggctttcctggagtattaccaggaacacctggcgtatgcttgcccaacagaagacatttacttggaatag

SEQ ID NO: 230938 - DNA, 1641 bp, Artificial Sequence
  Description of Artificial Sequence: Synthetic coding sequence
atggctgatagagctgaaatgttctcactgtcaaccttccattctctcagccctcccggttgtaggcctcctcaagatatatcactcgaggagttcgatgatgaagatctctctgagattaccgacgactgcggcctcggtctgagttacgactctgaccactgtgaaaaagacagcttgagcttaggcaggtcagaacaaccacaccctatctgcagcttccaggatgatttccaagaatttgagatgattgacgataacgaggaggaggatgatgaggacgaggaagaggaagaagaagaggaggagggcgatggagagggccaggaaggcggagaccctgggtcagaggccccagcaccagggcctctgatcccttcaccctccgtcgaggagccccacaaacatcgcccaacgaccctgcggttaacaactctcggtgcacaggatagtctgaacaacaacggagggttcgacttggtgcgccctgcctcttggcaagagacagctttgtgctcccctgctcctgaggctctacgagagctgcccggacctctaccagctacagataccgggccaggaggcgctcagagccccgtgagaccaggatgtgattgtgaaggaaatagacctgctgaacctccagctcctgggggaacttcaccgtcaagcgacccagggattgaggcggatctcaggagtcggtcgtctggagggcgagggggacggaggtcgagccaggagctatcctctccaggatccgactctgaagacgcagggggtaggctgggaagaatgatctcctcaatttccgagactgagctcgagctttcttcagacggcggttcctcttcaagtggccgatctagccatctcactttctctaaaaaattcttgaacgtgtttgtgaattccacctccaggtcatcaagtacggaatccttcggtcttttctcgtgcctggtcaacggagaagagcgggaacagacacatcgggctgtgttcaggttcatcccgaggcaccctgacgagctggagctggacgtggacgaccctgttctcgtagaggcagaggaagacgacttctggttccggggatttaatatgcgaactggcgaacgtggggtcttccctgcattttacgctcacgccgtacctggccctgccaaagacctgctgggatcaaaacgctctccgtgttgggttgagcgttttgacgtgcagtttcttggatccgtcgaagtaccttgccatcaggggaatgggatcctgtgtgccgcaatgcaaaaaatcgcgaccgcacggaagctgaccgtgcaccttcggcctcccgcatcttgcgacctggaaattagccttcgcggagtaaaactctctctgtccgggggtggacccgaattccagcgttgctcacacttcttccaaatgaaaaatattagcttttgcggctgtcatccgagaaactcgtgttattttggattcatcaccaagcatcccctgctttcaaggtttgcctgccatgtgtttgttagccaggaaagtatgagacccgtcgctcagagtgttggaagggcgtttttggagtactaccaggagcatctggcttacgcctgccccactgaggatatttacctggagtag

SEQ ID NO: 230939 - DNA, 1149 bp, Artificial Sequence
  Description of Artificial Sequence: Synthetic coding sequence
atgtcagactccaaatgcgattctcagttttattctgtccaggtggccgactccacttttaccgtattaaagcggtaccagcaattaaagcctattggttctggggctcaggggattgtctgtgctgccttcgacactgtacttgggataaatgtggctgttaagaaactgtctcggccattccagaaccaaacccatgctaagcgggcataccgggaactcgtcctgctgaagtgtgtcaatcataaaaatattataagcctactgaatgtgttcactccacagaaaacccttgaagaattccaggacgtctatctggtcatggaactgatggacgcaaacctttgccaagtcattcacatggagcttgaccacgaacggatgtcctatctgctttatcagatgctatgtggcataaaacacttacactcagccggaattatacacagggacctaaaaccctccaacattgtcgtcaaatcggactgcaccctgaaaattctcgactttgggctcgccagaactgcatgtactaacttcatgatgacaccttacgtcgtaacccgctactaccgggctcctgaggtcatactcggaatgggctacaaagagaatgtcgatatatggtctgtgggatgtattatggctgaaatggtgctgcacaaagttctgttccctgggagggactatatagatcaatggaataaagtgatagagcaacttgggacaccaagcgcggaatttatgaagaagcttcaacccaccgtacggaattacgtagagaacagacccaaatatccgggtattaagtttgaggagttattccctgattggatcttcccatcagagagcgagcgagacaagattaagacttcccaggctagggacttgctgagcaaaatgttggttatcgacccggataaacggatctccgttgatgaagctctgaggcacccatacattaccgtgtggtacgatcccgcagaagctgaggccccaccgccacaaatctacgacgcccagctggaggagcgggaacatgctatcgaggaatggaaagaactgatttacaaggaggtgatggactgggaagaaaggtccaagaatggtgtcgtcaaggatcagcctagtgctcaaatgcagcagtag

SEQ ID NO: 230940 - DNA, 1149 bp, Artificial Sequence
  Description of Artificial Sequence: Synthetic coding sequence
atgtcggactccaaatgcgatagtcagttttactctgtccaagtggcagatagtaccttcaccgtgctcaagcgttatcagcagcttaagccaatcggatctggcgcacagggtatcgtgtgcgcagcatttgacactgtgcttgggataaacgttgctgtcaagaagctgagccggccatttcaaaatcaaacacatgcaaaaagggcctaccgagagctcgtccttctcaaatgcgtaaatcataaaaatatcattagcttgttgaacgttttcactccgcaaaaaactctggaggagtttcaagacgtgtacttggttatggagctgatggacgccaatttgtgtcaggtcatacacatggagctggatcacgaacgcatgtcataccttctataccagatgctttgcgggatcaaacacttgcacagtgcgggtatcatccatcgcgatctcaagccatccaacatagttgtcaagtccgactgtaccctcaaaatcctagactttgggctggctaggacggcctgtacaaattttatgatgaccccctatgttgtcacgcgatactaccgcgcaccggaggtgattctaggcatgggatacaaagagaacgtggatatttggtccgtcgggtgcatcatgggagaacttgtcaaggggtgcgtgattttccagggcaccgaccatatcgaccaatggaacaaagttatcgagcagctcgggacacccagtgcggaattcatgaaaaaattgcaacctaccgtcaggaactacgtggagaaccggccaaaatatcccggaatcaaatttgaggaactcttccctgattggatcttcccaagtgaatccgagcgagacaagatcaagacgagccaagcccgtgacctattatcaaagatgctcgttattgaccccgataagcgcatctcggttgatgaggcactgcgtcatccttacataaccgtatggtacgatcctgccgaggcggaggcacccccaccacagatttacgacgcccagcttgaagagcgggagcatgccatcgaggaatggaaggagctaatttataaagaagtaatggactgggaggagcgcagcaagaatggtgtggtgaaagatcagccctcagctcaaatgcagcaatag

SEQ ID NO: 230941 - DNA, 375 bp, Artificial Sequence
  Description of Artificial Sequence: Synthetic coding sequence
atgtcggatagcaaatgcgatagccagttttatagtgtccaggtggctgattcaaccttcaccgtgttgaaacgctatcagcagctcaagcccattgggagcggggctcaaggaattgtgtggcgccaccattgctctgctctcccctttatagggagaatgaggcctgtttcagtgatcgtaactccttggatcaatcaggagggcatgctgtgcgaggggctggggtggccatccctgccctggtgtctgacaagtactgtttgcccagcccaaaatgttaggatagtctcccttacgctgaacgtttcactgctgcatggaaagacagtgtccagacgaagcatcaccggccagctcaaatgttgcatatag

SEQ ID NO: 230942 - DNA, 729 bp, Artificial Sequence
  Description of Artificial Sequence: Synthetic coding sequence
atgtcggactcaaagtgcgactcacaattttactccgtgcaggtggccgactccactttcactgtgctcaaacggtaccagcagttaaagcctattggatccggtgcccagggcatagtctgcgctgcttttgacacagttctgggcatcaacgttgccgtgaaaaaactctcgcgcccttttcagaaccagacgcacgctaagagagcctatcgcgagctggttctcctgaaatgcgtaaaccacaagaacattatctcattgctcaacgtgtttactcctcagaagaccctggaggaattccaagacgtctacctggtcatggagctgatggacgctaatctctgtcaggtgatccacatggagctcgaccacgagcgcatgagttatctcctctatcagatgctgtgcggaattaaacacctacacagtgcgggaatcatccatagagatctaaagccttccaacatcgtcgtgaagtctgactgtacgcttaaaatactggactttggactcgcaagaactgcatgtacgaactttatgatgacaccttacgtggtgactagatattaccgtgcacccgaagttatattgggcatggggtataaggaaaacgttgacatctggtcagtgggctgcatcatgggtgagctggtgaagggttgtgtcatctttcaaggcaccgaccggatcctgccccgagaccttggacccgcaatgctgagttag

SEQ ID NO: 230943 - DNA, 1275 bp, Artificial Sequence
  Description of Artificial Sequence: Synthetic coding sequence
atgagtgatagtaagtgtgactcacagttttacagtgtacaggtcgctgatagcaccttcaccgtgctgaagagataccaacagttgaagccaatcgggtcgggtgctcaaggtattgtttgcgcagcctttgacactgttctggggataaacgttgccgtgaaaaaactcagtcgtccatttcagaatcaaacccatgcaaagcgggcttacagggaactcgttttactgaagtgcgtcaatcacaaaaacataatctcactccttaacgtattcacaccccagaaaaccctcgaggagtttcaagacgtatacctggttatggagttaatggatgccaacctgtgccaggtcatccacatggaactcgaccacgagagaatgagctacttgctgtaccaaatgctgtgcgggataaaacatctccatagcgcagggattattcatagggatctgaaaccatccaatatcgtggttaagtccgattgcaccctcaaaatccttgatttcggcctggcccgaacagcctgtaccaatttcatgatgactccatacgttgtcacgagatactaccgcgctccggaggtgatcctcggtatgggctacaaggagaacgttgacatctggagtgttggttgcatcatgggtgagcttgttaaaggttgcgtcatctttcaggggaccgatcacattgaccagtggaataaggtgattgaacagctggggactccttccgccgagttcatgaaaaaactccagcccacagtccggaactatgttgagaacagaccgaaatatccaggaattaagtttgaagagctctttccagactggatttttccgtccgagtcagagcgcgacaaaataaaaacatcgcaggcgagggacctcctgtctaaaatgctggtaatcgacccagataagcggatctccgtggatgaagcattgcgccatccctacataacagtgtggtatgatcctgcagaggccgaagcacccccaccccaaatttatgatgcccagcttgaggaacgagaacatgcaatagaagagtggaaagaattgatttacaaggaagttatggactgggaagagagatcgaagaatggtgtggtcaaagaccagccttctgacgcggctgtgagtagtaatgccaccccatcacagagcagttcaattaatgacatcagctctatgtcgacagagcaaactttagcaagcgatactgacagcagtctcgatgctagcaccggcccattggaggggtgtagatag

SEQ ID NO: 230944 - DNA, 1275 bp, Artificial Sequence
  Description of Artificial Sequence: Synthetic coding sequence
atgagcgacagcaagtgcgactcccagttctattcggtccaagtagccgacagtacctttaccgtgctgaagagataccagcaattgaaacctatcggatcaggagcccaaggaatcgtgtgtgcggcattcgacacagtcctcggaattaacgtggccgttaagaagttaagtcgaccatttcaaaaccaaacacacgctaaacgtgcttaccgggaattggtgctgcttaaatgtgttaaccataaaaacattatatctctgctgaacgtcttcacacctcaaaaaaccctggaagagttccaggatgtgtatttggtgatggagctgatggacgcaaacctgtgtcaggtgatccacatggagcttgatcacgagcggatgtcttacctgctgtatcagatgctatgcggcataaagcatcttcattcagccggaatcatccaccgtgacctgaaacccagcaatatcgtggtgaaaagcgactgcacgttgaagatattagatttcggcctggccagaactgcctgtaccaactttatgatgaccccatacgtagttacccgatattatcgcgctcctgaagttattttaggcatgggttacaaagagaatgtggacatatggagcgttggctgcataatggccgagatggtcctacacaaagtgctgttccctggaagggactatatcgatcaatggaacaaggtgattgaacagctgggcacaccaagtgcagaattcatgaaaaaactccaacctaccgtcagaaactacgtggagaataggcccaagtatcctggaatcaagtttgaggaattattccccgactggatttttccttccgagtcagagcgagataagatcaagacctcccaggcaagagacttgctgtctaagatgctcgtgatcgacccagataagagaatctctgtagacgaggctctgaggcacccgtacattacggtgtggtacgaccccgctgaggcagaggcaccgcctcctcagatctacgacgcccagttagaggaaagagagcatgctattgaagagtggaaagagcttatatataaagaggtcatggattgggaagagcgctctaaaaacggtgttgtgaaggatcagccatctgatgcagctgtaagctctaacgccactccgtcccagtcatcaagcatcaatgacatcagttcgatgtccacagagcagacactcgccagtgacacagatagttccctcgatgcttccactgggccactcgaaggttgccggtag

SEQ ID NO: 230945 - DNA, 315 bp, Artificial Sequence
  Description of Artificial Sequence: Synthetic coding sequence
atgtctgattccaagtgtgactcccaattttatagcgtgcaggttgccgacagcacatttactgttctcaaacgatatcagcagctcaaaccaattgggagcggagctcaggggatcgtgtgcgcggcattcgatacagtccttggtatcaacgttgccgtcaaaaagctgagcaggccttttcaaaaccagactcacgccaaaagggcgtaccgggagctagtgctgttaaaatgtgtgaaccataaaaatataatttcattgttaaacgtgttcaccccccagaagaccctagaagagtttcaggatgtgtag

SEQ ID NO: 230946 - DNA, 645 bp, Artificial Sequence
  Description of Artificial Sequence: Synthetic coding sequence
atgtcagattcaaagtgcgactctcagttttattcggtgcaggtggcagacagcacatttaccgtgcttaagcgttaccaacagctgaagcccattggatctggggctcagggcatagtgtgtgccgcatttgataccgtgttgggtatcaacgtagccgtcaagaagctgtctagaccctttcagaaccagacccacgccaagcgggcttacagagagctggtcctgctgaaatgtgtaaatcacaaaaatataatatcactcttgaacgtgtttactccacagaagacccttgaggagtttcaggatgtgtacctggttatggaactgatggacgctaatctgtgccaagtgattcacatggaattggaccatgaacgaatgagctacttgttataccaaatgctctgcggaatcaaacacctgcatagcgccggtattattcatcgagatctgaagccatctaacattgtggtgaaatctgactgcacactgaaaattctggacttcggactcgcaagaactgcttgcacgaatttcatgatgacgccttacgtcgtcacacgttactaccgcgctccagaggtcattcttggcatgggctacaaggagaatgccatcaaatactggaccctctggcattag

SEQ ID NO: 230947 - DNA, 1347 bp, Artificial Sequence
  Description of Artificial Sequence: Synthetic coding sequence
atgctgtggttggcgttagggcctttcccagccatggagaaccaagttcttgtgatcaggatcaagatccccaacagcggcgctgtagactggacggtgcactccggccctcaattgttgttccgggacgttttagatgttatcggacaggtgttgcccgaagccaccacaacggcattcgaatacgaagatgaggatggcgatcgaatcactgtgaggtcagatgaggaaatgaaggccatgttgtcctattactactccacagtgatggaacagcaggttaatgggcaattgatagagcctctacagatctttccccgagcctgtaaacctccaggcgaaagaaacattcatggacttaaggtcaatacccgcgcagggccttcacagcatagctctcctgcagttagcgattcattaccttcaaactctttgaaaaagtcatccgctgaactgaagaaaatcctggctaatggacagatgaatgaacaggatatacgctaccgagataccttgggacacggaaatggaggtaccgtgtacaaagcctaccatgtgccgtctggtaagattctcgccgtaaaggtgattcttcttgatatcacactggaactgcagaagcagatcatgagtgaacttgagatactttacaaatgtgattcctcctacataattgggttctacggagcttttttcgtagagaataggattagcatctgcacggagtttatggatgggggatcgctagatgtatatcgcaaaatgccggaacacgtcctgggccgtattgccgtcgccgtcgtaaaaggcctcacatatctgtggagtttgaagatcttacaccgcgacgtgaagccttcaaatatgctggtgaatactcgcggacaggtgaagctgtgtgatttcggtgtctctacacagctcgtgaacagtatcgctaagacatacgtgggaacaaatgcttacatggcgccagagagaatcagtggtgaacagtacgggattcattcagatgtctggtctttagggatctccttcatggagctagcgctaggcagattcccatacccacagattcagaaaaaccagggatcactcatgcccctccagctcttgcaatgcatcgtcgatgaggattcccctgtgttgccagtgggggagttctctgagcccttcgttcacttcattacacagtgtatgcgcaaacagcccaaagaacggcctgcccctgaagagctgatgggccatcctttcattgttcaattcaacgacggcaatgctgcagtggtgagtatgtgggtgtgccgggctctagaggagcggagatctcaacaaggacctccctag

SEQ ID NO: 230948 - DNA, 1317 bp, Artificial Sequence
  Description of Artificial Sequence: Synthetic coding sequence
atgctctggctcgcactgggtcctttccctgcaatggagaaccaggtgctggttatccggataaagattcctaatagcggagccgtagattggaccgtccactccgggcctcaactgctgttcagagatgtcctggatgtaattggacaggtgctgccggaagccaccactaccgcttttgaatacgaggacgaggacggagacaggataacagtgagatccgacgaggagatgaaagctatgctgtcttattattacagtactgtgatggagcagcaggtgaatggtcagctcatagagccactccaaatcttccctcgggcatgcaagccaccaggagagagaaatattcatggtctgaaagtgaataccagggctggtccgtcccagcactcttctcctgctgtttccgacagtctcccatcaaatagtcttaagaaatcaagcgccgagttaaaaaagattttggctaacggccagatgaacgagcaggatataaggtacagagacacgctcggccacggaaacggcggaactgtttataaagcctaccacgtaccgagcgggaaaatcctggcagttaaagtgatactcctggacataacgctggaacttcagaagcagataatgtcagagctggagatcctatacaaatgtgactcaagctatattattggattttacggagccttttttgtagaaaatcgtatctccatatgcacggagtttatggacggcggaagcctggacgtgtacaggaaaatgccggagcacgtgcttgggaggatcgctgtcgcggtggtgaagggcttgacatacctctggagtctgaagatcctgcatcgggacgtgaaaccttccaacatgctagttaatacccggggtcaggtaaagctgtgcgattttggagtgagcacccagctcgtcaactccatagccaagacctatgtcggtactaatgcttacatggccccagagaggatctccggcgaacagtacggaatccactccgacgtgtggagtctgggaatctccttcatggagattcagaaaaaccaggggtcattgatgccactacaactcttgcagtgcatcgtcgatgaagactcgccagtacttccagtgggagagtttagcgaaccattcgtgcattttatcacccagtgcatgcgcaagcagcctaaggagcgccctgcacccgaagaactcatgggacacccatttattgtccagttcaacgacggcaatgccgcagtggtttcaatgtgggtttgcagagccctggaagagcgaaggtcccagcaggggccaccatag

SEQ ID NO: 230949 - DNA, 1335 bp, Artificial Sequence
  Description of Artificial Sequence: Synthetic coding sequence
atgctgtggctggctctgggtcccttcccagccatggagaatcaggtgctggtgataagaataaagatcccaaattccggagctgtcgattggacggtgcactcgggacctcagctgctattcagggatgtgttggatgtcattggtcaggtgcttccggaagcgacaactacagccttcgagtatgaggacgaggatggagacaggattacagtgagatctgacgaggagatgaaagccatgctaagctactattattccacagttatggagcagcaggtcaacggccagctcattgagcccctccagatcttccctcgagcctgcaaaccaccgggtgaacgtaatatccacggcctgaaagtgaacacacgcgctggaccctcccaacattcatctcccgcagtgtctgattctctaccaagtaactctctcaagaagagctcggctgagttaaagaaaatcctggccaatggacaaatgaacgaacaagacattcgatacagggacaccttaggtcatggcaatgggggaaccgtgtacaaggcataccacgtgccctccgggaagatccttgccgtgaaggtcatacttttagatatcaccctcgagctgcagaagcagattatgtccgagctggaaatcctctacaagtgtgactcgtcatacatcatcggcttttatggggcatttttcgttgaaaataggataagtatatgcaccgagttcatggatggaggttcgcttgatgtgtatcgtaagatgcccgagcacgtgttagggagaatcgctgtggcggtggtgaagggtctgacgtatctttggagcctcaagatcctgcaccgggacgtgaaaccttccaatatgctcgtcaacactcgcggtcaggtcaagttatgcgattttggagtttcaacccagctagttaactccatcgccaagacctacgtggggacaaatgcctatatggcacccgagcggatctccggcgaacaatatggcatccacagtgatgtgtggagcctcggcatttcctttatggaaatccagaaaaatcagggctccctgatgcctctgcagctcctccagtgcattgtggacgaagactcccctgtgctgcctgtaggggagttctctgagcccttcgtccattttataacccagtgcatgcggaagcaacctaaggaacggcctgctcctgaggagctgatgggtcatccgtttatcgtccagttcaacgacgggaacgccgctgttgtaagcatgtgggtctgccgagccttagaagagcggaggtcgcccgcaagtttaccctccccaagctcttccatttag

SEQ ID NO: 230950 - DNA, 1239 bp, Artificial Sequence
  Description of Artificial Sequence: Synthetic coding sequence
atgatggaaggccattttcctcagtccgacgtaatcggacaggttttgcctgaagccacaactactgctttcgaatatgaggacgaggacggggacaggatcactgtgcgcagtgatgaggagatgaaggccatgttatcctactactacagcacagtcatggagcagcaggtaaacggacagttgatcgaaccactacagatcttcccaagagcttgtaagcctcctggggaaagaaacattcatggactgaaagtcaatacccgcgctggccctagccagcatagttctcccgcagtaagtgactccctcccctctaacagcctgaagaaatcctccgcagaacttaagaagattctagccaacggccagatgaatgagcaggacatccgatacagggacactcttggtcacggtaacgggggtactgtgtacaaggcctaccacgtcccaagtgggaagatcctggcagtgaaagtgattctgttggatatcaccctggagctccagaagcagatcatgagtgagctcgagattttgtataaatgcgactcatcatacattattggattctatggcgctttttttgtcgagaatagaatctcaatatgcaccgaatttatggacgggggtagcctggatgtgtaccgcaagatgcctgaacatgtgctgggtagaattgcagtagccgttgtgaaaggcctgacatacctatggagcctgaaaatcttacaccgggacgtgaaaccaagtaatatgctcgtgaatacccgcggacaagtgaagttatgcgacttcggagtcagtacccagctagtcaatagcatcgctaagacctacgtcggaacaaacgcctatatggcgcctgagaggatcagcggcgaacaatatggcattcactccgatgtttggtccctgggaatctcttttatggaactggccttgggcagatttccatatccccagatccagaaaaaccagggaagtttgatgcctctccagctcctacaatgcatcgtggatgaggactccccagtacttcccgtgggagagttctcagagccattcgtgcactttattactcagtgcatgcgaaagcagcccaaggagcgacctgcccctgaggagctgatgggtcaccctttcatcgttcagttcaacgacgggaatgccgctgtggtctctatgtgggtgtgccgggctttggaagaacgcagatctcagcagggtccaccatag

SEQ ID NO: 230951 - DNA, 1005 bp, Artificial Sequence
  Description of Artificial Sequence: Synthetic coding sequence
atgagccagtctaaaggaaagaaaagaaatcccggtcttaagattcccaaggaggccttcgagcagccacaaacctcctctaccccgcctcgcgatttggacagtaaggcctgtatctccataggcaatcaaaacttcgaggtgaaggccgatgatcttgaaccaattatggaactggggcgaggggcttacggggtagtggaaaaaatgcggcacgtgccttctggtcaaatcatggccgttaagcgcattcgcgcaactgttaactcccaggagcagaagcgtctcctcatggatctcgatatttcgatgcggacagtggattgcccattcacggtgacgttttacggtgccctgtttcgcgagggtgacgtctggatttgcatggagcttatggatactagcctagacaaattttacaaacaggtgattgacaaaggacagacgatacctgaggatatcctaggaaagattgcagtgtccatagtcaaagcacttgaacatctgcactccaaactgagcgtgatacatcgagacgtgaaaccatctaatgtgctgattaatgccctgggccaggtgaagatgtgcgattttggaatatctggataccttgtcgattcggtagccaagaccatcgacgccggatgcaagccctatatggcccctgagaggatcaacccagagttgaatcagaagggttactctgttaaatctgacatatggtccctcgggatcacaatgatcgagctggctatcctacgtttcccctacgactcttggggcacaccgtttcaacagcttaagcaggtggtggaagagccaagccctcagctcccagcagataaattctctgcagagtttgtcgatttcactagtcagtgcctcaagaagaatagtaaggagaggcccacgtaccctgagctgatgcaacaccccttcttcactcttcatgaaagtaaaggcaccgacgtggcaagcttcgtgaaactgatactgggcgattag

SEQ ID NO: 230952 - DNA, 1005 bp, Artificial Sequence
  Description of Artificial Sequence: Synthetic coding sequence
atgagccagagtaagggcaaaaaacggaaccccggattgaaaattcctaaagaagcttttgaacagccccagacaagttcgacgccaccaagggatctggactcaaaggcttgcatctctataggcaaccagaactttgaggtgaaagcagatgacctggagccaatcatggagctggggaggggggcatacggcgtggtggagaaaatgcgccatgtgcctagtggtcaaattatggccgtgaagagaattagagcgacagtgaattctcaagagcaaaagcggctgctcatggacctcgatatctccatgcgcaccgtggactgtccatttactgtgactttttacggagcgctgtttcgcgaaggagatgtctggatctgcatggagctgatggacacttcccttgacaagttttataagcaggtaatcgataaagggcagaccataccggaggatatcttggggaaaatagcagtctctatcgtgaaagctctagagcatctgcactcaaaattgtctgtgatccaccgggatgttaaacctagtaacgtcctaattaacgctctgggccaggtaaagatgtgtgactttggtatctccggctacctagtcgattctgtggcgaagacaatagatgctggctgtaagccatatatggcccctgagagaattaatcccgagttaaaccagaagggctatagcgttaagtccgatatatggtctttaggtatcaccatgatagaactggcaatcctgcgatttccttacgattcttggggaacgccctttcagcaattaaagcaggtggtggaagagccgtcgccgcagctgccagccgacaagttctccgccgagtttgtggactttacctcacagtgtctgaaaaagaacagtaaggagaggcccacttaccctgagctcatgcaacatcctttcttcaccctgcacgaaagcaaggggactgacgtggcatcttttgtaaagctgatcctgggggattag

SEQ ID NO: 230953 - DNA, 2865 bp, Artificial Sequence
  Description of Artificial Sequence: Synthetic coding sequence
atggaggaagaggagggtgcggtagctaaggaatggggtacaacgccagctggcccagtgtggactgccgtattcgactatgaagccgcaggagatgaggagttgaccctgcgacgcggagacagggtgcaggttctttcacaagactgcgccgtgtcaggggacgaggggtggtggaccggtcaattgcctagcgggcgagtcggagtgttcccttctaattacgtcgcccctggcgctccggctgccccagcaggtcttcaactgccccaggaaattccctttcacgagctgcagctagaagagataatcggagtaggcggattcggcaaggtctatcgggcactctggcgcggagaggaggtcgccgtgaaggctgccagactggatcctgagaaggaccctgccgtgacagcagaacaagtgtgccaggaagccagattgtttggggcactgcaacacccaaatatcattgcgctgaggggcgcttgtctaaatccaccacacctgtgccttgtgatggagtacgcaaggggcggagctctctcgagagttctggcaggacgacgggtgcctccgcatgttctcgtaaactgggcagtgcaggtcgcacggggtatgaactacctgcacaacgacgccccagtccccatcattcaccgggacctcaaatctatcaacattctcattctggaagccatcgagaaccataacctcgcagatactgtgctgaagattactgactttgggctagccagggaatggcacaagacaaccaaaatgagcgccgcaggcacctacgcctggatggccccagaggttataaggcttagcttatttagcaagtcatcggacgtttggtctttcggagtgttactctgggaacttctgaccggggaagtcccctacagagagattgatgctctggctgttgcctacggggtggcgatgaataagctgactctgccaataccttccacctgcccggagccctttgcaagacttctggaagagtgctgggacccggatccgcacggtagacctgattttggcagcattctgaagaggctcgaagtgatcgagcagtccgccctctttcagatgcccctggagtccttccactcactgcaggaagactggaaactggaaattcaacacatgtttgacgatcttcgtaccaaggaaaaggaacttaggagccgggaagaggaactgctgagggccgctcaggaacaaagatttcaggaggaacagctgagacggagagaacaggagctggctgaacgcgagatggacattgtagagcgggaactgcacttactgatgtgccaattgtctcaggaaaaaccgagagtacggaaacgcaaggggaacttcaagcgaagccgactgctcaaacttcgggagggcggaagtcacatctctcttccatctgggtttgagcataagataaccgtgcaggctagccctacgctcgataagcgaaagggaagcgatggggcttcaccccctgcaagcccatccataatcccacggctgcgcgctattcgtctaacccctgtcgattgcggaggctcttccagtggtagctcatccgggggttcaggcacttggtccagggggggaccacctaagaaggaggagcttgttggcggtaagaagaagggaaggacctggggaccctcttctactcttcaaaaggagagagtgggcggagaagaacggttgaaggggctgggagaagggtcaaaacagtggtcctcctcggcaccgaacctagggaaatctcccaagcacaccccgattgcgcctggattcgcttccttgaacgaaatggaggagtttgccgaggcagaggacggtgggagctccgtgcctccctctccttacagcaccccctcttacctctccgtgccactgccagcggaaccctccccgggtgctcgggctccctgggagcctacgccctcagcaccacctgccagatggggccacggtgcacgtaggcgttgtgatctcgccctcctagggtgtgcaactctgcttggagcggttgggctcggcgctgacgtagctgaggccagagcagccgatggtgaggagcaacgaagatggttggacggcttgttcttcccaagggctggcagattcccgcgaggcctgagtccccctgctagaccccacggcagaagggaagatgtcggtcccggactaggcctggctccgtccgcaaccctcgtatctttgagtagtgtgagtgattgcaatagcactaggtctcttctaagaagtgactcagatgaagctgcacccgcagctccgtccccacctccctcaccaccagcaccaacgcctacaccttcgccaagtaccaaccctttggtggatctcgagttagaaagtttcaagaaggatcctcgacaaagcctgacccctacacatgtaaccgcagcctgtgccgtcagtcgcggtcacagaaggacgccatctgatggggctctcgggcagcgcggaccaccagaacccgcaggacacggtcctggcccacgggacctgctagactttcccagactgcccgatccccaggccctgttcccagctcgtagacgcccacccgaattcccaggacgacccacaacacttactttcgcccctagacctaggccggctgccagccgtccacgattagacccatggaaactggtatcattcggtagaaccctcacgatctctcctccatctcgccctgatacgcctgagtcccccggacccccttccgtacaacctacgcttttagacatggacatggaaggccagaatcaggattctaccgtgccgttgtgcggagcccatggctcccactag

SEQ ID NO: 230954 - DNA, 2544 bp, Artificial Sequence
  Description of Artificial Sequence: Synthetic coding sequence
atggaacccctgaaaagcctgtttctgaaatcacccttgggatcctggaatggctctggttctggtgggggagggggtggcggtggtgggagaccagaagggagtcctaaggctgccggatatgctaatcctgtgtggacagcgctgttcgactacgagccgtctggacaggacgaactggcattaaggaaaggagacagagtagaagttctgtcacgcgatgcggctatatcaggagacgaaggatggtgggccggtcaagtaggcggacaggttggaatcttcccatcaaactatgtttctcggggaggcggacctcccccatgtgaagtggcgagcttccaggaactgagacttgaagaggtgatcggaatcgggggatttggaaaagtttacagagggagctggaggggggagctggtcgctgtaaaagcagccagacaggacccggatgaggacatctctgttactgctgaaagcgttagacaggaggccagactctttgcaatgcttgctcaccctaatattatcgctcttaaagcagtgtgtctggaagagccgaatctgtgtctagtcatggagtatgctgcgggaggtccccttagtcgggcattggccggtagaagggtgcccccacatgtcctggtcaattgggccgtgcagattgccagaggcatgcactatcttcattgtgaagccctggtcccagtgatccacagggacctaaaatctaataatattctgctgttgcagcctatcgaatctgatgacatggaacacaaaaccctgaaaatcactgacttcgggctagctagggagtggcataagacaacccagatgagtgctgctgggacgtacgcttggatggccccagaggtaattaaggcttctactttttctaagggcagcgacgtatggtcgtttggcgttctgttgtgggagctactgactggcgaggtgccctatcgtgggatcgactgtctcgcggttgcatacggcgtggccgtaaataagcttactctgcccataccttccacctgcccagagccctttgcccagctcatggcggactgctgggcccaagaccctcaccggagaccggattttgcatccatcctgcagcaactggaggctctggaggcccaagtgctgcgagagatgccacgcgatagttttcactccatgcaggagggatggaagcgtgagatccaaggactgttcgatgagcttcgcgcaaaggagaaagaactcctctctagagaagaagaactgacacgagctgcaagagagcagagatcacaggctgaacagctgaggcggcgagagcacctgctcgcgcagtgggaattagaagtgtttgagcgggagctcacgctgctgttacagcaggttgatagggaacggcctcacgtgcggaggcgcaggggaaccttcaagaggagcaagttgagggcccgtgacggtggtgaaagaatttccatgcctctcgacttcaaacacagaattaccgtgcaggccagcccagggctcgatagacggaggaacgtttttgaggtgggtccgggtgattctcctacctttcctaggttcagagccattcagctagagccggcagagccgggacaggcctgggggagacaaagccctcgcagactcgaagattcatccaacggagaaagaagagcatgttgggcctggggtccatcttctcccaagcccggtgaggcccagaacggtcgaaggcggtcgcggatggacgaggctacgtggtacctggactccgatgactccagtccactgggctccccttccacaccgcctgccctcaacggaaatcctcctcggccttccctggagccagaagagcccaagagaccagtccctgccgaaagaggttcatcctcagggacgcctaaactgatccagagggctctgcttaggggtaccgctctgctggcctccttgggcctgggtagggacctgcagccgccaggcggtcctggtcgggaacggggagaatcacccaccactcctcctacccctaccccggctccttgtcctactgaaccccctccatcgccattgatctgcttcagtttgaaaaccccagacagcccacccacgccagctcccttgctgttggatttagggatcccggtggggcagcgtagtgcaaagtccccccgaagagaggaagaaccacgaggtgggactgtgtccccacctcctggtaccagcagatcggcaccaggcactcccggaacccctagatcccctccactgggtttgatctccaggcccaggccatctcctctccggagccgaatcgacccttggtctttcgtttctgccggacctcgtccctctcctctgccttccccacaacccgctcctaggcgtgccccatggactttattcccggattccgaccccttttgggacagccctcctgcaaacccatttcaaggaggcccacaggattgtcgggctcagaccaaggacatgggggctcaggccccatgggtaccggaagccggtccctag

SEQ ID NO: 230955 - DNA, 1773 bp, Artificial Sequence
  Description of Artificial Sequence: Synthetic coding sequence
atggaacacaagaccctaaagattacggacttcggacttgcaagggagtggcataaaaccactcagatgagcgcggctggcacctacgcctggatggccccagaagttattaaagcatcgacttttagtaagggctcagacgtgtggagtttcggcgtgcttctctgggaactcctgacaggcgaagtgccatataggggcattgactgcctcgctgtggcctatggggttgccgtgaacaaactgacccttccgattccttcgacatgccctgaaccgtttgcgcaactgatggccgattgctgggcccaagacccccaccggaggcccgatttcgccagtatcttgcagcaactagaagcattggaggcacaggtgcttagagaaatgccacgtgatagtttccattccatgcaggagggctggaaacgagagatccagggcctgtttgacgagttgcgggcaaaagagaaggaattgttgtctcgggaagaggagctgactagagccgcacgtgaacagagatcccaagcagaacagctccgtaggcgagagcacctgctggcgcagtgggaactggaagtttttgagagggagttgacgctcttactgcaacaggtggatcgcgagaggccacatgtgcgcaggagacgtgggacgttcaagcggagcaaattgcgggcacgtgatggtggcgagcggatcagtatgccccttgatttcaagcaccggatcaccgtacaggcttcgcctggactcgatcggaggagaaacgtgttcgaagttggcccaggagatagtccgactttccctcgcttcagagccatccaactggaaccagccgaacctggccaggcctggggcaggcaatctccaagacggcttgaagacagttctaatggtgaacggcgtgcctgctgggcgtggggaccctcctcccccaagcctggtgaggcacaaaacggaaggcgccgttctcggatggatgaagcaacatggtacctggatagcgatgatagttctcctctcggttcacccagcacaccccctgccttgaacggcaatccccctcgcccttccctcgaaccagaagagcctaagcgcccagtgcctgccgaacgtggctcctcttcaggcactcccaagttgatccaacgggctttgctgaggggaacagctctcctagcgtcactagggctgggcagggatcttcaacctcccggaggacccggacgggagagaggtgaatctcctacgactccgcctactcctacgcccgcaccgtgtcctacagagcctccccctagtcccttgatttgcttctccctgaagacccccgattccccgccaaccccagcccctctgctgctggacctcggaatccctgtcggccagcgttcagccaagagtccaaggcgcgaggaggaacccagaggcggaaccgtcagcccgccacccggtacctccagatcagctccagggacgcctggaacgccgaggagtcccccacttggtctgattagccgacctagaccctctcctcttagaagtagaattgatccctggtcgtttgtgagcgccggtcccaggccatcaccacttccgagccctcagcctgccccaagacgcgctccctggacgctgtttcctgacagtgatcccttttgggactcacctccagcaaatccgttccagggagggcctcaagactgccgggctcaaaccaaggacatgggtgcccaggccccatgggtccctgaggccggaccatag

SEQ ID NO: 230956 - DNA, 2580 bp, Artificial Sequence
  Description of Artificial Sequence: Synthetic coding sequence
atggcctgcctacacgagaccagaactccgtcccccagcttcggcggttttgtgagcacattgagtgaggccagcatgaggaagctggacccagatacctctgactgcaccccagagaaggacctgactcctacacatgtgttgcagctccacgaacaggacgccggtggcccagggggagcagccggatcccccgagtcaagagcgtcaagagttcgagccgatgaggtgcgtctgcagtgtcagtccgggtcaggatttctagagggcctgttcgggtgtttgagaccagtctggacaatgatagggaaggcctatagcacggagcataagcagcagcaggaagacctatgggaagtgcccttcgaggaaattctggacctgcagtgggtgggatctggagcacagggagccgtctttctgggaagattccacggggaagaagtggctgtgaaaaaagtgagggacctgaaggaaaccgacattaaacatctgaggaaactcaaacaccccaatatcattacctttaagggggtgtgcacccaggctccgtgctactgtattctgatggagttttgcgctcagggacagctctacgaggtgcttagggccggtcggcctgtcactcctagcctgctagtggactggagtatgggcattgccggaggaatgaactatctgcacctgcacaagatcattcatagagacctgaagtcacccaacatgctgataacgtatgatgatgtggtgaaaatttctgattttgggacctccaaggagctgtccgacaaaagcactaagatgtcttttgctggaaccgtcgcctggatggctcctgaagtgattcgtaacgaacccgtgtctgaaaaggttgacatttggtcttttggcgtggtgctatgggagctcctgactggcgagattccctataaggatgtcgacagcagcgccatcatttggggtgtggggtcaaattcgttacacttgcctgtgccttcaagctgtccagacggatttaaaatactgctgagacagtgctggaacagcaagcccagaaaccggccaagctttaggcagatcctgctccatcttgatatcgcgtctgccgacgttctctcaaccccccaggaaacgtatttcaagtcccaggccgagtggagggaggaggtgaagctccactttgagaaaatcaaatcagaaggcacttgtctccaccgccttgaagaagagctggtgatgaggagaagggaagaacttaggcacgccctggatatcagggagcattacgagaggaaactggaaagagccaacaatctgtatatggagctgaacgctctgatgctgcaactagaactgaaagaacgggagctgttacggagagagcaggctcttgaaagaagatgtcccggacttttaaaacctcacccaagccggggtctccttcacggcaacaccatggaaaaattgatcaaaaaacggaatgtgccccagaaactgtctccacattctaagcgccctgacatcctcaaaacggaaagccttctgccaaaactcgatgcggcactttccggagtggggctgcccggatgccccaaggggccaccttcccccggtcgttcccggagggggaagacacgccaccgtaaagccagcgccaagggtagctgcggcgatctgccaggcctcaggacagccgtgccgccacatgagcccggtggaccgggtagccccggtggactcgggggtgggccatccgcttgggaagcctgtcctccagctcttagggggcttcaccacgatcttctgctgcgaaaaatgtccagcagtagtcctgacctgctaagcgccgctcttggatcccgtgggcgaggagccaccggaggtgccggagacccaggctcacctcctcctgccaggggcgatacacccccttcggaaggttcagcaccgggatcaactagtcccgatagtcccggaggggcaaaaggagagccaccaccacccgtgggccctggcgagggggtcgggctgctcggcaccggcagggagggcacttccgggaggggaggatcgagggctgggtcacagcacctgacaccggctgctctgctgtaccgtgccgcagtgaccaggagccagaagcgcggtatatcaagtgaagaggaagaaggagaggtggattccgaagtcgaactgacatcctcacagaggtggccacaatctcttaacatgcggcagtctctgtcaaccttctcctccgaaaacccatctgacggggaagaagggaccgcttccgagccctcaccatcgggtacccccgaagttggaagcaccaataccgacgagcggcctgacgaacggagcgacgatatgtgcagtcaggggtcagagatcccgctcgatcccccaccgagcgaggtcataccaggaccagagcctagctcactccccatcccacatcaagagctgctgagggaacgcggaccccctaactcggaagactcagactgcgattcgacggagcttgacaactccaactctgtcgatgccctacggcctcctgcatccctgcccccatag

SEQ ID NO: 230957 - DNA, 2901 bp, Artificial Sequence
  Description of Artificial Sequence: Synthetic coding sequence
atggcaaactttcaggaacatctctcctgcagttccagcccccacctgccatttagcgaatctaaaaccttcaacgggctgcaggatgagcttactgcaatggggaatcaccctagtccgaagctgctggaggatcagcaggaaaagggaatggttagaaccgaactgattgaaagcgtccattcaccagttaccacgactgtgttgacctctgtctctgaggattcccgagaccagtttgagaactcagtgctgcagctgcgagagcatgacgaaagcgagaccgccgtgtcccaagggaacagcaacaccgtggatggggagagtacatcaggaacggaagacatcaaaattcagttctcccgatctggcagcggctcgggaggatttctcgagggactgtttggttgtctccggccagtgtggaacatcattgggaaggcctattccacagattacaaactgcagcagcaggacacgtgggaagtgccatttgaagagatctcagaactgcagtggctcgggagcggagctcagggggcagtatttctagggaaattccgggctgaagaggttgccattaagaaagtcagggagcagaacgaaacagacattaagcacctcaggaagctcaagcacccaaatattatcgcattcaagggagtgtgcacacaagccccttgctattgtatcatcatggaatattgcgctcacgggcagctgtatgaagtgctgcgtgccggacgcaagatcaccccaaggttgctggtggactggtcgacaggaattgctagcggcatgaattatctccacttgcataagatcatccaccgggacctgaaatcacccaatgtactggtgacccacacagatgcagtgaagatttctgatttcgggaccagcaaagagctgtcggacaaatccacaaagatgtcatttgcgggaaccgtcgcgtggatggctccagaggtcatccggaacgaacctgtttccgagaaagtggacatctggtcgttcggcgtcgtgctgtgggagcttctcacaggcgagattccttacaaagacgtagatagttccgccatcatctggggagtgggaagcaacagtctgcatctgccagtgccctcaacatgccccgatggatttaagattctgatgaaacagacatggcagtctaagcctcgcaaccggccttcattcaggcagacactgatgcatttagatattgcctccgccgatgtgctggctacacctcaggaaacatattttaagtctcaggccgagtggagagaggaagtgaagaagcattttgagaagattaaaagtgagggaacatgcattcacaggctcgacgaggaattgataaggcggaggcgggaggagctgaggcacgctctcgacatcagggaacattatgaacggaagctggagagagccaataacctgtatatggaactgagtgctattatgctgcagctggaaatgcgggagaaggaactgatcaagcgcgaacaagccgtggaaaagaagtaccctggcacgtacaagcggcaccccgttcgcccaatcatccatcctaacgccatggaaaaactgatgaagcgaaaaggagtgccccataagtccggaatgcagaccaagagacctgatctgcttcgcagcgaaggcatccctactactgaagtcgcccctaccgccagtcccctgtcaggatccccgaagatgtcaaccagcagcagcaagtcacgctatagatctaagcctcgtcatcgacgagggaatagcagaggatcccatagtgatttcgccgctatccttaagaaccagccagcgcaggagaactctcctcatccaacctatttgcatcaggcacaaagtcaatacccttccctacaccaccataattccctgcagcagcagtaccagcagccacctcctgccatgagtcaatcacaccatccgcgactaaacatgcacggacaggacatcgctacatgtgccaataatctgcgatacttcggacccgcagcagccctgaggtctcccctcagcaaccatgctcagcgacagctccctggttcctccccggacttgatttccacagctatggcagcagattgctggcggtcttcagagcctgacaagggtcaagccggaccttggggctgttgtcaggccgacgcttacgacccctgcctgcaatgcagaccagaacaatacggctcattggatatacctagcgcagagccggtggggagaagtcccgatctcagtaagtctcccgctcataaccctctgctagaaaatgcccaaagcagcgaaaaaaccgaagagaacgagttttctgggtgtcggagcgaaagcagcctcggaaccagccaccttgggacacccccagcgttacctagaaagaccagacccctccagaagtcaggcgatgacagttccgaagaggaagaaggagaagtagactccgaagtcgagtttcctcggagacagagaccacatcggtgcatttcctcatgccagtcatactctactttttctagcgagaatttttcggtgtccgatggtgaggaaggaaacacctctgaccactcaaacagccccgacgagcttgccgacaagctggaagataggttggctgaaaagctagacgacctgctttctcaaactccagaaatccctatagatatctcttcacactcggatggcttaagtgataaagagtgcgccgtacgcagggtgaaaacgcagatgagcctagggaagctgtgcgttgaagagcggggatacgaaaaccccatgcagttcgaagaaagcgattgcgacagcagcgatggagagtgtagtgacgctactgttcgcacgaataagcattactcttccgcaacctggtag

SEQ ID NO: 230958 - DNA, 2901 bp, Artificial Sequence
  Description of Artificial Sequence: Synthetic coding sequence
atggccaacttccaagagcatctctcgtgcagcagcagtccacatttgcccttttccgagtccaagacattcaatggcctccaggatgagctgacagcgatgggcaatcatccatcgcccaagctgctcgaggatcagcaggagaagggcatggtaaggacagagttgattgagtcagtgcactccccggttactaccaccgtgttaacaagtgtgtccgaggattcgcgggatcagtttgagaatagtgtcctgcaactaagggagcatgatgagtctgagactgctgtctctcagggtaactctaacaccgttgacggagagagtaccagcggtacagaggacatcaaaatacagttttcaaggtctgggtccggctcaggcggtttcctggaagggttgttcggctgtctccggccagtgtggaatattatcggaaaggcctactcaacagattacaagctccagcagcaggacacttgggaggtgccatttgaagaaatttcagagttgcagtggttgggatctggggctcagggagccgtgtttctgggcaagttcagggcggaggaggtggctataaaaaaggtccgcgagcaaaatgagacggacataaaacatttgcgaaagttaaagcatccaaacattatcgccttcaaaggggtttgcacgcaggccccatgttattgtataatcatggagtactgcgcacatggacagctctacgaagttttgcgcgcaggcagaaaaatcacaccccgacttctcgttgattggtctacaggaatagctagcggcatgaattacctgcatcttcataagataatacacagggacctgaaatcaccaaacgtgttggtcacccatacagacgcagttaaaattagcgactttggaactagcaaggagctctcagacaagtcaaccaagatgagctttgctgggaccgtagcttggatggcacctgaggtcattcgcaacgagccggtgtctgaaaaggtcgacatctggtcattcggcgtcgtgttatgggagctgttaacgggggaaattccatacaaggatgtggattcctccgccataatctggggagtggggtcaaacagccttcacctacctgtacctagtacatgcccggacggctttaagattcttatgaagcagacctggcaatcaaagcccaggaatcgtccgagctttcggcagactctgatgcacctcgacatagcatcagctgacgtgctggccactcctcaggagacgtatttcaaatctcaggccgaatggcgggaagaagtcaagaagcactttgaaaaaattaagtccgaaggaacgtgtatacaccgcctggatgaggagctaattcgccgacggagagaggagcttagacacgccctagacatcagggagcactatgaacgaaagttggagcgggctaataacctctatatggagctgagcgcaattatgttgcagctcgagatgagagagaaggaactaatcaaaagggaacaagcagtggagaagaaataccccggtacctacaaaagacatcccgtaagacctattattcatcccaacgcaatggagaagttgatgaagcgtaagggcgtcccccataagagcgggatgcagacaaaacgcccagatctactgcgttctgagggtattcctactactgaggtggcaccgaccgcctctccactttctggctccccaaaaatgtccacttcttcatccaaaagtcgctatcgcagtaaaccgcgtcataggaggggcaacagtaggggctctcattcagactttgcagcaatcctgaaaaatcagcccgcacaggagaattccccgcatcctacttatctccatcaggcacagtcccagtacccctcattgcatcatcataacagtttacagcagcaatatcagcagccaccacccgctatgtctcagagccaccaccctagactgaatatgcatggacaggatattgcaacttgtgccaacaacctgagatattttggcccagcagccgctttgagaagccccctaagtaaccatgctcagaggcaactgcccggaagttcccctgacctgatcagcactgccatggctgccgactgctggcgtagctctgaacccgacaaaggacaagctggaccatgggggtgttgccaggctgacgcttatgatccgtgtctgcagtgtcgccctgagcagtacgggagtctggatattccctcagctgagcctgtgggcaggtctccggacctgtccaagagcccagcccacaatccactgcttgagaacgcccagtcttctgaaaaaaccgaggagaatgaattttccggatgccgaagcgaaagtagtcttggcacctcccacttgggcactccccctgccctgcctcgaaaaacaagaccactccaaaagagtggtgacgactcctcagaggaagaggaaggcgaagtggacagcgaggtcgagtttcccagaaggcagcggccacatcgttgtatatcttcttgtcagtcctatagtacattttctagtgagaattttagcgtgtcggacggcgaggaagggaacacaagcgaccactcaaacagtcccgacgagcttgccgacaagttggaagaccgcctggctgaaaagctcgacgatcttctgagccagacacccgagatcccaatcgacatttcttcccattctgacggcctatccgataaggaatgtgctgtccgccgagtcaagactcagatgagcctagggaagctatgcgtggaagaaaggggatacgaaaacccaatgcagtttgaagaatcagactgtgatagttcggatggcgagtgctctgatgctacagtgcggacaaataagcactatagctcagcaacctggtag

SEQ ID NO: 230959 - DNA, 414 bp, Artificial Sequence
  Description of Artificial Sequence: Synthetic coding sequence
atggcgaacttccaggaacacctgagttgtagcagttctccacatcttcccttctccgaaagcaagacattcaacggtctgcaagacgagctgactgccatgggtaaccacccatcccctaagttactggaggatcagcaggagaaggggatggtacgtacagagcttatcgaatcagtccacagccctgtgactacaacagtcctgacttctgtgtccgaagactcaagagatcagttcgagaattcagtgctacaactgcgggagcatgacgaatcagagactgctgtctctcaaggaaactccaataccgtagatggggaatcgaccagcggaaccgaagacataaagatccagttctcccgcagtggctctggaagcggcggtttcctggagggactgttcgggtgttag

SEQ ID NO: 230960 - DNA, 342 bp, Artificial Sequence
  Description of Artificial Sequence: Synthetic coding sequence
atggctaactttcaagaacatttatcgtgctcctcatccccacacctgcccttctcggagtcgaagacctttaatggactgcaggatgaactaaccgccatggggaaccacccttcacctaaactccttgaagaccaacaagagaagggcatggtgcgaacggagctcatcgaatctgttcacagcccggtgactaccacagtccttacatcggtatctgaggactcccgcgatcagttcgaaaacagtgtcctccagctcagagaacacgacgaaagcgagacggccgtttcacagggcaattcgaacacagtggatggagaatccacatcaggcacctag

SEQ ID NO: 230961 - DNA, 2469 bp, Artificial Sequence
  Description of Artificial Sequence: Synthetic coding sequence
atgagttatgtggaatgtaagtgcctgcagcttgagaacaagaacacctgggaagtgccctttgaggaaatctctgagctgcaatggttgggatctggcgctcaaggagcagtatttctagggaaatttagagctgaggaagtggctatcaaaaaggtgcgtgaacagaacgagactgatattaaacacctgagaaaactcaaacacccgaacatcatagccttcaagggcgtttgtacacaggcaccctgctactgtatcatcatggagtattgcgcccatggccagctgtatgaagtccttagagctggccgaaagattaccccccgacttcttgttgactggtccacagggatagcctctggtatgaattacctacacctacataaaatcatccatcgcgatctaaagagccctaatgtgcttgtgactcataccgacgccgtcaaaatttccgattttgggacatcaaaagaactttcagacaaatccacaaaaatgtctttcgcaggaactgtagcatggatggccccagaggtgatccggaacgagccagtcagcgagaaggttgatatctggtcttttggagtggttctgtgggagttgctgacgggagagattccatacaaagatgttgatagcagtgctatcatttggggcgttggatccaacagtctgcaccttccagtgccttcgacatgcccagacggattcaagattctcatgaagcagacgtggcagtccaagccaaggaaccggcctagttttcggcagaccctgatgcatctcgacatcgcttctgctgacgtgctcgccacgcctcaggaaacttacttcaaatctcaagcggagtggcgggaagaggtgaaaaaacatttcgagaaaatcaagagtgagggcacatgcatacaccggctggacgaggagttgataaggaggaggagggaggaattacgccatgcactggacattagagagcactacgagcgaaagctggagcgcgctaataacctctacatggaactgtctgccatcatgctccaactggagatgcgggagaaggaactgattaaacgagagcaggctgtggaaaagaagtatcccggaacttataagcggcacccggtgaggcccattatccatcctaacgctatggaaaagcttatgaaacggaaaggcgtaccacataagtccggcatgcaaacgaagaggcctgatctgcttagatcagaggggatccccacaaccgaggtagcacccactgcaagcccactgagcgggagccctaaaatgtctacgagcagcagtaaaagccgatacagaagcaaaccccgtcataggcgagggaattctcggggaagccactctgattttgcagcaattttgaagaaccagccagcgcaggagaacagtcctcatcccacatatttacaccaggctcagagccagtacccatctttacatcaccataatagcctccaacaacagtatcaacagccaccacctgcgatgtcacagagccaccatcctaggctgaacatgcacggccaggatatcgctacctgtgccaacaacctgcgatactttggcccagcggctgctctccgaagcccgctaagcaaccacgcccaacgccaactcccaggcagctcccccgaccttatcagcaccgccatggccgctgattgttggcggtcctctgagccagataagggccaggccggtccttggggatgttgccaagctgacgcgtacgatccttgcctccagtgccgccctgagcagtacggctctctggacatcccatctgccgaaccagtcggcaggtcaccggatttgtcaaagtcgcccgcacataaccccctcctggagaatgctcagagcagcgagaaaaccgaggagaatgaattttcggggtgccgaagcgagagctctctcggtacatctcaccttggaacccctcctgccttacctcgcaaaacacgaccacttcagaaatccggggacgactcatccgaagaagaagaaggcgaggttgatagtgaggtagagttccctcgtcgacagaggccccatcgctgcatctcgagctgccagtcttattccacatttagcagcgaaaatttctcagtctctgatggcgaagaggggaacacaagcgatcactcaaacagtccagatgagctggcggataaacttgaggatcgcctcgcagagaagctagatgacttactctctcagaccccagagattcctatcgacatctctagccattctgacggtttgagcgataaggagtgcgcagtaaggagagtcaaaacacagatgtccttgggcaagctgtgcgtggaggaacggggatatgaaaatcccatgcaattcgaggagtctgattgcgactcctccgacggagaatgctccgatgcgactgtcaggacaaacaagcattattcttccgctacttggtag

SEQ ID NO: 230962 - DNA, 2280 bp, Artificial Sequence
  Description of Artificial Sequence: Synthetic coding sequence
atgtattgtggaatccagatcctggccctctgggagcggggagtctgcacccaggccccatgttattgcattatcatggagtactgcgctcacggtcagttatacgaagtgctccgagccggaaggaaaatcacccctcgcctgctggtagactggtctaccgggatcgccagcggaatgaactacttacatctgcataagatcatccacagggacttaaaaagtccaaatgtcctcgtgacacataccgatgccgtaaagatctctgacttcgggacttcaaaagagttgagtgataagagcaccaaaatgtccttcgccggtacagttgcctggatggcacctgaggtcatcagaaatgagcccgtgtctgagaaggtcgatatctggagctttggcgtggtgctgtgggaactactgaccggcgaaattccatacaaggacgtggactcctccgcgataatctggggggtaggatccaactcacttcacctccctgtgccctctacttgtcctgacgggttcaagatattaatgaagcagacctggcagtccaaacccaggaatcgccctagcttccggcagacattaatgcacctggacatagcctctgccgacgtgttggctacaccgcaggagacttactttaagtcccaggctgagtggagggaagaagtaaaaaaacactttgagaagattaaatcagagggcacatgtattcaccggctggacgaagagctcattcgtaggagacgcgaggagttgcgccatgctcttgacatacgcgaacattacgagagaaaactggagagggcaaataacctatatatggagttgtccgccattatgcttcaacttgagatgagggagaaagagttaattaagcgggagcaggccgtggaaaagaagtatcctggcacctacaagcggcatcctgtgagacctatcatccacccaaatgcaatggaaaagctgatgaagcgcaaaggtgtgccccacaaaagtggcatgcaaacgaagaggcccgatttgcttcgttccgaagggatccctaccacagaggtcgcccctaccgcatcccccctgagtggatcccccaaaatgagtacttcctcttctaagtcgcgctaccgctcaaaaccacggcatcggagaggaaattcgcgagggtcccattctgacttcgcagcaatcttaaagaaccaacctgcccaagaaaacagcccacacccaacgtatctgcatcaagcccagtctcagtatccttctctccaccaccacaacagtctccagcagcagtaccagcagcctccccctgcaatgagccagtcgcaccaccctaggcttaatatgcacggccaggacatcgctacttgcgccaataacctccgctacttcggcccagccgctgctttgagatcgcctttgtctaatcacgcacagagacagttacctggtagcagccccgacttgatcagtacagccatggccgctgactgttggcgttcttcagaaccagataaaggtcaagctggaccctggggctgttgccaggccgacgcctacgacccctgcctccaatgcagaccagaacaatatggaagtctggacatacccagtgccgaacccgtcggacgttcacccgacctgagtaaaagcccggcacacaatccactgttggagaacgcccagagtagcgagaaaaccgaagagaatgagttctcggggtgtaggagcgagagtagcctgggtacaagtcacctcgggactcctcctgcactgccgagaaaaacaaggcctctgcaaaaaagtggagacgacagctccgaggaagaggagggtgaggtggactccgaagtggaattcccgagaagacagagaccccatcggtgtataagcagttgtcagagctactctacctttagctccgagaacttttctgtgagcgacggcgaagaaggaaacacctccgaccactccaatagtcctgatgaactggcagataagctagaagacagattagcagaaaagctggacgacctcctgagtcaaacacccgaaattccgatcgatatcagttctcacagtgatggactgagtgacaaggaatgtgccgtgcggcgtgtcaagactcaaatgtctctcggcaagctctgtgttgaggagcgcggatacgagaatcctatgcagtttgaagagtccgactgcgacagttcggatggtgaatgcagcgacgctacggttcggaccaacaaacactatagcagcgccacatggtag

SEQ ID NO: 230963 - DNA, 2841 bp, Artificial Sequence
  Description of Artificial Sequence: Synthetic coding sequence
atggcggtgatggaaatggcttgcccaggcgctccaggctctgccgtgggacagcagaaagagctgccaaaagccaaagagaaaactccacctcttggaaagaagcagtcttccgtctacaagctggaggctgtagaaaaaagccctgtgttctgcgggaagtgggagatcctcaacgacgtaattacaaaagggaccgccaaagaggggtctgaagccggacccgctgctatttccattatcgcacaggcagaatgtgagaactcacaagaattttccccaaccttcagtgaaaggatttttattgcaggttccaaacagtattcacagtccgaaagtctggaccagattcccaataatgtcgctcacgccaccgaggggaagatggctcgcgtgtgttggaagggcaaacgtagaagcaaggcccgtaagaagcggaagaaaaaatcctctaagagcctcgcacacgccggtgtggctcttgccaagccactccccagaacccctgagcaggaaagttgcacaatcccagtacaggaagatgagtccccactgggggcaccttacgtgaggaacacccctcagttcacaaagccccttaaggagccgggactcgggcagttatgcttcaagcagctgggggagggcttacgggctctgcctaggagcgagctgcacaaactgatctctcccctgcagtgtctgaaccacgtgtggaagctacatcatccacaagacggagggccactaccattgcccactcatccgttcccttatagtagactgcctcacccctttcccttccacccgttacagccttggaagccacatcccctagagtcttttttgggaaagttggcgtgcgttgattctcagaaacccctgcccgacccgcatctgagtaaattggcttgcgtcgatagtcccaagccacttccgggtccccatctggaaccgtcctgcctgtcccgaggcgctcatgaaaagttctccgtggaagagtacctggtgcacgccctccagggatctgtttcctccggccaggcccacagtcttaccagtcttgctaaaacctgggccgctcgcggaagccgctctagagaaccgagcccaaaaacagaggataatgaaggggtgctccttacggaaaagctgaagccagttgactacgagtatagggaggaagtccattgggccactcatcagcttcgcctcgggagaggtagtttcggtgaagtccaccgtatggaggataaacagactggtttccagtgcgcagtgaagaaggtccggttagaggtcttccgcgcagaagagctcatggcctgtgcgggacttacaagtccaagaatcgttccgctgtacggcgcagtgcgggaaggaccatgggttaatatttttatggagttgctggagggcggatctttgggacagttggttaaagagcagggctgcctgccagaggaccgagcactttactatctcggacaagccctggaaggcctggaatacctccattcccgcagaatcctgcatggagacgtgaaggccgacaacgtgctgctgagctccgacggcagccacgccgctttatgcgatttcgggcacgccgtgtgcctgcagcctgatggcttggggaaatccctgttgacaggcgattatattcccggaaccgagacacacatggcgcctgaggtcgttctcggcagaagttgtgatgccaaagttgacgtgtggtctagctgctgtatgatgctgcatatgcttaatggctgccatccgtggacacagtttttccggggacccctttgtttgaagatagcttcggagccacccccagtgcgcgagattcctcccagttgcgctccactgactgcccaagccatccaggagggactgcggaaggaacctattcatcgcgtgtccgccgctgaactcggtggaaaagtcaacagggctctgcagcaggtcgggggtctgaagagtccctggagaggggagtacaaggagcccaggcatccacctcccaatcaggccaactatcaccagacattacacgcccagccccgagagcttagcccgcgagctccaggtccgcgtcccgctgaagagacaactgggagagccccaaagctgcaacctccactgcctccagagcctccagagcctaataagtctccccctttaactttgagcaaggaagagtccgggatgtgggagccgctccctctgagtagccttgagccagcacctgcgagaaacccatcatcgccagagagaaaagcaacagtacctgaacaggagctgcagcagctcgaaatcgagttgttcctgaatagcttgtctcaaccattttcgctggaggagcaggagcagatcctgtcctgcctgagtattgactccctctcactgagcgacgatagtgagaaaaacccaagtaaggcgtcccagtcaagccgtgatacactgagcagtggcgttcattcttggagttcacaggctgaggccaggtcctctagctggaacatggtcttggcgaggggcaggcccacagataccccgtcttactttaacggcgtgaaggtccagatccaatcattgaacggggagcacctgcacatccgggaatttcatcgagtgaaggttggcgacatagccaccgggatatcatcgcaaatacccgctgctgcattttcactcgtcaccaaagatggccagcccgtgaggtacgatatggaggtgccggactccggcatcgatctgcaatgcaccctcgcccctgacggttcctttgcctggtcttggagagtcaaacacggacaattggagaatcggccttag

SEQ ID NO: 230964 - DNA, 1302 bp, Artificial Sequence
  Description of Artificial Sequence: Synthetic coding sequence
tgctttaaacagctgggtgaaggcttgagggctctaccccgtagcgaacttcacaaattgatttcacccctgcagtgtctcaaccacgtatggaagttacaccaccctcaggacggtgggcctcttcccctcccgacccaccacccctttccgtttcacccgctgcaaccctggaaaccccaccccctggagtcctttcttggcaagctcgcttgtgtagatagccagaagcctcttcccgatccgcacctctctaaattagcttgcgtggactccccaaagcccctgccagggcctcaccttgagccctcctgtctcagccgcggtgcccacgagaagttctctgtggaagagtatctggtccatgcgttgcaaggcagtgtttcaagcggtcaggctcacagtctgacatcgctcgccaagacctgggctgctcgagggtctcgctctcgtgagccaagccccaaaacagaggacaatgagggagttttgctgacagagaagctcaagcctgtggattacgaatatcgtgaggaagtgcattgggccacccaccagttgaggctgggtcggggatctttcggcgaagtgcaccgcatggaggataaacagacgggcttccagtgcgctgtcaaaaaagtgcgccttgaggtatttcgggcagaggagctaatggcctgtgcagggcttacatcacctagaatcgttccactgtacggtgctgtaagggagggtccttgggttaacatctttatggaactgttggaaggtgggagtctggggcagctggtgaaggaacagggatgcttgcccgaagatcgcgcactctattatctgggtcaggctctcgaagggctggaatacctgcattcacgcagaattcttcacggggacgtaaaggcggacaacgtacttctgagcagcgatgggtcacatgccgctctctgcgatttcggacacgcagtttgtctgcagcccgatggactaggtaagtccttgttgaccggggattacatcccaggaacggagacccacatggcccctgaggtcgtgttaggccgtagttgcgacgctaaagttgatgtatggagttcatgttgcatgatgctgcatatgctgaatggatgtcacccgtggacccagttttttagaggccctctctgccttaaagtgggggatggcacgcagcacggccagcagggcgagcttcaggggccaggcgctcaggcggcaggatggcggggttgtagcgccgtggctgacggggctcggggtgggctagttatacacgtgggctcttag

SEQ ID NO: 230965 - DNA, 3942 bp, Artificial Sequence
  Description of Artificial Sequence: Synthetic coding sequence
atggaaagcggagggggtaatgccccagctggggctctgggggctgcttccgagtcgccccaatgccccccacctcctggagtagagggggctgccggtcctgctgaaccagatggcgctgccgaaggcgctgccggtggaagtggggagggcgagtcaggcggaggtcccagacgcgcactccgcgctgtatacgtccgctctgagagttcccagggtggggctgccggtggcccagaagccggtgctagacagtgtttattgagggcatgcgaagcagagggcgcacaccttacatccgttccatttggggaactggactttggggaaaccgcggtcctggacgctttctatgatgctgatgttgccgtagtggacatgagcgacgtgtcccgtcagcccagcctcttttaccatctcggagtgcgggaatctttcgacatggccaacaacgtcatcctatatcacgacacggatgctgacacagctctgtcccttaaggatatggtgacgcagaaaaatactgcctcatccggtaattactacttcattccctacatcgtaactccatgcgcagattacttctgttgcgaatccgatgcccaacggagggcctccgagtacatgcagcccaattgggataacattcttgggccactgtgcatgcccctggtggatagattcatcagcctcttgaaagacattcacgtcacgtcttgtgtttactataaagagaccctgctcaacgacatacgaaaggctagagagaaataccaaggtgaagaactggccaaagaactcgctagaattaagttgagaatggataatactgaagtcctgacttcagacatcatcatcaacctgctactttcctaccgcgacattcaggattacgacgccatggtcaagctggttgaaacacttgagatgttgccaacctgtgacctcgccgatcaacacaatattaagttccattatgcattcgcactgaaccgccgtaatagtaccggcgaccgagaaaaagcgctacaaatcatgcttcaggtattgcagtcttgcgatcatccaggacccgacatgttttgtctctgtggacggatctataaggacatttttttggattctgactgcaaggatgatacatcccgcgattccgcaatcgaatggtataggaaaggtttcgaactgcagtcctcgctgtattcaggaattaatctcgcagttctgcttatcgtagccggacagcagtttgagactagtttggaactcagaaagattggagtccggttaaattcactgctaggacggaaagggtctctcgagaagatgaacaactattgggatgttggacagttcttctctgtgtctatgctcgcccacgacgtcgggaaagcagttcaagctgccgagagactctttaagcttaaacctccagtgtggtatttgcgttcactggtgcaaaatctgttgctaattagaagatttaagaaaacgatcatagaacactcaccgcgacaggagcgattgaatttttggctcgacattatctttgaggctacaaacgaagtgacaaatgggcttagatttccagtgttggtgatcgagccaacaaaagtgtatcaaccaagttatgtgagcattaacaacgaggccgaagagcgtaccgtctccctttggcatgtgtccccaaccgagatgaaacaaatgcacgaatggaactttaccgccagtagcatcaagggcatttctctctctaaattcgatgaacgctgctgcttcctgtacgtccatgacaatagcgacgatttccagatctactttagtacagaagagcagtgctccagattttttagcttggtaaaagagatgattactaatactgccggttcgaccgtggaactcgaaggggaaactgacggcgatacgctcgaatatgaatatgaccacgacgctaatggagagcgggtcgtgttaggcaaaggaacatacggcattgtgtatgccggaagagatctgtcaaaccaggtgagaatagctattaaagagatacctgagagagacagcagatacagtcagccgcttcatgaggaaattgcactccataagtatctgaagcatagaaacatcgtccagtatctggggtctgtatctgagaacgggtacatcaagatcttcatggagcaggtccccggagggagcctgtcggccctcttaagatcaaaatgggggccaatgaaagagccaaccataaagttctacacaaaacaaatcctggaaggcctgaagtacctccacgagaaccagatcgtacacagggatataaagggggacaacgtcctcgtcaacacctacagtggggtggttaagatcagtgacttcgggacttccaaaaggttggcaggcgttaatccctgtaccgaaacattcaccggtacattacagtatatggcacctgagattattgaccagggacccagaggatacggcgcaccggcagatatttggtctttgggctgtaccatcatcgagatggccacttcgaagcccccatttcacgagttaggcgagccacaggcagccatgtttaaggttggtatgtttaagatacatcctgaaataccagaggccctctccgccgaagcgcgagcattcatcctctcctgtttcgaaccagaccctcataagcgcgctacgacggctgagctgctcagagaggggttccttcggcaagtgaacaaaggaaaaaaaaacaggatagcttttaagccctccgaaggccctcggggagtggtattggcattgcctacgcaaggcgagccaatggctacgtcaagcagcgaacacgggagtgtttccccagatagtgacgcccagcccgatgcactatttgagcgcaccagagccccacgacatcacctcggacacttgttgtccgtccccgacgaatcatccgccctcgaggacagagggctggcgtcatcacctgaagacagagaccaaggtctctttttgctgcggaaggattcagagcggcgagcgatcctgtacaaaattctctgggaagaacaaaaccaggtcgcatctaatctacaggagtgcgtggcgcagagcagtgaggaactacatcttagtgtgggccatataaagcaaatcataggaattctgcgggacttcatacgctctcccgaacacagggtgatggccactaccatcagtaaactgaaggtagacctagatttcgattcttcctcaattagtcagatccacctggtcctctttgggtttcaagacgccgtcaataaaatactgcgcaatcacctgatcaggccacattggatgttcgcgatggataatatcatcagacgggcagtgcaggctgctgtcacgattctgataccggaactccgcgctcacttcgaacccacatgtgagacggagggagtcgataaagatatggacgaagctgaggaagggtacccgccagcaactgggcctggtcaggaagctcagcctcaccagcagcacctttctctccaacttggagagttgagacaggagacaaatcgactgctcgagcacctggtcgagaaagagagggaatatcagaatctgctgcgtcagactctagaacagaagacacaggaactctaccatttgcagctcaagctgaagtctaactgcattacggaaaatcctgctggaccatacggtcagcggactgacaaggagttaatcgactggttgcggttacagggcgcagatgcaaagaccatcgagaagatcgttgaggaggggtacaccctatctgatatcctcaatgaaattaccaaggaggatctccgatatcttcgcctgcggggaggactgctctgtcggctgtggtctgctgtgtcgcagtaccggcgagcccaggaggccagtgagactaaggacaaggcctag

SEQ ID NO: 230966 - DNA, 4677 bp, Artificial Sequence
  Description of Artificial Sequence: Synthetic coding sequence
atgagagaagcagcggctgctctcgtcccccctcctgctttcgctgtaacccctgccgcagcaatggaggagcctcctcctccaccccctccccctcctccgcctccggaacctgaaactgaatcagaacccgaatgctgtctcgcagcgagacaggagggcacacttggtgactcagcgtgtaagtcccctgagtcagacctggaagatttcagtgatgaaaccaataccgaaaacctctatggcacgtcccctccttcaacaccacgccagatgaagaggatgtcaacaaagcaccagcgtaataatgtgggccgtccggcatccaggtccaatcttaaagagaaaatgaatgcacccaaccagccgccacataaggacactgggaaaactgtcgagaatgtggaagaatacagctacaagcaggaaaagaaaatccgcgcagcgctgagaactaccgagagggataggaagaaaaacgtgcagtgcagctttatgctcgatagtgtgggcggtagccttccaaaaaaatctattccggacgtcgacctgaacaaaccctacttgagcctgggatgcagcaatgcaaagttgcccgtgtccgtacctatgcccatcgcccgacccgctcgacaaacctccaggacagactgtcccgcagacaggctgaagtttttcgaaacacttcggctacttctgaagttaacctctgtgtcgaaaaagaaagatcgtgaacagagggggcaggaaaacacatccgggttctggttgaataggagtaacgagctgatttggttagaactgcaggcttggcacgccggaaggacaatcaatgatcaagattttttcttatatacagccagacaggcaatccccgacattataaatgaaattcttacattcaaagtcgattacggtagtttcgcttttgtgagggatcgggcaggctttaatggtacatcggtcgaaggtcagtgcaaggcaacccccggtaccaagattgtcggctactcgacacatcacgaacatctccagagacagcgtgtgtcctttgagcaggtgaaaaggatcatggaactgctggagtatattgaggccctgtatccgagtttacaggccctgcagaaggattacgagaaatacgctgcaaaagacttccaggaccgggttcaggccctttgtttatggttaaatatcactaaagacctgaaccaaaaattgcgtattatgggtacagtccttgggatcaagaacttgtccgatatcggatggcctgtgttcgagattccctcccctaggcccagcaagggaaatgaacccgagtacgagggagacgacaccgagggagaactcaaggagctggagtcttctactgacgagtccgaagaagagcagatctcagaccctcgggtgccagagataagacagcccattgacaactctttcgacattcaatccagggattgtatctccaagaagcttgaacgcctggaatccgaagacgactctcttggttggggcgctcctgattggagtacggaggccggtttctccagacactgcctgacctctatttatagacctttcgtagacaaagccctgaaacagatggggctgcggaagctgattctcagactgcataaactcatggacggatccctgcagcgggctagaatagccctcgtgaaaaatgatcgtcccgtagagttctcagaatttcctgaccctatgtggggcagcgattatgtgcaactcagccgcacccctccttctagcgaagagaaatgttcagccgtgtcctgggaggaactcaaagcaatggacttgccaagctttgagcctgcgttcctcgtgctatgtagagttctgctaaacgtgatccacgaatgtctgaaattgcggctggagcagaggcccgctggtgagcccagcctcctgagcatcaaacagcttgtccgcgaatgcaaagaggtgcttaaaggcggactgcttatgaagcagtattatcaattcatgctccaagaagtgctggaagatctggagaagcctgactgcaatatagatgcctttgaggaggatttgcataaaatgcttatggtatacttcgactacatgaggtcgtggattcagatgttgcagcagctgccgcaggccagtcacagcctgaagaatctgctggaggaggagtggaattttactaaggaaatcacgcattatatccggggaggcgaggctcaggccggtaaactattttgcgatatagctggcatgttgctgaaatcaaccggatccttcctggaattcgggctgcaggaatcttgcgccgaattttggactagtgccgatgacagctcagctagtgatgaaatcagaaggagtgtgattgagatttccagggcactcaaggaactgttccatgaggccagagagcgtgcatccaaggccttgggttttgccaagatgctgagaaaagaccttgagatagcagccgagtttcggctgagcgctcctgtgagggacttattagacgtgctgaaaagcaagcaatacgttaaagttcagattcctgggctggagaacctgcagatgttcgtgcctgacacactggctgaggaaaaatcgattatactgcagctcttgaacgctgctgccggaaaggattgttctaaagattcggatgatgttttgatcgatgcatatctcctcctgaccaagcatggcgaccgggctagggactcagaggactcatggggaacctgggaagcccagcctgtgaaggtggtgccgcaagtggagacagtggacaccctcaggtccatgcaggtggataatctacttttggttgtaatgcagtctgcacaccttacgatacaaagaaaagcctttcagcagagcattgaggggctgatgacactgtgtcaggagcagacatcatcccagcccgtcatcgctaaggccctgcaacagctgaagaatgacgcactcgaactttgtaatagaatctccaatgctatcgatcgtgtcgaccacatgttcacctccgagtttgatgctgaagttgacgagtcagagtccgtaacgcttcaacaatactacagagaagccatgatacaaggctataactttggattcgaatatcataaagaggtcgtcaggctcatgagtggcgagttcaggcaaaaaattggagacaaatatatcagctttgccagaaagtggatgaattacgtcttaacaaagtgtgagtcaggcagaggcacccgaccaagatgggcaacccaggggttcgacttcctgcaggctatcgaaccagcctttatctccgctctacctgaggatgacttcctctcccttcaggctctcatgaatgagtgtattggccatgtgatcggcaagcctcattcccctgtcactggcctttacctggccatccatcggaacagtcccagacccatgaaagtacctcgctgtcatagtgacccacccaacccccatctcatcattcctactccagaaggttttagggggtcctcagtcccagaaaacgacagactcgcctcgatcgctgctgaactgcaatttagaagcctgtccaggcattcctcgcctacagaagaacgcgacgaacctgcctacccgagaggtgatagctccggatcaaccaggagaagctgggagctgagaaccttgatcagtcagtctaaagacaccgccagtaaacttggtcctattgaggccattcaaaaatctgtgcggctttttgaagaaaaaagatatagggagatgcgtcggaagaacataattggccaggtttgcgataccccaaagtcctatgacaatgttatgcatgtcggtctgcgaaaagtgactttcaaatggcagcgagggaacaaaattggtgaaggacaatatggaaaggtgtacacttgtattagcgtggacaccggcgaactgatggctatgaaagaaatcagatttcaaccaaatgaccacaagaccattaaagagactgccgacgaattgaaaatcttcgagggaatcaaacatcctaatttggtccgctacttcggagtggaactgcaccgtgaagagatgtacatctttatggagtattgtgatgagggaactctcgaagaagtttcgaggcttggactgcaggaacacgtcatccgactttattctaaacagatcaccattgctataaatgttctccatgaacacggaattgttcacagggacatcaagggagcgaatatctttttgacatcgagtgggctgataaagctaggggacttcggttgcagcgtcaaacttaagaacaacgcccagaccatgcctggtgaggtcaattcaacacttgggacagctgcctatatggccccagaggttatcacccgcgctaaaggagaagggcatggcagggcagctgacatttggagccttggctgcgtggtgattgagatggtgactggcaagagaccgtggcatgagtatgaacacaacttccagattatgtataaggtaggcatgggacataaacctcccattccagagcggctgagccccgaaggcaaagactttctgtcacattgcctagaaagtgaccctaaaatgaggtggacagcctcccagcttcttgaccacagtttcgtgaaagtttgtaccgacgaagagtag

SEQ ID NO: 230967 - DNA, 4827 bp, Artificial Sequence
  Description of Artificial Sequence: Synthetic coding sequence
atgagggaagccgctgccgctctggttccaccacccgctttcgcagtaacccccgcagctgccatggaggagccacctccaccccctccccctccccctccccctccggagccagaaacggaatctgaaccagagtgttgcttggccgcaagacaggaaggcactttgggtgactcagcttgcaaaagcccagaaagcgaccttgaggacttctctgacgagactaacaccgagaacctttacgggactagcccacccagcactcctcggcaaatgaaacggatgagcaccaaacaccagcgcaataacgtgggacggccagcctccagatctaatttaaaggaaaagatgaatgctccaaaccagcccccacacaaagatactggaaaaaccgtggagaatgtggaagaatattcatacaaacaggaaaagaaaatacgtgctgctctgcgcaccacagaacgcgataggaaaaagaatgtgcagtgtagttttatgcttgattccgtgggaggcagcttacccaagaagagcatccctgatgtcgatctcaacaaaccctacctatccctgggttgcagtaacgccaagctcccggtgtctgtacctatgcccattgctcgccctgcaaggcaaacttcccgtacggactgccccgctgatcggcttaaattttttgagaccttgcggctcctgctcaagttgacctccgtgtccaaaaaaaaagaccgggagcagagaggtcaggaaaatacctcgggattttggctcaatcgctccaatgagctgatttggctcgagctccaggcctggcacgctggccgaaccatcaatgaccaggactttttcctgtataccgccaggcaggctatccctgacatcattaacgaaatattaacattcaaggtggattatgggtcctttgcatttgttagagaccgcgcaggcttcaacggaacctccgtggagggacaatgcaaagccaccccgggtaccaaaatcgtagggtattctacccaccatgaacatctgcagcggcaaagggtctcctttgagcaggtgaagaggattatggagctgctggaatacatcgaggcgctctacccttctctccaggccctccagaaggactacgagaaatatgcggcaaaagatttccaagacagagtgcaggcgctgtgcctgtggttgaatatcacgaaggacctgaatcagaagctgcggattatgggaactgtccttgggattaagaatctctccgatattggctggcctgtgttcgaaataccctctcccaggccctcaaaggggaacgaaccagagtacgaaggagatgacaccgagggagagctcaaagaactggagtctagtacggacgagtctgaggaagagcagatctcagatccgagggtgcccgaaattagacagccaatagataactcattcgacattcagtcgcgcgactgcatcagtaagaagcttgaacggctggaatcagaggatgacagtcttggctggggggcacccgattggtccactgaagccggttttagtcggcactgcctgactagcatttaccgtccttttgttgacaaagccctgaagcagatgggccttaggaagctgattctgcgtctgcacaaactcatggacggaagtcttcagcgagcaagaatcgcactggtgaaaaacgaccgtccggttgaattcagtgagtttcccgatccgatgtggggctcagactacgttcagctctcccgaaccccacccagcagcgaggagaagtgcagcgccgtgtcttgggaggagctgaaggccatggatcttccaagtttcgagccagcctttctggtactgtgcagggtgctcctgaacgtcatccatgaatgtctaaagttgcggctcgaacagaggcctgctggggagccttcactgctgtcaataaagcagcttgtcagagaatgtaaggaggtccttaagggcggactgttgatgaagcagtactaccagtttatgctccaggaagtgctcgaggacctggagaagcctgattgcaatattgatgcttttgaggaagacttgcacaagatgttgatggtctatttcgactacatgcgatcctggatccagatgttgcagcaattgccgcaagctagccattcccttaagaatttgcttgaggaggaatggaactttactaaggaaattacacattacatccgcggtggagaggcacaggcagggaaacttttctgtgacatcgcgggaatgctgctgaagtccactggctcatttctcgaattcggacttcaggagagctgcgctgaattctggacatcggcggacgactcctctgcaagtgacgagatccgcaggtccgtgatcgagatttcacgtgccctcaaggaactgtttcacgaggcgagggagcgcgctagcaaagccctgggattcgctaaaatgctgcggaaagatctggagattgctgccgagttccgcctgtctgccccagtaagggacctgttagatgtactgaagagtaaacagtatgttaaagtgcagatcccgggtctggaaaatttgcagatgtttgtccccgacactctagccgaagagaagtcaatcattcttcaacttttgaacgcagccgcaggcaaggactgcagcaaagactctgatgatgtcttgattgatgcctatctgcttctgacaaagcatggcgaccgggctcgcgattctgaggattcttggggcacctgggaggcccagcccgtcaaagttgtacctcaggtggagaccgttgatacgctacggtcaatgcaggtagacaacctgttgttggtggtgatgcagagtgctcacctaacgattcagcgcaaggcctttcagcagtcaatagaaggtctgatgacgctgtgtcaggaacagacctcctcacagccggtgatcgcgaaggcgctgcagcaacttaaaaatgacgcgttagaactgtgcaatcgtatctccaacgccatcgaccgagtcgaccacatgtttacctctgaatttgatgctgaagtcgacgaaagtgaaagtgtgactctacagcagtactatcgggaagcaatgatccaaggctacaactttggattcgagtaccacaaagaagtggtgcgactgatgtctggtgaatttcgacagaagatcggcgacaaatacatatcttttgctcgcaagtggatgaactacgtgctgaccaagtgcgaatcgggacgcggaacgagaccgagatgggccactcaggggttcgactttctgcaggcaattgagccggcattcattagtgccctacccgaagatgattttttgagcctgcaggccctcatgaacgagtgcattggacacgtcattgggaaacctcatagccctgtcaccgggctctacctcgctatccatagaaactcccctaggcccatgaaagttccaagatgccattcagatccacccaatcctcacctgatcatccctacacccgagggattcagcacacgcagcatgccatccgatgcaagatcacatggttcaccagccgcagcagcggctgccgctgcggctgctgttgccgcttctagaccgtccccatccggcggagattccgtgttaccaaaaagcatcagctccgcacacgatacacgcggatcatctgtcccagaaaacgacaggctcgcttctattgctgcagaattacagttccgaagcttgtccagacacagtagtccaacggaagaacgggatgaaccagcgtaccccaggggcgattcttctggttctacccgcaggtcctgggaactgaggactctaatatcccagagcaaggacactgcaagcaaactgggaccgatcgaagccattcagaaatcggtaagactgtttgaagagaaacgatatcgggagatgcggagaaagaatatcatcggtcaggtctgtgacacacctaaaagttacgataatgtgatgcacgtggggctgcgcaaggtgacctttaagtggcaaagaggaaataagatcggcgagggccaatacggaaaggtctacacctgcatctccgtggacactggtgagctgatggcaatgaaagagatccgttttcagcctaatgatcacaaaaccataaaggagacagcagacgagcttaaaattttcgaggggatcaagcacccaaatttagtcagatacttcggggtggaactgcaccgagaagagatgtacatcttcatggagtactgcgatgaaggcaccctcgaagaagtctccaggctgggactgcaggaacatgtcatccgcctctactcaaagcagatcaccatagctattaatgtacttcacgaacatgggattgtccaccgagacattaagggcgcaaacatttttctcaccagtagcggcctcatcaaactcggggacttcggctgctctgttaaacttaagaataacgcacagactatgcccggtgaggttaattccacattgggaaccgcagcttatatggcccctgaagttatcacacgggcaaagggcgaagggcacggcagggcagcagacatctggtctcttggttgtgttgtaattgaaatggtcacagggaaacgtccatggcacgagtatgagcacaacttccagattatgtacaaggtcggaatggggcataagccacccatccccgaaagattgtcacctgaggggaaggactttctgtcccattgccttgagtctgaccccaagatgagatggaccgcctcccagctgctggaccattcgttcgtgaaagtgtgcaccgacgaagaatag

SEQ ID NO: 230968 - DNA, 4497 bp, Artificial Sequence
  Description of Artificial Sequence: Synthetic coding sequence
atgagagaagctgcggctgcacttgtgcctccaccggcatttgctgtaacgcccgctgccgctatggaggaaccccctccccctcctccaccaccgccacctcctccagaaccggagaccgaaagtgaacccgagtgctgtctggctgccaggcaggagggcacactcggggactcagcctgtaagtctcccgagtccgatctcgaagattttagcgacgagacaaatacagaaaatctttatggcacatcccctcctagcacaccacgccagatgaagcggatgagtactaaacaccaacggaacaatgttgggcgacccgcttcgcgaagtaatctcaaggaaaagatgaatgctccaaaccagccccctcacaaagacaccggaaagacagtggagaacgtcgaagaatatagttacaagcaggaaaaaaagattcgcgctgctttgcggactacggagcgcgatagaaaaaaaaatgtccagtgttcctttatgctcgactcagtcggagggtctttacctaaaaagtctattcctgacgtggatctcaacaaaccctatttgtcacttggctgcagcaatgcgaagttacctgtgagtgtcccaatgcccattgccagaccagccagacagaccagcagaacggattgccccgcagatcgtttgaagttttttgagaccctccgtcttctgctgaaactcacaagcgttagtaaaaagaaagacagagagcaaagagggcaagaaaacacatcggggttctggctaaataggagcaatgagctcatttggctcgagctacaggcatggcacgcaggtaggaccatcaacgatcaggacttcttcctgtacaccgctcggcaggctatacctgacattataaatgagattctgacgtttaaggtggattatgggagtttcgccttcgttcgagaccgtgccggatttaatggcacgagtgtggagggccagtgcaaagcgacccctgggacaaaaatagtaggctacagcacgcaccacgagcacctgcagagacagcgggtgagtttcgaacaggtaaagcgcattatggagctattagagtacattgaggcactttatccctccctccaagctctccagaaggactacgagaaatacgccgctaaggacttccaggatcgcgttcaggcactgtgcctgtggctcaatataactaaggatcttaaccagaagctcaggatcatggggacagtcctggggatcaagaacctgtctgacatcggatggcccgtcttcgaaatcccaagcccacggccttctaagggcaacgagcctgagtacgagggcgacgacactgagggtgagctaaaggagctggaatcttcaacggacgagtccgaggaggaacagataagcgatccacgagtgcccgagatccggcagcccatcgataactctttcgacatacaatctcgcgactgtatttctaaaaaactggaaagacttgaaagcgaagacgattcattaggatggggagccccagattggtcaaccgaggcaggtttttcccggcattgcttgacgtctatctaccggccatttgtcgataaagccctgaaacaaatgggtttgaggaagctgattttgcgtcttcacaagctcatggacggaagtttgcaaagagcaagaattgccttggtgaaaaatgatcggccagtggagttttcagaattcccggaccctatgtggggctcggattatgtccagctgagcaggactccgccatcatcagaagagaagtgcagcgcggtcagctgggaagagcttaaagctatggatctcccctcattcgaacctgcttttctggtgctttgccgcgtgctgctcaatgtcatccatgagtgtctcaaactgcgtctggaacagcgtccggctggtgagccatccctcctgtccatcaaacagctcgtgcgcgaatgcaaggaggtgcttaaaggaggattgttgatgaaacagtactaccagttcatgttgcaagaagtgctggaggacctggaaaaacctgactgcaatattgatgcttttgaggaagacctgcacaaaatgctaatggtgtactttgattacatgcggtcatggatccagatgcttcagcagttacctcaggcctctcactcactgaagaacttgctggaggaagaatggaactttaccaaggagatcacgcactacatccgcggtggcgaggcccaggccggaaagctattttgtgatattgctggcatgctactcaagtcgacaggaagttttcttgagttcgggctgcaggagagctgtgctgagttttggactagtgcggacgattcatcggcatccgacgagattcgacgctccgtgattgagatcagccgcgcattgaaggagttatttcatgaggctcgtgagcgtgcttctaaagccctgggcttcgctaagatgctgagaaaagatcttgaaattgctgccgagttcaggctctccgcccctgtgcgcgacctgcttgatgtactgaaatcaaagcagtacgtgaaggtgcagatccctgggctcgaaaatttgcagatgtttgtgcccgacaccctcgccgaggaaaaatccattatcctccagctgctcaacgccgctgcagggaaagactgttccaaagattctgatgacgtcttgattgacgcttaccttctactgaccaaacacggcgaccgcgctcgcgactctgaggactcatggggcacttgggaggctcagcccgtgaaggtagtgcctcaggtggagactgtcgatacccttaggtccatgcaggtcgataatcttctcctggtggtgatgcagagcgcacacctgaccattcagaggaaagccttccagcagtcgatcgaaggccttatgacgctttgtcaggagcaaacctcatctcagcccgtaatagccaaagctttgcagcagttgaaaaatgacgctttagagttgtgcaataggatttcgaacgccattgatcgcgtggatcatatgttcacttcggaattcgatgccgaggtcgatgagagcgagtctgttaccctgcagcagtattaccgcgaggcgatgatccagggatacaacttcggatttgaatatcataaagaggtcgtacgtcttatgtctggagaattcagacagaagattggcgacaagtatatttctttcgccagaaagtggatgaactacgtcttgaccaaatgtgaaagcggcagaggcacacgacctaggtgggctacacaggggttcgactttcttcaagcaattgagccggcatttatcagcgctttgccggaagatgatttcctcagccttcaagccttgatgaacgagtgtatcgggcacgttatcggcaaaccacacagccctgttacaggattatatctggccatccatcggaatagccctcgacccatgaaagtgccaagatgccactctgacccaccaaaccctcatctgatcattccgacacccgaggggtttcgcggatcctcagtgccggaaaacgatcggctggcgtctattgctgccgagcttcaatttcgctcactgtccagacacagcagcccgacagaggaaagggacgagcctgcctatccccgaggggactccagcgggagtaccagaagaagctgggagcttaggacacttatctcacagtccaaggataccgctagtaagttggggcctatcgaggctattcagaagagcgtgcgtctattcgaggagaaaagatacagagaaatgcgtcgaaagaacatcatcggccaggtctgcgacacccctaagagttatgacaacgttatgcacgtgggcctgaggaaagtgactttcaaatggcaaaggggcaataaaatcggcgaaggccagtacggaaaggtatacacatgcatctcggtggacaccggcgagctgatggctatgaaggagatccgttttcagcctaatgaccataagactattaaagaaacagcagacgaactgaagatcttcgaggggatcaaacatcccaatctggtcagatatttcggtgtcgagctccatagggaggagatgtatatctttatggagtattgcgatgaggggacactggaggaggtgagcagacttggcctccaggaacacgtgattcgtctctattcaaagcagatcaccattgccataaatgtacttcatgagcacggaatagtacacagagacatcaagggtgccaatatttttctaactagcagcggactgattaaactgggggactttggttgtagcgtcaagttgaaaaataatgcccagaccatgcccggtgaggtcaactccacactggggactgccgcttacatggccccagaagtgattacgagggctaagggagaagggcacggacgcgcagccgacatttggagcctgggctgtgtcgtgatcgaaatggtcacaggaaagatttgtaaggacacggagtag

SEQ ID NO: 230969 - DNA, 324 bp, Artificial Sequence
  Description of Artificial Sequence: Synthetic coding sequence
atggaggagccaccacccccacctcccccacctccaccccctcccgagcccgagactgaatccgagcccgaatgctgcctggcagccaggcaagaaggcaccttaggcgatagcgcatgcaagagcccagaatctgaccttgaagacttttccgacgaaaccaatacagagaatttatacggtactagtcccccaagtacgcctcggcagatgaagcgaatgtctactaaacaccagagaaataatgtgggcaggcctgctagtcggtctaacttaaaaggggtcaggcagatcagccatgcagtatcttcctccttgaactag

SEQ ID NO: 230970 - DNA, 1866 bp, Artificial Sequence
  Description of Artificial Sequence: Synthetic coding sequence
atggagcaggttcccggaggaagcttgtccgccttgctcaggagcaagtggggtccactgaaagataacgagcaaactattgggttctacactaagcaaattctggagggcctcaaatacttgcacgacaatcagatagtccatcgtgatattaagggtgacaacgtgctcattaatacttactctggcgtgctgaagatttctgacttcggcaccagcaagcgactggcgggaattaatccatgtacagagacttttaccgggaccctccagtacatggcaccagaaattatcgataagggaccaagggggtacggtaaagcagcagatatctggagcctcggatgcaccataatcgaaatggccacggggaagcccccattctatgagttgggggaaccacaggccgcaatgtttaaggtcggtatgtttaaggtgcatcctgagatccccgaaagtatgagtgcggaggcaaaagctttcatcctgaagtgcttcgagcctgatcccgacaagagagcctgtgcgaacgatttgctcgtagatgagtttctgaaggtgtcgagtaagaaaaaaaaaacacaaccgaaactctcggcactgagtgccggaagtaacgagtacctaaggagcatctccctccccgtgccggtgctcgtggaggatacgtcgtccagcagtgagtacggttcagtgtcacctgacaccgagctgaaagttgatccattttcattcaagaccagggccaaatcttgtggcgagagggacgtcaaagggatcagaacacttttcctcggcattccggatgaaaactttgaagatcactccgccccaccttctccagaggagaaagatagtggattcttcatgttaagaaaggattctgaaagacgggctacacttcaccgcatccttacggaggaccaagacaagatagtccgaaaccttatggagtccctcgctcaaggtgccgaagagcctaagttgaagtgggaacatataacaaccctgattgcctctctacgcgagttcgttagaagcactgaccgtaaaattatagcaacgacccttagcaaactgaaactggaactggacttcgatagtcacggaatttcccaagtgcaggttgtcttattcggcttccaggacgctgttaacaaagtgttgcgcaaccacaacatcaagccacactggatgtttgctctggacagcattatcagaaaagcagtacaaacagccatcacaattctggtgcctgagttgaggccacatttctcactagccagcgaatctgacaccgcggaccaggaggaccttgacgttgaagatgaccacgaggagcagccatccaatcagactgttcgtcggcctcaggcagtgatcgaggacgctgttgctacaagcggcgtgagcacgttatcttctaccgtcagccatgactcacagagcgctcatcggtccttgaacgttcagttaggtcgtatgaagatcgaaacgaacagactcctagaggagctcgtgcgtaaggagaaggagctccaggccctgttgcatagggccattgaggagaaggaccaagagatcaagcacctcaaacttaaaagccagcccattgaaattcctgagctgccagttttccatctaaacagctcagggacgaatacggaagattccgagctgacagactggctaagggtgaacggcgcagatgaggacaccatttccaggtttcttgctgaggactacaccctgctggacgtgctgtattacgtcacgcgagatgacttaaagtgtttaagactgagggggggtatgctgtgtactctgtggaaggccatcattgattttcgaaacaagcagacttag

SEQ ID NO: 230971 - DNA, 4125 bp, Artificial Sequence
  Description of Artificial Sequence: Synthetic coding sequence
atgtcaaccgaggctgatgaagggattaccttctcagtgcctccttttgctccatccggcttttgtaccataccagagggaggcatatgcagacgcggaggcgctgccgctgtgggggaaggagaagaacatcagctgcccccaccacctccaggctctttttggaatgtggaaagcgccgcagcacctggaatcggctgccctgctgccacctcatcctcttcggccactcgcggtaggggaagttctgtgggcggtgggtctagacgaactaccgttgcttatgtgatcaacgaagcgtctcagggccagctcgttgtggcagagtctgaggcgctgcaaagtttgcgggaagcctgcgaaaccgtgggcgctactctagagaccctgcactttgggaagctggacttcggagaaacaactgtgttggaccgcttttacaacgccgacattgccgtcgtggaaatgtcagacgcctttaggcagccttctctcttctaccacttgggcgtgcgagaaagcttctcaatggccaataatattatcctgtattgcgacaccaattccgactctctgcagtccctgaaggaaatcatctgccagaaaaacaccatgtgtactggcaactataccttcgtgccgtacatgatcaccccccacaacaaagtttactgttgcgattcctcttttatgaaagggcttacagagctgatgcaacctaattttgagctcctgctcgggccaatctgtctcccactggtagaccgcttcattcagttgcttaaggtggcccaggcctcatctagccaatacttccgcgagtccattctcaacgacattaggaaagccaggaacctgtatactggaaaggaactggcagccgagctagcgcgtatcaggcagcgggtggacaatatcgaggttcttaccgccgacatcgtgatcaacctgttgttgtcctatagagatattcaagactatgattccattgtcaaactggtggagaccctggagaagcttccaacattcgatctcgcatctcaccatcatgtcaaattccactacgcatttgctcttaaccgccgaaacctccctggagatcgggctaaggcactcgatatcatgatccctatggtccagtctgaaggacaggtggcaagcgacatgtattgcctcgtgggccgaatctataaagacatgtttctggactcaaatttcactgataccgaatctagggaccacggcgcttcctggtttaaaaaagctttcgagtccgaacccactctccagagcggcataaattatgccgttctgcttcttgccgctggccaccagtttgagtcatcatttgagcttcggaaagtaggagtgaaactgtcgagcctcctgggcaaaaagggcaatctggagaaactgcagagctactgggaagttggatttttcttgggcgcttcggtcttggccaatgatcacatgcgggtgattcaagcatccgaaaaactctttaaactgaagactcccgcatggtatctgaaatcaatcgtggaaaccatcctgatttacaagcattttgtgaaactgaccacagagcaaccggtggcaaagcaggaactggtcgatttctggatggactttctcgtcgaggcgactaagacagatgtgacagtagtgaggttcccagtcctcattctggaacctaccaaaatataccagccgtcttacctgtctatcaataatgaggtagaggagaagaccatatccatctggcatgtactccccgatgacaagaagggaatccatgagtggaattttagcgcttcctctgtgcggggtgtttccataagtaagttcgaggaaaggtgctgttttctgtacgtcctgcataactcggacgacttccagatatacttctgtacggagctacactgtaaaaagttcttcgagatggtcaatacaataactgaggagaaaggacgctctactgaagaaggggactgtgaatccgacctgcttgagtatgactacgaatacgatgaaaatggagacagagtggtgcttggtaagggtacctatggaattgtgtacgctggcagggacctaagtaaccaggtgcgtatagccattaaagagatccccgagcgtgatagcaggtacagccagcccttgcatgaggagatagccttgcacaagcatttgaagcacaaaaatatcgtccaataccttgggtcatttagcgagaatggcttcatcaagatctttatggagcaggtgccaggtggatcactctccgccctgctgcgttccaaatggggtcctcttaaggacaatgaacagacaatcggattttatactaagcagatcctggaaggactcaaatacctgcacgataatcaaatcgtgcatcgcgacatcaagggagataatgttctaatcaacacctactccggagtgctgaagatttctgacttcggcaccagcaaaaggttagccggtattaatccctgtactgaaaccttcaccggcacactccaatacatggcccctgagatcattgataaaggcccacgcggttatgggaaggctgctgacatctggtccctcggctgtacaattatagagatggccaccggaaaaccacccttttacgagttaggcgagccccaggccgctatgtttaaggttgggatgttcaaggtacatccggagattcccgagtctatgtcagctgaagccaaagcatttatcctcaaatgctttgaaccagaccctgataagcgggcatgcgccaatgatctccttgtggatgagttcctcaaggtgtcctcaaaaaagaagaagacacagcccaaactgtccgccctgtcagcgggttcaaatgaatatctgcggtccattagtctgccggttcctgtgctcgtcgaagatacatcgagctcctccgagtatggctcagtcagtcctgacacagagctgaaggtcgacccattttccttcaaaacacgcgcaaagtcctgtggcgaaagagacgtgaaggggatacgtaccctgttcctgggcatcccagacgagaacttcgaagaccactctgcgcctccgagcccagaagagaaggatagtgggtttttcatgctccgtaaagattctgaacgaagggccaccctccataggatcttaacagaggaccaggataagattgtacgaaatctcatggagtctctggcccagggggctgaggaaccgaagttgaaatgggaacacattactacactgattgccagcctacgcgagttcgtccggtcaaccgatcggaagataattgctacgacactgagtaagctgaagctggagctggatttcgactcccatggcatctcgcaagtacaagttgtgctcttcgggttccaagacgccgtaaataaagttctgagaaaccataatatcaagccccactggatgttcgccctggactccattatacgcaaggctgttcagacagccatcacaatcctcgttcctgaactcaggccccacttcagcctggcctctgagtcggatacagccgaccaggaggatctcgacgtggaggacgaccatgaggaacagcctagcaaccaaaccgtacgacgtccacaggccgtcatcgaggatgctgtggctacttccggagtctcaactctatcctcaactgtgtcacacgattcccagagcgctcaccggagtttaaatgtacagctcggcaggatgaaaattgagacaaaccgcctacttgaggagttagtgcgcaaggagaaggagcttcaggccctgctccatcgggctattgaagaaaaagaccaggagatcaaacacctgaaactcaagtcccagcccatcgagattcctgagttgccggtgttccacctgaactcttccggaactaacaccgaggattccgaactcaccgattggctcagggtgaatggggctgatgaggatacgatcagccgattcctggcagaagattacaccttgctggacgtcttgtactacgtgacacgcgatgatctcaagtgtttgagactgcggggagggatgctgtgcacactgtggaaggctatcattgattttagaaacaaacagacctag

SEQ ID NO: 230972 - DNA, 3771 bp, Artificial Sequence
  Description of Artificial Sequence: Synthetic coding sequence
acccttcagagggcttcgggagccgcaaccgaagcaccaagaagatcagaaccgcctcctggcagcggcgtaccttccggcgagcgcgctccagagcgaaggcggaggagaggaggtgagggcgctgcccgtgacgggtcttgtttagcgaggagggcacgatctagcccagagctgtggcttgccaggcggtgtgggtgggccggtgatgcagctgctgtagctgccaggcccggagagatgtccaccgaagcagacgagggaataactttctcggtgcctccctttgccccaagcggtttctgtaccatccccgagggaggaatatgccgtagaggaggggcagccgcagtcggagagggggaggagcaccagctgcctcctccaccgccagggagcttctggaatgtggaaagtgccgctgcgccaggaatcggatgcccagcagctaccagttcctcaagtgcaacgagaggcaggggttcgtctgtcggtggaggctcaaggagaaccaccgtggcgtatgtgatcaatgaggctagccaaggacaactggtggtcgcagagagcgaggcccttcaaagtctgagggaggcctgcgaaacagtcggtgctacgcttgaaacgctgcacttcggcaagctggacttcggcgagactacagtgctggatagattctacaacgccgacattgccgtcgtcgaaatgagtgacgctttccggcagccttctctgttttatcacttaggcgtgagggaatcttttagcatggctaataatatcattctctattgtgacacaaatagcgactcacttcagtccttaaaggagatcatctgccagaagaacactatgtgcacaggcaactacacttttgttccctacatgatcaccccccataacaaagtatattgctgcgatagctcttttatgaagggcctcacagaactgatgcagcccaattttgaattgctgcttggcccaatctgcctgcctctggtggacagattcattcagttgttgaaagtggcccaggcctcctcctcacagtactttcgggagagcatcctgaatgatattcgaaaagcacgaaacctgtacaccgggaaggagctcgcagccgagcttgccaggattaggcaacgggtcgacaatatagaagtgttaaccgccgacatcgtgattaatttgctgctgtcctaccgtgacattcaggactatgatagcatagtgaagctcgtggagactctagagaaactgcccacatttgacttagcttctcaccaccacgttaaattccattacgcgtttgcactcaatcgccgaaaccttccaggggatcgagcaaaggcactggacattatgatccctatggtgcagtccgagggccaggtggcctcagacatgtattgcctcgtgggtcgcatatacaaggacatgtttttagactctaactttacagacacagaatctagggaccacggcgctagctggtttaaaaaagcttttgagtctgagcctacgctgcagtccggaataaactatgccgtgctcctacttgctgcaggacaccagtttgaaagtagctttgagctgcgtaaggtgggggtgaagctttcctcactgctcggaaagaaaggaaacttggagaagcttcaaagctactgggaggtcgggttcttcctgggggcatccgttctggccaatgatcatatgcgagtgatacaggcctctgagaaactgtttaaactgaaaaccccggcttggtacctcaaatccatcgtcgagactattctgatctataagcactttgtgaagctgaccacagagcaacccgtggccaagcaggaactggtggacttctggatggactttctggttgaggcaaccaaaaccgatgtcacagtcgtcagattccccgtgctcatcctggagcccacaaagatttatcagccctcctacttaagcatcaacaacgaggtcgaggaaaaaacgatcagcatatggcatgtgctgcccgatgacaaaaaaggcatccatgaatggaacttcagtgcttcctcggtgcggggtgtctctatcagtaaatttgaagagcgctgttgctttctttacgtgctgcacaactccgatgactttcaaatctatttctgtacggagctccattgtaagaaattctttgaaatggtgaacacaatcactgaagagaaaggacgcagtaccgaagagggcgattgcgaatctgacctgctggagtatgactatgaatacgatgagaacggcgatcgcgtggtcctgggaaaaggtacatacggcattgtctacgctggccgagacctgtcaaaccaggtcagaatagccatcaaagaaattcctgagagagactctcggtacagccagccattgcatgaggagattgcactgcataagcatctgaaacataaaaacattgtccagtatctaggctccttctccgagaacggcttcattaaaatctttatggagcaggttcctggaggatctctttccgccctgctacgatctaagtggggacccctgaaagacaatgaacagacaatcggtttttacactaaacagattttggaaggcttgaagtacctgcacgataaccagattgttcacagggacatcaagggagacaatgtgcttatcaatacttactcaggtgtgctgaaaatttccgacttcggtacctctaagaggctagcaggaatcaacccatgcaccgaaacctttacaggtaccctccaatacatggctcctgagattatagacaaagggccacgaggatatgggaaagcagctgacatctggagcctgggatgcaccattatcgaaatggcgactggaaagcccccattttacgaattgggcgagcctcaggccgctatgtttaaagtcggaatgtttaaggtgcatccagagatccccgagtccatgagtgcggaagccaaggcttttattctcaagtgttttgagccagatccagacaaaagagcctgcgcgaacgacctactggtcgatgaattccttaaggtttcttcaaagaagaagaagactcagcctaagttaagcgacctcagcattgctcaagctgagtacctgagatctataagccttcccgtacccgtgctcgtcgaggatactagttcatcctcagagtatggatcagtctctcccgatacagagctcaaggtagacccattttcatttaaaactcgcgctaagagctgcggcgagcgcgacgttaagggaatcagaacactgttcttgggaatacccgacgagaattttgaagaccattcagccccaccctctccagaggaaaaggacagcggtttttttatgctgagaaaagatagtgaacggagggccacacttcaccggatcctcactgaagatcaagacaagatcgtgcgcaacctgatggaatcactggcccagggagcggaagaaccaaaactcaagtgggagcacattaccaccttgatcgctagtctgagggagttcgttcgctcaacagacagaaagatcattgcaacaacgctgagcaaattgaagctcgaactagatttcgatagccacgggatttcacaggttcaggtggtgttgttcggctttcaggatgcagtgaataaagtgttgcgtaaccataacatcaagcctcactggatgtttgctctcgacagtattatcagaaaggccgtgcaaacagcgatcactattttggtacccggaattaagccctag

SEQ ID NO: 230973 - DNA, 3867 bp, Artificial Sequence
  Description of Artificial Sequence: Synthetic coding sequence
atggcaggcccatgtccaagaagcggagctgagcgggcaggttcctgctggcaggatcctctcgcagtggccctttcgagaggacggcagttggcagccccacctggtcggggatgcgcgcgtagtcggccactcagtgttgtctacgttttgacacgtgagccgcagccaggcttagaacccagggaaggaacagaggcggagcccttgcccctgcgttgcctgcgcgaagcatgcgcacaagtgccccgacctcggccaccccctcagttgagaagcctaccgttcggaaccctggagcttggcgatacagctgcactggatgctttctacaacgctgatgttgtcgtgcttgaagtatcttcctccttggttcagcccagcctgttttatcatctgggcgtgcgtgagagctttagcatgaccaacaacgttctcctgtgtagtcaagcggatctcccagacctgcaggcgctccgcgaggacgtttttcagaagaatagcgattgtgtaggttcctatacactgatcccatatgtagttacggctactggcagggttctgtgtggggacgctggtctgttgaggggactggccgatggccttgtgcaggcaggggtcggtacggaggccctgctcacccccctggtgggaaggctggctagactgctagaggcaactcccacggattcttgtggttacttccgggagaccatacgcagagatatcagacaggcgagagaacgattctctggccctcaactgcgacaggagctggctcgcctgcaacggagactcgactcagtcgaactactcagccccgatattatcatgaacttgctcctcagctaccgcgacgtgcaggactacagcgccattatcgagctggttgaaacactgcaagctctccctacctgtgatgtggccgagcagcacaacgtctgtttccactataccttcgctctgaaccgacgcaatcggccaggagacagagccaaagccttatccgtgctgctgccgcttgtgcagctggaaggcagcgtggcacctgacttgtactgtatgtgtggtcgaatttacaaagacatgttctttagttctgggtttcaggacgctgggcatcgcgaacaggcatatcattggtacaggaaggcgtttgatgtggaacccagtctacattcgggcattaatgcggcagttctgctgatcgcagctggacaacactttgaggattccaaggaattgcggttaataggcatgaagctgggctgtcttctggcgaggaaaggctgcgtggagaagatgcagtattattgggacgtgggtttttatctaggcgcacaaatcctagctaacgaccctacacaagtggtgctggctgccgagcaactatacaaattgaacgcaccaatttggtatctcgtgagcgtgatggaaactttcctcctttatcagcacttccgtcctacccctgagccaccaggagggcctccgcgaagggctcacttttggctccatttcttacttcagtcctgccagccatttaaaacagcctgcgctcagggtgatcagtgcttggtcctggtactagagatgaataaggtgctgctacctgccaagttggaggtgcgtgggacagacccagtctcaacagtcactctatccctcctggagccggagacacaggatatcccgagtagttggacctttcctgtggcaagcatctgcggagtcagtgcttctaaacgggatgaaagatgctgtttcctttacgctcttcccccagctcaggacgtacagctttgttttcccagtgtggggcactgtcaatggttctgcggtcttatacaggcatgggtcactaaccctgattcaactgctccagcagaagaggcagaaggagcaggcgagatgttggagtttgactacgagtacactgagactggagaacgacttgtgctggggaagggcacgtatggcgtggtgtacgccggtagggaccgccacacaagagtgcgaatcgcaattaaggagatccccgaacgcgactctcggttttcacagccactgcatgaggagatcgccctgcaccggcgtctcagacataagaatatcgtccgctacctcggatccgccagtcagggaggctacctgaagatttttatggaagaagtaccaggcggaagcctttctagcctgctccgctccgtgtggggccctttaaaggataatgaatcaacaattagtttctacacacgccagatcctacagggcctggggtatctgcacgataatcacatagtgcaccgggacattaaaggcgacaatgtgttaatcaatacttttagcggcctgctaaagattagcgatttcggtacaagcaagagactcgctggtatcacaccttgtaccgagacatttaccggtacattgcagtacatggcccctgagattatagatcagggacctcgaggttacggtaaagccgctgatatctggagtctggggtgcactgtgatagaaatggcaacggggaggccgccattccatgaactggggtcgccgcaagccgctatgtttcaggtagggatgtataaggtacacccacccatgccatccagcctttcagccgaagcccaagcgttcctcttgcgaaccttcgaaccagatcccagactcagagcaagcgcacaaaccctgttgggcgacccctttttgcaaccaggaaagcggtcgaggtcgccatcttcccctcggcacgccccacgaccgtccgacgctccctcggcctcacctacgccgagcgcaaattcaaccacccaatctcagactttcccatgtccacaggctcccagccagcaccctccatctccacccaaacggtgtctgtcctacgggggaacgtctcaactgcgggtgcctgaggagccagcagccgaagagcccgctagcccagaggaatccagcggactttctctgctccaccaggaaagcaaaaggcgcgctatgctcgcagccgtcttagaacaggagctccccgcactagccgagaatttacaccaggagcagaagcaggagcaaggggctaggctgggtcggaatcatgtcgaggagctcttacggtgtctgggggcacacattcacacacctaacagacgccagctggcccaagaattgagggctctgcagggccgtctgcgggctcagggactgggccctgcgctcctccatcgaccgttgtttgccttcccagatgccgtaaagcagatactacggaaacgtcagatccggccacactggatgttcgtcctggactccttgctgtcccgcgctgtgcgcgctgctcttggcgtccttggcccagaagttgaaaaggaagctgtcagcccccgttccgaggaactgagtaatgagggagatagccaacaatcccccggacaacaatctccattgccggtagagccagaacagggccctgccccattaatggtgcagctgagcttactccgagcggagaccgaccgactccgggagatactggccggaaaagaaagagaataccaagctttagtacaaagggcactgcagcgccttaacgaggaagctcgaacttatgtgctcgctcctgagccccctaccgccctatcaaccgatcagggcctggtgcagtggctgcaagagctcaatgttgattcagggactatccagatgctgttgaaccacagcttcactcttcataccctgttgacatatgccactagagacgacctaatttacacacgaataaggggagggatggtgtgtcgcatctggcgcgcaatcttagctcagcgggcaggatcaacacctgtaacaagcggaccatag

SEQ ID NO: 230974 - DNA, 315 bp, Artificial Sequence
  Description of Artificial Sequence: Synthetic coding sequence
atggtccagctctccctgctgcgtgcggagaccgaccggctcagagagatcttagcaggcaaagagcgagaataccaagccctggtccagagggctctgcagcggctgaatgaagaagccaggacttacgtcctagcccctgagccaccaacagctttatcgaccgaccagggactggtgcagtggctgcaggagttgaatgttgacagtggtacaatccagatggggagggatggcatgccccatcttgaaggacacctcggtacagcaagccggattcatacctcccatctttggacgctgcgcgcagaatag

SEQ ID NO: 230975 - DNA, 3843 bp, Artificial Sequence
  Description of Artificial Sequence: Synthetic coding sequence
atggctggcccatgtcctcggtccggcgctgagagggccggatcctgttggcaagacccactggctgtggccctgtcacggggacgccagctggctgctcctccaggcagaggatgtgctaggagccgacctctatcagtggtgtacgttctcactagggagccccaacctgggctggagccgagagagggcactgaagcagagccactgcctctgaggtgcctccgggaagcctgcgcacaggtgccacgccctaggcctcccccacaacttcgcagtctgccatttggcacactggaattgggcgataccgctgctttagacgcattctacaatgccgacgtcgtggtgctggaggttagcagctcgctcgttcagccctccctgttctatcatctgggagtgagagagtctttttcaatgacgaacaacgttctactgtgcagccaggccgacctacctgatctccaagccctgagggactgtgttggcagctacacccttattccctacgtagtgacagccacagggagagtgctgtgtggggatgccggtcttctacgcggtctggctgatggtcttgtgcaggcgggagttggtaccgaagcactgttgactcctttagtgggacgcctcgcaaggcttctggaggccacacctacggactcatgtggttactttcgcgagactatccgcagagatattagacaggcacgggagcgcttctcaggtcctcagctgagacaggaactggcaagactgcagagaaggctggattctgtcgagcttctgtctcccgatattatcatgaatcttctcctgagctacagggatgtccaggattatagtgctatcatcgaactggtggaaacacttcaggctttgcctacctgtgacgtcgccgaacagcacaatgtctgttttcactatactttcgcgctgaatagaagaaaccgccctggcgacagggccaaggccttaagcgtgctgctgcccctggtgcagctggaggggtccgtcgccccagatctctactgtatgtgtggcagaatctacaaggatatgttcttttcgtcaggattccaggatgctggtcacagagagcaggcatatcactggtaccgcaaagctttcgatgtggaaccctctctgcatagcggaatcaatgctgccgtgctgctgatcgctgctggccaacatttcgaagactccaaggaactccgtctcatcgggatgaagctggggtgcctcctcgctaggaagggttgcgtcgagaagatgcagtattactgggatgtgggcttttacctgggcgctcagatactcgccaacgacccaactcaagtcgtgcttgccgcagaacaactttacaagctgaacgctccaatttggtacttagtcagtgtgatggaaacatttctactgtaccaacattttcgcccaactcccgagcccccaggaggcccaccacggagggcccacttctggctccactttttgttgcagtcttgccagccatttaagaccgcctgcgcccagggcgaccaatgtcttgtcctggttcttgaaatgaacaaggtgctcctgccggcaaaattggaggtccgtggaactgacccagtctcgactgtgacattgagcttgctcgagccagaaactcaggacatcccaagctcgtggacgttcccagtggcctccatttgtggagtatcagctagcaagcgggacgaacggtgctgcttcctttatgccctacctccagcccaggacgtccagttgtgttttccatcagtgggacactgccagtggttttgcggacttatacaagcctgggtcacaaaccctgactccactgctcctgctgaggaggccgaaggagctggggaaatgctggaattcgactacgagtacacagagacaggcgaacgcttagtcttagggaaaggcacttatggcgtagtctacgcgggtagagacaggcatacccgcgtgcgtatcgctatcaaggaaattccggagcgcgactcaagattttctcaacccttgcacgaagaaattgctcttcatcggcgactcagacataagaatatcgtccgctatcttggatccgcgtctcaggggggataccttaagatctttatggaagaggttcccggtggatcactctcaagcctcctgaggtctgtgtgggggccactcaaggacaatgaatccaccatctcattctacacccgacagatccttcagggcttagggtaccttcatgacaaccacatcgtgcaccgagacattaagggtgataatgtgctgattaatacattttcaggtttgctaaagatcagtgatttcggaacatctaagaggctggcagggatcacaccgtgcacggagacctttacagggacgctgcaatacatggctcctgaaatcatcgatcagggtccgagaggctatggaaaggctgccgacatctggagtcttggatgcacagtcatcgagatggctactggcagacctccctttcacgaactggggtccccacaggcggctatgtttcaagtgggaatgtacaaagtccacccccctatgccaagctctctaagtgctgaagcccaggcctttttgctgaggacctttgaacctgacccaaggctcagggcttcagctcagacactgctgggagatcccttcctgcaacctgggaaacggtctcgtagcccctcctctccgaggcacgctccgagaccaagcgatgcaccgagcgcatcacctacccccagtgcgaattctactacccagtctcaaacctttccatgtccacaggcccctagccagcaccctccatcaccccctaaacgctgtttgtcctatggcggaacctctcagttacgcgttcctgaagaaccagccgcagaagagccagcatctcccgaggagagcagcggattgagcctattgcaccaggaatccaaaaggagagctatgttggccgctgtgctagagcaagagctacctgcacttgcggaaaaccttcatcaggaacaaaagcaagaacagggggcacgccttgggagaaaccacgttgaagaactccttagatgtctgggtgctcatatccataccccaaatcgcaggcaactcgcccaagaacttagggcccttcagggtcggttgcgggcacagggattgggccctgcattattgcataggcctctgttcgcgttccccgacgcggtcaaacagatcttgcggaaacggcagatcagacctcactggatgttcgtgcttgattcgttgctgagtcgagctgtgagggctgcgctgggcgtgctcggaccagaggttgagaaggaagctgtgagtcctaggtcagaagaactgtctaatgaaggcgacagccagcagtcgcccggacagcaatccccactgcccgtcgagcctgagcaaggtccagctccgcttatggtgcaactgtccctgttgagggctgaaaccgaccgtcttagagaaattctcgccggaaaggagcgcgagtaccaagcactggtgcagagggccctccagagactgaacgaggaggccaggacctacgtattggccccagaaccccctacagccctatccaccgatcagggacttgttcagtggttacaagaattaaacgttgatagcggaactatccagatgctgctcaaccacagctttaccctacacactctcctcacatatgccacccgggacgatctgatttatacaagaatccgtgggggaatggtgtgtagaatctggcgggctattctcgcacagcgagctggcagcacccctgtgaccagtggaccctag

SEQ ID NO: 230976 - DNA, 2397 bp, Artificial Sequence
  Description of Artificial Sequence: Synthetic coding sequence
taaatgaatctgttgctgtcttatcgcgatgtccaggattattcagcaatcatcgagttagtggaaaccttacaggccctgccaacctgcgatgtcgccgaacagcataatgtgtgttttcattacacctttgctctgaaccgtagaaatcggcctggagacagagcgaaggcactgtctgtgctcttgcctctggtccagcttgagggcagcgttgcgcctgacctgtattgtatgtgcggtcgtatttacaaagatatgttcttcagttcaggttttcaggatgccggtcatagagagcaggcttaccactggtaccggaaggctttcgacgtggagccttctctccattcaggaattaatgcagccgtgctcctgatagcagctggccaacacttcgaagacagtaaggagcttcgacttataggtatgaaactggggtgtctgttggccaggaaggggtgtgtggaaaagatgcagtactactgggatgttgggttttacctgggcgctcagatcttggcaaacgatccaacccaggtcgtccttgccgcagaacagctctacaaacttaacgccccaatatggtatctggtcagcgtgatggaaaccttcctcttgtatcagcacttccgccctacaccagaaccaccaggcggtcctcccaggagggcgcacttctggctccacttccttctccagtcatgtcagccctttaagactgcttgcgctcagggtgatcagtgtctggtcttggtgctggaaatgaataaggtactgcttcccgctaagctggaagtacgaggcacagaccccgtgagcactgtgactttgtctttgttggagcccgagactcaagacatcccttcctcttggacgttcccagtcgcgagtatttgtggggtgtccgcatccaagcgggacgagcgttgttgctttctttatgctttgccccctgcccaggatgttcaactgtgtttccccagcgtgggacactgccagtggttttgtggcttgatccaggcctgggtcacaaatcctgacagcacggcacctgccgaggaagcagagggcgctggcgagatgcttgagttcgactatgagtatactgaaaccggcgagcggctggtgcttgggaagggaacttatggggtggtgtatgctggcagagatagacacaccagggtgcggattgctatcaaagagataccagaaagagacagtcgctttagccagcccttacatgaggaaatcgcactgcataggcgcctgaggcacaaaaatattgtgcgctatctgggcagcgccagccagggagggtacctgaagatctttatggaagaagtccccggaggttcactgagttctctgcttagatcagtgtgggggccattaaaagataatgagtctaccatatccttctatactagacagatattgcagggccttgggtacctgcatgataaccatatagttcatcgcgacatcaaaggcgataacgtgcttataaacactttcagtggattgctgaaaatctccgacttcggaacctctaaaagactggctggcatcactccgtgtacagagacgttcacaggaaccctgcagtatatggcgcctgagatcatcgaccagggccctagaggctatggtaaagccgcagatatttggtccctgggctgcactgtaattgagatggcaaccgggagacctccatttcacgaactaggcagcccacaagcagccatgtttcaggttggaatgtataaagtccacccccctatgccttcaagtctcagtgctgaagcgcaggcctttctgctccgaacattcgaaccagaccctagactgcgggcttccgcccagacattattaggagatccatttctccaacccggtaaacgctctcgatctccctcatccccgagacatgcccctcgccctagtgacgctccttctgcatcacctaccccgagcgccaattcaactacacagagccagactttcccatgtcctcaggcaccgagtcaacatcctccttcaccccctaaacgctgtcttagttatggtggtaccagccaactgagagtcccggaggagcctgctgctgaagaacccgcatctccggaagagagttcaggcctgtcattgctgcatcaggaatctaagcgcagggctatgctggctgctgtgctggagcaggaactgcccgctttggcagaaaatctgcaccaggagcagaagcaagagcaaggtgcgaggttaggacgaaaccatgtagaggaattgcttagatgccttggtgcacatattcacacccctaatagaagacagctagctcaggagctccgcgcattgcagggatggatgaatggcgaagataaagggagcttttag

SEQ ID NO: 230977 - DNA, 249 bp, Artificial Sequence
  Description of Artificial Sequence: Synthetic coding sequence
taggagtaccaggccctcgtgcagcgggcattgcaaaggctgaacgaggaggctcgcacgtacgttctcgcccctgagccacccacagctctctcaactgaccaggggctggtgcagtggctacaagagctgaatgtcgactccggaactatccaaatgggcagagatggcatgccccacctggaggggcacctggggacagctagcagaattcacacttcacacctgtggaccctcagagccgaatag

SEQ ID NO: 230978 - DNA, 3867 bp, Artificial Sequence
  Description of Artificial Sequence: Synthetic coding sequence
atggcaggaccgtgccctcgaagtggcgctgagagagctggctcttgttggcaggaccctctagccgtggcactgtccaggggtaggcagctagctgctcctcctgggagagggtgtgctaggagtcgtcctttatcagtggtttatgtgttaactcgggaaccacaaccgggtctcgagcccagagagggtactgaggctgagcccctcccgttgagatgtctgcgggaggcgtgtgcccaagtgcctaggcctcgccctccgcctcaactaagatcattgcccttcgggactttagaactcggagatacagccgcattggatgcattttacaatgctgatgtcgtcgtcctagaggtgagtagctccttggtccaaccttccctgttctaccacctgggggtgcgtgagtcttttagcatgaccaacaacgtgcttctttgcagccaggccgatctcccagacctccaggcactgcgggaggacgtgtttcagaaaaacagtgattgtgttggaagttacactctgattccttatgtcgtcacagcgactggaagagtgctgtgcggcgacgccggactccttaggggactggccgatggtctggtgcaagctggggttgggacagaagcactccttactccacttgtaggcagactcgcgagactcctggaagctaccccgacggactcctgtggatatttccgcgaaactatccgtcgcgatattagacaggctcgcgagagattctcgggcccacagctacggcaggagctagcaaggttacaacgcagactggacagcgtcgagctcctcagtcctgacattattatgaatttactgctctcctatagagatgtacaagactactccgctattatagagctcgttgagacactgcaggcccttccgacctgcgatgtagccgagcagcataatgtgtgcttccattacaccttcgccctcaatagacggaatagaccgggagaccgggctaaggcactgtccgtcctgcttcctcttgttcagctggagggatccgtggccccagacctgtattgcatgtgcggtcggatttacaaagacatgttcttcagcagtggcttccaagacgctgggcaccgcgagcaggcctaccattggtaccgcaaagccttcgacgtggagccttcactgcactccggtatcaatgccgctgtattgctcattgccgctgggcagcattttgaagacagtaaagaactcagactgattgggatgaagttagggtgcctgctggcgagaaaagggtgtgtcgagaaaatgcagtactactgggacgttggcttttatctgggcgcacaaatcctggcaaatgatcctacccaggtcgtcctggccgctgagcagctctataagctgaacgctcccatttggtacctagtatccgttatggagacatttctcctgtatcaacatttccgcccaacacctgagcctcccggaggcccaccgcgacgcgcacacttctggctgcacttcctccttcaaagttgccagcctttcaagacagcttgcgctcagggcgaccagtgcttagtgctcgtgcttgagatgaacaaggtactcctccccgcaaaactggaagtgagaggcaccgatccagtaagtaccgtcactcttagcttactggaacctgaaacgcaagacataccctccagttggacctttccagtagctagtatctgtggggtgtcagcctctaagagggatgagagatgctgctttctctacgctctgccaccagcccaggacgtgcagctttgtttccccagcgtagggcattgccagtggttctgcggactgatacaggcttgggtcactaaccctgacagcaccgcccctgccgaggaagccgagggcgctggggaaatgctcgaatttgattatgaatatacggaaacaggggaaagactggttctgggaaaaggcacttatggagtggtgtacgccggaagggaccggcataccagagtgcgcatcgcgatcaaggagatcccagagagagactcaagattcagtcagcccctccatgaggagattgcactgcataggagacttaggcacaaaaacatcgtccggtatctgggaagcgcatcccagggaggctacctgaagattttcatggaggaggtgcccggaggctctctgagttccctgttgcgaagtgtctggggcccactcaaggataacgagagtacgatttcattctacacaagacagatactgcaggggcttggctatttgcatgacaaccacatcgtccatcgtgacattaagggagacaacgtcttgattaatacttttagtgggctgctgaagatcagcgactttggcacctcaaagcggctggcagggatcacgccatgcacggagaccttcaccggaaccttgcaatacatggctccggaaattatcgaccaggggcctagggggtacggaaaggcggcagacatatggtctctgggctgcactgtgattgaaatggccaccggtcggcctcccttccatgagctcggtagcccccaggccgctatgttccaggtggggatgtacaaggtgcatccccctatgccatcctctttgagtgctgaggctcaggcctttttgctgagaacgttcgagccggatccccgactgcgcgcttccgcccagactcttctgggggatccctttctccaaccaggtaagagatccaggtccccctcatcaccaagacacgcaccacggcctagtgacgctccatcagcatcacctaccccatctgctaatagcactacccagtctcagacgttcccctgcccacaggccccatctcaacaccctccatcaccacccaagaggtgcttgagttacggcggaaccagccagcttagggtgccagaggaacctgcggctgaggaacccgcatctccggaagagagctcagggctgagccttttacaccaggaaagcaaaaggcgggcaatgctggcggctgtgctggagcaagagttacctgcactcgctgaaaacctgcaccaggagcagaagcaggagcagggtgcacggctggggaggaatcatgtggaggaacttctgcgttgtctcggggcacatatccacacccctaaccgcaggcagcttgcccaggagctgcgtgctctgcagggacggcttcgagcgcaaggactcggccctgcattactgcatagacctctgtttgccttcccggatgccgttaaacagattctcaggaagagacagatccgccctcattggatgttcgtgctagatagtcttctctcccgagccgtgagagctgctctgggcgtgctcggtccagaggtggagaaggaagccgtgtctcccaggtcggaagagctgagcaatgaaggggactcccagcagagtcctggtcagcaaagcccactgcccgtagagcccgaacaggggcctgcccctctgatggtccagctcagcttattgagagcagagacagaccggttaagagaaatcctggcagggaaggagcgcgagtaccaggccctcgtccaaagagcgctccaacgactgaatgaggaggcacgcacatacgtcctggctcctgagccccctacagccctgagtactgaccaggggctcgtgcagtggctacaggaactgaatgttgactccgggacaatccagatgctgctgaaccacagctttacgctgcacactctgttaacttatgcaactagggatgacctgatttatacccgaatacggggtggtatggtgtgccgcatctggcgcgcaatcctggcccagagagctggcagtactccagtcactagtggcccttag

SEQ ID NO: 230979 - DNA, 2394 bp, Artificial Sequence
  Description of Artificial Sequence: Synthetic coding sequence
atgaacctgttattgtcttaccgggatgtgcaagactatagcgctattattgagctggtggagacgctgcaggccctcccaacctgtgatgtagctgagcaacataacgtttgttttcattacactttcgcgctcaatcggcgaaatcgcccaggcgaccgggcaaaggcactctcagtgctcctccccctggtacaactggaaggctccgttgccccagatctgtattgcatgtgcggcaggatttataaagatatgttcttcagttccggattccaggacgccggtcatcgggagcaggcttatcattggtaccgcaaggcctttgatgtggaacccagcctacacagtgggattaatgcggcagtgctgctgatagctgccggtcagcactttgaggacagtaaagagctacgactgattggtatgaagctgggttgccttctcgctcgaaaaggctgcgtggagaagatgcaatactactgggatgttggattctacctcggtgctcagatcctcgcaaatgaccctacacaggtggtgttagcggcagagcagctctataagctcaatgcccctatttggtatctggtctccgtgatggaaacattcctcctttaccaacacttccggccaacccctgaaccacccggaggacctccaaggcgcgcacatttctggttacacttcctcttgcaatcctgtcagccctttaagacagcatgcgcccagggggaccagtgcctggtattagtcttggagatgaataaggtactgttacctgccaagcttgaggtgagggggactgatcccgtctcaactgtgacgctctcactcttagagcctgaaactcaggacatcccttcaagttggaccttccctgtggcgagcatttgcggggtatctgcaagcaaaagagatgagagatgttgtttcctttacgcactgccacctgcacaagacgtgcagctctgtttccccagcgtgggtcactgccagtggttttgtggcctgatccaggcctgggtcacaaaccctgatagcactgcgccagcagaggaggccgaaggggctggcgagatgctagagtttgactatgagtacaccgaaacaggagagcgtctggtgctcgggaaaggcacgtacggggtggtctatgccggtcgggatagacatacccgtgttcgcatagcgataaaagagatccctgaacgtgattcgaggttttcacagccacttcatgaggagattgctttgcaccgaagactccgtcacaagaacatagtacgctacctcggatcggcgtcacagggaggctacctcaaaatttttatggaggaagtcccaggtggaagcctttcctccctcctgaggtccgtgtggggccctctgaaggataacgaatctaccattagtttttatacgcggcagatactgcaggggttgggttatctccacgacaaccacatagtgcaccgagatatcaagggcgacaatgttctcatcaacactttcagtgggctccttaaaatctctgatttcggcactagtaagaggctagctggcatcaccccgtgcacagaaacgttcaccggtacacttcagtacatggctcccgaaattatagatcaaggccctaggggctatgggaaagctgccgacatctggagtctgggttgtaccgtcatcgaaatggccacgggccgaccccctttccatgagcttggctcacctcaggcggctatgttccaggttggaatgtataaggtccatccgccaatgccttcttcccttagcgcagaggcgcaggcctttttattgagaacgtttgagcccgacccccgactgcgggcatcagcacagacactcctgggagatccatttctacagcccggaaagcgttcgcgcagtcccagtagtccgaggcatgcgccacgcccttcagatgcaccttctgcctcccctacaccttctgcaaactctaccacacaatcccagaccttcccctgtcctcaggctccatctcaacacccaccgtcaccccctaagcgatgcctttcatatgggggaacttcccaactgcgggtgcccgaagagcccgcagcggaggagcctgcttcgcctgaagaatcttcaggcctgagcctcttgcaccaggagagcaagagacgagcaatgctggcagcggttttggaacaggaactgccagcactggccgagaatctgcatcaggaacagaaacaggagcagggtgcacggctgggcagaaatcacgtcgaggagctgctgcggtgcctcggcgctcacattcatactcctaaccgcaggcaactggcccaggagctgcgggctctccaggggtggatgaatggagaagacaaaggttctttctag

SEQ ID NO: 230980 - DNA, 783 bp, Artificial Sequence
  Description of Artificial Sequence: Synthetic coding sequence
atggatatcgccagcactaacaccagcaataagtcggacaccaatatggagcaagtgcccgctactaatgataccattaaaagacttgagagcaagctgcttaaaaaccaagcaaagcagcaatcggagtcgggtaggctctccctaggcgcatctcgagggtcaagtgtggagagcctgccacctactagcgagggaaagcgaatgagcgcagacatgtctgaaattgaggccagaatcgctgccacaacggggaatggtcagcctagacgcaggagcatccaggatctgaccgtgacaggaaccgaacctggccaggtgtcctctcgaagttctagcccatccgtgcggatgattactacatcaggccctaccagtgagaagcctactcgctctcacccttggaccccggacgattccaccgatactaatggcagcgataacagtatacctatggcctaccttacactcgaccaccagctccagccactggcgccatgcccgaattcaaaagaatccatggccgtatttgagcaacattgtaaaatggctcaagaatatatgaaggttcaaacggagattgctctgctgttgcagaggaagcaagaactcgtcgctgaactcgaccaggatgagaaagatcagcaaaatacaagtcggctggtacaggagcataagaagctgttggacgagaacaaatctttgagtacatactatcagcagtgtaagaaacaactggaggtaattcggtcacagcagcagaaaaggcaggggacctcctag

SEQ ID NO: 230981 - DNA, 1557 bp, Artificial Sequence
  Description of Artificial Sequence: Synthetic coding sequence
atgtcaaccgcctccgccgcatcatcgagctcaagctcctcagccggagaaatgatcgaagccccttctcaggtattgaactttgaagagatcgactataaggagattgaggttgaggaggtagtaggcagaggagctttcggagtggtgtgcaaagcaaaatggagggccaaagatgttgcaataaaacaaatagagtctgaaagcgagcgcaaagcttttattgttgaactccgccagttaagtcgagttaaccaccctaacatcgtgaagctctacggtgcttgtctcaatcccgtttgtctcgtgatggagtacgccgaaggaggcagcttgtataacgtgctgcatggtgctgagccacttccttattacactgctgctcacgcaatgagctggtgcttgcagtgctcccagggcgtggcatatctgcattccatgcagcccaaggccctgattcaccgcgatctgaaacctcctaaccttctgctggttgcaggaggcaccgttctaaagatatgcgattttgggactgcgtgcgatattcagacccacatgactaacaataaggggtctgctgcatggatggcaccagaggtttttgagggctcaaactacagcgagaaatgtgacgtcttcagctggggtattatcctgtgggaagttattacaagaaggaagccctttgacgagattgggggacccgctttccgaatcatgtgggcagtgcacaacggaacacgccctccgctcatcaaaaacctgcctaaacccattgaatcacttatgacacgatgttggtccaaagacccaagtcagagaccaagtatggaggagatcgttaagatcatgacccacctgatgagatactttccaggcgcagatgagccactgcaatatccatgccagtactcagacgagggccagagtaactcggctaccagtactggcagcttcatggacattgcctctaccaatacatccaacaagtcagatacaaatatggaacaggtgcctgcgactaatgataccatcaagcgcctggagtcgaaactactgaaaaaccaggcaaaacaacagagcgagtcaggccgattatccctaggggctagtcgcggatcaagtgtcgagtcattgcctccaactagcgaaggaaagcgcatgagtgcagatatgtctgaaatcgaagctcgcatcgctgccactaccgcttacagcaagcccaaaaggggacacaggaagacagctagctttgggaatattcttgacgttcctgagatcgttatcagtggtaacgggcagcctcgccgtagaagtattcaggaccttactgtgacgggcacagaacctgggcaggtctctagcagatcttcctctcccagcgtgcgtatgatcacaacttctggtccaacctcagaaaaacccacacgctcccatccatggacccctgatgatagcactgatacaaacggatcagacaattctatccctatggcctatttaactctggatcatcagctgcaggctagaacctcatgtagaaccggccctgggtag

SEQ ID NO: 230982 - DNA, 1476 bp, Artificial Sequence
  Description of Artificial Sequence: Synthetic coding sequence
atgtcgacggcctcagccgctagtagctcctcgagttcaagcgccggagagatgattgaggctccttcacaggtcctgaattttgaggaaattgattacaaagaaattgaagtggaagaggtcgtggggcgtggggcattcggggtggtgtgtaaggccaaatggagggccaaggacgttgccattaagcaaatcgaatccgagtctgagcgcaaagcgtttatcgttgaacttaggcaactgagtcgggttaatcacccaaacatagtgaaactgtatggcgcatgtctaaatcctgtctgcctcgtcatggagtacgccgagggaggaagtctgtataacgtcctgcatggagcagagccccttccctactataccgctgctcacgctatgagttggtgtcttcaatgtagccagggagtcgcctacctgcatagcatgcaacccaaggctctaattcaccgggacctgaaaccgccaaatctgctgttggttgctggtggcacggtgctcaagatatgtgactttggcactgcatgtgatattcagactcacatgaccaataataagggttcagcagcgtggatggcccctgaagtcttcgagggttccaactactcagaaaagtgcgacgtgttctcttggggaatcattctttgggaggtcattactcgccgaaaaccattcgatgagatagggggtccagcattccgaatcatgtgggctgtccataatggcacgcgcccacctctcatcaagaatctcccaaaaccaatcgagtccctaatgactagatgttggtcgaaagatccttctcaacggccttccatggaggagatcgtgaagataatgacccacctcatgcgctactttcctggggcagacgaaccccttcagtacccctgccagtattccgacgaggggcagagcaacagtgcaacttctaccggttcttttatggacatcgcctctactaatacctccaataaatctgataccaatatggagcaggtgccagccaccaatgatacgataaagaggctggagtctaagctccttaagaaccaagcaaagcagcagtccgaaagcgggcgtctctcactgggcgcttctagggggagctctgtggagtctcttccccctacttccgagggtaagcgaatgtctgctgatatgtcagaaatagaggctagaattgctgccaccacaggcaacggacagcccaggcgcagatctatccaagaccttacggtaacaggcaccgagcctggacaggtaagctctaggtcctcttctccctctgtgagaatgatcactacctccggcccaacgagtgagaaacctacaaggtctcatccctggacccctgatgatagtactgatacaaacggctcagataactcaattcctatggcctacctcacactggatcaccagctgcaggcccgaacctcttgtcgcactggcccaggatag

SEQ ID NO: 230983 - DNA, 1821 bp, Artificial Sequence
  Description of Artificial Sequence: Synthetic coding sequence
atgtcaacagccagtgctgcttcctcctcttcctcctcttccgcgggagagatgatagaggccccatctcaagtcctgaactttgaagaaatcgactacaaagaaatcgaagtggaggaggtggtcggaaggggcgcttttggggtagtatgcaaagcaaagtggcgcgctaaggacgtggcgattaaacagatcgagtccgagtccgaacgtaaggccttcattgttgaacttcgccagctcagcagagttaaccaccccaacattgtcaaactctacggcgcttgtctgaacccggtctgcctggtgatggaatacgctgaagggggaagcctgtataatgtgctacacggggctgagcctctgccatattacactgcagcgcacgccatgtcatggtgcctacagtgcagccagggtgtcgcttacctacattccatgcagccaaaagccctgatccacagagacctcaagccgcctaacttgttactggtggctggcggaacagtgttaaagatttgtgatttcggcaccgcttgcgatatccaaactcatatgacaaataataagggctccgcggcttggatggctccagaggtgtttgaaggatctaattactccgagaagtgtgatgtcttctcatggggcataatactgtgggaggtgatcacccgccgtaaaccttttgatgagattggcggtcctgcctttagaataatgtgggccgtccataatggaacacggccacccctgataaaaaacctgcctaagccaatcgagtcattaatgacacggtgctggtcaaaggacccttctcagcggccttcaatggaggaaatagtaaagattatgacacacttgatgaggtatttccctggagccgatgaacctctccagtatccgtgtcaatacagcgatgaagggcaaagtaactcagccacttctaccggctccttcatggacattgcctccacaaacaccagcaataagtctgatactaatatggagcaggtcccggcaaccaacgatacaatcaagagactggagtctaagctgttgaagaaccaggccaagcagcagtcagagagcggccgactgagcttaggcgcttctagagggtcatccgtcgaatccttgcccccaacgtcagaaggcaagcgcatgagtgccgacatgtctgaaatcgaagcgagaattgcagctactactgcatactccaaaccaaaacggggacataggaaaacagcctcctttgggaacattctggatgtcccagagattgttatttctggaaatggtcagccaagacgcagaagcatccaggatttgacagtgaccggcacagagcccggacaggtgagttctcgttcgagcagcccgtcagtccggatgataaccacaagcgggcctacgtctgagaagcccacccgcagccatccctggacccctgatgacagtaccgataccaacgggagcgataattcaatcccaatggcctacttgaccttggaccaccaattgcagccactggccccttgtcctaattccaaggagagcatggccgtcttcgagcagcactgtaagatggcacaggaatatatgaaggttcagactgaaatcgcactacttctccagcgcaaacaggagctggtggccgagctggaccaggatgagaaagaccagcagaatacctcccgcctggtccaagaacacaagaaactgttggacgagaataagtctctatccacatattaccaacagtgcaagaagcagctcgaggtgattcggagtcaacaacaaaaacggcaaggaacctcctag

SEQ ID NO: 230984 - DNA, 1740 bp, Artificial Sequence
  Description of Artificial Sequence: Synthetic coding sequence
atgtccaccgcttccgcagcttcttcctctagttcctccagtgccggagaaatgatcgaagccccatcccaggtgctgaatttcgaggagattgattacaaagagattgaggtcgaagaagtggtgggcaggggggcttttggcgtggtttgcaaagcaaaatggagggctaaggacgtagcaattaaacaaattgagagtgaaagtgagaggaaggccttcatagtcgaactgaggcaattgagccgcgtgaatcatcctaatatcgtaaagttgtatggagcctgcctaaatcctgtgtgtttagtgatggaatatgccgaaggtggttccctatacaacgttctgcatggagcagagcccctgccatattatacagcagcacatgcaatgtcttggtgcttacagtgcagtcagggcgtcgcatatctgcactcaatgcagcctaaagctcttattcacagagacctgaaaccacccaatctccttctcgtggccggagggactgtattaaaaatttgcgactttggcaccgcttgcgacattcagacgcatatgactaacaacaagggaagtgccgcatggatggcacctgaagtgtttgagggttcaaattattccgagaagtgcgatgttttttcatggggcattatcctgtgggaggttataaccaggaggaaaccattcgacgagatcggcggacccgcatttcgaatcatgtgggctgtgcacaacgggacacgcccaccactcataaagaacctgcctaagcccatcgaatctctaatgaccaggtgctggtcaaaggatccaagccagcggccatccatggaggaaatagtgaagatcatgacacatctgatgcgttacttccctggcgctgatgaacctctgcagtacccttgtcagtacagcgacgaggggcagtccaactccgcaaccagcacaggaagctttatggacatcgccagcacaaatacatccaataaatccgacaccaacatggagcaggtccccgcaacaaacgatacgatcaagcgcttggagtccaagttacttaagaaccaggctaagcagcaatcagagtctgggagacttagtctgggagcgagccgcggttcctccgttgagtctctgcctccaactagcgaaggaaagaggatgtctgctgatatgagcgagatagaggctaggatcgctgctactactggcaatggccagcctcgcaggcgctctattcaagacctgacagtgaccggaacagaacccggacaggtttcgagtcggagttccagcccctccgtgcgaatgattaccacatctggccctacatccgaaaagcccacaagatcccacccatggacgcctgatgatagtactgacactaacggctctgataacagcatccctatggcatacctgaccctggatcatcagttacaacccctggccccttgcccaaattctaaggaaagcatggctgtgttcgagcagcactgcaagatggcccaggagtatatgaaagtccagacagagatcgctcttctgctccaaagaaagcaagaactggtagctgagctggatcaggatgagaaggaccagcagaatacaagcaggttagtgcaagagcacaaaaaattactggacgagaacaagagcttgtcaacgtattatcagcagtgtaagaagcaactggaggtgataagatctcagcagcagaaacgccagggcaccagttag

SEQ ID NO: 230985 - DNA, 1257 bp, Artificial Sequence
  Description of Artificial Sequence: Synthetic coding sequence
atgagcacagcctctgccgcatcttcatctagtagcagtagtgccggtgagatgatagaggccccaagccaggtccttaatttcgaggaaattgactataaagaaattgaagtagaggaagtggtggggagaggcgcatttggcgtggtttgcaaagctaagtggagagctaaagatgtcgccataaagcagatcgagtcagaatcagagcgcaaggcatttattgttgagctgaggcagctgagtcgggttaatcacccaaatctcctgcttgtcgccggtggcacagtgcttaaaatctgtgactttggcaccgcttgtgacatccagacacacatgactaataacaagggctccgctgcttggatggccccagaggtcttcgagggttccaactatagcgagaaatgcgatgtattctcctggggaatcattttatgggaggtgattactcggaggaagcctttcgacgagatcggcggtcccgcattcagaattatgtgggcagtccataacggcacacgaccccctctcataaagaatttgccgaagcctattgagtctctgatgacgcgttgctggtcaaaggaccccagtcaacgcccttccatggaggaaattgtcaaaatcatgacacacttgatgaggtacttcccaggagccgatgaacccctgcagtacccatgccagtatagtgatgaaggacagagcaacagcgcaaccagtaccggatctttcatggacatagctagcaccaacaccagtaataagtccgacacaaatatggagcaggtgcctgccacgaacgataccattaaacggttagagtcaaagctgcttaagaaccaagccaagcagcagtccgagagcggtcgactaagcctaggcgcatcgcgaggaagtagcgtcgaatcattacctcccacgtccgaagggaagcgcatgtctgctgatatgtcggagattgaggccagaatagcagccacaacaggcaacggtcagccacggcgaaggagtatccaagaccttacagtcactgggacagagccgggacaggtctccagccgaagctcatctccctcggtccgcatgatcacaacttctggtccaacatcggagaaaccaaccagatctcacccttggacccccgatgattctactgatacgaacgggagcgacaattccatccccatggcttatctaacacttgatcatcaactgcaggcgagaacctcctgtagaaccgggcctgggtag

SEQ ID NO: 230986 - DNA, 1404 bp, Artificial Sequence
  Description of Artificial Sequence: Synthetic coding sequence
atggagtatatgagtaccggatcggacaataaagaagaaatcgatctcctgatcaagcacctgaatgtatcagacgtgatcgatatcatggagaacctctacgccagcgaggagccagctgtctacgagccttcccttatgaccatgtgtcaggactcaaatcaaaacgatgagagatccaaatccttgctgctgtccggccaggaggtcccgtggttgtcatcagtccgatatggcactgttgaggacctgcttgcattcgccaatcatatcagcaatactgctaagcacttttatggtcagcgaccccaggagtctggaatcctgctcaatatggtcataaccccccagaacggccgataccagatcgacagtgatgttctgctgattccctggaagttgacatatagaaacatcggatcagattttatacccaggggagcattcggcaaggtgtacttggctcaggatattaagaccaagaaaagaatggcctgcaagcttatcccagtggaccaatttaagccctctgacgtggagatccaggcttgcttcagacacgaaaatatcgccgagctctacggcgctgtcttgtggggtgaaaccgttcatctctttatggaagctggtgaaggcggatcggtgctggagaaacttgagagctgtggaccaatgcgtgagttcgaaatcatttgggtgaccaaacacgtgctcaaaggactggatttcctccactccaagaaagtaatccatcacgatattaagccttctaacatcgtgttcatgagcacaaaggccgtcctggttgatttcggcctcagcgttcagatgacggaagatgtctattttcctaaggatttgcgtgggacagaaatctacatgtctcccgaggttattctttgcaggggacacagtaccaaggctgatatctatagcttgggggctacattgattcatatgcagactgggacgcctccctgggtgaagaggtatcctagatccgcctacccatcctacctctacataattcataagcaggcacctcctttggaagatatcgccgacgattgtagtcctggcatgagagagcttattgaagcgagccttgaacgtaatccaaaccatagaccgagagcagccgacttgcttaagcacgaagctctgaaccccccacgggaggaccaaccgagatgccagagcctggattcagcccttctggagagaaagcggttactgtcaaggaaggagctcgaattaccagagaacattgcagactcctcttgtacgggctctaccgaagagagtgaaatgctgaaacgacagcgttcactttacatcgacttgggagccctcgccggatacttcaacctggtccggggaccccctacactggagtatggttag

SEQ ID NO: 230987 - DNA, 1404 bp, Artificial Sequence
  Description of Artificial Sequence: Synthetic coding sequence
atggaatatatgagcacggggtcggacaacaaagaagagatagatttgttgataaagcatttgaacgtgtctgatgttatagacattatggaaaacttgtatgcttcagaagaacccgctgtctatgaacctagtctaatgacgatgtgtcaagactcaaaccagaatgacgaacgatcaaaatctttactcctgagcggacaagaggtgccctggctatcatccgttaggtacggaacagtcgaggatctgttagctttcgccaaccacatctccaataccgcaaaacatttttacggccagcgaccccaagagtccggcatcctcctgaacatggtgatcaccccacaaaatggaagatatcaaatcgattcggacgtcttactcatcccgtggaagctgacttatagaaatataggtagcgattttatccctcgaggcgctttcggcaaagtgtacctggctcaagatatcaagacaaaaaagcgcatggcctgcaagttgatccctgtggaccagtttaagcctagtgacgtcgagatccaagcctgcttcaggcatgaaaacattgccgagctgtacggagctgtcctgtggggtgagacagtccatctattcatggaagccggagagggtgggtcggtcctagaaaagctcgaatcctgtggcccaatgagggaattcgaaataatctgggtaacgaagcacgtcctgaagggcttggactttctccactccaaaaaggtcatccatcatgatattaagccttccaacatcgtgttcatgagtaccaaagccgtgctcgtggacttcggtctatccgtccaaatgacagaggatgtgtacttcccaaaggatctcagggggaccgagatctacatgtctccagaggtcatcctatgcagaggccatagtacaaaagccgacatttacagcctgggggcaaccttgatacacatgcaaacgggaacccccccttgggtcaagagataccctcgaagcgcgtatccatcctacttatatattattcacaagcaagcgccacccttagaggatatcgcggatgattgttcaccgggaatgagagagttgatagaggcgagcctcgaaagaaacccaaaccaccgcccaagagccgctgaccttttgaaacacgaggccctgaatccaccaagagaagatcagccgaggtgccaatcgctcgattccgctctgctggagcgaaagaggcttctgtccaggaaagaactcgaactgccggagaacatcgcagacagttcatgcactggcagcacagaggagagcgagatgctgaaacgacagagaagtctctacatagacctaggagcgttagccggttatttcaacctcgtgcgaggcccaccaacattagagtatggctag

SEQ ID NO: 230988 - DNA, 399 bp, Artificial Sequence
  Description of Artificial Sequence: Synthetic coding sequence
atggagtacatgagtaccggcagtgacaacaaggaggaaattgatctcctcataaaacatctgaatgtttctgacgtgatcgatatcatggagaacctgtatgcgtctgaggaacctgccgtttacgaacccagccttatgacaatgtgtcaggacagcaatcagaacgacgaaagatctaaatcgctgctgttgtccggacaggaggtcccttggctgagtagtgtccgttacgggacagtggaggatctactggcttttgctaaccatatctcaaacaccgcaaaacacttttacggacagcgaccccaggagtccggtatcttactgaacatggtgcggttcttccccatctcctgggtcctgtgcgcacaattaagctattgctctttcatatag

SEQ ID NO: 230989 - DNA, 1404 bp, Artificial Sequence
  Description of Artificial Sequence: Synthetic coding sequence
atggagtatatgagtaccgggagtgacaacaaagaggaaatcgacctgctgattaagcatctcaacgtcagtgacgtgattgatattatggagaacttgtacgcaagcgaagagcctgcggtttatgagccctcactgatgacaatgtgtcaggacagcaaccaaaatgacgagcggtcaaagtcgctgctgctatctggccaggaggtcccatggctgagttcagtccggtatggaaccgtggaagacctgctggcctttgcaaatcatattagcaacacagccaagcatttctacgggcagaggccacaggaatcagggattctgctgaacatggtcatcacgccacagaacggcagataccaaatcgacagcgatgtcctgttgatcccttggaaactgacatatagaaatattggatccgatttcatccctcggggagcctttgggaaggtgtacctggcccaggatattaagactaagaaacgcatggcctgcaaacttatcccagtcgaccagttcaagccgagcgatgtggagatccaagcctgcttccgccacgagaacatcgccgaactttatggtgctgtcctttggggagagacagtgcacctgttcatggaagccggagagggcggtagtgtgctggagaaactggagtcctgtggtcctatgagggaatttgagatcatatgggtaactaagcacgtccttaaaggactcgactttttacacagtaagaaggtgatccaccacgacatcaagcctagcaacatagtgtttatgtccaccaaagcggtgctcgtcgatttcggcctctccgtacaaatgactgaagacgtgtattttcctaaggacctgagaggcactgaaatttacatgtctccagaggtaatcttgtgccgcggacacagtacgaaagccgacatttattcattgggcgcaacgcttatccacatgcagaccgggaccccgccttgggtcaagaggtaccctagatcggcctacccgagttatctgtacataatccataagcaggcccctcctctagaggacatcgctgatgattgttctccagggatgcgcgagctgatcgaggcgtccctggagcggaatcctaatcaccggcctcgtgcagccgatcttctgaaacacgaagcattgaatccacccagggaagaccagccgcgatgtcagtccctggacagtgcactcctggagcggaagaggctgctgtccagaaaggagttagaactacctgaaaatatagccgattcaagctgcacaggctccacggaggagtcagaaatgttgaagagacagcggtcgctatatattgatctgggagccttggcaggttacttcaatttagtccgaggcccacccacactcgaatatggctag

SEQ ID NO: 230990 - DNA, 672 bp, Artificial Sequence
  Description of Artificial Sequence: Synthetic coding sequence
atggagtacatgtcaaccgggtccgataataaggaagagatagatctgttgataaaacacctgaatgtatcggacgtcatcgatatcatggagaatttgtatgcctccgaagaacctgccgtgtatgagccatcactcatgacaatgtgtcaggactccaatcaaaacgacgagaggtcaaagtcacttctgctgtccggtcaggaggtcccttggctgagctccgtacgttacggcactgtggaggacctattagcgtttgcaaatcatatatctaatactgctaaacacttctacggacagcgccctcaggagtccggcattctcctcaacatggtgatcacaccacaaaacggcaggtaccaaattgactcggacgttctacttatcccctggaagctgacatacagaaacatcggatctgattttattccccgaggtgcattcgggaaggtgtatctggcccaggacatcaaaacaaagaagcgtatggcctgcaaactgatcccagtcgaccagttcaagcccagcgacgtagagatacaagcgtgcttcagacatgaaaacatcgccgagctgtatggtgcagtgctgtggggcgagaccgtgcatctcttcatggaggccggtgaagggggtagcgttctggagaagctcgagagttgcggatag

SEQ ID NO: 230991 - DNA, 768 bp, Artificial Sequence
  Description of Artificial Sequence: Synthetic coding sequence
atggagtatatgtcaaccggatccgataataaggaggaaatcgacctcctgatcaagcaccttaatgtttccgacgtgatcgatatcatggaaaatctctacgcatctgaggagcctgccgtgtacgagcctagccttatgacaatgtgccaagatagtaaccagaacgacgaaaggagcaagagcctactgctgtcgggacaagaggtcccctggttaagtagcgtcaggtacgggacagtggaggatcttctggcctttgccaaccacatttctaatactgcaaaacatttctacggtcagagaccgcaagaatccggtatactgctcaatatggtgattacgcctcaaaatggcagatatcagattgactccgatgtgttactcatcccgtggaagttgacctaccggaacatcgggtccgactttattccaaggggggctttcgggaaagtgtacttggcacaggatattaaaacaaaaaagcgtatggcatgtaagctaataccggtggatcagttcaagcccagcgatgtggagattcaggcgtgttttcggcacgagaacatagctgaactatacggggcagtgctatggggagagacggtccatctgtttatggaggcaggcgaggggggtagtgtgctggagaaactcgagtcgtgtggcccaatgcgagagtttgaaattatctgggtcacaaagcatgtccttaaaggactagatttcctgcattccaagaaagtaatccaccacgatattaagtag

SEQ ID NO: 230992 - DNA, 573 bp, Artificial Sequence
  Description of Artificial Sequence: Synthetic coding sequence
tgagtcgaggatttgctggcctttgccaaccacatatccaacactgccaagcacttctacggccaacgtcctcaggagtctggaattctcctgaacatggttatcacaccccaaaacggcaggtatcagatagactcagatgttctgttgataccttggaagctcacctatagaaatatcggaagcgattttatcccaagaggcgcttttgggaaggtctatctcgcccaggatataaagacaaagaagaggatggcctgcaaactgatccctgtcgaccaatttaagccttctgacgtcgagatccaagcgtgttttcgacatgagaacatcgcggagctgtatggcgctgtgttatggggagagaccgtgcatttgtttatggaggccggagagggtggatccgtgctggagaagctcgagtcctgcggacccatgagagagtttgagatcatctgggtgaccaagcatgtgcttaagggtcttgacttcctgcactcaaaaaaagtcatacaccacgacatcaaaaggaagtatctctggacttacacctttctcgctcagcgggactag

SEQ ID NO: 230993 - DNA, 1404 bp, Artificial Sequence
  Description of Artificial Sequence: Synthetic coding sequence
atggaatatatgtctactgggagcgataacaaggaggaaattgacttgctgatcaaacacctaaacgtcagtgatgtgatagacatcatggagaatctgtatgcctcagaagagcctgccgtctatgaacctagtctgatgacaatgtgccaggatagtaaccagaatgatgaacgttccaagtcactcctactaagtggacaggaggtaccatggctcagctccgtgcgttacggtacagttgaagacctgttggcgttcgccaaccacatttccaacacggctaagcatttttatggccaaagaccccaggagtctggaatcctcctgaatatggtgattacacctcagaacggtaggtaccagatcgacagtgacgtcctccttatcccctggaagctcacatatagaaatatcggttccgatttcatcccccgtggtgcctttggaaaggtgtacctagctcaagacattaagaccaaaaaaagaatggcttgcaagttgatcccggttgatcagttcaagcctagcgatgtcgagattcaagcatgtttcagacacgaaaacattgcagaactatacggtgcggtgctctggggagaaaccgtccatctgtttatggaagctggtgaggggggttctgtgctcgaaaaactggagagctgtggccctatgagagaatttgagattatctgggttaccaaacatgtactcaaggggttagattttctccattcaaagaaggttatccatcatgacatcaagccaagcaacatcgtgttcatgagtactaaggcagtgttggtagatttcggtctatcagtccagatgacagaggacgtgtatttccctaaggatctgagagggaccgagatatatatgtctccggaagtcatcctttgccgcggtcactcgaccaaagctgatatatatagcctaggagctaccttgatccatatgcagacaggcactcccccttgggtgaaacgctacccgagatctgcgtatccatcatacttatacataatccataagcaagctccaccactggaggatatagccgacgactgttctcccggtatgagggaactgatagaggcctctcttgagagaaacccaaaccacagacctcgcgcagccgacttacttaagcatgaagcactgaaccctccaagagaagaccagcctaggtgccagagtcttgatagtgcgctgcttgagcggaaacgcctgctatcaagaaaggagttagagttgccggagaatatcgccgactcctcatgcacgggctctaccgaagaatccgagatgctaaaacgacaaagaagcttgtacattgaccttggcgctctagccggttatttcaacctcgtcagggggcctcccaccctggaatacggctag

SEQ ID NO: 230994 - DNA, 3357 bp, Artificial Sequence
  Description of Artificial Sequence: Synthetic coding sequence
atggagccttcccgagccctccttggatgcctggcctccgccgctgcggctgccccaccaggtgaagatggggcaggcgcaggggctgaagaggaggaggaagaggaagaggaagcagccgctgccgtcggccctggcgaattggggtgtgatgcacctcttccttattggacagcagtcttcgaatacgaggctgccggagaggacgaactgacattgcggctgggcgacgtggtagaggttttgagcaaggattcccaggtttccggagacgagggctggtggacaggccagctcaaccagcgagtggggatttttccctccaactacgttactcctcgatccgcctttagctcacggtgccagccgggaggggaggatcccagctgttatccacctattcagctgctggagatcgattttgccgaacttacattggaggagattattggaataggaggattcggaaaagtgtatagagccttctggatcggagacgaagtggccgtcaaggcggctcgacacgaccccgacgaggatatttctcaaacaatcgagaatgtaagacaagaagcaaaattgtttgccatgcttaagcatcctaacattatcgccctgcgaggagtttgcctcaaggagcctaatctgtgcctggttatggaatttgctagagggggacctcttaaccgcgtgctgtcaggtaagcgcattcccccagacatccttgtcaactgggcggttcaaattgcacgcggtatgaactacttgcacgatgaagctattgttcctatcattcacagagacttgaagtcatccaatatcctcatccttcagaaagtggagaacggcgacttgtccaataagatacttaagatcacagattttggcctcgctagggaatggcatcgaacgaccaaaatgtccgccgctggtacatatgcctggatggctccagaagtgatcagagccagcatgttcagcaagggcagcgacgtctggtcatacggggtgctgctttgggaactgcttactggtgaagttccctttcgaggcattgacggcctggccgtggcctatggagtggcaatgaacaagctagcacttccaatccccagcacatgtcccgagccgtttgccaaactgatggaagattgctggaacccagatccgcactctaggccatccttcaccaacattctggatcaactgaccacgattgaggaaagcggtttcttcgaaatgcccaaggacagttttcactgccttcaagataactggaagcacgaaattcaggaaatgtttgatcagctgagagccaaggagaaagagcttcgcacctgggaagaggagttaacccgcgctgcccttcagcagaagaaccaggaggaactgctcagacgccgagagcaggaactggccgagagagagatcgacatactggaacgagagttgaatattatcattcatcagctgtgccaggagaaacccagagtgaaaaagcgaaaaggcaaattccgcaaatctcgactcaagctcaaggacggcaaccggatatcactgccctcagacttccagcacaaattcaccgtgcaggcttctcccacaatggataagcgaaagagcttaatcaacagccggtcctccccccctgcctcacccaccattatcccccgactgcgagcgatacagctgacaccaggcgagagcagtaagacctgggggagatcctccgttgttccaaaagaagagggagaagaagaggagaaaagggcacccaagaagaaaggtaggacgtggggtccaggaacgctcggccagaaagaactggcgtcgggagacgagggctctccacagcgcagggagaaggcaaacggcttatctaccccctccgaaagtccgcacttccacctgggcctgaagtcacttgtcgatggatataagcaatggagctccagcgcccctaatttggtgaaggggccacgtagctcaccagccttgcccggattcacctcactgatggaaatggctctcttagcagctagctgggtagttcctatagatatcgaagaagacgaagacagcgaagggcctggcagcggcgagagccgtttgcagcactcccccagccagagttatctctgtatcccttttccgcgaggagaggacggcgatggaccttccagtgacggcattcacgaagaaccaactcctgtgaattcggccacatcaactccacagttgacccccacgaacagcttgaagcgaggaggagcccatcatagacgctgtgaggtcgcattgttaggttgtggcgcagtgttagcagcgacgggcctcggcttcgacctgctggaggccggtaaatgccaactgctgcccttagaggagcctgagcccccagccagggaagagaaaaaaagacgggagggtctgttccagcggtcctccagaccaagaagaagcacaagccccccaagccgtaagctgttcaagaaggaggagccgatgcttctgctcggcgatccttccgctagtctgaccttgctgagtctgagctccatatcagaatgtaatagcaccagatcgctgttgcggtctgattctgatgagattgtcgtatacgagatgcccgtgtctccagtggaggccccaccattgagcccatgcactcataacccactggtgaatgtccgggtcgaacgcttcaaacgggacccaaaccagtccctcacacctacacacgtgaccctaacaactccctctcaacctagcagtcaccgaagaaccccaagcgatggggcactgaagcccgagaccctgctggcctccagaagtcctagctccaacggcttgagcccatcacctggcgcaggcatgcttaaaaccccctcaccaagtcgcgatcctggggagttccccagactcccagatcctaatgtcgtatttccgcctacccctaggcgatggaatacacagcaggattcaactctcgagcgtccaaagacattggaattcctgccccgtccacgtccctccgccaatcgccagcgcctcgatccctggtggtttgtgagcccatctcacgccagatccacttctccagcaaactccagctccaccgaaactccctcaaacctcgacagctgcttcgcttcttcgtccagcacggttgaagagaggcctggactgcctgccctattaccatttcaagcaggaccgctacctcctaccgagcgcaccctactggacctggacgctgagggacagtcccaggattccactgtgcctctgtgccgcgctgaactcaacacacaccgaccagctccctacgagatccaacaagaattttggagctag

SEQ ID NO: 230995 - DNA, 2463 bp, Artificial Sequence
  Description of Artificial Sequence: Synthetic coding sequence
ctggtgctgatcctgcagaaggtggagaatggcgacttgtccaataaaattctcaaaatcaccgacttcggactggccagagaatggcacaggacaacaaaaatgtccgctgccggaacgtatgcctggatggcgcctgaggtgattcgcgcatccatgttctccaaaggcagcgatgtgtggagctatggggtgttgctctgggagctcctcacaggcgaagtgccatttcggggtatcgacggcctggccgtcgcctatggcgtggctatgaacaagctggcactgcccataccttctacatgccctgagcctttcgccaagctcatggaggattgttggaacccggatccgcactctcgacctagcttcacaaatatactggaccagctgaccacaatagaggaaagcggattctttgaaatgcctaaggacagttttcattgcctccaggacaattggaaacatgagattcaggaaatgttcgaccaattaagagcaaaagagaaagaactccgaacctgggaggaagagctcacgcgagcagctctgcaacagaaaaaccaggaggagttgctgagaaggcgcgaacaagaacttgctgagagggaaatcgatatactggaaagggagctgaacattattattcatcagttgtgccaggaaaaaccaagagtcaagaagaggaagggtaaatttcgcaaatctcgcctgaagctgaaagacggtaataggatctccctgccttccgacttccaacataaatttactgtccaggcgtcaccgacaatggacaaaaggaagtcccttattaacagtcgcagtagtccccctgcctccccaacaattattccccgacttagggctattcaactaacacctggcgaatccagcaaaacctggggccgaagttccgtagtaccaaaggaggagggggaggaggaggagaaacgagcccctaagaaaaagggcaggacctggggcccagggactctcgggcagaaagagttagcgagcggcgacgaaggcttgaaaagtctggtcgacggctacaaacagtggtcttccagcgcacccaatctcgtcaagggacccaggagttcccctgctcttccgggtttcacctccctgatggagatggcttgttttagctcgactttggtgatttttacggaagacgaggactccgagggcccaggctccggagagtctcgactgcagcactctccctcccagtcatacctctgcatcccctttccaaggggtgaggatggcgacggaccgtccagcgatggtatccacgaggagcccactcctgtgaacagtgccacctccacccctcaactgacccccaccaactccctgaagagagggggagctcatcacaggcgctgtgaggttgctctgctcggttgcggagcagtgttagcggcaaccggcttgggattcgatcttttagaggccggtaagtgtcaacttctaccccttgaggaacctgagcctcctgcccgagaagagaaaaagagaagagaggggctctttcagcgctcgtcacgaccacggcgatctacgagcccaccatcgcgcaagctcttcaagaaggaagaacctatgttgctgctgggtgacccgtccgcgagtctgaccctattgtcactctcgagcatatccgagtgcaacagcaccaggagccttctcaggtccgatagcgatgaaatagttgtgtacgagatgccagtgtcacccgtggaggcgcctcctttatccccctgcacacacaaccccctggtgaacgtgcgcgtggagcggttcaagcgtgaccccaaccaaagcctcacacctactcatgtcaccctgaccacacctagtcagccatcctctcaccgtagaactccaagcgacggcgcactaaaacctgaaacactgctggcgtcccggtcccctagctcgaacggactgagccctagcccgggagctggaatgctgaaaacaccgtctccttctagggacccaggggaattcccaaggctgccagacccgaacgtggtctttcctcccacacccagaaggtggaacacgcagcaggacagtacactggagcggccaaaaacactggagtttctgcccagacccagaccatctgccaaccgacagaggcttgatccttggtggtttgtgagtccttcgcatgcgagatccacctccccagcaaattcatccagtacagagacgccttctaatcttgacagttgcttcgcgtcatcaagctctacagtggaggagagaccaggattacctgcgctgctaccttttcaagctggccctctgccgccaactgagcgcaccctacttgatcttgacgccgagggccagtcccaggatagtaccgtgcccttatgccgagctgagctcaacacccacagaccagctccatatgagatccagcaggaattctggtcatag

SEQ ID NO: 230996 - DNA, 3315 bp, Artificial Sequence
  Description of Artificial Sequence: Synthetic coding sequence
atggagccctcaagagcactgctgggatgcctggctagcgctgctgccgctgctcctcctggggaggacggtgcaggggcaggggctgaggaggaggaagaggaagaagaagaagccgctgcagctgtaggacctggtgaattgggatgtgacgctccactgccgtactggaccgcagtgtttgaatacgaggccgcaggagaggacgagctgacactgaggctgggcgatgttgtagaggtgctgtctaaggattcacaagtgtcaggagatgagggctggtggacaggacaactgaaccagcgggttggcatcttcccttcgaattatgtgactcctaggagcgctttttctagtaggtgtcaacctggaggcgaggacccgagctgctatccccctatccagctgctggaaattgattttgcagagttgacgctggaagagataattggaataggtggcttcggtaaagtgtatcgtgccttttggataggggacgaagtggcagttaaggccgctcgccacgatcccgatgaagacatctcgcaaaccatagagaatgtcaggcaagaagccaagttgttcgcgatgctgaagcatcctaacattatagccctacggggagtgtgtttgaaggagcctaacttatgcctggtgatggaatttgcccgaggcggacccctgaatcgcgtactgagtggaaaacgcatcccgcctgacattctcgtaaactgggcagtgcagatcgcacgcggaatgaattaccttcatgacgaggctatcgtgccaatcatccacagagatctgaagtcaagtaatattctcattttgcagaaggtcgagaatggagatttgtccaacaagattcttaagatcactgacttcggactcgccagagaatggcaccgcaccacaaaaatgtcagcggcaggcacctatgcctggatggccccagaggtcattcgtgcgagtatgttttctaaaggctctgacgtttggtcttacggcgtccttctttgggagctgctcacaggcgaggtgccctttcgcggaatcgatggattggcagtggcgtacggggtagccatgaataaactggccctcccaattcccagtacctgccctgagccatttgcaaaactgatggaggactgctggaaccctgacccacacagtaggccttcattcacaaatatattggatcaactcacaactatcgaagaatctggctttttcgagatgcccaaggactccttccactgtctgcaagacaactggaaacatgagattcaggaaatgtttgaccaacttcgagctaaagagaaagagctgcggacatgggaggaagagctgacccgtgccgctctgcagcagaagaaccaggaggaactcttgcgcagacgagagcaggaacttgccgaacgcgagattgatatcctagaaagggagctcaatattatcatccaccaactgtgtcaggagaaacccagagtaaagaagcgaaagggtaagtttaggaaaagtcggctgaaactcaaggatggcaaccgcatatctctcccctctgactttcagcacaagttcacagtccaagcatcaccgactatggataagcggaaatctctcatcaacagtcggagttccccacctgcaagccccaccataatacctcgactgcgggcaatccagctcacacctggggagagcagtaagacatggggacggtcgtcagtggtccccaaggaggaaggagaggaagaggaaaagcgcgcacccaaaaaaaagggtagaacgtggggcccagggacactcgggcaaaaggagctggcgagcggagatgagggctcgcctcagagacgggagaaggccaatggattatctactccctctgagtccccccactttcacctgggcctgaagtctctcgtcgacggatataagcaatggtccagcagcgccccaaacctggtgaaagggcctcggagctctcccgctcttcccggattcacctcacttatggaaatggaggacgaggactcagagggacccggatccggcgagtcccgattgcagcattctccgtcccagagctacctctgtatccccttcccccgtggcgaagatggtgatggcccatcatctgacggaatacatgaggagcctacaccagtaaattccgctacgagcaccccacagttgacgcctacaaatagcctgaagcgcggaggcgcacatcatcggcgatgcgaggtggccctcctgggatgcggagccgttctggccgctacgggcttggggttcgacctgctcgaagccggaaagtgccagctgctcccattggaggaacctgaaccacccgctagagaagagaaaaaacgcagagaaggcctctttcagagaagctcaaggccaaggcgcagtacaagtccacccagtcgtaagctctttaagaaggaggaaccaatgctcctgttaggagatccaagcgcctcgcttaccctgctgtcgctgtcgagcatcagtgaatgtaatagcacaagaagcctactgcgcagcgactcggacgaaatcgtggtgtacgaaatgcccgtctctcccgtggaggctccaccgttgtcaccatgtacgcacaaccccttggtgaacgtcagagtcgagaggttcaagcgggaccctaaccagagcttgaccccgactcacgttacccttaccaccccgtcccagccttcttctcacaggcggacccctagcgacggggctctgaaacccgaaacattgctggcttcacggtcaccctcttcaaatgggttgagtccaagccccggagctggtatgttgaagaccccctcaccttcaagggaccctggcgagttcccacggctcccagaccctaatgtagttttccccccaactccgagacgttggaacactcagcaggattccacactggagagacccaagacacttgaattcctgcccaggccacgcccttcagccaacaggcagcgcctggacccttggtggttcgtaagcccctcacatgctaggtcaacttctcccgcaaattcaagctccacagaaacgccctccaaccttgacagctgcttcgccagttcctccagcactgtcgaggaacgaccaggactccctgccctccttcccttccaggccggtcccttgcctcccacagagcgcaccctgctggatctggacgcagaaggccagtcacaagactctacagtccccttgtgtcgagccgaattaaatacccaccggcctgccccatatgagatccagcaggaattttggtcatag

SEQ ID NO: 230997 - DNA, 1005 bp, Artificial Sequence
  Description of Artificial Sequence: Synthetic coding sequence
atggccctgcggtggggcatcgtgtccgtgggactgataagttctgactttaccgctgtactacagaccctccctaggagcgaacatcaggttgtggctgttgctgcccgagacttgtctcgcgcaaaagagttcgcccagaagcacgatatccctaaggcttatggtagctatgaagagctggccaaggatccaagcgtggaagtcgcttacataggcacacaacatccacagcacaaagccgctgtgatgctctgcttggctgccggaaaggccgtactgtgtgagaagcccaccggtgttaatgcagctgaagtgagagagatggtggctgaggctagatcacgcgcactgtttctgatggaggccatttggaccagattttttcctgctagtgaggccctgagatctgttctcgcccagggcaccctgggtgacctgcgggtggcccgagctgagttcggtaagaacctgatccacgtcccgagggccgtcgatcgtgctcaggccggtggagctctccttgatatcggcatttactgtgtgcaattcaccagcatggtcttcggaggccagaagcctgaaaagatctctgtcgtagggagacgccatgagacgggggtcgatgacaccgtcaccgtgcttctccagtacccaggtgaggtgcatgggtcgtttacttgctcaataacagtacagctgtccaacactgccagcgtctcaggaaccaagggcatggtgcagctgctgaacccgtgctggtgtccaactgaactggtcgtcaaaggcgaacataaagagtttcccctgccaccggttcctaaagattgtaattttgacaacggggcaggcatgagttacgaagcaaaacatgtgtgggagtgcctcaggaaagggatgaaggagagtcccgtgatcccactctcagagagtgaactattagccgatatcctggaggaggtgcgcaaagcaattggggtgacctttccccaggacaaaagatag

SEQ ID NO: 230998 - DNA, 2466 bp, Artificial Sequence
  Description of Artificial Sequence: Synthetic coding sequence
atggatgtcgtggatcccgatatcttcaatagggatcccagagaccactacgatctgctgcagcgcctagggggtggcacctacggggaagtgtttaaggctagagataaagtcagtggcgatctggtcgccctcaagatggtgaagatggaaccagacgacgacgtgtcaaccctccaaaaggagatcttgatcctgaaaacatgtaggcacgccaacatcgtcgcttatcacggatcctatctgtggctccagaagctctggatctgcatggaattctgtggagccggaagcctgcaggatatttaccaggtcactgggagcctgtctgaacttcagatctcctatgtctgtagagaggttcttcagggcttggcctacctgcattcacagaaaaagatacaccgcgatattaagggagccaacattctgatcaacgacgcgggtgaggtgaggctcgcagatttcggcattagtgcgcagataggcgctactctggctaggcggttaagcttcattggcaccccttactggatggcccctgaggtggctgcagtggcgcttaagggaggctataatgagctctgtgacatttggagcctcggcattacggccattgagttggccgagttacagcctcccctcttcgatgtccaccccctgcgcgttctctttcttatgaccaaatccggctaccagccccctcgactgaaagagaagggcaagtggagcgctgcgttccataacttcatcaaggtgaccttaacaaagagtcctaagaagcgtcccagcgcgacaaagatgctatcacaccagttggtctcacagcctggtcttaatcgtggactgattttagatctattggacaagctgaagaatcctggaaagggacccagcattggagatattgaggatgaggaacccgaacttcctcccgctatccctagacgcatcagaagcactcaccgctcttcttccctgggtatccccgacgcagattgctgcaggcgccatatggaattcaggaagttgaggggaatggaaaccaggccccctgcaaatacagccagacttcagccccctagggacctgaggagcagctcgcctcggaagcaacttagtgaatcatcagacgatgattacgacgacgtagacatccccacacccgcagaagacactcctcctcctcttcccccaaaacctaagttccgcagccccagcgacgaaggaccaggctccatgggcgacgatgggcagctctctcctggggtcttagtgcgctgcgcgagcgggccaccacccaatagccctcgtccgggacccccaccaagtacgagttctccccacctgaccgcccacagtgagccaagtctgtggaaccctccctcgagggaactggataagcccccactgttgccacccaagaaggagaaaatgaagcggaaaggctgcgctcttttggtcaagctctttaacggctgcccactgaggattcactccaccgcagcttggacccatccctctaccaaagaccagcacctacttctgggcgctgaggaggggatcttcatcctgaatcgaaacgatcaggaggcaacccttgaaatgcttttcccttcgagaacaacttgggtgtattccattaataacgtcttaatgagtctgagcggtaagaccccacacttgtatagccactcaatactcgggcttctggaacgtaaagaaacaagggctggtaacccaatcgcacacattagtcctcataggctcctggcgaggaaaaatatggtatctactaaaatacaggataccaaggggtgtcgagcctgttgtgtagctgaaggggctagttccggtggtccattcctttgcggcgcactggaaacgtctgttgttctgttgcagtggtaccagccaatgaacaagtttctcttggtaaggcaggtcctgttcccattgccgacgcccctgtccgtatttgcactgttgacgggccctggaagcgaacttccagctgtatgtatcggcgtgtctcctgggagacctggtaagagcgtcctatttcacactgtgcgttttggggctcttagttgttggctcggggagatgagcaccgagcaccgtggtcccgtccaggtgacccaggtcgaggaggatatggtgatggttctcatggacggcagtgttaagctggttactcctgagggttcccccgtgagaggtctcagaacgccggaaattcctatgaccgaggccgtggaggccgtggctatggtgggcggacagcttcaagctttctggaaacacggcgtccaggtgtgggccctcggctctgaccagctgctccaggagttgcgggacccaaccctgacatttcggctgcttggctctccccgtccagtggtggtggagaccagaccagtggacgacccgacagcaccctctaacctctacattcaagaatag

SEQ ID NO: 230999 - DNA, 720 bp, Artificial Sequence
  Description of Artificial Sequence: Synthetic coding sequence
atggagtttaggaaacttcgaggtatggagacacgccctccagctaacacggcacgccttcagcctccacgtgatttacggtcgtcttcgccacgtaaacagctgtctgagtcctctgacgatgattacgatgatgtggacatcccaacccccgcagaggatacaccccctcctctgccaccgaagcctaaattccggtctcccagtgacgagggacctgggtcgatgggcgacgacggtcaactttcccccggagtgctagtgcggtgcgcttccgggccacccccaaactctcccagaccagggcctccaccctccacgagttcccctcatcttaccgcacactccgagccatccctctggaacccgccatcccgagagctggataagccacccctgttacctcccaagaaagaaaaaatgaagaggaaaggatgtgcccttctggtgaagctgttcaacggctgccccctccgtatccactccaccgctgcatggacacatccctccaccaaagatcagcatcttctccttggggctgaggaggggatatttatcctcaaccggaacgaccaggaggccacgttggagatggagcgccctcccacttgcatcctgatcgcatctctggcttgttggaatggtaaacgacccgaacaagagacccccagtttaacactggcccctactgcgtactggcagggtacttccagccagtag

SEQ ID NO: 231000 - DNA, 2502 bp, Artificial Sequence
  Description of Artificial Sequence: Synthetic coding sequence
atggatgtagtcgacccggatatcttcaaccgggaccctagggaccattatgatttgttacagaggttaggaggtggaacatacggagaggtattcaaggcaagagataaagtgtcaggtgatctggttgccctgaagatggttaagatggaacctgatgacgacgtgtctacattacagaaggaaatccttattctgaagacttgcagacacgccaatatagtggcataccacgggagctacctctggctgcagaaactatggatctgtatggagttctgcggggcaggatctcttcaggacatttatcaggtgacaggttccctgtctgagttacaaattagctatgtgtgccgcgaagtgctacaaggactggcttacctacactcccagaagaagatacatagagatattaaaggggcaaatatcctaatcaatgacgctggcgaggtgaggctggccgattttggaatatctgcccaaattggagccacactcgctagacgcctgtcattcattggcacaccttattggatggccccagaagtggccgctgtcgccctcaaggggggatacaatgagctttgcgacatctggtctcttggcattaccgctatcgaactcgccgagctgcagccgccattatttgacgtccaccctttacgagtactttttctaatgactaagtccgggtaccagcccccaagattaaaagagaaaggcaaatggtcagccgcatttcacaatttcattaaagtgaccttgacgaagtctccaaaaaaacggccttccgctaccaaaatgttgtcccatcagctggtctcacagccaggccttaaccggggtcttattctggatctgcttgataaactcaagaaccccggtaagggcccatctatcggggacatcgaggacgaagaacctgaactgcctcccgctattcctaggcggattaggagcacccacagaagctcctccttaggcatacccgatgctgattgttgccggcgtcatatggaattccggaagctgcgagggatggaaacccgtcctcctgcgaatacagcccgactccagcctcctagggaccttaggtctagctcccctcggaagcaattgagcgaatcatctgatgatgattatgatgacgtcgatatccctacccctgctgaagatacacccccaccactgccccctaagcctaagttccggtccccctctgatgaaggacccggtagcatgggcgacgacggacagctgtcgccaggggtgctggtaagatgcgcttccgggcctccacctaactccccgagacctggccctccccctagcacctctagtccccacctgactgctcatagcgagcctagcctctggaacccaccttcgcgcgagcttgataagccaccactgctgcctcccaagaaagagaaaatgaaaagaaagggctgtgcccttctggttaaactgttcaatggttgtcccctgagaatccattccaccgcggcttggacacatccttctactaaggaccagcatcttctgcttggggctgaggaggggatattcatcctcaacagaaacgatcaagaagctacactggagatgctgtttccctctcgaactacatgggtgtatagcataaataatgtcctgatgtcgctctccggcaagacgccccacctgtatagtcacagcattcttggtttgctggagcgcaaagagacgagagccggaaacccaatcgctcacatctccccacacaggctgctcgcaaggaaaaacatggtttctactaaaatccaggacaccaaaggctgcagagcatgctgcgtggcagagggggcttcaagcggcggacccttcttgtgcggcgctttagagactagcgtcgtgttgcttcagtggtatcaacccatgaataaattcctccttgtaagacaagtgctgtttccactgcctactcctctctccgtttttgccctactgaccggtcccggatcggagctaccggctgtgtgcataggagtttctcccggtcgccctgggaagtcggtcctcttccacacggtccggtttggtgctctgtcatgctggctcggcgagatgtctactgagcatagggggcctgttcaggtgacccaggtggaagaggatatggtgatggtgctgatggacggttcggtgaaactggtgacaccagagggaagtcctgtccgtggtcttagaacccccgagatcccaatgacagaggccgtggaagcggtggccatggtcggtgggcagctacaggcattctggaagcacggagtgcaggtgtgggccctgggcagcgaccagcttttacaggagttgcgcgatccaacattgacttttcggctactgggatcaccgaggctggagtgcagcggcaccatatctccccactgtaacttacttcttcctggatcgtccaactcgcccgcatcagctagtcgcgtggctggtattaccggcctgtag

SEQ ID NO: 231001 - DNA, 2463 bp, Artificial Sequence
  Description of Artificial Sequence: Synthetic coding sequence
atggcattgctccgagacgtgtcattgcaggaccctagagaccgctttgagctgctgcagagggttggggcaggaacttatggcgacgtctataaagctagagacacagtgacatccgagttggccgctgtgaaaatagtgaaactcgaccccggtgatgacatctcttcattacagcaggaaattaccatattaagagagtgtagacaccccaacgtcgtcgcatacatcggttcttaccttcggaatgatcgcctgtggatctgcatggagttttgcggcggtggaagcttacaggagatctaccacgccactggacctctggaggagcggcagattgcttatgtctgtcgagaagctctcaagggcctgcatcatctccactcacaagggaagatccatcgggacatcaagggcgctaacctgttgctgaccctacagggtgacgtcaagctggccgattttggcgtctcaggcgagttaacagcctccgttgcgaaaaggaggtctttcatcggaactccttattggatggcaccggaggttgccgcagtggaacggaaaggcggatataacgagctgtgtgatgtgtgggccctgggtatcaccgccatcgagctcggcgagttacagcctccactcttccacctgcaccctatgcgcgcactgatgctgatgtccaaatccagctttcagccccctaagctgcgggataagaccaggtggactcagaattttcatcatttcctgaagctggccttgactaagaatcctaagaaacgacccactgccgagaagctattgcagcacccctttactacccagcagctgccgagagctctcctgacacagctgttggacaaggcttccgatccccacctgggaacccccagtccagaagactgcgagctggagacatatgatatgtttccggacactattcacagccggggtcagcatggacccgctgaaagaacaccctcggagattcagttccaccaggtgaaatttggcgctccccgtagaaaagagactgaccccctaaacgaaccttgggaggaagagtggacactactaggaaaagaagaacttagcgggagcctgcttcagagcgtgcaggaagctctcgaggagcgaagcctcacaattaggagcgcctcagagttccaggaacttgattccccggatgatacgatgggtactatcaaacgcgcaccgtttcttggacccctcccaaccgacccacccgcagaagagcccctgtcctcaccgccaggtacactaccccctcctcccagtggacccaactcctcaccacttctcccgacagcttgggctactatgaagcaaagggaggatcccgaacgatcatcatgtcacggtctcccaccgacacctaaagtccacatgggggcatgtttctccaaagtgttcaatggttgccccctgagaattcatgcagccgtgacctggatccaccctgtcacccgggaccagtttttagtggtcggcgctgaggagggcatctacacattaaatctacacgagttacacgaagacaccctggaaaagctcatatcccaccggtgcagctggctgtattgtgtcaataacgtcctacttagtctatctgggaaatctacgcacatttgggcccacgatctgcccggactgtttgaacaaagaaggttgcagcagcaggtcccactctcaatcccaacaaacagactaacccagcgaattattcctcggagattcgcactgagtactaagatccctgacactaaaggatgtctgcagtgtagagttgtgcgaaatccttacacaggtgccacctttctcctcgctgcccttccaacatctctcctgctcctacaatggtatgagcctctgcagaaatttttgctgctgaagaattttagctctcccctgcctagcccggcaggaatgctcgagcccctggtgctggacggcaaagaactgccacaggtctgtgtcggtgcagagggacctgaagggccagggtgcagggtactgttccacgtacttccactagaggcgggactgacccccgacattctgattccaccagaaggcattccgggaagtgctcagcaagtgatccaagtggaccgcgatacgatcctggtcagcttcgagcgctgtgtgcgcattgtgaatatgcagggagagcccactgccactctcgcgcctgagcttacattcgactttcccattgagactgtagtatgtcttcaggactcagtgctggcattttggtctcatggtatgcagggacgcagtctggacactaatgaggtgacacaggaaattactgatgaaacgaggatctttagggtgctgggcgcacatagggatattatcttggagtccatcccaaccgacaaccccgaagcacactcaaatctgtacattctgacaggacaccagtcgacttattag

SEQ ID NO: 231002 - DNA, 2541 bp, Artificial Sequence
  Description of Artificial Sequence: Synthetic coding sequence
atggaggcacccctccgtcccgcagccgatatattgagaagaaatccgcaacaggattatgagcttgtgcaaagggtgggcagtggcacctatggagacgtatataaagcacgcaatgtccataccggagagctggctgcagtgaagattattaagcttgagcccggtgatgatttctctctgattcagcaggagattttcatggtgaaggaatgtaaacattgtaatatcgtggcatactttggatcctacttgtctcgggagaaattgtggatctgcatggagtactgcggcggaggctctttgcaggatatttaccacgtcacaggcccactaagcgagctgcagatcgcttacgtgtgtagagaaacgctgcaggggttagcctatctgcatactaagggcaaaatgcacagagacataaagggagccaatatcctgttgaccgatcatggggacgttaaactggccgattttggtgtggccgctaaaatcacggctactatagccaagcgcaagagtttcatcgggactccctactggatggcccctgaagtcgcagctgttgaaaagaatggcggatataaccagttatgtgatatttgggccgtcggtattacagccatagagttgggagagctgcaaccccctatgtttgacttacaccccatgagggctctgtttctgatgtctaagagcaacttccagccgccaaaactgaaggacaagacaaaatggtcaagcaccttccacaactttgtgaagatagctctaaccaagaaccctaaaaagcgcccaaccgctgaacgccttctcactcacacatttgtcgcccagccaggcctcagtcgggcattagctgtggaactgctcgacaaggtcaacaatccagacaaccatgcccattacaccgaagctgacgacgacgactttgaaccacacgccattattcggcacaccatacggagtactaaccgcaacgcgagggctgagcgcacagcatctgaaatcaattttgacaagctccagtttgaaccacccctgaggaaggaaaccgaggctcgcgacgaaatgggtctgtcgtccgaccctaacttcatgttgcagtggaacccattcgttgacggtgcaaacaccggaaagtctacgtccaagagggccatacccccacccctccctcccaaaccccgtatcagcagttacccagaggataattttccggacgaggagaaggcttctacaatcaaacactgtcccgactccgaatcaagagcccctcagattctgcgcaggcagtcaagtccttcatgcgggccagtcgcagaaacctcctcaatcggtaacggggacggtatttctaaacttatgtcagagaatactgagggtagcgcacaggctcctcagctcccccgtaaaaaggacaagagagacttccccaaaccggctatcaacggcctaccacctacccccaaagtcctcatgggggcatgtttttcgaaagttttcgacggttgtccgctcaaaattaattgtgcaacaagctggattcatccagacacgaaagaccagtacatcatcttcgggacggaggatgggatctacaccctgaacctgaacgaattgcacgaagccactatggagcagctctttccgcgaaagtgcacctggctgtacgtaatcaacaataccctgatgtctctgtctgtgggaaaaacgtttcagctgtactcacacaacctgatcgcgctattcgagcacgccaagaagcccggacttgctgctcacattcaaactcatcgcttcccggaccggattctgccgagaaagtttgcgctcacaaccaagattcccgatacaaagggctgccataagtgctgcattgttagaaacccctatactgggcataagtacctgtgcggggcattacagagtgggattgtactcctccagtggtatgagcctatgcagaaattcatgcttatcaaacattttgacttccccctgcctagcccgctgaacgtgttcgaaatgctcgttattcccgagcaagaatacccaatggtgtgcgtcgctatctccaagggtaccgagagcaatcaggtagttcagtttgagacaattaacctgaatagtgcctcaagttggttcacggagattggcgctggctcgcaacagttggacagcattcatgtaactcagcttgagcgcgacactgttctggtgtgtttagacaaatttgttaaaatcgtcaatcttcagggcaagcttaaaagcagcaagaaactcgcttcagagctctctttcgattttaggatcgagtccgtagtgtgcctgcaggactcagtgctggctttctggaagcacgggatgcaggggaagagtttcaagagcgacgaggttactcaggaaatatcagatgagactagggtcttccggttgctgggctccgatcgggtggttgtgctggaatccagaccaaccgagaatccaactgcacactcaaatctctatatcctcgcgggtcatgaaaatagctactag

SEQ ID NO: 231003 - DNA, 699 bp, Artificial Sequence
  Description of Artificial Sequence: Synthetic coding sequence
atggcaactgcagagagccgggcactgcagttcgccgagggggcagcgtttcctgcttaccgagctccacacgctggaggggctctactgcctcccccttcaccagccgcagccttgcttcctgctccccctgcgggtcccggtcctgccacctttgctggctttctggggcgtgatcccggacctgctccccctcccccagcatccttaggttcgccggctccccctaagggggcagctgcacccagcgcctcccagagaaggaagaggacaagtttttccgccgaacaactccagctgctggaactagtcttcagacgcactcgctaccctgacatacacctccgcgagaggctggctgcacttactttattgcccgagagcaggattcaggtctggtttcagaatcggagagcgaagtcacgcaggcagagcggaaagagctttcagcccttggccagaccagagattatcttgaatcactgcgcccctggaaccgagacaaaatgtcttaagccccagcttcctctggaggtcgacgtcaattgcttgcctgagcctaacggtgtcggtggtggcatctcggattcatcatcacaggggcagaatttcgagacatgttctccactaagtgaagacatcggatctaaattagatagttgggaggaacatatattctcagctttcggtaacttttag

SEQ ID NO: 231004 - DNA, 723 bp, Artificial Sequence
  Description of Artificial Sequence: Synthetic coding sequence
atggctaccgctgaatccagagccctccaatttgcagagggcgctgcttttcctgcataccgggcaccgcacgccggaggggcattattaccccctccgtccccagcggctgcattacttccagctccccctgccggacccggacccgctacatttgctggctttctgggcagggaccccggtcccgctccccctcctcccgcttccctgggctcccccgcaccgccaaagggcgcagctgccccaagcgctagtcagcgcaggaagagaactagtttctcagctgagcagcttcagttgttggaactggtcttccgcagaacccggtaccccgatattcacttaagagaacgattggcggctctgacactgttacctgagtctaggatccagctgctcttttcacctctgtttcaagtttggttccagaatcgcagagctaaatcccgccgacagtctgggaagagtttccagccattagcaagaccagaaatcattctaaaccattgtgcccctgggactgagacaaagtgtctgaagccacagctgcctcttgaagttgatgtaaattgtctgcccgagcccaacggcgtgggtggcggtattagtgactcctcgagtcaaggacaaaatttcgaaacttgctcccctctttctgaagatataggaagcaaactggattcttgggaggagcatattttctcagcattcggaaatttctag

SEQ ID NO: 231005 - DNA, 882 bp, Artificial Sequence
  Description of Artificial Sequence: Synthetic coding sequence
atggccacctttagcgggcctgcaggccctattctgtcgctgaatccgcaggaggatgtggaattccaaaaggaggttgcccaggtgcgcaagcgcattacccaacggaagaaacaggaacagctcaccccgggtgtggtctatgtgagacatttgcccaatcttttggatgaaacacagatattcagttactttagccagttcggtaccgtgaccagatttagactgagcagaagcaagcgcactggcaactcaaaagggtatgcctttgtggaatttgagagcgaggacgtagccaaaatcgtcgccgagaccatgaacaactacctttttggggagcgtcttctcgaatgtcatttcatgcctccggagaaggtgcacaaggaactctttaaagattggaatatacccttcaaacagccttcatacccgagcgtgaagcggtacaacagaaatcgcaccctgacacagaagcttcgcatggaagaaaggtttaagaagaaagagcgattgttgcgtaagaagctcgccaagaaaggtatcgattacgactttccatcactgattctccagaagactgaatcgataagtaaaaccaatcgacagacttcaaccaaagggcaggtattgcgaaaaaaaaagaaaaaggtgtcagggactttggacacacctgagaaaaccgtggactcgcagggtccaacccccgtgtgcacgcccacctttctggaacgacgcaaatcccaggtggctgagctaaacgacgacgataaggatgacgaaatcgtgttcaaacagcctatctcatgtgtaaaagaagaaatccaagagacccagactcctactcatagtcgaaagaaaagaagacgcagcagcaaccagtag

SEQ ID NO: 231006 - DNA, 1257 bp, Artificial Sequence
  Description of Artificial Sequence: Synthetic coding sequence
atggcaccacgcggtcggaggcgcccaaggccacacagaagcgagggggcacgcaggagcaagaacaccctggagcgtacccatagtatgaaagataaggccggacaaaaatgcaaacctatcgacgtgtttgacttccccgacaatagtgatgtatctagtatcgggagactgggagaaaatgagaaagatgaggaaacttatgagacctttgacccccctcttcactcaactgccatttacgcagatgaagaggagttttctaaacattgtggcctcagcctttccagcaccccccctgggaaggaggcgaagcgaagcagcgacaccagtggcaacgaagcctctgagatcgagtctgtgaaaatctccgccaagaaacccggtcggaagctgagaccaatcagcgacgactctgagtccatagaagagagtgacacaagaaggaaagttaagtcggccgaaaaaatctccactcaacgacacgaggttattcgaactacggccagttccgagctgtctgaaaagcctgctgagtctgtgacaagtaaaaagaccgggcctctgtcagcccagccatctgtcgaaaaagaaaacctggccatagagtcacaatcaaaaacgcaaaaaaagggaaagatcagtcacgacaaaaggaaaaaatcaagatccaaggcaatcggctctgacaccagcgacattgtgcatatctggtgccctgaaggcatgaaaacttccgatatcaaagaactgaacattgttttgccggagttcgaaaagactcacttggagcaccagcaaagaatcgaatccaaagtctgcaaggctgccatcgcgacattttatgtgaacgtcaaagagcagtttattaagatgctaaaagagagccagatgctgaccaatctcaagcggaagaatgcaaagatgatatccgatatcgaaaagaagaggcagcgcatgattgaagtccaggatgaactccttagactcgagccccagctgaaacagctgcaaactaagtatgatgaacttaaagaacgcaagtctagtctccggaacgccgcttatttcttaagcaacctgaagcaattatatcaggattatagcgatgtgcaggcgcaggaacccaacgtcaaagagacatatgacagttcctctctaccggctcttctgttcaaagccagaacactgctcggagcagaatcacacctgcgaaacattaatcaccaactggaaaagctccttgatcaaggctag

SEQ ID NO: 231007 - DNA, 963 bp, Artificial Sequence
  Description of Artificial Sequence: Synthetic coding sequence
atggctccaaggggcagacgccgtcctcgaccccataggtccgaaggtgctaggcgttccaagaatacactcgagagaactcattccatgaaagataaagctggacagaaatgcaagcctatcgacgttttcgactttccagataatagtgacgtttcttccatcggcaggctgggggagaacgagaaggatgaggaaacttatgaaactttcgacccacctttgcattccacagccatctacgccgacgaagaggagttctccaaacactgcggcttatcactgagctccacgccccctggcaaagaagcaaagagaagtagtgacacatcaggaaatgaagccagcgagattgagtcagtgaagattagtgctaaaaagcctggtagaaagcttcgacccatcagcgacgattcagagtccatcgaagagtcagatacgcggagaaaggtaaaatctgcagagaagatatcgactcaaaggcacgaagtgattcggacaacagcaagctccgaactgagtgagaagcctgctgagagcgttacatccaaaaaaacaggaccgcttagcgcacaaccatctgtagaaaaggaaaacttggcaatcgagtcacaatcaaagacacagaaaaaaggtaagattagtcatgataaacgtaaaaaaagcaggagcaaagccatagggtctgatacctcagacatcgtgcatatttggtgtcctgaggggatgaaaacctcagacataaaggaactgaacatcgtgctgccagagtttgagaaaacgcacctggagcaccagcagaggatcgaaagtaaggtgtgtaaagcagctatagcgacattctatgtcaacgtaaaggaacagttcattaagatgttgaaggagagtcagatgctcaccaatctgaagcgcaaaaatgccaaagtgagagcgacagccgagaccacaacgaacaagatctag

SEQ ID NO: 231008 - DNA, 963 bp, Artificial Sequence
  Description of Artificial Sequence: Synthetic coding sequence
atggcacctcgaggaagacgacgacctagacctcaccgctccgagtcagctcgtaggagcaagaacacactggagcgcacacacagtatgaaggacaaagctgggcagaaatgtaaaccaatcgatgtgtttgacttccctgacaattcggacgtcagctctatcggcaggctcggcgagaacgagaaagacgaagagacctacgagacattcgaccccccactgcacagcacagctatttatgctgacgaagaggagttctctaagcattgtggccttagtctcagttccacgccgccaggcaaggaggctaaacgcagttctgatacttcaggcaatgaagcctctgagattgagagcgttaagatttctgctaagaaaccgggtaggaagttgcgaccaatttcagacgattccgaaagcatagaggagtctgacacccgaaggaaagtgaagagcgcggaaaagatctctacacagcggcacgaggtgataagaactaccgcctcctccgagctctctgagaaacccgcagaatccgtaacgtccaaaaaaacaggcccattgtcagcccagccttccgtcgagaaagaaaacttggccatcgagagccagagcaagactcagaaaaaggggaaaatctcacacgacaaaagaaagaagagtcggtctaaggcaattggctccgatactagcgatatagtacacatatggtgccccgaggggatgaaaacttccgacatcaaggagctgaacattgtgttgcccgaattcgagaaaactcatctggagcatcaacagaggatcgagtctaaggtgtgcaaggcagccattgccaccttttatgtgaacgttaaggagcaattcattaagatgctgaaggaaagccaaatgcttaccaacttgaaacggaagaacgctaaagtgcgcgctactgccgagaccacaaccaataagatctag

SEQ ID NO: 231009 - DNA, 1014 bp, Artificial Sequence
  Description of Artificial Sequence: Synthetic coding sequence
atggcacctcgaggcaggaggcgccctagacctcaccgcagcgagggggctagacgctccaagaatacactcgagaggacccattcaatgaaggacaaggccggacagaagtgcaagccaatcgacgtcttcgacttcccagacaactccgacgttagtagcatcgggcgactgggggagaatgagaaggatgaggagacttatgaaactttcgatccccctcttcactccaccgccatttatgccgacgaggaagaattctctaagcactgcggcctctctctgtctagtacaccacctggcaaagaggctaagaggtcaagcgacacttcgggcaatgaagcctccgagattgagagtgttaagatctccgccaagaaacccggacggaagctacgaccaatttccgacgattccgagagcatagaggaatctgacacaagaaggaaggtgaaaagcgccgaaaagatttctactcaacggcacgaggtgattaggaccacggccagtagtgagctgtccgagaaacctgcagaatctgtcacttctaagaaaactgggccactctctgcccagccctctgtagaaaaagaaaacctggcgattgaaagccaatcaaagacgcagaaaaaaggaaaaatttcacatgacaagagaaagaagagcagatcgaaagctattggctctgacaccagcgacatcgtccacatttggtgcccagaaggcatgaaaacatccgacatcaaggagctaaatattgtcctccctgagttcgagaaaacacacctagagcaccagcaacgaattgagtctaaggtgtgtaaagctgcaatcgcaaccttttacgtgaacgttaaagagcagttcataaaaatgctgaaagaatctcaaatgctcacaaatctaaagcgcaaaaatgcaaaaatgatcagcgacatcgaaaagaagcgccagcggatgatcgaggtgcaggacgaattactcaggctctggaccggggcagggctctggtag

SEQ ID NO: 231010 - DNA, 2760 bp, Artificial Sequence
  Description of Artificial Sequence: Synthetic coding sequence
atggcagctgatgtattcatgtgtagtccccgtcgtccgagatcaaggggtcgacaggtccttctgaaaccccaggtatcagaagacgacgacgattccgacaccgatgaaccaagccccccacccgcatccggcgctgccactcctgctagagctcatgcatccgcagcccctccaccgcctcgcgctggtcctggacgcgaagagcctccccgaaggcagcagatcatccatagcggacactttatggtgtcaagtccccacagagagcatccacccaaaaagggctacgattttgacaccgtgaataagcagacctgccagacctacagctttggtaaaacctcgagttgccatctgagcattgacgccagtttgaccaaacttttcgagtgtatgacgttggcgtactctggtaagctggtgtctcccaagtggaagaacttcaaaggcttgaagttgcaatggcgggacaaaatacggctgaacaatgcgatttggcgcgcttggtatatgcagtatctggaaaaacgcaaaaatcccgtttgccacttcgtgactcccttagacgggtccgtcgatgtcgatgagcatcgacgtcccgaggctatcacaaccgaaggaaagtactggaaatctcggattgaaatcgtaatcagggaatatcacaagtggcgcacatactttaaaaagagactacagcagcacaaggacgaagaccttagcagcctggtccaggacgacgatatgctctactggcacaaacacggagacggttggaagacaccggtgcctatggaggaagatccactcctggacacagacatgctcatgtcggaatttagtgataccttgttcagtacactttccagccaccagccggtggcatggcctaacccacgtgaaattgcacacctgggaaacgctgatatgattcagccaggactgatcccccttcagcccaacctggacttcatggacacctttgagccttttcaggatcttttcagttcaagccgctccatcttcggatccatgttgcctgctagtgctagtgctccggtacctgaccccaacaatccgcctgcacaggagtccattcttccaacaaccgcacttcctacagtgagtctgcctgatagcctgattgcgcctccaacagctcccagcctggcacacatggacgagcagggctgtgaacatacaagtcggacagaagacccctttatacagccaactgatttcggcccaagtgaacccccattaagcgttccccagcccttcttgcctgtgttcactatgccactgctcagtccaagcccagccccaccaccgatttctcctgtgttgcccctggtgccccctccggcaactgccctgaaccctccagcacctcccaccttccaccaaccccagaaatttgctggagtgaataaagcgccaagtgtgatcacacataccgcttctgccaccctcacccatgacgcaccagccaccacatttagtcagtcacagggcctcgttatcacaacccaccacccagctcctagcgctgccccttgtgggctggccctcagtccagtcacaaggcccccacagcctcgcctgacgtttgtgcatccaaagccagtgtccttgactggcggacgtcctaagcagccgcacaaaatcgtgcccgcacccaagccagaaccagtcagcctggtgctgaagaatgctagaattgcaccagccgctttcagtggccaaccgcaggctgtgatcatgacctctgggcctctgaaacgggaaggaatgctcgcatctacggtgagccagtcaaacgtggtgatcgctcccgctgctattgcccgagcccctggcgtgccagaatttcactcaagtatactcgtcacagatctcggtcatgggacctccagtcctcctgcccctgtatcaaggctcttcccctctactgctcaggacccactggggaaaggcgaacaggtgccccttcatgggggatcacctcaagtaactgtgactggcccaagtcgagactgcccaaattctggccaggcaagtccatgcgccagcgaacagagccccagcccccagtcaccgcaaaataactgtagtggcaaatctgaccccaagaatgttgccgctctgaaaaataggcaaatgaagcacatcagtgcggagcagaaacgacgctttaacatcaagatgtgtttcgacatgctgaattccttgatatccaacaactcaaagctgactagccacgcaatcacccttcagaagaccgtggagtacattaccaaactgcagcaggagaggggacagatgcaggaagaggctcgacgtttgcgggaggaaatcgaggagctcaatgcaactattatctcatgtcagcagcttcttcctgccaccggtgtgccagttaccagaaggcagttcgatcacatgaaggacatgtttgacgagtacgtgaaaaccaggacattgcaaaattggaagttttggatcttcagcatcattattaagcccttgttcgagtcatttaagggtatggtatcaacgagtagtttagaggagctacatcgcactgctctctcctggctggatcagcattgtagcctccctatacttcgtcccatggtgttgtccactctgcggcagctgtccacaagtacaagtattctaaccgacccggcacagctgcccgaacaagcgagcaaggcggtgacacgtatcggcaaaaggttgggcgagagttag

SEQ ID NO: 231011 - DNA, 657 bp, Artificial Sequence
  Description of Artificial Sequence: Synthetic coding sequence
atggacgaacagggatgcgaacacaccagccggactgaggaccccttcatccaacctactgattttggcccatctgagccccctttgagtgtgcccccacccccaatctcacccgtgctgcctctggtgccaccccctgcaaccgctctcaatcctcccgcaccccctacctttcaccagcctcagaagtttgccggagtgaataaggccccttcggtgatcacccacacagccagtgcaaccctcacccacgacgccccagctacaacattttcccaaagccagggattagtgattaccacacatcatccagctccgtccgccgcaccctgcggcctggcccttagtcccgtcaccagacctcctcagccgcgactaacctttgtccatcctaagcctgtgtcacttacgggcggtcggcctaaacagccacacaaaattgtccctgccccaaagccagaaccagttagccttgtgctcaaaaatgccagaatcgccccaggtgagcccggaggagagactcagtgcggcgcaccgccagaccctgaaggatgctttcccatccctaaggcttttaaactggttaccacaaccaccacactcgtctgtacctgcatgcggacccatatccatctaaacgaaacgaaagtcagctag

SEQ ID NO: 231012 - DNA, 1581 bp, Artificial Sequence
  Description of Artificial Sequence: Synthetic coding sequence
atggacgagcagggatgtgagcacactagccgaaccgaagacccctttatccaacctacagactttgggccaagcgaaccccctctctctgtgccacagccattcctgcccgtatttacaatgcctttgctcagcccaagtcccgcaccgcctccgataagtcccgttctgcccctagtgccgcctcccgcaacggctctcaatcctcctgcccctcctactttccaccagcctcagaagtttgccggagtgaataaagcaccttctgtgataacacataccgcaagcgctacccttacccacgacgccccagccaccacctttagtcagagccagggcttggtcattacaactcaccaccctgcccctagcgccgcaccgtgtgggctggctctgagccccgtgaccagacctccacagccccgactcacattcgtccaccctaagccagtcagccttaccggaggtagaccaaagcaaccacacaagattgtcccagctcctaagcctgagcccgtttccctagttctgaaaaacgccaggatcgcacctgccgctttttccggccagcctcaggcagtgatcatgacctctggacctctgaaacgggaagggatgttggcttcaacggtatcgcagtctaatgtcgttatcgcacccgcagcaattgctagggctcccggagtgccagagtttcatagttcaattctcgtgaccgacttggggcacggaacgtctagcccgccagccccagtgtctagactgttccccagtaccgctcaggacccactcggaaagggcgagcaagtgcccctgcacggcggatcaccgcaggttactgtgacgggcccttctcgcgactgtccgaacagtggccaagcctctccctgcgcgtccgagcagtctccatcaccccaatccccgcagaataattgttccggcaagtccgatcctaagaacgttgctgctctaaagaaccggcagatgaagcatatctcagctgaacagaagcgcagattcaacatcaagatgtgctttgacatgctcaacagcctgatctccaataactccaagctgacctcacatgctatcaccctccagaagacggtggaatacatcaccaagctacaacaggaacgcggacagatgcaagaagaggcccgacgcctgagagaggagatcgaagagctaaacgctacgattataagctgtcagcagctccttcccgctactggcgttcctgtgacacgaagacaattcgatcacatgaaggacatgtttgacgaatacgtgaagacgaggaccctgcagaattggaagttctggatattttcaataattattaagcccttgttcgaaagcttcaaaggcatggttagcaccagttccctggaagaattgcatcgcactgctttatcatggctggatcagcattgcagtctccccattctgaggcctatggtcctctccactctgcggcagctttcaacgtctacctcgattctcactgatccagctcaattgccagagcaggccagcaaggccgttacgagaatcggtaagaggctcggggagagttag

SEQ ID NO: 231013 - DNA, 2559 bp, Artificial Sequence
  Description of Artificial Sequence: Synthetic coding sequence
atggcaggggctttagctggactggcagcaggcctccaggtgccacgcgttgcgccttcacccgattccgacagtgacactgactctgaagacccgagccttcgcagatctgccggtggcctgctgagatcgcaggttattcatagtggccacttcatggtcagctccccacacagcgacagccttccacgccgaagagaccaggaaggcagtgtagggccatctgacttcgggccacggagtatcgacccaaccctgacccgactctttgagtgcctgagtctcgcttacagcggtaagttggtcagtcccaagtggaagaactttaagggactgaagctgctatgtcgcgataagatacgtctgaacaatgccatctggcgagcctggtatatccagtacgtgaaacgacgtaaaagccccgtctgtgggtttgtgacacccctacaggggcctgaagcagacgcacacagaaagccagaagcagtggtgctggaaggaaattactggaaacgcaggattgaagtcgttatgagggagtaccacaagtggagaatttactataaaaagagattacgaaagcctagtcgtgaggacgacctcctggcacctaagcaggccgagggccgatggccgcctccagagcagtggtgtaagcaacttttctcgtccgtcgtgcccgttctgttgggagatcctgaggaagaacctgggggacgacagctgctggatttgaactgttttttgagcgatatctcagacacgctgttcaccatgacacagagcgggccaagcccgctgcagctgcctcctgaagatgcgtatgtcggcaatgccgacatgatccagccagacctgactcccctccaaccctcattggatgacttcatggatatatcggattttttcaccaactcacgcttgcctcagcctcccatgccttccaatttccccgaaccaccttcttttagtccagtcgtagactcgctctttagctcaggtacgctgggtcctgaagttcccccagccagttctgccatgactcacctgagtggtcattcacgccttcaggcccgaaatagctgcccgggtccacttgactcctcagcatttcttagctccgattttctcctgccggaggacccaaagcccagactcccacctccgcctgttcctccacccctgttacactatcccccacccgcaaaagtgcccggacttgagccttgtccaccccctccttttccacccatggcgcctcctactgctctcttacaggaagagcccttattttccccgcgattccctttccccaccgtgcctcctgctcccggagtttcacccctgcccgcacctgcagccttcccccctaccccccagtctgtaccaagccccgcaccaacccccttccctatcgaactactgcccctaggatacagtgagccggcttttggaccatgtttttccatgcccagggggaaaccgcctgctcctagtcctcgcggacagaaggcctcacctcctacccttgctcctgccactgctagccctccgacaacggcaggttccaacaacccgtgtctgacacaactgctgacagcagccaagcctgagcaagcccttgagcccccactcgtgtccagtacactgctgcggtcgccgggaagcccacaagaaaccgtgccagaattcccatgcaccttcctgccgcctacccccgcacctaccccaccccgaccacctcccggacccgctaccctggctccatcaagacccctactggtgccaaaggctgagcggctaagtcccccagcacctagtggctcggagcgaaggctcagcggggacctgtctagcatgcccggtcccggaacacttagcgtgcgagttagcccccctcagcctatactgtctcgaggtaggcctgattcaaataagaccgagaatcgtcgaatcacccatataagtgcagagcagaaacggcgttttaatatcaagttggggtttgacaccctgcatggcctcgtgtccactctaagtgcgcagccatcgctgaaagtgagcaaggcaacgacacttcagaagactgcagaatacatcctgatgttgcaacaggagagagccggactgcaagaagaagcacagcaactcagagacgaaattgaggagttaaacgccgcaatcaatctctgtcaacagcagctccccgctaccggagtcccaatcacacaccagcgattcgaccaaatgagggatatgtttgacgattacgttcgaacacgcactctgcataactggaagttttgggtgttctctatcctgatacggcctctgtttgaatcgttcaatggcatggtttcaacagctagcgtgcacacattgagacagacttctctcgcatggctggaccaatattgctccctgcctgctcttaggcctactgttctgaattccctgcgacagttggggacgtcaacctccattctgactgatcccggaagaataccagaacaagccactagggccgtgaccgaaggaacccttggtaaaccgctgtag

SEQ ID NO: 231014 - DNA, 2496 bp, Artificial Sequence
  Description of Artificial Sequence: Synthetic coding sequence
atggcgggtgcactggctgggctcgcggcaggtctgcaggtaccgagggtagctccttcaccagatagcgattccgacaccgattccgaagacccctccctaagacgtagtgccggtggccttcttagaagtcaggtcatccacagcggccactttatggtctctagcccccatagtgacagcttgccgagaaggcgggatcaggaaggaagcgtcggaccatcagatttcgggccaagaagtatcgacccaaccctcacccgtctgtttgaatgcttgtctttggcttatagcggtaaattggtcagcccaaaatggaaaaacttcaaggggctgaagctcctgtgtcgcgataaaatccgcttaaataatgcaatctggcgagcctggtatattcagtatgtgaagaggagaaaatcacctgtgtgcgggttcgttacaccgctccaaggtccagaggcagacgcccaccgaaagcccgaggctgttgtcctcgaaggaaattactggaaaaggcgtatcgaagtcgtgatgcgggagtatcacaagtggcgtatttactataagaaacgcctacggaagccgtctcgcgaggacgacctgttggccccaaaacaggccgaagggaggtggccccctccagagcagtggtgcaaacaactgttctcatccgtggtccccgtcctgctcggagaccccgaggaggagccgggaggccgtcagcttttagatctgaattgtttcctctctgacataagtgacacactgtttacgatgacacagtccgggccttcacctttgcagctacctcctgaagacgcctatgtcggcaatgctgatatgatccagccagatttgactcctctccagccatccctggatgacttcatggacatcagcgatttcttcactaattctagactcccgcagcctccaatgcctagcaatttccccgaacctccaagttttagccccgtcgtagatagtctctttagtagcggcacccttgggccagaggtacctcccgcttctagtgccatgactcacctgtctggacactcccgcctgcaagctcgcaatagctgtcctggccctttggattcaagcgccttcttgagcagcgactttctccttccagaggacccaaaacccaggttgcctccccctcccgttcctccaccattattgcactatcccccacccgcaaaagtccctggcttagagccctgtccaccccctccctttcctcctatggcccctcctactgcactcctgcaagaagagcccctattttcacccaggttcccatttcccacggtccctccagcccctggcgtctcccctttgccagctccagcagcgttcccacccactccccagtcggtgccctcacccgctcccacacctttccccattgaactcctgcctctgggctacagcgaaccggcttttggtccctgtttttctatgcccaggggaaaacccccagcccctagcccaaggggtcaaaaagcgtctccccctactctggccccagccacagcaagtcccccaactacggccggtagtaacaacccctgtctcacacaactgcttacagccgcaaagcccgagcaggcactggagcccccattagtgtcctccactctgttgcggtccccaggatcaccacaggaaacagtgccagaattcccgtgcaccttcttaccccctacccccgcaccgacaccaccacggcctcccccaggacctgccacccttgctccgtccagaccactactggttcccaaggctgagaggctctctccacctgcacctagtggcagtgagcgtagactgtccggagacctctcatccatgcctggacccggaacactgagtgtgcgggtctctccaccccaaccgatcctctctcggggacggcctgacagcaataaaaacaggaggattactcatatctctgccgagcagaaaaggcgcttcaatattaaactgggatttgatacattgcatggcctggtgtcgactttgtcagctcaaccttcgctaaaagagcgggctgggctgcaagaggaggcccaacagttgcgtgacgagatcgaggagctcaatgccgcaatcaatctgtgtcagcagcagctgcccgcaaccggcgtccccatcactcaccagcggtttgatcagatgagggacatgttcgacgattacgtaaggactcgcacgctgcacaattggaaattctgggttttcagcatactgattcgacccctgttcgagtccttcaacggtatggtcagcaccgcctcggtccacaccttgcgacaaactagcctggcctggctggatcagtactgcagcttaccggctctacgtccaaccgtgctgaacagccttcgccagctggggacgtcaacctcaatccttaccgaccctgggaggatcccagaacaggccacccgggcagtgacagagggaacgctgggaaagccattatag

SEQ ID NO: 231015 - DNA, 2280 bp, Artificial Sequence
  Description of Artificial Sequence: Synthetic coding sequence
atggctggggcactggccggactggccgcaggactgcaggtgccaagggtggctccttcgcccgacagtgatagcgataccgattccgaggatccaagtctcagaagatcagctgggggactcctgcggagtcaagtcatccacagtggccattttatggtgtccagccctcatagcgactccctccccaggcggagagatcaggaaggctccgtgggacctagcgatttcgggccacgcagcatagacccaacactcactcggctgtttgagtgcctctctctggcctattcagggaagctcgttagtcctaaatggaagaactttaagggtctgaaactattgtgcagagataaaatcaggctcaacaacgcaatctggcgcgcttggtacatccagtacgttaagagacggaagagcccggtctgtggctttgttacgcctctgcagggacctgaggctgatgctcataggaagccagaagcagttgtcttagagggtaattattggaagaggagaattgaactccctcccgaagacgcgtacgtgggcaacgctgacatgattcaacctgatctaacacctctacagccttctctagacgatttcatggatatttctgatttctttacaaactctcggttaccccaaccaccaatgcccagcaacttccccgagccaccaagctttagccccgttgtggacagcctcttttcatcaggaaccttaggacccgaggtcccccctgcctccagcgccatgacacacctttcaggacattctcggctgcaggccaggaatagttgcccagggccactggactcgtccgcttttctgtcatccgactttctcttgccagaggatcccaagcctaggctgccgccaccacccgtaccgccaccattgctacactacccccctccagccaaagtgcctggtttggaaccatgtccacctcccccttttcccccaatggcgccaccgactgctctgctccaagaagagccgcttttttcaccacggtttccatttccgaccgttccaccggctcctggcgtcagcccacttccggcacccgctgcctttccaccaactcctcagtctgtgcccagtccggctcctactccattccccattgagttactgccgcttggatattcggagcctgccttcgggccatgtttttctatgcctcgcggaaagccacccgctccaagtccccgtggacagaaagcctcccctcccactttggctcccgcaactgcttcccccccaactaccgctggttcaaacaatccctgtctgactcagttactcacagcagctaagcccgagcaggctctggagcctcccttagtctcttcaacactgctgcggagcccgggaagtccccaggagaccgtacctgaattcccctgtacttttctgcctcccacccccgcacctacgccccctaggcccccaccaggccctgccaccctcgcaccttccagacccctgctcgtgcccaaggccgagcggctctctcccccagctcctagtgggtccgaaagacgcctttcaggagacctgtcatctatgcccggtcccggaaccctgtccgtccgagtctcgcctcctcagcctatccttagtaggggacgcccagactcgaacaagacagaaaataggagaatcacccacataagcgcagaacagaaacgacggtttaatatcaagcttgggtttgacacgctgcatggattagtgtcaacactaagtgctcaaccatcactgaaggtgtctaaggcaactacactgcagaagaccgctgagtatatcctgatgttgcagcaggagagagcaggcttgcaggaagaggctcagcagttacgggatgagatcgaggaactaaacgccgctattaatctctgtcagcagcaacttcctgccactggcgttccaatcacgcaccagcggttcgatcagatgagagacatgttcgatgattacgtgaggactcgcactctccataactggaaattttgggtcttttcaatcctcattaggccactgtttgagtcctttaatggcatggtgtccacagcctctgttcacaccctgaggcaaaccagtcttgcctggctcgaccagtactgctcgctcccagcacttcgcccaactgtcttgaactccctccggcagctcggaacaagcactagcattctcaccgacccaggaagaatacctgagcaggcaacccgggctgtgaccgaaggcacgctgggaaaaccactttag

SEQ ID NO: 231016 - DNA, 2553 bp, Artificial Sequence
  Description of Artificial Sequence: Synthetic coding sequence
atggccggagccctggcagggctcgcggcaggactccaggtgccccgagtggctccctctcccgattcggactcagatactgacagtgaggatccatctctacgacggagcgcagggggtctcctaagaagtcaagtgatacattcgggccattttatggtctcctctccacactctgactctcttccacgtcgtagagatcaggaggggagtgtcggaccatctgacttcgggcctcggtctatcgaccctaccctgacgaggctgtttgaatgtctgtcgctggcatacagtggtaagctcgtgagcccaaagtggaaaaatttcaaggggctgaaacttctttgcagggataagatcagacttaataatgccatctggcgcgcttggtacatacagtacgtcaagcggaggaagagccccgtttgtgggttcgttacacctcttcaggggccagaggccgatgcacacagaaagcccgaagctgtggtcctggagggaaactactggaagcgacgtattgaagttgtgatgcgcgagtatcataaatggcgcatctactataaaaagcgcctgagaaagccttcccgcgaggatgatctgctggccccaaagcaggcggaaggacggtggccccctcctgagcagtggtgtaagcagctgttctcctccgttgtaccagtgctgctgggcgaccccgaggaagaaccgggaggacggcagctgctcgaccttaactgtttcctgtccgatatctcagatacactgtttaccatgacccagagcgggccttcgccattgcagctgccacccgaagacgcatacgtcggcaatgctgacatgatccagcccgacctgactcccctacagcctagtctagacgattttatggacatcagtgacttcttcacaaactccaggttaccgcagcctcctatgccgtcaaacttcccagagcccccatccttctctcctgtcgtggactccctgttttcatcggggaccctcggccctgaagtgcctccggctagctctgctatgacccatctaagcggacacagtaggttacaggccagaaattcttgccctggccctctggactcttccgcctttctgtctagcgattttctgttgcctgaagatcctaagcccagacttcctcccccacctgtaccgcctccgctgctccactatccgcctccagctaaggtcccaggactggaaccctgccctccccctccattcccccctatggcacccccaacagctctcctgcaggaggagccactgttttctccgcgattcccctttcccactgtgccgccagctcccggagtctcccctttgcccgctcctgctgcgtttccccctacaccccaatcggtaccttcacctgcacctacaccattccctatagagcttctgccccttgggtacagcgagcccgcttttgggccttgcttctccatgccgagggggaaacctccagccccttcccccaggggacagaaggcaagtccgccaacactcgcccctgcaacggctagcccacccaccacagccggatcgaacaatccttgtttaacacagctgctgacagccgcaaagcctgaacaagcactagagccacctttggtctcttccactctgctacggtcacctggaagcccacaagagacggttcccgagttcccctgtacgttccttccaccaaccccagctcccactccaccacggcctccacctgggcctgccacattggcgccatcacgaccactgctcgtgccaaaggccgagcggttatctcctcccgctccctctggctccgaaagaagactcagtggggatctatcttcgatgccaggccctggcacactcagcgttagagtgtcacctcctcagccaatcttgagcagaggtagacccgacagcaacaagaatagacggattacacatatttccgcagagcagaaaaggcggttcaacatcaaactaggatttgatactctgcacggacttgtgtccacactgtctgcccagcccagtctgaaggtctccaaggcgactacgctccagaagaccgccgagtacatactgatgctgcaacaggaaagagccggacttcaggaagaggcacagcagctcagggacgagatcgaggagctgaacgctgcaatcaatctctgtcaacagcagttgcccgcaaccggcgtccccatcacccatcaacggtttgatcaaatgagagatatgttcgacgattacgttcgcacccggacactgcataattggaaattttgggtgttctctattctgattagacctttgtttgagtcatttaacggcatggtctctacagccagcgtgcacactcttagacagactagtctggcttggctggaccagtactgtagtttacccgctctgcgacctacagtgctcaattctctacggcaattggggacctctacttccattttgacagacccgggtcggattcccgagcaggctacccgggcagtgaccgaaggcacgttgggcaaacccctgtag

SEQ ID NO: 231017 - DNA, 2502 bp, Artificial Sequence
  Description of Artificial Sequence: Synthetic coding sequence
atggctggtgccctggccggactggccgcaggacttcaggtgcctcgcgtcgctccctcccctgattcagactctgacaccgacagtgaggacccctccctgcggagaagtgccggaggacttttacgtagccaggtgatacattcaggacacttcatggttagcagcccccacagcgactccctgcctaggaggagggatcaggagggtagtgttggaccatcagatttcggtccacggagcatagaccctaccctaaccagactattcgaatgtttgtcccttgcatattctgggaaactggtctctccaaaatggaaaaattttaaggggttaaagctactgtgccgcgacaagatccgactgaataacgctatctggagggcatggtatatccagtatgtgaagaggcgtaagtcacccgtctgcggttttgtgacccctctgcagggacccgaggccgacgcacacagaaaaccagaagcagtcgtcctcgaaggaaattattggaagagacggattgaggtggtgatgagagaataccacaagtggagaatttattataagaagaggttacgcaagccgtcacgagaagatgacttgttagctcctaagcaggctgaaggtcgatggcctcctcctgaacagtggtgtaaacagctgttcagttctgtggtccctgtactgcttggagatcccgaggaggagccagggggaaggcagctgctggacctcaattgtttcctctcagatattagtgacactcttttcacaatgacacaaagcggtcccagccccctgcaactgcctcctgaagatgcctacgttggaaatgcagatatgatccagccagatctgacacccttgcaaccaagtttagacgactttatggacatttccgacttcttcactaattcccgacttccacagcctcctatgccatcgaattttcctgagccccctagtttttctcccgtggttgatagtctgttcagcagtgggacacttggaccagaggtgccacccgcaagctcagctatgacacatctctcaggtcactcgagactgcaggccagaaattcttgccctggaccgctggacagctctgcattcctctcttcagactttttactgcccgaagatcctaagccgaggctgcctcctccacctgtgcctccccctctgctgcactatcctccgcctgccaaggtgcctggccttgagccttgccctccgccaccttttccgccaatggccccaccgacggctcttctgcaggaagagcccctgttcagtccaaggttcccatttccaacggtgcccccagcacctggagtgagcccgcttccggctcccgctgctttcccccctaccccacagtcagtcccatcacctgccccaaccccttttcccatcgaattgctcccactcgggtactccgaacctgcattcggaccctgttttagcatgccacgcggtaagccaccagccccatccccaaggggacagaaggcgtcgccccctaccctggcacctgcgaccgccagccctccgacaactgccggtagcaataatccttgccttacccagctgcttactgcagcaaagcctgaacaggcgctcgaacctccactggttagttccacactgctccggtcaccgggaagtccccaggagaccgttcccgaatttccctgtacctttctcccccctactccggcacccacaccacccagaccaccaccgggacctgccaccctcgcgccatccagaccactgttggtgcctaaggccgaacggctgagcccccctgccccatcaggatctgagcgacgacttagcggagatctgagctcgatgcccggacccggaactctttccgtccgggtgtccccgccacagcccatcctgagccgtggacggccagattcaaacaaaaccgagaataggcgcattactcatatcagcgcagaacagaaacgccgtttcaacattaagctcgggttcgataccctccatgggttggtttctacactttcagcccagccatccctgaaagagcgcgcaggcctacaggaagaggcccaacagttgcgtgatgagatcgaggagctgaacgccgcaatcaatctctgtcagcagcagctccccgcaacgggggtgcctattacgcaccaaaggttcgatcagatgcgagacatgttcgacgactatgtcaggacaaggacccttcacaactggaagttttgggtttttagcattctcattagacctctctttgagtctttcaacggaatggtgtctactgcctctgtccacacacttcgacagacctcgcttgcctggctggatcagtattgttcactgcccgcactgaggcccaccgtcctgaactcactcagacagctcggcacctccactagcatcctgacggacccaggacgcatcccagaacaggcaactagggccgtgactgaaggcactttgggcaagcctctgtag

SEQ ID NO: 231018 - DNA, 1059 bp, Artificial Sequence
  Description of Artificial Sequence: Synthetic coding sequence
atgaacaccatcgtctttaataagctcagcggggcagttctgttcgaggacggtggcgcatccgagcgagagcgtggaggaaggccctattctggcgtgttggacagtccgcacgctagacctgaggtggggataccagacggcccacctctgaaggacaatctggggctcaggcatcggagaacaggagcccgacaaaacggcggaaaagtgcggcacaagcgacaggccctgcaggatatggcgaggccattaaagcagtggctgtacaagcatcgggacaatccctatcccaccaaaaccgagaagatcttactggccctcggttcacagatgacattggtccaggtgagtaattggttcgccaatgcgagaagacgactcaaaaacacggtgcgtcagccggatctttcatgggccctcagaatcaagctatacaataagtatgtacagggcaacgcagagaggctgtctgtgagctcagatgattcttgctctgaggacggcgagaaccctccaaggactcacatgaatgagggcggatacaacacacccgttcatcatccggtgatcaagtcagaaaactcagtaattaaggccggtgtgagacctgagtctagagcttccgaggactatgttgcccctccgaagtataaatccagcctgctaaaccggtatttgaacgactcgctgcggcacgtgatggcaaccaataccactatgatgggcaaaacacgacagcgcaatcattcggggtcctttagcagcaacgaatttgaggaggagttggtatccccctcttcgtccgaaacggagggaaacttcgtgtaccgcactgacaccctggaaaatggaagcaataagggcgagtccgccgctaacaggaaaggcccaagtaaggacgatacctactggaaagaaatcaatgcagctatggcactgacaaacctggcccagggtaaagacaaactgcagggcacaactagctgtattattcagaaaagcagtcacattgccgaggtgaaaactgtgaaggtgcctctggtgcagcagttctag

SEQ ID NO: 231019 - DNA, 1059 bp, Artificial Sequence
  Description of Artificial Sequence: Synthetic coding sequence
atgaataccattgtcttcaataaactaagtggggcagtattattcgaagacggtggcgcttctgagcgcgaaagaggcggacgaccttactccggggttcttgattcccctcatgctcgccctgaagtggggatccccgacggccctcccttaaaagataacttgggccttcgccaccgtagaaccggtgccagacagaacggcggtaaagtgagacacaagcgccaggccctccaagacatggctcgccctttgaagcagtggctttacaaacatcgtgataacccctaccctacaaagacagagaagattcttttggccctcgggtcgcagatgactctcgtccaagtttcgaactggtttgccaacgccaggcggcgattgaagaacaccgttaggcagcctgacctgtcctgggctcttcggattaagctctataataaatacgttcaggggaatgccgaaaggctcagcgtgtctagcgatgattcctgcagcgaggacggtgaaaatccaccgagaacacacatgaacgaggggggttacaataccccagtgcaccaccccgtgataaaaagtgaaaacagcgtcattaaggctggcgtaagaccagaatctcgggctagcgaggattacgttgctccacccaagtataagagtagccttttaaaccgatatttgaatgactctctcaggcacgtcatggctaccaacaccactatgatgggcaagactagacaacggaatcattccggatctttctcttccaatgaatttgaggaagaacttgtaagcccgtccagcagtgaaactgaagggaacttcgtgtacagaaccgatacgctggagaatggaagtaataagggagaaagcgccgcaaatcggaagggtccctccaaggatgatacttactggaaagaaatcaatgccgctatggcacttaccaaccttgcacaggggaaggacaagttgcaaggtactacaagctgcatcatccagaaatcctcccacattgcggaagtgaagacagtcaaagtgcccctcgtccaacagttttag

SEQ ID NO: 231020 - DNA, 177 bp, Artificial Sequence
  Description of Artificial Sequence: Synthetic coding sequence
atgaatactatagtgttcaacaaactatccggagccgtcctgtttgaggacggaggcgcatcagaaagggagcggggaggcaggccatattctggcgtgctggactctccccacgctcggcctgaagtgggcattccagatgggccacctcttaaagacaaccttgggctgcgctag

SEQ ID NO: 231021 - DNA, 288 bp, Artificial Sequence
  Description of Artificial Sequence: Synthetic coding sequence
atgaacttcgatttcccattcaaaaaaggaagtggaatcccgctgctcactaccaatctctccccacagtgcctgtccctacttcatgctatggtcgcttatgacccggatgaacggatagccgctcatcaggccctccaacacccttacttccaggagcagaggactcagaatggatcagaggacgaggcaagtgctgtcctgctgcccattcagaccagaagcagtctcaatccactgctgtcgacctgtatgttgccgggaagatcagtgacacttcttgtatag

SEQ ID NO: 231022 - DNA, 1260 bp, Artificial Sequence
  Description of Artificial Sequence: Synthetic coding sequence
atgaaaaattacaaagctattggcaagatcggagagggcacttttagcgaagttatgaaaatgcagtcacttcgggacggtaactactacgcttgcaaacaaatgaagcagcgctttgagtccatagaacaggtgaacaacctgcgcgagatccaagccctccggcgtctcaaccctcaccccaacatcctgatgctgcatgaggtcgtgtttgatcggaaaagcgggtctcttgctttaatctgcgaactgatggatatgaatatctacgaactgatacggggtagaaggtatccactgtccgaaaaaaaaataatgcattacatgtatcagctgtgcaagagcctcgaccacattcataggaacgggatctttcacagggatgtcaagcctgaaaacattctgatcaaacaagacgtactgaagctgggcgatttcggcagctgccgctcagtgtattcaaaacagccttacactgaatacattagcactaggtggtatcgcgctcccgagtgcttactgaccgatggcttttatacgtataaaatggatttgtggtccgcaggatgtgtgttttatgagattgcatctctacagccactcttccctggcgttaatgagctcgatcagatctcaaagattcacgatgtcataggcacacccgctcagaaaatcctgacgaagttcaaacagtctagggccatgaacttcgattttcccttcaaaaaggggtctggcatcccactgctgacaacaaacctgagccctcagtgcctgagtcttttgcatgctatggttgcctatgatccggatgaaagaatcgctgcccaccaggccctgcagcatccgtatttccaggaacagcgaaaaaccgagaagagggcgttgggttcccaccgaaaggccggatttcccgaacacccggtagccccagagcccctttccaattcctgccagataagcaaagaagggaggaagcaaaaacagtccttgaaacaggaggaggaccggcctaagagacggggtcctgcatacgtgatggagcttcccaagctgaagctttcgggagtagtaagattgtcaagctattcttcccctaccctgcaatcagtgttaggctccggcacgaacggcagagtcccagtgttaagacctctgaagtgcatcccagctagcaagaagactgatccccagaaagacttgaagcctgcgccacaacagtgcagactaccaactatcgtgcgaaagggaggacgatag

SEQ ID NO: 231023 - DNA, 2667 bp, Artificial Sequence
  Description of Artificial Sequence: Synthetic coding sequence
atggcgggagctgcagccgaatctggtcgagagctctggacttttgccggtagtcgtgacccgtcggcaccacggctggcttacggatacggaccaggctccctcagagaactgcgggctcgggagttcagcagattagctgggacagtctacctggaccatgccggagcaactctgttctcccagtcccagctcgaaagctttacgtccgatctgatggagaacacatacgggaaccctcattcccagaacatttcttctaagctgacgcacgacacagtagaacaagtccgttacagaatcctggcacacttccacaccactgctgaggattacacagttatctttacagcgggatcaacagccgctctaaagctggttgctgaggcctttccctgggtcagccagggccctgaaagcagcgggagccgcttttgttatctgaccgattctcatacctcagtcgttggcatgcgtaatgtgacaatggccatcaatgtcatttccacccctgtgaggcctgaagatctctggtctgccgaggagcgaagcgcttcagcctccaatccggattgccaactgccccatctcttttgctatcccgctcagagcaacttcagtggtgtccgctatcctctcagttggatcgaggaggttaagagtgggcgtctgcaccctgtcagcacgcccggaaagtggttcgtactgttagacgctgctagttatgtgagcaccagccccttggacctttcagcccatcaggctgactttgtccccatctccttctacaagatcttcggtttccccaccggactcggggcactgctggtgcacaatagagcagctcccctgctacgaaagacatattttggcggaggaacggcttccgcatatctcgccggagaagatttctatatcccaagacagtcggtagctcagcgcttcgaggacgggacaatcagtttccttgacgtcattgctcttaagcacgggttcgacaccctggaaaggcttactgggggaatggagaatattaaacagcacactttcaccttagcgcagtatacttatgtggcactttcatcattacagtaccctaacggtgcacctgttgttcgtatctactccgactcagaattttcatcaccagaagtgcagggaccgatcattaactttaatgtccttgatgataagggtaacatcatcggttacagccaggtggataagatggcttccttatacaatatccacctgagaacgggatgcttttgtaatactggggcttgtcaacgacacctcgggatctccaatgaaatggtgcgcaaacattttcaagccggacacgtatgtggcgacaacatggacctaattgacggacagccgactggctcagtgcgcatatcattcggctacatgagcacactcgacgacgtgcaggcctttctacgctttatcattgatacgcgtctacattcatcaggagattggcccgtcccacaagctcatgcggatacgggtgaaacaggagctccttctgctgattcccaagccgacgtcatccctgccgtaatggggagaagaagcctctcaccacaggaagatgccctcaccggcagcagagtctggaacaatagcagcacggtcaacgcagtcccagtggcccctcctgtgtgcgacgtcgcgagaacgcagcccactccgtccgaaaaggcagccggagtgttagagggcgctcttggcccacatgttgtgacaaatctctacctgtatcctattaaatcttgcgcagcttttgaggtaacacggtggcccgtggggaaccagggccttctctacgatcggtcatggatggtggtgaaccataacggggtgtgtctgtcccagaagcaggaaccacgactgtgtcttatccagcctttcattgatttgcgacaacgaattatggtcattaaagctaagggtatggaaccaattgaggtgcccctggaggaaaactcagagagaacccaaatccgccagtcacgtgtgtgtgcagatcgcgtgagcacgtatgattgcggtgaaaagatctcttcatggctctccactttcttcggaagaccctgccatctgattaagcagtccagtaatagccaaagaaacgccaaaaagaagcacggcaaagaccagttacctgggacaatggccacgttgtccctggtcaatgaagcccaataccttctcatcaacacatcatccatccttgagttacataggcagctgaacacatcagacgaaaacggtaaagaagaactgttttcactgaaagacctctctcttagattccgcgctaatatcataatcaatggcaagagggccttcgaagaagagaagtgggacgagataagcattggaagtctgagatttcaggtgctcggcccttgccacagatgtcaaatgatttgtattgaccagcagaccggacagagaaatcagcacgtttttcagaaactgagcgagtcccgggagacaaaggtgaactttggcatgtacttgatgcacgcctcccttgacctgagttctccatgcttccttagcgtgggatctcaggttttaccagtcctcaaagaaaacgtcgaaggacacgatctgccggcatccgaaaaacatcaggacgtcacatcttag

SEQ ID NO: 231024 - DNA, 1863 bp, Artificial Sequence
  Description of Artificial Sequence: Synthetic coding sequence
atggcagctcgacctttgtcccgcatgctgagaaggcttctgcgtagtagtgcacgcagctgctcctcgggagcccctgtgacacagccctgtcccggtgagagcgctcgcgcagccagcgaggaggtttccagacggaggcagtttctgagagagcatgctgccccattctccgcattcctgactgattccttcgggagacaacactcttatctgaggatcagcctgaccgaaaaatgcaacctgaggtgccagtattgcatgcctgaggaaggcgttcctttgacccccaaagcaaacctgcttacaacggaagagatcctgaccttggccaggctgttcgtgaaagaaggtatagataagatccgattgacaggaggagagccattaatccgccctgacgtggttgacatcgttgcacagctgcagcgactcgaaggactgaggacaattggggtgacaactaacgggattaacttagctaggctcttgcctcagttgcaaaaagccggactcagcgctatcaatatcagcctggatacactagtgcccgcaaaatttgaatttattgttcggaggaagggattccacaaagtgatggaagggattcacaaggccatagagcttgggtacaaccccgtaaaggttaattgcgtagtcatgcggggtttaaatgaggacgagctcctagattttgccgcactgaccgagggactccctctggatgtcaggtttatcgagtatatgcctttcgatggtaataaatggaatttcaagaagatggttagttacaaggagatgcttgacaccgttagacaacagtggcctgagctggaaaaagttcctgaagaggagtccagcacggcgaaggcattcaagatccctggatttcagggacagatctccttcataacctccatgtccgagcacttctgcggaacctgcaaccggctgcgaataactgctgatggcaatctcaaagtgtgcctcttcggaaacagcgaggttagtttgcgcgatcacctgcgcgctggagcctccgaacaggagctactaagaatcattggggctgccgttggcaggaagaagcgccagcacgctgagctcttccttatgttccccaattccccacccgcaaatccaagcattttttcctgggacccgttgcatgtccagggcctccgcccacgcatgtctttctccagtcaggttgctacactgtggaaaggctgcagggttccacagacaccacctctggcacagcagcgtttaggatctggaagctttcagcgccactacacttcccgggctgattcagatgcgaattctaagtgcctgtctccaggttcttgggcctccgctgccccttccggaccccagctcacatccgagcagctcactcatgtagacagcgaaggtagggcagctatggtggatgtggggcgtaaaccggacaccgaacgcgtagctgtcgcatcagccgtggtattactcggcccagtagcgtttaaactcgtacagcagaatcaactgaagaagggcgatgccctagttgtggctcagctggcaggagtacaggccgctaaagtgactagccagctgattcccctttgccatcacgtggcattgagccacattcaagtccaactggaattggattccacaagacatgctgtcaagatccaagccagttgccgcgctcggggtcctacgggcgtggagatggaggccctgacttctgccgcagtggctgctcttaccctatacgatatgtgtaaagccgtcagtagggatattgttctggaggagatcaagctgatctccaagacaggcggtcagaggggcgacttccaccgggcttag

SEQ ID NO: 231025 - DNA, 1911 bp, Artificial Sequence
  Description of Artificial Sequence: Synthetic coding sequence
atggctgccagacctctgagcagaatgctgcgcagactcctgagaagctctgccagatcttgttcctccggggcaccagtcacacaaccatgccctggggagtctgccagagcggctagcgaagaggtcagccgccgaagacagtttctgcgagagcatgccgcaccattttctgcgttcctgaccgacagctttgggcgacagcatagctacctgagaatttctctcacagaaaagtgtaacttgaggtgtcagtattgcatgccagaggagggcgttccattaaccccaaaagccaacttgctaactaccgaggagattcttacgctcgctcgcctgtttgtcaaggaagggattgacaaaattaggctcacgggaggggagcctctgatcaggcctgacgttgtggatatcgttgcacaactccaaagactggagggacttaggactattggagttactaccaatggcattaatctggctagattactgcctcagctacagaaagccggtttgtccgcgatcaacatctctttggataccctggtgcctgcaaaatttgagttcattgtacgcaggaaggggttccacaaggttatggaaggaatccacaaggctatagaattaggatataatccagttaaagtcaactgtgtcgttatgcgcggtctgaatgaggatgagctgttggattttgccgctcttactgaaggattgcccctagatgtcaggtttatagagtatatgccttttgatggaaacaaatggaattttaaaaagatggtgtcttataaagagatgttggacaccgtgcgccaacagtggcccgagctggagaaagtgcctgaggaagaatcgagcactgcgaaagcattcaaaatcccaggctttcagggtcagatatcatttattacatcaatgtccgaacacttctgcggtacctgcaatcgtctgcgcattacggccgatgggaatctcaaagtctgcctgtttggcaacagcgaagttagcctgcgggaccacctccgcgcaggggcatcagagcaggaactgctgcgaatcatcggcgctgcggtgggtcgcaaaaaaaggcaacatgcgggaatgttcagcattagccagatgaagaaccgcccaatgatcctcatcgagcttttcctgatgttcccgaattcacctcctgccaatccaagcatcttcagctgggatccgctccacgtgcagggccttcgccctagaatgagtttctcgtcccaagtggccacactgtggaagggctgtagagtgccacaaacccctccccttgcccagcagagattaggctctggttccttccagcggcattatacttcccgtgcagactcagatgctaactctaagtgcctttcccctgggagttgggcctctgccgcaccatccggccctcagctgaccagtgaacaacttactcatgttgacagtgagggtcgtgctgcgatggtagacgtgggcagaaaaccggatacagagagggttgctgtggcctcagctgtcgtcctgctgggcccagtggcattcaaattggtccagcaaaaccagctgaagaagggggatgcgctcgtggtggctcaactagcaggcgttcaagccgctaaagtgacgagccagctgatacccctttgccaccacgtggccctcagtcacatacaggtacaactcgagcttgattcaaccaggcacgccgtcaaaatacaggcctcctgtcgagctcgcggtcctacgggtgtcgaaatggaggccctaactagcgcagcggtggctgcactgactctgtatgacatgtgcaaagccgtgagtagagatatagtcttggaggaaatcaaactcatctctaagacaggtggacagcgcggagatttccaccgagcgtag

SEQ ID NO: 231026 - DNA, 456 bp, Artificial Sequence
  Description of Artificial Sequence: Synthetic coding sequence
atgcctttcgatggtaataagtggaattttaagaagatggtgagctacaaagaaatgctggacactgttcgacagcaatggccagagcttgaaaaagtgcctgaggaggagtccagcaccgcaaaggcgttcaagatacccggattccagggccagatatccttcatcacctccattctgacagtagctcgatcctgttggccactctttctgtggcccccttcatccgagaccggatgtgcgcacatgggacattcacctaaggactcgtgccagaccacacagcccaccccaggccctgttcatgggtgctctactcacccaagcctgttttggtccatttccggcaaggagaagttaatgattgactgcttgcacccacactctgctcagataaagctcaggtgtcaactatgcaggtgcaagaatgaagatactgtgtgggtgggccattag

SEQ ID NO: 231027 - DNA, 1071 bp, Artificial Sequence
  Description of Artificial Sequence: Synthetic coding sequence
atgtggaaatcctggaaattgagaacggatgtcagggaggtgtccaggcggaggcaattcctgcgcgaacatgcagcacccttttcagctttcctgactgattctttcggacgtcagcacagctatcttcggatctcccttaccgagaagtgtaatctgcggtgccagtactgtatgccggaggaaggcgttcccttgacacctaaagcaaacctccttactaccgaagaaatattgacactagcccgactgtttgtgaaagaaggaattgacaagatcagacttaccggcggtgaaccattgattcgccctgatgtcgtggatattgtggctcaactgcagcggctggagggccttcgaaccatcggcgtcaccactaacggaattaatcttgctcgtctgctgcctcaactgcagaaggccggactgagcgccattaatatttcactggatacgctggtccctgccaaattcgaattcattgtgagacgtaagggttttcacaaggtcatggagggtatacacaaggctattgaactggggtacaaccctgtgaaggttaattgcgtcgtgatgcgcggtcttaatgaagacgaactgctcgattttgcagcactgaccgaaggactgccacttgatgtcagatttattgaatatatgccgttcgatggaaataagtggaattttaagaagatggtgagttataaagaaatgctcgacacagtccgtcagcagtggcccgaattagagaaggtgcctgaagaggagagttccaccgcaaaggctttcaagatacccggttttcaaggacagatctctttcatcaccagtatgagtgaacacttctgtggcacctgcaatagactccgtatcacagcagacggaaacctgaaggtatgcctgttcggcaacagcgaagtgtctctgcgcgatcacctgagggccggagcttccgaacaggagttgttacggattattggtgcagctgtaggcagaaagaagagacagcatgccggaatgttctctatcagtcagatgaagaaccgcccaatgatactgattggcggatag

SEQ ID NO: 231028 - DNA, 1158 bp, Artificial Sequence
  Description of Artificial Sequence: Synthetic coding sequence
atgtggaaatcgtggaaactgagaactgacgtcagagtacgtgagggggcaggagggagcccatgcgcctcctcacagcctgggagtaggggaccctgcttcctgccaggcctgtccagccaggaagtgtctcgcaggaggcagttcctacgtgagcacgcggctcccttttccgccttcctgacagactcttttggtcgtcagcactcctaccttagaatctccctgacagagaagtgcaacttacgctgtcagtattgtatgccagaggagggagtgcctttgactcctaaggcaaaccttctcacgacagaggagatcctgaccctcgctcggctgtttgtgaaggagggtatagacaaaatacgccttacaggaggagaacctctgatccgcccagacgtggtagatatcgttgcccagttgcagcgcctggagggcttgcgtaccattggggtgacaaccaacgggatcaatcttgccaggcttttgccacagctgcaaaaggccggactcagcgccattaacataagcttggacacgttggtgcccgcaaagtttgaattcattgtgaggcggaaggggttccataaggtgatggaaggtatccacaaagctattgaactaggatataatcctgtgaaagtgaactgcgtcgtcatgcgcggactcaatgaagacgaacttcttgatttcgccgctttaacagaggggttgccccttgatgtgagattcattgaatacatgccgttcgacggtaataaatggaacttcaagaagatggtatcttacaaggagatgttggatactgtgcggcagcagtggccggagctggaaaaagtgcccgaggaggaaagtagcaccgccaaggcctttaaaatcccgggttttcagggacagatttcgtttattacctctatgtccgagcacttctgtggcacatgcaatcgactaagaattaccgccgatggaaatcttaaagtgtgcctctttggaaactctgaggtgagcctacgggatcacctcagggcaggggcaagcgaacaagaacttctgaggatcatcggggctgcagtcgggaggaaaaaaagacaacatgccggtatgttctcaatcagccagatgaaaaaccgcccaatgattctgattggcggatag

SEQ ID NO: 231029 - DNA, 1158 bp, Artificial Sequence
  Description of Artificial Sequence: Synthetic coding sequence
atggcagcacgccctctctccagaatgctccggagactcctgaggagcagtgcccgatcctgctcttcaggggcaccagttactcagccttgtccgggagagtccgccagggccgcaagcgaagaagtcagccgtaggcgacagttccttagggaacatgcagcacccttttcagctttcctcaccgacagcttcggcaggcaacacagttacctgcgcatctccttgaccgagaagtgtaatttacggtgccagtactgcatgccggaggagggcgtgccacttacacccaaagcaaatttgcttactaccgaagagatcctgaccctcgccaggctgtttgtgaaggaaggaatagacaagattagactcaccggaggggagccgctaataaggcctgatgtcgtcgatatcgtggcccagctgcaaagactcgaaggcctgcgaactattggagttaccactaatggcatcaatctggcccgactgttgccccaactgcaaaaggccggattgagcgccatcaacatcagcttagacacactggttccggctaaatttgaattcatcgttcgacggaaaggatttcataaagttatggaaggcatacacaaagcgatcgaactggggtataacccagtaaaagtgaactgtgtggtgatgagaggcttaaacgaggatgaattacttgactttgccgctctcaccgaggggttacccctggacgtacgctttatcgagtacatgccgtttgatgggaacaagtggaattttaagaagatggttagctataaggagatgttagacacagttcgccaacagtggccagagcttgagaaggtgccggaagaggaaagtagcaccgcaaaagcctttaaaattcctggattccaggggcagatctcattcattacctcgatgtccgagcacttctgcggcacctgtaaccgtctcaggataactgctgacggcaatctgaaagtctgtctgttcggaaattcggaggtctctctaagagatcacctcagagcgggagcgtcagagcaggaactgctccgtataataggcgcagctgtggggcgtaagaagcggcagcatgccggtatgttctctattagccagatgaaaaataggcctatgatactgataggaggctag

SEQ ID NO: 231030 - DNA, 1602 bp, Artificial Sequence
  Description of Artificial Sequence: Synthetic coding sequence
atgccagaggagggcgttccactgacacctaaagcaaatctcctgactaccgaggaaattctgactctcgcacggctctttgtgaaggagggaatagataaaatcagactcaccgggggagagcccttgattaggcccgatgtagtggatattgtggcccaactccagagactagagggcctcagaaccataggggtgacgaccaacgggatcaatctagcacggttgctgccacagttgcagaaagccggactctccgccattaacatcagtctcgacaccctggtgccagcgaagtttgagttcatcgtccgcaggaagggtttccacaaggttatggagggtatccacaaagcaatagagctcggatataatccagtaaaagtcaattgcgtggtgatgagaggcttaaatgaagacgagctgcttgacttcgcagcactgacagagggtcttcccctggatgtcaggtttattgagtacatgccctttgatggtaacaagtggaactttaagaagatggttagctacaaagaaatgctggacactgtgaggcagcagtggcctgaactggaaaaggttcctgaagaggagtcctccaccgccaaggcctttaagattccagggtttcagggccagatctctttcatcacatcaatgtcggagcatttttgcggcacctgcaacagattgagaatcacggccgacgggaacctaaaggtgtgcttgtttggaaattcggaagtgagcctcagggatcatctgagggctggagcttccgaacaagagctgctcagaataatcggagccgcagtaggcaggaagaagcgccagcacgccgaactgttcctcatgttcccaaacagtcctcccgcaaacccctcaattttttcttgggaccctcttcatgtccagggcctccgcccacgcatgtctttctcaagccaagtcgccaccctatggaaaggctgtcgagtgccccagacacccccactggcccagcaacggttaggaagcggatcattccaacggcattacaccagcagagccgactccgatgccaattctaaatgtctgagccccggatcctgggcctctgcagcaccttccggtccacagctgactagcgagcagcttacacatgtggatagcgagggaagagcagctatggtggatgtggggagaaaacccgacacagagcgcgtagcagtggcctctgccgtggtcctcctgggtccggtagcttttaagctcgttcagcagaaccagctgaagaagggtgacgctctggtggtggctcagctggcaggtgtgcaggctgccaaggtcacctctcagctcataccgttgtgtcatcatgtggccctttcacatatccaggtgcagctggaacttgattcgactcgccacgccgtgaagattcaagccagttgccgcgcacgcggacccactggcgtcgaaatggaggcactgaccagcgcagccgtcgcagcgctaactctctatgacatgtgcaaagcggtgagcagagatatcgtgctagaggagataaagcttatttcaaaaactggcggacagagaggggacttccatcgagcttag

SEQ ID NO: 231031 - DNA, 1911 bp, Artificial Sequence
  Description of Artificial Sequence: Synthetic coding sequence
atgtggaagtcttggaaactgcgtacggatgttagagtcagagaaggggcagggggtagtccttgtgcatctagccaacccggtagtcgcggaccttgtttcctcccaggactgagctcccaagaggtgtcgcgacgtagacaatttctccgcgaacacgccgcacccttctccgcttttctgactgattcgtttgggagacaacactcttaccttcggatttcattaacagaaaagtgcaacttgcgctgtcagtactgtatgccagaagagggggtgcctcttaccccaaaagctaacctcctcacgacagaggaaattctgacactggccagactcttcgtgaaagagggcatagacaaaattcggctaaccgggggagaaccattgattagaccagatgtggttgatattgttgctcagctgcagcgtttggaaggtctgcgcacgatcggggtcacaactaatggtattaacttagcgaggctgctaccgcagctccaaaaggccggactgtcggcgataaacatcagtctggacactctggtgcctgctaagttcgaatttatcgtccggcgaaaaggcttccataaggtcatggaagggatacacaaggcgattgagctgggctacaacccagtcaaagtgaactgcgtagtcatgcgagggctgaatgaggatgaactcctcgatttcgcagccctgaccgaaggcctacccctggacgtccgatttatcgagtacatgccattcgatggcaacaaatggaactttaagaagatggtatcttacaaagaaatgctcgacacagtccggcagcagtggcccgagctggagaaagtgcccgaagaggaaagctcaacagccaaggcgttcaaaatccccggttttcagggccagatatcattcattacttctatgtcagagcacttctgcggcacctgtaaccgactccggatcactgcggatgggaatctaaaggtttgcctctttggtaatagtgaggtgagcctgcgagatcacctgcgcgctggagcctccgagcaggaacttctccgcatcatcggagccgcagttggtcggaaaaaaaggcagcatgctggaatgttttctatctcccaaatgaagaaccggccaatgattctgatagaactgttcctcatgtttcctaactcccctcctgccaacccctcgatctttagctgggatccgcttcacgtgcagggtctccgaccccgaatgtcattttcttcacaggtcgccacactgtggaagggctgccgcgtgccgcagaccccgccactggcccagcagagactgggtagtggatcattccagcggcactataccagtagggctgactctgacgctaacagtaaatgcctgtcccccggatcgtgggctagtgccgcaccgtcaggtcctcagctcacctcagagcagctgacacatgtcgatagtgaaggccgagcggcaatggttgacgtcggcagaaaacccgacactgagagggtagcagttgcctcggccgtggtactgctggggcctgtggcgtttaaactcgtgcaacagaaccaactgaagaagggtgatgcattggtcgttgctcagctcgctggcgtccaagctgcaaaggtgaccagccagctgattccactctgccatcacgtcgccctgtcccacatacaggtccagcttgagttggacagcacccgccacgccgtgaaaatccaggcttcctgtagagctcggggtccaaccggtgtggagatggaggcactcacctcagccgctgtcgccgcactcaccctctatgatatgtgtaaggctgtgagtcgtgatatcgtcctcgaggaaataaaactcatctctaagacgggagggcagcgaggggattttcatagagcgtag

SEQ ID NO: 231032 - DNA, 1071 bp, Artificial Sequence
  Description of Artificial Sequence: Synthetic coding sequence
atgtggaagtcgtggaagttgcgtaccgacgttagggaggtcagccggagaagacaatttctgagagagcacgccgctccgttctccgccttcctgaccgacagctttggccgacagcacagttacctccgcatttctttaacagaaaaatgcaatttgagatgtcaatattgcatgcccgaagagggcgtgcctctcacacccaaggccaatttactgacaacagaggagatcttaacccttgccaggctcttcgtgaaggaaggaatcgacaaaatcaggttaacagggggagaaccgcttatccgacccgatgtcgtggatatagtcgctcagctccagcgccttgaggggttaagaactataggagtcacaactaacggaattaacctggctagactgctccctcagctacagaaggccggactcagcgccataaacatttccctggacactctcgtcccggcaaagttcgaattcatcgtgaggaggaaagggttccataaagttatggagggtatacataaggcaattgagcttggctataatcccgttaaagtgaattgtgtcgttatgaggggcctgaacgaagacgagttacttgacttcgccgcactgacagaaggactgccgctggacgtgaggtttattgagtacatgccgttcgatggtaacaagtggaatttcaaaaagatggtctcgtataaggagatgctcgacacggtaagacaacagtggcctgagctcgaaaaagtccccgaagaggagtcatcaaccgctaaggccttcaagattcctgggttccagggacaaatctcttttattacctctatgagcgagcatttctgtgggacgtgcaatagactgaggattaccgctgatggtaacttgaaggtgtgcttgttcggtaattctgaagtgtcccttcgcgatcacctgcgggcaggggctagcgaacaggagctcttgcgaatcataggagcggctgtgggacgaaagaaacgccagcacgccggaatgttttcaatctcgcagatgaagaacagaccaatgatcctcattggaggttag

SEQ ID NO: 231033 - DNA, 267 bp, Artificial Sequence
  Description of Artificial Sequence: Synthetic coding sequence
atggtgcccctgtgtcaggtggaagtactatattttgccaagagtgctgagatcaccggagtgaggtcagaaactattagcgtgccccaggagatcaaggcgctgcaactctggaaggagattgagacacggcatcccggtttggctgacgtcaggaaccagatcatatttgccgtgagacaggagtatgtggaactgggtgaccaactgctcgtgttgcagccaggtgacgagatcgcggtgataccccctataagcggcggatag

SEQ ID NO: 231034 - DNA, 567 bp, Artificial Sequence
  Description of Artificial Sequence: Synthetic coding sequence
atgtcttcactggaaatatcttcctcctgttttagcctcgagaccaaactgcccctgagcccacctctagtcgaagactcggctttcgaaccgtctaggaaggatatggatgaggtcgaagagaagtctaaagacgtaattaacttcacagcagagaagttatccgttgacgaggtctcccaattggtgatcagcccactgtgtggtgcgattagtctgttcgtgggtaccactagaaataattttgaggggaaaaaagtgatttcgttggaatatgaggcgtacctgccaatggcagagaacgaggtcagaaagatttgctctgacatacgccagaagtggccagtcaaacacattgccgtgttccatagactgggcctggtgcctgttagtgaggcgtcaatcatcatagcagtgtcctcagcacatcgggctgccagcctcgaggccgtatcatatgctatcgatactctaaaggccaaagttcctatttggaagaaggaaatttatgaggaatcatcaacctggaaaggaaacaaggagtgtttttgggcatccaattcttag

SEQ ID NO: 231035 - DNA, 267 bp, Artificial Sequence
  Description of Artificial Sequence: Synthetic coding sequence
atggtccctctgtgtcaagtggaagtactgtatttcgccaagtccgccgagataaccggcgtgagatcagaaacaatttctgtgcctcaggagatcaaggccctccagttgtggaaagaaattgagactcggcatccgggtctggctgatgtgcgcaatcagattatttttgcagtccgccaagaatatgttgaattgggcgaccagctcctcgtattgcagcctggagacgaaattgccgtgataccaccgatttcgggcggttag

SEQ ID NO: 231036 - DNA, 267 bp, Artificial Sequence
  Description of Artificial Sequence: Synthetic coding sequence
atggtgcccctttgtcaggtggaggttctgtatttcgccaagagcgccgaaatcacgggagttcgctccgaaactatatccgttccacaggagatcaaagcactccagctgtggaaggagatagaaaccaggcaccctgggctggctgacgtgcgcaatcagattatctttgcagtgcgacaagagtacgttgaactcggggatcagttgctcgtgctgcaacccggagacgagattgccgtcatacctccaatttctgggggatag

SEQ ID NO: 231037 - DNA, 267 bp, Artificial Sequence
  Description of Artificial Sequence: Synthetic coding sequence
atggtgcccttgtgtcaggtggaggtgctctattttgctaagagtgcagagattacgggggttagaagcgaaacaattagtgtgcctcaggaaataaaagcactacagttatggaaggagatcgaaacgcggcatccgggactggcagacgtcaggaatcagatcatttttgcagtaagacaggaatacgttgagctgggggatcagctactggtgttgcagcctggagacgagattgcagttatccctccgatctccggcggatag

SEQ ID NO: 231038 - DNA, 462 bp, Artificial Sequence
  Description of Artificial Sequence: Synthetic coding sequence
atgagttcattagagattagctctagctgcttttcactagagacaaagcttcccctgtcgccccctcttgtggaagacagtgcatttgagcccagccgcaaagatatggacgaggtggaggagaagtctaaggatgttatcaacttcaccgccgaaaagctctctgtggatgaggtgtcacagctggtgataagccctctctgtggcgcaatatcgctgttcgttggaacaacaaggaacaattttgaaggcaaaaaagtgatatccctggagtacgaggcatacctcccaatggctgaaaacgaggtgcgtaagatctgcagtgatataagacaaaagtggcccgtaaagcacatcgcggtgttccataggctcgggctggtcccggtgtccgaagcctcaattataatcgcagtgtctagtgcccacagggccgctagcctggaagccgtgagctattag

SEQ ID NO: 231039 - DNA, 1644 bp, Artificial Sequence
  Description of Artificial Sequence: Synthetic coding sequence
atggaggttggtggggacactgccgctcccgctccgggaggcgctgaggacttggaggacactcaatttccgagcgaggaagccagagaagggggaggggtgcacgctgtgcccccagacccagaggatgaaggcctggaggaaacaggctctaaggacaaagatcaacccccttcccccagcccccctccccagtctgaggctctgagttccaccagtcggctctggtcaccggcagccccagaaaatagcccaacttgctcccctgaatcatcttctggaggacagggcggtgatccttcagatgaagaatggcggagccagcgcaaacatgtgtttgtcctcagcgaggctggaaaaccaatttattcccgatatggatcggtggaggccctcagcgccacaatgggcgttatgacagccctcgtatcttttgtccaatctgccggagacgcaatacgagccatttatgccgaagatcataagctcgtcttcctccaacaagggccactgctcctggtggctatgagtcgcacttctcagtctgctgcccaactcaggggcgaactgctggccgtacacgcccagatcgtcagcacactcacaagggcctcagttgccaggatctttgctcacaaacagaattatgacctgagacgcttactggcgggtagcgagcgtaccctcgaccggttactcgactccatggaacaggaccccggagcactgctcttaggcgcagtgcgctgtgtccctctggccaggcctctacgagatgctctgggcgctctgctgaggcggtgtacggccccaggactcgctctaagtgtcctagccgtgggtgggaggctgattaccgctgcccaggagcggaatgtgctggctgaatgccgcctggatcctgcagatctccagttactccttgactgggtaggtgccccagctttcgccgctggcgaagcatgggcccctgtttgcctgcctcgtttcaatcctgacggatttttttacgcttatgtggcaagactcgatgctatgcctgtgtgtctgttactgcttgggactcagcgggaagcattccatgctatggcagcgtgtcgacgacttgtggaagacggaatgcacgcactaggagcaatgagggcactgggcgaagccgcatccttttcaaacgccagcagcgcaagcgctccagcttacagtgtgcaggctgtcggcgctcccggtctgcgccatttcctttataagcccctggatatccccgatcaccatcggcaactccctcagttcacttctcccgaactggaggccccttacagtagagaagaagaaagacagcggctgagtgacctgtatcacagactacatgcgagactccactccactagccgcccactgcgcctcatttatcatgtagctgagaaagaaacgttactggcttgggtaacctctaagttcgagctgtatacgtgtctaagcccgctggtgaccaaggcaggggcaatccttgtggtcacaaagcttctgcggtgggtgaagaaagaggaggaccggcttttcattagataccctcctaaatacagcacgcctcctgctacaagcacggatcaggccgcacacaacggattgttcacagggttatag

SEQ ID NO: 231040 - DNA, 438 bp, Artificial Sequence
  Description of Artificial Sequence: Synthetic coding sequence
atggaggtcggaggcgacacagccgctccggctcccggaggagcagaagatcttgaagatacccagtttccatcagaggaagcccgagaaggaggtggagtgcatgccgttcctccagacccggaggatgagggactggaggaaactggctcaaaggacaaagaccagcctccttctccttctccgccaccgcaatctgaagctttgagctctacaagtcggctttggtcaccagcggcaccagagaactcccctacgtgctctccagagtcatcttccggaggccagggaggcgatccctctgacgaggagtggcgttctcagagaaacggctgtcggacatgcaccactgcctgcatgctagtgagcacagctccgccagatccatgcgcgtcttttacaacctggttgagacgtagacactattggcccggatag

SEQ ID NO: 231041 - DNA, 1317 bp, Artificial Sequence
  Description of Artificial Sequence: Synthetic coding sequence
atggaggttggcggtgacaccgcagctcctgcacctgggggagccgaggaccttgaagatactcaatttccgagtgaggaggcgagagagggcggtggggttcacgccgtgcctcccgaccccgaggatgagggcctggaggagaccgaggatcataagctggtgttcctccaacagggcccacttctgctggtagcaatgagtcgcacctctcagtccgcagctcagctgcgaggagaacttctcgctgtgcacgcccagattgtgtctactttaactagggcttctgtggcaaggatctttgcccacaagcagaactatgatttgagaagattattagctggctccgaacggacgttagatagactgctggacagcatggaacaagaccctggcgcattattgttgggggcagtgcggtgcgtgccccttgccaggcccttaagggacgcactgggggcactactgcggaggtgtactgcgccaggcctggccctgtccgtactcgctgtcggcggtcggctgataacagccgcacaggaaagaaacgtgctggctgaatgtcgactagatcctgctgacctgcagctgctactggattgggtgggtgctccagccttcgccgctggagaggcatgggctcctgtttgtctccccaggtttaacccagacggcttcttttatgcttacgtggcgaggctcgacgctatgcctgtctgccttctacttctcgggacacagagggaggcctttcacgctatggctgcatgccggagactcgtcgaagacgggatgcatgctctgggcgcaatgagagccctgggagaagccgcttccttctcaaacgcctcctctgcctctgcccctgcctattccgtgcaagctgtgggcgcaccgggactcaggcattttctctacaaacctctcgatatcccagatcaccaccgccagctgccacagtttacgtcacccgagctagaggccccatacagtagagaagaggagaggcagagactgtcagatctataccaccggcttcacgcgaggttacactccacctcgagaccacttcgcttaatttatcatgtggcggaaaaagagactctgctggcctgggtgacctccaagttcgagctgtacacctgcctctcccctctggttaccaaggccggtgctattttggtcgttaccaagctattacgttgggtcaagaaggaagaggaccgcctatttatccgctacccaccaaaatactcaaccccccctgccacctccacggaccaagcagcccacaacggtttgtttaccggcctttag

SEQ ID NO: 231042 - DNA, 1206 bp, Artificial Sequence
  Description of Artificial Sequence: Synthetic coding sequence
atggtatccggccagctccgattcggcgttaaaaccgaggatcacaagctggtgtttctccagcaggggcctttactcttggtggctatgagtcggacaagccagagtgcagcccagctgaggggagaactcctggcagtccacgcacagatagtgtccaccttaacccgcgcttctgtcgcgaggatcttcgctcacaagcaaaattacgacctacgcagactgctggccggatccgagcgcaccctggataggctgctggatagcatggaacaagacccaggggcacttcttctaggggctgttcggtgtgtgcctctggcacgaccattaagggacgcgttgggcgctcttctgcggaggtgtaccgcccctggattggctctgtccgtgctggccgtcggcggaagactgattacagcggcacaggagcggaatgtcctggctgagtgccgcctggacccggctgacctgcagctgctgctggattgggtcggggcacccgcatttgcagccggtgaagcctgggcccctgtctgcctgccccgtttcaaccccgatggctttttctacgcatacgttgcccgactggacgcaatgcctgtttgtcttcttttgctgggcacccagagggaagcatttcacgccatggccgcatgcaggcgcctggttgaggatggaatgcatgccctaggggctatgcgggctctgggtgaggccgcatccttttcgaatgcctcgtctgcaagcgcaccagcttactctgtccaggctgtaggcgcaccaggcttaaggcactttctgtacaaacccttggacatccccgaccaccatcggcagttaccccagtttacctcccctgaactcgaagcaccttattcccgggaggaggagaggcagcggctttctgatctgtatcacaggctccacgcccgtctgcactccacgtcccggccattgcgactgatttaccatgtcgctgaaaaggagacactgcttgcatgggtgactagcaaattcgagttatatacttgtctctcaccgctggtcacaaaagccggagcaatattggtcgtcacgaagctcctgcgttgggtgaaaaaagaggaggatcgcctctttatcaggtacccaccaaagtacagcactccaccagctaccagcactgaccaggccgctcataacggactcttcaccgggctgtag

SEQ ID NO: 231043 - DNA, 1584 bp, Artificial Sequence
  Description of Artificial Sequence: Synthetic coding sequence
atggaaaatcaagaaaaggcctctatcgccggacacatgtttgacgtggtagttatagggggaggcattagcggcctttctgcagccaaactcctgaccgagtatggcgtgagcgttctagtgctcgaagctcgagatagggttggcggaaggacgtatacaatcagaaacgagcatgtcgactatgtcgacgttggcggagcctatgtgggcccaacacaaaatcgcatactgcgtctgtccaaagaactcggaattgagacgtacaaagttaatgtttccgagaggctggtgcagtatgtgaaaggcaaaacctacccatttcgaggcgctttccctcctgtatggaacccaattgcctaccttgactataataacctttggcggactatcgataatatgggcaaggagattcctaccgacgccccttgggaggctcagcacgccgacaagtgggataagatgactatgaaggagctgatcgataaaatctgttggacgaaaactgctaggaggttcgcctacctctttgtgaacatcaacgtcacaagcgaaccccacgaagtctccgctttgtggtttctatggtatgttaagcaatgtggcggtacgaccaggatcttcagcgttaccaatgggggacaagagcggaaatttgtcgggggttctggacaagtctcggagcggatcatggatcttttgggggaccaggtgaaactgaaccacccggtgacccatgttgatcaatctagtgacaacattattattgaaacactgaatcacgaacattacgagtgcaagtacgtgatcaacgcgatcccccctacactcactgctaagattcattttagacccgagttgcctgcagagcggaaccagctcatccagcggctgccgatgggcgcagtaattaaatgtatgatgtactacaaagaggcattctggaagaaaaaagattactgcggatgcatgattattgaggatgaggatgctccgatatccattactctggacgacacgaagcccgatggcagtttgcccgcaatcatgggttttatcctggcacgtaaggccgaccggctggcaaaattgcataaggagattcgtaagaagaagatttgtgaactgtacgccaaggtactggggtcacaggaggctttgcatccagttcattatgaggaaaaaaactggtgcgaagagcagtactcaggaggctgttacaccgcgtatttccccccaggtatcatgacacaatacggcagggtgattcgccagccggttgggaggatcttcttcgccggaactgaaacagccaccaaatggagcggatatatggaaggagccgtagaagccggagagcgtgccgctcgggaagtacttaacgggctgggcaaggtgacagaaaaggatatctgggtgcaggagccagaatccaaggatgtccctgcagttgaaattacccacactttttgggagcggaacttgccaagtgtgtccgggctcttgaagatcataggctttagtacaagcgtaaccgccttgggcttcgtcctatacaaatacaagctgctgcctaggagctag

SEQ ID NO: 231044 - DNA, 1185 bp, Artificial Sequence
  Description of Artificial Sequence: Synthetic coding sequence
atgggtaaggaaatccccactgacgcaccttgggaagcccagcacgcagataagtgggataagatgacaatgaaggaacttattgacaagatctgttggactaaaactgctcgaaggtttgcctacctgttcgtgaatatcaacgtaaccagtgaaccacacgaagttagcgccctgtggttcttgtggtatgtgaaacagtgcggaggtacaactagaatttttagcgtgaccaatggtggacaggaacgtaagtttgtcggaggatcagggcaagtgtctgaaagaataatggatctgcttggggatcaggttaagctgaaccacccggtcacacacgtggaccaatctagtgacaacatcatcatcgagactctgaatcatgagcactacgagtgtaagtatgtcattaacgcgattcctcccacgctgaccgctaaaatacattttaggcctgagctgccggcagagagaaaccaattaattcagcgactgccaatgggggcagtaattaagtgcatgatgtactataaggaggcattctggaaaaagaaagattattgcggatgcatgataattgaagacgaggacgctcccattagcataactttggatgatacaaaacctgacggtagtctccccgcaataatggggttcattctggcccgaaaagctgacaggctggccaagttacataaagagatccgtaaaaaaaagatctgcgagctgtatgcaaaggttctcggctcgcaagaagccttacacccagtgcattacgaagagaagaattggtgcgaagagcaatacagtgggggatgttataccgcctacttccccccaggaatcatgacccaatacggacgagtgattcgccagcccgtcggcaggatattcttcgcgggaaccgaaactgccaccaagtggtctggttacatggagggagcagtggaggctggcgagcgcgcagcccgtgaggtgctgaacggactgggcaaggtaactgaaaaggacatctgggtccaagaacctgaaagcaaagacgtccctgcagttgagattacccatactttttgggagagaaacttgccatcagtctccggtcttctcaaaatcattgggtttagcaccagcgtgacagccttaggctttgtactgtacaaatacaagctgctgccacgaagctag

SEQ ID NO: 231045 - DNA, 1563 bp, Artificial Sequence
  Description of Artificial Sequence: Synthetic coding sequence
atgagcaacaagtgtgatgtggttgtcgtgggcggtggcattagcggtatggctgcagccaagctccttcatgattccggacttaatgttgtggtcctggaagccagagatagggtgggcggaagaacctatacactcaggaaccagaaggtcaaatacgtggacctgggcggtagctacgttggtcctacacagaaccgaatcctgcggctggcaaaagagctgggcctggagacatataaagtgaatgaagtcgaacggctgattcaccacgtcaagggaaagtcatacccgtttaggggaccgttcccaccagtgtggaatccaatcacatacctggaccacaataatttttggaggacgatggatgacatggggagagaaatcccctctgacgcaccatggaaagcaccactggccgaagagtgggacaacatgactatgaaagaattactggataaactgtgctggactgagagtgcaaagcagctggccacactgtttgttaacttgtgcgtcaccgctgagacacacgaagtatcagccctatggtttctgtggtacgtcaaacagtgtggcggaacaacaagaataatcagtaccacgaacgggggtcaagaaaggaaatttgtgggtggatccggacaggtcagcgagcgtattatggatctcctgggtgacagggttaagctggaacgcccagtcatttacatcgatcagacccgggagaatgtgctggtggaaactctcaaccacgagatgtacgaagctaagtacgtcataagtgcaataccccctacgttgggaatgaaaatccattttaacccacctctgcctatgatgagaaaccagatgatcacacgcgtgcctttaggaagcgtgatcaagtgtattgtttactataaggagccgttttggcgaaagaaagattactgcggaactatgattatcgacggcgaagaagcaccagtggcatatacactggacgatacaaaaccagaggggaactacgccgctattatgggttttattcttgctcataaggctaggaaactggctagacttactaaggaggagcgtctgaagaagctctgcgagctctacgccaaagtcctggggtccctagaggccctggaaccagttcattacgaagagaagaactggtgcgaggagcaatactccgggggttgttacaccacttattttcctccgggaatcttgacacagtatgggagagttctacgccagccggttgaccgcatatattttgccggaaccgaaacagctacccattggtcaggatacatggaaggcgcagttgaggcaggcgaacgtgccgctcgggaaatactgcacgccatgggtaaaatacccgaggacgaaatctggcagtccgaaccggagtcagtggacgtcccagcgcaacccattactaccacctttttggaacgtcatttaccatccgtgccaggtcttttacgactgattggcttgactactatcttttccgctacagccctcgggtttctggctcacaagcggggactgctggtcagggtgtag

SEQ ID NO: 231046 - DNA, 1515 bp, Artificial Sequence
  Description of Artificial Sequence: Synthetic coding sequence
atggccgcagccaagctgttgcatgactctggcctgaacgtcgtggtccttgaggctcgggatagagtgggaggtcgcacgtatacattgagaaatcagaaagtcaagtatgtagacctgggcggatcatacgtgggcccaacacagaaccggatcctgcggttggccaaggaactgggtttagagacctataaagtcaacgaagtggaaagattgatccatcacgtcaaaggcaagagctacccatttaggggcccatttcccccagtgtggaaccctatcacatacctcgaccataataacttttggcggaccatggatgacatgggccgagaaataccttcagatgctccttggaaagctccacttgcagaggaatgggataacatgactatgaaagagctgcttgataagctgtgttggaccgaaagtgcaaaacagctggccaccctcttcgtgaatctctgtgtgacggctgagacccatgaagtcagtgccctttggtttttatggtacgttaagcagtgcggcggaacaaccagaatcatctccaccactaatggcggacaggaaaggaaatttgttggcggttctggccaagtctctgaaaggattatggatcttctgggggatcgtgtgaaactcgaacggcctgtcatctatattgatcagacccgggagaacgtcctcgtggagacactgaaccacgagatgtacgaagctaagtacgtcatttctgcaatccccccaactttagggatgaagattcattttaacccccctttgccaatgatgaggaaccagatgatcactcgagtcccgctggggtcagtgataaagtgcattgtctattacaaagaacccttttggcgcaagaaggattactgcggtactatgattattgatggagaagaggcgcctgtggcctatactttagacgacacaaagcccgaagggaattacgctgccatcatgggttttatactcgcacacaaggccaggaaactggcaaggctgactaaagaggaaaggctgaagaaactgtgcgagctttatgctaaggtgctgggaagtctagaagcactcgaacctgtccattacgaagagaaaaattggtgcgaggaacaatatagcggtggatgctataccacgtatttccctccaggaatcctaacccagtacgggagggtcctgagacagccggtggaccgaatttattttgctggcactgagaccgcaacccactggagtgggtatatggaaggggcagtggaggccggagagagggctgcgagggaaattttgcacgccatggggaagatccctgaggatgaaatatggcagagcgagcccgaatctgtggacgttccggcacaaccaattaccacaactttcctggagcggcacctgccctctgtccctggactgctgcgcttaatcgggttgaccaccattttctccgccacggcgcttgggttcctcgcgcataagcggggactgctcgtccgtgtgtag

SEQ ID NO: 231047 - DNA, 1236 bp, Artificial Sequence
  Description of Artificial Sequence: Synthetic coding sequence
atggcggctgctaagctgctgcacgatagcggactaaacgtagttgtgctcgaggcgagggacagagtcggtgggcgtacctacacactgaggaaccagaaggtcaagtacgtggatcttggtggaagttacgtgggcccaacccaaaataggatcctgagactggccaaggagctgggattggagacctacaaggtcaacgaggttgaacggctgatccaccacgtgaaaggcaagtcttaccccttcaggggaccattccctccagtctggaatcccattacctatctggatcataacaacttctggagaactatggacgacatgggaagggaaataccttccgatgccccttggaaagcccctctcgccgaagaatgggataatatgaccatgaaggagcttctggataagctctgttggacagagtcagccaaacagctcgccactttgtttgtgaatctttgcgtcaccgcagaaacccacgaggtgagcgctttgtggtttctttggtacgtaaagcagtgcggcggaactacgcgtatcataagtaccaccaatggcggtcaggaacggaagtttgtgggcggatccggacaggtgtccgaaaggattatggacttactcggtgaccgggtcaagctggagcgacctgtaatttacattgatcagacccgcgagaacgttctggtggagaccctgaaccacgagatgtacgaggctaagtatgtgatctcggcaattccaccaaccctggggatgaagatccacttcaaccctcccctgcctatgatgcgcaatcagatgatcactagagttcctcttggctcagttatcaaatgtattgtgtactataaggaacccttctggaggaaaaaagattattgtgggactatgattatagacggcgaggaggcccctgtcgcctacacgctggatgatacaaagcccgaggggaactatgccgctattatgggatttattctggctcataaggctcggaagctggcacgcctcacaaaagaagaaagactcaaaaagctttgcgaactgtatgccaaggtgctaggtagcctcgaggccctggaaggctctacccccgcttctggccaggacctgctatgccgacacagagattgccacaccttagaacggctacatggcggagggtgtaggggccgaggcgaatccagccccagggaccctgcctgccatggcgaagattcaagaggttag

SEQ ID NO: 231048 - DNA, 741 bp, Artificial Sequence
  Description of Artificial Sequence: Synthetic coding sequence
atgttcgcgcctagactgctggactttcaaaagaccaaatatgcaaggtttatgaaccatagggtgcccgcacacaaacgttaccagccaaccgagtacgagcacgctgccaattgtgcgacgcatgctttctggatcattccttcgatcctgggtagttccaacctctacttcctgagtgacgacgattgggagacgatttccgcgtggatctacgggctgggactgtgcggcctctttgttgtatccacagtgtttcacacgatctcctggaaaaagagccacctgcggatggtggagcattgccttcatatgttcgatcgcatggtgatctatttctttatagctgcctcttacgccccatggttgaatctcagagaactcggcccatgggcaagccacatgagatggctggtgtggatcatggccagcgttggtacaatttatgtgttcttcttccacgaacgctacaagctggttgaattgctttgttatgtcgtgatggggttctttccggctctggtgatcctgtctatgccgaacaccgaagggatttgggagctcgtaacagggggagtgttctactgcttggggatggtattcttcaagtcggatggtcgaattccatttgcacacgctatatggcatttattcgtggcgttcggcgctggcacccactattacgcaatctggaggtatttgtatctgccctccacacttcagactaaggtatccaagtag

SEQ ID NO: 231049 - DNA, 813 bp, Artificial Sequence
  Description of Artificial Sequence: Synthetic coding sequence
atgtttgcccctcgcttgctggatttccagaagactaaatatgcccgattcatgaaccatagagtgccagcccacaagcggtaccagccaacagaatatgaacacgccgctaactgcgcaacacacgccttctggataattccatccatcctggggtcttcaaacctgtattttctctcggatgatgactgggagactatctccgcctggatctatggactgggcctgtgcggcttgttcgtggtcagcacagtttttcacacaatttcttggaaaaagagtcacctccggatggttgagcactgtttgcacatgtttgaccgaatggtcatctacttcttcatagctgctagttatgccccatggcttaacttgagggaactgggtccttgggcgtcacatatgcggtggttggtgtggatcatggcctccgtcgggacaatttacgtgttcttttttcacgagcgcacaggctcctgtgtgcaatttttgcggggagaagcatgtcccaaggccggtacagcctgcttgccagcccgttacaagctggtggaacttctgtgctatgtggtgatgggtttttttcccgctctggtgatcttgtctatgcccaacacagaggggatttgggagctggtgactggcggagtgttttattgcctgggcatggtgttcttcaaatccgatgggagaatccctttcgcccacgctatttggcacctgtttgtcgcctttggagcgggaacacattattatgccatttggaggtatctgtatctgccaagtaccctccagaccaaagtgtcaaaatag

SEQ ID NO: 231050 - DNA, 582 bp, Artificial Sequence
  Description of Artificial Sequence: Synthetic coding sequence
atgttcgctcccaggctccttgattttcagaaaactaaatatgcaagatttatgaaccaccgagtgcccgcacacaaacgctaccagcccaccgaatacgagcatgctgctaattgcgccactcacgccttttggattataccaagtatcctgggttcatctaacctctacttcttaagtgacgatgactgggagactatcagcgcttggatttacggcctgggactctgcggtctgtttgtggttagtacagtgttccacacaatatcatggaaaaagtcccatctgcggatggttgaacactgtttgcacatgttcgatcgaatggttatttacttttttatagcagcatcatacgccccttggctgaaccttcgcgagctggggccttgggcatcgcacatgagatggcttgtgtggataatggcctccgtgggcacaatctacgtcttctttttccatgagcgatataagctcgtggaactgctgtgttatgtcgttatggggttcttccctgcgctggtgatactgtccatggccggaaagctgaggcctggaatgacatgcctgaagcggcagtag

SEQ ID NO: 231051 - DNA, 942 bp, Artificial Sequence
  Description of Artificial Sequence: Synthetic coding sequence
atggagactggccctgaagatccttcgtcaatgcccgaagagagctcacccaggaggacaccccaatccatcccttatcaggacttaccacacctggttaacgcggatgggcagtatcttttctgccgctactggaagccaaccggcacacctaaagccttgattttcgtgagccatggagccggagagcactctgggagatatgaggagttggctaggatgctcatgggactggatcttttggtgttcgcccacgaccacgtcgggcacgggcagtccgaaggggaacggatggtcgtgtccgattttcacgtattcgttcgagacgtgctgcagcacgttgattcaatgcagaaggactatcccggattgcccgttttcttactgggtcactctatgggcggagcaatagccatcctgacagccgctgagagacctggacatttcgctggaatggttttgatctccccactggttttagccaatccagaatcagcaactacttttaaggttctcgcagcgaaggtccttaacctggtcctgcccaacctttctctgggccctattgatagctccgtcctcagtcgaaacaagacagaagtggatatctataacagtgatccgttaatctgtcgagcagggctgaaggtgtgctttggaatccaactactcaatgcggtcagtcgggttgaaagggccctccctaagctgactgtacccttcctcctgctccaggggagcgccgatcggctgtgcgactctaaaggcgcttacctcctcatggaacttgccaagagtcaggacaaaactctcaagatctacgagggcgcataccacgtgttgcacaaggagttgccagaagtgaccaactctgtgtttcatgagataaacatgtgggtttctcagcgcactgccaccgccggtacggcttcccccccttag

SEQ ID NO: 231052 - DNA, 912 bp, Artificial Sequence
  Description of Artificial Sequence: Synthetic coding sequence
atgcccgaggagtcttcgccaaggagaaccccacagtcgatcccatatcaggatctgccacacctggtaaacgccgatgggcaatacctgttttgtaggtactggaaaccaacagggacgcccaaggctctgattttcgtgagccatggcgctggtgagcactctgggcgatatgaggagttagcaagaatgctcatgggcctcgatctcctggtctttgcccacgaccatgtgggacacggacagtccgaaggcgaaagaatggtcgtaagtgatttccacgtgtttgtgagagatgtcttgcaacacgtcgatagtatgcagaaggattatccgggtttgcccgtatttctgcttgggcattccatgggaggagcgatcgccattctaaccgctgctgagcgtccagggcactttgcaggcatggtgctgatttcaccactggtgttggccaacccagaaagcgccactaccttcaaagtactggccgctaaggtactaaacctggtccttcctaacctgtctctgggtccaatagattcttccgtgttgagcagaaataagaccgaagtcgacatctacaattctgatccgttgatctgtcgggctggattaaaggtatgcttcggaattcagcttttaaatgccgtgtctagagtcgaacgagctctgcctaagctgaccgtgccgtttctgctgttacaggggagtgccgaccggttgtgtgattctaaaggcgcttacctcttaatggagttggctaagtctcaggataagactctcaagatctacgaaggagcctatcacgtcctccataaggagctgcccgaagtcacaaattctgtgtttcatgaaataaacatgtgggtttcccagcggactgccacagccggaacagcttctccaccatag

SEQ ID NO: 231053 - DNA, 912 bp, Artificial Sequence
  Description of Artificial Sequence: Synthetic coding sequence
atgcccgaggagagctccccgaggcgaacacctcagtctattccttatcaggatttaccacatctagtgaacgctgacggtcagtacctcttttgcaggtattggaagccaacaggaaccccaaaggcgttgatattcgtctcacatggcgcaggtgagcactctggcagatacgaggaattagccaggatgttaatgggccttgacttgctggtattcgctcacgatcatgtggggcacggacaatcagaaggcgagcgtatggtggtatcagatttccacgttttcgtgcgggacgttctacagcacgtggacagtatgcagaaggactatcccggactgcccgtctttcttctcggacattccatgggaggtgctatcgctattttaacggctgcggaacgacctggtcactttgccggaatggttttgatctctccgttggttctcgccaatcccgaatctgccacaactttcaaggtactggccgctaaggtgctgaatctcgtgttgccaaacttatctttaggacccatcgattcatctgtgctgtctagaaataagactgaagtggacatctataattccgatcctctcatctgcagagctggactcaaggtctgtttcggaattcagctcttgaacgccgtcagcagagtggagagggccctccccaagttaacggtgccgttcctcctgctacagggttccgcagacaggctgtgcgactcgaaaggcgcttacctgctcatggagctggccaaaagtcaggataagactttgaagatctacgaaggagcataccacgtgttacacaaggagctgcctgaagtcaccaacagcgtgttccacgaaataaatatgtgggtgtctcagagaactgctaccgccggaaccgcgtctcctccttag

SEQ ID NO: 231054 - DNA, 852 bp, Artificial Sequence
  Description of Artificial Sequence: Synthetic coding sequence
atggagacaggacctgaggaccctagctctatgccagaggagtcctctcccaggaggaccccccagtctatcccatatcaagacctccctcacctggtaaatgccgacggacaatacctgttttgtcgctattggaaacccaccggcactcccaaggcactcatatttgtgtctcatggcgctggggagcactctggtcggtacgaagagttggccagaatgctgatgggactggacctcctggtgtttgctcacgaccatgtcggccatggtcagagcgagggagaacggatggtggtttctgatttccacgtgttcgtgcgagacgttcttcagcacgtcgattccatgcaaaaggattaccctggtttgccagtattcctactaggacactccatggggggagccatcgctatcttaacagcagctgagcgccctggtcatttcgccggtatggtcctaatctctcctctcgttttggcaaatcccgagtccgccacaacctttaaggtggacatatacaactccgatcctctcatttgccgcgctggcctgaaagtgtgcttcggcatccagctcttgaatgctgtcagccgagtcgaacgggcattacccaagctaaccgtgcccttcctgctgctccaagggagtgccgacagactttgtgattctaagggggcatatcttctgatggagctggccaaatctcaggacaagacactgaaaatctacgaaggtgcctaccacgttctccacaaggagctgccggaagtcactaatagtgtctttcacgaaatcaatatgtgggtctctcagaggactgctactgccggaaccgcctccccaccttag

SEQ ID NO: 231055 - DNA, 234 bp, Artificial Sequence
  Description of Artificial Sequence: Synthetic coding sequence
atgcctgaagagtcatcacctaggaggaccccacaaagtattccttaccaggatctccctcacttagtcaacgccgacggtcagtatctcttctgccgatactggaagcccaccggcacaccaaaagcactgatcttcgtgagtcacggcgctggcgagcacagcggcaggtacgaggagctggccagaatgctcatgggacttgatttgcttgttttcgcgcatgaccattag

SEQ ID NO: 231056 - DNA, 942 bp, Artificial Sequence
  Description of Artificial Sequence: Synthetic coding sequence
atgaagaccagacccgaagacccaagtagcatgcctgaggagagtagccccagacgtaccccgcagtccatcccctaccaggatttgccccacttggtgaatgccgatggacaatatctgttctgtcgttactggaaaccaacgggaactccaaaggctctcatattcgtgtctcatggtgctggggaacattcgggacggtatgaagagctggctagaatgctgatgggcctggatctgttagtgttcgcccacgaccacgtgggtcacggacaatccgagggcgaaagaatggttgtatccgactttcatgtgttcgtgcgcgatgttcttcaacacgtggacagtatgcagaaggactaccccggactccctgtcttcctgctggggcacagtatgggcggagcaatcgccatcctgacagccgcagaacggcctggccatttcgctggcatggtgttaatctctcccttggtgctggccaatcccgaatctgccacaactttcaaagttttggcagccaaagtgcttaacctggtgctgcctaacctgtcactgggcccaatcgactccagcgtactgtctcggaataaaacagaggttgatatttacaactctgaccccctgatctgtcgggcaggtctgaaggtgtgcttcgggatacagttgctgaacgccgtaagtcgggttgaacgggcattacctaagctgaccgtgccgtttctgctcctgcaggggtccgccgatcggctttgtgactccaaaggcgcttatcttctgatggaacttgccaaatcgcaagacaagaccctcaaaatttacgaaggtgcgtaccacgttttgcataaggaactgcctgaggtcacgaactccgttttccatgaaattaatatgtgggtatcacaaaggaccgcgacagccggaactgcatcgccaccatag

SEQ ID NO: 231057 - DNA, 1842 bp, Artificial Sequence
  Description of Artificial Sequence: Synthetic coding sequence
atgtgctgctggcctctcctactgctctggggactgctgcctggtaccgctgctggcggtagtggcagaacatatccacaccgcacgcttcttgactcagagggcaagtactggctgggctggtcccaaagggggtcccagatcgcattcaggctgcaggtgagaaccgccggatatgtgggcttcggattctctccaacaggggctatggcatctgctgacatcgtagtgggtggagtggcacacgggagaccttatcttcaggattacttcactaatgcaaatcgtgaacttaagaaggacgcgcagcaggactaccatttggaatacgctatggagaatagtacgcacaccataattgagttcacccgcgagctgcatacttgcgacattaacgataagtccattacagattcgactgttagagtgatttgggcctatcatcacgaagatgctggtgaggcagggcctaaataccatgattcaaatcgaggtactaaatctctgagattactgaacccagaaaaaacctctgtgcttagcaccgctctgccgtatttcgatctcgtgaaccaagacgtacccattcctaacaaagatacaacctattggtgtcagatgttcaagattcccgtgttccaggagaaacaccatgttattaaggtcgagcccgtcatccaaaggggccatgaatcactggtgcatcacatcctgttgtaccagtgctccaacaacttcaacgactctgttctggagtctggtcacgaatgttatcatccgaacatgcctgacgcattcctcacatgcgagaccgtgatttttgcctgggcgatcggcggagagggtttcagctacccaccccacgtgggtttgagcctagggacaccactggacccccattatgtcttactggaagtccattacgataacccaacctacgaggagggcctaatagacaactcaggcctccgcctgttctacactatggatattcgcaaatacgacgcaggcgtcattgaggccggtttgtgggttagcctgttccatacaattcctcccggtatgccagagtttcagagcgagggtcactgcactttggaatgcctggaggaggctctggaagctgaaaaacctagtggaattcacgtgttcgccgttctgctgcacgcacacctggccggtaggggcatcaggctcaggcattttagaaaaggaaaagagatgaaacttctggcatatgacgatgattttgacttcaattttcaggaatttcagtatttgaaggaggaacagacaatccttcccggtgataatctgataacagaatgcaggtacaatactaaggatcgagccgagatgacatgggggggtctgtcaacccgctctgaaatgtgcctaagttacctcctctattacccaagaattaatctgacccgatgtgcatccatccctgatatcatggagcagttacagttcataggggtcaaggagatataccgacccgtgaccacttggccattcatcattaaaagcccaaaacagtataaaaacctcagttttatggatgccatgaacaaatttaaatggacaaaaaaggagggcctgtcctttaacaaactcgtactatccctgccagtgaacgtgagatgctctaagaccgacaacgctgaatggagcatccaggggatgaccgctttgcctcccgacatcgaacggccatataaagcagagcccctggtttgtggcacctcctcctctagctctctgcaccgtgattttagcattaacctcctggtttgcctgcttctgctttcgtgtacactgagtacaaaatccctgtag

SEQ ID NO: 231058 - DNA, 1023 bp, Artificial Sequence
  Description of Artificial Sequence: Synthetic coding sequence
atgagcgaactagagcagctgcgccaagaagccgaacagctccgcaaccaaatccaggacgccaggaaggcctgtaatgacgctaccttggtgcagatcaccagcaacatggattcggtcggaagaatccagatgaggactagacggactctgagagggcacctagccaagatttatgcgatgcactggggctatgactccaggcttcttgtgagcgccagccaggacggaaagttaatcatttgggactcatacacaacaaacaagatgcacgccatcccccttagaagctcctgggtcatgacgtgtgcttacgccccttctggaaactacgttgcatgcggtgggctagacaatatatgcagtatttataatctgaaaacacgcgagggcaacgtgcgcgtttctcgcgagctcccaggacacacggggtacctgtcatgctgccgctttctggacgactcacagattgtaacttcaagtggcgacacgacatgtgccctctgggacatagaaacagcacagcaaaccactacatttacagggcactctggagatgtaatgagtctgtccctgtcgccagacatgcgtaccttcgtgtcaggtgcctgcgacgcctctagcaagctatgggacatcagagatggcatgtgtcgtcaaagcttcactggtcatgtaagtgacatcaacgccgtatccttttttccgaatggctatgctttcgccactggttctgacgacgccacctgccggctgtttgatctcagagccgatcaggagctcctgctttatagccacgacaatataatttgtggaataacttcagttgcatttagtaagtcagggcgacttcttttggccggttatgatgactttaactgcaatgtgtgggatactctcaaaggcgatcgggcaggagtgctggccggacatgacaatcgggtctcatgtcttggagtgacggatgatggaatggctgtggcaacaggctcatgggactcatttcttcgcatctggaattag

SEQ ID NO: 231059 - DNA, 1089 bp, Artificial Sequence
  Description of Artificial Sequence: Synthetic coding sequence
atggccccaaagcaagaccctaaacccaagttccaggagggagagcgagtgctgtgttttcatgggcctctgctgtacgaggccaagtgcgtcaaggtggcaatcaaagacaagcaggtgaagtacttcattcactactctggctggaataagaagagtgccgttcgacccagacgtagcgagaagtctctgaagacccacgaggacattgtggccctgttccctgtacccgagggcgcaccaagcgtccatcatccactcctgacaagctcatgggatgagtgggtaccagagagtcgggtgctgaagtatgtggacacaaacctgcaaaagcagcgcgaactgcagaaagcgaatcaagagcagtacgcggaggggaaaatgagaggggctgcccctggtaagaaaacctcgggtctccaacagaagaacgttgaggtaaaaacaaaaaagaacaaacaaaaaacgcccggaaatggggatggcggatcgacttccgagacaccgcagcctccaaggaagaagcgtgcccgagtcgatcctaccgtcgaaaacgaggaaacgttcatgaaccgagtggaggtcaaagtaaagattccggaggaattaaagccatggctggtggacgactgggacttaatcacccgccagaaacagctgttctatttacccgcaaagaagaacgttgactcaattctggaggactacgctaactacaaaaagagcagggggaacaccgacaataaagagtatgccgtgaacgaagttgttgcgggaatcaaggaatattttaacgtcatgctcggcacacagctgttgtacaaattcgagcggcctcaatatgctgagatcctggccgatcacccagatgcaccaatgtcccaagtatacggcgcaccacatctgctgagactatttgtacgcattggcgcaatgctagcatacacgcctttggacgaaaaatctctggctctgctgctgaactacttacacgactttctgaagtatctggcgaagaactccgccaccttgttttcagctagtgactatgaagtagcccctcctgagtaccatagaaaagcggtctag

SEQ ID NO: 231060 - DNA, 1047 bp, Artificial Sequence
  Description of Artificial Sequence: Synthetic coding sequence
atgatccctttcccccacccccaggtgacagacgctctgggcaggtacagcaattacattttgtccagtaccgtcgagtccccctccttgaggagtatgaacttcgaaaagcagggagagagggtcctgtgctttcatggacctttgctgtacgaggccaagtgtgtgaaagtggctattaaggacaaacaggtgaagtacttcatacactattcagggtggaacaagaactgggatgaatgggtgccagaatcccgagtgttgaagtacgttgacactaatcttcagaagcagcgggagctgcaaaaggccaaccaggagcagtacgcggagggaaagatgcgcggagcagccccagggaagaagacaagcggcttacagcagaaaaatgttgaggtgaagaccaaaaaaaataaacagaagaccccagggaatggagacggcggtagtacctccgagactccacagcctccaagaaaaaagagggccagagtggacccaactgtggagaacgaagaaactttcatgaatcgtgtggaagtcaaagttaagatccccgaagagctcaaaccatggctggtcgacgactgggatttaataactcgccagaagcagcttttttacttgccagccaaaaagaatgtcgactcaatcctcgaggattatgcaaactacaagaaatctagaggcaatactgataacaaagagtatgccgtgaacgaggtcgtggccggaataaaggagtacttcaatgttatgttaggcacgcaacttctatacaagttcgagcgtccccagtacgcagagatcctcgcagaccacccggacgccccaatgtctcaggtctatggagctccacacctcttacgattattcgtgcgcatcggtgctatgctcgcatataccccattggacgaaaaatctctggccctcctcttaaactacctgcatgattttctgaagtacctggcgaagaacagtgcgactctttttagcgcgtcggattacgaagtcgctccaccagaatatcatcggaaggcggtgtag

SEQ ID NO: 231061 - DNA, 972 bp, Artificial Sequence
  Description of Artificial Sequence: Synthetic coding sequence
atggcccctaagcaggacccgaaacccaaatttcaggagggggagagggttctgtgttttcatggcccattactctatgaagcgaaatgcgtcaaggtggcaatcaaagataaacaggtgaagtattttatccattattccggctggaacaagaattgggatgagtgggtgcctgaatcacgggttttgaaatatgtggacacgaacctgcaaaaacaaagggaactgcagaaagcaaatcaagagcagtacgcagagggcaaaatgcgaggagcagcccctggaaagaaaacatccggcctacagcagaagaatgtggaggtcaaaactaaaaaaaacaagcaaaagacacccggtaatggcgacggaggaagcacaagcgagactcctcagccgccaagaaagaaacgagcacgcgtggaccctactgtggaaaatgaagaaaccttcatgaacagagtggaggtgaaagtgaaaatccctgaagaattgaaaccttggctcgtggatgactgggaccttatcacccggcagaagcagctgttctacttgccagctaaaaaaaacgtggacagcattttagaggactatgcaaactataagaaaagccgcggaaataccgataataaggagtacgccgtgaacgaggttgtggcgggaatcaaggagtacttcaatgtgatgttgggcacccagctgctttacaaattcgagcgcccacaatatgccgaaattctggccgatcaccctgacgcccctatgtcacaggtgtatggagccccacacctgttgcggctctttgtgcggataggggcaatgctggcatacacgccgctggatgaaaagagtcttgctcttctattaaattaccttcatgatttcctgaagtacctcgccaaaaatagcgccacccttttctccgcaagcgattatgaagtcgccccacccgagtatcacaggaaggctgtctag

SEQ ID NO: 231062 - DNA, 708 bp, Artificial Sequence
  Description of Artificial Sequence: Synthetic coding sequence
atgcggggagccgctcccggaaaaaaaacgagcggactgcagcagaagaatgtcgaagttaagaccaagaaaaataagcagaagacgccgggaaacggtgatggtggtagtacgtccgaaacccctcagcctccgaggaagaagcgcgcacgcgtggatccaactgtggaaaatgaggagacattcatgaatcgggtagaagtcaaggtgaagattcctgaagaattaaaaccctggttagtcgacgactgggatctgattactcggcagaagcagttgttttacctgccagctaaaaaaaatgtggattctatactagaagactacgcaaattacaaaaaaagccggggaaacactgacaacaaggaatacgccgtgaacgaagtggttgcaggaattaaagaatacttcaatgtgatgctgggaacacagttgctgtacaaattcgagagaccacagtatgccgagatattggccgatcaccctgatgcacccatgagccaggtatacggagcccctcatcttctccgcctgtttgtgcgaataggagctatgctcgcgtacacccctttggacgaaaaatctttggctctccttctgaattatttgcatgactttcttaaatacttggcaaaaaattcagctaccctcttttcagcatctgattatgaagtcgcaccacctgagtatcacaggaaggctgtgtag

SEQ ID NO: 231063 - DNA, 708 bp, Artificial Sequence
  Description of Artificial Sequence: Synthetic coding sequence
atgcgtggggcagcaccaggaaaaaaaaccagcgggttacaacagaagaatgtggaggtaaagacaaagaagaataaacagaaaaccccaggcaacggggacgggggatcgacatcagagaccccacagcccccacgcaaaaagcgagccagagtggatcccactgtggagaatgaggagacatttatgaaccgggtagaggtcaaggtaaagattcccgaagaattaaaaccttggctggtagacgattgggacttgataacccggcagaaacaacttttctacctgcctgccaagaagaacgtggattcaatacttgaagattacgccaactataagaaatccaggggcaacacagacaataaagaatatgccgtgaacgaagtggtcgccggtatcaaagaatatttcaatgtaatgctgggtacccagttactgtataaattcgaacggcctcagtacgctgagattttggccgaccaccctgatgccccaatgtcccaggtatatggagccccacacttgctgaggctgttcgtgaggatcggcgctatgctggcctataccccgttggatgagaaaagtttggctcttctacttaactatctacacgactttctgaagtatctcgcaaaaaattcagccacactcttttcagcatcagactatgaggtcgcccctcctgagtatcatcgcaaagccgtgtag

SEQ ID NO: 231064 - DNA, 345 bp, Artificial Sequence
  Description of Artificial Sequence: Synthetic coding sequence
atggtctctcggaaggctgttgccgctctactggtagtgcacgtcgccgctatgctggcctcccagaccgaagcatttgtgccaatcttcacatatggtgagctgcagagaatgcaagaaaaggagagaaataaggggcagaagaaatctctgtctgtttggcagaggagtggtgaggaaggcccagtcgaccctgctgagcctatacgtgaggaagaaaacgagatgatcaagctcacggcacccttagagattggcatgagaatgaattcacggcaacttgagaaataccccgctacgttggaagggctattgtccgaaatgctgccacagcatgccaaatag

SEQ ID NO: 231065 - DNA, 348 bp, Artificial Sequence
  Description of Artificial Sequence: Synthetic coding sequence
atggtgtcccgcaaggcggtggcagccctgttagtggtgcatgtcgcagcgatgcttgcatctcagaccgaggcctttgtgccaattttcacctatggtgaactgcagagaatgcaagagaaagagagaaataagggtcagaagaagtccctcagcgtgtggcagcgctccggagaggagggtcccgtagaccccgcagaaccaattagagaggaagagaacgagatgattaagctgactgcccctctggaaatcggcatgagaatgaactcccgccaactcgagaagtaccccgcaacactcgaagggcttctatctgaaatgctgccacaacacgccgctaagtag

SEQ ID NO: 231066 - DNA, 327 bp, Artificial Sequence
  Description of Artificial Sequence: Synthetic coding sequence
atggtgtcacgcaaagcagtggcagccttactggtcgtacatgtggccgctatgcttgccagccagacagaagcttttgtccccatattcacctacggcgagcttcaacgcatgcaagagaaagagagaaacaaggggcaaaaaaagagcttaagcgtctggcaacgaagcggtgaagaaggaccagtagaccctgcagaacctatccgcgaggaggagaacgagatgatcaagctgaccgcccctttagagattgggatgcgtatgaactcgcggcagttggagaaataccctgccacattggaagggctcctgaccgcaaagtag

SEQ ID NO: 231067 - DNA, 1011 bp, Artificial Sequence
  Description of Artificial Sequence: Synthetic coding sequence
atggccagacgcagatcccaacgggtgtgtgcctccggcccaagcatgttgaacagcgccagaggtgccccagagcttctgcggggtacagcgaccaacgctgaggtctccgccgctgccgctggggctacggggtcagaggagctcccacctggggatagagggtgccgtaacggaggcggacgcggacccgctgcgactaccagttccacgggcgtggccgtcggtgcagaacacggcgaagactccttgtccaggaagccggatcctgaaccagggaggatggatcaccatcagcctggcacgggcagatatcaagtgctcctgaatgaggaagacaattccgagtccagcgccatcgaacagcctcccaccagtaatcctgctccacagattgtccaagccgcttcatccgcacccgcactggagaccgatagcagcccaccaccctatagttccatcacggttgaggtgcctaccactagtgacactgaagtctacggagaattttatccggtaccacccccttacagcgtggctacaagcctccctacttatgacgaggcagaaaaagccaaagctgctgccatggctgctgcagcagcggagacctctcaacgaatccaggaggaggaatgcccaccaagagatgattttagcgatgctgatcagctccgagttgggaatgatgggatttttatgctcgcatttttcatggcattcatttttaattggcttggcttttgtctgagtttttgtatcacgaacacaatcgccggtagatacggtgccatttgcggctttggattgtccctcattaagtggattctgatcgtgagattctcggattacttcaccggatatttcaacgggcagtactggctctggtggatttttctggtcttgggacttctgctgttctttcggggattcgtgaactacctcaaagtgagaaacatgtcagaaagtatggcagctgcgcataggacacgctacttctttctgttgtag

SEQ ID NO: 231068 - DNA, 1161 bp, Artificial Sequence
  Description of Artificial Sequence: Synthetic coding sequence
atgggctcaccatggaacggctcagacggccctgagggagcacgtgagccgccttggcccgcacttcctccctgtgatgaacgcaggtgctccccttttccacttggggctctggttcctgtgacagcagtttgtctttgcctgtttgttgttggggtatcaggtaacgtggtcaccgtgatgctaattggtcggtatcgtgatatgcgcaccaccacaaacctgtacctggggagcatggctgtgtctgatctattgatacttctcgggctgccctttgatctctaccggctatggagaagcagaccatgggtcttcggacctctgctgtgtaggctctctctctacgtaggagagggttgtacatatgctacactcctccacatgaccgctctcagcgtcgaacggtatttggcgatctgtaggcctctgagagctagagtactggtcactagaagaagggtgagagctctgatagcagtgttgtgggccgtagctcttttatcagcaggtccctttctgtttctcgtcggcgtcgaacaggatccgggaatctcagttgtacccggactgaacggcactgcgcgtatagccagctcccctttggcatcctcaccaccgctgtggctttctcgagcccctccaccaagccccccatccggacccgagaccgcagaggcagccgctctcttttcaagagagtgcaggcctagcccagcccagctgggtgcgcttcgagtgatgctgtgggtgacaaccgcttatttttttctcccattcctgtgcctgtcgattctatatggcctgataggcagagaactgtggtcttccaggcgtcctttacggggaccagcagcgtcaggcagggagcgtgggcatagacaaacggtgcgggtgctgcggaaatggagccggagagggtcgaaagacgcatgtttgcagtcagcacccccagggaccgcacagactcttggcccactaccgttgctggcccagctgtgggcacccctgcccgctcccttccctatatcaattcccgcaagcactagacgcggtggtggctctggcatctacaatctcctggtggcactccccaggtggcagaaccatctgcacaaacatggtcggtttgcggacgatgtactgctctctgtcctttag

SEQ ID NO: 231069 - DNA, 1206 bp, Artificial Sequence
  Description of Artificial Sequence: Synthetic coding sequence
atggagaagtccaagaatttcagaattgacgccctcctggccgtcgacccacctcgggcagcatctgcacagtcagcccctttggctctggttacctctctggcagccgcagccagtggaacaggcggagggggtggcggaggtggtgcatcaggaggtaccagcggaagctgttctcccgctagcagtgaacctcctgctgcccctgccgaccgactgcgtgccgaatcacccagcccacccaggctgctggcggctcattgtgctcttctgccaaagcccggttttcttggagcgggaggcggaggcggtggaacaggcggaggacacgggggaccacatcatcacgcacatcccggtgccgcagccgctgcagctgccgcagcggcagccgcagccgctggtgggctggctctggggctgcaccctggcggagctcagggaggcgcaggtcttcctgcccaggcagcactctacggacatccagtctatggctattctgccgcagcagctgctgcagccctcgccggtcagcaccccgctctgagttactcttaccctcaggttcagggcgcacatccggcacacccagcggatcccatcaagctgggggcaggtacctttcagctggatcagtggttacgcgcttcaaccgcgggaatgatcctgcccaagatgccagatttcaactcccaggcacaatctaacctactgggtaaatgcagacgcccacgaacagcattcacctctcagcagcttctggaactcgagcaccagttcaaattaaataagtacctgagcaggcccaagagatttgaggtggctacctccctcatgctaacagaaacccaggtcaaaatctggttccagaacaggaggatgaagtggaaacgctccaaaaaggcaaaagagcaggcagctcaggaggccgaaaaacagaaaggcggtggcggtggagccggaaagggaggcgcagaggagccaggtgccgaagagctgctgggcccaccagctcccggagataagggttccgggcgaaggctacgagacctgagggattcagaccccgaggaagacgaggacgaggacgatgaagatcactttccatattccaacggtgccagcgtccacgccgcaagctcagactgttcatccgaagacgactcccctccaccaagacccagccaccagcccgcaccccaatag

SEQ ID NO: 231070 - DNA, 696 bp, Artificial Sequence
  Description of Artificial Sequence: Synthetic coding sequence
gcagcagccgctttggcgggtcaacacccggctctgtcatattcatacccacaggtgcagggtgctcaccctgctcatcccgcagaccccatcaaacttggtgctggaacctttcaactggatcagtggctgagagcctctactgcaggaatgatacttccaaagatgccagattttaattctcaggcacagtcaaatttgttgggaaaatgtaggcgtcccagaaccgcttttacatcccaacaactgcttgaactcgagcatcagtttaagctgaataagtacctgtcaaggccgaaacgctttgaggtcgcgaccagtctgatgctcacagaaacgcaagtaaaaatatggtttcaaaaccgtcggatgaaatggaagcggagtaagaaggccaaggagcaggccgctcaggaggcggaaaagcagaagggcggaggtggcggtgctggcaagggcggtgcggaggagcccggagcagaagagttgcttggcccaccagcccctggcgataagggcagtgggagaagactcagagatctgagggacagcgatcctgaagaggacgaagatgaggacgacgaagatcactttccgtattctaacggggcatctgtgcatgcggcaagctccgactgcagttcagaagacgatagtcccccacctcgtccaagccaccagcctgctccccagtag

SEQ ID NO: 231071 - DNA, 570 bp, Artificial Sequence
  Description of Artificial Sequence: Synthetic coding sequence
atgggcggtttgagtactgttggcgcttgtcctggcattcttggcgcacagcaggcccaagcccagtctaacctcctggggaagtgcaggagacccaggacagcctttacctcccagcagctgctagaactggagcatcagtttaagcttaataagtacctcagccggccaaagcgtttcgaagttgcgacttccttgatgctgaccgaaacccaggtgaaaatctggttccagaatcggagaatgaagtggaagcggtccaaaaaagccaaagagcaggctgcccaggaggcagagaagcaaaagggagggggagggggtgccggtaagggcggagccgaggaacccggagccgaagagctcctaggcccacccgctcccggagataaggggtctggacgcaggcttcgtgacttgagggatagtgacccggaggaagatgaagatgaggacgacgaagaccactttccctacagcaacggtgcaagcgtgcacgcagcctcaagcgattgtagctctgaggacgactcccctcctcccaggcccagtcaccagcctgcaccgcagtag

SEQ ID NO: 231072 - DNA, 1692 bp, Artificial Sequence
  Description of Artificial Sequence: Synthetic coding sequence
atgccatccaagttttcatgcaggcagctaagagaagctgggcaatgttttgagtcttttctggtcgtgagggggctcgacatggagacagaccgggagcggctgaggaccatatataatcgtgactttaagattagtttcggaaccccagctcctggatttagcagcatgctctatggtatgaagattgcgaatctggcctacgttactaagacccgggtgagatttttcagactggatagatgggcagacgtgcggtttcctgagaaacgaagaatgaagctaggctccgatatatctaagcatcacaagagccttttggccaagattttttatgacagagcggaatacctgcatggcaaacacggggtggatgttgaggtgcaggggcctcacgaggcacgagacggccagcttttgatccgcttagatctgaaccgcaaggaggtgctaacgcttcgactgagaaatggagggacccagtcagtcactctgactcacttgttcccactgtgccggaccccgcagttcgcattttacaacgaagaccaagagctgccctgtccacttggtccaggggagtgttatgaacttcacgtgcattgtaagacgtccttcgtgggctacttccccgcaaccgtcctgtgggagctcctggggcctggagagtctggcagtgagggtgctgggactttttacatagctcgtttccttgccgctgtggcacactctcctctcgcggcacaactgaagcctatgacgcctttcaagaggacgagaattacaggtaatcccgtcgtgaccaaccggatcgaggaaggtgagagacccgaccgtgccaagggctacgaccttgagctgtctatggctctcggaacatactacccaccccctcggctgcgacagctgttaccaatgcttctgcagggtacatcaatatttacagctcccaaggagattgccgagatcaaggcacagctcgagactgctctaaagtggcggaattacgaagttaaacttaggctcctgttgcacttagaggaactgcagatggagcatgatattaggcactatgaccttgagagtgtgccgatgacatgggatccagttgaccagaatcccagattgcttaccctggaggtaccgggagttaccgaaagtcggccttcagtgttgagaggagaccacctttttgccctgcttagtagtgaaacacaccaggaggatcccattacttacaaaggctttgttcataaggttgagcttgaccgagtcaaactgagcttctccatgagcctgctgtcacggtttgtagacggccttacattcaaagttaacttcacattcaatcggcaaccactgagagtacagcaccgtgccctggaattgaccggcaggtggctgctatggcccatgctgtttcctgttgcccctagggacgtgccactgctaccgtcagatgtgaaactgaaactttacgaccgcagcttggaatccaaccccgaacagctgcaggccatgcgacatattgtaaccgggacaacaaggccggctctgaccgcgtgtcttaccctgaaccaaaacccggctgagcttcctttgcagggcaccggcaggttaggcgagggggtatacaatccttcgcactccactcccagcccagcgggagaaaatgacaccagttcctgttag

SEQ ID NO: 231073 - DNA, 3012 bp, Artificial Sequence
  Description of Artificial Sequence: Synthetic coding sequence
atgcccagcaaattctcttgcaggcaattgcgagaggcgggacagtgctttgagagcttcctcgtggtgagaggattggatatggagaccgacagagagcgcctgagaactatctacaatagagattttaagattagctttggtactccagctcccggtttttcgtcaatgctgtatggaatgaaaatcgctaatttagcttacgtcacgaaaaccagagtccgcttctttaggctcgatagatgggccgatgttaggttcccagaaaaaagacgaatgaaactgggctctgacatcagcaaacaccacaagtccctactggccaaaattttttatgacagggcggagtacttacacggtaaacatggtgtagatgtagaggtgcagggccctcatgaggctagagacggtcagttattaattaggctggacctcaatcgtaaggaggtattaacactgcgcttaagaaatggtggaacgcagtctgtgacattgactcacctcttccccttatgcagaaccccacagttcgctttctacaatgaagaccaagagttgccatgccctttggggcctggcgaatgctatgagctccacgtgcattgcaagacttcgtttgtagggtattttccagcaacggtgttgtgggagttgttgggacccggtgaatctggaagcgaaggagccggaaccttctacatcgccagattcctggcggcagtggcccactctccattggccgctcagctcaagcctatgacacccttcaagcgtacaagaattacgggcaaccctgtggtgactaatcgaatagaggaaggggaaaggcctgatagagcaaaaggttacgatcttgagctctcaatggctctgggaacatattacccacccccacgcctgcggcagttgctccctatgttactccaagggacgtcaattttcaccgctcccaaggagattgccgagatcaaagcccagctggaaaccgcactaaagtggcgcaactacgaagtgaagctgaggttattgctacacctggaggaactgcagatggagcatgacatcagacattatgacctggaatctgtgcctatgacctgggaccccgttgaccagaatcctagactgctgactctggaagtacccggagttactgagtctcgtccatccgtcctgaggggggatcacctcttcgccctgctttcttctgaaacccatcaggaggaccctatcacatataaaggcttcgtgcacaaggtggagctagaccgagtgaagctatccttttccatgagcttgctcagtaggttcgtggacggtctgacctttaaagttaactttactttcaatcgccagcccttacgtgtgcagcacagagcactggaacttacgggacgctggttactgtggcctatgctcttccccgtggcacccagggacgttccccttctcccgagcgatgtcaagctgaaactttacgaccgatcactcgaatctaaccccgaacagctgcaggccatgaggcacattgtcaccggtactacacgccctgcgccatacataatttttggccctccgggaaccggtaagactgtcactctagtagaagccatcaaacaggtcgtgaaacacttacccaaggcacacattctggcctgcgccccaagcaatagtggggctgatttactgtgtcagagactgcgggtgcatctcccttcttccatataccgccttcttgcaccatcccgggatatccgaatggttcccgaggacataaaaccctgctgtaattgggacgccaagaaaggggagtacgtttttccagccaagaaaaagctgcaagagtatagggtgttgatcaccaccctgattacagccggacggcttgttagcgctcagttccccattgaccattttacgcacatctttatcgatgaggcgggacactgcatggagcccgagtccctcgtggctatcgctgggctcatggaggtaaaggaaacaggtgaccccggaggtcagctcgtgttggctggagatccgaggcagttgggacccgtgcttagatccccactgacacagaaacatggtctcggatattcccttttggagcgcctgctgacatataactccttatacaagaaggggcctgacggatacgacccgcaatttatcactaagctgctccgcaactatcggtcgcacccaactatcctggatataccgaatcaactctattacgagggagagcttcaggcatgtgctgatgtggtcgaccgagagaggttctgccggtgggcgggactgccacggcagggattccccattatctttcatggcgtgatgggcaaagatgagagggagggaaatagtccttcctttttcaatccggaggaagccgctacagtaacctcctacctaaaactgttgctggccccatcctctaaaaagggtaaagccagactgagtcccagaagcgttggtgttatatccccatacaggaaacaagttgaaaagatcaggtattgtataaccaaacttgatagggaactgcgcggattggacgatatcaaggacctaaaagtggggagcgtggaagagttccagggacaagaaaggagcgttatcctcatcagcacggttcggagctcccagtcattcgttcagcttgacctcgatttcaatttaggcttcttaaagaatccaaagcgctttaacgtggccgtgaccagggccaaagccttactcataattgtgggcaaccctctcctactcggccatgacccagactggaaagttttcctcgagttctgtaaagagaatgggggatataccggatgcccgttccccgcaaagttggatcttcaacaaggtcagaaccttctgcagggtttgagtaaactatccccttctacaagtgggccacatagtcatgactatttaccacaagagagggagggggagggtgggctgtctctgcaggtagaacccgaatggaggaacgagctttag

SEQ ID NO: 231074 - DNA, 2844 bp, Artificial Sequence
  Description of Artificial Sequence: Synthetic coding sequence
atgctgtacggcatgaaaattgccaacctcgcttacgtcaccaaaactcgagtccggtttttcaggctcgatagatgggccgacgtgagattccctgaaaagcgtaggatgaagctggggtcagacatctcgaagcaccacaaaagcctacttgctaaaatcttctatgatagggcagagtacctgcacggaaaacatggcgtggatgtcgaggtgcagggccctcatgaggcccgagatgggcagcttctgatccgcttggacttaaatcggaaagaagtgctgaccctccggctgcgtaatggaggaacccagtctgtcaccctcactcacctatttcccctgtgtaggacgccccaattcgccttctacaatgaggatcaagagctgccctgtcccttgggccctggggaatgttacgagttgcatgtgcattgcaagacttccttcgtgggctactttcctgcaaccgtcctatgggagctactggggccaggggaatctggtagcgagggcgctgggaccttttacatagcgagattcctggctgctgtggctcactcacctctcgccgctcaactcaaacctatgactcctttcaagagaacaaggattactggtaaccctgtggtgactaataggatagaggaaggcgagaggcctgatcgagccaaggggtatgaccttgagctctctatggctctgggcacttactatcctccacctcgcctacgacaactccttcctatgctgttgcaggggacatctatattcacggctcccaaagagattgctgagatcaaagcacagctcgaaactgccctcaaatggcgaaactacgaggtcaagctgagactgctacttcacttagaggagctacagatggaacacgatatcaggcactatgatctggagtcagtccctatgacctgggatccggtggaccagaaccctaggctgctgactcttgaagtccccggagtgaccgaaagccggccttctgtccttagaggggaccacctatttgcactgctgtcatccgagacgcaccaagaggatccgatcacatataaaggctttgtgcacaaggtggaactagatcgtgttaaattgagttttagcatgtcacttttaagtaggtttgtggatggtctgaccttcaaagtgaattttacttttaatagacagcccctccgcgtgcagcacagggcccttgagctcactggccgatggcttctctggccaatgttatttccagtcgctcctagagacgtcccacttttaccatccgacgtcaagttgaagctttacgacagatccttggagagcaaccctgaacagctccaggcaatgcggcatatcgtaaccgggaccacacgtccggctccgtatataatatttggccctcctgggacagggaaaacagtcacgcttgttgaggcaataaagcaggtggttaagcacttgcccaaagctcacatacttgcgtgtgccccttctaacagtggtgccgacctgctctgccagcgattgcgcgtgcatctgcctagttccatttaccggctgttggccccaagcagagatattcggatggtcccggaagatataaagccatgttgtaattgggatgcaaaaaaaggcgaatacgtgttcccagcgaagaaaaaactgcaggaatatagagtgcttataacaacattaattaccgctggcagactggttagtgcccagttccccattgaccattttacccacatttttattgacgaggcagggcactgtatggaacctgaaagtctggtggctatcgccggtttgatggaggtcaaagagactggcgatcccggaggccagctcgtgctcgccggagatccacgacaactcgggccagtgcttcggtcaccactcactcagaagcacggtctgggatatagcctcctagagaggctgctgacctacaactccctctacaaaaagggaccagacggctatgacccacaattcatcacgaaactgctccgcaactaccggagccaccctactatcctggacatcccaaaccaactctattacgagggtgaacttcaagcttgcgcggatgtggtggatcgcgagaggttttgccggtgggccggacttcctcggcaaggcttcccaatcatatttcacggagtgatgggcaaggacgaacgggagggtaatagtccctctttcttcaaccctgaagaggccgcaactgtaaccagctatctgaagcttctcctcgcccctagttccaaaaaaggaaaagccaggttgtcaccacggtccgtgggtgtgatctcaccctacaggaagcaggtagagaagatccggtactgcataactaagttggaccgcgagttacgcggtctggacgatatcaaagacctgaaggtgggttctgtggaagagtttcagggccaggagagaagtgtgatcctgatcagtaccgttagatcttctcaatcattcgtccaactggacctggatttcaatttgggattcctcaagaaccctaagcggttcaatgtggcggtcaccagggcaaaggcattgctcatcattgtcggcaatcctctgctcttgggccacgatccagactggaaggtctttctggaattttgcaaagagaatggcggttataccggctgccctttccccgcaaagctggaccttcaacagggacagaatttactccagggcctgagtaaacttagcccttctacgagtgggcctcatagccacgattacctcccacaggagagggagggcgaggggggattgagcctccaggtcgaacccgagtggcgcaatgagttgtag

SEQ ID NO: 231075 - DNA, 3012 bp, Artificial Sequence
  Description of Artificial Sequence: Synthetic coding sequence
atgccctccaaattctcatgtagacagctgcgggaagcgggacagtgttttgaatctttcctggtcgtgaggggtttggacatggagacagaccgtgagaggctgcgtaccatctataaccgcgactttaagatcagcttcgggaccccagcccctggattcagctctatgctctatgggatgaagatcgcaaatctggcctatgtgaccaagacacgggtccgattttttaggctggaccggtgggcagacgttcgttttccagagaagcgaaggatgaaattgggatcggatatatccaagcaccataagtcgctgttggccaagattttctacgatcgggcagaatacctacatggtaagcacggggtggacgtcgaagtgcaaggcccacatgaagctcgagacggccagctccttataaggttggacttgaatagaaaggaggtcctgaccttgaggctgcgcaacggaggcacccagagcgtgaccctcacgcatctttttcctttgtgccgcacccctcaatttgcattttataacgaggatcaagagctgccctgccccctgggccctggcgaatgctatgagctccacgtgcactgtaagacctccttcgtcggatatttcccagccacagtattatgggagctcctgggtcccggagaatctggcagcgagggagccggaactttttacatagccaggtttttggctgctgtggcgcattctccgctggcagcacagctgaagcctatgacccccttcaaaagaaccaggataacaggcaaccccgttgtcacgaatcgtatcgaggaaggtgaacgcccagatcgggctaagggatacgatttggaactttccatggccctgggtacttactatccacccccacgattacgtcagctgctccctatgctgttgcagggcactagtatattcacagctcctaaggagatcgccgagattaaggcacagttggagaccgcgctcaaatggcggaattacgaagtcaagctacggctcctgctgcatttagaagaattacaaatggagcacgacataagacattatgatctggagtccgtgcccatgacctgggacccagtcgatcagaacccccgacttcttacgcttgaggttcccggagtgacggaatctagaccaagtgtgctccgaggagaccacctgttcgccttgcttagttccgagacccatcaggaggatcctattacgtacaaagggttcgttcacaaagttgagctggaccgtgtgaagcttagtttctcaatgtcactgctgagtcgtttcgtggacgggctaaccttcaaggtgaactttaccttcaacagacaaccactccgggttcaacaccgggcactcgaactcaccggcaggtggctattgtggcccatgctcttcccagtcgcccctagggatgtccccctgctgcctagcgacgtgaagctcaaattatacgaccgctccctggaaagcaatccagagcaactgcaagccatgcgccacattgtgaccggtacaacccgtccagctccatacataattttcggtccacctggcacaggaaagaccgtgacgttagtcgaggctatcaaacaagtggtcaagcaccttcctaaagcacacatactcgcctgtgccccaagcaacagtggcgctgacctgctgtgtcagagactgcgggtgcatctccccagctccatctaccgattattagctccatctcgggacatcagaatggtgcccgaggacatcaagccatgctgtaattgggacgcaaagaaaggagagtatgtgttccctgctaagaagaagctgcaggagtaccgcgtgcttatcacaacactgattaccgctggcaggttggtcagtgctcagtttcccatcgaccattttacccacatcttcatcgatgaagcaggtcactgcatggaaccagaatctttagtggccatcgccggtctgatggaggtgaaggagacgggcgatccgggaggtcagcttgtcctggcaggtgaccccagacaactcgggccagtcctgcgatctcctctgacccagaagcatggcctgggatattctttgttggaaaggctccttacctataacagcttatataagaaggggcctgatggatacgatccccagtttatcaccaagctgttgagaaactatcggtctcatcctaccattttagatatcccaaatcagctttactatgaaggcgaattacaggcttgtgcagacgtagtagaccgcgaacggttttgccggtgggcaggactcccaaggcagggcttccccataatcttccatggcgtaatggggaaggacgaaagggagggtaactccccttcgtttttcaatcccgaggaagccgcaactgtaacatcctacctgaagttgctgctggcgccatcctctaaaaaaggaaaggccaggttgtccccgagatctgtgggggttatatctccatacagaaaacaggtggagaagatccggtactgcatcaccaagttggaccgcgagctcagaggcctcgacgatatcaaggatcttaaagtgggatccgtggaggagttccagggccaggagagaagtgtgatccttatctccacggtccggagctcacagtctttcgtccagcttgatctcgacttcaatttaggctttctcaagaatcccaagcgattcaatgttgcagtgactcgagctaaggccctgcttatcatagttggcaatccactgctcttggggcatgaccctgactggaaagtcttcctagagttctgcaaggagaatgggggatatacaggctgccctttccctgctaaattggatttgcagcagggacagaacttactgcaggggctgagtaagctttctccttctactagcggcccacattctcacgactatttaccacaggagagggaaggcgaagggggactatctctgcaggtcgagccagaatggagaaacgaactgtag

SEQ ID NO: 231076 - DNA, 2826 bp, Artificial Sequence
  Description of Artificial Sequence: Synthetic coding sequence
atggagaccgaccgggagaggctcagaactatctataaccgcgattttaagatttccttcggcacccccgcacccggtttctccagtatgctatacgggatgaagatcgccaacttagcatacgttactaagaccagggtgcggtttttcaggctggataggtgggccgacgtacgctttcctgagaaacggcgtatgaaactaggctctgacatcagtaaacaccacaagtccctgttagccaaaatcttttacgatcgagctgagtatctgcatggcaaacatggaggaacgcagagcgtgaccctaacccatttattcccactttgccgcaccccgcagttcgctttctacaacgaggaccaagaattgccgtgcccattaggcccaggggagtgctacgagctgcacgttcactgcaagacctccttcgtgggctattttccggcaactgtcctctgggaactcttggggcctggcgagagtgggtctgagggcgcaggaacattctacatcgcccgttttctggccgctgtggcccacagccccttggccgcacaactaaaacccatgacaccattcaaacggacgagaatcacagggaatcctgtggtcaccaacaggattgaggagggagaacggccagatagagctaaaggatacgacctggagttgagtatggcacttgggacttattacccgccacctcgtctcagacagctgctcccaatgctactgcaggggacgtcgatttttactgcacccaaagagattgcagagatcaaggcccaactggagacagcactgaagtggagaaactatgaggtcaaactgaggctgttgctgcacctagaggagctgcagatggaacacgacatcaggcattacgacttggagagcgtcccaatgacatgggacccggtggaccaaaacccccgtttactcaccctggaagttcctggcgtaacagaatccagaccgtctgttcttcggggtgatcatctttttgcactgctgtctagcgagacccatcaggaggatcctatcacgtacaagggatttgttcacaaggttgagctggaccgcgtaaagctgagcttcagcatgagcctgcttagccgcttcgtggacgggctgacttttaaagtgaattttacatttaatcggcagcccctgcgtgtgcaacatcgggctttagagttgaccggcagatggctcctctggccgatgcttttccccgttgctccaagggacgtaccacttctgccaagcgacgtcaaactgaaattatacgaccgttccctggagagtaaccctgaacagctccaggcgatgcgtcacatagtcaccggcacaacacggcctgctccatacataatattcggacctccgggaaccggcaaaaccgtgactctggtggaggctatcaagcaggtcgtaaagcatttgcctaaggcgcatatactggcctgcgcgcctagcaactcaggagcggacttactttgtcagcgacttcgggtacacctgccgagctcaatatatcggctgctggcaccatccagggacattaggatggtgccagaggacattaagccttgttgcaactgggacgctaagaagggcgaatacgtgtttcctgcaaagaaaaagctgcaggaatacagggtgctcatcacgaccctgattactgccggacggttagtgagcgctcaatttcctatcgatcacttcacccacatctttattgatgaggccggtcattgtatggaaccagaatctctagtagctatagccggacttatggaagtaaaagagacaggcgatcccggtgggcagttagtgctggccggagatcctcgccagctgggccctgtgctaagatctcccctgacgcaaaaacacgggctaggctactctctgctagaacggcttcttacatataatagtctttataaaaagggacctgatgggtacgacccacagttcattaccaagttgctccggaattacaggagccaccctaccattcttgacatccccaaccagctatactacgagggagagctgcaagcttgcgccgatgttgtggatagagagcgcttctgccggtgggccggtctgccacgccagggcttccctatcatattccacggtgtgatggggaaggacgagagggagggaaatagtccttccttttttaatccggaagaggcagcaactgtgacaagttacctcaaactgctgctcgccccttcttccaagaaaggaaaggcacggttgagcccaagatcagtcggggttatttccccttaccgcaaacaagtggagaaaatccgctactgtattaccaaactggatcgggaactgcgcggacttgatgatattaaagacctaaaggtggggagtgtcgaggagttccagggacaagagcgatccgtcatcctcatcagcactgtccggagctctcagagtttcgtacagttagacctagatttcaaccttgggtttctgaagaaccctaaacgttttaacgtggccgtgactcgagctaaggcgctgctcatcatagtgggtaaccccctgcttctcggtcatgatcctgactggaaggtcttcctggagttttgtaaggagaatggaggttataccggatgtccattcccagctaagcttgaccttcagcaggggcagaacctccttcagggcctgagcaagctgagcccctccacctccggtccccacagtcatgactatctcccgcaggaacgcgaaggcgaaggtggactgagcttgcaggtagaaccggagtggcggaacgagctttag

SEQ ID NO: 231077 - DNA, 3012 bp, Artificial Sequence
  Description of Artificial Sequence: Synthetic coding sequence
atgccttccaagttcagctgtaggcagctaagagaggctggacagtgtttcgagtccttcctggtggttaggggtctcgatatggaaaccgaccgcgaaaggttgcgcaccatctataatcgcgatttcaaaatcagtttcggaactcccgctccgggtttttccagcatgttatatggcatgaagatcgccaaccttgcttatgtcacaaagaccagggtgcgctttttccggctcgaccggtgggctgatgtcaggttcccagagaagagaaggatgaaactcgggtcggatataagcaaacatcacaagtccctgctggcaaaaatcttttatgaccgtgccgagtacttgcatggaaaacatggtgtggatgtcgaagttcagggcccacacgaagccagggacgggcagcttctgatccgtctggatcttaataggaaggaagtgttaactcttaggcttaggaacggagggacccagtctgtcaccttgactcacctttttcctttgtgccggactccacagttcgcattttacaatgaagatcaggagctgccgtgtcccctgggaccaggggagtgctatgaacttcacgttcattgtaagaccagttttgttggctattttccagccactgttctatgggaacttctgggcccaggcgagagcggcagcgagggggctggcaccttttacatcgcacggttcctggctgcagtggcccacagtccattggcagcacagctcaagcctatgacaccatttaaacggacccgcatcacaggaaatcccgtggtgaccaatcgcatcgaggaaggagaacgccctgatcgcgctaaaggctatgatctggagctgagtatggcgttaggaacctattacccccctcccagacttagacagcttctgccaatgcttctccaggggaccagtattttcaccgccccaaaggaaattgcagagatcaaagcccagttggagactgcactcaaatggcgaaattacgaggtaaagctgcgtcttctactccatctggaagaactgcagatggagcatgacatacggcattacgatcttgaaagcgttccaatgacctgggatcctgtggaccaaaaccctaggctcctaacattagaggtaccaggcgtgactgaatcccgtccaagtgttctgaggggcgatcatttatttgccctcctctcatccgagacacatcaggaagaccctattacctacaaaggttttgtgcataaagtcgaattggatagggtgaaattgagcttttctatgagccttctgagtagatttgtagacggcctgacattcaaggtcaattttacctttaacagacagccgctacgagtacagcacagggcgctggagctgacagggagatggctgctgtggcccatgttattccccgtggcccctagggacgtgcccctcttgccttcagacgttaaactgaagctatacgatcgttccttggagagcaaccccgagcaactccaggcaatgcgccacatcgtcacagggacaactcgcccagccccatatattatctttggacctcctggtactggcaaaacagtgacgctggtagaggcaatcaagcaggtggtgaagcatctccccaaggcccacatactcgcttgtgccccatcaaacagcggcgctgatttgctgtgccagcgcttacgtgttcatctgcctagttcgatctatcggctgttggccccttctcgggacatacggatggtcccggaagatattaaaccttgctgtaattgggacgccaagaaaggggagtatgtttttcccgcaaagaagaaactgcaggagtatcgtgtgctcatcaccacactgattaccgccggacgcttggtctctgctcagtttcccatcgatcacttcacccacatattcatagatgaagccggtcattgtatggaacctgaaagcctggtagcaatcgcgggactcatggaagtgaaggagacaggagatccgggtgggcagttggtgctggcaggggaccctaggcagctgggaccagtgctgaggtccccattaacccagaagcatggcttgggttatagtcttttggaacgtttgctgacctacaattcactttacaagaagggcccagatgggtacgatccccaattcatcacaaaactcctgagaaattaccgctcccatcccactattcttgacattccaaaccagctctattacgaaggcgaactgcaggcttgcgctgacgtggtggacagagagcggttctgcagatgggctggcctccctaggcaggggttcccgatcattttccacggtgtaatgggcaaagacgagagagaaggcaattcgccctctttttttaatcccgaagaggccgcaacagtgactagctatcttaaactgctcctggccccttctagcaaaaaaggtaaagcacgattgagtccacgatccgttggtgtgatatctccctacagaaagcaagtggaaaaaatccgctactgtataaccaaacttgatcgggagctcagaggccttgacgacatcaaggacctcaaggtaggctcagtcgaggagttccagggccaagagagaagcgtgatactaatcagtacggtacgttctagtcaatcctttgtgcagcttgacttagactttaacctgggttttcttaagaatcctaagaggtttaatgtggctgtgactagagctaaggccttgctgattattgtcggcaaccccctattgctagggcacgatccagactggaaagtgtttctggagttttgcaaggagaacggtggatacaccggctgtccttttccagcaaagttagacctccagcaggggcagaatcttctccaaggcctcagcaagctgtccccgagtacctcaggccctcacagccatgattatctgcctcaggagcgcgaaggagaggggggactgagcttgcaggtcgaacccgaatggagaaacgagctctag

SEQ ID NO: 231078 - DNA, 171 bp, Artificial Sequence
  Description of Artificial Sequence: Synthetic coding sequence
atgcccagtaagttctcctgcaggcaacttcgggaggctggtcagtgctttgagtccttcctggtggtgcgtggcctcgatatggagaccgaccgcgagaggcttcggaccatttacaacagggattttaagataagcctagcttcgtctaagtcgatattgcagtcatag

SEQ ID NO: 231079 - DNA, 3636 bp, Artificial Sequence
  Description of Artificial Sequence: Synthetic coding sequence
atgctcagcctagccgcaaaacttgtggcttttttttggaggaccgcagatacccccagagaagaggccggacagctagagcctgaactggcggagggggatactaaactcaaaaccgtgcgaggagtagttacgaggtattgctctgactacggcatgatagacgacatgatttacttcagcagtgatgccgtgaccagcagggtgctccttaacgttgggcaagaagtcattgccgtggtcgaggaaaataaagtgtcaaatgggctgaaggccatccgtgtggaggccgtgagtgacaaatgggaggacgactccagaaatcacggatctcctagcgattgtggaccccgtgtgctcattggatgcgttacatcactggtcgagggcgctggctgcatcagccagaccacctacttcagtttggagtctgtctgtgaaggattcgaaccatgcaagggggactgggtcgaggccgagtatagaattaggcctggcacgtggagctctgaagcgacctccgtgaagccactgcggtacaaacgggtggacaaggtgtgtattagctccctttgtgggagaaacggtgttctcgaagagtccattttcttcacgctcgactcgttgaagttacctgatggttatactccacgccgtggggacgttgtgaacgccgtagtggtggagtcatctcaaagctgttacgtatggcgcgcactgtgcatgactctggtaaaacgtagggatgccgctcctgtccacgaggcaactcatttttacggaacaatccttctcaagaataagggggatatcgaggtgacccaggtcacacactttggtactctcaaggaagggcgttcaaaaaccatggtgatttggattgaaaataagggagacatcccacagaacctggtgagttgcaagttggccggatgggataaaagcaagcagttcaggtttcagatgttagataaagaccaaatgtgtccagtggtatcctttgtgtccgtccctgaaaaagaaaacagctccgatgagaatatcaattcattgaactctcacactaaaaataaaacctcccaaatgagtgagtctagcttggtgaacaaccggggaatcagcccaggagattgtacttgcaaaggagaaaatggcgaaaaagacaatattctttcaaggaaacagatgacagagccagagcctggcggtctggtgcccccaggcggaaagacatttatcgtcgtgatctgcgacggtaaaaacccaggtcgttgtaaggagctcctgctgctatgcttctcagacttcctgatcggccgataccttgaagttaacgtgatcagcggcgaggaatccttaattgcggctagagagcccttcagctggaagaagctgaagtcgtcacaggccttgaccagcgcgaaaaccactgtggtcgtgaccgctcagaaacgcaactccagaaggcagctccctagttttctgccccaatatcctatccccgataggctcagaaaatgtgttgagcagaagatagacatcctgacctttcaaccgttactggccgaattgttgaacatgtcgaactacaaggagaaattctcaaccctactgtggctggaagaaatctacgcagagatggaactcaaagagtacaacatgtctggaatcattttgcgtagaaacggtgatctactggtgttagaggtcccaggactggccgagggaaggccctcactgtacgccggagataagctaatcctgaaaacacaggagtacaacgggcatgctatcgaatatattagctatgtaaccgagatccacgaagaagatgtcacactgaaaatcaatcctgagtttgagcaggcctacaacttcgaacctatggatgtcgagttcacttataatcggaccacaagtcgccgatgtcattttgcccttgaacatgtcattcatcttggtgtgaaggtgcttttcccagaagaaattattttacagtccccacaggtcacagggaactggaaccacgcacaggatactaagagcagcggccaatccactagcaaaaaaaacaggaagacgatgacagaccaggctgagcacggcactgaggagcggagggtgggggataaagatttgcctgtcttggcgcctttcactgcagagatgtccgactgggtcgacgaaattcagactccaaaggcacgcaaaatggagttcttcaatcctgtgcttaacgagaatcagaagctggctgttaagcggatccttagcggtgattgcaggcctctcccctacatcctgttcggtccaccaggcacaggaaaaaccgtgactataatcgaagccgtgctgcaggttcacttcgcactgccagactcccgcatcctcgtctgcgccccaagcaacagcgccgctgacctcgtgtgcctaagactccacgagtctaaagtgttacagcccgctacaatggtccgggtcaatgcaacctgtcggtttgaggaaattgttatcgatgcagtcaaaccttattgccgagatggggaggatatatggaaggcctccagattccgcattattattactacctgcagctcctccggactattttaccagatcggcgtgagagtcggccattttactcacgtgttcgtcgacgaggcaggccaagcaagcgagccagagtgcctcatacctcttggtttgatgtcggatatctctgggcagattgttctagccggagaccctatgcagctcgggccagtgatcaaaagtagattggccatggcgtatggtctaaatgtgagtttccttgagcggctcatgtcccgtcccgcttaccagcgagatgaaaatgccttcggggcttgtggcgctcataacccactgttagtcacaaaactggtgaagaattaccgctcacacgaggcattgctcatgctaccgagtcggctcttttaccatagagaactcgaggtatgtgcagatccaacagtcgtaacctccctgcttggttgggaaaagttgcctaagaaaggcttcccactgatcttccacggtgtgagaggctcagaagctcgggagggcaaatccccctcctggtttaaccccgcagaagcagtacaggtgctacgctactgttgcctgctcgcccactctatctcttctcaggtttccgcttctgatatcggtgtgataaccccctaccggaaacaggtggaaaagatcagaatacttctgcgcaacgttgatctgatggatatcaaggttggctcggttgaggagtttcaagggcaggagtatcttgtcatcattatctcaacagttagatcaaacgaagatagattcgaagacgatagatacttcctgggctttctgtcgaatagcaagcgctttaatgtagcaatcacaagacctaaggcccttcttatcgtgctcgggaatccgcacgtcctggtgagagatccctgcttcggggcattgcttgaatacagcatcaccaatggcgtgtatatgggttgcgatctgcccccagcactacagagtctgcagaattgtggcgaaggagtcgctgatccctcttatccagttgtccctgaatcaaccggccctgaaaagcatcaggagccaagttag

SEQ ID NO: 231080 - DNA, 378 bp, Artificial Sequence
  Description of Artificial Sequence: Synthetic coding sequence
atgagcgatatctccggtcaggtgactaaactggtgaagaactataggtctcatgaggccctacttatgcttccctcgaggctgttttaccacagagagctcgaagtctgcgccgatccaacggttgtgacgagtctgcttgggtgggaaaaactgcccaagaaaggctttcccctaatctttcacggggttcgcggaagcgaggccagagaagggaaatctccttcctggtttaatcctgcagaggccgttcaggtgctgaggtattgttgcctgctggctcacagcatttcatcacaagttagtgcctcagacataggtgtgatcactccctacagaaagcaggtccggcctgcacaggctaggctggtactgtag

SEQ ID NO: 231081 - DNA, 378 bp, Artificial Sequence
  Description of Artificial Sequence: Synthetic coding sequence
atgagtgacatctcaggacaggtaaccaagcttgtgaagaactatagatcacacgaggcgctgctcatgctgccctcccggttgttctaccacagggagctcgaggtgtgcgctgatccaacagttgtgaccagcctcctaggatgggagaaactgccaaaaaagggtttcccgctgatatttcatggagtccgaggcagtgaagcgcgagaggggaagtctcccagttggttcaacccagctgaggccgtgcaggtactgcggtactgttgtctcttagcgcattcaatcagctcacaggtgagcgctagtgatatcggggttatcaccccgtataggaaacaagtcagacctgcacaggctcggctcgtgttgtag

SEQ ID NO: 231082 - DNA, 1017 bp, Artificial Sequence
  Description of Artificial Sequence: Synthetic coding sequence
atgttccgcgtcggccatttcacccacgtgtttgtggacgaagccggacaggcctcagaaccggaatgcctgatccctctgggactaatgtcagatatcagcgggcagattgtgctggcgggagatccaatgcaactgggccctgtaatcaagtctagactggctatggcatatgggctgaatgtgtcctttttggagcgcctgatgagcaggcccgcttatcagcgcgacgaaaacgcctttggcgcttgtggcgcacataatcccttgctggttaccaaattagtcaagaactatcgatcacacgaagcgctgcttatgttaccctccagactattctatcaccgtgaactcgaggtttgtgctgatcctacggtcgtgacttccttgctaggctgggaaaaactgcccaagaaaggctttcccctaatattccatggagtcagagggagtgaggctcgagagggcaaaagcccctcttggtttaacccagcagaggcagttcaggtgctgcggtattgttgtttactggcccactctatttctagccaggtctctgcgtctgatattggggtaatcactccataccgcaagcaagttgagaaaattaggatcctcctgcggaacgtggacctgatggatataaaagtgggatcagtggaagagtttcaaggacaagaatatttggtaatcattatttcgacagtccgcagcaacgaggataggtttgaagatgacagatactttctgggttttctatccaactcgaagagattcaatgttgcaattacacgccctaaggccttacttatagtgctggggaatcctcatgtccttgtgcgcgacccatgctttggggctttactggaatacagcatcaccaatggcgtctacatggggtgcgatctgcctccggcactgcagtctctgcagaattgtggggagggcgtcgcagacccctcctacccagtggttcctgagagcactggcccagaaaagcaccaggagccgagctag

SEQ ID NO: 231083 - DNA, 3498 bp, Artificial Sequence
  Description of Artificial Sequence: Synthetic coding sequence
atgctaagcttggccgctaaactggtcgcctttttttggaggaccgccgacacccctcgggaggaggctggacaattggagccggaactggccgagggagacacgaaacttaaaaccgttcggggagtcgttacacggtattgctccgattatggcatgatcgacgacatgatttactttagctctgacgccgtgacctctcgcgtactgctgaacgtaggacaggaggtaatcgccgtggtggaggaaaataaagtcagcaacggtttaaaggctattagggtggaggctgtcagtgataaatgggaggatgacagcaggaatcacggctccccctccgattgcggccctagagttttgattgggtgtgttaccagcctcgttgaaggtgccggatgcatatcacagacgacttatttttcgctcgagtctgtgtgcgaaggcttcgagccctgcaaaggcgactgggtggaagctgaatatcgcattaggccaggtacatggagcagtgaagccacatccgtgaagcctctacgttacaaacgtgtggataaagtgtgcatttcgtctctctgtggcaggaacggcgtgctggaggaaagcatcttctttacactcgacagtctcaagcttccggatgggtacacgccacgacgcggtgacgtggtcaatgcagtagtggttgagtcatctcaatcctgttacgtgtggagggccctgtgcatgaccttggtcaaaagacgagatgccgcacccgtacatgaagccactcatttctatggcaccattttactgaagaacaaaggcgacatcgaagtcacccaggtgacccactttgggaccctcaaggaggggagatctaagacaatggttatctggatcgagaacaaaggagatattcctcagaatctcgtatcctgtaaactagccggatgggacaagagtaagcagtttcgttttcaaatgctagacaaggatcagatgtgccccgtcgtttccttcgttagcgtgcccgagaaagagaactcatcagatgaaaacatcaactctcttaactcccacactaaaaataagacttcccagatgtccgagagcagtcttgtgaataaccgcggaattagtcccggagattgcacttgcaaaggagaaaatggcgagaaggacaacatactcagcagaaagcaaatgaccgaaccagaacctgggggtctggtgccacctggaggcaagacgttcatcgtggtgatatgcgacggcaagaatccaggcaggtgcaaagaattgctgctgctttgtttttccgatttccttatcggcagataccttgaagtcaatgtaatctctggcgaggaatcactcatcgccgctagagaaccattttcttggaagaagctgaagagttcccaggcgctgaccagcgccaaaaccaccgtcgtggtcacagcccagaagaggaattcccgccgtcaactgccaagtttcctgccacagtaccctatccccgaccggctacgcaaatgcgtcgagcagaagattgatatccttacttttcagcccctgctggcagagctcctgaacatgagcaattacaaggagaagttctccacgctgctgtggctcgaggagatctacgcagagatggaactcaaggagtataacatgagtggcattattttaagacggaacggcgatcttcttgtgctcgaagttcctggacttgcagaaggtagaccatcgctgtacgccggagataagctgattctaaaaacacaagagtataatggacatgccatagaatacatcagttatgtcaccgaaattcacgaggaggacgtcactctgaagattaaccccgagtttgaacaggcatataactttgaacctatggacgttgagtttacctacaaccggacaacctcaagacggtgccactttgcccttgagcacgtaatccacctgggcgttaaagttcttttcccggaagaaattatcttgcagtcaccccaggtgacgggaaattggaatcatgcccaggatacaaaatcctccggccagtccacttctaaaaagaatagaaagacaatgaccgaccaagccgagcatggcacggaggagaggcgggtcggagacaaggaccttccagtcctggcacctttcactgcagagatgtcagattgggtggacgagatccagactccaaaagctcgaaagatggagttctttaaccctgtgctaaacgaaaaccagaaactcgctgttaaacgcatactcagtggcgactgtcggcctctcccctatatcctcttcggcccaccgggaacaggaaaaaccgtgaccatcattgaggccgtattgcaggtgcacttcgcactacctgactcccggattttagtgtgcgctccaagcaactccgctgccgacctggtttgcctgcgactccatgagtctaaagttctgcaaccagcaacaatggtccgcgttaacgctacgtgtcgctttgaagagatcgtgatcgacgccgtgaagccttactgccgagacggagaagacatatggaaggccagtcggtttagaataataataactacatgcagttcctctggactgttttaccagattggggtgcgagtggggcactttacacacgtgttcgtcgatgaggcaggtcaggcctcggagcctgagtgcttaataccccttggactgatgtctgacatctcgggccaaatcgtgctggcaggtgaccccatgcagctaggaccagtgatcaagagccgcctggcaatggcttacggcttgaatgtgtccttcctggaacggctgatgtcacgcccagcctatcagcgcgatgagaatgccttcggcgcttgcggtgcgcataaccccctactggttactaagcttgtgaagaactaccggagccatgaagccctgttgatgcttccatcgcggttgttttatcatcgcgagcttgaagtttgcgccgatccgaccgtcgtgacgtccctgctgggctgggagaaactccctaagaagggtttcccactgatctttcatggtgtccgcggttctgaggctcgcgaaggcaagtctccaagctggttcaatcccgctgaagctgtgcaggtgctgaggtattgctgcctcctagcacatagcatttcgagtcaagtatctgctagcgacattggcgtcattaccccttaccgtaaacaagtggagaagatcaggatcctcctgagaaatgtggacctcatggacataaaagttggtagtgttgaggaatttcagggccaggagtacctagtgattattatttcaaccgatccttgttttggagcactgctcgagtactccatcactaacggagtctacatgggctgtgaccttccacctgctctgcaatctcttcagaactgtggcgaaggcgtcgccgatcctagttaccctgtggtgccggaatcaacaggcccagagaaacaccaagagccaagttag

SEQ ID NO: 231084 - DNA, 636 bp, Artificial Sequence
  Description of Artificial Sequence: Synthetic coding sequence
atgtcgttccttccagtgcgaagcgttatcggcggtggcgataccaaactgaagacggtgagaggggtcgtaacccgctattgttccgattacgggatgatcgacgacatgatctacttcagttctgacgcggtaacctctagggttctgttaaacgtgggccaggaagtgatcgccgtggtggaggagaacaaagttagtaacggcctgaaagcaattcgcgtcgaagctgtttctgataagtgggaggatgactccagaaaccacgggtccccctctgattgcggcccaagggtgctgatcggctgtgtgacctccctggtggagggcgctggatgtattagccagactacctactttagtctggagtcagtctgcgaggggtttgaaccctgtaaaggtgactgggtagaggcggagtataggattaggcccggtacgtggtcaagtgaggccacgtccgtcaaaccgctcagatacaagcgggtggataaggtcgcatgccgtctggtcgctccgctctgcgcctcaggtcgcccagccatccgcggtaatttgcacggacccggatttagctgcatgtgctggaaacccggtaagatcaaactgtgtcacggccagagagaaaagaagtag

SEQ ID NO: 231085 - DNA, 3498 bp, Artificial Sequence
  Description of Artificial Sequence: Synthetic coding sequence
atgtccttcctgccggtgaggagtgtgatcggcggaggtgacaccaagctgaagacagtaaggggtgttgtgacaaggtattgctcagactacgggatgatcgatgacatgatttattttagctctgacgctgttacctctcgggtcttgctcaacgtggggcaggaggtgatcgccgttgtggaggagaataaagtgagtaatggcttgaaggctatcagagtggaggccgtgtctgacaagtgggaagacgactccagaaatcacggttctccaagcgactgcggccctcgagttctgatcggctgtgtgactagcctggtggagggtgcagggtgcattagtcagaccacttatttttctctcgagtccgtttgtgagggtttcgagccttgcaagggcgactgggtagaggccgagtatagaattaggccgggtacctggtcctctgaggccacaagcgtcaagccactgcgatacaaacgggtggataaggtttgcatatcgtccctgtgcggtcggaacggagtgctagaagaatccattttctttaccctggactccctgaagcttcccgacggatacacgcctcggaggggagatgtggtgaatgctgtggtggtcgagtcatcgcaaagctgctacgtgtggcgggcactgtgtatgaccctggtgaaaaggcgagatgccgcaccagtccatgaggcgactcacttctatggaacaattcttctgaaaaacaaaggcgatatcgaggtgacacaagtcacccacttcggcaccctgaaagagggaagaagcaagacgatggtgatctggatcgaaaacaaaggcgatatccctcagaacctggtcagctgcaagctggctgggtgggataagtccaagcagtttaggtttcagatgctggacaaggatcagatgtgtccggtcgtgtcattcgtatccgttccagaaaaagagaatagcagcgatgaaaatatcaactccctgaattcacatacgaaaaataaaacgtcacagatgtctgagagtagtctagtgaacaatcgcggaatcagtccgggagactgcacatgcaagggcgagaacggcgaaaaggacaacattctgagtcgcaagcagatgacagaacctgaacctggaggcctggtccctccaggtgggaaaaccttcatcgtcgtcatatgtgacgggaaaaatcccggtcgatgcaaggaactccttctgctatgcttttctgattttctcattgggcgttacctggaggtcaatgtgatctcaggggaagaatcgcttattgccgctagggagcccttcagctggaaaaagctcaagtcgtcacaggcattaacatccgcaaaaacaacggtggtggtgacagcacagaagagaaattccaggcgtcagcttcctagcttcctccctcagtatccaattcctgatagactgcgaaaatgtgtggagcagaaaattgacattctgactttccaacccctactagctgagctgctcaatatgagcaactataaggagaaatttagcaccttactctggctcgaggagatctacgccgagatggaactcaaggaatacaacatgagcggaatcatcctccgccgaaacggcgacctgctcgtcctggaagtcccaggccttgcagaaggtagaccctcattgtacgctggcgataaactgatactgaagactcaggaatacaacggccacgccatcgagtacatcagttacgtgaccgagatccacgaggaggatgtgacacttaagatcaacccagagttcgaacaggcctataatttcgaacccatggacgtcgaatttacttacaacaggaccacttcccgacgatgccacttcgcacttgagcacgtgatccatcttggggttaaggtgttattccccgaagagattatccttcagtccccacaagtaacaggcaattggaatcacgcccaggacaccaaaagctctgggcaaagcactagcaaaaagaaccgtaagaccatgactgaccaggctgaacatggaaccgaagaacgtagggtaggcgacaaggatctaccagtgctggcaccatttaccgcggagatgtcagactgggtcgacgaaatccagacaccaaaggcccgtaagatggagttctttaaccccgtcctgaatgaaaatcaaaagcttgccgtcaagcgtatcctgagcggcgattgtcgacctctgccgtacattctgttcggacctccaggcacaggaaaaaccgttacgatcatcgaggcggtgcttcaggtgcacttcgcgttacccgactcacggatcctcgtgtgtgcaccgagcaactccgcggcagacctggtttgcttgagactgcacgaatccaaagttctgcaacccgcaaccatggttagagttaacgccacctgtcgcttcgaggaaatcgtgatcgatgctgtgaagccttactgtagagacggagaggatatctggaaggcaagcagatttcgcattatcattactacatgcagtagctctgggctgttttaccagatcggcgtccgagtgggccatttcacacatgtgttcgtagacgaggccggtcaggcgtctgagcccgagtgtttgatcccacttggtctcatgtcggacatctctgggcagattgtcttggcgggagatcccatgcaactgggacccgtgatcaagtcccgtctcgctatggcttacgggctgaatgtgagtttcctggagcgactgatgtcgcggcctgcctatcagagggatgagaacgcttttggcgcttgtggggcacacaaccctctgctggttaccaaactcgttaagaattacagaagccatgaggccctacttatgctgccatccagactgttttaccatagggaactggaggtatgtgctgatccgaccgtggtgactagcctgctggggtgggaaaagcttccaaaaaaggggtttcctctcattttccatggggtgcggggaagcgaagccagagaaggcaagtcaccaagttggttcaatccagctgaagctgtgcaggtgctcaggtactgttgtttgctggctcattctatctcgtctcaggtctcagcttcggacatcggggttatcaccccttacagaaaacaggtggagaaaatccgaatcctgctgagaaatgtggacctgatggatatcaaagtgggatctgttgaggagtttcagggtcaggaatacctcgtcatcattataagcacagtgaggtcaaatgaagatcgctttgaagacgaccgttactttctaggattcctgtccaacagcaagcggttcaacgtggccatcacccgccctaaagccctcctcattgtgcttggtaatccccatgttctggttcgactgtggcgtggcggaggcaggccactgttgcccagtggggctaggatccataggacgcgggaggcctccggggcacagttgatctgctccgggtag

SEQ ID NO: 231086 - DNA, 3636 bp, Artificial Sequence
  Description of Artificial Sequence: Synthetic coding sequence
atgctgtctctcgcggctaaactggtggcatttttctggagaacagctgatacccccagagaagaagcaggccagctagagcctgaactggctgagggagataccaagcttaagaccgtcagaggggtagttacccgatattgttccgattacggtatgattgatgatatgatctacttctcatccgatgccgtgaccagcagagttctgttgaacgtgggccaggaagtcattgctgtggtggaggaaaataaagtgagcaacgggctgaaagccatccgggtggaagctgtgtccgacaagtgggaggacgacagcaggaatcacggctccccatcagattgtggcccaagggttctcatcgggtgtgtcacttccctggtggagggcgctggatgcatttcccagacaacatacttttctctcgaaagtgtctgcgaagggtttgaaccctgcaaaggcgattgggtggaagctgagtatcggatacggccagggacgtggtctagcgaggcaacctcagtcaagccgttgagatacaagcgtgtcgacaaagtttgtatttcttctctgtgcggtaggaatggcgtgcttgaggagagcatatttttcacgcttgacagtctcaagctgccggatgggtatactccgaggagaggagatgtggtaaatgccgtggttgtcgagtccagccagagctgctacgtgtggagggccctgtgtatgactctggttaagcggagagacgctgccccagttcacgaggctacccacttttacgggacaatactgctaaagaacaagggcgatatcgaggtcactcaggttacacatttcggaacccttaaagagggccgttctaagacaatggtcatttggatcgaaaacaaaggtgatatcccacagaacctggtgtcctgcaagctggcaggatgggataaatccaagcaattcaggttccagatgctggataaggaccagatgtgcccggttgtgtcgttcgttagcgtgcccgagaaggaaaactcttcagacgagaatattaacagccttaacagtcacacaaaaaataagacttcccaaatgagcgagtcaagtctggttaataaccgaggcatttcccctggtgactgcacgtgcaagggcgagaacggtgaaaaggacaacattctcagccgtaaacagatgactgagccagagcccggaggactggtgcccccaggtggtaagacattcattgtggtaatctgcgacggaaagaatcccggaaggtgcaaggagctgctattattgtgtttttctgactttctgatcggcaggtatctggaagtgaatgtgatttccggcgaagagagccttatcgcggctcgagagccgttctcatggaagaagctgaagagctctcaagctttaacctccgctaaaactacagtagtcgtgactgcccagaagagaaatagccgacgccagttgccttccttcttgcctcaatatcccatccccgataggctccgcaagtgtgttgaacagaagatcgatatcctgacattccagcctcttcttgccgaactgctcaacatgagcaactataaagagaaatttagcacgctcctgtggctcgaagagatttacgcggaaatggagctaaaagaatataacatgtcaggcatcattctccgtagaaacggtgatctccttgttcttgaagtgcctgggttggcagaagggaggccatcattatacgcaggcgacaagcttattctgaagacccaggaatacaacggacatgccatcgagtacatctcttacgtgacagagatccatgaagaggatgttaccttgaagattaatccggagttcgaacaagcctacaactttgaaccgatggatgtggaatttacttacaatcgcacgacatctcggcgatgccacttcgcactcgaacatgtgatacacttgggggtcaaggtgttgttcccagaggagattattctccaaagtccgcaggtaaccggtaattggaaccacgcccaggatacaaagtctagtgggcaatccactagcaaaaaaaatagaaaaacaatgacagaccaggccgagcacggcaccgaggagcgccgagtgggcgataaagatctgccggtgttggccccttttacagccgagatgagtgattgggttgacgaaatccagacccccaaggcccgaaaaatggagttctttaatcccgtgctcaatgagaaccagaagctggccgtgaagaggatcctgtccggggactgccgccctctgccttacatcctgttcggccctcccggtacgggcaaaacagtaacaattatcgaggcggtgctgcaggtgcatttcgcccttcccgactcgcgtatcctggtttgcgccccttctaactccgccgcagacctcgtctgcttacggctgcatgaaagtaaagtcttacaaccggctacaatggtgagggttaacgctacatgccggtttgaagagatagtgattgacgccgtgaaaccttactgcagggacggcgaagacatctggaaggcttcccgattccggatcatcatcacgacatgcagttcttccggattattttaccagattggagtcagagtggggcacttcacccacgttttcgtggacgaggcgggacaggcaagcgaacctgagtgcctgatccccttggggctcatgtcagatatttctgggcagattgttctggccggagatcctatgcaacttggaccagttatcaagtctcgcctcgcaatggcatatgggctaaacgtctcctttttggaaaggctcatgtccaggcccgcataccagcgagacgaaaacgcgttcggtgcctgcggtgcacacaaccctctactggtaacaaaactggtcaagaattatagatcacacgaagctcttcttatgctcccttcccggctcttctatcacagggaactggaggtctgcgcagatcctaccgtggttacctccttgttaggatgggaaaagcttccaaagaaagggtttcctctgatctttcacggcgtgcggggatccgaggccagagaaggcaagtctccaagttggtttaaccccgctgaagcagtacaggttctccgatactgttgtcttctcgcgcactcaatatcttcacaggtctctgcaagtgatatcggcgtgatcaccccctacaggaaacaggtggagaaaatccggattctcctgcgcaatgttgacctaatggatatcaaggtaggctctgtcgaggagtttcagggccaggaatatcttgtaattattatttccacagttcgctctaatgaggatcgcttcgaggacgaccgctactttctaggttttctgagcaactccaagcgctttaacgtcgccattacacggccaaaggctctcctgattgttctgggaaatccccacgtcctcgtgcgagacccctgctttggagctctgcttgagtactctattacaaacggggtatatatgggctgcgacctaccgccagcactgcagtccctccaaaactgcggggaaggagtggctgacccctcttacccagtagtgcccgagtctacagggcctgagaagcaccaggaaccttcctag

SEQ ID NO: 231087 - DNA, 483 bp, Artificial Sequence
  Description of Artificial Sequence: Synthetic coding sequence
atggctgccgaaagaaaaacgcgtctctctaagaacctgttgcggatgaaatttatgcagagaggcctggattcagagacgaagaaacaattggaggaagaggaaaaaaagatcatctctgaggagcactggtacctggacctccccgagttgaaagagaaggagtctttcatcatcgaagagcaaagtttcctgctgtgcgaggacttactctacgggagaatgagtttcaggggatttaaccctgaggtggagaagctcatgctgcaaatgaacgctaagcataaggctgaagaagtggaagatgaaactgtggagttagatgtgagcgatgaggagatggctcgaaggtacgagacgcttgtggggacaataggcaaaaagttcgcacggaagcgtgatcacgcaaattacgaggaggatgaaaatggcgatatcacccccattaaggcaaaaaaaatgttcctgaaaccacaggattag

SEQ ID NO: 231088 - DNA, 627 bp, Artificial Sequence
  Description of Artificial Sequence: Synthetic coding sequence
atgaaagcatgtaagcgcggtaactccgacattgtgagattggtgatcgagtgtggggcagattgcaatattttgtctaagcaccagaattccgccttgcatttcgccaaacagagtaataatgtgttggtgtatgacttactgaagaatcaccttgagactctttccagagtcgccgaggaaacaattaaagactacttcgaggcccgtttagcgttactcgaaccagtgttccctattgcttgccacaggctctgcgagggacccgactttagtaccgacttcaattataagcctccacaaaacatccccgaaggttccgggattcttctgtttatttttcacgctaactttctgggaaaagaagtgatcgcacgcctttgcgggccatgctcagttcaggcagtagtattgaacgataaatttcagctgcccgttttcctgacaggctccagatcagttgtccaagccggtgtccagtggaggggccttcagttaacgggagtcctcacatcccaggctcaagccatcctccctccccaaccgcctaactatctgggcctcaagatgaccgtgatcctgttcactcactctgccctgttacaagtcccaattaacagcagttag

SEQ ID NO: 231089 - DNA, 2583 bp, Artificial Sequence
  Description of Artificial Sequence: Synthetic coding sequence
atggaacaagtggccgaaggagcccgagtgactgctgtgcctgtatcagcggctgactcaaccgaggaactagccgaagtggaagagggcgtgggcgtggtgggcgaagataacgatgcagctgctcgtggcgctgaggcatttggggactcagaggaagacggtgaggatgtgtttgaggtcgagaaaatcctcgacatgaaaacagaggggggaaaggtgttgtataaggtgagatggaaaggttataccagtgatgacgacacctgggagcccgaaatacacttggaggattgcaaagaggttctgctcgagttccggaaaaagatcgccgaaaacaaagcaaaggctgtccggaaagatattcaaagactcagcctgaataatgatatttttgaggctaattcggatagtgaccagcagtctgagactaaagaggatactagcccaaagaaaaaaaagaaaaaacttcgccagcgcgaagagaaatcacctgatgaccttaaaaaaaaaaaagcaaaagccggaaagttgaaggacaagtcgaagcctgatctggaaagttctctcgagtcactggttttcgacctcagaactaagaaacggatctccgaggccaaggaggaactgaaggagtccaaaaaaccgaaaaaggacgaagtgaaagagactaaggagcttaaaaaggtaaaaaaaggagaaattagggatttaaaaaccaaaacacgggaggaccccaaggagaacagaaaaaccaagaaagaaaagttcgtggaatcgcaggttgaatcagaaagctccgtgctgaacgacagcccatttcctgaagacgactctgaagggcttcactccgactcccgcgaagaaaaacagaacactaagagcgccagagaacgcgctggacaagacatgggcttggagcacgggttcgaaaagccacttgactccgccatgtccgctgaagaggacacagatgtgcgcggtagaagaaagaaaaaaactccgagaaaggctgaagacacgcgggagaaccggaaactggaaaacaaaaatgccttcctcgaaaaaaagaccgtgcccaagaaacaaagaaaccaggaccgctccaaaagtgctgccgaactcgaaaagctaatgcctgtttctgctcaaacacccaaagggaggaggttgagcggggaggaacgaggattatggtctaccgacagcgccgaagaagacaaggaaacgaagcggaatgaaagcaaggaaaagtaccaaaaacggcacgactcagacaaagaagagaagggcaggaaggaacccaaaggcctgaaaacattaaaagaaatacggaacgcatttgacctgtttaaactgacacccgaagagaagaacgatgtcagcgaaaataacaggaagcgcgaagaaatccctctggactttaagaccatcgatgatcacaaaactaaagaaaacaagcagtccctaaaggagcgacgcaacacaagagatgagactgacacttgggcatatattgcggcagagggggaccaggaggtgctggacagtgtgtgccaagctgacgaaaacagcgatggacggcaacagattctgtctttgggcatggacctgcagctggaatggatgaagttggaggacttccaaaagcacttagacggtaaagacgagaatttcgcagccacggacgcgattccgtctaatgtgctgagagatgcagtgaagaatggggattacatcacggtgaaggtagcattgaactcaaacgaagaatataacctcgaccaggaggacagcagcggcatgacattagtgatgcttgcagctgcgggtggccaggatgacttattacggctgctcattaccaagggagccaaggtcaatggcaggcagaagaacgggactacagctctaatccatgcagctgagaaaaatttcctgactactgtcgcaatcctgctggaggccggagcctttgtaaacgtgcagcaatcaaatggcgaaaccgcactgatgaaagcctgcaagagaggaaatagtgatatcgtgcggttggtgatagagtgcggcgctgactgtaacattctgtccaagcaccagaactcagcactccacttcgctaagcagtctaataatgtactggtgtatgatctactcaaaaaccaccttgagactctgtctcgggtagcggaagaaactatcaaagactatttcgaggctcgcctggctctgctggaacccgtcttccccatagcgtgtcaccgcctctgcgagggtccagatttctctaccgacttcaattacaaaccaccgcaaaatatcccagagggttcagggatccttcttttcatctttcatgccaacttcctgggtaaagaggtcatcgcccgactctgcgggccttgtagcgttcaggctgtcgtactcaatgataaattccagctccccgtgttcctggactctcactttgtgtactccttcagtcccgtggcaggccctaacaagctatttattcggctgaccgaagctccttctgccaaagtcaaactgcttatcggtgcatatcgcgttcagctccagtag

SEQ ID NO: 231090 - DNA, 2604 bp, Artificial Sequence
  Description of Artificial Sequence: Synthetic coding sequence
atggaacaggtggccgagggggctcgcgttaccgcggtgccagtaagcgccgctgactcgaccgaagaattggctgaggtcgaggaaggagtgggcgtggtgggcgaggacaatgacgctgctgccagaggggctgaggcttttggcgatagcgaggaagatggagaggatgtgtttgaggtagagaaaattctcgacatgaaaaccgaagggggaaaagtgttatacaaagtgcgctggaaagggtatacctcagatgacgacacctgggagcctgaaatccacctggaggactgcaaggaagttctgctcgagttcagaaaaaagatcgctgagaacaaggccaaagctgtgaggaaggacatccagcgcctcagcttgaacaatgacatattcgaagccaacagcgattcagaccagcagtctgaaacaaaagaggacactagccctaaaaagaagaaaaagaaactgcgacagagagaggaaaagtctcctgatgacctcaagaaaaagaaggccaaggccggaaaactgaaggacaagtctaaacccgacttagagagtagcctcgagtccctggtgtttgatcttcggactaagaagcgtatttcagaagccaaagaggagttgaaggagagcaagaaacctaagaaggacgaagtgaaggagactaaggagctgaaaaaggtaaagaaaggcgaaattagagacttgaaaactaagacccgcgaagatcccaaggaaaacaggaagacaaaaaaagagaaattcgtcgagtcgcaggtggagagcgaatcttcagttctgaatgattcaccgtttcctgaggacgactcagaggggctgcattccgactcccgggaggaaaaacaaaatacgaaaagcgccagagaaagagctgggcaagacatggggctagaacatggatttgaaaagccactggatagcgccatgagtgccgaggaggacactgacgtgcggggtaggagaaagaaaaagactccccgaaaggccgaagacacacgtgagaacaggaagcttgagaataaaaacgctttcctggaaaagaagaccgttccaaagaagcaacgcaaccaggaccggtccaaatccgcagccgaactggagaaactaatgcccgtgtccgcccagacaccaaaagggcgacggctgtccggcgaggagaggggcctttggagcactgactctgcagaggaggacaaagaaacaaagcgcaatgagtccaaagaaaagtaccagaagaggcacgactccgataaggaggagaaaggcaggaaggagcccaaggggttgaagacattaaaggagattagaaacgcctttgatctctttaagttgacaccagaggagaagaacgatgtcagtgaaaacaaccgtaagcgcgaagaaattcctttagatttcaaaactatcgacgatcataagacaaaagaaaataaacaaagcctgaaagagaggcggaatacacgcgacgagaccgatacttgggcttacatcgctgccgagggtgaccaggaggtcttggatagcgtttgtcaagcagatgagaatagcgacgggagacagcagattctgagcctgggcatggacttgcagttggaatggatgaagctcgaagatttccaaaagcacctggatggcaaggacgagaacttcgcagcgaccgacgccatcccatctaacgttctcagggacgctgtgaaaaacggtgattacattacggtgaaagtcgctctaaacagcaatgaagaatacaacctagatcaggaagactcctcagggatgaccctggtaatgctggctgccgctggagggcaggacgatctgttgaggctgctcatcacaaaaggcgctaaggtcaatgggagacaaaagaatggaaccactgctttgatccacgcagccgaaaagaattttctgaccaccgtagcaattcttttggaagctggagccttcgtgaacgtccagcaatccaatggggagactgcgctgatgaaggcctgtaagagaggcaacagcgatatagttcggcttgtgatagaatgcggagcagactgcaacatcctgtcaaagcaccagaacagcgcacttcatttcgctaaacagtctaataacgtgttggtctacgaccttttaaagaaccacttggagacactctctcgtgtcgcagaggaaaccattaaggattacttcgaagcaaggctggcactattagagcccgtgttcccgatcgcgtgtcaccgcctgtgcgagggcccagacttttccactgacttcaactataagccccctcagaatatcccagagggaagtggcattttgctctttattttccacgccaacttcctgggcaaggaagtaattgctcgtttgtgcggcccttgctccgttcaagccgtcgtgctcaacgacaaattccaactccctgtctttcttacaggctcacgttcagttgtccaggctggagtgcagtggcggggtctccagctcactggagtcctaacatctcaggcacaggccatcttaccgccacagcccccaaattatttagggctgaaaatgcatgctacaactagcggctag

SEQ ID NO: 231091 - DNA, 1812 bp, Artificial Sequence
  Description of Artificial Sequence: Synthetic coding sequence
atggagcaggtggccgagggggctagggtgaccgctgtccctgtcagtgccgctgatagcaccgaagagttggctgaggtcgaagagggagtaggcgtagtcggagaagacaatgacgccgctgcgagaggagcagaagccttcggagattcggaggaagatggggaggacgttttcgaggtagaaaagatcctggacatgaagactgagggcggtaaagttctctataaagtccgatggaaagggtacacgagcgacgacgatacatgggaacccgagattcatttggaggactgtaaggaggtgctgttagaatttcgtaagaagatcgctgagaacaaagccaaagcggtcaggaaggacatccaacggctttcgctgaacaacgacattttcgaggccaatagtgattccgatcagcagtctgagaccaaggaggatacctctcccaagaagaaaaagaagaagttgcgccagagggaagaaaagagcccagacgacctaaagaagaaaaaagctaaggccggtaagctgaaagacaaatccaagccagatctggaaagtagtctggaaagcctggtgtttgacttgagaaccaagaagaggatcagtgaggctaaggaggagctgaaggaatctaaaaaacccaaaaaagatgaggtgaaggaaactaaggagctgaagaaggttaaaaaaggagaaattagagacctcaaaaccaagaccagagaagatcccaaagaaaatcgaaaaacaaagaaagaaaagtttgtggagagccaagtggagagcgagtcttctgtgctcaacgactcgccgttcccagaagacgactcagagggcttacactctgatagccgagaggagaagcagaacacaaaatctgcccgtgaaagggcgggacaagacatggggctcgaacacggatttgaaaaaccgcttgatagtgcaatgtcagctgaggaagacaccgacgttcgaggccgacggaaaaagaagacccctcgtaaggctgaggataccagggaaaacagaaaactcgagaacaaaaacgcttttttagaaaagaagaccgttcccaagaagcaaaggaatcaagatcgaagcaagtccgctgccgagctcgaaaagctcatgcccgttagcgcccagacgcctaaggggcgacggctgagtggggaagaaagaggcctgtggtctaccgatagcgccgaggaggacaaggaaacaaaacggaacgaatctaaggagaaataccagaagcggcatgactccgataaggaggaaaaaggtcgcaaagagccgaaaggcttgaaaaccttgaaggaaattcggaatgccttcgacctctttaagcttacccccgaggagaagaatgacgtgtctgagaacaatagaaagcgcgaagaaatccctctggattttaaaaccatcgacgaccacaagacgaaggaaaacaaacagtccttgaaggagcggagaaatactcgagatgaaaccgatacatgggcctacatcgccgcagagggggatcaagaggtcttagactccgtgtgccaagctgatgaaaattccgacggacgacaacagatcctctccctgggaatggatttacagctggaatggatgaagttagaggacttccagaagcatctggatggaaaagacgagaacttcgcagcgacagatgccatacctagcaacgtactccgagatgccgtgaaaaaaaaaaagaagaaaaaatttctcggcacgtacaccttttttttatttttctttttcgaaaagccggacttagtgccgttattttag

SEQ ID NO: 231092 - DNA, 3087 bp, Artificial Sequence
  Description of Artificial Sequence: Synthetic coding sequence
atgggcttcttttcactttcgtcagagcgaaacgaatccgtaatccactacccggagtcgacagaaccggaaattcaacaagagatgtcgacatcccaaccagattgcaacgttgattcctgttctgtttcctctggctatgggaccttctgcattagtgaactgaatctgtacaagagcaaggatcctaaagagtttatggagcacatcgatgtccctaagggccagtacgtggctcccgcagttccagccgaatccctggtggacggcgtcaagaatgaaaacttttacatccagacgcctgaggagtgtcatgtgtcgttgaaggaagacgtgtcgatatctcctggtgaatttgaacacaatttcctgggcgagaataaagtgtccgaagtctactctggaaagaccaattccaatgccatcaccagttgggcgcaaaagctgaagcagaatcagcctaaaagggcccatgttgaagacggcggaagtaggtctaaacaaggtaatgaacagagtaaaaagactcctattgagaagagcgatttcgctgccgcaacacatccaagagccttttacctatccaagccagatgaaacaccgaatgcctggatgagcgatagcggaaccggtctgacatactggaaactggaggagaaggacatgcaccactcattgcccgaaacactggaaaagacttttatttcattgtcttcaaccgacgtgtctccaaatcaatctaatacttcaaatgagatgaagctgcccagtttaaaagatatttactataagaaacaacgggagaataaacagcttccagagcggaacctaacctcggcgagcaatcctaaccatcccccagaagtgcttacactggaccctacattgcatatgaaaccaaaacagcagatcagtggcattcagccacatggcttgccaaatgcccttgatgaccgcatctcgttttcccctgactccgtgttggagccttcgatgagctccccttcagacattgatagctttagccaggctagtaatgtgacttcccaactccctgggttcccgaagtatccctctcatacaaaagcatcacccgtggatagctggaagaatcagacgtttcagaacgagtcaaggacatcttcgacctttccttctgtttacacaataaccagtaacgacatctcagtaaatacagtggacgaggagaacacagtgatggtggccagtgcgtcagtatcccaatctcagcttccagggaccgccaatagcgttcctgagtgtataagtttaacatccttggaggacccagtgatactgagcaaaatcagacaaaacttaaaggaaaagcatgccagacacattgccgaccttcgggcatactatgagtcggaaatcaattcgcttaagcagaagctggaggccaaagagatttccggggtggaggattggaagattactaaccagattttggtcgatcggtgcgggcagcttgatagtgctctgcatgaggcaactagtcgggtgaggactctggagaataaaaacaatctgctggaaattgaagttaatgacctcagggagagatttagcgcagcgtccagcgccagtaagattctgcaggaacgcatcgaagagatgagaacgtcgtcaaaggagaaagacaatacgatcattcggctgaagagtcggctccaggacttggaggaagcctttgaaaatgcatataagcttagcgacgacaaagaggcgcaactcaaacaggagaataagatgttccaggatttgctgggggaatatgagtccctaggcaaggaacaccggagagtgaaggatgccctgaacactaccgaaaataagctgctcgacgcatacacacagatctctgatcttaaacggatgatttctaaacttgaggcacaagtgaagcaggtcgaacatgagaatatgctttcactgcgtcataattcccggattcacgtgcgcccttcaagggccaacacgctcgctaccagtgatgtttcccgcaggaagtggctgatccctggcgcagagtactcgatatttacggggcaacctctggatacccaagatagcaacgtggataatcaattagaagagacgtgtagcctcggacaccgatccccactggagaaggatagctcacctgggtcctcttccacctccctgctgatcaagaagcagagagagactagcgacacccccataatgagggccctgaaggaactggatgaggggaagatcttcaagaactggggtactcagaccgagaaggaagacacaagtaacattaacccgaggcagaccgagacttccgttaatgcctcacggtccccagagaaatgcgcccagcagcgacaaaagcgcctgaactcagcctcccagcggagttcttcccttccgcctagcaaccggaaatcatccaccccaaccaaacgcgaaataatgctgactcccgttaccgtggcgtattctccgaagcggagccctaaggaaaatctctctcccggtttttcccacctgctgagtaagaacgagtcttcccctattagattcgatatactcctcgacgaccttgataccgtgcccgtatcaactctccagcgtaccaacccaaggaagcaactgcaatttttgccactagacgactcagaggagaagacctatagcgagaaggctactgacaatcacgtgaatcactcttcctgcccggagcccgttcctaacggagtcaagaaggtgtcagtcaggacagcatgggagaaaaacaaaagcgttagttacgaacagtgtaaacccgtgagtgtcaccccccaaggaaatgacttcgaatatacagctaaaattcggactctggctgagaccgagagatttttcgatgagcttaccaaagagaaggatcagatcgaagccgcactcagccgtatgccctctcctgggggtcgaatcacccttcagacccggctcaatcagacaccccaaatatgtgaggaatcctcacacaagtgtgcttttgcgggtcattacgtgccttgccatttgtacgattacaggttccaaggctag

SEQ ID NO: 231093 - DNA, 3096 bp, Artificial Sequence
  Description of Artificial Sequence: Synthetic coding sequence
atgggcttctttagcctctcttcagagcgcaacgaatctgtgattcattatcctgaatctaccgaacctgagatccagcaggaaatgtcgacctcgcagcctgattgtaatgtagacagctgtagcgtttcctccggttatggcaccttttgcataagcgaactgaatctctacaagtcgaaggaccccaaggagtttatggaacatatcgatgtgccgaaagggcagtatgtggccccagccgtacccgctgagtcattagtcgatggggttaaaaatgaaaacttctacatccaaacgcctgaggagtgccatgtgtctctgaaagaagacgtgtctatctccccaggtgagttcgaacacaatttcctaggcgaaaacaaagtctctgaggtctattcgggaaaaacgaactctaacgcaatcactagctgggctcaaaagctcaaacagaatcagcctaagcgcgctcacgtggaagatggaggaagtaggtccaagcaaggaaatgagcaaagcaagaagactcccattgaaaagagtgattttgccgcagctacacatccacgagcgttttatctgtctaaacccgatgagactccaaatgcctggatgagtgactcagggaccggactgacgtattggaagctggaagaaaaggatatgcaccactctttgcctgaaacgctggagaagaccttcattagcctctcctcaacggatgtgagcccaaaccagagtaataccagtaatgaaatgaagctcccaagtttgaaagacatctactacaaaaaacagcgtgaaaataagcagttaccagaacgaaatctgacctcagcatccaaccccaaccacccacccgaggtcttaaccttagacccaacactgcatatgaagccaaagcagcagatctccggaatacaaccacatggcctgcccaatgctctggacgatcggataagcttctctccagacagtgtccttgagccttccatgtcctcgccatccgatattgattccttctctcaagccagtaacgtcacctcccagcttcctggcttccccaagtaccctagccacacaaaagccagccccgttgactcttggaagaatcaaacatttcagaacgaatctagaaccagctcaaccttcccatctgtctacactattaccagtaatgacatctctgtgaatacagtggatgaggaaaatactgtcatggtcgcaagcgcttcggtgagtcagtctcagcttcccggaactgccaacagtgtgccggaatgcatcagtctaacctccttagaggaccccgtaatcctaagcaaaataagacaaaatctcaaggaaaagcacgctagacatatcgccgacctccgcgcttactatgagtccgagattaattcgctcaagcagaaactagaagccaaggaaatcagtggagtggaagattggaaaattactaatcaaattttggttgatcgatgtggccaactcgattccgccctgcatgaagccacctcccgcgttcgtactctggaaaacaagaataacctgctggagatcgaggttaacgacctacgcgaacggttcagcgccgctagtagtgccagtaaaatcctgcaggagcgcattgaagaaatgcgaaccagtagtaaggaaaaggataatactattatccggttgaagtctagactgcaagatctagaggaggcttttgaaaacgcctataagctcagcgacgataaagaggctcagttgaagcaggagaacaagatgtttcaagaccttttaggcgagtacgagagcctgggcaaggaacatagacgagttaaagatgctcttaataccaccgagaacaaactgctggacgcatacacacagatttccgatctgaagaggatgatttcaaagttagaggcacaggtcaagcaggtggaacacgagaacatgttatcactgcgccacaattcccggattcatgtgagaccctcacgtgcgaacaccctcgccacttctgacgtttctcgccgaaaatggcttatccccggagctgagtactctattttcacaggccagccccttgacacccaggactcaaacgtggacaaccagctggaggaaacctgttcacttggacaccggtccccccttgagaaagatagcagccccggatcaagcagtaccagtttactgatcaagaagcagcgcgagacatctgacacccctattatgagggcgctcaaagaattggacgaaggaaagatttttaagaactggggaactcagactgagaaggaagacacctcaaacatcaacccaagacaaactgagacatccgtaaacgcatctcgatctcctgaaaaatgtgcccagcagcggcagaagagactcaatagtgcttcacagcgtagctccagccttccgccaagcaaccgaaaatcttccacccccaccaaaagagaaatcatgctgacacctgtcacggtcgcctattcacccaaacggagtcctaaggagaacttaagccccggattctcccacctgctgtccaaaaacgaatcatctccaatccgcttcgacattctcctagatgacttagacactgtgccggtgagtactttgcaaagaaccaaccctaggaaacagctccagtttctgccattggatgactcagaggaaaagacctactcagaaaaggctactgacaatcatgtgaaccacagctcgtgccctgaaccagtgcctaatggcgttaagaaagtcagtgtcagaacggcctgggagaagaacaagtcagtatcttatgaacaatgcaaacccgtctcggttacaccacaagggaacgactttgagtacacagcaaaaattcgaaccctggcagagacagagcgttttttcgacgagttgactaaggagaaggatcagattgaagccgcactgtctagaatgccctcccccggtggcaggatcactcttcagacgaggctgaatcaagaggccctcgaggatagacttgagcgtataaaccgggagctggggagcgtgcggatgaccttgaaaaaattccacgttcttcgtacatctgccaatctgtag

SEQ ID NO: 231094 - DNA, 1167 bp, Artificial Sequence
  Description of Artificial Sequence: Synthetic coding sequence
atggagccctcccctgccgcaggtgggctggaaactacacgtcttgtgtcaccacgggaccggggaggagcaggtggctctctgaggctgaagtccctgttcaccgagcccagcgagcctctccctgaggaatctaaaccagtggagatgccgttccaccattgccacagggacccacttcccccaccaggcctgaccccagagcggctgcatgccagacgtcaactatatgccgcttgtgctgtctgttttgtattcatggccggagaagtagtagggggatacctggctcattcactcgccatcatgacagatgcggctcacctgctggccgacgtcggttcaatgatgggaagcctattctctctctggctttccacacggccagcgacacgcacaatgactttcggctggcatcggagcgaaacattgggggcacttgccagcgttgtgtcactgtggatggtgaccggcatactgctgtatttggccttcgtgcgcctccttcattctgattaccacattgaagggggagcaatgctgttgaccgctagtattgccgtctgcgccaaccttctcatggcgtttgtgctgcatcaggctggtccgccacactcccatggctccaggggcgcagaatatgcccctctcgaggaaggacccgaagagcccctccccctcggcaacacatccgtgagggctgctttcgtgcacgtcctgggcgacctccttcagtctttcggtgtattggccgcaagcatcctgatatatttcaagcctcagtacaaagcggcagatcccataagcacttttctgttttctatctgtgcgctgggcagcaccgcgcctactctccgcgatgtcctgaggattctgatggagggtaccccacgcaatgtcggtttcgaacccgtgagagacactctgcttagtgtgcccggtgtgagggccactcacgaattacacctgtgggcactgactcttacgtatcacgtggcctcagcacaccttgcaattgactcaacggcagaccccgaggcagtcctggcagaggcatcgtcccgtctctatagtaggttcggcttcagttcctgtaccttacaggtggaacagtatcaacctgagatggcacaatgcttaaggtgtcaggaaccccctcaagcctag

SEQ ID NO: 231095 - DNA, 363 bp, Artificial Sequence
  Description of Artificial Sequence: Synthetic coding sequence
atgtgccacctgtacgaaggacctgtagttggaggctggtataaagtgctggatagatttatccctgggacgaccaaggtggacgcactcaagaaaatgctactggaccaaggtggcttcgccccatgctttctgggctgtttcctgccattagtcggggctctgaacggactgtctgctcaggacaactgggctaagctccagcgcgactacccggatgctctgattacgaattattacctgtggccagcggtccaactagcaaatttttacctggtgcccctacactaccgactcgccgtggtccagtgtgtggccgtgatctggaatagttacttgtcatggaaagcacacagactgtag

SEQ ID NO: 231096 - DNA, 531 bp, Artificial Sequence
  Description of Artificial Sequence: Synthetic coding sequence
atggccttgtggagggcataccaacgcgcactggcagctcacccctggaaagtgcaggttcttactgcgggaagcttaatgggcctgggcgacatcatctcacagcaactagtcgagcgacggggtttacaggagcaccaacggggacgcacactgacaatggtctctctcggctgtgggtttgtaggacccgtcgtcggaggatggtacaaggtgctggaccgcttcatcccgggtacaaccaaggtggatgctctgaagaagatgctgctagatcaagggggattcgcaccctgttttctcggctgtttcctgcctctggtgggggctctaaacgggctcagcgcgcaagataactgggctaagctacaacgagattatcccgatgcacttatcacaaattactatctctggcctgccgtgcagctggcaaatttttaccttgtccccctgcattatcggctggcagtcgtgcaatgcgtcgccgtgatttggaactcttacctcagttggaaagcccatcgcttgtag

SEQ ID NO: 231097 - DNA, 513 bp, Artificial Sequence
  Description of Artificial Sequence: Synthetic coding sequence
atggctctgtggcgggcttatcagcgggcactagcagcccatccttggaaggtgcaggttttgaccgctgggtccctgatgggccttggcgacattatttctcaacagttagttgagcggaggggcctgcaggagcaccagagaggacggaccctgacgatggtttcccttggatgcggctttgtggggccagtagtagggggatggtacaaggtactggacaggttcataccgggtaccaccaaggtggacgcactgaagaagatgttactggatcagggcggatttgccccttgctttctcgggtgcttcttacctctggtgggcgcactgaatggcctgtccgcacaggacaattgggctaagttacaaagagactaccccgacgcattgatcacaaattattatgtggggagatgcccaatgtgttgctgttacctagaactgctgccagtcctggagggcacatctgcactgagtttgccacacagcatagtttcaacgttacagtag

SEQ ID NO: 231098 - DNA, 342 bp, Artificial Sequence
  Description of Artificial Sequence: Synthetic coding sequence
atggcactttggagggcctatcaacgtgcattggcggcacatccatggaaggtgcaggtgttgacagcaggatccctgatgggcctaggagacattattagtcagcagctggtagagagacgcggactgcaggagcatcagaggggcaggacattgacaatggttagcctgggctgtggctttgtggactatcccgatgcattaattaccaactactacttatggccggcagtacagctcgcaaatttttacttagtcccgcttcactacaggctggctgttgttcagtgcgtggcagtaatttggaacagctacctttcttggaaggctcaccgcctctag

SEQ ID NO: 231099 - DNA, 576 bp, Artificial Sequence
  Description of Artificial Sequence: Synthetic coding sequence
atggcgctctggcgcgcttatcagagagctttggctgcccatccatggaaagttcaggtcttaactgccgctcatcccaggaggtgcccagacaacacgtgtgtgccctgtatcggatcgctaatgggcctcggagacatcatctcgcagcagctggtggagagacgcggattacaggaacatcagagagggaggaccctgacaatggtgtctctcggatgtggattcgtgggccctgtggtggggggatggtacaaggtgctggataggttcatccctggcacaaccaaggtggatgctctcaaaaagatgttgttagaccaggggggtttcgctccatgctttctcggatgctttctccctttagtgggggcactgaatggactgtctgctcaggacaactgggctaaactgcagagagactatcctgatgccctgatcacaaactactatctctggccagccgtgcaacttgctaatttttacctggtgcccctgcattacaggttagccgtggtgcagtgcgtggctgtaatctggaatagctatctgagttggaaggctcacaggctgtag

SEQ ID NO: 231100 - DNA, 348 bp, Artificial Sequence
  Description of Artificial Sequence: Synthetic coding sequence
atgggactcggggacataatcagtcaacaacttgtcgaacgacggggactgcaagagcatcagagggggaggacccttactatggtgtcactgggatgcggatttgtcggacccgtggttggaggctggtataaggtgttggatagattcatccctggcaccactaaagtggacgctttaaagaaaatgttgctggaccagggaggcttcgctccctgttttttgggatgctttctaccattggtcggagccctaaatgggctgagcgcccaagataactgggccaagctgcagagggactatcctgatgccctgattacaaattattacctgtggcccgctgtgtag

SEQ ID NO: 231101 - DNA, 366 bp, Artificial Sequence
  Description of Artificial Sequence: Synthetic coding sequence
tgaagtttgatggggctgggagacattattagccagcagctggtcgaaagacgagggctccaggaacaccaaaggggtaggactctcacaatggtgagtctgggctgtgggttcgtggggccagtagtgggagggtggtacaaggtgcttgatcgatttatcccaggcactacaaaagtcgatgctctgaaaaaaatgctcctggaccaggactatcccgatgcgctaataactaactattatctgtggccggctgtccaattagctaacttttatctggtgcctcttcattaccgtctggctgtagtgcagtgtgtggccgtcatctggaattcttacctctcgtggaaagctcatagactatag

SEQ ID NO: 231102 - DNA, 204 bp, Artificial Sequence
  Description of Artificial Sequence: Synthetic coding sequence
taggattcccagggtaaaaagactggctttactggcatcaagaaaggagactatccagatgcactgataactaactattacctgtggcctgctgtccagctggccaatttctatctcgtcccccttcattatcgtttagctgtggtacagtgcgttgcagttatttggaattcttacctcagctggaaggcacatcgactctag

SEQ ID NO: 231103 - DNA, 912 bp, Artificial Sequence
  Description of Artificial Sequence: Synthetic coding sequence
atggccccagccgcagatatgacatcccttccgctcggcgtgaaggtggaggatagtgctttcggcaaacccgcagggggaggcgcagggcaggcaccttccgctgcagccgctacagccgcagctatgggggctgatgaggaaggggctaagcctaaggttagtccctcactacttcccttctctgttgaagccctgatggccgatcacagaaagcctggtgctaaagagtccgctttggccccatctgaaggcgtgcaggcagctgggggtagcgcccagccgctgggagtgccaccaggcagcctcggcgctcccgacgcgccaagctcacccagacctcttggccacttctctgtcggaggattactgaaactgcctgaagacgctctcgttaaggctgagagcccagaaaagccagagagaacaccctggatgcagagtccccgattctccccgcctccagccagaagactgtctcctcctgcgtgcacactcaggaaacacaaaacaaatcgtaagcctcgaaccccattcacaaccgcgcagttgctggccttggaacgcaaattccgtcagaaacaatacctctccattgcagagcgtgccgagttttcctcctccctgtcccttactgagacacaagtgaaaatatggtttcagaatcggagagccaaggcaaagaggctccaagaggcggaactggaaaagctgaagatggccgctaagcctatgttaccgcctgcagcctttggtctcagcttcccattgggtggccctgcagccgtggccgcagccgctggcgcaagtctatacggggcttcggggcctttccaaagagcggcactcccagtggcgcctgtgggcttgtacactgcccacgtgggatacagcatgtatcacttaacatag

SEQ ID NO: 231104 - DNA, 804 bp, Artificial Sequence
  Description of Artificial Sequence: Synthetic coding sequence
atggccagtcctagcaaaggtaacgacctgttttccccggacgaggaaggaccagcagttgtcgctggacctggaccgggtcccggaggtgctgaaggggctgccgaggaaagaagagttaaggtatcgagcctgcctttttcagtggaagccctgatgtccgacaaaaagccacctaaagaagcctcgcctctgcccgcagaaagcgcctcagccggagctacactgagacctctgttactcagcggccacggcgcaagggaagcacacagtcccggacctctggtgaagcccttcgagactgcaagcgtgaaaagtgaaaatagtgaagatggtgctgcgtggatgcaggaacctggcagatattcccctcctccgaggcacatgtctcctaccacctgtacgctccgcaagcacaagacgaatcgaaaacctcgcaccccattcacaacgtctcagctcctggcactggaaagaaaattccggcagaaacagtatctgagcattgctgagcgggctgaattttccagctcattgaatctcaccgagactcaggtgaagatatggttccagaaccggagggcaaaggcaaagcggcttcaggaggctgagctcgagaaactcaaaatggccgcaaagcccatgctgccaagctcttttagcctcccctttcctatctcatcccctctgcaggccgcaagtatttatggagccagttaccctttccatcggccagtgctgcccatccctccagtggggctgtatgctacaccagtaggctacggtatgtaccatttgtcatag

SEQ ID NO: 231105 - DNA, 981 bp, Artificial Sequence
  Description of Artificial Sequence: Synthetic coding sequence
atgaacacctccccgggaacagtgggtagtgatcccgttatcttggccaccgccggttacgatcataccgtccggttctggcaggcgcacagcggcatctgtacacgcacagtgcagcaccaagattcccaagtgaatgcattggaggtcactcccgaccgatctatgattgcagccgctggctaccagcatatccgcatgtatgaccttaatagtaacaaccccaacccaataatctcctacgacggagtgaataagaatatcgcctcagttgggttccacgaggatgggagatggatgtatacaggtggcgaggactgtactgcacgcatctgggacctcagatctcggaatctgcagtgccagcgaatttttcaggtgaatgcccctatcaattgcgtgtgtctacatcccaatcaggctgagttaatcgtcggtgaccagtccggggcaattcatatttgggatctgaagactgaccacaatgaacaattgattccggagcccgaagtaagcattactagcgcccatattgacccggacgcatcttacatggctgctgtgaacagtaccggcaattgttacgtatggaatctgaccggaggaatcggggacgaggtaacccaactgatccctaagacgaagattcccgctcacactcgctacgccctgcagtgtcgcttcagccctgactctactctgttagctacatgctccgctgaccagacctgtaaaatttggaggacgagcaatttttccctgatgaccgagctgagcatcaaatccggaaaccctggcgaaagttcccgtgggtggatgtggggatgtgcctttagcggcgactcccagtacatagtcacagcaagcagcgacaacttggcacggttatggtgtgtggaaacaggggagattaaacgcgagtacggcggacaccagaaggccgtagtgtgtcttgctttcaacgacagtgtcttagggtag

SEQ ID NO: 231106 - DNA, 981 bp, Artificial Sequence
  Description of Artificial Sequence: Synthetic coding sequence
atgaatacctcgccaggcaccgtcggcagcgaccccgtgattctggcgacagctgggtacgaccacacagtacgcttctggcaggctcacagcggaatctgtactagaacagttcagcaccaggacagccaagtgaacgcgctggaagtgacaccagaccggagcatgattgcagctgctggttatcagcacatccggatgtacgacctcaacagcaacaaccctaacccaattatctcctatgacggcgtcaacaagaatattgccagcgttgggtttcacgaagacggcagatggatgtacaccggcggagaagattgtaccgcacggatatgggacctcagatcccggaacttgcagtgccagcggattttccaggttaatgcacctatcaactgcgtgtgtctccatccaaatcaggcagagctcattgttggggatcagagcggggcaattcacatttgggatttaaaaacagaccataatgaacaactgatccccgagccggaggtgagcattacaagtgcacacattgacccagatgcctcgtacatggccgctgtgaattcaacagggaattgttatgtatggaacttaaccggaggaataggagatgaggtgactcagctgattcctaagacaaagattcctgcccacacacggtatgctcttcagtgtcggttctccccggactctacgttattagctacatgtagtgctgaccagacttgcaagatctggagaacttctaatttcagtctcatgacagaactctccattaagagcgggaatcctggtgaaagtagccggggatggatgtggggctgtgcttttagcggagactcgcagtacattgttaccgcatcttccgacaacctggcccgactgtggtgcgtcgaaaccggcgagattaaaagggagtacggaggtcaccagaaggcggtggtctgtttggccttcaatgattccgttctcggttag

SEQ ID NO: 231107 - DNA, 984 bp, Artificial Sequence
  Description of Artificial Sequence: Synthetic coding sequence
atgaataccagcccaggaaccgtcggcagcgaccctgttatactcgctactgccggttatgatcacacagtacgattttggcaggcgcattctggcatatgcacccgtactgtacagcaccaggactcccaagtgaacgctctggaggtgacccctgaccggtcgatgattgccgcagctgggtatcagcacattcgaatgtatgatttaaacagcaataatccaaaccccatcatctcatatgacggggtgaacaagaacattgccagcgttgggttccacgaggacggccgttggatgtacactggcggtgaggattgcaccgccaggatctgggacctgcgctctcgcaacctgcaatgccagcggatattccaggtcaatgcccctatcaactgcgtatgcttacacccgaaccaggcagagctcatcgttggagaccagagcggagcaattcacatctgggacttgaagaccgaccacaatgagcagttaataccagagccggaagtcagcatcacatcagctcatatcgaccctgatgctagctacatggccgcagttaactctaccgggaactgttacgtgtggaacctgacgggcggaatcggagacgaagtgactcagctgatccctaagacaaaaatacccgcacacacccgttacgccctccagtgtcggtttagccctgacagtaccctcctggccacttgttctgccgaccagacatgtaaaatctggagaacaagcaacttttcccttatgacagagttgtctatcaagagtggcaatcccggagagtccagtagaggttggatgtggggctgtgcattctccggagatagccaatatatcgtcactggcgaaccccgtccaggcctgccccatccgtggccacccgctttggcatctagggcttctcctccaaggctgcaactcccgctctgttgggggaggctcctaggactccacctgcgcagttag

SEQ ID NO: 231108 - DNA, 654 bp, Artificial Sequence
  Description of Artificial Sequence: Synthetic coding sequence
atggaacacgcgccttggtcccctggggcaagttctagggctcgagctggccatactatgaatactagtccagggactgtaggcagcgatcctgtgatcttggctactgctggctatgaccacaccgtcaggttttggcaggcacactccgggatctgcacccgcaccgtacagcatcaagattcccaagttaacgccctggaagtgactcccgacaggtccatgatcgcggctgcgggttaccagcacattagaatgtatgaccttaatagcaacaacccgaaccccatcatctcttacgacggggtgaataagaacatcgcaagcgtgggcttccatgaggatggaaggtggatgtacactggaggtgaagattgcacagcgaggatttgggacctacgcagtcggaacctgcagtgccagaggatttttcaggtgaacgcgcctattaattgtgtctgcctgcaccctaaccaagccgaactgattgtaggcgaccagagtggagccattcacatatgggacctaaagactgaccataacgaacagctgattccggagccagaagtgtccattacgtccgctcatatcgaccctgacgcctcttatatggctgccgtgaactcaaccgccccacgacatctgctggggtag

SEQ ID NO: 231109 - DNA, 981 bp, Artificial Sequence
  Description of Artificial Sequence: Synthetic coding sequence
atgaacacgtccccaggaacagtagggtcggaccccgttattctcgctaccgcgggttatgatcacacggttcggttttggcaggctcacagtgggatctgcacaaggaccgtccaacaccaggatagccaggtgaatgcgctggaggtgacccccgaccggtccatgattgctgcagccggttaccagcatattcgcatgtacgacctgaatagtaacaaccctaatccaatcatttcttacgacggcgtcaacaagaacattgcctcagttggctttcatgaggacggacggtggatgtacacgggcggagaggattgtactgccaggatttgggatctccgatcccgaaaccttcaatgtcagcgcatttttcaggtgaacgcgcctatcaactgcgtgtgtctccaccccaatcaggccgaactcatagtcggtgatcaatccggcgcaatccacatctgggatctcaaaactgatcacaacgaacagctgatcccagaacccgaagtaagcatcacatcagcacacatcgatccagatgccagctacatggccgcagtcaacagcaccggtaattgttatgtgtggaacctgacaggcggtattggagacgaagttactcagctcatcccaaaaacaaaaataccggcacatactcgatacgccctccaatgtcgtttcagccccgactctacccttctagccacctgtagtgccgatcagacgtgcaagatatggcggactagcaatttctctctgatgactgaactatcaattaagtctgggaaccctggcgagtctagccgcggttggatgtgggggtgtgccttcagcggcgattcgcagtatattgtgacagcctcatcagacaacctagcaaggttgtggtgcgtagagaccggcgaaatcaagcgcgaatacgggggtcaccagaaagccgtggtttgcttggcattcaatgactcggttctcgggtag

SEQ ID NO: 231110 - DNA, 981 bp, Artificial Sequence
  Description of Artificial Sequence: Synthetic coding sequence
atgaacactagtccgggaacagtgggtagtgatcctgtcattctggcgaccgccggatacgaccacactgtacggttttggcaggcccacagtggaatttgcaccagaacggttcaacatcaggattcccaggtaaacgcactggaggtcacccctgatcggtcaatgattgcagccgcagggtaccaacacatccggatgtacgacctgaatagtaataatcccaatccaatcattagctacgatggggtcaataagaatattgcttcggtgggctttcatgaggacggcagatggatgtacacaggaggcgaagactgcaccgcccgaatctgggacctccgctctcggaatctgcagtgccagcgcattttccaagtgaacgcacctatcaactgcgtttgtttacaccccaaccaggccgagttgatagtgggggatcaaagcggcgcaatccacatttgggacctgaagaccgaccacaatgagcagctcatacctgagcccgaagtttcaataacgtcagcccatatcgatcccgatgcatcctatatggcagctgttaacagtaccggaaactgctacgtgtggaatctgactgggggtattggcgacgaggtgactcagctcattcccaagaccaaaattcccgctcatactcggtacgccctgcagtgccggttctctcccgactcaactttgctcgccacctgtagtgctgatcagacttgtaaaatatggagaaccagcaactttagtctgatgactgagctgtcaattaagtccgggaatcccggagagagctctcgaggctggatgtgggggtgcgcattcagtggagatagccagtacatcgtgacggcgtcaagcgacaacctggcacgcctgtggtgtgtagagaccggagaaatcaaaagagagtacggaggacaccagaaggcagtggtgtgcttggcctttaatgactctgtgctcgggtag

SEQ ID NO: 231111 - DNA, 1473 bp, Artificial Sequence
  Description of Artificial Sequence: Synthetic coding sequence
atggctcagagggcggtctggttaatttcacacgagccaggcactccgctgtgtggaactgtgcggttcagccgacgctatccaacagtcgagaagcgggctagagttttcaatggcgcatcttatgtgccggtaccagaggacggacccttcctgaaggcattacttttcgaactgagattgctagacgacgataaagacttcgtcgaaagtcgggactcatgttcaaggatcaacaaaacctccatttatggactcttgataggaggcgaagagctctggcccgtggtggcttttctgaaaaacgatatgatctatgcctgtgtgcctctggtagagcagaccctgagcccacggcctccgctgatttcagtctccggcgtttctcagggcttcgagttcttgtttggcatacaggattttctgtactccggtcagaagaatgattcagagctgaataccaaattatctcaactgccagatttgctacttcaggcttgtcctttcggtaccctgctggatgcaaacctgcagaactcactggacaataccaacttcgcctccgttacacagccacagaagcagcctgcttggaagacggggacttacaagggaaaaccacaggtctccatcagcattaccgagaaagtgaagtcaatgcaatacgataagcagggtatagccgacacttggcaggtggtcggcacggtgacatgtaaatgcgacttagagggcatcatgcccaatgttacaattagtttgtctctcccaacaaatgggtcacctctgcaggacattctcgtacacccttgtgttacgtcgctggatagcgccatcctaacatcctcctccattgatgcaatggatgactctgccttcagtgggccttacaagtttccctttacccctcctctcgaaagcttcaatctgtgtttctacactagtcaggtgccggtcccgccaattttagggttctaccagatgaaagaagaggaagtgcagctgagaattaccatcaacctcaagctgcatgaaagcgtgaagaacaactttgaattctgcgaagctcatattccattttacaaccgagggccaattacccatctggagtacaaaacgtcctttggtcagcttgaagtgtttcgcgagaagtccctgctgatttggattatcggccagaagtttccaaagagcatggaaatttctctgagcggtaccgtgacgttcggtgccaaatcacacgaaaaacaaccattcgatcctatctgtaccggggaaaccgcttatttgaaactgcacttcaggatcctggattataccctgacaggttgctatgctgatcagcatagtgtgcaggtcttcgccagcggcaagcccaagattagcgcccatcgaaaactcatatcctccgattattacatctggaatagcaaggctccggctccggttacttacgggtcattacttctatag

SEQ ID NO: 231112 - DNA, 16437 bp, Artificial Sequence
  Description of Artificial Sequence: Synthetic coding sequence
atgttagtcatttggattttgacactggcattaagactctgtgctagcgtgacaactgttacaccagaaggatccgctgtccacaaggcgatttctcaacagggaacactgtggacaggggaggtgctcgaaaaacaaaccgtggagcaaggtaaaagcacactgaggagacagaagaaccactttcatcgatccgctggtgaactgcgctgcagaaatgcattgaaggacgaaggggcttcagcaggttggtctgttatgtttgcaggcgagtccgtggtggttctggtccatctatggatgacgggcgctagagtcaagaacctcggactcgtcgagttcgctagtccaggagatgatggagacggccgagccgaggggttttctctgggcctccccttgagcgagcaggcacgggcagccggtgccagagagaaggaaagacaagagaccgtgatcaatcatagtaccttcagtgggttctcccaaatcacaggttctaccgtgaacacatccatcgggggtaacacaacatctgccagcacaccttcctcctcagatcccttcactaccttctctgactatggggtgtcagtgactttcataaccgggagcaccgcaactaaacactttctcgattctagcaccaactccgggcattccgaagagtccacagtttcccactcaggacctggagctactgggactaccctgttcccgagccactccgccacctcagtttttgtcggagagccaaaaacatccccaatcacctccgcctcaatggagaccaccgcactccctggttcaacaactacagccggactgagcgaaaaaagcactactttttatagttctccccgttcccccgatcgcaccctgagccccgcacgaacgaccagttccggcgtctcagaaaagagtaccacctctcacagcaggcctggcccaacgcataccatcgcctttcccgattcaaccaccatgccaggcgtgtcacaggaaagtaccgccagccacagcataccaggttccacagataccacgttaagtccaggaacaaccactccctcctccctgggccctgaatcaacaactttccactcgtcccccggatacacgaagactacgcgactcccggataacacgaccacgagcggactgttggaagctagcacacctgtccatagtagcactggcagcccacacaccacactctctcctagctccagcactactcatgaaggcgagcccaccactttccaaagttggccgagctccaaggatacgtcacctgcaccatcagggactactagcgcattcgtgaaactgtcaaccacttaccactcgtctccgtcatcgactcctactacgcatttttcggcatcctccaccactttaggacactcagaggagtcaacccccgtgcattcttcacctgtcgccacagccaccacccctccccctgctcgaagtgcaacctctgggcacgtggaggagagcaccgcttaccacagatctccgggaagtacccagaccatgcatttccctgagtctagcaccacaagcggtcactccgaggaatccgctacctttcacggaagcacaacccataccaaatcctccacccccagcacaacagccgcactggcccacacaagctaccacagctcactgggcagcactgaaacaacccactttcgggattcctccactatttctggcagaagcgaggagagcaaagcatcacattcatctccagacgcgatggccaccacggtccttccagccggtagcactccttccgtactggtgggggatagcacaccatcacccatttcatctggctccatggaaaccacggcgttacctggatcaactaccaagcctggcctcagtgagaagagcaccacattttattcctctcccagatcacccgacaccacccatcttcctgcttctatgacttcctcaggggtctctgaggaaagcacaacctcccattccagaccaggtagcacccacaccacagctttccctggtagcacgaccatgcccggactgtcccaggagagcacagcaagccacagtagccctggtccaaccgacacaaccttatcccctgggtctaccactgcatcatcactcgggcctgaatacactactttccacagtcggcctggaagcacagaaacaaccctgttgccagataacaccactgcgagcggcctgctggaagcttctatgccggtacactccagtaccagaagccctcacaccactctgtcccccgctggctctaccactcgccaaggggagtctacaaccttccactcatggcctagctcaaaggacacgcgcccagcaccgcctactaccactagcgcctttgtggagccctctacaacctcgcatggctccccttctagtatccccactacacatatctcagccaggtcaacaacgagcgggctggttgaggaatccactacatatcattcttcccctgggtctacccagaccatgcacttccccgagtctgacactacctcaggacgcggagaggaatccaccacaagccacagttcaacgacgcatacaatatcatctgctccgtcgacaacctctgcccttgtcgaagagccaacatcataccacagctccccaggatcaaccgctaccacccatttcccagattcaagcactaccagcggaaggtctgaggaatctactgctagccatagcagccaggatgctaccggaaccattgtgttgcctgcacgaagcacgacatcagtcttgctaggagagagtaccacttccccaatctcctccggctcaatggaaaccaccgcccttccaggctccactaccacaccgggactgtccgagcgctccactaccttccactcttctccaaggagccctgccacgaccctgtcgcctgcctccaccacatctagcggggttagtgaggaaagcaccacatctcgctcccggcctggaagtacacatactactgcgtttccggatagcaccactacgccaggtctgtctcgacattccacgacttcacactccagccctgggtccacagatactactctgctcccggcttccaccacaaccagcggtccgagccaggagtcaactactagccatagttcctccggttccactgatacggcgctttcccccggtagcacgaccgccttgtcctttggacaagagagtactacatttcattctaatcctggtagcacccataccaccctcttccccgatagcaccactagttctgggattgtggaagcctcaaccagggtccatagtagcaccggatctcccagaaccactttaagtccagcgtcttcaacctcccctggtcttcagggcgaatccacggcattccagacccatcctgctagtacacatactactccaagcccccctagtaccgcaactgcgcctgtagaggaatccacaacctaccacagatcacccggatcaacacctacaacccactttccggctagctccacaacttctggtcactcggagaaatcaactatttttcattcctctcccgatgcctccggaaccactcccagcagtgcgcactccacaacctcaggaaggggcgaatccaccacctctcggatttctcccggaagcacggagatcacaaccctcccaggatctacaaccactcctggcttgtccgaggcatctacgacgttctactcttcaccacgcagtccaacgactactctcagtcccgcatctatgacctccctcggcgttggggaggaaagcaccacgtcccggagccaacccggttcaacccactccaccgtctccccggcttcaacgactactcccggactgtccgaggaaagcaccaccgtatactcatcaagcagaggcagcaccgagacgacagtcttcccacatagtacaacaaccagtgtgcacggggaggagcctacaacattccattctcgcccagcaagcacccatactacactgttcaccgaagacagtacaacatctggtctcaccgaagaatccacagccttccctggctcccctgctagtacacagaccgggttgcccgcaactctgacgactgctgatcttggagaggaaagcacaacttttcccagctcgtctggatccaccgggacaaagctcagccccgctcggtctaccacttctggcctggtgggcgagagcacacctagcaggctcagtccctccagcaccgagaccacaaccctgccaggtagcccaacaaccccctccctaagtgaaaaatcaactactttctacacttcacctcgctcacccgatgccacgctctcacccgctacaacaaccagttccggggtgtcagaagagtctagcaccagtcactctcagcctgggagtacacataccactgctttcccggattctaccactactagtgatctgagtcaggaacctaccacatcgcatagttcgcaaggcagcaccgaagcaacactatccccaggctccaccacagccagcagcttaggtcagcagagcaccacttttcacagctctccaggagataccgagactactctgctgcccgacgacacaatcacctcgggactcgttgaggccagtacaccgacacacagctctacaggctctctgcacaccacgctcacacctgcttccagcactagtgccggactgcaggaagaatcaacaactttccagagttggccaagctcttccgacacaactcccagtcctcccggaacaacagccgctcctgtggaggtttccactacctaccactcccgcccttcttccacccccacgacacacttttcagccagcagtaccactctgggcaggtccgaggagtctacaaccgtgcattcttcccccggagcaactggcacagccctgtttccgacccgctctgccactagcgttcttgtgggcgagcctactacaagtcccatatcttctggtagcacagagacaactgcactgcctggatcaactaccacagccggactttctgaaaaaagcaccaccttctactcatctcctcgatcccccgacactactctgagccccgctagtacgacaagcagcggggtgtctgaggagtcaacaacatctcattctaggccgggttctacccacaccacagccttccccggatctacaaccatgcccggtgtgtctcaggagtctacagcctcccacagtagccccggtagtaccgacacaactttatccccagggtcgaccacagcttccagtctcggtcctgagtccaccaccttccattcatctcctgggagtaccgagacaacgttactgccagacaatacaactgcgtctggactcttggaggcctctacacctgttcactcttcaaccggctcaccacacacaacgttgtctccagccggttccacgacccgccaaggcgagtcgacgacctttcaatcttggccgagctctaaggataccatgccagctccgcctacaaccaccagcgcatttgtagaactctctacaacaagtcatggatcccctagctccacgcctaccactcacttttccgcttcatctacaaccctgggcagatctgaggaatctactaccgtccactcatctccggtcgccacagccaccacacccagccccgctagaagtaccacatcaggactcgttgaggaatccacggcctatcactcaagtcccggatcaacgcagactatgcacttccccgagagcagcacggctagcggcagatcagaggagtccagaacctcccactcctcaacgacacacaccatttccagcccaccatcaactaccagcgccctcgtggaggaaccaaccagttaccattcctcgccgggaagcacagccaccacccacttccctgactccagcacgacctccggacgaagtgaggagagcacggcttctcactcaagccaggacgctacgggcaccatcgtgctgcccgctcggagcaccactagcgttttgctgggggagagcactaccagccccatctcgagtggaagtatggaaacaacagcgcttcccggatctaccacgacccctggcttatcagagaagtccactacctttcactcaagccctagatctccagctaccacattgagccccgcaagcaccacttcctccggcgtgtcagaagagtcaacaacgtcacattctcgcccaggctcaactcacactaccgcatttcccgattcaacgactacaccaggactgtctcgacatagtaccacatcacactcttcacctggaagcaccgacaccaccttgctcccggcatctaccacgactagtggccctagtcaagaaagcaccacttcccactcatcacccggttctactgatactgccctgtctcctggcagtacaactgcgttgtcgtttggacaagagtccaccacgtttcattctagccctggatctactcacactacactgtttccagactctaccacatcctcgggcatcgttgaggcctcaacgagagtccatagcagtaccggttctcctcggaccacgctgtccccggctagtagcacttctcctggattgcagggggaaagcaccgccttccagactcaccctgcatccacccacacgactccaagcccgcctagcactgctactgctccagtggaagaaagcacaacgtaccatagaagcccaggtagtactcccactacccattttcccgctagttcaacgacctcaggtcacagcgagaagtccactatcttccattcatctcccgatgcgtccgggacaacccccagctctgcacacagcacaacctcaggaagaggcgagagcactacatctagaatcagccctggaagcacggagatcactaccctgccaggatctacaaccacacccggactgagtgaagccagcaccacattctattcctcgcctcggagcccgaccaccactctgtctccggcatctatgacgtcgctgggagtgggagaggaatcaacgacttcaaggtctcaaccagggtccacacattcgacagtatccccagctagcactacaaccccgggactatccgaggaaagtaccacggtctattcaagcagtcctgggtcaacagagacgacggtttttcccaggacccccaccaccagcgtgcgtggtgaggagcctaccaccttccacagtcggccagccagtacccacacgacactctttacagaggattccactacctcagggctgacagaggagagtacagcgttccccggatcgcccgcatccacccagacagggcttccagctaccctcacaacggccgacctgggcgaagaaagtaccaccttcccatcctcgtccggcagcaccggcacaacactcagcccagcccgtagcacaacctctgggctggtaggcgaatccacccctagtagattatctcccagtagtacggagacaacgaccctccccggatcacctaccacccccagcctgtcagaaaagtccacaacattctacaccagcccacggtcgcccgacgccactttgagccccgctactaccacgtcgagtggcgtttcagaagaatcttctacatcccattcccagcccggatcaacccataccaccgcatttcctgattcaaccacgacccccggtctgagtaggcactcgaccacctcacatagttctccaggttcgacagataccacactgcttccggctagcacgactacgtcaggaccatcacaggagtccacgacttcccattcctcccccggaagcactgacaccgcgctgagtccaggttctaccaccgctctgtccttcgggcaggagtctactaccttccacagttcaccgggatcaactcatacaactttatttcctgacagtacaactagctctggtatcgtagaagcctctacgcgcgtgcatagctccacagggagtcctcgtactacactgagcccagctagttccactagccctggattacagggcgagagtacgacttttcaaacccatccggcaagcacacacacaacaccgtctccacctagtaccgcaacagcacccgtggaagagtcaacgacctatcaccgaagccctggcagcactccaaccacacatttccctgcgtcatccactacaagcggacattccgagaaaagtactatttttcattccagccctgatgccagtggaaccactccatccagcgcccacagcaccacaagcggcaggggtgaaagcacaacatcccgcatttcacctgggtctacagagataaccacattaccaggtagtacaaccacgcccggactcagtgaggcttccacgacattctatagttctccacgaagccctacaaccactctatcccccgctagcatgacgtccctgggcgtcggagaagagtccaccacatccaggagtcaacccggaagcacccactctaccgtctctccggcttcaaccaccacacccggtctcagcgaggagagtaccacagtctatagtagctcacctggctctacagagactactgtgtttcctagatcgactactacttctgtgcggggtgaggagcctacaacgtttcactctaggccggcaagcactcacactacactgtttactgaggactccactaccagcggactcacagaagaatccaccgctttccctgggagcccagcttcgacccagactggtctacctgcgaccctgacaacggctgaccttggcgaggagtccacaacattcccctcgtcctctggatctacaggcaccactctgagtcccgcacggagcactacttctggcctcgtgggagagtcaacaccctctcggctgagcccgtcgagtaccgagactactacacttcccggtagccctactacaccaagtttaagcgagaagtccacgaccttctacacaagccccagaagtccggacgctacattgtcccctgctactaccacaagttctggagtgagcgaagagtcctcgacaagccattctcagccagggagcacgcatacgacagcctttccggatagtacaacaactagcgggctatcccaggagccgactgccagccacagctcacaagggagcacagaagcaaccctatctccagggtcaacaaccgctagctcattgggacagcaatctactaccttccacagctcacccggtgataccgaaacaaccttattgccagacgacacaatcacgtctggccttgtcgaggcatcaactccaacacacagttctaccggaagccttcacacaactctgactcctgcctccagcacctcggctgggcttcaggaggagagtacaacattccaatcctggccttcctcttccgacacgacaccttctccaccaggaacaacagccgcacctgtggaggtgtccaccacctaccattctagaccaagttcaactcccacaacgcatttcagcgctagttcaaccacgctcgggagatccgaggagagtactaccgtgcatagcagtcccggtgcaaccggcacagcactcttccctactcggtccgccacatctgtcctcgtgggcgagccaaccaccagcccgatctccagtgggagtacagaaaccacagcactgccgggttccaccacaaccgctggactatccgagaagtccactacgttctattccagtcctaggagcccagacacgacgctgtctcccgcttcaacaacatcctcaggagtgagtgaggagagcactacatcccattccagacccggttcaacccacactacagcgtttcccggatcaacaaccatgcccggagtctctcaggagtccactgcaagtcattcatcccccggatcaactgacacgactctgtccccaggaagtaccaccgcctcttctctggggccagagtccactaccttccacagtggtcccggatccaccgagaccaccctcttaccagataacaccacagcttccggtcttctcgaggcctccactcccgtacacagctctacaggcagcccgcacacaacccttagccctgcagggagcacaacccggcagggagagtcaactacgtttcaatcgtggcccaactcaaaagatacaacaccggctccccctactaccacatccgcctttgtggagctgtcaaccacttctcacggaagtccgtcatctacaccgactactcacttctcagctagcagtaccactctgggacgcagtgaggaatccacaacggtgcactcaagtcccgtcgccaccgcaaccacgccatccccggctcgctcaacaacatctgggcttgttgaggagtccactacataccatagcagccccggatctacacagactatgcactttcccgagtcagacacaacatccggtagaggggaggagtctactactagccactctagcacaactcacacaatttcgagtgcgccaagtactacgagtgctctcgtggaagaaccaacctcctaccattctagccctggatctaccgccactacccattttcctgattccagcaccacttcgggtcggagcgaagaatccaccgcgtctcattcatcgcaggacgccaccggaaccatcgttttgccggcacgatcaacaacgtccgtgttgctgggcgagtctaccacctctccgatctcttcaggctctatggaaactacagcactgccaggctctacaaccaccccgggactgagtgaaaagtccaccactttccacagttcccccaggtcccccgctaccacactctcccctgccagtaccacttcctcaggggtctccgaagaatccactactagccacagtcgtcccggaagcactcacacaacagcctttcccgattctacgacgacacccggtctctccaggcatagtaccaccagtcatagtagccctggaagcacagatactacattgctgcctgcatcgactaccacctctggctcatctcaggagagcacaactagccactcctcatcaggcagcaccgatacagcactgagcccaggttcgaccacagccctaagtttcggccaagagtcaaccactttccatagctcacctggctcaacacatactaccttatttcccgactccactacttccagcgggattgttgaggcttccactcgggtgcacagctccaccggatcaccacgcaccactttgtcgcctgcttccagcacatcacccggactgcagggagaatccacggccttccagacgcacccagcctcgacccataccaccccttcacctccctccacggccaccgccccagttgaggaatctacgacatatcaccggtctcccggttcgacacccaccacccatttcccagccagcagcaccacctcgggacactccgaaaaatctacaatcttccacagctctccagacgcctcaggcaccacgccatcatccgcacattctaccacgagtggacgaggagaaagtaccacatcccggattagcccgggaagtactgaaatcactacactgcctggctccactactaccccaggacttagtgaggcttcaactaccttttatagttcgccaagaagtcccaccaccactctgagcccagcttccatgacaagccttggtgtgggagaggagagtactacaagccgctcgcagccgggaagtacccatagcacggtatcccctgcatctacaactacgcctggacttagcgaagaaagcaccactgtgtactcttcatctccgggaagcactgagaccactgtcttccccaggagcacaaccacttccgtgcggagggaggagcccaccacgttccattcacgccctgcttccacgcatacaacactctttaccgaagacagcaccacatccggtcttacagaggagagtaccgcttttcctgggtctccagcttccacccaaactggcctgccagctacattaacaaccgccgacttgggcgaagagagcaccaccttcccctcttcttcaggatctacagggaccaagctgtcacctgctcgcagcacaacaagcggactcgtcggtgaaagtacaccaagtcgcctgtcccccagctctaccgaaaccacaacactcccaggatctcctactactccttcccttagcgagaagagcacaactttctacacgagtccgaggagccccgacgcgacactcagccccgctacaaccacatcttccggagtgagtgaggaaagcagcacctctcacagtcagccaggatccacccacacgactgcattcccggacagcacaactacgtctgggctttcccaggaacccactacatcccactcatctcaggggagtaccgaggccaccctgagtcctgggtccaccacagcgtcctctttggggcaacagtcaacaacattccatagcagtcccggtgataccgagacaaccctattaccggacgacaccattacaagcgggctggtggaggcttcgacccccacgcatagctcgactggatcgctccatacaacactaacacccgcatccagcacgagcacaggcttgcaggaagaaagcactacctttcagtcctggcctagctccagcgatacaactccctcccccccatctacaactgcagttccagttgaagtgtccaccacgtatcatagcaggccgtccagcactcctaccacccatttttctgcgtcatcaacgacgctgggtcgctccgaagagagcaccactgtgcattccagccctggagctaccggcaccgctctgttccccacaagatccgccacgagtgtactggttggggaacctacaacaagcccaatctcttccggctctaccgagactacagccctgcctggatcaacgaccaccgcaggactgtctgaaaaaagcaccacgttttacagctcccctagaagtccggacacgacactgagccctgctagcactactagctcgggcgtcagtgaagagtctactactagccacagccgtcccggttccatgcatactactgccttcccttcatctacaaccatgcctggcgtgagtcaagagtcaactgcctctcatagtagccccggttcaaccgatacaaccctgtctcctggcagcaccactgcttccagccttggaccagagtcgactactttccattcctcaccaggtagcactgaaactaccttgcttccagataataccacggctagcggactgttagaagcgtcgacacctgtgcacagcagtaccgggtcaccgcataccaccctgtcgcccgcaggctcaaccaccaggcagggagaaagtacaacctttcaatcttggcccaacagcaaagatacgacgccagctcctcccacaactacaagcgcttttgtggaactctccactacatcccacgggtctccatcaagtactccaacaacccatttttcagcgtcctctacaacacttggtcggtccgaggaatccactactgtgcattcctcacccgtggccaccgctactaccccttccccagctcggagtacaacctccgggcttgttgaggagtccactacctaccatagttccccaggcagtacacaaacaatgcattttccagaatcaaataccacatctggcagaggtgaggagagcaccacctcgcactcttctacaacacataccatcagctcagcaccctctaccaccagcgccctggtggaggagccaacaagttatcacagctcacccggatccacagcgactacgcacttcccagattcaagtacaaccagcgggcgaagtgaggaaagcaccgccagtcactcaagccaggacgctactggaacaatcgttttgccagctcggtctacgacctccgttctgctcggagagtcgacaacatctccgatctctagtggaagcatggagacaactgcgctgcctggctcgacaactacacctggactgtcagaaaagtccaccacctttcattcttcacccagttcaacacccaccacccacttcagtgctagtagcaccaccctggggaggagcgaggagtctaccacggtccattcaagtcctgtggctaccgctacgaccccatcccccgcacgcagcacaacttcagggctcgtcgaagagtcaacagcttatcactcaagccccggatcaactcaaaccatgcattttcccgagtccagcaccgcctctggcaggtcggaggagagtcgaaccagccattcttcaacaacccacactatatcctccccgccaagtacgactagtgcactggtagaggagcctacgtcctaccacagttccccgggttcgatcgccacgacccactttccagagagctctacgacttcgggcagatctgaagagagcactgcttctcacagctctcctgacactaacgggatcactcctctgcccgcacacttcactaccagcgggaggattgccgagtccaccacattctacatttctccaggtagtatggagaccacacttgcctcaaccgcaacaactcccggactatctgccaaaagcaccatcttatattcctcctcacgctctccggaccaaacactgtctcccgctagcatgaccagtagcagtatatcgggagagcctacctccctgtactcccaggccgaaagcactcatacaacagcttttccagcctctaccaccacgagtggcctgtcccaggagagtacaacattccactctaagccaggctccaccgagacaaccttgtctcctggctccattactacttctagtttcgcccaggaattcaccacaccccattctcagcctgggagcgcattatctaccgtgtcacctgcatccaccacggttccagggctctctgaggaatccaccacattctattctagccctggctctaccgaaacgactgcattcagtcacagcaacacgatgtccatccatagccagcagtccacccctttccctgattccccaggctttactcatacagtgctgcctgccactcttactaccactgacattggacaggaatcgaccgccttccactcaagctcggatgcaaccggcacaactccactcccagcgcgatctaccgcatccgacctggtgggagagccaacaactttttacatttctccatcacccacttatacgaccctgttccctgcatcttctagtacctcagggctgacagaggaatcgaccacctttcatacttcaccttccttcacttctactattgtcagcaccgagtcacttgagacgctggctcctgggctgtgtcaggaggggcagatttggaacggcaagcagtgtgtgtgcccccagggttacgtggggtaccagtgcttgtcccccctagagagctttcctgtggagaccccggagaagctcaatgctacccttggcatgaccgttaaggtgacctaccgcaatttcacggagaagatgaatgacgcctcctcccaggagtatcagaattttagcacgttgttcaagaatcgtatggacgttgtacttaagggtgacaacttacctcaataccgaggagtgaatatccgccgactccttaacggcagtatcgtggtgaagaatgacgtgatcctagaggccgactacactttggaatatgaggagctcttcgagaacctcgcagagatagttaaggcaaagataatgaatgagacgagaactaccctgctagatccagactcctgtcggaaagcgatcttatgctactccgaggaagatacattcgtggatagctccgtaacccccggattcgactttcaggagcagtgtacccagaaagcggctgagggctacacccagttttactacgtggacgtgctggatggaaaattggcgtgcgtcaataaatgcacgaaggggaccaagtcccagatgaattgtaacctgggaacgtgccagttacagaggagtgggcctaggtgcttgtgccctaatactaacacacactggtactggggcgaaacctgcgagtttaacattgccaagtcattggtttatggcatcgtcggcgcagtgatggcagttctactcctggcacttattatcttgatcatcctattttccctgtcccagcggaaaaggcaccgcgagcagtatgacgtgccacaagagtggaggaaagaggggacaccagggattttccagaagaccgccatttgggaggaccagaatttgagagagagtaggttcggactggaaaacgcgtataacaattttagaccgacgctggagacagtggactctgggacggagcttcatattcagcgccctgagatggtggcttccacagtttaa

SEQ ID NO: 231113 - DNA, 16008 bp, Artificial Sequence
  Description of Artificial Sequence: Synthetic coding sequence
atgctggtcatctggatccttacactcgcactgcggctttgcgctagcgtcaccacggtcactcctggctcaaccgtgaatacatccatcgggggtaacacaacctcggcgagcacgccctctagttccgatccttttactacttttagtgattatggagtctctgtcaccttcattaccggttctactgccaccaaacatttcctagatagctcgaccaacagtggtcactctgaggaatctacagtgagtcattcgggcccaggcgcaaccggcactaccctcttcccaagtcattcggctacaagtgtgtttgtgggagaacccaaaaccagtccaattacaagtgcttcaatggaaaccaccgcactgcctggttcgaccacaaccgccggtctcagcgagaagagtacgacattttactccagtccgagatccccggacagaaccttgagtcccgctaggaccacatcatctggcgtgtctgaaaagagcactacctctcactcacgtcccggacctacacataccattgcttttcccgatagcaccaccatgccaggagtgtcgcaagaaagtactgcgagtcattctattcctgggtccactgacactactttgtctcccggaacaaccacaccttctagcttgggtcctgaatcgactacgtttcactcatcccctggctatactaagactacaagattacccgataatacaaccacttcagggctattggaagccagtacacccgtgcacagtagtaccggctcaccacacaccacactttcaccttcaagtagcactactcacgagggagagcctaccactttccagtcttggccgagttccaaagatacctctccagcgccatccggcacgacgtcagcctttgtgaaactcagtaccacatatcacagttcaccctctagtacgccaacgacacacttctccgcgagctctacaacgttgggacatagcgaagagagcaccccagtgcactcaagtccagttgctaccgctacaacacctcccccagctcggtccgccactagtggccatgtcgaggagtccaccgcttatcataggagtccgggatcgacgcagacaatgcattttccagagtcatccacgacctccggccactcagaagagagtgccacctttcacggaagcacaacccacacgaaatcttcgacccctagcactaccgcggctctggcacatacatcttatcactcttccctaggctctactgagactacccacttccgggattctagcaccatatccggtcgctcggaagaaagcaaggcttcacatagctcacccgatgctatggcaacaaccgtcctcccagccggttctacaccatctgtcctggtgggcgattccaccccgagccctataagttccggcagcatggaaactaccgccttaccaggttccaccacaaaaccaggtctgtccgaaaaatcaacaactttttattcgtccccacgcagccccgacactacacacctgccagcttctatgacttcatccggggtctcagaggaatccacaacgtctcactccaggccgggatccactcatacaacggcttttccaggttctaccacaatgccaggcctatctcaggagtctacagcatctcatagtagtccgggaccaacggacaccactttgtcacccggaagtaccacagcgagttctttgggcccagagtatactacttttcactcccgccctggctcaacggaaaccaccctgctgcctgataacaccactgcttcaggcctgctggaagctagcatgccagttcattcttccacccgtagtccccatacaacacttagtccggctgggtctaccacacggcagggcgagagtaccaccttccactcatggccttctagcaaagacaccaggccggctcctcctaccactacgagcgcgtttgtggagccctccactacttctcacggatctccatcttcaatacctacaacgcatatctctgccagatccacaacttccgggctggttgaagaatcgaccacctatcactcctctcccggaagcacccaaacgatgcattttcccgaatcagatacaacctctggcagaggcgaagagtctacaacttctcactccagcaccacacataccattagtagcgccccatctaccacgtcagccttagtagaagagccgacatcctaccattccagtccgggaagcacagccactacacactttcctgatagctccaccactagcggacggtctgaagaaagtaccgcctctcactcttcccaggacgccaccggtacaatcgtgctgccggctcgaagtacgacaagtgtcctgctgggtgagtctacgacgtcccctatttccagcgggtccatggagacgacggccctgccaggtagcaccacaacaccgggactgtccgagcgctccaccacttttcatagctcacctcggagccctgcaaccactctgagcccagcgagcactactagctcaggcgtgagtgaagagtccaccacaagtaggagcaggccagggtctacacacaccactgcgttcccagactctaccactactcccggtctgagccggcatagtactaccagtcactcatctcctggctcgacagacacaacacttctcccagccagcactacaaccagcgggccttctcaggaatcaactaccagccattcctcctccgggtccacagacaccgctctgtctcctggtagtactacagcactctcttttggccaggagtctacaacattccacagcaatcccggaagtacccacacgactctgttcccggacagtacaacgtcgagcgggatcgtggaggcctccaccagggtacactcatccacaggcagccccagaaccacactgagtcctgcctctagtacaagtcccggactgcaaggcgaatccactgcctttcaaacgcacccagcctccacccatactacgcctagccctccttccactgccaccgctccggttgaagaatcaaccacataccacagaagccccggtagcacacccactacccactttcccgcaagttcaaccacttccggtcactcagaaaaatccacaattttccatagctctcccgacgctagcggaactacaccatcttcagcccacagtaccacttctggtcgcggtgagtccacaacctccagaatctctcctggaagcactgaaattactactttacctgggtccactacaacccccggactctcagaagccagtaccacgttctactcaagcccaaggagtcctaccaccaccttgagcccagcatctatgacttccctgggcgtgggcgaagagtctaccaccagccggtcccaacccggtagcacccactcaaccgtgagtcctgcctcaactaccacacctggcctcagcgaggaatccacaactgtgtacagctccagccgagggagcaccgagacaaccgtgttccctcattccacgactaccagtgtgcatggcgaggagcccaccacttttcactcaaggcccgcttctacccatacaactctctttaccgaggactctactaccagcgggctgaccgaagagtctacagccttccctggaagtcctgcttctacacagacaggactgccagcaaccctgacaaccgccgacctgggagaagaaagtaccacttttccctcgtcaagtgggtctaccggcacgaagttgtctcccgctcggtctaccacatccgggctggtaggcgagagtactccttcaagactttcaccatctagtaccgagacaaccacgttacccggttcacccaccactccatccctgtccgagaaaagcactaccttctacacctcacccagaagccccgatgcgacactttcccctgccaccaccacaagtagcggcgtctcagaggaaagctctacgagccattctcagcccggatctacgcatactactgcatttcccgatagtacaaccacctctgacttatctcaagaaccaacaacctcccactcaagtcagggctcgacggaggcaaccctatctcccggttcaacaacagccagcagcctagggcagcagagcaccacctttcactcctctccaggagatactgaaaccacactcctgccggatgacactattaccagcggacttgtggaggcttctacccctacccactcaagcaccggctcccttcacactacgttgacccccgcaagtagcacatccgctggacttcaggaagagtcgacaactttccagagttggcccagctctagcgatacaactccatctccccctgggaccacagctgctccggtcgaggtgagcaccacttaccactcgcgcccttccagtacacccaccacacatttctccgcgtcatcaactacgttgggcagatcagaggaaagcaccacagtccacagtagtcccggtgctaccggcaccgccctgttcccgacgagaagtgccacatccgtcctcgttggcgaaccaaccaccagccccattagctctgggtccactgagactacagccctccccggtagtacaacgaccgcagggcttagcgagaagagtactacattctactcgtcacctcgcagcccagacaccacactgtcacccgcatcaacgacaagtagcggagtaagtgaggaatctacaacctctcactcccgacccggttcaacccatacaacagccttccccggttcaacaaccatgcctggagtgagccaggaatcgaccgccagtcattcttctccgggttcgactgacacaacactcagccccggatctaccaccgcgtcatcccttgggcctgaaagtacaacgttccattccagtcctggatccacggagaccactctgctgcccgataatacgactgcctccggactgcttgaggcctctacccccgtccattcatcgaccggcagccctcacaccacactttccccggctggctctacaactagacaaggcgaaagcaccaccttccagtcttggcctagctccaaagataccatgccggcacctccgacgacaacatcagccttcgttgagttatcgactacatcccacgggagcccatcgagtacacccacaacacacttctctgcttcgtccaccacgctggggagatccgaagagagcacaaccgtgcactccagtcctgtggccaccgctaccacgccttcccctgcacgcagcactactagcggccttgttgaagaaagcactgcttaccactcctcacccggatctactcagacaatgcacttccccgaaagctctacggcctctgggaggtccgaagagtcccgtacttcacactccagcacaactcacactatttcttctcccccttccacaacttctgccttagttgaggagcccacttcctatcacagttcaccaggatctacggcaacaacacattttccggacagcagcacaacatccggcaggagcgaagagagcactgcctcccactcatcgcaagatgccaccggtactatagtgctgcctgcccgtagcacgacctctgtcctgttgggcgagtctacaacaagtcctatcagttccggttctatggagactactgccctaccaggctccactacaacccctggtctgagcgagaaatccaccactttccatagctctcctcgatcacctgctaccacactgagtcccgctagtaccacatcctctggagtcagtgaagagtcaaccacaagtcactcgcgtccagggtccacccacactacagcctttcctgatagcacgacaacccctgggctgagtcgccatagtacaacttcccacagtagccctgggagcactgacacaacattgctgcccgcttctaccaccacctctggtccgtctcaagaatccacaacatcacattccagccctgggagcacggatactgctttgtccccagggagcaccaccgccctgtcttttggacaagaaagtaccaccttccactcctcacccggttctacacataccacactgtttcctgacagcaccacgtctagcggcatcgtagaggcaagtactagggtacattccagtaccggcagcccgcgtaccactctgtccccagcatcttcaaccagtcccggactgcaaggagaatcgacagcttttcagactcaccccgcttccacccatacaaccccttcgcccccaagcacagcaaccgctcctgttgaagaaagtacgacataccatcgctccccaggatctacacctaccacgcatttccctgcctcttcgacgactagcggccacagtgagaagtccacaatattccacagctctcccgacgcatctgggaccacacctagctcagctcatagtaccacttcaggtagaggcgaatcaaccacctcccgaatttccccgggaagtacagaaattaccactcttcctgggagtacaactaccccaggcctctctgaggccagcaccaccttttacagtagccctcggtccccgacaactactctgtcaccagcttcaatgaccagcctcggagtgggcgaggagagcacaactagccgttcgcaaccgggtagcacccactcgacagtatcccccgcttcaaccacaacccccggactgagcgaggaatctaccaccgtctactccagctcacctgggtccacggagacaaccgtatttcctaggacgcctacgacttctgtgcgaggcgaggagcctactacttttcactcgcggccagcatccactcacacgaccttatttaccgaagactctaccactagcggtctcacggaggaaagcaccgcttttcccggtagcccagctagcacacaaactggcctgcctgcgacacttaccacagctgacctgggagaggagagcactaccttcccctccagctccggatctactggaacaacactcagccctgcgaggagtacaacctcaggacttgtaggtgagagtactccctctcggctgagcccctcaagcacggagacaaccactctccccggttcccccactacccctagtctttcagagaaatcaaccacattttacacgtcccccagatctccagatgctacactgagccccgctactacaacgtcctctggggtgtctgaagaaagttccacaagccatagccagccagggagcacccatactacagcctttccggactccaccacgacacccggactttcccgccatagtaccacctcccacagcagtccaggctccaccgacacaactctgctacccgcttccactacgacctccggaccttcgcaggagagcactaccagtcacagttcccctggttctactgacactgctctttctcccggttccactaccgccctcagcttcgggcaggagagtactacctttcacagcagtcccggatctacacacaccactctcttcccggactctaccactagttccggaatcgtggaggcaagtacccgcgtgcactcgtctaccggatcccctcggactaccctgtccccagcgtcttccactagcccagggctgcagggagagagcacaacattccaaacgcatcctgcaagtacccatactaccccctccccccctagcaccgccacagcgccagtggaggaatctacaacataccacaggtcacccggatctacccccactacccacttcccagcttctagtacaactagcggccattcagaaaaatctaccatcttccattcttctccggatgcctctgggacaaccccttcaagcgcacatagtactacaagcggaagaggcgaaagcaccaccagccggatctcaccgggaagcacagaaatcacaactctacccggatccaccaccaccccagggttatcggaagcaagtaccactttctactcctcccctcggagccccaccactactctctcccctgcctctatgacctccctcggggttggcgaggagtctactacgagccggtctcagcccggtagtactcattctaccgtgagtcccgcttccacaacgacgcccggactgtcagaagagtctactaccgtatatagttctagcccaggttctaccgaaacaacagtctttcccaggtccacgacaacctcagtgcggggagaggagcccaccacctttcatagtaggcccgcatccactcacactactttgttcaccgaagacagcaccactagcggcctgaccgaagaatcaaccgcgttcccagggagcccagccagcacacagacggggctgcccgctactctgaccaccgcagatctaggcgaggagtccacaaccttcccttcctcatctgggtccactggcaccacactctcccccgcaagatccaccacgagcggactggtgggtgagagtacaccgagtaggctgtctccaagtagcaccgagacaaccaccctgccaggcagcccaaccacgcccagtctttcagagaagagtacaactttttacacgtctccaagatccccagacgcaaccctcagtcctgctacaacaacaagcagcggggtaagtgaagaaagcagcacttcccactcacaacccggtagtactcacacaacagcctttcctgattccacaactacgtccgggttaagtcaggaacccaccgcatcacactcatctcaaggctcaacggaggccactttgtcccctggatccacgacggcctcctctctcggccaacagagcaccacttttcactccagtccaggggataccgaaacgacccttctgccagacgataccataaccagtggtctcgttgaagcctctacccccacccacagttccacaggatccctccacacgaccctcactccagccagttctaccagcgctggtctgcaagaggaaagcactacattccagtcgtggcctagttcctcagatacaaccccttcccccccaggcaccaccgcagcccctgtggaagtttctaccacgtaccactccaggccctcatccaccccaacgactcacttttctgctagcagcaccacactggggcgtagcgaggaatctactaccgtccattcatctcctggcgctacgggaacagctctcttcccgacacgcagcgcaacttccgtgctcgtgggtgagccgactacttcccctatcagttctgggtcaactgagacgacggcattgcccggttctacaaccaccgcaggcctttcagaaaaaagtactacgttctactcatccccgaggagtcctgacactactctgtcgccggcttctacgaccagcagcggcgtctctgaggagtccacaacttctcacagccggcctgggtccactcacacaacagctttcccaggcagcactaccatgcctggtgtctctcaagaatccacagcatctcacagttctcctgggagcactgacaccacgttgtctcccggaagtacaactgctagttcgttagggcctgagtcgaccacatttcactcaggacccggttccaccgaaaccaccctgctaccagataacactacggcctccggcctgctggaggcttccaccccagtacattccagtacgggaagcccacacacgaccctgagtccggcaggctctacaacaaggcaaggcgaaagtaccactttccagtcctggcctaattcgaaggataccacacccgcaccccctacaactacctccgcttttgtggaacttagtacaaccagccacggctcgcccagtagtacccctacgactcacttttcagcttccagcaccacactggggagaagcgaggagagcacaactgtccactccagccccgtagccaccgccacaacgccatcaccagctagatcaaccactagcgggctggtggaagagtctactacctatcactcctctccagggtctacgcagaccatgcattttccagagagcgataccacatctgggagaggggaggaatccacaacaagccacagcagtactactcacaccattagcagcgccccaagtactactagtgcgctggtggaagagcccacctcttaccattccagtcccggaagtactgctacaacgcacttccccgacagctcaaccacgagtggtcgctcggaggagagcaccgcctcccattctagccaggatgcaaccggaaccatcgtactgcccgctcggtccacgaccagcgttctgctaggagagagcacgacgtcaccaatctcttcaggatccatggagaccaccgctttacccggatccactactacccctggcctttctgaaaagagtaccaccttccactcgtcacctcgtagtcccgcaaccacactatcccctgcaagcacgacgtcatcaggcgtgagtgaggagtcgacaacttcccattcaaggccgggatccactcatactacagcattcccagattcaacaaccacccccggtctgtctcggcactcaacaacgtcccattcgtctcccggatctaccgacactactctgctccctgcaagcactaccacttcaggtagctcccaggaaagcaccacgagccattcctcgagcggatccacggacacggcattgtcccccggtagcaccactgcgctcagtttcgggcaggaaagcacaactttccacagctccccaggctccacgcatactacactatttccggattctactacatcttctggcatcgtggaggccagtacacgagtgcactcctccaccgggagcccaagaacgactctctcgccagcttccagcactagccccggtttgcagggcgaatctacagcctttcagacccatcctgcgtccacccatactacgccatctcctccaagtacagcaactgctccagtggaggaaagcactacctatcacaggtcccccggatccacgccaacgactcacttccccgcatcttctacgactagtggtcattccgaaaaatctacgatctttcacagttctcctgatgcttctggcaccacaccaagcagcgcccacagcactacttccgggagaggcgagagtaccacttcacgcatttctcctggaagcaccgagatcaccacgcttcccggttctacaaccacacctggactctctgaggcttccacgactttttactctagcccccgatcgccgacaaccaccctgtcgcccgcttccatgactagccttggtgtcggagaggaaagcaccactagtcgatcccaacctggctcaacacactctaccgtcagtccggcatctaccacaacgccaggtctgtcggaagaaagcacaaccgtctactccagctctcccggaagcaccgaaaccacagtgtttccacgcagcactaccacctctgttcgccgagaagagccaaccacatttcacagcaggcccgcttccacccataccaccctgttcaccgaggactcgacgacctccggactgacggaagaaagcacggcttttccaggcagccccgcaagtacacaaactggcctgcctgctacactgacaacagcggaccttggagaagagtccactacttttccctcctcgtcagggtctaccggaaccaagcttagcccagcaagatccaccacttctggactcgttggtgagtcaacaccttctcgcctctccccaagctctacagagaccaccacgctgccagggtctcctacgacaccctcgctctccgagaaaagtaccacattttacacttctccacgctctccagatgcaaccttaagccctgccactactacctcctctggggtgtccgaggaaagctctacaagtcatagccagccaggcagcacacatactaccgctttccctgatagtactaccacatccggtctgtcgcaggagcccactacgtcacacagcagccagggctcaaccgaggcaactttatcacctgggagcaccacagcaagctccctgggtcagcaatcaacgaccttccactccagccccggagataccgagacaactttactgcctgacgacaccattacgtccggcttagtagaggcttccactcccactcactccagtactggatccctacatacaacactaaccccagcaagcagcacatctacaggactgcaggaggagagcaccaccttccagagctggcccagttcttcagacactactccctctccaccttccaccacagccgttcccgttgaggtctctaccacataccatagtagaccaagctcgacccctactacacacttttctgcttcctcaacaacccttggcagatccgaagagtccactacagttcacagcagtcctggagccactgggacagcgctttttccgacacgatccgctacctcagtactggtgggcgaacccaccacatcccccataagctcagggagcaccgagacgacagctctgcctgggagcaccacaacagcaggcctgtcagagaagtcaaccaccttctactctagtccacgaagtccggataccacgctgagtccggcaagcacgaccagttccggcgtatctgaggaatctaccacatcccattcacgccctgggtccatgcatactacagcatttccaagtagcaccacgatgccaggagtcagccaggaatctaccgcgtcacattcctcccccggatcaacagataccaccctgtcacccggatctaccactgccagcagtcttggacctgagagcaccacctttcattccagcccagggtcgacagaaactactctcttgcctgataacactacagcctctgggctccttgaagcatccacccccgtgcactcttccacgggttctccccataccacgctctcacccgcagggagtactaccagacagggggagagtaccacctttcaatcttggccaaattctaaagacacaactccggctccgccaaccactacctctgccttcgtggagctatccaccaccagtcacggctcccctagctctacacccaccacccatttcagtgctagcagcactaccctgggtcgctccgaagaatctacaaccgtccactccagtcctgtggctaccgccacgacccccagcccagcccgaagcactactagcggtctcgtcgaagaaagcacaacgtaccattcttcccccggatcgacacagactatgcacttccctgagtccaacacgacctcgggtagaggggaggaatctacaacctcacactcaagcaccacacacacgatttccagcgctccttccaccacctcagcgcttgtcgaggaacccaccagttatcactcttcccccggatctacggccacaactcattttcccgatagtagtacgaccagcggaaggagcgaggagtctacagcctcacactcaagccaggacgctaccggcaccatcgtgctccccgcacgttccacgaccagcgtcttgcttggggaaagcacgacatctcccattagctctggttctatggagaccacggctttgcccggttccaccaccactcccggactttcagagaaaagcactacctttcattcttcacccagttcgacacccacaactcacttttcagcctcctcaacaactctgggacgttcagaagagagtaccacagtgcactcctcccctgtggccaccgcgaccactccatcccctgccagatcgacaacctccgggctagtggaagagagtaccgcgtaccactcatcccccggatcgacccagaccatgcatttcccagaatcaagtacagcgtccggaaggtctgaggaatctaggactagtcactcctcaacgacacatacaatttctagcccgccttccaccacctccgctcttgtggaggagccaacgagctaccactcctctcccggttccatcgcaacaacacacttcccagagtcttccacaacctcgggtagaagcgaggagtccaccgcctcacattctagtcccgataccaatggcattactcccctccctgcccactttaccacttctggtcgcatcgccgaaagcacgaccttttatatcagcccaggatcaatggagactacgttagcgagtaccgccacaacgcccggactcagcgctaagtccacgatactgtactcctcttcacgcagccctgaccaaacgttgtcacccgctagcatgacatcctcatcaatatctggcgagcccactagcctgtactcacaggccgagagcacccacaccactgcttttcctgcatccacaacaactagcggtctgagtcaggaatctaccacattccatagcaagcctggctctaccgagaccactttatcacctgggtcaataacaacctcttcctttgcccaggagtttacaacacctcactcccagcccggtagtgctctctccacagttagccctgcaagcaccacagttccaggactgtccgaggagagtacgaccttttactcaagtccaggcagtactgaaacgactgcattcagccacagtaataccatgagtattcacagccaacagtctacacccttcccggattcaccgggattcacccacactgtcctgccagccaccctgacaacaacggatattggacaggaatccacagcctttcactccagttctgacgctacaggaactactcctctccccgctaggtctaccgcttccgatcttgtgggtgagcccaccaccttttatatcagtccctctccaacctacaccacgctcttccctgccagctcaagcacttcaggcctgaccgaggaatccaccaccttccacactagcccatcctttacatccacaatcgtgtccactgaaagtctggaaactcttgctccgggactgtgtcaagaaggtcagatatggaatggcaaacagtgcgtgtgtccgcaaggctacgtaggctaccagtgcctgagcccgctcgaatctttccccgtcgagacccccgagaagctgaatgcaacactggggatgactgtcaaggttacatatagaaattttaccgagaagatgaacgatgcctcctcccaggaatatcagaatttcagcaccttgtttaagaatcggatggatgtggttctgaagggggataatcttccacagtaccggggtgtcaatatcaggcgccttcttaatgggagtatcgtagtcaaaaacgacgtaattctcgaggccgattatactcttgagtatgaggaactttttgagaacctggccgaaattgtgaaagccaagatcatgaatgaaaccaggacaaccttgctggatccagacagctgtcgcaaggcaattctgtgctactccgaagaggatacgtttgtggattcttctgtgaccccaggatttgattttcaggagcaatgcacacaaaaagctgctgaggggtacacccagttttattatgttgacgtgttggacggaaagcttgcctgcgttaacaagtgcacaaagggcaccaagagccagatgaattgcaacctgggcacctgccagctgcaaaggtcgggcccacgttgcctgtgtcccaataccaacacacactggtattggggcgaaacctgcgagttcaatattgctaagagccttgtgtatgggatcgtcggggcagtgatggccgtgctcctgttggcactgattattctcatcatcctgttctcactgagccagcgcaagcgacacagagagcagtacgatgttccccaagagtggcgtaaggagggcaccccagggattttccagaagacagcgatctgggaggaccaaaatttacgggaatccagatttggtttagagaatgcgtataataattttaggccgaccctggaaaccgttgactctggcaccgagctgcacattcagcgcccagaaatggtcgctagcaccgtttac

SEQ ID NO: 231114 - DNA, 1536 bp, Artificial Sequence
  Description of Artificial Sequence: Synthetic coding sequence
atgaaggcaatcattcacctgaccctcctggcccttctctctgtgaacaccgccacgaatcaaggaaattccgctgacgcagttaccaccacagaaaccgcaacttcaggccctacagtggcagccgctgatacaaccgagactaatttccctgaaaccgcatccaccaccgccaacacgcccttcccaaccgccacctctcctgcacctcctatcatctctacccacagctcgtctaccatccccaccccagccccaccaattatttccacacatagttcaagcacaatacccatacctaccgcagcggactctgaaagtaccacaaacgtcaatagtctcgctacttcagatatcatcaccgcctcatcccccaacgacggcctgattacaatggttccgtcggaaacccaaagcaataacgagatgagtccaacaactgaggataaccagtcttcagggccacccaccggaaccgctctcttggaaacgtccactttaaatagtaccgggccttctaacccttgccaggacgacccttgtgcagataactctctgtgcgtcaagcttcataacacttccttctgcctctgccttgaggggtattactacaattcatcaacatgcaagaaagggaaagtgtttccaggcaaaatatccgtcacagtgtcagaaacatttgatcctgaggagaagcactccatggcctatcaggatttacactccgaaatcacctccttattcaaggatgttttcggcacttctgtgtatgggcagactgtgattctgactgtatccacgtcgctttctcccaggagtgaaatgagagccgacgacaagttcgtcaacgtgaccatcgtgaccatattagcagagaccacttcggacaacgagaagactgtcactgaaaaaatcaacaaagcgatcagatcttccagcagtaattttctgaattatgacctgacgctgcgctgtgactattacggctgcaatcagactgccgacgattgccttaatggtctggcctgcgactgtaagtcagaccttcagagaccgaacccccagtcccccttctgtgtggctagctcactgaagtgcccagacgcctgcaacgcccagcacaaacagtgccttattaaaaagtcaggcggtgcacctgaatgtgcctgtgtcccgggttaccaggaagatgctaacggaaactgccagaagtgcgccttcggctactccggactcgactgcaaggataagttccagctcatcctaacgatagtgggaactatcgctggcatcgtcatcctgtcgatgattattgctcttatcgtgacagcgaggtctaataataaaacaaaacacatcgaggaggagaacctaattgacgaggattttcagaatttaaaactgcggtctactgggtttaccaacctcggggctgaaggatcagtattcccaaaagtgagaatcaccgcatctcgggatagccagatgcaaaatccgtactctagacactcatccatgccacgcccagactactag

SEQ ID NO: 231115 - DNA, 13482 bp, Artificial Sequence
  Description of Artificial Sequence: Synthetic coding sequence
atgccccgacctgggaccatggcactttgcctactgacccttgttctttcattacttccacctcaggccgctgctgaacaggatctcagcgtgaatcgagctgtttgggatggtggaggctgtatctcacagggggatgtgctgaaccggcaatgtcaacaactgagccaacatgtccgcactggatctgctgcaaacaccgccaccgggaccacatcaactaacgttgtggaaccccgaatgtatttgtcttgtagtacaaacccagaaatgactagcatcgagtcttcggtaacttctgacaccccaggcgtttcgtccacccgtatgactccaacggagtctagaacaacatctgagtcaacgtcagatagtaccaccctgtttccctcctccacagaagatacttcatcccctaccacacccgaaggcaccgacgttccaatgtctactccctcggaagaaagtataagctctacgatggcatttgtaagtaccgcccctttaccgagctttgaggcgtacaccagcctcacttataaagtggacatgtccacccccctcacgacaagtacccaggcctctagctctccaaccactcccgagagcacgaccattcctaaatccaccaactccgagggatctacacccctgacgtccatgccagcatctacaatgaaggtcgcttctagtgaagccatcactctgctgactactcctgtggaaatctctacacctgtaacaatatccgctcaggcaagcagctcaccgactaccgccgagggccctagtctgtccaacagtgctccgtctgggggatcgacccctttgacacgaatgcccttgtcagttatgctcgtcgtttctagcgaagccagcaccctgagtacaactccagccgcaactaatattccagtgatcacctccaccgaggcttccagctcccccaccacagccgaaggcacgagcattcccacctccacctacaccgaaggttctactcctctcacctccacccctgcaagcaccatgcccgtggcaacgtcagagatgagcacccttagtattactcctgtggacacatcaacacttgtcaccacatccacagaaccaagttctttacctactacagcagaagcaaccagcatgttaacgagcaccttgagcgagggtagcacacccctcaccaatatgcccgtctcgaccatcttagtcgcctcctccgaggcatccacaacctcaacaatcccagtcgactccaaaactttcgtgactactgcatcagaggcctccagttctcccaccaccgccgaagatacaagcatcgccacaagtaccccttctgaagggtcaacccctctgaccagcatgcctgtgtctaccacaccggtcgccagtagcgaggctagtaatttatcaaccactcctgtcgattctaagactcaggtaacaactagtacagaagcctccagttcgcctcccactgctgaggtgaatagtatgcccacctctacgcccagcgagggcagcaccccacttacttctatgtctgtctcgactatgccagtcgccagctccgaagcctccactctgtccactactccggtcgatacatcaactcctgtaacaacctcgagcgaagcatcatcttcttcgaccacccccgaggggacaagtatccccacgagtactccgtctgagggatcaaccccactgaccaatatgcccgtgtccactcgcctggtcgtctcttctgaggcctcaacaactagcactacccctgctgattcaaacacgttcgttacaacatccagtgaggcctcatcaagctccactacagccgaaggcacctcaatgccaaccagcacatacagtgagcggggaaccactattacttccatgtctgtgagcactacgctggtagcctccagcgaggcatcaactctttccacaacacccgtcgactccaacacacctgtcactactagcacagaagccacctcaagctcaactaccgctgaggggacgagcatgcccacgagtacatacactgagggttctacacccttgacgagtatgcctgtaaatactacactcgttgcatcatccgaagcctcaaccctgtctaccactcctgtggatacttcaaccccagtgactacatccaccgaggccagctccagtcctacgacagctgatggtgcatccatgcccacttcaactccttcagagggctccacaccactgacttcaatgcctgtgtccaagaccctgcttacctcatccgaagcttcaacgctgtctacgactccactcgatacctctacccacatcacgacttctaccgaagcatcttgttccccaacaacaacagaagggacctccatgccgatatctacgccttccgaaggcagtcctttgcttacaagcatcccggtgtctattacgccggtcaccagcccggaggcgtctaccttaagtacaacaccggtggactccaactcacctgtcacgacatccaccgaggtgagtagcagtcctacgcctgccgagggtacatctatgccaacaagcacatacagcgaggggaggacacctctgacttccatgccagttagtaccaccctcgtggctacgtccgcaatttccacattgagcacgactcccgtggatacgtccaccccagtgactaacagcaccgaggctaggtcgagcccaaccactagtgaagggacttccatgcctacatccacgcccggagaaggatccacccctttgactagcatgccagacagtacgactccggtggtatcgagcgaggccagaaccctctccgcaacgcctgtcgatacatcgactcctgtaacaacctctacagaggcgacctccagtcccacaaccgctgaaggaacttccatccctacttctacgccgtctgaagggacaacacctttaacttctactcctgtgtcccataccctcgtggcgaattctgaggcttccaccctgagcaccactcccgtggactcaaacacaccgctcacaacaagtactgaagcttcctccccacctcctactgcggagggcacatccatgcccacatccacacccagcgaaggtagcactcccctgacccggatgcccgtcagtaccactatggtggcaagcagcgaaaccagtaccttaagtaccaccccagccgatacctcgacacccgtgaccacttacagtcaagcctcttcttctagcacaactgccgatggtactagcatgccgactagcacctactctgaaggctccactcctctgacatccgtccctgtgagcacaaggctggtcgtctcctctgaagcgagcaccctgagcacaacccccgtggatacatctatccccgtgactacaagtaccgaggccagttcttctccaacgacggctgaaggcacttcgatccccaccagtcccccttctgaggggaccacacccttggcttctatgccagtgagcacgactctcgtcgtcagttccgaggccaacacactctccactacacccgtggactccaaaacccaggtcgccacttccactgaggcttcctccccccctcctactgcagaggtgacaagcatgcctacttctactccaggcgagcgctcaactccattgaccagtatgcccgttaggcatactccagtagctagctccgaggcatctaccctgagcacatctcctgtggatacgtccactcctgtgaccactagcgcagagacttcgtcctctccaactactgccgaagggacgagcctgcctacttctactacctccgagggaagcacactcctgaccagcatccctgtctccacaactctcgtgacgagccccgaggcatccacccttttaactacaccggtggacaccaaaggaccagtggtgaccagcaatgaggtgtcttcttcacctacccccgctgagggcacctcaatgcccacctcgacttattccgagggaagaacccctctaacctcaatacccgtaaacaccaccctggtcgcctctagcgctatttcaatcctatctaccacacctgtggataacagcacgccagtgaccacttcaactgaagcttgttcttcgcccacaaccagcgaaggcaccagtatgccaaactccaatccttcagagggtactacccctctgacttcaatacccgtgagcaccacgcccgtggtgtcaagcgaggcctccactctgtccgccacccccgtggacaccagcactccaggcacgaccagcgccgaagcaacatcctcaccgactaccgcagagggaatttccattccaacttcaaccccaagcgagggtaaaaccccactgaagtctatacccgtgagcaacacccccgtcgcgaactctgaagcatcaacattgtcaaccactcctgttgattctaatagccctgttgtaaccagcactgcggtgtcctcaagtcccaccccagcggagggaacctcgatcgccattagcacaccgtctgaaggctctactgctctcacttctatccctgtctccactaccaccgtggcctcttccgagataaactcattgtcaaccactcccgcagtcacaagcactccggtgactacttattcccaagcttcatctagtccaaccaccgctgatggtaccagcatgcagacctcaacctacagtgaagggagtacccccctgacctcactccctgtgtcgactatgcttgtagtgagttccgaagctaacacgctgtccaccacaccaatcgactcaaaaacgcaggtcacggcgtcgaccgaagctagttccagtactactgccgaggggagctcaatgaccatcagcactccatcggaaggctccccattactgaccagcattcccgtgagtacaactcctgtcgccagccctgaagcgagtacacttagtacaacgcccgtggattcaaatagccctgtcataaccagcacagaggtaagctcgtctccaacacccgcagaaggcactagtatgcccacttctacctacacagaaggcagaacgcctctaacctctatcacagtccggacgacgcccgtggcctccagcgccattagcacgttatccaccactcccgttgataactccactcccgtaaccacatccaccgaagcacgatcctcacctacaacatcagaaggcacctctatgcccaatagcacacctagcgagggaactacccccttaacatcgatcccggtgtccactacgccagtgttgtcctccgaagcctcaaccttgagcgcgactcctatcgatacatctaccccggtgaccacttctaccgaggccacaagcagtcctactacagccgaaggaactagtatacctacttccacactatcagaagggatgactccgctgacatccacaccggtctcccacaccttggtagccaactctgaagcctctacgttgagtacaactcccgttgattcaaattcgccagtggtgacctccacagccgtgtcgagcagcccaacgccagcggaaggcacatccatagcgacatcaactccaagcgagggtagtacagcgcttacttcaattcctgtgagcaccacaaccgttgcatccagtgaaacgaacactttgagtaccacccctgcagttacatcaacgcccgtgacaacctacgcccaagtttcttcgagtcccactactgctgacggatcatccatgccaacatctacccccagggaagggaggccccctcttacctcgattcctgtgtccactaccactgtggctagctccgagatcaacacactctccaccactctggccgacacacggaccccggtgaccacgtacagccaggcaagctcttcgcctactacagccgatggcactagcatgccaactccagcatacagtgaaggcagtacaccactgacctcaatgccactgtctactaccctggtggtgagttcggaggcctccactctctcaactacccccgtggatactagtacaccagcgacgacgtcaacagaggggtccagctcaccgacgacagcaggtggtaccagcattcagacgtccacaccttccgaacgcactacacctttggccggtatgcctgtgtctacaacactggtggtatcttccgagggcaataccctgagtactacccctgtagacagtaaaactcaggtcactaatagtactgaggctagcagcagcgccactgccgagggatcaagtatgactatctctgccccatccgagggctcacccctgttaacatctatccccttgtctaccactcccgtggcaagtcccgaggccagcaccctctccacaacacctgtcgacagcaattcccccgtgataacatccactgaagtttccagttcccctatcccgactgaaggcacctcgatgcagaccagcacatatagcgatcgcagaacaccgctcacatctatgcctgtcagcacaaccgtggtggcctcatccgctatctctactctgtctactaccccagtggatacctctactccggtgaccaattctactgaggccagatccagccctaccacctcagagggcacatctatgccaacgtcaacccccagtgagggatccactcctttcacttctatgcctgtgtctacaatgccagtcgtcacatccgaagcctctaccctcagtgcaacccccgtcgatacaagcacccctgtcacaacttccaccgaggccacaagtagcccaacaacagccgaggggacttcgatccccaccagcacactgtctgaaggaacaacaccgctgacctccatccctgtgagccataccctggtcgctaacagcgaggtatctaccctcagcactacacccgtggactccaatacaccatttacgacatccacagaggcatcatctcccccaccaacagctgaagggacctctatgcccacgtcaacttcctccgagggtaacaccccattaactagaatgcctgtttccaccaccatggtagcttcctttgagacgagcaccctgtccactacacccgcagacactagtacaccagtcactacttactcacaagccggttcctcacccaccactgcagacgacacaagcatgccaacatccacatactccgagggttcgactcctctgacctcagtaccagtgtccacgatgcctgtcgtgagcagcgaagcgtcgacacatagcaccacgccggtagatacttcaacaccagtgacaactagcacagaagcaagcagctccccaaccaccgccgaaggaacttctatccctacaagccccccttcagagggtactacgccgctggcgtccatgcctgtgtcgaccactcccgtcgtctcttccgaggccggaacactgagcacaacaccagtggatacatcaacccccatgacaacatcaacggaagcatcgagcagccccactactgctgaggacatcgtggtgccaatcagtacagcgtcagaaggcagtactctccttacttcaatcccagtgtcaacaaccccagtcgcttcacccgaggctagtacactgtccaccacgcctgtggactcaaatagtccagtagtcacctctactgagattagttccagcgccaccagtgcggaaggaacatcaatgcccacctctacttatagcgaaggcagcaccccgctgaggtcaatgccagtaagcacaaagccacttgcttcttccgaggcatctacactgagtactaccccggtcgatacatcaatcccagtgacaacaagcaccgaaacatcctcatcccctactaccgctaaagatacttctatgccaatctccacgccctctgaagtctctacttctctgacctctatcctggtgtcaacaatgcctgtagcctcgtccgaggcctcaaccctgagcacaacgccagtcgatactcgcacccttgtgacaacctcgactggaacttcgtcatcacctacaactgccgaagggagcagcatgccgacaagcacccctggtgaaaggagcacgccactgactaatatactcgtgtccaccacactgctggccaacagtgaggcttcgactctgagcacaacgccggttgatacctccacccctgtgaccactagcgctgaggcttcttccagccccacgacagccgaaggtacaagcatgaggatcagcacaccctcagatggatctacaccactaaccagcatcttggttagcactctgccagttgcatctagcgaggcttctaccgtcagcacaactgcagtcgacactagtattcccgtgactacatcaacggaggcctcttcatctccgaccacggcagaggtgaccagtatgccgacttccacaccgagtgaaacctccacccctctcacaagcatgcctgtgaaccacacacccgtggcctcctccgaggccggaacactgtcaaccactcctgtcgatacatcaaccccagtcaccacttctaccaaggctagctcttcccctaccaccgctgagggcatcgtcgtccctatatccaccgcttcagagggatctactcttctcacatccattcctgtgagtactacacccgttgcctcaagcgaggcgtccacattgagtaccactccagtggataccagcattcctgtcactaccagcactgagggatcttcgtcccctacgacggctgaggggaccagcatgcccatcagcaccccctccgaggtgagcaccccgctgacctcaatcctggtctcgaccgtgcccgtggcaggttctgaggcgtcgacgctgtcaaccacccctgtggatacgaggactcccgtgacaacatctgcggaggcatcttcttcccctacaacagcggaggggacctcgatgccaatcagtacacctggcgaacggagaacaccccttacttcaatgtctgtgagtacaatgcctgtggctagttctgaagcaagcactctgtcaagaacacctgcagacacgagcacccctgtgactacctccacggaagcatctagctcaccgactactgccgaaggcacggggattcccatctctaccccatctgagggttccaccccgctgacttccattcccgtgtccacgacccctgtggcaatcccagaagcatccaccctgtccactactcccgttgattccaattcacctgtcgtcactagcacagaagtgtcatctagtcccacgcccgctgaaggcacatctatgccaatctctacatacagcgaagggtccacgcccttgaccggtgtgcctgtctcaacgaccccagtgacctctagtgccatcagcacgctaagcaccacccctgtcgacacctcgacccccgtcaccacctctaccgaagcgcactcctcccccacgacaagcgagggtacttccatgcctacttcgacaccgtccgaaggcagcactcccctgacatacatgcctgtcagcactatgctggtcgtaagctccgaggactccacattgtcggcaactccagtggacaccagcacgcccgttaccacaagcacagaggccactagctcaaccacggccgagggaacttctattcctacaagcacgccatccgaaggcatgactccgctcacgagtgtaccggtatccaataccccggttgctagctcagaggcgtccatcctaagcacgacgcccgttgacagcaacacccctctgaccacgagtactgaggctagctcatctccccctactgctgagggcaccagcatgccaaccagcacccctagcgaaggttccacacctttaacaagcatgccggtttctactactaccgtggcatcttccgaaactagcactttgagcaccacccctgccgacacctcaacacccgtcacaacgtactctcaagcttccagcagcccacccattgccgatgggacctcaatgcccactagcacatacagcgagggctcgactccactgacaaacatgagttttagtacaacacccgtcgtttcgagcgaggcatcaaccctgtcaactacaccagtggacacaagcacccccgttactacatctaccgaggcatcattgagccccaccacagctgagggaacgagtataccaacgagctcaccctctgaaggcacaacacctcttgctagcatgccagtatctacaacgcccgtcgtctccagtgaggttaatacccttagcacaactccagtggattcgaacacactggtgactacctctacggaggccagctctagccccacgattgctgagggcacatcgttgcccaccagcaccacttccgagggatccactcctctgtctatcatgccactttcgactacacctgtggcttcatcagaggcctccacactcagcacgactcctgtagacaccagcaccccagttaccacgtcaagccccacaaatagcagccctaccacagcagaggtcacgtctatgccgacaagtacagccggagaaggctctaccccactcaccaatatgcccgtgagcactactccggtcgcttcgtcggaggctagcacactctcaactacaccagtcgattctaatacattcgttacaagctcctctcaagccagctcatctccggcaaccctacaggttaccactatgcgcatgtcaacacctagcgaagggagtagctcattgacaacgatgctcctgtcttctacctacgtgacgtcctctgaagcatcaactccttccaccccctcggtggacaggtcaacgcctgtcaccacttccacccagtccaacagcacccctaccccacctgaagtgatcactctgccgatgtcaacaccctctgaagtctccaccccacttacaattatgcccgtgtctacaacttcggtgaccatttccgaggcgggaaccgcttccactctcccggtcgatacctccacacctgtcattacgagcacccaggtttctagtagccccgttacccctgagggcaccactatgccaatctggaccccaagtgaagggtccactcctctgaccacaatgcccgtgagcactacgcgtgtgactagctctgaaggcagcaccctatcaacaccatctgtggttacttcaaccccagttacgacctctacggaggcgatctcatcttctgccactctagactcaacaacaatgagcgtaagcatgccgatggagattagtactctggggacaacaattctggtttccaccactccagtcaccagatttcctgagagctccacgccctccataccatcagtgtacacctcaatgtctatgaccacagcttccgagggtagctcatcgcccactacactggaggggactactacaatgcccatgtctaccacatccgagcggtccactcttctcactacggtgctaatatcaccaatctctgtaatgtctccatctgaagcgagcacattgagtacacctccgggagacacctctactccgctgcttacaagcactaaggcaggaagttttagtatccctgccgaggtgacaaccattagaataagcataacgtctgagcggtcaacacccttgacaaccctgctagtctcaacgacgctcccaacgagttttcctggcgcatccatcgcatcgaccccccctctggatacctcaaccactttcactccctccactgatactgcgagtacccccactattccggtggcaacaaccattagtgtaagcgtcatcaccgaaggatctaccccaggaacaactatctttattcccagcactccagtaaccagcagcaccgccgacgtgttccccgcaaccacgggcgctgtgtcaacacccgtcatcaccagcacagagttgaacactcccagtactagttcaagtagtactaccacctccttcagcaccaccaaggaatttactacgcccgcaatgacaaccgccgcacccttaacatacgtaaccatgagtaccgccccatccaccccaaggacaacatctagaggctgcaccaccagcgcctccacactctccgccaccagcacaccgcatacctcaacttcggtgacaacacgccctgttacacctagttcggagtcaagtcgaccttccactatcacatcccataccattcccccaacctttcccccagcacatagttctactcctccaacaaccagcgcttccagtacaaccgttaatcccgaagctgtgacaacgatgacaacaaggactaagccttcaacccgcaccacaagcttcccaactgtcacaacgactgcggtaccaacaaacaccacaatcaagtctaatcccacgtctactcccacagtgcctaggaccactacgtgtttcggcgatgggtgtcagaataccgcgagccgctgcaaaaatggaggcacatgggatgggctgaagtgccagtgtcctaatttgtactacggcgaactgtgtgaagaagtcgtgagcagcatagacattggtcctccagaaactatctcggctcagatggagttaacggtgacagtgacctcagtgaaatttaccgaagaactcaagaatcactcaagtcaggagtttcaggagtttaaacagactttcacagaacagatgaatatcgtgtattctgggattcccgaatacgtaggggtcaacatcaccaaattacgcttgggctccgttgtggtcgagcatgacgttcttttgcgtacaaaatatacacctgaatataagactgttctcgataacgcaacggaggtggtgaaggagaaaatcactaaggttacaacacagcagataatgataaacgacatttgctcagatatgatgtgctttaacacaacggggacacaggtccagaacattaccgtaacacagtatgaccctgaagaggattgcaggaagatggcgaaagaatacggagactacttcgtggtagagtaccgcgaccaaaaaccttactgcatttcaccctgcgagcctggcttttctgtgagcaaaaactgcaacttgggcaaatgccagatgagtctgtctgggcctcaatgtttatgcgttaccactgaaacccactggtattctggggaaacctgcaatcagggcactcagaagtctctagtatacggcttggtgggcgcaggcgtggtgctgatgcttatcatcctggttgccctcctgatgctggtgttccgcagcaaaagagaggttaagcgccagaagtaccgcctgtctcagctttataagtggcaagaggaagatagtggtccagcccctggcacattccagaatataggattcgatatctgccaggacgatgacagtattcatcttgagtctatctacagcaactttcagcctagtctgcggcacatcgaccctgagaccaagattagaatccaacggccacaggttatgacgacgtctttctaa

SEQ ID NO: 231116 - DNA, 843 bp, Artificial Sequence
  Description of Artificial Sequence: Synthetic coding sequence
atgacgactgctctgggcagccagctatccagctcccaaacagtgatccccggatcctctggaactatctcacatactactgtggccccaggcagctctgtgacaggtactacaaccggtgctagtgatgatcaggtcacaggttctaaaacggggaccactggagttgccctgagcaccacagttgcaccaggatccagtagtacagaagccacaactagcacaggtgtgcaccggaccactgtggtgggacaaaaaaccggagctaccacccgaggatcagctaagcaaggcaccaggtcgacgatcgaggctacaaccagtttcaggggaaccgggacaaccggctctggtatgaatactggaaccactggagtagtgagtgggaatactatatctccctccagctttaataccgaggccacatccggcacctccgaacggcctaatcccggaagcgaaattggtactaccggaattgtcagtggcactacggttgctcctggcagtagcaacaccgaagccacaacatcccttggaaacggcggaaccacggaggcaggctctaaaatcgttaccacaggcatcacgactggcaccactatcgttcctggttcttttaacacaaaagccactacttccaccgatgtaggcgtcgccactggcgtgggcatggcaacaggcatcaccaatatcatcagcggcaggtcccagcccactgggagcaagactgggtacaccgtgactggctccggcaccacggcccttcctggtgggttcagaaccgattcccccagtttcccattattcttgatctgttcttataggggtcacaatttttag

SEQ ID NO: 231117 - DNA, 837 bp, Artificial Sequence
  Description of Artificial Sequence: Synthetic coding sequence
cctactggcacgcagactccaacccccacgcctatttcgacgaccaccactgttacccccacgccaacccccacggggacacagaccccgacaacgactccaatcaccaccacaacaactgtgacacccacaccaaccccaaccggcactcagactccgaccaccgtattgatcactacaacaacaacaatgacaccaactcccacccccacatctaccaaatccactactgtgaccccaatcacaacaactactacagtaaccgcaaccccaacccctaccggaacccaaacgccgacaatgatccctatcagcacgacaacgaccgtcacacctactcctaccccaacgaccggatcgactggaccacccacccatacatccactgcacctattgccgagttaaccaccagtaatccccctcccgagtcatccacacctcagacatcccgtagcactagctcgcccctgaccgaatctacgaccctcttatcaacactgccacctgctattgagatgactagcacagccccaccaagtacgcctacagcccctacaactacatcgggtggacacacactgtctccccctccctccacaactacctctcctcctggcaccccaacccggggaactacaactggctcaagttctgcgcctaccccgtctacggttcaaaccacaacgacgtccgcatggacccccacacccacgcctctgtctacacccagcattattcgaacgaccggcctccgtccatacccctcaagcgttttaatatgctgcgttctgaacgacacttactacgcccctggtgaagaggtctataacggatag

SEQ ID NO: 231118 - DNA, 5342 bp, Artificial Sequence
  Description of Artificial Sequence: Synthetic coding sequence
atggggttgccattggcacgcctggcggcagtatgtcttgccctgtcattggccggaggttcagagctgcagaccgagggacggactcgcaatcacggtcataacgtttgctccacctggggcaattttcactataaaacctttgacggcgacgttttcaggttcccaggcctttgcgattacaacttcgcctctgactgtagagggtcttataaagagttcgctgtacatttgaagcgcggacccggacaagctgaagcacccgctggagtagaatcgatcttactcacgattaaggatgataccatctacctgactcggcacctagccgtcctgaatggagcagtagtgagtaccccccactattctcctggacttctgattgagaaaagcgatgcatacaccaaggtgtactcccgggcaggactgacgcttatgtggaacagagaagatgctttaatgctggagttagacacgaaattcaggaaccatacctgtgggctttgtggggactacaacggactccaaagttatagtgagttcctttcagacggggtgctgtttagtccactggaatttggtaacatgcaaaagatcaatcagcccgatgtcgtgtgtgaggatccagaagaagaagtggccccagcatcttgctcagaacatagggccgagtgtgaaagactgctgactgccgaagcctttgccgactgtcaggatctcgtcccgttggagccctatctgcgggcatgccagcaggatagatgtcgctgccccggtggcgacacctgcgtgtgttcaactgtcgcagagttctcacgacagtgtagccatgccggaggacgcccaggaaactggcgaactgcaaccctctgcccaaagacctgtccgggaaacctggtgtatttggagagtggctcgccttgcatggatacgtgctctcatctggaggtatcttccctgtgcgaggaacataggatggatggctgcttctgcccagaaggaacggtgtatgatgacatcggagacagcggatgtgttccagtgtcgcagtgtcattgtcggcttcacggccacttatatacgccagggcaggagatcactaatgactgcgagcaatgcgtttgtaatgccggaagatgggtgtgtaaggatctcccttgccctggaacttgcgctctggagggcggatcgcacattactacctttgatggtaaaacttatactttccacggcgactgctactatgtgcttgccaagggcgaccataatgatagttacgcgcttctgggcgagctggctccctgtggcagtaccgacaagcaaacatgcctcaagacagttgtgttgttagctgacaaaaaaaaaaacgtcgttgtcttcaaatcagacgggtctgtcctgcttaatgagctgcaagtaaatcttccccacgtgaccgcgtccttctcagtgttcagaccctcaagctaccacattatggtgtccatggcaattggtgtgcgcctgcaagtccagctagccccagtcatgcaactttttgtcaccctggaccaggcctctcagggacaggtgcaaggactttgcggcaattttaacgggctcgagggcgatgactttaagacagcctccgggctggtggaggctacgggcgctggcttcgccaatacttggaaagcccagtcttcctgtcatgacaagctggactggctggatgacccatgctccttgaacattgaatccgctaattatgcggaacactggtgttctcttctaaaaaaaactgagactccctttggtagatgtcactcggcggtcgatcctgcagaatactacaaacggtgcaaatacgatacctgtaactgtcaaaacaatgaagactgcctttgcgccgctctcagttcttatgccagagcatgtactgcaaaaggcgtcatgttatgggggtggagagaacacgtttgcaacaaggacgtgggatcgtgccccaattcacaagtgttcctgtacaacctgacaacgtgccagcaaacatgcaggtcactttcagaggccgatagccattgcctggagggattcgctcccgtggatgggtgtgggtgtcctgaccacacctttctcgacgagaaaggtcgatgtgtgcccttggctaaatgttcctgctatcacagggggttatacctagaagccggagatgtggtcgtccgacaagaagagcgctgcgtgtgtagagatggccgactgcactgtagacaaatccgcctaatcggacaaagctgtaccgcacccaagatccacatggactgttctaacctcacagcgctcgcgacctccaaacctagagctctcagctgtcaaacgctagctgctggttactatcacacagagtgcgtgtccgggtgtgtctgtccagacggccttatggatgatgggcgagggggttgcgtggtggagaaggagtgcccgtgtgtccataacaatgacctttactcaagtggagcgaagatcaaggttgattgcaacacctgcacctgcaagaggggtagatgggtctgcactcaggctgtttgtcatggaacctgcagcatttatggatcgggacactacatcaccttcgacggtaaatactatgatttcgatgggcactgcagttatgtggcggtgcaggattactgtggccagaactccagcctggggagcttcagcatcatcacagagaatgtcccgtgtggaacaacgggcgtgacttgcagcaaagccattaagatcttcatgggcagaaccgagctgaaacttgaggacaagcatagagttgttatccagcgagatgagggccaccacgttgcctacaccactcgggaggttggacaatacctggtggtggagagcagcacgggtatcattgtaatctgggataagaggacaactgtctttataaaactcgcaccaagttacaaggggacagtatgtggactttgcggcaattttgaccataggtcgaataacgacttcactactcgggatcatatggtcgtaagctccgagcttgactttggtaatagctggaaggaagcacccacatgtcccgatgtgagtacaaacccagagccctgcagtctaaatccccaccggcgtagttgggccgaaaaacagtgtagcatcttaaagagtagcgtctttagtatttgccactccaaggttgaccccaagcccttctacgaggcctgtgtgcatgactcatgttcttgcgatacaggcggtgattgcgaatgcttttgcagcgccgtggccagctacgctcaagaatgtaccaaggagggcgcatgtgttttctggcgaactcctgatctgtgtcccatattttgcgactactacaatccaccacacgagtgtgaatggcactacgaaccctgcggaaatcggagttttgagacttgccgaacaatcaatggaatacacagtaacatctctgtgtcatacttggagggctgttatccaaggtgccccaaagatcgaccgatctatgaagaagatcttaagaagtgcgtgacggccgacaagtgcgggtgctatgtggaggatacgcactatcccccaggggcatccgtccctacagaagaaacctgcaagtcctggtgtacatgcacgcagacccacaccgcttatcatgtacatactcacggtaagatccttaaccagacacaggatggcgctttctgttactgggaaatatgtggtccaaatggaaccgtggaaaaacactttaacatctgcagcatcaccacccgaccttctaccctgaccacatttaccactatcaccctgccaacaactcctacaacgttcactaccacaacgaccaccacaacccctacatctagcaccgtcctctccacaacccccaaattgtgctgtttatggtctgactggattaatgaagaccacccctcctctggaagcgatgatggggatagggagacctttgacggagtctgcggggctcccgaggatatcgagtgcaggtctgtaaaagatccccacctctcactggaacagcttggacaaaaggtccaatgtgacgtgtcagtgggattcatctgtaagaacgaggaccagtttgggaatggtcctttcggcttatgctatgactataaaatacgcgttaattgttgctggcctatggataagtgcatcaccacccctagccctcctacgactacaccatctccccctcccaccagcacaacaactttgccacccaccacaacgcccagcccccctaccacaaccacgacaactccccctccgaccacgacgccttctcctccaatcacaaccaccacaacccctccccctactaccacccccagtccacccatctcaaccaccacaactccaccacctacgaccacccctagcccccctacaaccaccccctccccacccaccacaactcctagtcctcccaccaccacaactactaccccgcctccaactactacgccaagccctcctacaactacaccaattacccctccagcttctacgaccactttacctccaacgaccactccgagtccccctactacgactaccaccaccccccctcctacaacaactcctatcaccacaactaccacggtcacccctactccaactcctacaggtacccaaacacctactaccaccccaattacgactacaactactgtcactcccacgccaacccccacagggacgcagactcctacctcaacacctattactaccaccacgactactcctacacccacagccattacaaccactactaccgtcacgccaaccccaacccccactggcacacaaacccctacaaccacacctatcacgaccactacgactgttaccccaaccccaacccccaccggaacccagtcacccactcccacagcgattactactactaccaccgtgacccccactcctacacccacagggacgcaaacccctacatcgacccctattaccactactaccacagttacgcccactcccacacctaccggcacacagacacctactcctacccccatctcaactacaacaacagtgaccccgacacctactcccacagggacccagacaccaaccacaaccccaattacaaccactacaaccgtgacacccactcctacacccacaggaacccagacacctactactacaccaaccccgacaagtacaaaatccacaaccgtgacccccattacgacaactacaaccgtgaccgcaacccctacccctactggaacacagacacccaccatgattcctatctctacgacaactacggtgaccccgta

SEQ ID NO: 231119 - DNA, 1230 bp, Artificial Sequence
  Description of Artificial Sequence: Synthetic coding sequence
gatattgagtgtcgatccgtaaaggatccccacctgtctcttgaacaactcggccagaaggtgcaatgtgatgtgagcgtagggtttatttgtaagaatgaggaccagtttgggaatgggccatttggactttgctatgactacaagatcagagttaattgctgttgcacccctactagaggaaccactacagggtcctctagcgcccctaccccttctaccgtccagactactacaacatccgcgtggacaccaactcctacccctctgagcacaccatcgattataaggacgaccggacttaggccctatcccagcagtgtgcttatctgttgcgttctgaacgacacctattacgcccctggcgaagaagtttacaatggaacctatggcgatacgtgctacttcgtgaactgcagcctcagttgcacgctcgagttttacaactggagttgccccagcactccgagcccaacacccaccccctcaaagagcacaccaactccctccaaaccaagttcgacccctagtaagccaactcccggtactaagcctcctgagtgcccagattttgaccccccacggcaagaaaatgagacgtggtggctgtgtgattgttttatggccacatgtaaatacaataatacggtggaaattgttaaggtggaatgtgagccgccacctatgcctacctgttctaacggcctccaaccagttcgagtggaggatccagacggctgctgctggcattgggaatgcgattgttattgcacggggtggggtgatccacattacgtgacatttgacggcctgtactattcgtaccaagggaattgtacgtacgtgttggtggaggagattagtccttctgtagacaacttcggggtctatatcgacaactatcactgcgatcctaacgataaggtgagttgcccgaggacattaatcgtcaggcatgaaacacaagaagtgctgatcaaaaccgttcacatgatgcccatgcaagttcaagttcaggtcaatcgtcaggcagtggccctgccgtataagaagtatggcttagaggtctaccaaagcggaattaattatgtcgtagacatccccgaactcggcgtactagtatcctataacggactcagttttagcgtgcgtttgccatatcaccggtttggaaataatactaaggggcagtgcggaacatgcactaatacgacgagcgacgactgttag

SEQ ID NO: 231120 - DNA, 8453 bp, Artificial Sequence
  Description of Artificial Sequence: Synthetic coding sequence
atgggcctcccacttgctcgcctggctgcagtttgcctggctctctccctggctggcggaagcgagttacagacggaaggacggactagaaaccacggccacaatgtgtgcagtacctgggggaacttccattacaaaactttcgatggcgacgtgtttcgctttccgggtctgtgtgactataacttcgctagcgattgccgaggcagttataaagagtttgccgtgcacctgaaacgtggccctggtcaggccgaggccccagctggagttgagtctatcttgctgactataaaggacgacaccatctacctgacgcggcatctggctgtactgaacggtgccgtggtctcaactcctcactactccccgggactcctgatcgagaagagcgacgcatacaccaaagtgtactctcgagctggcctcacactgatgtggaacagagaggacgctctgatgctggagctggacaccaaatttcggaatcacacttgtggtttgtgtggagactacaacggccttcagtcctattccgagttcctgtctgatggagtgctcttttcacctctggagttcgggaatatgcagaagataaatcagcctgacgtggtctgtgaagacccagaggaggaggtggccccagctagctgttctgagcaccgcgctgaatgtgaacgactgcttacggcagaggccttcgctgattgccaggatctagttcccctggagccataccttcgggcatgtcagcaagaccgctgccgctgcccgggaggcgatacctgcgtatgcagtactgtggctgagtttagccggcagtgctcacacgccggtggacgcccaggtaactggagaactgcaacactgtgtcccaagacttgcccgggaaacctggtctatcttgagtcgggttctccctgcatggatacatgcagtcacctggaagtgagtagcttatgcgaagaacatcgaatggacgggtgtttctgccctgaagggactgtctatgatgacatcggtgacagtggatgcgtgcctgtcagccagtgtcattgccgtttgcacgggcacctgtatacgcctgggcaggaaatcacaaacgactgcgagcaatgcgtatgcaacgccggtagatgggtatgcaaggacctgccgtgcccgggtacttgcgctctcgaggggggatcacatattactacctttgacggcaagacgtacactttccacggagattgctattatgtgctggcaaagggggaccacaacgattcctatgcgctgctcggtgaattggccccatgcggctccaccgataagcaaacatgtttgaaaacagtcgttcttctagccgacaagaagaaaaatgtggtggtgttcaagtcagacggctccgtgctgctgaacgagctgcaggtgaacctgccacacgtgactgcaagtttcagtgtcttcaggccctcatcctaccacatcatggtttcgatggctattggcgtacggctgcaggtccagctggctcccgtgatgcagttgttcgtgacactcgatcaggcatcccagggtcaggtgcaggggttatgcgggaattttaacggactcgaaggggacgatttcaagaccgcatccggccttgtggaagccacaggggcagggtttgcaaacacatggaaagctcagtcgtcttgccacgataagttggattggttagacgatccttgcagcctgaatattgagtctgcaaactacgcagaacactggtgctccttgctgaagaagaccgagacaccgtttggtcggtgtcacagtgcagtcgatccagccgaatactataaacgatgtaaatacgacacatgtaattgccagaacaacgaagactgtctgtgcgctgccctatcctcatacgccagggcctgtactgcaaagggagtaatgctatgggggtggagagaacacgtatgtaataaggatgtgggcagctgtccaaattcccaagtgtttctctacaacctcacaacctgtcaacagacctgccggagtctgtccgaggctgactcgcactgcctggagggattcgccccagtggacgggtgtggatgtccagaccacacttttctggacgaaaaaggcagatgcgtgcctcttgccaagtgtagctgttatcacaggggtctgtacctggaggccggtgatgtggtggtccggcaagaagagagatgcgtgtgccgtgatggaagacttcactgtcggcaaatacgcctcattggccagtcctgtacagcgccaaaaatccacatggattgctccaatctgaccgctctggcgacaagtaagccacgtgccctgagttgtcagacattagcagccggatactatcacaccgagtgcgttagcggatgtgtctgcccagatggccttatggatgatggcaggggcggttgcgttgtagagaaagagtgcccctgtgtccataacaacgatctttacagctcaggggctaagatcaaggtggattgcaatacttgtacctgcaagcgaggcaggtgggtgtgcacacaggccgtctgccacgggacctgttccatctacggctcgggtcattacatcaccttcgatggcaaatactacgattttgacgggcactgctcctatgtggccgtccaggactactgcggacagaacagctccctgggatcattttctataattactgagaatgtgccatgtgggacaactggagttacctgctctaaggccattaagatcttcatgggacgtaccgagctcaagctcgaggataagcatcgcgttgtaattcaacgggatgagggccatcacgtggcgtacacgactcgcgaggttggtcagtacctggtcgttgagagttctaccggtatcatagtgatttgggataaaaggacgactgtgtttatcaagctcgctccgagttacaagggaacggtatgcggactctgcgggaattttgaccataggtccaacaacgactttaccacccgagatcatatggttgttagctctgaactggattttggaaacagctggaaggaagccccaacatgccccgacgtgtccacaaatcccgagccatgtagcttgaacccgcatcgtcgctcatgggcagagaaacagtgcagcatactgaaaagttcggtgttttccatttgccattccaaggtggatcctaaacctttctatgaagcatgcgtccatgacagctgcagctgtgatactggtggtgattgtgaatgcttctgctctgcagtcgcttcttatgcgcaggagtgcactaaagaaggtgcttgtgtgttctggcggacccctgacttatgcccaattttttgtgactactacaaccctccacacgagtgtgaatggcactacgagccatgtgggaaccgcagctttgaaacatgcaggaccattaacggcatccactccaacatctcagtgtcttacttagaagggtgctaccccaggtgccctaaggaccggcctatctacgaagaagacttgaaaaaatgtgtcaccgctgacaaatgtggatgctacgtagaagatacacactacccacccggagctagcgttcctacagaagaaacctgtaaatcttgtgtgtgtaccaacagcagccaggtggtctgtcgaccggaggaaggaaagatcctgaaccagactcaagacggagcattctgctactgggagatttgtgggccaaacggaacagtagagaagcatttcaatatctgcagtattactacccggccttccacactgacaacattcaccacaatcactctgcccaccactccaaccacattcaccacaaccacgactacaactacccctacatctagcaccgttctgtccacgacccctaagctgtgctgtctatggtcagactggatcaacgaggatcatccgtcaagcggatccgacgacggtgatcgcgagacgttcgatggggtgtgcggtgctccagaagacatagagtgcaggtccgtcaaggacccccatcttagtctggagcaattaggccagaaggtacagtgcgatgtgagcgttgggttcatttgcaaaaatgaagatcagtttgggaatggccctttcggcttgtgctacgactacaagattagagttaactgctgttggcctatggataaatgcatcacaacccctagccccccaacgactacaccttcacctccacccaccagcaccactactctccccccaacaacaactccttcccccccaactactacaacaacaactccccctcccactacaactccttccccccctattaccaccaccacaactccacctccaactacgacccctagcccacctatcagcacaactactacgccacccccaaccactactccttcacctccgactaccacacctagcccacctacaaccactccaagcccccctacgaccaccacaactacaccccctcctaccacaaccccgtccccgccaaccactacccctattacccccccagctagcacaacaacgttgcccccaacaaccacaccttcccccccaactacgaccaccaccacaccccctcccacaactactcctatcaccactactacaactgtgaccccgaccccgactccgactgggacccaaacccccactactactcctatcaccacaaccactacggtgacacccactccaacccccacaggaactcagacccctacctctacaccaattaccacaacgacgaccgtgacccctaccccaacaccaaccggtacccagacgcctacaactaccccaatcactaccactacaacagtgaccccaacccccactcccactggcacacagacgccaaccccaactgcgatcactactaccactacagttacccccacaccaacccctaccgggacccagacacctaccaccacacctataaccacgaccaccacagtaaccccgaccccaacacccaccggcacccagtcacccactccgactgcaatcaccaccaccaccacagtgacgcccacccctacccccaccggaacccagactcctacgagtacccctatcacgacaacaacgacagtgacgccaacacctacaccaaccggcacgcagactcctacccctacgcctatttcaacaaccaccaccgtgacccctacaccgactcctaccggaacccagaccccaacaaccactccaataaccacaaccacaacggtcacgcccactcccacacccacggggacgcagacccccacaaccgtacttattacaacaacaacgaccatgacccccacgccaacaccaacgtccacaaagagtacaactgttaccccaattaccaccactacaaccgtgacggcgactcccacccctaccgggacgcagacacctacaatgataccaatttctacaaccaccacggttacgccgactcctacacctaccacaggctctacagggcctcctacccatacaagtacagcccctatcgcagaactaacaacatcaaatcccccaccggaaagtagtaccccacagacttccagaagcactagttccccgctaacagagtctaccaccctgctgagcactttgcccccagcaattgagatgactagtacagccccaccctctacgcccaccgccccaacaactacctctggtggtcacaccctttctccaccaccctcaactacaactagccctcccggaacccctacgagaggaaccacgacggggtccagttccgctcccactccatcaacagtgcagactactacaacatctgcttggacccccacaccaacccccctgtcaactccatcgatcatacgcacaacggggcttaggccatatcctagcagcgtccttatctgttgcgtgctgaatgacacctattacgcaccgggtgaggaggtttataatgggacctacggtgatacgtgctactttgttaactgctcactgagctgcacgctcgagttttataattggagttgcccttctacaccctctccgaccccaactccttcaaaatccactcccacaccctcaaaaccctcatcaaccccctcaaagcccaccccagggactaagccccctgagtgtccggatttcgacccacccaggcaggagaacgaaacatggtggctctgtgactgctttatggcgacatgtaagtataacaatacagtagaaatcgtgaaagtagaatgtgagccaccccctatgccaacttgctccaacggattacaaccagtgcgggtcgaggaccccgacggatgttgctggcattgggaatgtgactgttattgcacaggttggggcgatccacattacgtgacatttgatggactgtattattcctaccagggcaactgcacctacgtgctggtcgaggagatcagccccagcgtcgacaacttcggcgtgtatattgacaactatcactgtgaccccaatgataaggtgtcttgtcctaggacgctcatcgtccggcatgagacacaagaagtgctaataaagactgttcatatgatgccaatgcaggtgcaggttcaggtgaacagacaggctgtcgcattgccctacaaaaagtacggactcgaagtatatcagagcggcattaactatgttgtagatattcccgaactgggcgtactggtgagttataacgggctatccttcagtgtacggttgccttatcatagattcggaaacaacacaaaaggtcagtgcggcacgtgtacgaatactactagtgatgattgcatccttccttccggtgagatcgtgtctaattgtgaggcagcagccgatcaatggctagttaacgatccgtcaaaaccgcattgcccacacagtagcagcaccacgaaacggccagcagtgactgtccccggtggtggaaaaaccaccccacataaggactgcactccgtcccctttatgtcaacttatcaaagacagtctattcgcacagtgtcacgcattggtgccacctcaacactattacgacgcctgtgtgtttgatagttgctttatgccaggatctagtctggagtgcgcttcactgcaagcctatgcggctctatgcgcccagcagaacatttgcctggactggcgcaatcatactcatggagcttgcttagtcgagtgcccaagtcatcgcgaatatcaggcttgtggcccagctgaagagcccacatgtaaatcatcctcctctcagcagaacaacacagtgttagtcgagggatgtttttgccctgaggggaccatgaattacgcccctggtttcgatgtgtgtgtgaagacctgtggctgtgttggccctgataatgtgccacgcgagtttggagagcattttgaatttgattgtaagaattgcgtgtgtttggaaggaggctctggaattatctgccagcccaaacgatgctcgcagaaaccagttacacattgtgtcgaagatggcacttatcttgctactgaggtcaaccctgctgatacgtgttgtaacatcactgtgtgcaagtgtaatacctccctctgcaaagagaaaccatctgtgtgtcccttgggatttgaagtgaagtctaaaatggtccccggacggtgctgccctttctactggtgcgagtcaaaaggcgtctgcgtgcatgggaacgccgagtatcaacccggatcaccagtttactcctccaaatgccaggattgcgtatgcaccgataaggttgataacaacaccctgctcaatgttattgcttgtacccatgtgccttgcaacacatcctgctcaccaggcttcgagctgatggaagccccaggtgagtgctgcaaaaaatgtgagcagacccactgtatcatcaagaggcccgacaaccagcacgtaatcctcaagccaggcgatttcaagtctgaccctaagaacaattgtaccttcttctcatgcgtgaaaattcataatcagcttatttcctctgtgagcaatattacctgccctaattttgatgctagtatctgtattcctggctcaattaccttcatgccaaatggctgctgcaagacgtgcactccgcgtaacgaaacacgtgttccatgcagtacagtgccagttaccaccgaagtatcatacgcgggatgcacaaaaaccgtattgatgaaccattgctccggcagctgcggtacttttgtgatgtatagcgctaaggcccaagccctggaccactcctgtagctgctgcaaggaggagaagacatctcagagagaggtggtgctgtcttgtcctaatggtggcagtttaacgcacacttacacgcacatcgagagctgtcaatgccaggatacagtgtgtgggttgccaacagggacatctaggagagcgcgaagaagtccgaggcacctggggtctggcta

SEQ ID NO: 231121 - DNA, 2631 bp, Artificial Sequence
  Description of Artificial Sequence: Synthetic coding sequence
atctatagtactgtgtcgacctctaccactgccattacgtcccactttaccacttccgaaacggccgtgacccccactccagtgacccccagttcattaagcactgacattccaacaactagtctgagaaccttgacaccaagtagcgttggaacaagtacatcgctgacaaccaccaccgatttcccaagcatccctactgacattagcacactgcccacaagaacacatattatctcttctagcccaagcattcagagcactgaaaccagctccctggtcggcaccacatcccctactatgtccaccgtgaggatgacattaagaatcacagagaacacgcccatatctagtttctctacctcaatcgtagtcatccctgagacaccgactcagactcctccggtactgacgagcgcgaccggaacacaaacaagcccagcccctactacagtgacctttggaagtaccgatagttcgaccagcaccttgcacacccttaccccgtcaacagctttgtctactatagtttcaacttctcaggtgccaatccctagtacacactcgagcaccttacagaccactccgtcgacgccttccctgcagacctcattgactagtaccagtgagttcacaaccgagtcatttaccaggggctcaaccagtaccaatgcaatcctgacctcgttttcaacgattatttggtcttcaacaccgactatcatcatgtcctcatctccatccagcgcttcaatcacccctgtgttcagcacaacaattcactcggtaccatcctccccatatattttttctacagagaatgttgggtctgcctcgattacgggcttccctagcctttcttcatctgctactacgagtacgagttccacatcctctagtttaactactgctctcaccgaaataaccccattcagctatatttcactgccatctaccactccatgtccaggcactatcacaataacaatcgttcccgcttccccgaccgacccatgtgtggaaatggacccgagtaccgaagcaacctcaccccctactacgcccctcaccgtgttcccatttacaactgaaatggtcacctgtccaacatccatcagcattcagaccaccctgactacttacatggatacctcctcaatgatgcctgagtcagagtcatctatcagccctaacgcttcttcctccactggaactggaactgtgccgaccaacactgtttttactagcacccgattaccgacctcggagacgtggctaagcaatagctctgtaatccctcttcccttaccaggggtgagtaccattccccttacgatgaagccgagttcttcacttcccactattctgaggacctcttccaagagcacacacccatctcccccaaccacacgcactagcgaaacccccgttgctacaacccagacacccacaaccctgacctcccggcgaactactaggatcacgtcacaaatgactacacagtctactctcacaacaactgcaggaacctgtgacaacggcggaacatgggagcagggacagtgtgcttgcctgccgggattctcaggcgaccgctgtcaactgcagacaaggtgccagaacggaggacagtgggatggcctgaaatgccaatgtcctagcaccttctatggtagttcatgcgagtttgccgtagaacaggtcgatctggacgtggttgagactgaggttgggatggaagtgagtgttgatcagcagttttccccagacctcaatgataatacgtctcaggcctatcgcgatttcaacaagactttctggaaccagatgcaaaaaattttcgccgacatgcaggggtttacatttaaaggagtggaaattctgtcgctgcgtaacggaagtattgtcgtcgactacctcgtgctgctcgagatgcctttcagcccgcagctcgagtccgagtatgagcaagtaaagaccactctgaaagaagggctccaaaacgcctcacaagatgccaactcctgccaggactcccagaccctgtgtttcaagcccgattccatcaaggtcaacaataatagcaagaccgagctgacaccagaagcaatttgtagacgtgctgctccaacgggttacgaagagttttattttcctctagtagaagccacccggctgaggtgcgtgacaaaatgtacaagtggggtcgacaacgccattgactgtcatcaagggcagtgcgtgttggaaacatcaggacctgcctgcagatgctatagtaccgatactcattggttttctggtccccgttgtgaggtcgcagtgcactggcgtgcgctggtcggcggtttgaccgcgggtgctgccctgctggtcctcctactgctggccctgggcgtcagagccgtgagatctgggtggtggggaggtcagcgacgcggaagaagttgggatcaggacagaaagtggtttgagacctgggacgaggaagtggtggggactttcagcaactggggcttcgaggatgacggaacagacaaagacaccaatttccacgtcgccctggaaaacgttgacactactatgaaggtgcacattaaacggcctgagatgacaagctcatccgtatag

SEQ ID NO: 231122 - DNA, 927 bp, Artificial Sequence
  Description of Artificial Sequence: Synthetic coding sequence
tgcgacaatggagggacttgggagcagggacagtgtgcgtgcttacccggtttcagtggcgaccgctgccaactgcagacacggtgccaaaacggaggccagtgggacggtctcaaatgccagtgcccaagcactttttatggtagtagctgcgagttcgcggtcgaacaggtggacttggatgtcgtggagacagaggtcggaatggaagtatcagtcgatcagcagttcagtcctgatctaaacgacaatacctcccaggcttatcgcgactttaataagacattctggaaccaaatgcagaaaatctttgccgacatgcaaggattcacattcaaaggggtcgagatattgtcccttaggaatggatccattgtggtcgattacctggttctcctggagatgccattttctccccagctcgagagtgagtatgagcaagtgaagaccaccctgaaggagggactgcaaaacgcctcacaggacgccaactcctgccaagattcacagacactgtgcttcaagcccgatagtattaaggtcaacaacaactctaagaccgagttaactccagaagccatttgtcgtagggcggctccaactggttacgaagagttctactttccactggtggaggcaactcgcctcagatgtgtcaccaagtgcacttctggcgtggataatgcaattgattgccaccaaggacagtgcgtgctggaaacctccggccctgcttgtcgctcctgggaccaggaccgtaaatggtttgagacctgggatgaggaggtcgtgggaacgttcagtaactggggcttcgaagatgacggaactgacaaagatactaatttccacgtggcccttgagaacgtggataccaccatgaaggtgcacattaaaaggccagagatgaccagcagctctgtgtag

SEQ ID NO: 231123 - DNA, 3531 bp, Artificial Sequence
  Description of Artificial Sequence: Synthetic coding sequence
atgaagggcgcacgctggcgaagggtgccctgggtgtccttgtcctgtctgtgtctgtgcctcctgccccacgtggtgccaggcatgacaacaccgagccttaaaaccgatgggggtcgcagaaccgcaacttcccctcctcccacaacttctcagactattatctctacgataccgtctaccgcgatgcacacaagatctacagccgcacctatacctatcctgcccgaacgtggtgtgtcactgtttccatacggagcgggagccggtgaccttgagttcgtgcgcagaaccgtcgactttacctcgcctttgtttaagcccgctactggcttccccctcggcagttccctgcgcgactcgctgtatttcacagacaacggtcagatcattttccctgagtccgactatcaaatcttttcttatccaaatcccctgcccaccggctttacaggccgtgatcccgttgccctcgtggccccattctgggacgacgccgacttttctaccggacggggtactacgttctaccaggagtacgaaactttctacggggagcacagcttgttggttcagcaggccgagtcgtggatccgcaaaatgacaaacaacgggggatataaggctcgctgggcccttaaggttacctgggtgaatgcacacgcctacccggctcagtggacgctggggagcaatacatatcaggcgatcctaagcacagatggaagccgctcctatgctctgttcctgtatcagtctggaggaatgcagtgggatgttgctcagagatcaggtaatcctgtcctgatggggttctcctctggcgacggctatttcgagaatagcccactcatgagccagcctgtgtgggagaggtacagacccgataggttcctcaatagtaactctggactgcagggcctgcaattctaccgactccacagagaggaacgacctaactataggttagaatgcctgcagtggctgaaatcacagccacgctggccgagttggggatggaatcaagtgtcgtgcccttgctcatggcagcaggggcgacgcgacctccgatttcagccggtatctatcggaagatggggcctagggtctcgccagctgtgctcttttacaagctggagaggtggagtctgctgctcctacgggccatggggcgaattcagggagggatggcatgtgcagagaccctggcagcttgctcaggagctcgaaccccagagctggtgttgtcgatggaacgacaagccctacttgtgcgccctttatcagcagaggaggcctcatgtaggctgcgccacatatcggcctcctcagcctgcttggatgtttggagatcctcacatcaccacgctggatggcgttagttataccttcaacggcctcggtgacttcctgctggtgggagcccaagacggaaattcttctttcctcctacagggacgtaccgcccaaacaggctcagctcaagcaactaactttatcgcttttgccgctcaatatagatctagttcccttggtcccgtgaccgtgcagtggttgctagagccccatgatgccattagggtgctgctggacaatcaaacagtgaccttccagccggaccacgaagatggcggaggccaggaaacattcaatgctacgggtgtactcctgagccggaacggaagcgaggtcagcgcctcctttgacggctgggccaccgtgagcgtcatcgcactgtccaatattctgcatgccagcgccagcttgcctcctgagtaccagaacagaaccgagggactgctaggagtttggaacaacaaccccgaggacgattttaggatgcctaacggcagtactatcccaccagggagtcctgaagagatgctctttcattttggaatgacatggcagattaatggcacaggcctgctgggaaaacggaacgaccagctgccatctaacttcactcctgttttttacagccagttgcaaaaaaatagtagctgggctgaacacctcattagcaactgcgacggggactcctcctgcatctatgatacgctggccctgcgaaatgctagtattgggctgcacaccagggaggtgagcaagaactacgagcaggccaatgcgacactcaaccagtatccgccatcaattaatggaggacgcgtgatcgaagcctacaagggacagactacactgatacagtacaccagcaatgccgaggacgcaaacttcaccctgagagatagttgtaccgatctagagttgttcgagaacggtactctcctctggacgccaaaaagcctggaacccttcactcttgaaattctagcacggtctgccaagatcggcctagcttctgccctgcagcctaggacagtggtgtgccactgcaatgcagaatcccagtgtctctacaaccagacgtccagagtaggaaactccagtctggaggtggctgggtgcaagtgcgatggaggcactttcggccgatactgtgaggggagtgaagatgcctgcgaggagccctgttttcctagtgttcactgcgtgccaggaaagggttgcgaagcgtgccctcccaatctcactggcgatggccgtcattgtgctgccctcggctcctcttttctgtgccaaaaccagagctgtcccgtgaactactgttacaaccagggccattgctacatttcgcagacactgggatgtcaacccatgtgtacctgccccccagctttcaccgactcccgatgctttcttgcaggaaataacttctccccaacggttaacctcgaactgcccttacgtgttatccagttgctgctttccgaagaggaaaatgcatctatggccgaggtgaacgcttccgtcgcatatagattgggcaccttggacatgcgggcattcctgcgaaactctcaagtagaacgtattgattcggccgcacccgctagcggaagtccaattcagcactggatggtgataagcgagtttcagtatagacctcggggtcccgttatagactttctgaacaaccagttgctggccgctgtagtcgaggctttcctgtatcatgtcccacgcagatccgaagagccacgtaatgatgtcgtgtttcagccaatctcaggagaggatgtaagagatgtgaccgcgctgaacgtgagtacactcaaagcttactttcgctgcgatgggtataaaggatatgatttagtgtactcccctcaatccgggttcacctgcgtctcgccctgcagccgcggttactgcgatcatgggggacagtgccaacacctcccctctggaccccgatgcagttgtgtttccttttccatttacactgcctggggggagcactgtgagcacctgagcatgaagttagatgccttctttgggattttctttggggcactggggggactgctgctgctcggtgtcgggacgtttgtggtattacgattctgggggtgcagtggagctcggttcagctactttctgaatagcgcagaagctctgccttag

SEQ ID NO: 231124 - DNA, 3378 bp, Artificial Sequence
  Description of Artificial Sequence: Synthetic coding sequence
atgaagggtgcccgttggcggcgtgtgccctgggtgtctctcagctgcctctgcctgtgcttgctcccccacgtggttcccggagtttcactgttcccttatggagccggagccggtgatctggaattcgtcagacggacagtcgactttactagccccttgttcaaacctgcgactggattccctctgggcagctcactccgagacagcctctacttcacagataacggccaaatcatcttccctgaaagcgactaccaaatatttagttaccccaatccgctgcctacgggctttactggtagggatcccgtcgctttggtggccccattttgggacgatgctgacttcagcaccggacgcggaaccaccttctaccaggagtatgagaccttctatggcgagcactcactgctcgtacagcaagccgaaagttggattcgtaagatgacgaacaatggaggttacaaagccaggtgggctctgaaggttacatgggtaaatgcgcatgcctaccccgctcagtggaccctcggcagtaacacatatcaggcaatcctctcgactgatggatccaggagttacgccctctttctgtatcagtcaggcggtatgcagtgggacgtcgcccagcggtcgggcaacccagttcttatggggttctcgagtggggacgggtattttgagaactccccactgatgagccagcctgtatgggaacgctaccggcctgatcgatttttgaactcaaacagtggcctgcagggtctccaattctatcgacttcacagagaagaacgacctaattacagattagaatgtctgcagtggctgaaaagccagccacgatggcccagctggggctggaatcaggtcagttgtccttgtagctggcagcaggggagaagagatttgcgctttcaacccgtgtccatagggagatgggggctcggctcccgacaactgtgctctttcactagttggcgaggtggtgtgtgttgcagctacgggccttggggcgagtttagagagggctggcacgtgcagaggccatggcagctggcccaggagctggagccgcagagctggtgctgtcggtggaatgataagccctacttgtgcgccctgtatcaacagcggcgtccacacgttggctgcgccacctatcgacctccccaacctgcatggatgttcggggatccccacataactacattggatggggtgagttatacatttaatggactgggagacttcctcctggttggcgcacaggatggaaactccagtttcttgctgcagggacggaccgcccagactggaagtgcccaggccacaaacttcatagcttttgccgctcagtaccgatcctcttctctgggtccagttacagtgcagtggctgttggaacctcacgatgcgattcgggtcctattagacaaccagactgtaacgtttcagcctgatcatgaggacgggggagggcaagagacttttaatgccacgggagtactgctttctagaaatgggagcgaagtgagcgcatcatttgacggatgggcgaccgtgtcagtgatcgccctgagtaacatactccatgcaagcgcgtccctgccacccgaatatcagaatcgtacagagggcctgctgggtgtgtggaacaataatccagaagacgacttcagaatgcccaatgggagcaccattcctcctgggtcccctgaagaaatgttatttcatttcggcatgacatggcagatcaacgggaccgggctacttggaaaacgtaatgaccagcttccgtctaattttactcccgtgttttattcacagctccagaaaaactcatcatgggctgagcacttaattagcaattgcgacggagattcttcatgcatctacgatacgctggctttacggaatgccagcatcggccttcacacaagggaagtatccaaaaactacgaacaggccaatgctactctcaaccagtaccccccaagtatcaacggtgggagagttatcgaagcctacaaaggccagaccacactgattcagtacacctcgaatgccgaggacgcgaacttcaccctcagagatagttgcacggatctggagctcttcgagaatggtactttactctggacccccaagagtctcgagccattcacactggaaatactggccagatcggccaagattggcctggcctccgcgctccaacctcgtaccgtcgtctgccattgcaacgccgagtcccagtgcctctacaaccagacgtctagagtcggcaattcttccctggaggtggccggttgcaaatgcgatgggggaacgttcgggcgttattgcgagggaagcgaagacgcatgtgaagagccttgtttcccatccgtgcactgtgtcccaggtaaggggtgtgaggcttgtcctcccaatctcactggcgacgggcgtcattgcgctgcccttggctcttcctttctctgtcagaaccaatcctgccctgtcaattactgttacaaccaggggcattgttacattagccaaaccctgggttgtcagcccatgtgcacctgcccaccggcatttacagatagccgatgctttcttgcaggcaataacttcagtccgactgtcaacctagaacttcctctacgggtcattcagctccttttgagtgaagaggagaacgcttccatggccgaagttaatgcatccgtagcctaccgcctcggaaccctggacatgcgtgctttcctgagaaatagtcaagtggagcgcatagacagcgccgctcccgcttccggatcaccaattcagcactggatggttatcagcgaattccaataccggccaaggggaccagtgatagacttcctgaacaatcaattactggcagctgtggtggaggcgtttctctaccacgtacccagacgaagcgaagagccaagaaatgacgtggtgttccaacctatctccggcgaagacgtgcgagatgtgactgccctgaacgtgagcacactcaaggcctattttcggtgcgacggttacaaaggctacgatttggtctatagcccccagagtggcttcacatgtgtctccccctgtagccggggttactgtgaccacggagggcaatgtcagcacctgccgtccgggccacggtgcagttgcgtgtctttcagtatatatacagcatggggggagcactgcgagcacttatccatgaagctggatgctttcttcggcatcttctttggggctctgggcggattgcttcttctgggggtaggcacctttgtggttctgagattctggggatgctccggggctcggttcagctacttcttgaactcggcggaggccctcccatag

SEQ ID NO: 231125 - DNA, 5739 bp, Artificial Sequence
  Description of Artificial Sequence: Synthetic coding sequence
cctgggaccactgaggacaccttgatcacaggatctaagactgcggctcccgtgacatctactggttctacaacagctaccctggagggtcagtctacagcagcttcctcgcgaacctcaaaccaggacatcagcgcctcttcacagaatcaccagacaaagagtactgaaactactagtaaggcccaaactgatacactgactcaaatgatgacatccactctttttagtagcccaagcgtgcacaacgtgatggagaccgcacctcccgatgaaatgaccacgtcattcccctcatcagtcactaacacattaatgatgacatctaaaacgattacaatgactaccagcacggacagcacccttggaaatacggaagaaacatcaaccgctgggaccgaaagcagcacaccagtcactagtgcggtgtccatcactgctggccaggaaggacagtcgaggaccacatcctggaggacttctatccaggacacaagcgcctcatctcagaatcactggaccaggtcgacccaaactactcgggagtcccagacctctacccttactcataggacaactagtaccccatcgttttcccccagcgtgcataacgtgaccggaacagtcagccagaagaccagtccgtccggggagaccgccacctcatcattatgctcagtaaccaataccagcatgatgacctccgagaagatcaccgtcaccacatccactggcagtacactaggtaatcccggagagacctccagtgtgcccgtaacgggctccttgatgccagtaactagcgccgcactggtgaccttcgatcctgagggccagtcgccagcgactttttctcgcactagcacacaagacactactgccttttctaagaaccaccagacacagtcagtggaaacgacaagagtgagccagattaataccctgaacacgcttacaccagttactacatccaccgtgttgtcgtccccatctggcttcaacccttctggtacggtgtcacaggagacctttccatcgggcgaaaccaccacgagcagcccaagctctgtttccaatacattcctcgttaccagcaaggttttccgtatgcctacatctagagattccactctgggaaacacggaagagaccagcctgtcggtgtcaggaaccatcagcgccatcacttcgaaggtttctaccatatggtggagcgacactctttccactgctctctccccctcttccctgccacctaagatcagcaccgcttttcacacacaacagagtgagggagctgaaaccacgggaagaccacacgagaggagttcattctcccccggagtgagtcaggagatcttcactctccatgagacaacaacctggcccagttcattttcttcgaagggtcatacaacctggtcccagactgagctcccaagcacatcaacgggggcagccacgcgcctggtaacaggcaatccctccacaggcacggcgggtaccatacctcgagtacccagcaaggtgtcagccattggagaacctggggaacccaccacttactctagccattctacaaccctgcccaagactactggcgctggcgctcaaacacagtggacacaggaaaccggaacaaccggggaggccctgttgtcctccccttcctattccgtgacccagatgattaagactgcaacatctccatctagctcacccatgcttgacaggcataccagtcagcaaattaccactgccccaagtacaaatcacagtaccatccatagtacaagcacgtcaccacaggaaagtccggctgtatcccagagaggtcatacccaagctccgcagactacgcaggaatcccagacaactcgctcggtctcaccaatgaccgataccaaaacggtgacaaccccaggtagtagctttaccgcttcgggccacagtccttcggagattgttccgcaggacgctcctaccatttctgccgcaaccactttcgcgcctgcaccgaccggtgatggacatacaacccaagctcccaccacagctctccaggctgcgcctagctctcacgacgctactctggggccatctggtggtactagcttatctaaaactggggctcttactttggccaattcggtggtgtccacccccggaggaccagaaggccagtggacctccgcctccgcaagtacatctcccgacaccgctgccgctatgacacacacacaccaagctgaaagcactgaggcatccgggcagacgcagacaagtgagccagcttctagtgggtccaggacaactagtgctggcacagccactcctagctcttcaggagcctccggtaccacaccctccggcagcgaggggatcagtacatcaggggagactactcgattcagctccaacccgtctagggactcacacaccacacaaagcacaaccgagctgcttagtgcaagcgccagccacggagccatccccgtaagtacaggaatggcctcttccatcgtgccaggcacctttcaccctacactgtccgaagcttctacggcgggtagacccacaggacaaagttcaccaacctcacccagtgctagccctcaggagacagctgccatcagccgcatggcccagacccagaggacccggacgtctcgaggctccgataccatctctctggctagccaggccacggacacattcagtaccgttcctcccacaccccctagcattacgtctaccggcctgacgagtccccagaccgaaacccacactctgagcccatcgggaagcggaaaaacgttcacaaccgctttgatcagcaatgctaccccattaccagtgacctatgccagctccgcgagcacgggacacgcgactccacttgccgtttctagtgctacctccgcttcaaccgtgagttcagacagccctttaaagatggagactcctgggatgaccactccatctctcaagaccgatggcggtcgcagaaccgccacctctccacccccaactacctcacagactataatctcaacgatcccaagcacggccatgcacacgagaagtaccgccgctcccattcccatactgcccgaaaggggggtaagcctctttccatatggagccggagcaggggacctcgagttcgtcaggaggaccgtggactttacgtcccctctcttcaagcccgctacagggttcccactgggatcaagcctgcgggactccctttatttcacagacaacggccagatcattttcccggagtccgattaccagatcttttcctaccccaaccctctgcctacagggtttaccggtcgggacccagtcgccttagttgcccctttctgggatgacgcagatttctctactgggagagggacaacattttaccaggagtacgaaactttttacggagaacacagcctcttagtgcagcaggctgaatcatggatcaggaagatgacaaataacgggggatacaaagccaggtgggcgctgaaggtgacctgggtaaacgctcacgcatatcctgcccagtggacattgggtagcaacacgtatcaagcgatactgagcactgacgggtctcgttcctatgcgctgtttttatatcagtcaggaggcatgcaatgggacgtcgcccaaaggtccggcaatccagtgctgatgggcttcagttccggcgatggatatttcgagaattctcctcttatgagccagcccgtgtgggagcgatacaggccagatcggttcctgaacagcaacagtggtctgcaagggctacagttctacaggctccaccgcgaggagcgtcctaattatagattggagtgcttgcaatggttaaagtcccaacctagatggccatcgtgggggtggaatcaggtttcatgcccctgttcatggcagcagggaaggagagatctcagattccagcccgcatcccttccaccagagtatcagaaccgaaccgaggggctgcttggcgtgtggaacaataatccagaggatgatttcaggatgcccaacggctccaccatccctccgggaagcccggaagagatgctgttccattttggcatgacctggcagattaacggcaccggactgcttgggaaacgcaatgatcaactaccgagcaattttacccccgtgttttacagtcagttgcaaaaaaattccagctgggcggagcacctgattagcaattgtgacggggactcatcctgtatatacgatacactcgcgctcaggaatgccagcataggcctccacaccagggaggtgtccaagaactacgaacaagcgaacgctactctcaaccaatacccaccatccatcaatggcggaagagtaatcgaagcctacaagggtcagaccactctgatacagtacacatctaacgccgaggatgctaattttacactcagggactcttgtacagatctcgagttgttcgagaacgggactctcctgtggactcctaagagcctggagccctttacactcgagattttggcccgttccgctaagatcggattagcttcggccctccaaccacgaaccgttgtctgtcattgtaacgctgagagccagtgcctgtataaccagacatccagagtggggaatagctccctggaagtggcaggctgcaagtgtgacggcggaacttttgggaggtattgcgaaggttccgaagacgcctgtgaagaaccctgttttccaagtgtgcattgcgtgcctggtaagggatgcgaagcatgcccaccgaacctcacaggagacggcagacattgtgccgctctgggtagtagctttctgtgccagaatcagtcttgccccgttaattactgctataaccagggccactgctacatctcccagactctgggctgccagcctatgtgtacctgcccacccgcatttaccgactcgaggtgtttcttagcgggaaataatttttcacctacagtgaacctggagctgcctttgcgcgtgatccagttgctgttgtcggaggaggagaacgcatcaatggccgaggtgaacgcctccgtagcgtaccggctcggcactttggatatgagagccttcctgaggaattcccaggtggagcgtatcgactcggcggctcccgcttctggatcccctattcagcattggatggtcattagcgaatttcaatatcgccctaggggcccagtgatcgattttctgaacaatcagttactcgctgcagtggtggaagccttcttataccacgtgccgcgtcgatcagaagagcctagaaacgatgtcgtatttcaacctatttccggagaggatgtgagagacgtaactgccctgaatgtaagtaccctgaaggcctattttcgctgcgatggatataaggggtatgacctggtttacagcccccagagtggcttcacttgtgtgtccccttgctctcggggttactgcgaccacggtggacagtgccagcacctgccttcaggcccacggtgctcatgtgtcagcttctctatttatactgcctggggggagcattgcgagcacttgagcatgaaattagacgccttcttcggaatcttcttcggcgcactggggggactcttactgctcggcgttggaacattcgtcgtcttaaggttctggggctgctcaggcgctagattttcatattttttgaacagtgctgaggcgctgccgtac

SEQ ID NO: 231126 - DNA, 16239 bp, Artificial Sequence
  Description of Artificial Sequence: Synthetic coding sequence
atgaaaggtgcccgatggcggagggtcccttgggttagcctctcctgtctgtgtttatgtttacttccacatgtcgtgcctggcaccacagaggatacactgatcactgggtctaaaactgcagccccagtcacttcgacggggtccacgaccgctactcttgagggccagtctaccgccgctagcagccgaacctctaatcaggacatctcagcctcatcccagaatcatcagactaagagtaccgaaactaccagcaaggcacagaccgataccctgacacaaatgatgacgagcaccctattctctagtccctccgttcacaacgttatggaaacagctcccccagacgaaatgaccacaagttttcctagctctgttacgaacactttgatgatgaccagcaaaacaatcacaatgacaacatcaacagattctaccttgggtaatacagaggagacttcgaccgcagggaccgagagctcaacaccagtcaccagtgccgtaagtattacagccggacaggaaggccaatctaggactacatcctggagaacttcaatccaagatacctccgcatcaagccagaaccactggacccgcagcactcaaacaacccgcgaatcccaaacatctaccctcactcatcggaccacatcaaccccaagcttcagcccttccgtccacaacgtaacgggcacagtcagccagaagacctcgccctccggcgaaaccgctacctcctccctttgttcagtgaccaatacaagcatgatgacaagcgaaaagattaccgtgaccacctctaccgggtctacattaggtaatcccggagaaacatccagcgtgcccgttaccggttctctgatgccagtgacatcagcagcccttgtgacttttgacccggagggacagtcccccgcaacattcagccgcacttctactcaagacactactgcattctcgaaaaaccatcaaacccagagcgtggaaacaactcgcgtgagccagattaacaccctcaataccctcaccccagtgactacaagcactgtgctgagttctccgagcggattcaacccaagtggtacagtctcccaagaaacctttccttcgggcgaaaccaccacctcctctccaagctcggtgagcaacacctttctggtgaccagcaaagtgttccggatgccgacatcccgggacagcaccttaggaaacacagaagaaacgagcctctccgtgtcaggaacaatatctgcaattacatccaaggtgagcaccatctggtggagcgatactctgagcaccgctttatctccaagctccctgcccccaaaaatctccaccgcctttcacacccagcaaagcgagggggcagaaactactgggcgaccacacgaacgctcctccttctctccaggcgtgagtcaggaaatcttcactcttcacgagaccaccacttggccgtcttcgttctcctccaagggacacaccacctggtcacagacagagctcccctccacgagtacgggagccgcaaccagactggtaaccggcaacccttccacaggaaccgcgggaactatacctcgggtgccctcaaaagtttcggcaatcggggaacctggggaacctacgacttactcctcacactccacaactctccccaaaacaacaggggcaggagcgcaaacacaatggacacaggagacaggtaccactggagaagccttgctgtcgtccccaagttacagcgttactcagatgataaagaccgcaacctcaccatcttctagccctatgctggaccggcacaccagtcaacaaatcaccaccgccccttccaccaaccactcaacgattcatagcacatccacaagcccacaggagtcgcctgccgtgtcacagagagggcacacacaagcacctcagacaacacaggagagccagacaacccggagcgtatccccaatgactgacaccaagaccgtgacaacccccggatccagctttactgccagcggccatagtcctagcgagattgtacctcaggatgcccctaccatcagcgcggcaaccacgttcgccccagcgcctactggcgacgggcataccacgcaggctccaaccactgcgctacaggctgcaccctccagccacgatgctaccctaggtccttccggtggaacaagtctttctaagaccggcgcactcaccttagcaaattccgtggtgagcacgcccggagggcctgaagggcagtggaccagcgcctctgcctcaactagccctgacacagccgcagctatgactcatacccaccaggcagagagcaccgaagctagcgggcagacgcagactagcgaacccgcatcctctggcagcaggacaactagcgccggaactgccacaccgagtagctcaggcgcatcgggaactaccccgtcaggttcagaagggatttctacatcgggcgaaacaacacggttcagctcaaacccttcacgtgatagccacactacccagtccaccaccgaactgctcagcgccagcgcaagccacggcgctatacccgttagtaccggcatggcctcgtccatcgttccaggtacctttcacccaactctgtcagaggcatccaccgccggtcggcctacaggccaatcgagcccaacttctccaagcgcatccccacaggagacggctgctatttcgagaatggcacagacgcagcgaacccgaaccagccggggttcggacacgatctccctagcaagtcaggcaaccgataccttttctacagtacctcccacacctccatcaatcacctccacgggcttgacatcgcctcagacagaaacgcatacactctcacctagtgggtccggaaaaacctttactactgcgctcatctccaatgctacccctctccctgttacttatgcctcttctgcgagtacaggtcacacaacacccctccacgtcacagacgcctctagcgtctcaacaggacacgccactcctcttcctgtaacgtctcctagctctgtgagtactggccacacaaccccacttccagttacagacaccagttctgagagcaccggtcacgtgactcccctaccggtcaccagcttcagctcggcctcgacaggcgattcgacaccacttccagtgaccgatacaagttcagcgtctaccggacacgtcaccccccttcctgtcacttcactaagtagtgcatctaccggtgacaccactcctctgcccgtcacagacacgtcctcagcttccaccggacatgccacctccctgccggtgactgatacttcaagcgtctctacaggacacaccacaccactgcccgtgacggatacgtccagcgcgtccactgggcatgccacatccctgccagtcacggacacaagctctgtgtccaccggtcatacaaccccgctgcatgtgaccgacgccagcagcgcctctacagggcaggcaacccctcttccagtcacctctctatcttccgtgtctaccggtgacactacacccctgccggtgacttccccgtcgtcagcttccacagggcacgctactcctctgctcgtgaccgacacatctagtgcctcaaccgggcatgctacacctctcccagtgaccgatgcttcgagcgtaagcacagatcacgccacttcactccctgtgacaattccctccgcggcttccactgggcataccaccccccttcctgttaccgacaccagttctgcctcaaccggtcaagccacctccctgctggtaactgacacaagttccgtgagcactggggacacaacgccgttgcccgtcacatctacatcttcagcctccacggggcacgtaacacctctgcacgtgacctctcccagctctgcctccacagggcatgccacacctttgcccgtcaccagtctgtcaagcgcctctaccggggatacgatgcctctcccagtgacgtctcctagttcagccagcactggggacaccacacccctccccgtgacggacgcctcatctgtttcaacagggcacaccacacccctccacgtgacagacgcctcctccgcttcaacaggccaagctacaccattgccagtgacttcactcagctccgtgtccaccggcgacaccactccattaccagtgacctccccatcctcagctagcacaggacacgccactcctctcctggtgacagacaccagctctgcctcaacggggcatgcgacccccctccccgtgacagacgcctcatccgtatcgacagaccatgccacatctttaccagtgactattccttccgcagcctccacagggcatactacgcctctccccgtgactgacacctcctccgcgagcaccggccaggccacctcacttttagtgaccgatactagttccgtgtccaccggggacaccacccctctccctgttacaagcacatctagtgcgtccaccgggcacgttacccccctccacgtcacctctccatcatcagcaagtaccgggcacgcgacccccctccctgtaacttccctatcaagcgcaagtacaggcgacacaatgcctctgcccgttacaagtccaagcagcgcttctaccggagacaccacgccactgcccgtaaccgatgcatcttccgtgtctacaggccacacaacccccctgcctgtgacttctccatccagcgcgtcaactggccacacaacacccctgcctgtgacagatacttcaagcgcctctaaaggcgatacaacccctcttcccgtcacctcaccgtcttccgctagcaccggccacaccacccctctacccgtaacagatacaagcagtgcttcgacaggagacacaacacctctaccagtgaccaatgcttcaagcctttcaactgggcacgctacccccctgcatgtgactagtccgtcttcagcgagcaccgggcatgcgacccctctgcccgttacaagtacatcttccgcttctactggacacgccacaccactgcctgtgaccggcctgagctcagccaccacagatgatacaaccaggctacccgtgactgatgtcagctcagccagtaccggtcaggcaacccctctacctgtgacatcacttagcagtgtctcaaccggtgacacaacccccctgcccgtcacttcccccagctctgcttcaacaggccatgcaagtcctctgctggtgacggatgcaagcagtgcaagcacaggccaggcgactccgctgcccgttaccgacactagcagtgtgagtaccgcccacgctactccccttcccgttacaggtttgagttccgctagtactgatgacacgacaaggctgccggtgaccgacgtgagttctgcctccacgggccaggccattccattgcctgtaacttcgccctcctctgcctctaccggcgacacgacccctctacctgttacagatgcatcctctgcgtccacaggcgacaccacttctctacccgttacaatcccttcgtccgcaagttcaggtcatacaacatccttacctgtaactgacgcgagtagtgtgtccactggtcacgcaacgagtctccttgtaacagatgcctcttccgtgtcaaccggggataccacccctcttcccgtcacagacacgaacagcgcctccacgggggatacgaccccactgcacgtcacggatgcgagctctgtctccacgggccatgccaccagcctcccagttacatcgctttcatccgcaagcaccggtgacaccactccactgccagtaacctcacccagctcagcctcatccgggcacactacacccctcccagtcacagacgcgagctctgtcccaacgggacacgccaccagtcttccagtcaccgacgcctcttcagtgtctacggggcacgcaacacctctgccagtcacagatgcatccagcgtcagcactgggcatgctaccccactgcccgtaactgatacaagttcagtgagcaccggacaagccaccccactgcccgttacctcattgagttcagccagcactggagataccacccccctgccggtgacggacactagttcagcttctacaggacaagatacccccctgcccgttacctctctgtcctccgtgagcactggagatactactcccctccccgtgactaatccctcgtcagccagtacggggcacgccactccactcctggtgacagatgcttccagtataagcacggggcacgccacatctttattggtaactgatgctagctctgtgtctaccgggcacgccaccgccctgcacgatactgacgccagctccctctccaccggtgatacgacgcctttgcctgtgacaagtccaagctcaacgtcgacaggcgatacaacacccctcccagtgactgagacctccagtgtgtctaccgggcatgcaacatctttaccggttaccgacacaagttctgcatctactggccacgccacaagcctgcctgtcacagacacatccagtgcatcaactgggcacgccacccccctgcctgttactgatacaagctcagcaagcacaggacaggctacgcccctgccggtgacgagccccagcagtgcatctactggacacgcgatccccctgcttgtcaccgatacgtcatctgcctcaactggccaggccactccattgccagtgacgtctctttcatcggcctccactggggacactacccctttaccggtgacagatgcctctagcgtgagtacaggtcatgccacatcgcttcccgttaccagcctatctagcgtatccactggcgatactactcctctgcctgtgacgagtccctctagtgcgtcaactggccacgccacccctcttcatgtcaccgatgcaagcagcgcttccacagggcacgctacgcccttgccagtcacgtccctttcttcggcatcaaccggagatactactcccttaccagttacctctcccagttctgcctcaacaggtcacgcgacacctttgcatgtgactgacgcttcaagcgtgtccacaggggataccactcctttgcctgtgaccagctccagtagtgcctccagcggacacactacgccactgcccgtcacagatgcttcatctgcaagcaccggcgacacgacgcccctgcctgtgacagataccagctcagcctccacaggacatgccacccatctccctgttactggcttgtcttctgcctcgaccggggacactactaggctgcctgttactaatgtttcatctgccagcacagggcatgcaaccccccttcctgtgaccagtactagcagcgcttctaccggcgacaccacaccgctacccggaaccgatacttcctcagtgtctacgggtcacactactccacttctcgtgacagacgcctcctcagtctccacaggtgacaccacccggctgcctgtgacatccccatcatctgctagcaccgggcataccactccacttccggtgacagataccccaagcgcttccaccggcgacaccacacctctcccagtcactaatgccagtagcctttctacaagacatgccacaagcctgcacgtgactagtccttcttcggcatccaccggacatgctacgagtctcccagtcaccgacacctccgctgctagcaccggccatgctacacctctccccgtcacatcaacttcttcagcctcgaccggcgacaccactcctctgcccgtgaccgacacatactccgcgtccaccggccaagccaccccactgccggttacatcgctgtcctctgtgtctacaggggacacaaccccattgccggttacttctccaagctccgcttctactggacacgccacacccctcctcgttaccgacgcaagttctgcctctaccggtcaggctacaccactgcctgtcacctcactgtcctcagttagtaccggggataccacgcccctgcccgtgacaagcccttcttcggcttcaacggggcatgccacctccttaccggttacagataccagttccgcatccacaggggacaccactagcctacctgtgactgataccagttcagcgtataccggtgataccactagcctgcccgttaccgacacctcgtcttcctccacaggggatacaaccccactcctggttaccgaaacgagctccgtgtccacaggggataccactcccctgcccgtgaccgacacatcttccgccagcaccggacatgccacccctttgccagtgaccaatactagttcagtctcaaccgggcacgcaacccccctgcacgttacaagcccatccagcgcttctactggccacacgactccccttcctgtcaccgacgcctcttcagtgagtacaggacatgccacctcacttcccgtgactgacgcctcgagcgtgttcaccggacacgcgaccagtttacccgtcacgatcccatcatctgctagttccggccatacaacccccctgcccgtgaccgatgcctcttccgtcagcacagggcacgccacatcactgccggtgaccgacgcttcctccgtatcaaccggacatgcaacaccactgccagtgacagacgcttccagtgtgtcaacaggccatgcaacaccgcttccattgacctctctctctagcgtgtcaaccggagatacgactcctctgcccgtaacagacacaagctcagccagcacagggcaggcaacacctctgcctgtgactagtctgagctcagtatcgactggcgatacgacaccactaccggtgaccgacaccagctctgcctccactgggcatgcaacatctttgccagtgacagatacctcatccgcctctaccgggcatgccacgccgcttccagacaccgacacctccagtgcaagtacaggacacgccacactcttgccagtgactgacacttccagcgcctccataggccacgcgacatctctgccagtgaccgacacatccagcatttccacaggccacgccacccccctgcacgtaacatctccttccagtgcatctaccggacatgccacacccctgcctgtcaccgatacatctagtgctagcaccggccacgccaatcccctccatgtaacatcgcctagcagtgctagtactggccatgccacacccctccctgtgacagatactagttcggcctccaccggtcacgctactcccctgccggtcactagtctatcaagtgtgagcaccggagatacaacaccccttcctgtcacctctccttcatcggcaagcactgggcacacaacacccttgcccgtgaccgacacttcttctgcctcaacaggacaagccaccgcactgcctgtcaccagcacatctagcgcaagtacaggcgacacaacaccgctgcccgttactgatacctcctctgccagcaccggacaggcaacgcccttgccggtaacctcgctgtcctccgttagcactggcgacaccacccctctccctgtgaccagtccatcaagcgcttctaccggacatgccactcccctgctggtgaccgacgcatcttctgcttcgaccggccaggccactcccttgccagtgactagcttatcatctgtttcgaccggggacacaacgcctcttcccgtgaccagtccctccagcgcaagcacagggcacgctaccagtctgccagtgactgacacaagcagcgcaagcacgggggatacaacctcactgccagtcaccgacacgtcttccgcatacaccggggacacaacctccctgccggtgacagatacctcatcatcatccaccggagacaccacgcctctgctggtgacagagacatcctccgtctcaacggggcacgcaacccctctgctagttacagatgccagcagtgctagcaccggtcacgccacacctcttcacgtgacatctcctagctccgccagcacgggagacactacccccgttcccgttacagacacttccagtgtgagcactggccatgcaacccctttgcccgttaccgggctgtccagcgccagtacgggagacaccactagactgcccgtgacagatataagctccgccagcacaggtcaagccaccccgctccccgtgaccaatacatcctccgtgtctaccggggatacaatgccgctgcccgtcacctcacccagttccgccagcacagggcacgcgacccccctgccagtgacctctacctctagcgcgagtacggggcacgccaccccagtgcccgtgacttccacctcctcagcttcgacaggacacacaactccattacccgtgacagatactagctccgcgtctacaggggacacaaccccactgcctgtcactagcccgagttccgcctccactggacacaccactcctcttcacgttacaatcccctccagcgccagtactggggacacctccacccttccagttacaggtgcatccagtgccagtacgggacatgccacccccctccctgttacagatacatccagcgtcagtactgggcacgctacaccgcttccagttacctcattgagcagcgtctccactggtgacactactcctctgcctgtgactgatgcttcaagcgcatcaactggccaggctaccccacttccggtgacaagtctatccagcgtcagcaccggagatacaactcccctgctggtcacagatgcttcatccgttagcactggacacgccacccctctgcctgtgacagatactagctcagcctccaccggagataccactcggctccccgtgacagacacaagttccgcctctacaggccaggccactcccctaccagtcacctcactgagctcggtatctactggggataccacacctttattggtgacagacgcgagtagtgtctccaccggacacgccacacccttacctgtgaccgatactagctccgctagcacaggagacacaactcgactccccgtgaccgacacttccagtgcaagcaccgggcaggctacgcccctgcctgtgacaattccatcttcttctagcagcgggcatactactcccctcccagttacttccacctctagcgtgagtacagggcatgtgacaccgctgcatgttacatccccgtctagcgcctcgactgggcacgtcactcctttgcccgtgacatccacgtcctccgcatccaccggccacgccactccattactcgttaccgatgcgtcctctgtttctacagggcatgccacccccttacctgtgacagacgcttcatccgccagcactggcgacacaacgcctctgccagttaccgacacttcctccgcaagcactggccaggctaccccactccccgtgacttctctcagtagtgtctctacaggcgacactactccccttcctgtgactgatgcttcttcagcttccactgggcatgctactcccctgccagttaccattcctagcagtgtaagtacgggcgacacgatgcctttacccgtgacatcccccagtagcgccagcacagggcacgcaacgccattgccagttacaggcctctccagtgctagcactggcgatactacgcccctccctgttactgacactagttctgcctcaaccaggcacgctacacctttgcccgtgacagacactagctcggcctctacggatgacacgaccagactgccagtaactgacgtatcttccgcttccacgggtcacgctacccctctcccagtgactagtacatcctcagcctccacaggggacactactcccctgcctgttactgacacttcatctgtctccaccggacacgccacatcacttccagtgacctctcgatcttccgcaagtacagggcatgcgacaccactacctgtgactgatacaagctcggtttctactggccacgccacacctctgcctgtgaccagcacctcaagcgtatccaccggtcacgccacccccttgcctgtgacctctcctagcagcgctagtaccggacatgctacgccggtcccagtgactagtaccagctcagcctccacaggtgacactacccctctaccagtgacaaatgctagctcacttagcaccgggcacgccacacctttgcacgtgacatctccctccagcgcctcgcggggagatacctccaccttgcccgttacagatgcctcctcggcatctacaggacacgcaacacctctaccactgaccagcctgtcctccgtgtcaactggcgataccacacctttacccgtgactgacacttcctcagcgtccacggggcaagctacacctctcccagtaactagtttatcttccgtgtcaaccggagatacgactcccttaccagtgactattccatcatctgcctcaagcggacatacaaccagcttacctgtgaccgacgcttcatccgtctccaccgggcatggaacccccctccctgtgacttccacctcaagcgcttccactggcgataccacaccactacccgtcactgacacttctagcgcctctactggccacgccacacctttaccagtgaccgacacatcctcagctagcaccggacatgccacacccctgcccgtcactagcctgtctagcgtttcaacggggcacgccacacctttagctgtgagctctgccacaagcgcctcaactgtgagttctgatagtcctttgaaaatggaaaccccgggtatgaccacacccagccttaagactgatgggggaaggaggaccgctacgagtccaccgcctacaacctcccaaaccataatctcaactatcccaagcaccgctatgcacacacgtagcacagcggctcctatccctattcttcctgagcgaggggtttctctcttcccttatggcgcaggagctggagatcttgaatttgtgcgtaggaccgttgacttcacctcacctctattcaagcctgccacaggcttccccttggggtccagtttgcgcgattccctgtacttcaccgataacggccagataatcttccccgagagcgactaccaaattttcagctatccaaacccactaccaacgggatttactggtagagacccagtggcactggttgctcccttctgggatgatgccgacttctcgaccggcagggggaccacattttaccaggaatatgagacattttacggtgaacactcactgttggtacagcaggccgaatcgtggattaggaaaatgaccaacaatggcggatacaaagctaggtgggccctcaaggtcacctgggtaaatgcacacgcgtaccctgcccaatggaccttggggtctaacacctaccaggccatcctctcaaccgatggctctcgctcctacgcactgtttctgtaccaatccggcggaatgcagtgggatgtggcacaacgatctggcaatcccgtgttgatgggcttctcatccggggatgggtattttgaaaatagcccactgatgagccagccggtgtgggaacggtacagaccagacaggtttctcaattcaaactccggattgcagggtctccaattctatcggctgcatcgtgaggaacggcctaactaccgccttgaatgtctccagtggctgaaaagtcaaccaaggtggccgtcatggggctggaaccaagttagctgcccatgtagttggcagcaaggaagaagggacttacggtttcagcccgtgagcattgggcgatggggactcggttcccgtcaattgtgttcctttacctcttggaggggcggtgtttgctgctcttatggcccttggggtgaattccgagagggctggcacgttcagcgaccttggcagctcgcacaagagctggaaccccagagctggtgctgccgttggaatgataagccctacctctgcgctctgtaccaacagagaagaccccacgtgggctgtgccacttaccggccaccacagcctgcttggatgttcggagacccacacatcacaacactggatggcgtgagttatacttttaacggcctcggcgattttcttcttgttggagcccaggacggcaattcctcttttttattacaaggcagaactgcccaaactggctctgcccaggcgacgaatttcattgcttttgctgcacagtaccggtcgtcctctctggggcctgtaactgtccagtggcttctggaacctcatgacgccatccgggttttattggacaaccaaacagtcacttttcagcctgatcatgaggacggaggcggacaagagaccttcaatgctaccggtgtcctgctgagcaggaatggatcagaagttagcgccagctttgacggatgggccactgtgagcgtgatcgctttgtcaaacattctgcacgcttccgccagcttacccccagaatatcagaaccggacggagggccttctgggtgtctggaataacaatcccgaagacgatttcaggatgccaaatgggtcgaccatacctcctggctccccggaggaaatgctgtttcactttggcatgacctggcagatcaacggcacaggcttgctcggaaagcgtaatgaccagctcccctctaacttcacaccagttttctacagccaactgcaaaagaattccagctgggcagagcacttaattagcaattgcgatggggatagctcatgtatttacgacacacttgccttaaggaacgcctccataggtcttcatactcgagaggtcagtaagaactatgagcaggccaacgccaccctgaaccaataccctccctccatcaatgggggtcgagtgattgaagcttacaaggggcagactaccctcattcagtacacgtccaatgctgaagatgctaactttaccttgcgagacagttgtaccgatctcgaactttttgagaatggcaccctactctggacacccaagtcccttgagccatttacactggaaatcctcgcgaggtccgccaagataggtctggctagtgcattgcaaccacggactgtagtgtgtcattgcaatgccgagagtcaatgcttgtacaatcagacatcacgggtcggaaattctagcctggaggtcgccggttgtaagtgcgacggaggcactttcgggcgttattgtgagggcagcgaggatgcctgcgaagagccgtgcttcccgtctgtgcactgcgttcctggcaaagggtgtgaagcgtgtccgccaaatctcaccggagacggtagacactgtgcagcgttaggttcatcatttttgtgtcagaaccagtcttgtccggtgaactactgttataatcagggccactgttatatttcccagacactgggttgtcagccaatgtgtacctgccccccagcctttacagactcccgttgcttcctggctggaaataatttcagcccaaccgtgaatcttgagcttccattaagggtgatccagctgctcctttccgaagaagagaacgcctctatggccgaagtgaatgcctctgtagcttaccgtctggggaccctcgatatgcgggcattcttacgcaattctcaggtggaacgaatagacagcgccgctccagctagcggatcgcccatccaacactggatggttatctctgaattccaataccgcccaagaggccctgttatcgatttcttgaataatcaactgctcgcggcagttgtggaggcgttcctttatcacgtgcctagaaggagtgaggaacctagaaacgacgtggtcttccagcccattagcggagaggatgtgcgggacgtgactgcactgaatgtgtcgacattgaaggcctacttcagatgtgacgggtacaagggctacgacctcgtttactccccacagtccgggttcacctgcgtgtccccctgttcgagaggctactgtgaccacggcggacaatgtcagcacttgcctagcggcccacgctgcagctgtgttagcttcagcatttacactgcctggggcgagcactgcgagcatctttcaatgaaactggatgccttctttggaatcttcttcggcgctctgggaggtctcttgttactgggcgtaggaaccttcgtggttctgcgcttttggggctgttcgggagctcgattcagctacttcctgaactcggcggaggctttaccctag

SEQ ID NO: 231127 - DNA, 16083 bp, Artificial Sequence
  Description of Artificial Sequence: Synthetic coding sequence
atgaagggcgctcggtggcggagggtgccttgggtgtccctctcttgtctctgcctgtgtttgctcccacacgttgtgccgggtacaactgaggataccttgatcactgggtctaaaacagccgctcctgtgacgtccactgggagtactaccgccactctcgaagggcaatccaccgctgcgagctcccggacctccaaccaggacattagtgcctcttcgcagaatcaccagaccaaaagtactgagacgacctcaaaggcccagactgatacgctcactcaaatgatgacaagtactctgtttagcagcccgagcgtgcacaacgtgatggaaacagcccctcctgacgagatgacaacgagcttccccagctctgtaaccaataccctcatgatgaccagcaagaccattacaatgacgaccagcaccgatagtactctggggaatactgaggaaactagcacagcagggactgagtcctccacccccgttacaagcgcagtatccattacagcaggccaggaaggccagagcagaaccacatcttggcgaacttcaatccaggacacgtcagcctcctcccagaaccactggacccgctcgacccaaaccacacgcgagagtcaaacctccactcttacccatcggacaacctcaactccctccttcagcccatccgtacacaatgtgaccggaacggtcagtcagaagacgagtccatccggcgagacagcaacctcaagcctctgttcagtaacaaacacatcaatgatgacatccgaaaagattacagtgacgacttccacagggtcaacactcggcaaccctggggagactagttctgtcccagtgacgggatccttgatgcccgtgacgtctgccgcactcgtgacctttgatccagagggccaatcacctgcgacattcagtaggaccagtacacaggacacaaccgccttttctaagaatcaccagacacaaagtgtggaaacgacaagagtgtcgcaaattaacaccctgaacaccctcacaccggtgacaacgtccacagtgctgagtagcccttccggcttcaacccaagcggcactgtttctcaggaaacctttccaagcggagaaacaaccacatctagtccctcctccgtgtcaaacacattcctcgtgaccagtaaggtgttccggatgcctacatctagggacagcaccctcgggaatacggaagagacgagcctgtctgtaagcgggaccatatccgcaataaccagcaaagtgtctacaatttggtggtctgatactctgtcaaccgctctgtccccatccagtctcccgccaaagattagcaccgcattccacactcagcagtccgaaggggctgagacaacaggaagaccacacgagaggtcatctttctctcccggtgtgtctcaggagatattcacactccacgagaccacaacatggccatcatcgttcagctcaaaggggcacaccacctggagtcaaacagaactaccgtccacttccaccggtgccgctacccggctggtgaccggtaatccttccacaggtacagccggaactatccctcgagtcccatctaaggtgagtgccataggcgagcctggcgaaccgaccacttatagctcccattctacgacgctcccaaagaccacgggcgcaggggcacaaactcagtggactcaggagacaggaactacaggtgaagctcttctgtccagtccttcttactctgtaacgcagatgataaagactgcgacttctcctagcagctctcctatgttggaccggcatacatctcagcaaatcacgactgcgccttcaaccaatcattcaaccatccactcaacaagcaccagtccgcaagagtctcccgctgtgagtcagagggggcatacgcaagctccccagactacccaggaatctcagacaactaggagcgtatctcccatgaccgacacaaaaacagtgaccaccccaggctcatccttcacagcatccggacattcaccaagtgagatagtgccccaggatgcgcctacgattagcgctgccactaccttcgcaccggctccaaccggcgacggtcatactacgcaggcaccaaccaccgctctgcaggctgcccctagttctcatgacgccacccttggcccatccggcggtacgagcttgtccaaaaccggagcactgaccctggcgaatagtgttgtaagcacgcccggaggcccagaaggacagtggaccagcgccagcgccagcacttcccccgacaccgcagcggcaatgacccacacacaccaagccgaaagcacagaagccagtgggcagacccagaccagcgagccagcctcatctggctctaggactacctccgccggaacagcaaccccgtccagttctggggcatctggaaccacaccttcaggtagcgaaggaatcagcacctccggcgagacaaccagattttcctctaacccgtcgcgtgactcccacactacccagagcactaccgagttactttccgcaagcgcttctcacggtgctattcccgttagcacaggtatggcatcatccatcgtgccaggaacgtttcatcctacacttagcgaagccagtaccgctgggaggcccacagggcaatcaagccctacctctccctccgccagtccccaggagaccgcggcaatcagcaggatggcccagacccagagaactcgaacatctcgcggatcagacactatcagcctggctagtcaagcaactgacaccttttccaccgtgcctccaacaccacccagtatcacaagcactggccttaccagcccacagacggaaacccatacactgtccccgtctggcagtggaaaaacttttaccacggcccttattagtaatgccactccactgcccgtcacgtacgccagttctgcttcaacgggccataccacccccttgcacgtgacagatgcatcttctgtgtccactgggcatgccacccctctccccgtgacatccccgtctagtgtgagtacggggcacaccactcccctgccggttaccgatacctcatcagagtccaccggacacgtgaccccgctgcccgtgactagtttcagttcggcgtcaacgggagactccacaccactgcctgtgactgatacctcatcagcaagtaccggccacgtgactcctctcccggtaactagcctaagctcagccagcaccggcgatacgacacctctgcctgtgaccgatacctcatccgccagcaccggccacgccacaagcctgccggtcactgatacatcatccgtcagtaccggacatactactcccctcccagtgacagatactagcagtgcctctacaggccacgctacctcactgccagtaactgatacttcatctgtgagcaccggccacaccactcccctacacgtcaccgatgcttcatcagcctccaccggccaggctacccccttacccgtgacgtcacttagctctgtctcaaccggtgacacaactcctctccctgtgaccagcccttcttcagcttcaactggtcatgccacacccttgctcgttacggacacatccagcgcaagtacaggccacgccactccactccccgtaacagacgccagttccgtttctacggatcacgctacgtccctcccggtgaccattcctagcgccgcaagtacaggacacacgacacccctccccgttacagatacatccagcgcgtcaactggtcaggctaccagcttgctggttaccgatactagctccgtgagcaccggcgatactacacccctgcccgtaacctccacttcgtctgcaagtaccggacatgtgacccctttacacgtgacttctccaagcagtgccagtacaggccatgcaacaccgttgcctgttacgagcctctcatctgcttccactggtgatactatgcctctgccagtcactagtccgtcaagcgcaagtactggcgataccacgccattgcccgtgacagacgcatccagcgtaagcacgggccatacgacaccccttcacgttaccgacgcctcctcagcaagcaccggacaggctacaccccttccagtgactagcctatcctctgtctctaccggagacactacccctctgcccgtcacctccccctcatctgccagtacagggcatgcaacgcccctgctggtcacagatacaagctccgcttccactggccacgccacacccctgcccgtgaccgatgcgtcatctgtttcgaccgatcacgccacttctctccccgtgacaatccctagcgccgcatccacaggacacacaactccattgcctgttactgacactagttccgcgagtacaggccaggccaccagcctcttggtcactgatacctcatcagtttctaccggggacaccacgccgctgcctgtgacgtcaacaagcagcgcttccacaggccatgttactcctctacatgtgacatctcccagttccgcttctactggccacgctacgcccctgcccgtgacttccctgtcatcggcatcaactggagataccatgcccctgcccgtgacatccccaagctcggcctcaaccggtgataccacccccctgcctgtgaccgatgcctcctctgttagtacggggcacactactcctctgccggtgaccagcccttccagtgcttcaaccggccacactactccactgcctgtcacagacacttcctccgcctccaaaggagataccactccactgcccgttacatcccccagctccgcttctaccggacatacaacacccctgccagtcaccgacacaagtagcgcgtctaccggagacaccacaccactgcctgtgactaacgcctcttcgctctcgacagggcacgcaacacccttgcatgttaccagcccgagctccgctagcaccggacatgctacccccctgccagttacttcaacttcctctgcctcaaccgggcacgctacccctttgcccgtgacgggcctgagctctgcgaccaccgacgataccacacggctccctgtcaccgatgtgtctagcgcgagcaccggacaagccacacccctgcctgtaacaagcctgtcatccgtgtcaaccggagacactactccacttccggtgaccagccccagctcagcctccaccggccacgcttctccactcctagtgacagatgcttctagcgccagcaccggccaggccacaccgctcccagtcacggatacatcaagcgtgagcaccgcccacgctaccccattgcctgtgacaggcctctcttcagcatcaacagatgataccacccgtctgcctgtcaccgacgtgtcatccgccagcacgggccaggctattccactccctgtaacatcccctagtagcgctagtacaggcgacacaacccccttgcctgtgacagatgcgtctagtgctagtacaggagacaccacgtctctgccagtaacgatacctagttcggcctcatccggacacaccacatcgctgcccgtcaccgacgcatcgagtgtgagtaccggccatgccaccagccttctggtaacagacgcctcttccgtgtccaccggagacaccactccactgccggtaacagataccaactccgctagcaccggggacacaacgcctctccatgtgacggacgctagcagcgtttccacaggccacgctacctccttgcccgtcacttcgttgtctagcgcctctactggcgacacaactccactgccggtcacaagcccatcctcagcaagctccggccacaccacaccactgcccgtaacagacgcctctagtgtcccaacaggacatgcaacgtctctacccgtgacagacgcctcaagtgtgagcacgggccacgccacacctctgccagtcactgatgcttcatcggtcagcaccggccacgccacccccctccccgtgacagatacttcctcggtaagcaccggtcaggccacccctctcccggtaacctcccttagcagcgcgtcaaccggagataccaccccgttgcctgttactgacacgagctctgctagtactggtcaggatactccgctcccggtgacgtcgctatcctcagtgtcaaccggcgacaccaccccactccccgtgactaacccgtcttccgccagtaccggacacgccaccccattgcttgttacagacgcctccagtatctcaaccggccacgccacttcactcctggttacggacgcatcctccgtctccaccggccatgccactgcactgcacgacactgatgcctctagtctgagcacaggcgacacaacccccctgcctgtaacaagcccatcctcaacctccaccggcgataccactcccctgcccgtgaccgagacctcatcagtgagcaccggtcacgctaccagcctgcccgtgaccgacacctcaagtgcatcaaccggacatgcgacttctttgcctgtgaccgatacatccagtgcctccacagggcatgcaacgccgttaccagtgaccgacactagtagcgcttccacaggccaagccaccccgctccccgtaacatcccccagtagtgcctccactggccacgccattccacttctggtaaccgatacaagcagcgctagcaccgggcaggctactccattacccgtcaccagcttatcatctgcctctactggagatacgacgccgctgccggtgaccgacgcatcttcggtatcaacggggcacgcaacctcattgcctgtcacatctttaagctccgtgtcgacgggggacaccacaccattgcccgtcacatccccctcctctgccagtaccggtcatgccaccccactgcatgtgactgatgcttccagtgccagtactggacatgccaccccactccccgttacgtctctttcatcagcctcgactggcgacaccacccctttgcctgttacgtccccgagcagcgcgtccacgggccacgccacaccgctccacgtaaccgacgcatccagcgttagtacaggagataccacccccttgcccgtcacatcctcgagcagcgcttctagtggtcatacaacgccactccccgtgactgatgccagttcagccagcaccggggacacaacccctctgcccgttacagacacaagctccgcaagcaccgggcatgccacccacctccctgttactggtctgtcatctgccagcaccggggataccacgcgacttcccgtgactaatgtatcgagtgccagcaccggtcacgcaacacccttgcctgtgacgagtaccagttccgccagtactggcgataccactcccttaccaggaacagatacctccagtgtcagtaccggccataccacccctctgctcgtgaccgatgcctcatcagtctctactggggacactaccaggctccctgtgacttctccctcctccgcttcgacaggccacacaaccccactacccgtgaccgacaccccatctgctagcacaggggacacgacgccactgccggttacgaacgcatctagtctttctacgcgacacgccaccagcctccatgtgacgagcccttcctctgccagcacgggtcatgcaacttccctgccagtgaccgacactagtgctgcttccaccggccacgccacaccgctgcccgttacatctacaagctctgcctcaacgggagacaccacgccactgcccgtgacggacacttactccgcaagtaccgggcaggctactccactacctgttacgtcgctttcttctgtgtcaacgggcgacaccacccccttaccagtaaccagccctagttccgccagcaccggccatgcaactccactcttggttactgacgcctcatcagccagcactggccaggccaccccattgcctgtgacatctttaagttccgtctccaccggagacacaaccccgttgcccgtgactagtccctcctcagcatcaaccggtcacgccacatcactacccgtaaccgacacctcgagtgctagcacgggagataccactagcctcccagttacggataccagctctgcctacacaggcgacactacctccctgcccgtcacagatacaagcagcagcagtacgggtgatacaacacctctgttggttactgagactagcagtgtcagtaccggcgatactacgccactgcctgttaccgatacctcgtcggcgtctaccggtcatgccacacccttgccggtgaccaatacatctagtgtctcaaccgggcatgccacacctctccacgtcacatctccttcatctgccagcacgggacacaccaccccgttgcctgtaaccgacgcctcttccgtgtcaacaggacacgctacttccttgcctgtgaccgacgcttcctccgtttttaccggccacgcaacctctctgcccgtgacaattccgagttcggcatcctctgggcacaccacccccctccccgttaccgacgccagctctgtgtctacaggacacgcgacctcgctgcctgtcaccgatgcgagtagtgtaagtacaggccatgcaactcctctaccagtcaccgatgcttcttccgtgtccaccggccacgccaccccactgcccctgacctctctaagctcagtgtccaccggagatacgacccccctgcccgtcactgatacaagctccgcatcaacaggtcaagctacccccctccctgtgacaagcctctccagcgtgagtaccggcgatacaacgcccctgccagtgacggacacatcgtccgcttccaccggacacgcgaccagcctgccagtaactgatacgagctccgcttcaacaggccacgccactcctttacctgacactgataccagcagcgcttccactggtcatgcgaccctgctgcctgtcactgacacctcctctgcatccatcgggcacgcaactagcctcccagtcacagacacatcttcgatatctacagggcatgccacacccctgcatgtgactagcccatcatccgcatccaccggtcatgcaacacccctgcccgtcaccgatacgtccagcgctagtaccggccacgctaatcccttgcatgtcactagtccttcatctgcgagcaccggacacgcaacacctctgccggtgacggataccagcagcgcgtccacaggacacgctactcctctccccgtgacaagtctaagttccgttagtaccggcgataccacaccactgcctgttacttccccttcctctgcaagtaccggccacaccactccacttcccgtcaccgatacttctagcgcatcgaccggtcaagccaccgccctaccagtgacgagcacgagctccgcctcaaccggtgacacaacacccttgccagtcactgatacctcaagcgccagcacgggacaggccacgcccctgcctgttacgtcattgtcttccgtgtctactggcgacaccacacctttgcccgtgacaagcccctcctcagcttcgaccggccacgcgacacccctgctggtaaccgatgcttcgtcggctagtacaggccaagccacgcccctgcctgtgactagcctgtcaagcgtgtctacaggcgacactacgccactacctgtgacctccccttcatcggcctccacggggcatgcaacgtccctccctgtgacagacaccagtagcgcctccactggtgatacaacaagtctcccagttactgacacctcgagtgcatataccggggacacaacatccctgccagtcactgataccagttcttcctctaccggggataccacaccactgctagttacagagactagctctgtgtctactgggcacgccacgccacttctggttacagatgcgtcctcagcctcaactggtcacgctacgccactgcacgtgacatccccatcaagcgcctcgaccggcgataccaccccagttccagtcactgacacgtcttccgtaagtacgggacacgctactcctctacctgtgacggggctctcttccgcctctactggggataccacccgcttacctgtgacagacatcagctccgcttctacgggtcaagcaacgcccctgcccgtaaccaataccagtagtgtgagtaccggcgacacaatgccgttaccagtaacctcacccagttctgccagtaccggccatgctacacccctgcctgtgacaagcacaagcagtgcttcaacgggacacgctactccagtccccgtgacatctactagctctgcctcaaccggacatactaccccattgccagtcactgatacatccagtgcgagtacgggcgacactacacccttgccggtcacctccccaagtagcgccagcacaggtcacactaccccactgcacgtgacaatccccagcagcgccagcacaggtgatacttccacacttccagtgacgggcgctagctccgcaagcacggggcacgccacccctcttccagtaactgacactagcagcgtatctaccggccatgctacaccgctccctgtcacgtccctgagttctgtgagtactggggacaccacaccactgcccgtgactgacgcctcctccgcttccactggccaagccactccactgcctgtgacttcactgagcagcgtgtcaacaggggatacaacccccctgctggtcaccgatgcctcatccgtatccacgggccacgcaacccctctccctgttaccgatacgagctctgcctctactggagacacgaccagactgccagtgacggacacaagcagtgcttccacaggccaggctacgccactgcccgtgacatctctgtccagtgtgagcaccggcgatacaactccactgttggtcaccgacgcctcttctgtgagcactggtcatgcgacaccactgccagtgactgacacttccagcgcaagcaccggagacacgacacgactgccagttacggacacctcttccgcaagtacaggccaggcgacaccactgcctgtgacgatccctagcagttcaagtagtggacatactactcctctccccgttacatccacatcaagtgtctctaccggccatgtcactcctctgcacgttacctctccctcctctgcaagcactggccatgtgacccccctccccgtgacctcgacaagcagtgcttctacgggtcatgccacacccttactggtgaccgacgcaagttccgtgtcgaccgggcacgccactcccctgcccgtgaccgacgccagtagcgcatccacaggagacacaaccccactccctgtcacagacacatcatcagcatctacaggccaagccacaccgttgccagtgaccagtctgagttccgtgagtaccggagacaccaccccgttgcccgtgaccgacgccagcagcgctagcactggtcatgcaacaccattgcctgtgactattcctagctcagtctcaacaggcgacacaatgcctctgccagtgacatctccaagctccgccagcacggggcatgctacccccctgcctgtgaccggcctatcctctgcctccacaggggacacgacacctctccccgttaccgacactagctcggcatccacccggcacgccacacccctgcctgtgactgacacaagctccgcctctacggatgacacaacaagactccccgtaacggatgtttcatccgcaagcaccgggcatgccactccacttccagtaactagtacatcatccgcatctacaggagatacgactcccctgccagtcacggacacttctagcgtaagcaccggccatgctacatcccttccagtgacttcaagatcctcggctagcactggccacgccaccccattacccgtcacagacacttcttctgtctcgacgggacacgcaacccccctgccagtcaccagcacttccagcgtttctacgggccacgctacacctctccccgtgacctctccctcatctgcttctacaggacacgcgactcctgtgccggtcacaagtactagctcagccagtaccggcgacaccactcccctgcccgtgaccaatgcaagcagcctatctactggacatgctactcccttgcacgttacttccccctcatctgcctcccgtggcgacaccagtactttgcccgttacggatgccagttcagcttctacaggtcatgcaacccccctgcccctgacttccctatccagcgtctcgaccggggatactactccccttcccgtgaccgatacctcatccgcaagtacagggcaggcaaccccactccctgtcacaagcctgtctagtgtttcaacaggtgataccacccccttgccagtaacaattccctcgagcgcctcaagtggtcacactacaagcctcccagttactgatgccagctctgtttcaaccggacacgggacgcctcttcccgttacaagcacttcatcagcctcgactggcgacaccacaccactgccagtgacggatacatcatcagctagtaccggtcatgctactccattgcctgtcaccgacacttcctctgcttctactggccatgctacccccctgcctgtcactagcctcagttccgtgtctactggtcatgcaacccccctggctgtttcatctgccacttcggctagcacagttagctccgactcccccctgaagatggaaacccccggaatgacaacaccatccctcaagactgacggcggaaggagaactgcaactagccccccacccaccaccagccaaacaattatttccaccatcccatctaccgcaatgcatacccgcagtactgcagctcctattcccatccttcccgagaggggtgtctccctcttcccctatggagctggcgcaggcgatttggagtttgtgagacggacagtcgactttacttcacccctgttcaagcctgctacaggattccctttgggcagctccttgcgcgactctctatacttcaccgataacggtcagatcattttcccagagtcagactaccaaatcttctcctatcctaaccctctgccaaccggttttacgggcagagaccctgtcgccttagtggcacctttctgggatgatgctgatttctctaccggcaggggtacgacattctatcaaagcaacacgtatcaggctatccttagtaccgatggaagccgctcatacgcgctctttctctaccagtcaggtggcatgcaatgggacgttgctcagaggtctggaaatcccgtattgatgggtttctcttccggtgacggctactttgagaactcaccgctaatgtctcagccagtctgggaaaggtatcgcccagataggtttctgaactctaactcaggacttcagggactccagttctatagactgcacagggaagagagacctaattaccggctcgaatgcttgcagtggctcaaaagccagccgagatggccaagctgggggtggaaccaggtgtcctgtccgtgctcttggcaacaggggcgtagagacctacggtttcagccagtttcaattggcagatggggcctgggatctagacagctctgcagcttcacctcctggagaggcggagtctgctgctcttatggtccctggggagaattccgcgaaggctggcatgtgcagaggccctggcagctggctcaagaactggaaccccagtcatggtgttgccgttggaacgacaaaccttatctgtgtgccctgtatcagcagaggcgaccccatgtcggatgtgctacatatcgcccacctcagcccgcttggatgtttggtgacccacacattactacgcttgacggggtgtcatatactttcaatggacttggagactttctgctggtaggcgcacaggacggaaattcttccttcttacttcaggggcgtactgcgcagactggatctgctcaagcaaccaattttatagctttcgctgcccagtatagatcctcttctctgggtcccgtaaccgtacaatggctattagagccccatgacgctatccgagtgctactggataaccagaccgtgaccttccagcctgaccatgaggacggaggaggtcaggagacattcaacgctacaggtgtgttgctgtcaagaaatggctccgaagtgtcagcatcattcgacggttgggccaccgtgtcagtcatcgccctgtccaacatattgcatgcttcagccagtctgcccccagagtaccagaaccgcacggagggtctgctgggggtgtggaataacaaccccgaggatgactttcgcatgccgaatggcagcaccattcccccaggcagccctgaggagatgcttttccatttcggaatgacatggcagattaatggcactggtctcctcggcaagcggaacgatcagctcccatccaatttcacaccagtcttttattcccagctgcaaaaaaattcaagttgggcagagcacttgatcagcaattgtgatggcgattcaagctgtatttacgataccttggcactaagaaatgcaagcattggcctgcacaccagggaagtgtcgaaaaattatgagcaggccaacgctaccctcaatcaatatccgccaagcataaacgggggaagagtgattgaagcatacaaggggcagactaccctgattcagtatactagcaacgcagaggacgctaactttacactaagagactcgtgcacagaccttgaactgtttgagaacggaacgttgctgtggacccccaaaagccttgaacccttcacattggagattcttgcccgatctgccaagattggccttgcgagcgccctgcagccacggacggtcgtttgccactgtaatgccgagagtcagtgtttatacaaccaaactagcagggtgggtaattcttccttagaggttgctgggtgtaagtgcgacggaggaacgttcgggagatattgtgagggctcagaagacgcgtgtgaggaaccatgctttcctagtgttcattgcgtgccgggtaaagggtgcgaggcatgccctcccaatctcaccggggatggcaggcactgtgcagcattgggtagcagtttcttatgtcagaaccaaagctgcccggttaactactgctacaatcaggggcattgctatatctcgcagacacttggttgccagcccatgtgcacttgccctccagcatttactgacagcagatgcttcctcgccggtaataactttagccccacagtcaacctggagttgccactgcgagtgattcaacttctgctcagcgaggaagagaacgccagcatggcagaggtaaatgctagtgtggcctacagactcggcaccctggacatgcgggcatttctgcgaaattcccaagtggaaagaatagactccgccgctcctgccagtggtagtcccattcagcattggatggtgatcagtgaattccagtacaggcctcggggtcctgtcattgacttccttaataaccagctattggccgctgtggtggaggccttcctgtaccatgtgccaaggcgatccgaggagccacggaatgacgttgtgttccagccaatctctggcgaggatgttagggatgtgacagccctgaacgtttcgaccctgaaagcatacttcaggtgcgacggctacaaaggttatgatctggtgtatagccctcagagtggcttcacatgtgtgtctccttgcagtcggggatactgtgatcatggaggacagtgccagcacctgcccagcggcccacgatgcagttgcgtctctttttcaatttacacagcctggggcgagcattgcgagcacctgtcaatgaaactggatgcattctttggtattttctttggggctcttggcggattgcttctgcttggggtcgggacattcgtggttctccgcttttggggttgcagtggcgcaagattctcctactttctcaattctgccgaggccttaccctac

SEQ ID NO: 231128 - DNA, 1863 bp, Artificial Sequence
  Description of Artificial Sequence: Synthetic coding sequence
atgagtgtgggaagacggaaacttgccttgctgtgggccctcgccctggcgctagcttgcacacgccacaccgggcatgcgcaggatggtagctccgagagcagttacaaacatcatcccgctttgagccctatagccagaggcccatcaggggtgccactccggggtgccaccgtttttccaagccttaggaccattcctgtggtcagagcatcaaatccggcacataacggccgagtgtgctccacctggggttcattccactacaagaccttcgatggtgacgtgttccgattccccggtttgtgtaattatgttttttccgagcattgtggggcagcctacgaagactttaaccccgctactcctcagccaggcgtaagcgggccacacgccgagcagggccctcatgaaggtggctggcgcggacatccagcagaccagggacttaggcccggacaaaggcctcccggacccgctgccctgcagcctgtttgggggccacattctagggcagctgccaccccccgatggaggcccggatgggcgcttagtagctgtggtaccacgatgaccgcatgctgctggctggacacaaaatatgcaaacaaactctgggctttatggggccttcaacgggatgcacgcggacaaagggccccactgcctcagcatcaggccgacacacacggtatacgggagccggcacggtggaccaccccaaggtcctctgttcggacgttgtccctcaatccacggggaaccgccccactggcgttagggatttgcgaagaactgcttcacggacagctgttctcaggttgcgtggcgttggtcgatgttggcagctacttagaggcttgcagacaggatctttgtttctgtgaggataccgacctattatcctgcgtttgccatactcttgcggagtacagtagacaatgcacccatgcaggtggactaccccaggattggcgcggtccggacttctgccctcagaaatgtcccaataatatgcagtaccatgaatgcagatctccctgcgcagacacatgtagcaatcaggagcactcgagggcttgcgaagaccactgcgtggccggttgtttctgccccgagggcaccgtcctggacgacatcggacagacaggctgtgtgcctgtgagcaagtgcgcctgcgtgtataatggggctgcttacgcaccaggtgcaacttactcgactgattgtacaaactgcacatgtagcgggggacgctggagttgccaggaggtgccctgccccggaacctgcagcgtgctgggcggagcacacttctccaccttcgatggcaagcagtacacggtacacggagattgctcctacgtcctgactaaaccttgtgactcatccgcgtttacagttttagctgagctccggagatgcggattgactgattctgagacctgcctcaaatctgtcacactctcactagacggggttcaaaccgtcgttgtgatcaaggcatcgggtgaggtgtttctgaaccaaatatatactcaattgcccatctccgcagctaatgtgacaatcttcagaccctccactttcttcattattgctcagacctcactgggactgcagcttaacctacaactcgtacctacgatgcaattatttatgcagctcgcacctaagctgaggggtcaaacatgcggcctgtgtggcaattttaactcaatccaggcagacgactttaggactctgtctggtgttgtggaagccaccgctgccgcttttttcaataccttcaagacacaggccgcttgtcccaacatccgcaatagctttgaggatccctgctctttgtcagtggagaattag

SEQ ID NO: 231129 - DNA, 1872 bp, Artificial Sequence
  Description of Artificial Sequence: Synthetic coding sequence
atgagtgtgggtcgccgaaagctggccctgctgtgggctcttgccctcgctctggcttgtacgcgccacaccggacatgcccaggatggttcttcggaatcttcctacaagcaccaccccgctctgtccccaattgcccgaggcccatcgggggtcccattgcggggtgccaccgtttttccgtcccttcggactatcccagtggtgcgtgcctcaaatccagcccataatgggcgtgtctgctctacatggggctcctttcactacaaaacatttgatggcgacgtcttcagatttcctggcctatgcaactacgtgtttagcgagcactgtggcgctgcgtacgaggatttcaatattcagttacggcgatctcaggagagcgctgcacccactctctcccgggtgttgatgaaggtagacggcgtggtgatccagctgaccaaaggtagtgttctggtcaatgggcaccccgttctcctacctttttcgcagagtggggtccttattcaacagtcatcaagttacacaaaagtcgaggcccgtctgggactggtgctgatgtggaatcacgacgactcactgctgctcgaattggacacaaagtacgcaaacaagacttgtggtctgtgcggcgatttcaacgggatgcctgtggtgtccgaacttctctctcacaacacaaagcttacaccaatggagttcggtaatctgcagaagatggacgaccctactgaacagtgccaagatccagtgcctgaacctccacggaattgcagcacgggctttgggatatgtgaagaactccttcacggacagctgttttcaggatgtgtagccctggttgatgtcggcagctatctcgaggcttgtaggcaggatctgtgtttctgtgaggacactgacctgctgtcctgcgtgtgtcacacgttggctgagtattcccgacagtgcacccatgcaggcggtttacctcaagactggcgaggtcctgacttttgccctcaaaagtgtcccaacaacatgcaatatcatgagtgtagatctccatgcgccgacacttgcagcaaccaggaacattccagagcttgcgaggaccactgtgtggccggatgcttttgtccggaaggtaccgtgcttgacgatatcggccagaccgggtgcgtgcccgtttctaagtgtgcctgtgtatataatggagccgcatacgcccctggagccacgtacagcaccgactgcactaattgtacatgcagcggcggtcgctggtcgtgtcaggaggtaccgtgtcccggtacctgctctgtcctcggtggcgctcacttcagcaccttcgacggcaagcagtacactgtccacggggattgttcttacgtgctgacaaaaccatgcgatagctccgccttcactgtactggcagagctgaggagatgtgggctgacagactcagaaacatgtctgaagtccgtgactttgtctcttgatggggtgcaaaccgtggttgtgatcaaagccagcggtgaagtctttttaaatcagatatatacacagctgccaatctctgcggcaaatgtcacgatatttcggcctagtacattttttattatcgcacaaacaagtcttggattgcagctcaatctgcagctagtccccactatgcagctctttatgcagttggcaccaaaactccgcggacaaacatgcggtttatgcgggaactttaattctattcaggctgatgatttccggactcttagcggggtggtggaggccactgcagccgcattctttaatacctttaaaacacaggctgcatgcccaaacatccgaaactctttcgaggatccttgtagcctgtctgtggagaactag

SEQ ID NO: 231130 - DNA, 17120 bp, Artificial Sequence
  Description of Artificial Sequence: Synthetic coding sequence
atgggagccccaagcgcatgcagaaccctcgttctggccctcgcagctatgctggtggtcccccaggccgagacacaggggccagtcgagcctagctgggagaatgctggccacacaatggatgggggagcgcctacctctagccccacacgacgagttagctttgtaccaccagtgactgtttttccaagcctctctcctttaaatccggctcacaatggtcgcgtgtgtagtacatggggagacttccactacaagacgttcgacggcgatgttttcagattcccaggactgtgtaactacgtattctccgagcattgtcgcgcagcttacgaggatttcaacgtgcagttgcgcagaggacttgtgggttcacgaccggtcgtgacgcgggtggtgatcaaagctcaaggactggttttggaggccagcaacggctctgtcttgattaacggtcagcgggaggagctgccctactcacggacaggactcctcgtggaacagagtggcgattacatcaaagtgagcatccgactcgttctgacatttctgtggaacggcgaggattctgcccttttggagctggatccaaaatacgcaaaccagacttgtggcctgtgcggtgattttaacggtcttccggctttcaatgaattctacgcacacaacgctcggctcactcctctgcaatttggtaacctccagaaattggatggacccacagagcaatgccctgaccctcttccgctgcctgctggcaactgtactgatgaggaggggatttgccaccgcactctcttgggaccagctttcgctgaatgccacgcccttgtagattccaccgcatatctggccgcatgtgcccaggacctgtgccggtgccccacatgcccttgcgctactttcgtggagtactcgcgccaatgcgcccacgcaggcggacaaccccgtaattggaggtgtccggaactgtgtcccaggacatgtccccttaatatgcagcaccaagagtgtggcagcccatgtacagatacctgtagcaatcctcagagagcacagctgtgtgaggaccactgcgtcgacggatgcttctgtcctcccggaagcactgtcctggacgatattactcattctggatgtctccccctaggacagtgcccctgcacccacggcggtcgcacctatagtcccggaacttcgttcaacacaacctgctccagttgcacctgcagcggcggactttggcagtgtcaggatctcccttgcccaggtacatgcagtgtgcagggcggtgcgcacatctccacttacgatgaaaagctgtacgatctccacggtgactgttcttacgtcctgtcgaaaaaatgtgccgacagtagctttacagtgttagccgagctacgcaaatgtggcctgacggataacgagaactgcctcaaagctgtgaccctctccctggacggaggagacaccgctataagagtgcaggccgatggaggcgtcttccttaacagtatatacacccaactgccactgtccgccgctaatatcacattattcacgccctcatctttctttatagttgtccagacaggcctgggcctgcaactcctcgtgcaacttgtgcccctgatgcaagtcttcgtgcgcctggacccggcacaccaagggcaaatgtgcggactgtgcggaaactttaatcaaaaccaggctgatgattttaccgctcttagtggggtcgtggaggctacaggagctgccttcgcaaacacctggaaagcacaggccgcatgcgcaaatgctcgcaattcatttgaagatccatgcagcctctctgtcgagaacgagaactacgcccgacactggtgttcacgactgacagaccctaattccgctttttcccgctgtcactccatcatcaatccaaaaccattccactccaactgcatgtttgacacttgcaattgtgaaagaagcgaagactgtttatgtgctgccctcagttcctacgtgcatgcttgcgcagccaagggcgtccagctttccgactggcgagatggcgtgtgtactaagtacatgcagaactgccccaaaagccaaagatatgcatacgttgtcgacgcttgccaacccacttgtagaggcctgtcagaggctgacgtgacttgcagtgtgtcattcgtccctgtagatgggtgtacctgtcccgcaggcacattcttaaacgacgccggagcatgcgtccccgcacaagagtgtccgtgctacgctcatgggacagtgttagctcccggtgaagtggtgcacgatgagggggcagtctgcagctgcacgggcggaaagctgtcgtgcttgggcgcatccctccagaagtctacgggatgtgccgcaccgatggtgtatttagactgttcaaattcaagtgctggaacccccggagcagagtgtctccgctcatgccacacccttgatgtgggctgcttttccacacattgcgtgagcggctgtgtgtgccccccagggctcgtttccgatggaagcggcggatgcatcgctgaggaagactgcccctgtgtgcataatgaggccacatacaagcccggagaaaccatcagagtagattgcaacacttgtacctgtaggaaccgcaggtgggagtgttctcacagactgtgcctcgggacgtgcgttgcctacggggacggacacttcataacctttgacggcgaccgatactccttcgaggggtcctgcgagtatatattagcacaagattattgcggcgataatacaacccatgggaccttccggatcgtcaccgagaacattccctgcggaaccacaggcaccacatgtagcaaggcaatcaaactgtttgtcgagagttacgagttgatcctccaggaaggaactttcaaggcagtggccagaggtccgggtggagaccctccttataagatccgctatatgggcatatttctggttatcgaaacgcacggcatggctgtgagctgggatcgaaagacctcagtgtttattagactacatcaggactataaaggaagagtctgtgggctctgcgggaatttcgatgataatgcaattaatgacttcgccactagatcccggagcgtagttggcgatgcattagaatttggaaattcatggaagctatccccttcgtgtcctgacgctctggccccaaaggacccgtgtaccgctaatcccttccgcaagtcatgggctcagaaacagtgctcgatacttcacggacctactttcgccgcatgtcggtcacaggtggatagtaccaaatattacgaagcctgcgtaaatgacgcctgcgcctgcgatagtggcggtgactgtgagtgtttctgcactgccgttgccgcttatgcacaggcctgtcatgacgccggactgtgcgtgagctggagaacccccgatacttgtcccctgttttgtgatttctacaacccccatggtgggtgtgagtggcattatcagccttgcggcgcaccctgccttaagacctgtaggaacccatccggacactgtctcgttgacctgcctggtctggaaggatgctatccgaaatgccccccaagccagcccttctttaacgaagaccagatgaagtgtgtagctcagtgtgggtgttacgacaaggatggaaattattatgacgtgggtgcgcgagtcccgacagctgagaattgtcagtcctgcaattgtacaccctcaggcatccaatgcgctcactctttagaagcctgcacatgtacttacgaggaccgcacatattcctatcaggacgtcatttacaatacgaccgatggacttggtgcctgcctgattgccatatgcggaagcaacggcaccattattagaaaggcggttgcctgtccaggtactcctgccaccacaccctttacctttaccacggcatgggtcccacattcaaccacgagtcccgctttgccagtgtccactgtgtgtgtgagggaagtctgtagatggagctcttggtacaatggtcatcggccagaacccggtctcgggggtggtgattttgaaaccttcgaaaacctgcggcagcgaggatatcaggtttgcccagtgttagcggacatcgagtgtagagcggctcagctgccagacatgcctttagaggagctgggccagcaggtggactgcgatcggatgcgcggactgatgtgcgcaaattcacagcaaagcccccctctttgtcatgactatgaattgagggtgctctgctgcgagtacgtcccttgtggcccaagccctgccccaggaactagcccacaaccctcactctccgcatccacagagccagcagtccccactcctacccagactaccgcaaccgaaaagaccaccctctgggtgacacccagtatcaggtctaccgctgccctgaccagtcaaacaggttccagcagtggtcctgtgacagtgacgccctccgcacccggtacaaccacatgtcaacctagatgccaatggacagagtggttcgacgaggactaccctaagagcgagcagctgggcggagacgttgagagttatgacaagatccgggctgctggagggcacctgtgtcagcagcctaaagacatcgagtgccaagctgaatcctttcccaactggactctggcacaggtcgggcagaaggtgcactgcgatgtgcatttcggactggtctgcaggaactgggaacaggagggggtgttcaagatgtgttataactatcggattcgggtgctgtgttgctccgatgaccattgcaggggaagagcgacaacaccaccacccactactgaacttgagactgctacgactaccaccactcaggcgttgttcagcacgccccagccaaccagcagccccggtctgacccgtgcaccgcctgcctctacaaccgcggtgcctacgctttctgagggactgacctcacctaggtacacgtccacccttgggacagcaactacagggggacccaccactcctgccggaagcacagagcccacagtcccaggcgtggcaacgtctactttacctacccgtagcgcattgcccggaaccactggctccttgggaacatggcggccaagccagccccctacgctggctccgacgactatggcaacaagtcgtgccaggcctacaggaaccgccagcacagccagtaaagagcctctcaccacaagtctcgcccctaccctaacaagcgagctgagcacttctcaggccgagactagtacccctcgtaccgaaaccactatgtctcccctcacgaacactaccacttcccaaggcaccacccgctgtcagcctaagtgcgaatggacggaatggttcgacgtggacttccctacctctggagtggcagggggagacatggagactttcgaaaacattcgggctgccggaggaaagatgtgctgggctcccaaatctatcgaatgtcgggctgaaaattatccagaagttagtatcgaccaggtgggacaggtgctgacctgtagcctggagaccggtttgacctgtaaaaacgaagatcagacaggacggtttaacatgtgtttcaactacaacgtgcgggtgctttgttgtgatgattacagccattgcccttctactcctgcaactagcagcactgcaacacccagctcaacccccggaacaacctggatcttgacaaaacccaccaccactgccactacaactgctagcactgggagtactgccaccccaaccagtacactgcggaccgctccaccaccaaaggtactgacaaccaccgctaccacaccaactgtaacaagctcaaaggctactccaagtagttcccccggaacagcaacagctttgccagccctgcggagcacagctacaacgcccaccgccacgagcgttactcccatcccatcttcatctctgggcaccacttggactagattatctcagaccaccactccaaccgctacgatgagcactgctacaccttctagcaccccagaaacagcccacacgtccacagtcctaaccgcgactgcgacaaccaccggggctactgggtctgtagcaactccttccagcacacccggaactgcacataccacaaaggtgccgaccaccactacaaccggattcacggccaccccatcaagcagccctggaactgcactgacaccccctgtgtggatctcaaccacaactactccaactacccggggaagcacagtcactccctccagcattcccggtacaactcacaccgccaccgtgctgactaccacaacaacgacagtggccaccggctctatggctacacccagttctagcactcagactagcggcacgcctccttctttgacaaccaccgcgactaccattacagccacagggagtaccacaaacccctctagtactccaggcacaaccccaatcccgcctgttctcaccactaccgccactacaccggcagctacctcaaatacagtcaccccaagttccgcgttaggcactactcacactccgcctgtaccaaacacaatggcaaccacgcacgggcgatctctcccaccctcctctccccataccgtcagaactgcctggacgagcgcaacttcaggaattctggggacgacacacatcacagaaccatccaccgttacctcgcatacactagctgccacgacgggaactactcagcactcgactcctgccctgagttctcctcatccctcatcaagaacgaccgagtcgccgccatcacccggaactacaaccccagggcacaccactgccaccagccgaactaccgcaacagctactcctagcaagacccgcactagcaccctcctgccgtcgtcaccaacctcagcgcctattacaaccgtagtcacaatgggatgtgaaccccagtgtgcatggagtgagtggctggattacagctaccccatgcctggaccctctggaggcgacttcgacacttactcaaatatcagggccgcagggggtgctgtgtgtgagcagcctctgggccttgaatgccgggctcaggcacagcctggagtacctctgcgcgaactgggtcaagtagtcgagtgctctctcgattttgggctcgtttgccgcaatcgggaacaggtgggtaagtttaagatgtgctttaattacgagatacgcgttttttgttgcaattatggtcattgcccctctacgcctgccacaagcagtactgcaatgccctcatcaacccctggtacaacttggatccttaccgagttgactacaacagcaacaaccactgaatctaccggttcgaccgccactccctcctctactccagccacagccggaactcctcacgtctcaacaactgctactacgcctacagtgacttcctccaaggccacgcccttctccagtcccggaaccgccaccgcactgccagccctccgttccacagctacaacgcccaccgctacctcatttactgctatcccctccagctccctggggacaacctggacgcgactcagccaaacaaccacacctaccgctaccatgtctacagccacaccctcctcaacccccgagacagtccatacttcaaccgtactaacaaccaccgccacaaccacaggcgcaacagggtccgttgcgaccccatcatctactccaggaactgcacacaccacaaaggtgctgaccacaaccaccacagggttcaccgccacaccatccagcagcccaggcactgctcgcaccctgccagtgtggattagcacaaccacaactcctaccacaaggggctctaccgtgaccccttcttctattccaggaaccacccacacccccacggtcctgaccacaaccacgacaactgttgcaacaggttctatggctaccccttcttcctccactcagaccagtggcactccaccgtccttgaccactaccgccactactataaccgctactgggtccaccaccaatccctccagcacccccggtaccaccccaatcccccctgtacttactacaacagccaccacgcccgcagccacaagctcaaccgtgacacccagttctgctcttggaacgacgcatacccctcccgtgcctaatacgaccgctactactcatggcagaagtttgtctccctcttccccacacacagtgcggacggcatggactagcgctacttctggcactttgggtacaacccatatcactgaaccctctaccggcacgtcacatacccccgctgctaccactggtaccacacagcactccaccccggcactcagctccccacacccttccagcaggactacagaaagccccccttcacccggtaccaccacaccgggtcacacaagggctacttctcgtaccacagctactgcgacgccctcaaagacgcgcacctctactcttctcccaagcagccccacgtccgcccctattactaccgtggtgacaatgggctgcgagcctcaatgcgcctggtccgagtggctggattactcttatcccatgcctggtccttcaggcggagattttgatacgtactctaacatcagggccgctgggggtgctgtgtgtgaacagcccctgggactcgagtgtcgggctcaagcccagcccggagtgcccctgcgggagttggggcaagtggtggaatgctccctcgacttcgggttagtgtgtaggaacagagagcaagtcggcaagttcaaaatgtgcttcaattatgagatccgggttttttgctgcaactatggccattgtccatcaaccccagccacgtcctcgactgctactccatcttctacgcccggtactacctggatcctgactgagcagacaactgccgcaactacaaccgcgaccaccggcagcaccgccatcccctccagtactcccggtacagccccaccacctaaagtactaaccagcacagccacaacaccaaccgcaacgtcatctaaggccacttctagttcctccccacgcaccgcaacgactctacccgtcctgacctccaccgccactaaaagcactgctactagcttcactcctatcccatcctttacgctgggtacaacgggaaccctgcccgagcagacaacaacgccaatggctaccatgtcaactatccacccatcttcaactccagagactacacatacatctaccgtgcttacaacaaaagcaacgaccactcgggctacaagctcaatgtctacaccttcatccaccccgggaaccacgtggatcctcaccgagctcaccaccgcggcaacaactacagccgcaactggcccaaccgccaccccatctagcacccctggtaccacctggatcctcaccgagcccagcacgaccgccaccgtgacagtgcctacggggtctacggccactgcctcatcgaccagagctaccgccggtacattaaaggtcctcactagtactgctaccactcccactgtgatctcgagtagagccaccccaagctccagcccagggaccgccactgccctgcctgccctaagatctaccgccactaccccaacagcaacaagtgtgaccgctatcccttcatcttccctcggtactgcgtggacccggctgtctcagactactactcccacagccacaatgtccaccgctacaccctcctcaactccagagaccgtacatacatctacggttctgactaccacaaccacaacgactcgggcaacaggctccgtggctactcctagtagcacacccggaactgcccacacaactaaggtgcccacaacgaccacaaccgggtttaccgccacaccgagttccagccccggtactgcgctcacgccccctgtttggatctctactaccaccacacccactacaaggggcagtaccgtcaccccaagctcaatccccggaaccactcacacagccacagtgttgactaccacgacaaccacggtcgcaacaggctcgatggctactccatccagcagtacccagaccagcgggactcctccttccctcacaaccacagccacaacaatcacagctaccggctcgacaacaaatccatcctctacacctggtacaactccaatacctcctgtgcttaccacgactgccactacgcctgcagcaacaagtagtactgtgacacctagctcagctctgggtaccacccataccccacccgtgccaaacactactgccactacccatgggaggagtctccctccatcatccccacacactgtgaggacagcctggacatcagcgacttctggcattttggggaccacacacatcaccgagcccagcacagtgaccagccatacacccgcagctaccacgtcaacgacccagcactcaaccccagcactcagtagccctcacccatcgagtagaaccactgagtcccctccatccccgggaactacaacccctggtcacaccaggggaacctcacgcactacagctaccgccacgcccagtaaaacacgcacctccaccctgctgcccagtagccctacttctgcacccataacaaccgtcgttacaacgggatgcgagcctcagtgcgcctggtctgagtggcttgattactcatatcccatgcccggacccagtgggggagacttcgacacctactccaatatcagggctgccggaggagccgtatgcgagcagccattgggtctcgaatgcagagcccaggcacaacccggtgtcccactgcgtgagctggggcaggtggtagaatgtagtttagactttgggttggtctgtcggaacagagagcaggtgggaaagttcaaaatgtgctttaattatgagattcgagtattttgttgtaactatggacattgccccagcaccccagccacatcttccactgcgactccaagcagtaccccagggaccacatggatcttgaccaaacttactacaacagcaactaccacagaatccacaggttcaacagccacaccatcgagcacccccggagcaacagcaggtacaccacacgttagtacaactgcaacaactccaactgtcacgtctagcaaggccacacctttttcctccccagggaccgccacggcgctgccggcattgaggtcaactgctacgactcccaccgctactagcttcacagccatcccatcttcctcactgggtacaacgtggacccgtctcagtcaaactacaaccccaacagcaactatgtccaccgccacaccttcgtccacacccgaaaccgctcacacgtccacggtccttacaactaccgcaacaactaccagggctacggggtccgtcgcgaccccaagctcaactcccggaacagctcatacgaccaaggtgcctactacaaccaccaccggatttaccgttacgccttcctcctctccaggcaccgccagaactcccccagtctggatttctacgactaccacccccaccacaagtggcagtacagtgacccccagctcagtgcccggaactactcatacccctactgtgctgactaccacaacgactaccgttgctaccgggtcaatggcgaccccatcttccagcacccaaacctcgggaacgcctccctctttgataaccacagcaactactatcacagccacgggctcaactaccaacccatcttccaccccaggaacaactcctatacctccagtgctcactaccaccgctactacgccagccgcaacgagctcgactgtgacccccagcagcgcactgggaactactcatacgcccccagtccctaatactacagccactactcacggtcgctctctgtccccgagttctccccacaccgtgaggaccgcatggaccagcgctacgtcaggtacattggggaccacacacatcacagagccgagcacaggtacatctcacacccccgcagcaactaccggaacgactcagcatagtacaccagctctctccagcccccacccttcatcaagaactacggagtccccaccctcgccaggcacgacaactccaggacacacaaccgccacgtcacgcacaactgccaccgcgaccccaagtaagacgcgtacatccactctgctgccttctagccccacctctgcccctatcaccacagtggtgaccactggatgcgaaccccagtgcgcatggagcgagtggcttgactatagctaccccatgcccggtccttctggaggtgacttcgatacttatagtaatatcagagcagccggaggagccgtttgtgaacagccgctcggactggagtgtagggcacaggctcagcctggcgttcccctgggagagctgggtcaggtggtggagtgctccctggacttcgggttggtttgcaggaatagagaacaggtgggaaaattcaaaatgtgctttaattatgaaattagggtcttctgctgcaactacggacactgtccttccacgcccgctaccagtagcactgcaatgcctagctctacaccaggaacaacctggatcctgacggaattgactacaacagctactaccacagcttctaccggtagcacggctactccttctagcacccccggtactgcgcctcctcctaaggtgcttacgtccccggctactactcccactgcgactagtagcaaggcgacttcctcctcaagcccgcgaacggccacaacgctacccgtcttaacctcaacggccaccaaaagtactgccacgtccgtgactccaatcccctcttctactttgggcacgactggaaccctacctgaacagactacaacccctgtcgcaaccatgtctacaattcacccttctagtactcccgaaactacccacacctctaccgtgctgaccacaaaagctaccaccaccagagccacctcgtctacctcaacccctagctcaacaccagggacaacatggattctgacagaactaactaccgctgctacaactacagccgcaacgggacctactgccacacctagtagtactcccggaaccacatggatattgaccgaattaacgacaacagctaccaccaccgcttccactgggtctactgcaaccccgtcgagcacccccggaactacatggatcttgactgaaccctctaccacggcaaccgtgaccgtgccaacaggttccacagctaccgccagtagtacccaggctacagcaggaacaccacacgtaagcactacagctacgacccccaccgtcaccagctccaaagctaccccctcaagttctccaggaaccgccactgccctgcccgctctccgaagtacagcaaccacacctaccgcaacctcatttactgccatcccatctagtagcttgggaacgacatggactagactgtctcagacaacaacaccaaccgccaccatgtcaactgccacgccatcatcaaccccagaaacagtccatacatctaccgtactgactgctaccgcgaccacaactggcgcaactggatctgtggccactccgagttccacccccggtacagctcacactaccaaagtacctacaactaccacaacaggctttacagctactcctagcagtagtcctgggaccgccttgacaccacccgtttggatttccacaaccactactccaacgactacaaccccaacaaccagtggctcaactgtgacccccagttccatcccgggtaccactcacacagcacgggtcctgaccacaactacgacaaccgtggcgaccggatccatggcaacaccctcctctagcacccagacctccggcacccctccatcactgacaacaaccgctaccactattaccgcaactgggagcacaactaacccttcctctacacctggaactacacccatcactccggtcctgacctctaccgccaccacaccagcggcaaccagctccaaggccacctcttcatctagccctcggaccgccaccacgttgccagtcctgacctctacggctaccaaaagcaccgccacttccttcaccccaattccctccagtacactgtggactacgtggacagtccctgcacagacaacaacacctatgtctactatgtcaactatccacaccagctctacacctgagactacccatacttccaccgttctgaccacaaccgccaccatgactagagctaccaattctaccgcgacaccctctagcacactgggcacaactcgaatcctgactgaactcaccactacagcaaccactaccgctgccaccggatcaacagccactcttagctccactccaggcacaacctggattctgactgaacctagtaccattgcaacagtcatggtgcccacaggtagtactgccactgccagcagcaccctgggaaccgcgcatactccaaaagtggtgacgacaatggcaacaatgccgacagccaccgcctcaacagtcccctcctcttccaccgttggaacgacacggactcctgccgtccttccctcatctctgccaacattcagcgtcagtaccgtttcaagctctgtcctgaccacattgcgtcccacgggctttccttcaagtcatttctctaccccgtgtttttgccgagcctttgggcagttttttagtccaggggaggtaatttataataagacagatcgcgcagggtgtcacttctatgccgtttgcaaccagcactgtgacatcgatcgattccagggtgcatgcccaacttccccaccacctgtgtctagcgcccctctttcctccccgtcccccgctccgggttgtgacaatgctatccccctccggcaggtaaacgagacgtggaccttggagaactgtactgtggccagatgtgtcggagacaacagagtggtgctcctggatcctaaaccagtggccaacgtgacgtgtgtaaacaagcaccttcctattaaagtgtcagacccttctcagccctgtgatttccactatgagtgtgagtgcatttgcagtatgtggggcggttcacactattctactttcgacggaaccagctacacgttccgcggtaattgtacatacgtattgatgcgagaaatacacgcacggtttggcaacctctccctgtaccttgataaccactactgtaccgcttctgccaccgccgctgccgctcgatgccccagggcactctctatccattacaagagtatggatattgttctaacagtgacgatggtgcacggcaaagaagaaggcctgattctgtttgaccaaataccggtgtccagcgggttctcgaaaaatggcgtcctcgtctctgtgctgggaaccactactatgcgggtggacatccccgcactcggcgtgtctgtgaccttcaacgggcaggttttccaggccaggctcccctatagtttgttccacaataatacagagggccagtgtggaacctgtacgaacaatcaaagggacgattgcctgcaacgggacggcactaccgccgcaagctgcaaggacatggccaagacttggttagtgccagacagtcggaaggacgggtgttgggcaccgactggtaccccgcctactgcaagtcctgcggctcccgtttcatctacacctactccaacgccctgtcctccgcagcccctgtgcgacttgatgttgagccaggtctttgccgaatgtcacaatctagtgccacccggtccattttttaacgcctgcatcagcgaccattgcagaggtcggcttgaagtcccttgccagtctctggaagcttatgccgagctctgtcgagcacgcggagtgtgctcagattggaggggagccacaggcggactgtgtgatttgacttgtcccccaacaaaagtgtacaagccgtgtggacctatccagcccgctacttgcaactctcgtaaccaatccccacagctggaaggcatggcggagggatgtttctgtcccgaagatcagattttatttaatgcccatatgggcatttgtgtccaggcgtgcccctgcgtaggcccagatggcttccctaaatttcccggtgagagatgggtgagcaattgccagagctgtgtgtgcgacgaggggagcgttagcgtccagtgcaagcctttgccctgtgacgcacaggggcagccccctccttgcaatcgacctgggttcgttactgtgacccggccacgggcagaaaacccttgttgccccgaaaccgtctgcgtgtgtaacaccactacttgtccccagagcctcccagtgtgtccgcctggccaagagtctatttgcacccaggaggaaggcgattgttgcccaactttccgttgccgcccacaactgtgctcctacaacggcaccttttatggcgtcggagcaaccttccccggagccttgccatgccacatgtgcacgtgcctcagtggagatacacaagacccaacggtgcaatgtcaggaagacgcatgcaacaacaccacctgtcctcaggggttcgagtataagcgcgtggccggacagtgctgtggggagtgcgtgcagacagcctgcctcacacctgacggacagccagttcagctgaacgagacatgggttaattcccatgtcgataactgcacggtttatctctgtgaagcagagggaggagtgcacttgttaaccccgcagcccgcaagctgcccagacgtctctagctgtcgtggctccctgcgcaagactggatgctgctacagctgtgaggaagacagttgccaggtcagaattaataccacaatcctttggcatcaggggtgcgagacagaagttaatatcaccttctgcgaagggagctgtccaggggcttcaaaatatagcgctgaagctcaagctatgcagcaccagtgcacatgttgccaagagcgcagagtgcatgaagagacagttccgcttcactgtcccaatggatccgctatcctccacacatatacccacgtggacgaatgcggttgtaccccattttgcgtacccgctcccatggcaccaccacatacacggggattccccgctcaggaggcaacagctgttta

SEQ ID NO: 231131 - DNA, 16586 bp, Artificial Sequence
  Description of Artificial Sequence: Synthetic coding sequence
gcgccacgtatgggggcacctagtgcctgtaggaccttggtccttgcactcgcagccatgctggtggtaccacaggccggtaaatcacccccattgcgacccctgagtcgcaattccggggctgggctggacgggggtgcgcctaccagctcacctactcgaagggtgtcctttgtcccccctgtcaccgtgttcccatccctgtcaagaaagcagatgctcccgctgccagccggtaaaggagttttcgctagtcctaaagggggaggcccagatttaggcgttcagctgccacctgctctgaatccagctcacaatggcagggtgtgctcgacttggggggacttccactataagacatttgatggagatgtgttcaggtttccaggcctttgcaactatgttttctcggaacactgtagagccgcttatgaggactttaacgtccagctcaggagggggctagtggggtccaggcccgtggtcacacgtgtcgtgattaaggcccagggcttggtgttggaggccagtaatgggtctgtccttatcaacgggcaaagagaggagctaccttattcgcgcacaggcttattggttgaacagtccggagattatatcaaggtgtccattagactcgtgctgactttcttgtggaatggggaggacagcgccctcttagagttggatcctaaatatgcaaatcagacctgcggcctctgtggtgattttaatggcctgcctgcctttaacgagttctatgcccacaacgcgcgtttaacacccctgcagttcggaaatcttcaaaagcttgacgggcctaccgaacagtgtccagaccctcttcctcttcccgcaggaaactgtactgatgaggaaggcatttgccatcgaaccttgctgggccctgcattcgccgagtgccacgccctggttgatagcaccgcatacctcgccgcttgtgcccaggatctttgcagatgtcccacctgtccatgtgcaactttcgtggaatatagccggcaatgcgcccacgctggcggtcagccaaggaattggcgatgtccagaactgtgtcccagaacgtgtcctctgaacatgcagcaccaagagtgtgggagtccttgcactgacacctgctctaacccccaaagagcacagctgtgcgaggaccattgcgttgacggttgtttctgcccgcctgggaggagctgtacagtgctcgatgatattacccattctggttgtctgcccttgggtcagtgcccatgcacgcacggaggtcgaacgtacagtcccggaacgagcttcaacacgacgtgcagtagctgtacgtgctctggaggtttgtggcaatgccaggacctaccctgccctggaacatgttcagtgcaaggcggagcccacatctcaacatatgacgagaaactatatgaccttcacggagactgtagttacgtccttagtaagaagtgcgctgatagttcctttacagtgttggccgaactgcggaaatgcggtctcaccgataacgagaattgcctgaaggcggtgacactatctctggacggcggagatacagccatccgcgtgcaggccgacggcggtgtgtttcttaactcaatttatacccagttgccacttagcgctgcgaacatcaccctgttcacaccttcatcattctttattgtcgtgcagactggtcttggcttgcagttgcttgttcagctcgtgcccctgatgcaggtgttcgttcggttggacccggctcaccagggccagatgtgtggcttgtgcggtaatttcaaccaaaatcaggccgacgattttacggctctgagcggcgttgttgaagccacaggcgcagctttcgctaatacctggaaagcacaggcagcctgcgccaacgcacgtaactccttcgaggacccctgcagcttgtctgtcgagaacgaaaactacgctcggcattggtgcagccggctaaccgaccctaactctgccttttcacgctgtcactctataattaacccaaaaccttttcactccaattgcatgttcgacacatgcaactgtgagcggtctgaggactgcctgtgcgcggcactctcctcatatgtgcacgcttgtgctgctaagggcgtgcagctgagtgattggagagatggcgtgtgcacaaaatacatgcaaaattgccccaaaagccaacgctatgcatatgtagttgacgcgtgtcaacccacttgcaggggcctgagtgaggcggacgtgacatgttcagtgtccttcgtgcccgtggatgggtgcacttgcccagcaggcacattccttaacgacgctggagcatgtgtcccggcacaggagtgcccctgttatgcccacggcactgtgttggcccctggcgaagtggtccatgacgagggagccgtctgtagttgtacaggcggaaaattgtcttgtctgggcgcaagccttcagaaaagcactgggtgtgcagcccctatggtgtacctcgattgctcaaactcatctgccggaacacctggtgcagaatgcctccgctcttgtcacacgcttgatgtgggttgtttttccactcactgtgtgtcagggtgtgtttgccctcccggactggtatcggacgggtccggcggatgtattgccgaggaggactgtccctgcgtccacaatgaggccacctacaagccaggggagaccatcagagttgattgtaacacatgcacttgcaggaacaggagatgggaatgttcccacaggctgtgtttgggtacctgtgtcgcatacggcgacggccacttcatcacttttgacggagatcgttactcgttcgaagggagctgcgagtatattttggctcaggattactgtggagacaacaccacccacggaaccttccgtatcgtgaccgagaatattccctgtggtacaaccggaacaacatgctcgaaagcaatcaaactgtttgtggaagtgcgcacagcccctgcagtctccacacccgatcccgctgcaaacgagcctgccccaagagaagcctcagtgggatttcgccagcgcctaccacccttgcaatcctatgagttaatcctccaagaggggaccttcaaggccgtcgctcgcggacccggtggggatccgccatacaagatacggtacatgggaatctttctggtgatcgagacgcacgggatggctgtgtcctgggacagaaagacaagcgtgttcattcggctgcaccaggattataaaggacgcgtgtgtgggttgtgcggtaatttcgatgataacgcgatcaatgattttgctactcgtagccggagcgtggtcggagatgctctcgagttcggcaactcatggaaactcagcccttcctgccccgacgccctggccccaaaggatccctgcactgccaatcctttccgaaagagctgggctcaaaagcagtgcagtattctgcatgggccaacattcgccgcatgtagatcccaggtcgattcaacaaaatactacgaggcatgtgttaatgatgcgtgtgcctgcgactccggaggagactgtgaatgcttctgtacagctgtagcagcttatgctcaggcttgtcatgatgctggcctttgcgtgagttggaggacccccgacacctgtcccctcttttgcgatttctacaacccgcatggcggatgtgagtggcactatcaaccctgtggtgcgccttgcctcaagacctgccgtaatccgtccggacactgcctggttgatctgcccggtcttgagggatgctatcccaagtgcccaccatcgcagcccttcttcaatgaggatcagatgaaatgtgtcgcccagtgtgggtgttacgataaggatggaaattattacgatgttggcgcacgggtgccaaccgccgaaaattgccagagttgcaactgtacccccagcggcatccagtgcgcccacagcctggaggcttgtacgtgcacctatgaggataggacttactcttatcaagacgtgatttacaacacaacggatggacttggggcatgtctgatagccatttgtggatctaacggtacaattataagaaaggctgttgcctgccccggaacgcctgccacaacaccctttaccttcacgacagcctgggtcccacattccaccacttcgccagctctgcccgtgtcaaccgtgtgcgtgcgggaagtctgccgatggtcttcctggtataacggccaccgcccagaaccagggctgggcggtggtgacttcgaaacttttgaaaatctacggcaaagggggtatcaggtttgccctgtcctggcagacatcgagtgcagagctgcacagcttccggacatgccactggaggagctgggccagcaagtcgattgcgacaggatgcggggactgatgtgtgcgaatagccagcaaagcccacccctgtgccatgactacgaactgagggtgctgtgttgcgagtatgtcccgtgcggaccatcccctgccccagggacgtctcctcagccctccctttccgcctcaaccgagccagccgtacctaccccgactcaaaccaccgcgactgaaaaaaccacgctgtgggtaacgccctctattcggtccaccgctgccctcaccagccagaccggtagctcatcgggccctgtaacagtaaccccatctgctcccggaaccaccacctgtcagcccaggtgccagtggaccgaatggtttgacgaagattatcctaagagcgagcagttaggaggggatgtggaatcttatgacaaaattagggctgccggtggccacctgtgtcagcagcctaaggacattgaatgccaggcagagtctttccccaactggacactggcacaggtgggccaaaaggtccattgcgacgtgcactttgggctggtgtgcaggaactgggaacaggaaggggtgtttaaaatgtgttacaactatagaatacgtgtgctctgttgctctgatgatcattgcaggggacgagcaaccacccctcctccaactactgaactcgaaactgccacgaccaccaccacacaagccctgttcagtaccccacaaccaacaagttcgcctggactcaccagagcgcctcccgcatccactacagccgtccctactctgagtgaaggcctgacctctccccgatatacaagcacactggggaccgccactacgggcggacctactacgccagccggatctacggaaccaactgttccaggcgtggccacttccaccctgcccacaaggtccgccctgcctgggacaaccggctccctgggtacttggcggccaagccagccccctacactggccccaaccacaatggctaccagtcgggcacgccctactggcaccgcatcaactgcgtcaaaagagccactgactacttctctggccccaacgcttacctcagaactttctacgtcccaggccgaaacgtccactccccgtactgaaacaaccatgtctccactgaccaacaccacgacttcacagggaactacgaggtgtcagccgaaatgtgagtggacagagtggttcgacgtagactttcccacctcaggcgtggcaggcggtgacatggaaacttttgaaaatatcagggcagctgggggtaaaatgtgttgggcacccaagagcattgagtgtcgggctgagaactaccccgaagtctctattgaccaagtggggcaggtgttgacctgcagcctggagacagggctaacctgtaaaaacgaggatcagaccggtcggtttaatatgtgtttcaactacaatgtcagggttctgtgctgtgatgattactctcattgtccgagcacacctgcaacttcttcgacagccacacccagctccacgcctggaaccacttggatccttacgaagcctacaacaaccgcaaccactacagcctctaccggatccacagcaacccctacctcaaccctgcggacagcccctccacccaaagtacttaccacaacagccaccacacccaccgtcaccagctctaaagccacgccttcctctagcccaggcacagccacggcgctgcctgcacttcggagcactgccacgacacccaccgctacctctgtgacccccattccttcctccagcctgggcaccacttggactcgtctcagtcagacaaccactccaaccgctacaatgtccacagccaccccaagcagtacacctgagaccgcgcacacaagtaccgtcctaacagctacagcaactaccacaggcgcaaccggctccgttgctacaccctcctccacacctgggaccgctcatacgaccaaggtgccaactacaactaccaccggatttactgccaccccaagtagctccccgggtaccgcattaactccccctgtgtggatctcgacaactactactcctaccacccggggatctactgtgacgccatctagtatccccggtactacacacaccgcgaccgttttgactactactaccactaccgttgccactggcagcatggctacgccctccagcagcacccagacctctggcacgacacacacccctcctgtgcccaatactatggccaccacccacggccgatccctgcccccatcatccccccacacagttaggacagcctggacgagtgcaacaagtggaattctgggtaccactcacattaccgagccaagcacagtgacaagtcacacactggcagcaacaacgggtaccacacagcactctactccagcactctcatcccctcatccatcctccagaactacagagagtcctccaagtcctggtactactacaccaggtcatactacagcgacatctaggaccaccgccacggcaaccccttccaaaacgaggactagcactctgcttcccagttccccgacatcggcacctataactactgtggtgacaatggggtgtgagcctcagtgcgcctggtcggagtggctagactactcctacccaatgccaggtccatctggcggtgattttgacacatattcgaacattagagccgcaggcggagcggtctgcgaacagcctctcggcctggagtgccgcgctcaagctcagcccggtgttcccctcagagaactgggacaggtagtggaatgcagtttggacttcgggctggtgtgtcgtaatcgcgaacaggtgggtaaattcaaaatgtgcttcaactatgagattcgtgtgttctgttgtaattatgggcattgcccatccacccctgcgacctcttccacagccatgccatcctccacacccggaactacctggatactcacagaattaaccacaactgctaccacgaccgagagcaccggctcaacagctacaccatcttcaactccaggaacgacttggattcttaccgagccgtcaaccacagctacagttacagtgccaactggatcaacagctactgccagcagtacgcaggcgaccgccggtaccccccatgtttctactaccgctacaacaccgactgtgacgtcctcaaaggcaactccttttagttcgcccggaaccgcaactgccctgccagccttacgctctaccgccacaactcctacggccacctcctttactgccattccctccagtagtctcggcaccacgtggaccaggctgagtcaaaccaccacgcccaccgccaccatgagcacagctaccccttcctccacacccgagactgttcacactagcaccgtactgactacaactgccacaaccacaggcgctaccggatccgttgctacaccttcaagtacgccagggacagcacacaccactaaagtgttaacaaccacaacaaccggattcaccgccacccctagctcttcgcctggaaccgctagaactttacccgtctggatatccacaactactacaccaactaccaggggatccaccgtcacgccaagctcaatcccgggtaccactcatacccctaccgtactcactactactaccactaccgtggcaacaggcagcatggctaccccgtcatcctcgacccagaccagtgggacgactcacacacctccagtgcctaacacgacagcaacaacacatgggagatctctcagcccctccagcccccacacagtgcgtactgcatggacctctgcgacatccggaactctgggaaccacacacatcactgaaccatccacaggcacaagccacacacctgcagctaccaccgggacgacgcagcattctacgcccgctctctcctctccacacccctcttctaggaccacggaatccccaccgagccctggtaccacaaccccagggcatacccgtgcgacttcgcgcacaaccgccacagccaccccgtcaaagactcggacaagtactctgctcccatcatcccccaccagcgctcctatcacgaccgtcgtcactatggggtgcgaaccacaatgtgcatggtccgagtggctggattactcctaccccatgcctggacccagcgggggtgacttcgacacctattctaacatcagagccgcaggcggtgccgtttgcgaacaacctttggggttggagtgtcgagcacaagcccagcccggtgttcccctgcgcgagctgggccaggtggtcgagtgctccttggacttcgggctggtatgtagaaaccgcgagcaggtgggaaaattcaagatgtgttttaattatgagatccgtgttttctgctgtaactatgggcactgccccagcactccggctaccagcagcaccgccacacctagcagcactccaggcacaacctggatactgaccgagcagactaccgccgctaccactactgcaaccaccggatctaccgctatccctagctctaccccaggtaccgctccgccacccaaggtgcttactagtaccgccaccactccgacagccacatctagcaaggctacaagtagctccagccctagaactgctaccaccttgccagtcttgaccagtactgccaccaagagcacggctaccagcttcaccccgatccccagcttcaccctcgggacgaccggcaccttacctgaacagacaacaaccccaatggcaaccatgtctactattcatccttcaagcacacctgagactacacatacgagtactgtgcttacaacaaaggcaacaacaaccagggcaacatcgtctatgagcactccatcttcaacccccggtactacatggattttaacagaactgactactgctgccactacaaccgcagcaaccggacccaccgctacgcctagtagtactcctgggacgacctggattctgacagagccttcaacaaccgccactgtgacagtacccaccggaagcacagccaccgcatccagcaccagagctactgccggaactctcaaggtcctgacatctaccgcaacaacccccacagtcatctcttcacgggctacgccttccagcagtcctggaaccgcgaccgcactgccagccctgcgtagcaccgcaacaacaccaacagccacctcggtgactgcaattccctccagcagcctggggaccgcatggacccggctcagccagaccactaccccgactgccacgatgtctaccgccacaccctcctctacacctgagacagtccatacatccacagtgctaacgacaactactaccactacccgggcaacagggagcgtcgccacaccctcctctacccccggaacagcacatacaactaaggtccccactaccacaacaacagggtttactgctacgcctagctcatcaccaggaaccgccctgactccaccagtgtggatttcgacaactacaacacccactacacggggatcgaccgttacaccatcatccattcccggtacgactcacaccgcaacagtactcacaaccacaaccacgaccgtggccacaggatctatggctaccccatcatcaagcacacagacctctggaacaactcatacaccccctgtacccaatactacagctacgacccatggccgaagtttacctccttcttccccccacacggttcgaacagcctggacctcggccacatcaggaatcctcggtacaacacacattacagagcccagtacagttaccagtcacacccccgcagcaaccacatccaccacccagcacagcaccccagcattgagctcccctcatcccagttcccgcacaacagaatcgcccccatccccagggaccactacacccggacacaccaggggcacgagtcggactacggcaacagctacacccagtaagactaggacttcgacgctgcttcccagtagcccaacctccgcccctattactaccgtggtgaccaccggctgtgagccccagtgtgcctggtcagaatggcttgattattcctatccaatgcccggtccgtccggaggagattttgatacttattcaaatattagagccgcaggcggagccgtgtgtgagcaaccccttggcttggagtgccgcgcacaagcccagcccggagtgcccctccgcgaattaggccaggtggtagagtgtagcctggatttcggactggtgtgccgaaatagggaacaagtcgggaagtttaagatgtgcttcaactacgaaattagagtcttctgctgtaattatggccactgtccgagcacacccgctaccagctcaaccgctaccccttcttcaaccccaggtacaacctggatcctcactaaactcaccaccaccgcgaccaccacagagagtactgggagtactgccacaccctcctccactccagggacaacctggattctcactgaaccaagtacaacggcgacggtgacagtgcctaccggttctacagccaccgcatcgtcaacacaagccaccgccggtacgccacacgtaagcaccacagccacaactcccactgtgacttccagcaaagctacacctttttctagccccggaacagcgactgctctgcctgccctgcgatcgacagctactacacccacagctacctcatttactgccataccatcctctagcctcggtacgacctggaccaggctatctcagactaccaccccaacagccacaatgtcaactgccacaccctcatccacacctgaaactgcccatacaagtaccgtattgaccactaccgcaaccactacgagagcaaccggctcagtggccactccgtcctctacacctggcaccgcacataccaccaaagtcccaaccactacgacaactgggttcaccgttacgcccagctcctccccagggacagccaggacgcccccagtctggatttcaacgacaaccacccccaccaccagcgggtcgacagtcactcctagctctgttcccggaaccacacacacccccacagtcctgactaccaccaccactacagtggccacgggctccatggccacaccgagttcttccacccagacgagcgggacaacacatactccaccagttccaaataccacggctactactcacggcaggagtctttcaccctccagtccgcacactgtgcgcacagcttggacttccgccacgagcggaacactggggacgacacatattacggagccatccaccggaacttcacacacacccgctgctacgactgggactacccagcactccaccccagccctgtcttctcctcaccctagcagccgcaccaccgagtctccaccctcccccggaaccactactcctggccatacaacagcaactagtcgtacgactgcaaccgccacaccctctaagactcggacttctacactgctcccctcctcaccgacaagcgcgcctattaccaccgtagttactactggatgcgagcctcagtgcgcctggtctgagtggctagactacagctatcccatgcccggaccgagcggcggagattttgatacctatagcaacatccgggcagcaggaggagccgtgtgtgaacagccactgggcctggagtgcagagcgcaggctcagccgggtgtccctctgggagagttaggtcaggtggtggagtgctctctcgactttggactagtatgtcgcaatcgcgagcaggtgggcaagtttaagatgtgctttaactatgagataagagtgttctgctgtaactacggccactgtcccagtacccccgctactagtagcacagccatgccctccagcaccccaggcactacatggattctgactgaactcaccacgaccgcaacaactacggcttcaacaggatctaccgccaccccaagctcaaccccgggaacggccccaccccctaaggtactaacttctccagctactacccccaccgctacatcgagtaaggcgacgtcttcatcaagtcctcgtactgccacaacccttcccgtcctgacatccaccgctacaaagtccaccgctacgtccgtgacacccatacctagttcaacattgggaactacgggcaccttaccggagcagaccactacccctgttgctaccatgagcactatacacccctcgtcaaccccagagaccacgcatactagtactgttctcacaacaaaagctactaccactagggcaacttccagcactagcactccttcctccacacctggcacaacatggatactaaccgagcttactacagccgcaaccactaccgccgcaaccgggccaacggccacaccatctagcacacccggtactacttggatattgacagagctgacgacaaccgccacgactactgccagcacaggttccactgcaacacccagtagcacgcctggaaccacctggatcctaacagaacctagcactacagccacagttactgtgccaacaggctccactgccacggccagttcaacccaggcaacggctggcaccccgcatgtcagtaccacggctaccactccaaccgtaacatcttcaaaagctactccttcaagttcacctgggaccgctacggccctacctgctctgcgctcgaccgctacaacaccgacagccacctcatttactgcaattccgtcttcttcactgggcacgacgtggactcgcttgagtcagacaacaactcctactgccacaatgtctacagcgaccccgtcttcaacacctgaaactgtccacaccagtacagtgctaaccgccactgccacaaccactggagccaccggatcagtggcaacaccgtcctcgactcctgggacagcccatacaaccaaggtgcccacaacaaccactacaggctttactgcgacaccctcaagttcccccggtactgccctgacacctcctacgacaacacccatgtccacaatgtctaccattcatacttcatctaccccagaaacaacacatacttctaccgttctgacaacgaccgcaaccatgactagagctactaattcaacagccactcccagcagcactctcggcacaacccggatcctgactgaactgacaacaaccgctaccaccacagccgctacggggtccactgccacacttagcagcacacccggaaccacttggatcttgactgaaccttccacgatcgcaacagtgatggtgcccactggctcgacagccactgcttcctcaaccctgggaactgcgcacacccccaaagtggtgaccactatggccacaatgcccactgctacagcctcaacagtgccttcttcctcgactgtcggtacaacacggaccccagctgtgctcccatcatccctgccaacgtttagtgtttccacagtcagtagcagtgtactaacgacccttcggcctaccggattccccagctcccacttcagtacgccctgtttctgccgagccttcggccagtttttttctcccggtgaagtcatctacaataagactgacagggccggttgccatttctacgccgtctgtaatcagcattgcgatatcgaccggtttcagggcgcatgtcccacctcaccccctcccgtgtctagcgctcctctgtcttccccttcacccgctccaggctgtgacaacgccatcccattgcgtcaggtaaacgaaacatggaccttggaaaactgcaccgttgcgcgttgtgtgggagataaccgggtcgtcctgctcgatcccaagccagtagcaaacgtcacttgcgttaataaacaccttcccattaaggtatctgatccctcccaaccctgtgatttccactatgagtgcgagtgcgaatgcgtgggtggccgagggataacccctggggctggcatatgcagcatgtggggaggatcccattactccaccttcgatgggacatcctacaccttccgcggtaactgcacttacgtgctgatgagagagattcacgctcgcttcggtaacttgtccctatacctcgacaatcactattgcacagccagcgccaccgctgcggctgcacgctgcccacgagcgctgagcattcattataagagtatggatatcgttctgacagttactatggtccacgggaaagaggaggggctgatcctgttcgaccagataccggtttcctcgggcttcagcaagaacggcgtgctcgtgtccgtcctgggcactacgacaatgcgggtggatatccccgcactgggagtcagcgtgaccttcaatggccaggtgtttcaggcacggctcccatactctctcttccacaacaacaccgaagggcaatgcggaacatgtaccaataaccagagggacgattgtctacagagggatggaacaacagcagccagctgtaaggacatggctaaaacctggcttgtacctgactcacgaaaggacggctgttgggcccctactggcacgccccctacagcgagccctgctgcgcctgtgtcttccacgcctacaccaaccccatgcccgccacagccactgtgcgacttgatgctatcgcaggtctttgcggaatgccacaatctggtcccacctgggcctttttttaacgcctgcattagcgatcactgccggggtcgcttggaagtcccctgtcagtcactcgaggcttatgcagaattatgccgggcacggggtgtttgttcggattggcggggtgccactggtggcctgtgcgacctgacatgccctcctacaaaggtgtataagccctgtggacccatccagcctgccacttgcaacagccgaaaccagtcaccacagctggagggcatggcagaaggatgcttttgtccggaagatcaaatcctcttcaatgctcacatgggcatttgtgtgcaggcttgcccttgtgttggcccagatgggtttcctaagttcccaggagagaggtgggtctccaactgccagagctgcgtgtgcgatgaaggatccgtttcagtgcaatgtaagcccctgccttgcgacgctcagggccaaccgccaccttgtaatcgcccaggcttcgtgacagtcacaagaccacgtgcggaaaacccgtgttgtcctgagacagtatgcgtgtgcaacactaccacttgtcctcaaagcctgcccgtgtgtccccctggtcaggagtcaatatgcacccaggaggaaggggactgctgtccaacctttaggtgcagaccccaactgtgctcgtataatggtaccttctacggtgtgggagcgacatttccaggtgctctcccctgccatatgtgtacatgtctgtcaggtgacacccaggacccgacagtgcaatgtcaggaagatgcttgcaacaacaccacatgcccccaggggttcgagtataagcgtgtggcaggtcaatgctgtggagagtgcgttcagactgcttgccttacaccagacggtcagccagtacaactgaatgagacttgggtgaacagccacgtggacaactgcaccgtgtacctgtgcgaggcagaagggggagttcaccttctgactccacagcccgctagctgcccggatgtgtctagttgccggggtagcctgcggaaaaccggttgctgttattcttgtgaggaagattcatgccaggtgcgtatcaatactaccatactttggcaccagggttgcgagaccgaagttaacataacgttttgcgagggtagctgcccaggagctagtaagtatagtgccgaggcacaagccatgcaacaccaatgcacctgctgtcaggaacggagggtgcacgaggagacagttcccctgcactgtcctaatggctcagcaatactccacacatacacacacgcggtgcaggtgctgtgcggactgctggcgtggggcttgcaggcaggaggacatatcagaggagccgtgcaggaccctcaacaacctctgaaagatcaggaggccagtggaaaggctcgccaaggcggaggatatcggcagacggtggcatggggcgacaagtctaatgcaagggcgtggctacaaaagcccgtcgtatgggtccagagcggagccttccctacacccggaccagccagcgccctctgtccctggta

SEQ ID NO: 231132 - DNA, 17297 bp, Artificial Sequence
  Description of Artificial Sequence: Synthetic coding sequence
atgggagcaccaagtgcctgccggactctcgttctcgccctcgcggcaatgttggtcgtccctcaagctgagactcaggggcctgtggaacccagctgggagaatgccggtcatacgatggacggcggagcgcctacttcaagtcccactcgcagggtgtcctttgtgcccccagtaaccgtcttcccatctctaagcccacttaatcccgctcataacgggagagtgtgtagtacctggggcgatttccattacaaaacctttgacggagatgttttccgctttccaggtctgtgcaattatgttttttctgaacattgtagagccgcatatgaggacttcaatgtgcagctccggagagggctggtgggctctaggcctgtcgttacgcgggtggtgatcaaggcccaggggctcgttctggaagcctccaacgggtctgtgctgatcaatggtcagagagaagaactcccttattcccggaccggactgctggttgaacagtccggtgattacatcaaggtgagcattaggctcgtgttgacctttctctggaacggggaggattcggctcttttggaactagatccaaagtatgccaaccagacatgcggcctgtgcggcgactttaatggcctgcctgccttcaatgaattctacgctcacaatgccaggcttacgcccctgcagttcggcaatctacaaaagttggacggccctacagagcagtgtccagacccactgccgctgccggcaggaaattgcaccgatgaggaaggaatatgtcatagaacgcttctaggacctgcgtttgcggagtgtcatgccctggtggactctacggcttacctcgccgcatgcgcccaagacctatgtcggtgtccaacatgcccatgtgccacatttgttgagtactcccggcagtgtgcccacgccggagggcagccacggaactggaggtgccctgaactgtgcccacgcacatgcccgctgaacatgcagcaccaggagtgcggctccccatgtacagacacctgtagcaatccccagcgggctcaactgtgcgaggaccactgcgtcgacggatgcttttgtccacctgggaggagctgcaccgttctggacgacatcacgcatagcgggtgtcttcccttgggacagtgcccatgcacgcatgggggacgaacctactcgccaggcaccagtttcaacactacatgtagttcttgtacttgctctgggggtctctggcaatgtcaggacttgccttgccctgggacatgctctgtgcaggggggagcccacatttctacctatgacgagaaactgtacgacttacacggcgactgttcttatgttttgtctaagaagtgcgctgatagctcattcacagtcttagcagagttgcgtaagtgcggactgacagataacgagaattgcctgaaagccgttacactaagcctcgatggtggagatactgctatacgtgttcaagctgacggtggagtgttcctgaattcaatttacacacaactgcctttgtcagctgcgaacataaccctatttaccccctcttccttcttcatcgtggtgcagacgggcctgggtctgcagctgctcgtgcagttagtcccgctgatgcaagtatttgtgaggcttgatcctgctcaccagggccagatgtgtggactttgtggaaatttcaaccagaaccaagctgacgatttcaccgctttgagcggcgtagtggaggctactggagctgccttcgccaacacatggaaggcccaggccgcatgcgccaatgcaaggaactccttcgaggatccttgcagcctgtcggtggaaaatgagaactatgcccgacactggtgttccagattgaccgacccaaacagcgccttttctcgatgtcatagcatcattaacccaaaaccttttcatagcaattgcatgttcgacacatgcaactgcgagcgtagcgaggactgtctgtgtgccgcattgtctagttatgtccacgcgtgtgcagcgaagggggtgcaactatccgactggcgggatggtgtttgtaccaagtatatgcagaactgcccaaaaagccagaggtacgcatatgttgttgatgcgtgccagccaacctgcagaggcttatctgaagcagacgtgacctgtagcgtatctttcgtgcccgtggatggctgcacatgtcccgcaggcacctttcttaacgatgctggcgcatgtgttcctgctcaggagtgcccatgttacgcccatggtacggttctggctccgggagaagtagtgcacgatgagggcgcagtgtgtagctgtaccggcggaaagctcagctgcctgggcgcatctctccagaagtcaaccggctgcgcggcaccaatggtctatcttgattgtagcaactccagcgccggaactccaggggctgaatgcctgaggagctgtcacacactggatgttggctgtttttctacacattgcgtctctggctgcgtatgtcccccaggcttggtgagtgatgggagtggcggttgcatcgcagaagaagattgtccttgtgtccacaacgaagcaacttacaaacctggcgagaccatacgagtggattgtaacacttgcacttgtagaaatagacgatgggaatgctcccacagattgtgtctgggtacttgcgtcgcttacggagacggtcattttatcacgttcgatggcgacagatactctttcgaaggctcatgcgagtatatccttgcgcaggactactgcggagacaacactactcatgggacgttcagaattgtgacggagaatattccatgcggaaccactggcaccacttgctcaaaggcaattaagctgttcgtggagagttacgaactgatccttcaagagggaacattcaaggccgttgcacgcggacccggtggcgatccaccctataagattcgctatatggggattttcctggttatagaaacacacgggatggctgtaagctgggaccgcaagaccagcgtttttatacggctccatcaggactataaaggcagagtatgcggactgtgcggcaacttcgacgacaacgccataaatgatttcgcgaccaggtccaggtccgtcgtgggggacgccctagagttcggtaactcatggaagctgtctcctagttgccccgacgcactggccccaaaggacccatgtacggcaaacccatttcgaaagtcctgggcccagaagcagtgtagtatactccacggtcccacctttgccgcatgccgaagtcaggtggattctactaagtattacgaggcgtgcgtgaatgacgcatgcgcctgcgatagtggcggtgactgcgagtgtttctgtactgccgtagctgcgtatgcacaagcctgtcatgatgcaggcctgtgtgtttcttggaggactcccgacacttgccctcttttttgcgacttctacaacccccacgggggatgcgagtggcactaccaaccctgtggggctccatgtctgaagacctgtcgaaatcccagtggtcattgtctagttgacctgccaggccttgagggctgctaccccaaatgtcctccgtctcagccgttcttcaacgaagaccagatgaagtgcgtggctcaatgcgggtgctatgacaaggacggaaactactatgatgtcggggcacgcgtccccacggccgagaattgtcaatcctgtaactgtacaccttctgggatccagtgcgctcactctctcgaggcctgcacttgcacgtatgaagatagaacatactcataccaagatgtcatctataatactacggatgggctgggggcttgtctcatcgccatttgcgggtcgaacgggaccattattcgcaaggcggtcgcatgccccggtactcccgctaccacaccgtttaccttcaccacagcctgggtgccacattccactaccagtcctgccctccccgtgtcaactgtgtgcgtccgtgaggtgtgccgttggtcctcatggtataatgggcatcggcctgaacccggactgggcggtggagactttgagacattcgagaacctgagacagcgagggtatcaagtctgtcccgtgttggctgacatcgaatgccgtgctgctcagctgcctgacatgcctctggaggagcttggccagcaggtggactgtgacagaatgagaggactgatgtgtgcaaattcccaacagtcacccccactctgccacgactacgagttgcgagtcctgtgttgcgaatatgtgccatgtggtccatcgcctgcacctggcaccagcccccagcctagtcttagcgcctcgactgaaccagcagtcccgacacctacccagacgacagccacagagaaaaccaccctctgggttacgccaagcatcaggagtactgccgcactgacttcgcagactggctcctccagtggaccggtgactgtgacgccgagcgcccctggcaccacaacatgtcagcctcgctgccaatggaccgaatggtttgacgaagactaccccaaatcggagcaacttggcggagacgtggagtcttatgacaagataagggccgcaggaggacacctgtgtcaacaaccaaaagacattgagtgtcaggcagaatcttttccaaattggaccctcgcccaggttggtcaaaaggtccactgtgacgtgcacttcggcctggtttgtagaaactgggaacaggagggcgtttttaagatgtgctataactaccgcattagggtgttatgctgcagtgatgatcattgtcgcggtcgggctacgactcctccaccaaccactgagctggaaactgccacaaccacaacgacgcaagccctgttcagtaccccacagcctaccagttccccaggcctgacacgagcacctcccgctagtactacagccgtgcctacactgtctgaggggcttacatcacccagatatactagcacactcgggacagctacgactggcggaccgacgacacctgccggttctacggaacccactgttcctggagtagccaccagtaccttacctacccgaagcgcactgccagggacgacgggcagtctcgggacatggagaccaagccagccccctactttggctcccacgactatggcaacctcccgagcaaggcccactggcaccgccagcaccgcatctaaagaacccctcacaaccagcttggctccaactttaacttccgagcttagcacatcacaggccgagacctccacccctcgcactgagacgacaatgtccccgttgactaataccacaaccagccaggggacaacacgttgtcagcctaaatgtgaatggactgaatggttcgacgtcgattttcccacctcaggagtggcaggtggcgacatggagaccttcgagaatattcgggcagccggaggtaagatgtgttgggctccaaagtctattgagtgtagggccgagaattaccccgaagtgtcaatcgaccaggttgggcaggtcctgacctgttctctggagaccgggcttacctgtaaaaacgaggatcaaacagggagatttaatatgtgctttaactataacgtgcgcgtgttgtgctgcgacgattactcccactgcccctcgacccctgcaacgtcatctacagccactcctagctccacacccggaacaacatggatcctcaccaaacctacaacgacagccaccaccacggccagtaccggatccacagccaccccaaccagtaccctgagaacggcgcctcccccaaaggtgctaacgactaccgccacaacccccaccgtaacatcatccaaggccactcctagttcctcgcccggaaccgcgacggcacttccagcgttgaggtccacggccacaacacccacggcaacgagcgtgacccctatcccttcctcgagcttgggaacaacatggacaagactaagccagacaactacacccacagcgactatgtcaactgctactcccagtagcaccccagagaccgcgcatacgagcaccgttctaactgctacagccactacaactggcgctactggcagcgttgccacaccctcttccacacccggtacagcgcatacgacaaaggtgcccactacaacgaccacaggatttacagcgacaccctctagttccccaggtaccgccctgacccctccagtttggatcagtacaactactacgccaacaacacggggtagtaccgtcactccttccagcataccaggaacaacgcacacagctacagttttgacaactactaccactacagttgctaccgggagcatggccaccccttcttccagtacccagacaagtggcacaccaccctccttaactacgaccgcgacaacaatcacggcgactggcagcacgaccaacccttcttcaacacccggaacaacaccgatccccccagtgctaactaccactgccactacacctgccgctacgtcaaatacagtaaccccctcgagcgcactggggacgacgcataccccacccgtccctaataccatggccaccacacatggaaggtctctacctccgtcttccccccacactgttcggaccgcctggacgtcagctacgtctggcatactgggtaccacccatatcaccgaaccatccaccgtcaccagccacacactggcagcaaccaccggaactacgcagcactccacacccgcattgagcagtccccatccgtcatctaggacgaccgaatccccgccaagccccggaacaaccacccctggacacactacagcaaccagccgcactacagctaccgctactccatccaagacccgcacaagcactctcctgccaagttcccctacgtctgcgccaataacaaccgtcgtgactatgggctgtgagccacagtgcgcttggtccgaatggttggactattcataccctatgcccggacctagcggcggagatttcgatacgtacagcaatatccgggcagctggcggtgccgtgtgcgagcaaccattggggctcgaatgccgggctcaagcccagcctggagtgcctttacgggaactgggtcaggtcgtggagtgtagtctggactttggtctcgtctgccggaaccgagagcaggtgggaaaattcaagatgtgctttaactacgagatcagggtgttttgctgtaactacggacattgtccatccacacccgctacatcttccaccgctatgcctagctctactcctggaactacctggatcttaaccgaactaactacaacagcaacaacaaccgagagtaccggtagcaccgccacgccaagcagtacgcccggaactacttggatactaaccgagcccagtactactgctacagtgaccgtgcctaccggcagtactgcgaccgccagttctacacaagcgactgccggtactccgcacgtatccaccactgccacgactcccacggtgacatcgagcaaagctactcctttttctagccctgggacagccactgccctcccagccctgcgctccactgctactaccccaaccgccacaagtttcaccgcgattccctcttcgagcctcgggacaacgtggacaagactgtcacagacaaccacgcctacagccaccatgtcaactgctaccccgtcgtcgacacccgaaacggtccacacctcgaccgtgctcaccactacggccactacaaccggtgccaccggaagcgtggcgaccccgtcctcgaccccaggtacagcccatacaacaaaggttctaacaacgactacgactgggtttactgctactcctagctctagccctggaacagctagaactctacccgtgtggatcagcacaaccacaacacccactaccagaggctcaaccgtgactccttctagcatccccggtactacccacactcctacagtactgacgacaacaacaacgacagtggccacaggatcaatggccactcctagtagcagcacccagacatctggcactccgccttccctcacgactaccgccaccacaatcacggccaccggctctacgactaacccaagtagtacgcccggaactacccctattcctccagtccttacaaccacggctacgacccctgcggctaccagcagtaccgtcactccatcctccgctcttgggaccacccatacaccacctgtgcccaataccacagctaccactcatgggagatcgctgtcccctagctcaccccacacggtgagaaccgcctggaccagcgcgacaagcgggactcttgggaccactcatatcacagaaccttccaccgggacctcccatacaccagcggctacaacagggacgacccagcacagcaccccagcgctgtccagtcctcatccgtcttcccgtacaactgagagcccaccgagccctgggaccacaacgccgggacatacccgggctacatcaaggaccaccgccacagctactccatcaaagacgcgtacgtcaaccctgctgccatcctcgccgacctctgccccaatcaccactgtggtcaccatgggatgcgagcctcagtgtgcgtggtctgagtggctcgactacagttatcccatgcctggacctagcgggggagatttcgatacctatagcaatatccgtgcagccggtggggcagtttgcgaacagcccctcgggctggaatgccgcgcacaggcacagcccggagttccgcttagggagctgggccaggtggtcgagtgtagtctggacttcggactggtgtgccgtaatcgagagcaggtgggtaagttcaagatgtgctttaactatgaaataagagttttctgctgcaactacggccattgcccgtctacccccgctacctcctcaactgctactcccagcagcacccctggcacgacatggatcctgactgagcagaccaccgccgctactaccacagcaaccaccggaagcacagccataccctcatccacacccggtacggccccacccccaaaagtcctgacgtcgacggcaacaaccccaactgctacgtcttcgaaagccacatcttcatcaagtccaaggactgccacaaccttgcccgtgttaacgtcgaccgccacaaaatctaccgcgacctcttttacaccaattccctcctttactttgggaaccactgggacactccctgagcaaaccactaccccaatggcaacaatgtccactatccaccccagcagtactcctgagaccacacacacctcaactgtgctgacaaccaaggccacaacaacgcgcgcaaccagttctatgagtacccctagttcgacccccggaaccacctggatccttaccgaactcacgaccgcggcaaccaccactgccgcaaccggccctacggccacaccctccagtacacccggtacaacttggatcctgacagagccaagcacaacagcgaccgtgacagtgccaaccgggagtaccgctaccgcgtctagcaccagagccaccgcaggcacactcaaagtcctgactagtacggcaactacgcccaccgtgatcagcagtagagctacaccatcatctagtcccggtaccgccacagcgcttcctgccctgaggtccaccgccactactcccacagccacctcagtgactgccattccatcttcttccctagggacagcctggactagattgtcccagaccacgacacccactgccactatgtcaaccgctactcctagcagcacgcctgagacagtccatacatcaacggtgttgaccactaccacgactacgactagggctacaggctctgtagcgaccccatcaagcacgccaggaaccgcgcacacaaccaaagttcctactacaaccacaactggatttactgcaaccccaagctcttcccctggcaccgccctcaccccaccagtctggataagcacgactactactcccacgacgcggggtagcactgtcacgccatcgtcaattcctggaaccacacacactgcgaccgtactgacaacaaccactacaacagttgcaaccggctccatggcaacccctagcagcagcacccagacaagcgggactccaccttcactgacgacaacagcaaccaccattacagcaactggctccaccacaaaccctagtagcactcccggtacaacgccaattccgccagttctaacaactactgcaacaacccctgccgctactagcagtacagtgacacctagcagcgcactggggaccacacacacaccaccggtccccaatacaacagccactactcacggccgatctctacccccatcaagtccacatacagtgaggacggcctggaccagcgccacctctggtatccttggcaccacacatattacagaaccgagcacagtcactagccacacccctgccgctaccacaagtactactcagcatagcacacccgctctgtcaagtccacacccctcttcccggacaaccgaatctcccccatcacctgggacaaccacaccaggtcacacgagggggacatctcgcacaacggcgacagcaaccccttccaaaacacggacttctactctactcccgagctctccgacctccgctcctatcacaaccgtggttacaacaggatgcgaacctcagtgcgcttggtccgagtggctggattactcttatcctatgccaggaccatccggtggggacttcgacacctatagtaacatccgggctgccggtggtgccgtgtgtgaacagcctctaggcctggagtgtagagcacaggcgcaacccggtgtgccgctgcgcgagctggggcaggtcgtggaatgcagcctagacttcggcctcgtgtgccggaacagagagcaagttggcaaatttaaaatgtgctttaattatgagataagggtgttctgttgcaactatgggcactgcccttctacaccagcaacctcttccacggcaactccaagtagcacccctggaaccacttggattctgacgaagttgactacaacggccacgactacagagtctactgggagtaccgcaacccctagctcaacccccggaactacttggatcttaacggagcctagcacaaccgcaacagtgactgtgcccaccggctctacagctacggcaagttcaacacaagccactgccggtaccccacacgtgtctaccaccgcaactacaccaacagtaactagttctaaggcaacgcctttcagctcaccaggcacagctacagcactccccgctctgaggagtacagccacaacaccaaccgcgacatcatttaccgctatcccaagttcctctcttgggactacctggacgcggctctctcaaaccacaactcccacggcgacaatgtccaccgctactcctagttcaacaccggagaccgcccacacatccacagtgctaaccactaccgccacaacaactcgggctactggttctgtggccactccctccagcacccctgggactgctcatactaccaaagtgcctactaccaccaccacgggatttacagttacaccttcttccagcccagggacagccaggaccccacccgtgtggatttccaccacaacgacccccaccacgtcaggatcaaccgttacacccagttcggtccctggcactacgcacaccccgacagtgcttaccactaccactactacagtggcgaccggatccatggctactcctagttctagcacgcagacatcaggcacaccacctagtttgatcacaactgcgactacgattacagctactggatcgaccactaatccaagctccacacccggtactactccaataccgcctgtgctcaccacaacagccactactcccgctgcgacctcatcaacagttacaccttcgtcagcgctaggaactacacacactcctcctgtgcctaacacgacagctacaacccacgggcgaagcctgtctccttcgagtccacatactgtgcgaacagcatggacatctgcaacctctgggactctggggacaacgcatatcacagagccttctacggggacctcacacactcctgccgctacaaccggcactactcaacactccaccccagcgttgagttcaccccatccgtcgtctcggactactgagagtccgcctagccccggaaccaccactcctggccacaccaccgccacgtccagaactaccgcgacggcaacacccagcaagacacgcacatcgacactgctgccaagctcaccgaccagcgcacccatcaccaccgtggttacaacaggatgcgaaccccaatgcgcctggtctgagtggctggactactcttatcccatgccaggccctagcggcggagattttgacacgtatagcaatatccgagccgctggcggtgccgtctgtgaacagcctctggggctggagtgccgggctcaggcccagccgggagtgccattaggtgaacttggccaggttgtcgaatgttcgctcgatttcggtttagtgtgccggaatagagagcaagttggcaaatttaaaatgtgcttcaattatgagatcagagttttctgttgtaattacggtcactgtcccagcacgccagctactagctctacggccatgccctcgtctacgcctggaacaacctggatcctgaccgagctcaccaccactgcgacaaccaccgcgtctaccggatccactgccacccccagcagcactccaggcacagcccctccacccaaagttctgacttcccccgctacaacaccaaccgcaacttcgagcaaggctacctcctcttcttcccccaggactgcaaccacactccccgtgctgactagcaccgccactaagtcaacggcaacttctgtcactcctataccttcctccacattggggacaactggcacactgcccgagcagaccacaacccccgtcgccaccatgtctacaatacacccatcaagtacccccgaaacaactcacacaagtaccgtactgactacaaaggcaaccactacacgggctacctcttcaactagcacgccttctagtactcctgggaccacatggattttgactgagctcaccactgccgctacaactaccgccgctaccgggcctactgctactccctcaagcacaccaggtacgacctggatcctcacagagctcaccacgactgccacaactacagcctctaccgggtctacagcgacgccctcctccaccccgggtacaacctggatccttacagaaccatcaacaaccgcgacagtcaccgtccccaccggatcgaccgcgaccgccagcagcacccaggctacagccggtacgcctcatgtatcaactaccgctaccactcctacagtgaccagttctaaagccaccccgtccagttctccgggaacagcgacagccctgcccgcacttcgctctacggcaaccactccaacggccacgagctttaccgctattccgtcaagttccctgggcactacatggacacgactgtcccaaaccaccacacccactgccacaatgtctaccgcgacgcctagttccacgcctgaaacagtccacacttcaacagttctcacagctactgcaactaccacgggcgctaccgggtccgtcgcaaccccaagctctacaccaggcaccgcgcatactactaaggtgcccacaaccaccaccactggattcacagccaccccgtcatccagccctggcactgctcttacaccaccggtttggatcagcacaacaaccacacccaccaccaccacacccactactagtgggagcaccgtgaccccaagcagtattccgggtacaacccatactgcacgggtcttaacaaccactacaaccacagtcgctactgggtcgatggccacacctagtagctcgacacagacatctggaactccacccagtctgaccacgaccgcaaccacaattactgccaccggcagtacaaccaacccttcgagcacgccaggaaccacaccgattacacccgtgcttacctccacggccaccaccccggcagctacctcaagtaaagcgacatcatctagcagtccgcgaaccgcaactaccctcccggtattaacctctacagccactaagtcaacagccacaagtttcacgccaatcccttcctccacactttggacaacctggaccgttccggcacagacgaccacaccaatgtccacaatgtctacgatccatacaagttccacacccgagaccactcacacatccaccgtactgaccaccacagccacaatgacacgcgcaacaaattcaaccgctacaccatccagcacactaggaaccacgcgcattctgaccgagctcactacgaccgctactacaaccgcagcaaccggctctacggctacgctaagctctactccaggtacgacgtggatactaaccgagccctctactattgccacagtcatggtgcccactggatctacagcaacagcgtctagtacgcttggaaccgcccacactccaaaagtcgtcaccactatggccaccatgccgactgccactgcctcaactgttccttcaagttccaccgtgggcacaaccagaaccccggctgttttgccctccagtcttcctacgttcagcgtgagcacagtaagttcatctgtactgacaacactgaggcccactggattccctagctcccatttcagcacgccctgcttttgcagggccttcggacagttcttcagtcccggtgaagtaatctataacaaaactgatcgggcaggctgtcatttctacgctgtatgtaaccagcactgcgatattgatcgttttcagggtgcttgcccaacatcacctcctcctgtttcgtcggcgcctctctcctcaccaagtccagcacccggttgcgataatgccatacccctgagacaggtgaacgagacttggacgctcgagaattgcacagtggccaggtgtgtgggggataaccgcgtcgtgctgctcgatcccaagccagtggccaatgttacctgtgtgaacaaacatttgccaatcaaggtgtcagatccatcgcaaccttgtgattttcactacgaatgcgagtgtatctgtagcatgtggggtggctctcattactctacattcgacggtaccagttacacatttagaggaaactgtacatacgtgctcatgcgcgagattcacgcgagatttggcaacctgtccctctaccttgataatcactattgtaccgcctcagccaccgcagctgctgcaaggtgtccaagagccctcagcatacactataaatccatggacatcgttctgacagtgaccatggttcacggcaaagaggagggtcttatcctgttcgaccagatcccagtgtcctctggattcagtaaaaatggtgttcttgtttcggtgttaggaaccacgaccatgcgcgtggacatccccgctctcggcgtgtcagtcacctttaatggccaggtcttccaggccagactgccctactccttatttcacaataatacagaaggccagtgtggcacctgcactaataaccaacgggacgattgtctgcagcgagatggcactacagctgctagctgcaaggatatggctaaaacctggcttgtgccagatagccggaaagacggctgctgggcgcctaccgggactccgcctacagcctctcctgccgctcctgtgagctctactccaaccccaactccctgcccacctcaacctctgtgtgacctcatgctgtcacaagtctttgccgagtgtcacaacctcgttccacccggaccattctttaatgcctgtatctccgatcactgccgaggcaggttagaggtcccatgtcagtctttggaagcctacgccgaactgtgtcgcgctcgtggagtttgctcagattggagaggcgcaacagggggactgtgcgacctcacttgtccaccaaccaaagtctataaaccttgcggcccaatccagcctgccacctgcaattcacggaaccagtcccctcagctcgaagggatggcagaaggctgtttctgccctgaagatcaaatcctttttaacgcacacatggggatctgtgtgcaggcgtgcccttgcgtgggcccagacggatttccaaaatttcctggtgagagatgggtttccaactgccagagttgtgtgtgtgacgaagggagtgtatcagttcagtgcaagccactgccatgtgatgcacagggccaaccacctccatgcaacaggccagggttcgtgaccgtcacccgaccccgtgccgagaatccatgttgtccagaaactgtgtgtgtgtgtaatacaactacctgcccgcagtctctccccgtgtgccctcccggacaggagagtatctgcacacaggaagaaggggactgctgccctactttcaggtgcagacctcaactgtgcagttacaatgggactttctacggggttggggcaacttttcccggtgccctgccatgccatatgtgcacttgcctctcaggcgacacacaagatcccaccgtgcagtgccaggaagacgcttgcaataatactacatgtccacaggggttcgagtacaaacgcgtggcaggtcaatgctgtggcgaatgcgttcagacagcatgtctgacccccgatgggcaacctgtgcagttaaacgagacttgggtgaatagccacgtggacaactgtaccgtgtacctgtgcgaggccgaaggaggagtgcatctcttgaccccacaacctgcaagctgccccgatgtttcgtcctgccgaggatctctcagaaagacagggtgctgctacagctgtgaagaggattcctgtcaggtccgaatcaacacaacaattctatggcatcaaggctgtgagacggaggtcaacatcactttttgcgaagggtcctgtccaggggctagtaaatattcagctgaggcccaggccatgcagcaccagtgtacatgttgtcaagaaagacgggtgcacgaagaaaccgtgcctttgcactgtcccaacggttcagctattttacacacatatactcatgtggatgagtgcggatgcacccccttttgtgtgccagcccctatggcacctccgcatactaggggttttcctgcccaggaggccactgctgtgta

SEQ ID NO: 231133 - DNA, 17289 bp, Artificial Sequence
  Description of Artificial Sequence: Synthetic coding sequence
atgggggcaccctccgcttgtaggaccctggttttggccctggccgcaatgttagtcgtgccccaggccgagacacaaggtcccgtggagccttcttgggagaatgcaggccacactatggacggcggagcccctacctcgtccccaactcgccgagtgagctttgtccccccagtgaccgtgttccctagtctctcacccctcaaccctgcgcacaacggacgggtgtgcagcacctggggagacttccactacaagactttcgacggagatgtgtttcgcttccccggactgtgcaactacgtgtttagtgagcactgccgcgctgcctacgaagatttcaacgtgcagttgcgacgagggctggtggggtcccgtcctgttgttacccgcgttgtgatcaaagcgcagggcttggtcctagaagccagcaatgggagtgttctgatcaatggtcaaagggaggagctgccctacagtcgaactggtctattggtggaacaaagtggagattacatcaaggtgtcaattcggcttgtcctaacctttttgtggaacggtgaggactcagccttgctagagctggaccctaagtacgccaatcagacctgtggcctgtgcggagacttcaatggcctcccagcattcaatgagttctatgcccacaacgctcggctgacaccactccaatttggaaacctccaaaaattggatggcccaaccgaacagtgcccagatccgctccctctaccggctggtaactgcaccgacgaggaaggcatttgccaccgcacacttctggggccagccttcgctgagtgccacgccctggtggattctacggcctatctagcagcttgtgctcaggatctctgccggtgcccaacatgcccgtgcgctactttcgtggagtattctcgtcagtgtgctcacgcagggggacagccccgaaactggcgatgtcctgaactatgtcccagaacatgccccctcaacatgcagcaccaagaatgcgggtccccatgcaccgatacatgctctaacccacagcgggctcagctgtgcgaagatcactgcgtggatggatgcttctgcccgccaggtaccgtgcttgatgatattacacacagcggctgtctgccgctggggcagtgcccatgtacccacggtggacggacttactctcccggtacttcttttaacactacttgttccagctgtacttgtagcggcggactgtggcagtgtcaggatcttccttgtcctggcacttgctcagtccaggggggagcgcacatcagcacctatgacgagaaactgtatgatctgcatggggattgttcatatgtcctctcaaagaagtgtgccgactcatcctttacggtgctggccgagttgcgcaaatgtggtctgactgacaacgaaaattgtctaaaagccgtgaccctctcgctcgatgggggtgacaccgcgatcagggtgcaggcggacgggggagtattcctgaactccatttacacccagctgcctctgtcagcagcaaatatcacattatttactccatcctcattttttattgtggtccagacaggccttgggcttcaactcctggtgcaactggtgcctctgatgcaagtgtttgtacgcctggaccccgctcatcagggccagatgtgcggtctgtgcgggaactttaaccaaaatcaggcggatgattttacagcgttgagcggagtggtcgaggccaccggcgctgcctttgccaacacttggaaagcccaggcagcttgcgccaatgcgagaaacagcttcgaggatccatgttccctgtcagtggaaaacgaaaactacgccaggcactggtgctcccgtctgaccgatccaaatagtgctttcagccgttgtcactccattattaatcccaagccattccactctaactgcatgtttgatacctgcaattgcgaacgaagtgaggattgcttgtgtgctgcccttagctcgtacgtccacgcttgtgcggctaaaggagtccaactttccgactggagagatggcgtgtgtacaaagtacatgcagaactgtcctaagtctcaacgctatgcctatgtggtagatgcgtgccagccgacctgcagaggactctctgaagctgacgttacttgcagcgttagcttcgtgcctgtggacgggtgtacatgtcctgctgggactttcctgaacgatgcaggcgcatgcgtgccagcacaggagtgcccttgctatgctcacggaacagtacttgctcctggcgaggtggtgcatgacgagggcgctgtgtgcagttgcactggagggaaactgtcctgtctgggggcatccctccagaagagtacgggatgcgccgctcctatggtttacttggactgtagcaatagtagtgccggaacacctggggctgagtgcctgcggagctgccatactctcgatgtgggctgcttttcaactcactgtgtttcgggttgcgtctgtcctccaggtctggtatctgacggttccggcggatgtatagctgaggaagattgtccatgtgtgcacaacgaggccacgtacaaaccgggagagaccattcgcgtggattgtaacacctgtacttgtcgaaaccgtcgatgggaatgttcacacaggctatgtttaggtacctgtgtcgcatatggagatggacattttatcacatttgatggggacagatacagctttgaaggctcttgtgagtatattttagcccaggattattgcggcgataacacgacacatggaacatttcggatcgttaccgagaacatcccctgcggaactaccggcactacgtgctccaaagcaatcaaactatttgtcgagtcctatgagctaatcctgcaggagggtaccttcaaggctgtagccaggggtccgggtggtgatcctccgtacaagatccgatatatgggaatctttctggtgattgaaacgcacgggatggcagtgtcctgggataggaagacgtccgtctttatcaggctccaccaagactataaaggtcgggtatgcggcctttgtggcaactttgacgacaatgcgattaacgatttcgccacacgctcaagaagcgtggtaggagacgccctggagtttggaaactcttggaaactcagcccaagctgccccgatgcccttgccccaaaagatccatgcaccgctaatccttttaggaagagctgggcccagaaacagtgttctatcctgcatggccctacctttgcagcctgccgctctcaggtggattcaactaaatattacgaagcatgcgttaacgacgcttgtgcatgtgactctggaggtgactgcgagtgtttttgcactgctgttgcagcctacgctcaagcttgccacgatgccggtctctgcgtgtcgtggcgcacacctgacacctgcccattattctgcgatttctacaacccccacggtgggtgcgaatggcactaccagccatgtggcgcaccctgtctgaagacctgtagaaacccatccgggcattgtctggtggatctgcccggactggaggggtgctaccctaaatgtcctccgagccagcctttttttaatgaagaccagatgaaatgtgtggcacagtgcggatgttatgacaaggatggcaattactacgacgtgggcgctagagtccctaccgccgaaaactgtcaatcgtgtaactgtactccctcaggcatacagtgtgctcattctctggaggcctgcacttgcacttacgaagatcgtacttacagctaccaggacgtaatttataatacaacagacggcctcggcgcttgccttatcgcaatttgcgggagtaatggcactatcataagaaaagcagtggcctgccccggtactcccgctaccaccccatttactttcacaaccgcttgggtcccccactccacaacatcccccgcactgccagtgagcactgtgtgtgtacgtgaagtatgccgatggtcatcctggtacaatggacacaggccagagccgggattgggaggcggagattttgagacattcgaaaatctcagacagcgtgggtatcaggtctgcccagtcctcgcagacatcgagtgccgagccgctcagctccccgatatgccactggaggaactgggtcaacaggttgattgcgatcgaatgagaggactgatgtgtgccaatagccagcagagccctccactctgtcacgactacgagctgagggtcttgtgctgcgagtatgtcccctgtggacccagtccagcacctggcacttccccccagcccagtctgagtgcgagcaccgagccagctgtccccacgcctacccagacgacagccacggaaaagaccacactgtgggtgaccccttccattaggagtactgccgctctgactagtcaaacagggagttctagcggcccagttactgtaactccatccgctcccggtactacaacgtgccagccccgatgccagtggacggaatggttcgatgaggactatccgaagtccgaacaactgggtggagacgtggaatcgtacgataaaataagggcagcaggcggacacctctgtcaacagcccaaggatatagaatgccaggcagaatcatttccaaattggaccctggcgcaggtggggcagaaagtccattgtgacgtgcatttcggtctcgtgtgtcgaaattgggaacaagaaggcgtgtttaaaatgtgctacaactacagaatccgtgtcctctgttgttcggacgaccattgccggggacgtgccactacacctccaccgacgacggaactggaaaccgccaccacaacaactacccaagccctcttttcaacaccccagccgacatctagccccggactgaccagagctcctcctgcctctaccaccgcggttccaacattaagcgaggggctcaccagccccagatataccagtacactggggacagcaactaccgggggacctacaacccccgcaggttcaaccgagccaacagtgccgggagttgctactagtacgctcccaaccagatcggccctacctggaactacgggtagtcttggaacatggaggccatcacagcctccaaccctggcgcctactactatggctacatctcgcgcaaggcccacggggactgcttcaaccgccagtaaggagcccttgaccacttcactggctcctacactgacgtccgaactgagtacttctcaagccgagacatctaccccgagaacagagacaaccatgtcaccactgacaaacaccaccacttcgcagggaactactcgatgtcagccgaagtgcgagtggaccgagtggttcgatgtcgactttccaacttctggagtggcaggaggggatatggagaccttcgagaacatccgcgctgcgggaggaaaaatgtgttgggcgcctaagtctattgagtgccgggctgagaactaccctgaggtgagcattgatcaagtcgggcaggttctgacctgcagtcttgaaacaggactaacatgcaagaacgaggatcagactggaagatttaatatgtgctttaattataacgtcagggtactgtgctgcgacgactattcacactgcccgtcgacacccgcaacaagctcaaccgctacaccaagttccacaccaggcaccacctggattctcaccaagcctaccacaaccgcaaccacaacggcatccaccggatcgacggctacaccaacctctacactccgcaccgccccaccacctaaggtgctgaccacgacagccactacaccaacagttacatcgtctaaagcgaccccctccagtagtcccggtacggcaacggcacttcctgctctgaggagtactgcgactaccccaactgccacatctgtgacccccattccatccagctccctaggcacaacatggacccgcttaagccagacaactactcccactgccaccatgtctactgccaccccaagttctacccctgagaccgcccacacttccactgttctgaccgccacagcgactaccaccggcgctacaggatctgtggcgacgccttcctctactcccggaacggctcataccactaaggttccaacaaccacaaccaccgggttcaccgcaaccccttctagtagtccaggcactgcattgactccacctgtttggatttcaacaaccacaacaccaaccacacggggttcaaccgtgaccccgtccagcattcccggaacgacacacacggcgaccgtgctcaccactaccaccacaacggttgctaccgggagtatggcaactcctagttccagtacccagacatctggcacgcctccctccttaacgactactgccaccactattaccgccacagggtccaccactaacccctctagcacccccggaaccacacctattcccccagtactgactacaaccgcaacaactccagccgcaaccagcaacactgtgacaccgagctcagccctcggtactacgcacactccgccagtgccaaatacgatggccaccacccacgggagatccctgccgccaagttctcctcatactgtaagaacagcctggaccagcgcaacttccggtatcttagggaccacgcatattaccgagcctagtacggtgacctctcacaccctcgccgctaccactggcaccacacaacactccactcctgcactatcaagtcctcaccctagcagtcgcactacagaatcccctcccagcccgggaacgactacccctgggcataccactgctacaagcaggaccaccgccaccgccacgccaagcaagaccagaacatccacgctcctgcccagtagccctacctcagctcctatcacaacggtggtgacaatggggtgcgagccccagtgtgcctggagcgagtggctagattactcctaccctatgcccggtccatctggaggagatttcgacacctattctaacataagagcagcaggaggggctgtgtgtgaacaaccactgggactcgagtgtcgagcacaggcccagccaggcgtgcctctgcgtgaactgggccaggtggtggaatgctccctcgactttggactggtatgccgcaatcgcgaacaagtgggaaagtttaagatgtgctttaactacgagatcagggtattttgttgcaactatggtcactgtccttccacccccgctacttcctcgaccgctatgccgtcttctaccccaggcactacgtggattctcacagaacttactacaactgctacaactacagaaagcacaggctccactgctactccaagcagtactccaggcacgacttggatcttaactgaaccctccacgacagccaccgtcaccgttccaaccggctccacagcgaccgcttcatctacgcaggccaccgcaggaactccacacgttagcacgactgctacaaccccgactgttaccagttccaaggcgactcccttcagctcacccggaacggctacagccctccccgcacttagatcaacagccaccacaccgactgccacatcctttactgccattccctctagctctctggggacgacctggaccagactgagccagaccaccacacctactgctaccatgtctacagccactccttcctcgactcctgagacggtgcacacttctaccgtactgacaactaccgcgaccacaaccggcgcaaccgggtcagtagcaactcccagttccaccccaggcacggcccacaccacaaaagtgctgaccacgaccaccaccggatttacagccacaccatcaagttcccctggcactgccagaacactgccggtgtggatcagtactaccaccacaccaactacgagaggatcgacggtcacgcccagcagtatacctggaactacccacacccccacagtattaaccacaactacaaccaccgtggccaccggctccatggccacccccagtagctctacacagacctccggcacccctccaagcctcaccacaaccgccacaacaattaccgctaccggaagcaccactaatcccagcagtactcccggtaccactcctatccctccggttctcacaaccacagccactacacccgctgccacaagctcaactgtcacccccagctcagcactcggcactacccacaccccgcctgttcccaatacaacagcaacaactcatggaaggagtctgagtcctagtagtcctcacaccgtgcgaacagcttggacatccgccacctctggtacacttggaacgacacacattacagaaccaagcacaggaacatcccacacacctgcagcaacgactggcaccacacagcacagcacacctgctctgagctctcctcacccgtcttctagaaccactgagtcacctccctccccaggaacaaccacaccaggccacactcgggctacatcacgtactacagccacagccactccttcaaaaactcggactagcaccctcctcccgtccagtccaacctcagcacccattacaacagtggttacgatgggctgcgaacctcagtgcgcttggagcgagtggctagactactcataccctatgccaggcccaagcggaggtgattttgatacatactcaaatataagggctgctggtggagctgtgtgcgaacagccactcggcctagagtgcagagctcaggcacagccaggtgtgccactccgcgaactgggccaggtggttgaatgttccctggactttgggctggtctgtcggaaccgggagcaggtcggtaagtttaaaatgtgcttcaactatgaaatccgcgtattttgctgcaattacggtcattgtcctagtactcctgcaaccagctcaacggcaaccccttcttccacgccgggtaccacttggatcctgacagagcaaactacagcagctaccaccacggccacgactggtagtacagcaatcccttcctctacccctggtaccgctcccccacccaaagtcctgacatccacggccacaactccaacggcgaccagttcaaaggcaaccagctctagctccccccgtaccgcaacaacactgccagttctcacctctacggcaacaaaatcaaccgcgaccagctttactcccatcccatctttcacccttggaaccacgggaaccctccccgagcaaaccactacaccaatggccaccatgagtaccattcacccatccagtacacccgaaaccacacacaccagcactgtgctgaccactaaggccaccaccactcgagcaacttcttcgatgtctacaccatcttctactcctgggacaacttggatactcacggaactgacaactgcagccacaaccacggccgcaaccgggccaactgctacacctagttccacgcccggaacgacgtggatcctgacggagccatctaccaccgcaacagtgaccgtacccaccggaagcacggcgacagctagctctacccgggcaactgccggaaccctcaaggttctcacatctaccgccaccactcctacagtgatctctagtcgtgccaccccctccagtagtccaggtacagccactgcactgccagctctgagatctaccgccactacgccgacagccacatctgtgaccgctatcccatctagcagtctcggcacagcctggacacggctgtctcagaccaccactcctacagcaactatgtccactgccactccaagctccactcccgagacagtgcatactagcaccgtgctcactaccactacgaccaccactagagccaccggaagcgtagctactccctcctcgaccccgggtacagcccacacgacaaaggtaccaacaacgaccaccactggttttactgcaaccccaagcagctcacccggaacagcccttacccccccagtgtggattagtacgaccactactccaacgactaggggaagcactgtgacgccaagtagcattcctggcacaacacataccgcgaccgtgttaaccactactaccaccacggtggccaccgggagcatggcaaccccaagcagctccacacagactagcgggacaccgccatctctgacgactaccgccacaactatcactgctaccggttccacaacaaacccctcaagtacaccaggcacaacgcccatcccgccagtgctcacaaccactgccacaactcctgcagcaacctctagcacagtcacacccagtagcgctcttggtacgacacatacgccgcctgttcctaacacaactgctacgacccacggcagaagcctgcccccttcctcgccacataccgtccgcaccgcctggacctctgccacctctgggattctgggcaccacgcacatcaccgagccctcaacagtgacatcacatacccccgcagcaactaccagtactacgcagcattcgacaccagcccttagcagcccacatcccagctcgcggactacagaatctccccctagtcctgggaccacaactccaggtcacacccggggaacatcaaggactaccgctactgccactcccagtaaaacacgaacgtccactctgctgcctagctcccctacgagtgcacctattacaacagttgtcacaaccggctgtgagcctcagtgcgcgtggagtgagtggttagattatagttatccaatgccaggcccatccggtggggatttcgatacttactccaacattcgtgcagccggaggcgcagtttgtgaacagcctctgggccttgaatgccgggcacaggcccagccaggagttcctctgcgggagctcggccaggtggtggaatgttcattagattttggcctggtgtgccgcaatcgggagcaagtcggaaaatttaaaatgtgttttaactacgagatacgcgtgttttgctgtaactacggccactgcccaagtacacctgccacttcttccacggctactccttcaagtacccctgggacgacctggatattgacaaagctgaccaccactgctacaacaacagaatccactgggtcaacagcaacaccctcgtccacgcctggaacaacctggattctgactgaacctagcacaactgccaccgtaacagtaccaaccgggtccaccgccactgcctctagcactcaagctaccgctggtactccacatgtctcaacgacagctaccacgcccaccgtgacatctagcaaggcaacccctttttcttccccaggaactgccaccgccctcccggctctaaggtcaactgccacgacccctaccgcaacatcgttcacggccataccatcttcttctctgggtaccacttggacacgactgagccagactaccaccccaactgctacaatgagcacagcaacaccctcttcaaccccagaaaccgcccacactagcacggtgctcactacaaccgccaccacgacccgcgctacaggttccgttgccacaccttcttcgaccccgggaaccgcacatacaacaaaggttccaacgacaaccaccaccggtttcaccgttacgccatcttccagcccaggaacagccagaacccctcccgtgtggatctccacgactactacccctactaccagcgggtccaccgtgacccccagtagtgtcccaggaactacccatacccctacggttctcaccaccactactactacagtcgctaccggctcaatggcaactccgagctcgagtactcaaaccagtggcactcctccctcactcatcaccacagccaccactatcacagccaccggatccacgaccaatccgtcctctactcccggaacaactccgatccctcctgttttgaccaccaccgctactacacctgctgccacaagcagcacagtgaccccctcttctgcgttgggcaccacgcataccccaccggtgcctaataccaccgcaacgacacacggaaggtccttaagccctagttctccgcatacagtgcgcacagcctggacaagcgcgactagcggaacactcgggacaacgcacattacagagccaagtacaggcacttcccacacccccgctgcgacaaccggcacgacgcagcacagcacccctgctctttcgagtccgcacccgtcaagccgaactacagagtcaccaccttcacccggtacaaccactcctggtcacacaactgctacttcacggaccacagccaccgcaacaccttcaaagacccgtacgtctaccctgctgcccagctcccctacctctgcccctattactacggttgtcactacggggtgtgagccccagtgcgcatggtctgagtggcttgactatagttaccccatgcccggaccatccggtggagactttgacacttacagcaacattcgagcggctgggggtgctgtttgcgagcaacctttggggctggaatgccgtgcacaagcccagccgggagtgccactcggagagctggggcaggtcgtcgaatgttccctggattttggcctggtgtgtcggaacagggaacaggttggtaagtttaagatgtgcttcaattatgaaatcagggtgttttgctgcaactatgggcactgcccttccaccccagccacgtcctcaactgccatgccgtccagcacacccggtacaacatggattctgaccgagctaacgaccaccgcgaccacaaccgcatcaacagggtctacagctaccccctcttctactcccggtacagccccacctccaaaggtgttaacaagccctgcgaccactcctacggcgactagtagtaaggccacctcttcctctagccctcggaccgctaccacccttcccgttctaacgagcacagcaaccaagagcacagcaacatcggttacacccatcccttcttctaccctggggactactggcacattgcccgagcaaacaaccacacccgttgccaccatgagtacaatacacccctcttcaactcccgagaccactcacacctctacagtgctcactacaaaggcaaccacaactagagcaactagttccacatctaccccatcgtcgactcctggtaccacctggatcctgaccgaactgactactgcggcaaccaccactgcagccactggaccaacggcgacgccttcttcaactcccggaaccacctggatattaaccgaactgactactactgctaccactacagcctccacaggctctacggctactccaagttctacgcctggcaccacatggatcttgacagagccatctactacagctacggtgacggtacccactggctctaccgccaccgccagttctactcaagcaacggcgggaacacctcacgtctctaccactgcaacaacccctacagtcacgtcttctaaggccaccccctcgagctctcccggaaccgccactgcattaccggctttgagaagtaccgcaactactccaactgcaacaagctttaccgcaatacccagttcttctcttgggaccacttggactcgactgtcccaaactacaaccccaactgctaccatgtcgaccgcaactcctagcagcacgccagagactgtgcataccagcacagttctaacggccacagccactaccaccggcgcaacagggtccgttgccacccccagtagcacacctgggactgcacatactaccaaggtgccgaccacaactaccacaggatttaccgccacaccatcctcctcacccggaacggcactaacaccccctgtttggatttccacaactacgactcctacgactacaacacccacaactagcggcagcacagttaccccttccagcatcccgggtacaacacataccgctcgggtgttgacgacaacaaccaccacggtggctacagggtctatggctacaccgtctagctcaactcagactagcggtactccaccgtctcttaccactactgcaacaacaattaccgcaactggcagcactactaacccgagtagcactcccggtacaactcctatcactcctgtcctgacaagtaccgccactactccagcagctaccagctccaaagccacttcatcgagcagtccacggacagctacaactttgccagtgctgacatctactgctactaagagtacagcgacctcctttacacccatcccaagcagcacactgtggactacatggaccgtacccgctcagaccacgacccccatgagcaccatgtctaccatccacacatcatccacaccagagactacacacacttcgacagtactgactaccaccgctaccatgacccgcgctaccaactctacggcaaccccatcttctacgttgggcacgactcggatccttacagaactcacaactactgctacaactaccgccgcaaccggtagtacagcaacactgtcatccactccaggcacgacctggattctaactgaacccagtactatcgcaacagtcatggtccccacaggatcaacagctacagcttccagcacgctgggaacagcacacactccaaaggttgtgacaaccatggcgaccatgcccaccgccacagcttccactgtgccaagttcctcgacagttggaactacgagaaccccagcagtccttccgtcatctctccctacgtttagcgtctcgaccgtctcgagttctgtccttaccactctacggcctacaggctttccttcctcccattttagcacaccctgcttctgtagagccttcggacaattttttagccccggtgaggtgatatacaataagacggatcgggctggctgccatttttacgccgtgtgcaaccagcactgtgacattgatcgatttcagggcgcttgtccaacgtccccaccccctgtttcttcagcgccattgagctcaccgagccccgcacccggatgcgataatgccatcccactcagacaggtaaacgagacatggacactggaaaactgcacggtggctcgttgcgtgggcgacaatcgtgttgtgcttctcgacccaaaaccagtggcaaatgttacctgtgtcaacaagcacttacccataaaagttagtgaccccagccaaccatgtgatttccactacgaatgcgagtgcatctgctctatgtggggcggaagccactactctacatttgacggcactagctacactttcagagggaattgcacttatgtgctcatgagggagatccacgcacggtttggtaacctatcactctacctcgacaatcactattgtactgcatccgccactgctgccgctgctcgctgccctcgtgctttgtccatacactataagtccatggacatcgtattaaccgtaacaatggtccacgggaaggaggagggcctgatcttatttgatcaaatacccgtctccagtggcttcagtaaaaacggtgtattagtgtcagtgctcggcacaaccacaatgcgcgtggacattcctgccctcggcgtatctgtgaccttcaacggacaggtgttccaagcccgattgccgtattctctgtttcacaacaacacagaaggacagtgcgggacctgcactaacaatcaaagagacgattgcctccagcgcgacggaacaactgctgcctcttgcaaagatatggctaaaacgtggcttgtgcctgacagcagaaaggacggctgttgggcacctaccggaactcctcctaccgctagcccagcagctcctgtttcttcaacacctacaccgaccccttgtcctcctcaacccctctgcgacctgatgttgtcccaggtgtttgctgagtgtcacaatctggtccccccaggacccttcttcaacgcttgcatttccgaccactgtcggggtagactggaagtgccgtgtcaaagtctggaggcctacgctgagctttgccgtgccagaggggtgtgtagcgattggaggggggcaactggtgggctctgtgacctgacgtgccctccaaccaaagtctacaagccctgtggccctatacagcccgcaacctgtaacagccgcaaccagtcccctcaactggagggcatggccgaaggctgtttttgccccgaggaccaaatcctcttcaatgcccacatgggaatatgcgtgcaggcgtgcccttgcgtcggccctgatgggtttccaaaattcccaggtgaacgctgggtcagcaattgccaatcctgtgtgtgcgatgaggggtcagtgtcagtacaatgtaagccactgccatgcgacgcccaggggcagccccctccatgcaataggccaggctttgttacagtgacaaggcctagggcagagaatccttgttgtcctgagacggtttgcgtctgcaacaccaccacatgccctcagtccttgccagtgtgccctccaggccaggagagcatctgtacacaagaagagggtgactgttgcccgacctttaggtgtcgtccacaactgtgcagctacaacggaacattttacggcgttggggctaccttcccaggtgccctgccctgccatatgtgcacatgtctgtctggagacactcaggatccaacagtgcagtgccaggaggacgcctgcaacaacaccacatgcccacaaggctttgaatacaagcgcgtcgcaggacagtgctgcggtgaatgtgttcagacagcatgtcttactcctgatggccagccagtacagttaaacgagacctgggtgaactcacacgtggacaactgtaccgtctacttgtgcgaggccgagggaggggtgcacctcctgactccccagccagcctcatgtcccgacgtgtcttcatgtcgtggatcactccggaaaactgggtgttgctacagctgtgaggaagactcatgccaagtgaggattaacacgacaatcctgtggcatcaggggtgcgagaccgaggtaaatattacattttgcgaaggctcatgccccggagcctctaagtactccgccgaggctcaggctatgcagcatcaatgcacgtgctgccaggaacgccgagttcacgaggagacagtacccctgcactgccccaatgggtccgccatccttcacacgtatacgcatgtggatgagtgcggatgcacacccttttgcgtccctgcccctatggctccaccacatactcgcggttttccagctcaagaagctactgctgtatac

SEQ ID NO: 231134 - DNA, 1611 bp, Artificial Sequence
  Description of Artificial Sequence: Synthetic coding sequence
gtgttctgctgcaactacgggcactgtccccctaggcctcccgcacttaggccctgcccaccccctttacgcggacggcctggctcgaccgagcttactactaccgccacgactactgcctctacagggtcaaccgctacacctagcagcacccctggaacggctccacccccaaaggtgctcacatcccctgctaccacaccaaccgccacttcttctaaggctacaagctcctcgagcccacgtaccgctacaactctaccagtgctgacaagtacagcgactaaatctacagctacgagcgttactcctataccttcatctaccctggggacgaccggtacactgccggagcagaccacaaccccggtggccactatgagcaccattcatccttccagtacgcctgagacaacccacacatcgacagtgttgacgactaaagcgaccaccactcgcgctacttcaagcacttcgacgccctcgtctaccccaggaacaacctggatcctgacagagctcaccaccgccgctacgacgacagccgcaacagggccaactgctacccccagttccacccccggtaccacctggatcctcaccgagctgaccaccacagcaactaccaccgcaagtacgggcagtaccgccacaccctcaagcacccccggaacaacgtggatcctcaccgaacctagtaccacagcaactgtaacagtgcctaccggttcgacagcaaccgctagtagtacgcaggccacggctgggacaccccacgttagtaccacggccactacacctacagtaactagttcgaaggcaactccatcttcctcgcccggaactgcgacggccctgccagctctgaggtctaccgctaccacccattcttaccagctgtatagccaccctcttctgctgcccactacatggactaggctgtcccagacaaccactcccacagctaccatgtccaccgcaaccccctcgtccaccccggagaccgtccacacttcgacggtattgacagccaccgccacgaccacgggccctgccctatggccccctcccccacctccacaggagcaactcactctccctaagtgtcgtctgccgcagccacgacactcccatcctctcctgcaacctcgggacggtacccatgcctcgagcgtcgaccagcacaatcaccatactcacaaccatcacacgcacaaccagtggctgcacggcgaccccctacttcaccctggcgaccacccacaccggcagtcagcagaccatcaccatcacaattgtacaggatctatggcaactccatccagttccacccagacttctggcacacctccctctctgacaactactgcaacaaccataactgccactggttcaacaacaaatccctcaagtacaccaggtaccactccgatcacacctgtgctcacaagtaccgccacaacgccggcagcgactagctccaaggccacaagctctagttcccctcgcaccgctaccacgctgcctgtcctgaccagcaccgccaccaaatcgacggcaacttctttcacaccaattccctctccctgcgggccaagaggccctagctag

SEQ ID NO: 231135 - DNA, 561 bp, Artificial Sequence
  Description of Artificial Sequence: Synthetic coding sequence
tccagtacccctggaacgacctggattctgacggagccttccacaacagccaccgtgaccgtgccaaccggcagtacagccacggcttctagcacacaggccactgctggtacgcctcatgtttccactacagccactacccctaccgtgacctcaagcaaggccacccccttttccagccccggtacggctaccgccttgcccgctctgagatccacggcaactacacccactgccacatctttcacggctatcccgtctagctgggcccctcccggtcccgcttaccatcggcctccacatcccagacccccatgccctcaaccacacccacccccactccagagactatctactccaccacagtgcctacctcccagaccccctagagggcaccgactgtgcgggcaccccctgctacatcccaggaatagttcccattatcagagcgcggactatcacaatcacttcaccgccacccccagttcctctccagggaccgcccgtacacttcctgtatggatcagcactactactacaccaacaaccaggggcagttag

SEQ ID NO: 231136 - DNA, 960 bp, Artificial Sequence
  Description of Artificial Sequence: Synthetic coding sequence
acaaaagctaccacaaccagagccacgagctctatgagcacccctagttctacccccggtactacgtggatactaaccgagttaaccactgccgctaccaccacagccgcaacacctcatggacatcctgtactgcatccacgagaccatctggacccacaccgggcacagcattataccgtgaccgtacccacagggtccaccgccacggcctccagcacccgcgcaacagctggaacgctgaaggtgctcaccagtcaccatacacattctcatcaactacaaagtcacagcctgctccagtctcgtgactgcaatcggccttcttcgacagagaagcacagccaccatacccactcataccagcggtactcccacccacttttcctgccaacggcctggacccggctgtcgcaaacaactacaccaacagccaccatgtccaccgctacaccttccagtacccccgagactgtccatacatctactgtgctgacaacaactaccaccacaaccagggccacactctggcccccacctccaccccctcaggaacagctgaccctgccgaagtgcagactcccccaaccaaggcattctcatcccctgctgcagccacgggacggaactcacgcctccagcgtcgatcagcataaccaccacacccacaaccaacgcctgcatggggatcccctcctgcacccaacaactcacacagccacagtgctgaccacaactactactacaccgctcgtgctgtggcaacacccaccactagctcacagacctgtggttccaccaagtttaaccaccaccgcaacaaccattaccgccaccggaagtaccacaaatcccagtagtacgcccggaaccaccccaatccccccagtgctgactacgactgcccacacatgcagtcaccagcaacacagcgattctctgctctgcccaagggattag

SEQ ID NO: 231137 - DNA, 2007 bp, Artificial Sequence
  Description of Artificial Sequence: Synthetic coding sequence
atgagagagatccacgccagattcgggaatttgagcctttatctcgacaaccactactgtaccgccagcgctaccgccgcagcggctcgctgccctcgtgctctgagcattcattataagtcaatggacattgtccttacagtgacaatggtccatgggaaggaggaggggctgatcctgttcgatcagattccagttagtagtggcttttctaagaacggcgtgctcgtctccgtcctcggaaccactactatgagagtggacatccccgctctcggggtgtccgtgactttcaacggtcaagtgtttcaagccagactcccgtactcactgtttcataataacaccgagggccagtgcgggacctgtactaataaccagcgagacgattgtttgcagcgggacggtacaaccgcagctagttgcaaggatatggccaagacatggctcgtcccagactcccgaaaggacggctgctgggctcctaccggcactccccctacagctagccctgccgctcctgtgagcagcacccctactccgaccccttgcccaccacagccactatgtgatttgatgctcagtcaggtgtttgctgaatgccataacctggttccaccagggccattttttaacgcatgtatcagtgatcactgtagaggcagactagaggtgccatgccagagcctggaggcttatgccgaattatgccgggctagaggagtgtgcagcgattggcgcggtgctaccggaggtctgtgtgacctgacctgcccccctaccaaggtatacaagccgtgtggccctatacagcctgcaacctgcaactctaggaatcagagcccacagcttgaggggatggcagaaggctgtttttgccctgaggaccagatcttgtttaatgcccacatggggatatgtgttcaggcttgtccttgcgttgggccagatgggtttccaaagttcccaggcgaacgctgggtcagcaactgtcagtcatgcgtgtgcgacgagggaagtgtgtcggtgcagtgcaagcccctaccttgcgatgcccagggacagcctcccccatgtaaccgtcctggatttgtcacggtaacccgccctcgggcagaaaacccttgctgccctgagacagtgtgtgtttgcaatactaccacctgcccgcagtctctacccgtgtgcccccctggccaggagtcaatttgcacacaggaggagggcgactgctgcccaacttttcgatgcaggccacaactatgttcatacaacgggacgttctacggagtcggggcaacctttcctggcgctctcccctgtcacatgtgcacgtgtctgtcgggcgatacccaggaccccactgttcaatgccaggaggatgcatgcaataatactacttgcccacaggggtttgaatacaaacgagttgccggacagtgctgtggcgagtgtgttcagacagcctgtctgacgccagatggccaacctgtacagctgaatgaaacatgggtgaactcccacgtcgataattgtactgtgtatctctgtgaagcagaaggcggagtccacctcctaacacctcagcctgcgtcctgtccagatgttagtagctgtcggggttctctcagaaaaacggggtgttgttactcttgcgaggaagactcctgccaggtccgtataaacacaacaatcctgtggcaccaaggatgcgaaacagaggtgaatataacattctgcgaaggaagctgccctggcgctagcaaatactccgctgaagctcaggcaatgcagcatcagtgcacttgctgtcaggagagacgggtgcacgaggagacggttccactacattgtcctaacggttctgcaatcctgcacacatatacgcacgtagacgaatgtggctgtaccccattttgtgtgcccgctcccatgagcccaccagcctgcgtttggcacccagccctgcgcgcaccggcagctcatctcgggctcgcccctccctag

SEQ ID NO: 231138 - DNA, 7319 bp, Artificial Sequence
  Description of Artificial Sequence: Synthetic coding sequence
atggtccagcggtggttactgctcagctgctgtggcgctctgctgtctgccggattggctaacacatcatataccagccccggtctgcagcgtttaaaggacagccctcagaccgcacctgacaaaggccaatgcagtacttggggtgccggacatttcagcacatttgatcatcatgtgtacgatttttccggcacctgcaactatatctttgccgcaacctgtaaggatgcgtttccgactttctcggttcagcttaggcgcggtcccgacggttccattagtaggatcattgtagagctgggcgcaagcgtggtgaccgtctccgaggctataatttccgtgaaagacattggagtgatttctttgccctacacatccaacggcctccagattacacctttcggccaaagcgtccggctggtggccaagcagctggaattggagcttgaggtcgtgtggggccctgatagccatctgatggtactcgtggaacgtaaatacatgggccagatgtgtggactttgtggcaactttgacgggaaggttacgaatgaattcgtgtccgaagaagggaaattcctcgagcctcataagttcgccgctctccagaaactcgatgaccccggagaaatctgcacatttcaggacatcccttctacacacgtcaggcaggcccagcacgcacgcatttgcactcaacttctgacgctcgtggcacctgaatgctctgtgagcaaggaaccattcgtccttagttgtcaagctgatgttgcggctgctcctcagccagggcctcaaaactccagttgcgccacgctttctgaatatagcagacaatgttctatggtgggccaacctgtgcgccgatggcgcagccccggactttgtagcgtcggtcagtgccctgctaaccaggtgtaccaagaatgtggtagtgcctgcgttaaaacgtgtagtaatccacaacattcttgttcttcgagctgcactttcgggtgcttctgtccagaaggtactgtgctgaatgacctgagtaacaatcacacttgtgtccctgtgactcaatgcccatgcgtgcttcatggggcaatgtacgccccaggtgaagtgactatcgcagcctgccaaacctgcagatgtactctgggcaggtgggtgtgtacagagcgtccttgtcccggtcattgttcgctggagggaggatcctttgtgacaacatttgatgctcgcccataccggttccacggaacatgtacatacatactcctacagtcgcctcaacttccagaagacggggctctgatggctgtgtacgacaaatcaggagtaagccatagcgaaacttcactggtcgccgttgtctatctgtctcgacaggacaagatcgtaatctcacaggatgaagtggtaacgaataatggtgaggccaagtggctcccgtacaagacaagaaacataaccgttttcagacagacaagcacgcatctccaaatggcgactagcttcgggctagaactggtcgtccaactcaggcctatatttcaggcttatgttacggtgggtccacaatttcggggacaaacccggggtttgtgcgggaattttaacggtgacaccactgatgactttaccaccagcatgggtatcgccgaaggaacggcgagtctgtttgtggactcctggcgggctgggaactgcccggctgcactagagagggagacagacccatgtagcatgagccaactgaataaggtctgcgcggaaacacattgcagcatgctgctcaggacgggtactgtttttgagaggtgtcacgcgacagtgaaccctgcccctttctataagagatgcgtttatcaagcgtgcaattacgaagagacattcccccacatatgtgccgcacttggagattatgtgcatgcttgctctttaaggggagtcctattgtggggatggaggtcctctgtggacaactgcaccatcccctgtacaggcaacaccaccttttcatacaactcacaagcttgtgagcgaacatgcctgagcctgtccgatcgtgctacggaatgtcatcacagcgccgttcccgttgacggttgcaactgcccagatggaacttatctgaaccagaagggcgaatgcgtgagaaaagcacaatgcccctgtatccttgaaggctacaaattcatcctggctgagcagagcactgtcatcaatggcatcacttgtcactgtatcaacggcaggctgagctgtccacagaggcctcagatgtttctggcttcatgccaagcaccaaaaacttttaaatcctgtagtcagtcttctgagaataagtttggtgccgcttgcgctccaacctgccagatgctcgctacgggggttgcgtgcgttcctacgaaatgcgagcctggatgcgtgtgcgcagagggcttgtacgaaaacgctgacggccaatgcgtgccacctgaggagtgtccttgtgagttcagtggggtttcctaccccggtggcgcagagctccataccgactgcaggacctgttcatgcagcagggggcgatgggcttgtcagcaagggacccactgtccatcaacctgtacactgtacggagaggggcacgttataacctttgacggccaacgattcgtctttgatggcaattgcgagtacatcctggctaccgacgtctgtggggtgaacgacagtcagcccacatttaaaattctcactgagaacgtgatctgtggtaattcaggagttacttgtagccgcgcaatcaagatcttccttggcggtttaagcgttgtgctggccgaccgtaattatacggtcaccggagaagagcctcatgtgcagctcggagtaacgccgggagcactttcactggttgtagacatttccatccctggtcgatataatctcacattgatctggaatcgtcacatgacaattctaatccggatcgctagagcgagccaagacccgctttgcggtctgtgcgggaactttaatgggaatatgaaggacgacttcgagacaaggtcccgatacgtcgccagctcagagctagagcttgttaatagctggaaggagtctccactctgtggagacgtttccttcgtgacagatccttgctcgcttaacgcctttagacgtagttgggctgaacgcaagtgtagcgtgatcaactctcagacattcgcaacctgtcacagcaaagtttaccatctgccttattatgaggcctgcgtgcgcgatgcgtgtggctgcgactctgggggtgactgcgaatgcctgtgcgacgcagttgctgcctacgctcaggcctgcttggacaagggagtttgtgtcgattggaggacaccggcattctgccccatctactgtggcttttacaacacccacacacaggacggacacggcgagtatcagtacacccaggaggcgaactgtacgtggcactaccagccatgcttgtgcccctcacagccgcagtccgttcctgggtctaacatcgaagggtgttacaattgttcgcaagacgaatacttcgaccatgaagaaggggtgtgcgtcccttgcatgcccccaacaacccctcagcctccaacgacaccgcagctaccaacaaccgggtcaaggccaactcaggtatggcccatgactgggacttcaaccacgattgggctgctctcatcgacaggacccagtccatcgtcgaaccatactcccgcttcccccacacaaactccgctgctccccgcaactctgacctcttctaagcctacagcgagtagtggagaaccccctaggcctaccacagctgttactccccaggcaacctcaggtctgccacctacagccaccctcagatcgacagctacgaagcccacagtgacccaggcaacaacgcgggctaccgcatccactgcatctcccgctaccactagcacagctcagtctacgactaggacaacaatgacactgccaactccggctaccagcggcacatccccaacattgccaaagagcacaaatcaagagctacctggcactacggctactcaaaccaccggtccgagaccaactcctgcgagtactactggtccaactacccctcaacctggccaaccaacaagacctaccgccacagagactacccagaccagaacaaccaccgagtatacaacaccccagacaccccacaccacacattcccctccaactgctgggagcccagtgccatctactggcccagtcactgctacctcattccatgctacaactacttacccaactccgagtcatcctgagacaaccctacctactcacgtgcctcctttctctacctctctggtgacacccagcactcataccgtgatcactcctacacacgcacaaatggccactagcgccagcaaccactcagcgcctaccgggactatcccaccaccaacgacactgaaagccacagggagcactcatactgcacctccaatcacgccgaccacatcggggacaagccaggctcactcctctttcagtacaaataagacaccaacatcattgcactcccatacctcatccacccatcaccctgaggtgactcccacaagcactacgacaataaccccaaaccccacttctacacgcacacggacacctgtcgcacacaccaactccgccacgtcttctagaccgccaccgccttttacaactcacagcccacccacagggagctcccctttttcaagtacaggccctatgacagccactagcttcaagacgaccaccacctatcccacccctagccatcctcagaccactctgcccacacacgtacccccattttctaccagcctagtgacaccaagtacacacacagtgattacacccacccacgctcagatggcgacttctgctagtatccacagtatgcccacaggcacgattcccccaccgacgacactgaaggcaacagggtcaacccacaccgcacctactatgacactaactacttcaggcacaagccaggctctatcgagcctgaacacggcgaagacgtcgacttcactccactcgcacacatctagcactcatcacgccgaggcaactagcacgagtacgacaaatataacgcctaacccaacttcaactgggactcctccaatgactgtcacaacatcaggcactagccagtcacggtccagcttcagtacggcgaagacgagcacaagtctccattctcacacttcatccacccaccaccccgaagttaccagtacatccacaacttcaattaccccaaaccacactagcacaggcacacggacaccagttgcccataccactagcgccaccagcagccggttacctactccctttaccacacattcaccacccaccggcacaacccctatcagctccacaggacccgtcaccgccacctctttccagactacaacaacataccccacacctagccacccgcacactaccttgcccacgcatgtcccatctttctccacctcgctcgtaaccccatccacccacaccgtcattataccaacacacacacagatggcgacctcggcctccatccactctatgcctacaggtacgatcccacctcccactacaattaaagcaacaggttctacacacactgcaccaccaatgacccccacaacctccggaacaagtcagagcccaagttccttcagtacggccaaaacgagcacctccttaccataccacacaagcagtacacaccatcctgaggtgacaccgacctctacaaccaatatcaccccaaaacatacgagtactgggacccgcacaccagtcgctcacaccacctccgcctcctcctctagactcccaactccgttcactacacactcccccccaaccggaagtagccccttcagctctactgggcctatgactgctacatcattccagacaacaacaacttacccgactccttcccaccctcagacaacccttcctacgcacgtccctccgtttagcacaagcctggtcaccccaagtacacacactgtgatcattactacccatacacagatggcaacttccgcctctatacactctactcccacaggtacagtgccaccacctaccacactaaaagcaactggttcaacacacaccgcccctcccatgactgtgaccacttccggaacatctcagacacacagcagcttctccaccgcgaccgccagctcttcctttatctctagtagctcgtggctcccacagaatagcagcagcagaccccctagctcacctattactactcagcttcctcatctgagttccgctaccacacccgtcagtaccaccaatcagttatcttcatctttctcacctagcccgagcgctccttcaactgtatccagctacgtgccatcctcacattcgagcccccagacgtcatccccttcagtgggaacatcctccagcttcgtatcagcccctgtccatagcaccactttatcatcgggctcccattcatcactatcaacccaccccaccacagccagcgtgtccgccagtcccctgtttccctctagtccagccgctagtactacgattagggctaccctgccccacacaatctcaagcccattcactctaagtgctctgctgccaataagcaccgtgaccgtcagccctactcctagttcccacctcgccagcagcacaatcgcttttcctagcactccccgtactacagcctcgacacacactgcaccagctttttcttctcagtctaccacctctagatcaacatcacttactaccagggtgccaacgagcggattcgttagcctgaccagtggggttaccggtataccaacctctccagttacaaatttaacaactcgccacccaggacccacactctccccaacaacacggtttcttacctcttcactaactgcccatgggtccactccagcctcggcccctgtgagctccctgggaacacctacccctactagtcccggagtgtgttccgtgcgagaacaacaagaagagatcacgttcaagggctgcatggctaacgtgacagtgacacgctgcgaaggggcttgtattagcgccgcaagctttaatatcataactcaacaggtggacgcgagatgctcctgttgcaggccactccattcatacgagcagcagctagaactgccctgtcctgatccctcaacaccaggtagaagactggtcttgactctccaagtgttcagtcattgcgtgtgctcatccgttgcttgcggtgatta

SEQ ID NO: 231139 - DNA, 1134 bp, Artificial Sequence
  Description of Artificial Sequence: Synthetic coding sequence
atgaagacactgcccctgttcgtttgcatctgcgccctctccgcctgtttcagtttttctgagggtagagagcgagaccatgagcttcgccatcggcgacaccaccaccagagtccaaagagccacttcgagttgccacactacccaggcctcctcgctcaccagaaaccattcattcgaaagagttacaagtgcctccacaagagatgccgccctaagctgcctccctccccgaataatcctccgaaattcccaaacccccaccaacctccaaaacaccccgataagaactccagcgtggtaaatccgactctggtcgctaccacgcagatcccatcagttacctttccatcagctagcaccaagatcaccacactgccgaatgttaccttcttgccacagaacgcgacaactatctcgagcagagagaacgtcaacacaagctcatccgtggcgacattagcacctgtgaactctcccgctccacaggacaccaccgccgcaccacctacacccagcgctacgacacctgcacctccaagctccagcgcacctcccgagacgacagctgcgccacccacaccttcagccaccactcaagcacccccatccagctctgctcccccagaaactactgccgcacctcccaccccgccagccacgacccctgctcctcctagctccagcgcacctcccgagacgactgcagccccacctaccccatctgcaaccactccagctcccttgtcgtctagcgctccaccagagaccactgcggtgcctccaacgccttctgccaccacgctggacccatctagtgcctcagcgcctccggagactaccgcagcccctcctacaccatcagctaccacgcccgctcctccttcttccccagcacctcaagaaacgacagctgccccaatcaccacacccaattcaagtcccactaccctggcaccagacacctcagagacttcagccgctcctactcaccagacgactacaagcgtcaccacacagacaaccaccacaaagcagccaacttctgcacctggccagaacaagatttccaggtttctcctgtacatgaaaaatctcctgaatagaattatcgatgacatggtcgagcagtag

SEQ ID NO: 231140 - DNA, 1134 bp, Artificial Sequence
  Description of Artificial Sequence: Synthetic coding sequence
atgaagactttgccactcttcgtctgcatttgtgccctgagtgcatgcttctccttctcagagggccgtgagcgcgatcacgaactccgacaccgcagacatcaccaccagagccccaagtcccactttgaactccctcactaccccggactactggcacaccagaagccatttatccgcaagtcctacaaatgtctacacaagagatgcaggcccaaactgccaccatccccaaataatccccctaaatttcccaatccccatcagccgccaaaacatcccgacaagaattcgtccgtggtcaatcccactctggttgcaactacgcagatccctagtgtgacatttcccagcgcaagcactaaaatcacaaccctgcctaatgtgacttttttaccacagaatgccacgaccatctcctccagggagaatgtgaatacatcctcaagcgtggctaccctggctccggtcaattcccctgcccctcaagataccacagcagcccctcctacgccttctgcaacgacaccggctccgccatccagcagtgctcccccagaaacaacggcggctcctcctactccatcggccaccacccaggcgccacccagcagctctgcgccacccgagactaccgccgcacctcctaccccacccgctacaacccccgcacctccctctagttctgctcctccagaaacaaccgccgctccccctactccctctgccactacacccgcacccctatcatcatctgcacccccagagaccaccgccgtgcctcccactccttcagccactacactggaccccagtagtgcaagcgcgcctccagaaaccactgcggctcctccaactccatccgctaccactcccgcacctccctcttcccctgccccacaggagacgacggctgccccaatcaccacacccaacagttctccgaccacactggcccctgatacctctgagacctccgcagccccaacacatcagacaactacttccgttaccactcagacgacaaccacaaaacagccaactagtgccccagggcaaaacaaaatcagtcggttcttgttatacatgaagaatttgctaaacaggatcattgacgacatggtagaacaatag

SEQ ID NO: 231141 - DNA, 1134 bp, Artificial Sequence
  Description of Artificial Sequence: Synthetic coding sequence
atgaaaaccctgcccctttttgtatgtatttgtgctctgtccgcgtgcttcagcttttccgagggaagggagcgggatcatgaactccggcacagacggcatcatcatcaatcgcccaagtcccatttcgagctaccacactacccgggacttttggcccatcagaagccattcatccgaaagtcatataaatgtctgcacaaacggtgccgcccaaaactgcctccttccccaaacaacccacctaagttccccaatccacatcagcccccaaaacaccctgacaaaaactcctccgtggtcaatccaacacttgtggctaccactcaaatcccctcggtcaccttccccagcgctagcaccaagatcacgacactcccgaacgtgaccttcctccctcagaacgcaaccactataagtagcagggagaacgtcaataccagcagctccgtggccaccctggcccctgttaattctcccgcacctcaggacaccactgctgcccctcccaccccaagtgccactactcccgcaccaccatcgagcagtgctcccccagagacaaccgcagctccccctacgccctctgccacgacccaagcccctccaagtagctctgccccacccgagaccacggcagccccacctacacctcccgctactacacccgctcccccatcatcctcagctccaccagagaccacagctgctcccccaactccaagtgccacaactcccgcacctttgagtagctctgccccacctgagactaccgcagtccctcctacacctagcgccaccaccttagacccttcaagcgcctccgctccaccggaaaccaccgcagcgccaccaaccccctctgctacaacccctgctcctccctcaagtcccgcacctcaggagacgacggcagccccaattaccaccccaaactctagccccaccacacttgcgcctgacacttctgagacatccgcggctccaacacaccagaccacaacctccgtcactacacaaacaaccacgacaaagcagcctacctccgctcctgggcagaacaaaataagccggttcctcctctacatgaagaacttattaaatagaataatagatgacatggtcgagcaatag

SEQ ID NO: 231142 - DNA, 411 bp, Artificial Sequence
  Description of Artificial Sequence: Synthetic coding sequence
atgaagacactgcccctttttgtgtgtatctgcgccttgagcgcttgcttcagcttttctgaagggagagagagagatcacgagttacgacatcgtcggcatcaccaccaaagccctaagtcgcacttcgaactgccgcactatcccggtttactggctcatcagaaaccttttatccgtaaatcatacaagtgcttgcacaaaagatgtcgacccaagttgcccccatctcctaacaatccacccaaatttcctaacccgcaccagcctccaaaacatcctgataaaaattcaagcgttgtgaatccaacactggtggccacaacccagatcccctcagtgacatttccttccgcttcaactaaaatcacaacacttccgaacgtgacgtttctcccacagaatgcctag

SEQ ID NO: 231143 - DNA, 1743 bp, Artificial Sequence
  Description of Artificial Sequence: Synthetic coding sequence
atgacagcacccgcaggtccccgtggctctgaaacagaaagactcctgacccccaaccccggttatggaacccaagccggaccatcccctgccccacccacccctcccgaggaggaagatttaaggcggagactgaagtatttctttatgtcaccttgcgataagtttagagccaagggtcggaaaccctgtaagctcatgcttcaggtcgttaaaattcttgtggttacagtgcagcttatcctttttggtctcagcaaccagcttgcagttaccttccgggaggagaatacaatcgcattccgccacttatttcttctgggctatagtgacggcgctgatgatacctttgccgcatacactcgcgagcagctgtatcaagccatattccatgcagtggaccagtacttagcacttccagacgtgtccctggggcgttacgcctacgtcaggggcggtggagatccatggactaacggctcagggctcgctctttgccagcggtactatcatcgcggacatgtcgaccccgctaatgatacattcgacatcgatcctatggtggttacggattgcattcaggttgatccacctgagcggccacctcctccaccctccgacgacctgacactgttggagagttcgtccagttacaaaaatctgactcttaagttccacaagctggttaatgtgaccatacactttagacttaaaactatcaatcttcagtccctgattaataacgaaatccccgattgttacacattctctgtactgatcaccttcgataacaaagcacacagcggtagaatacccataagtctggaaacgcaagctcacatacaggagtgtaagcacccttctgtgtttcagcatggcgacaatagcttcaggctcctctttgatgtggtcgttattctgacctgctcactgtcattccttctatgtgccagatcacttctgaggggatttctgctgcaaaacgaattcgttgggttcatgtggcgtcagcgcggaagggtgatttctttatgggaacgattagagttcgtcaatgggtggtatatcctcctggtcacttctgacgtcctgaccatctccgggactataatgaaaattggaattgaggccaagaacctggcctcctatgatgtatgttcgattttgctgggaacttcgacactgctggtgtgggtaggggttataaggtacctaacttttttccacaattataatatcctgattgcaactttacgggtggcactcccttccgtgatgagattctgctgttgcgttgccgtgatctaccttggttattgtttctgtggatggatcgttctgggcccttatcacgttaagtttcggagcctctctatggtgtcagaatgcctgtttagtcttatcaacggcgatgatatgtttgtcacattcgcagccatgcaagcccagcagggacggagctcacttgtatggctcttctcccagctttacctgtacagtttcatctctctctttatttatatggttttgagcctgtttatcgcattaataaccggtgcgtacgacacgataaaacatcccggtggagccggagccgaagagagtgaattgcaggcctacatcgcccagtgtcaggattcaccaaccagtggcaaatttcgaagagggtcaggctcagcctgcagtctactgtgttgttgtgggcgtgatccaagcgaagagcactctctgttggtgaattag

SEQ ID NO: 231144 - DNA, 1638 bp, Artificial Sequence
  Description of Artificial Sequence: Synthetic coding sequence
atgactccaagccagcccactagaggatctagctgcaccagaccaagctctatgctttggacaagcacttggcgatgccttacatgccactgggccggaatgcgtatgtccgttgtaggcgtcacacttggtcccatggctcagggtctcctctcagcctccggtactacaaccgaggccacatggacacggcctaccacccatttgacactgattaggtggtggctgctcaccgcatctagatggatccctccaagtggcccactgcgtccgcctgccacgatttctccttcctggaaagcagccccagtgactagaactagcaggtctaattcaacctcaacagcatgctccctggagggaggtcctggctggggaagacagcatacccgacactcccatccttcaaattactttcctaaggtagggactgggcctccccgaccacgctggtgtctgctcggcgaacactttccttgtcagcttcagagccagcacgtcgccggtgacgcaggcacctggggacgaaaaggccctgaggatgctccagatccccacccgagtctcctccctcggctcgtcaacgtcaccatccacttccgacttaagacgataaacctgcagtccttgatcaacaacgaaatccctgactgttatacattttcagtgcttataacttttgacaacaaggcacactcagggaggattccgatttccttggaaacacaagcccatatacaggagtgtaagcatccctcagtcttccagcatggagataacagtttcaggcttctgttcgacgttgtcgtgatactgacatgtagcttaagtttcttgctatgcgctcgcagtctgctgcggggattcttgctgcagaatgagtttgtcggcttcatgtggcgccagcggggacgcgtgatctctctgtgggaacggctggaatttgtgaatggttggtatatcctcctcgtgacctccgatgttctcacaatcagcgggactataatgaagatcggcatcgaggccaagaatctggcatcctatgacgtgtgttccattctccttggtactagcactctcctcgtgtgggtcggcgtcattcgttatttgactttctttcacaattacaatatattgatcgccaccttgcgcgtggccctcccatccgtgatgaggttttgttgctgcgtggcggtgatttacctcggatactgcttctgcggttggatcgtactgggaccttaccacgtaaagtttcggtcgctaagcatggtgtccgaatgtctgttttctcttataaacggtgatgatatgtttgtgacttttgccgcaatgcaagcacaacaggggcgaagcagcctcgtgtggctgttttcgcagctgtatttgtatagttttatctctctgtttatctatatggtgctctctttgttcatcgcactgatcacgggcgcttacgatactataaaacatccgggtggcgcaggcgcagaggaaagtgagctccaggcctacattgcccagtgccaggactctcccacgtccggtaagttcaggcggggatcggggtctgcatgcagcttgctttgctgctgtggtcgggacccttccgaggaacatagccttctggtgaactag

SEQ ID NO: 231145 - DNA, 1701 bp, Artificial Sequence
  Description of Artificial Sequence: Synthetic coding sequence
atggccaggcagccataccggttcccgcaggcaaggatccctgaaagaggcagtggggtgtttcggctgaccgtgcggaacgccatggcgcatcgggactcagagatgaaggaagaatgcttgcgggaggacctaaaattctattttatgagcccttgtgagaagtatcgtgcgagacgacagatcccatggaagctgggcttacagattcttaagattgttatggtgactacgcaactggtgcgattcggattgtccaatcaactggtcgtggcgtttaaggaggacaatacagtggcgttcaagcatctctttcttaaaggatattcaggaaccgacgaggacgactattcgtgctcggtttacacacaggaggatgcctatgagtcaatcttcttcgccattaatcagtaccatcagctgaaggatattactctgggcacattaggttacggagagaacgaggacaataggatcggactgaaagtctgtaaacagcactataagaaaggcacaatgttcccttccaacgagaccctgaatatcgataatgacgttgagctggactgcgtgcagctggatctacaggatctgagcaaaaagccacccgactggaaaaacagcagcttttttcgcttggagttttacaggctgcttcaggtcgagatttccttccacctcaagggcattgatttgcagactattcactccagggagcttcctgattgctatgtgtttcagaacacaattatttttgacaataaagcccattctggtaagattaaaatttactttgactcagacgccaagatagaagagtgtaaggaccttaacatttttggttccactcagaagaacgctcagtacgtactggtgtttgacgctttcgtgattgtaatctgtctggcatccctgattctgtgtaccagaagcatcgtgctagcattaaggctgcggaaacggtttcttaacttcttcttagagaaatataagcgaccggtgtgcgatacagaccaatgggaattcattaacgggtggtacgtcctggtcatcattagtgatctcatgacaattataggctccattctgaagatggagatcaaggctaagaatctgaccaactacgacctctgctctatcttcttaggcacttctactcttctggtctgggttggcgtgatccgatatctgggttattttcaagcttacaacgtattgatattaacaatgcaagcctccctaccaaaggttctacgattctgcgcctgcgccggaatgatttatcttggatatacattctgcggctggatcgtgctcggaccgtatcacgataaattcgagaaccttaacactgtcgccgagtgcctgttctcattggtgaacggcgacgacatgtttgccacttttgctcagatccagcagaaaagcatactggtttggctgtttagccgcctgtacctgtactcatttatcagcctgtttatctatatgattttgtccctgtttatcgctcttatcacggactcatacgatacaatcaaaaagttccagcagaatggcttccctgagaccgacctgcaagaattcctgaaggaatgctcctccaaagaggaataccagaaggaatcctccgcctttctttcctgcatctgttgcagacggaggaaaaggtctgacgaccatctcatcccaatctcatag

SEQ ID NO: 231146 - DNA, 1662 bp, Artificial Sequence
  Description of Artificial Sequence: Synthetic coding sequence
atggccgaccctgaggtggtcgtatccagctgctcctctcatgaagaggagaatcggtgcaatttcaatcaacagacgagtcctagcgaggaacttctgttggaggaccaaatgaggcgcaaattaaagttcttctttatgaacccatgtgagaagttctgggcaagggggagaaaaccctggaaattggccattcagattcttaaaattgccatggtgactatccagctggtgctttttgggctgagtaaccaaatggtggtggcgtttaaagaggagaacacgattgcattcaaacacttgttcctcaagggatatatggacagaatggatgacacatatgcagtgtacactcagagtgacgtgtatgaccagctgatcttcgcggtcaaccagtatctgcagctgtacaatgtcagtgtgggtaatcacgcatatgagaataagggcaccaagcagtccgcgatggccatctgtcagcacttctacaaaaggggcaatatctaccctggaaacgacaccttcgatatcgatcccgagattgaaacggaatgcttcttcgtggaacccgatgagccattccacattgggacgccagccgagaataaactgaaccttacactcgactttcacaggctccttaccgttgagctgcaatttaagctaaaggccatcaacctccaaacggttcgccaccaggagctgcccgactgttatgacttcaccctcaccatcaccttcgataacaaagcacattccggacggattaagatcagcctcgataatgacatttccattcgcgaatgcaaggactggcacgtatctggaagtattcagaagaacactcactacatgatgattttcgatgctttcgtaattctcacgtgtttagtaagtcttatattatgcattcgcagcgttattcgtggcctccaactgcagcaagagttcgttaactttttcctcttacattataagaaggaggtgtccgtatctgatcagatggaatttgtcaatggctggtacattatgataattatttctgacatactaacaatcatcggatccattctgaaaatggaaatacaagccaagtcactgacaagttatgatgtctgctctattttgctcggaacatctactatgttggtctggctgggcgtgatccgatatctgggattcttcgctaagtacaatctcctgattctaaccctgcaagctgccctgcccaatgtgatacggttttgttgctgtgctgccatgatttacctgggctattgcttctgtggatggattgtcctgggtccgtaccatgataaatttcggtccctgaatatggtgtccgagtgtcttttctctttgatcaatggcgatgacatgtttgctacattcgccaagatgcaacagaagtcataccttgtgtggctgtttagccgcatatacttgtactcctttatatcactgttcatatatatgatcctaagtctgttcattgctctcattacagatacctacgaaactattaagcagtaccaacaggacgggtttcctgaaaccgaactcaggacctttatatccgagtgcaaggatctacctaattccggcaaatacaggctggaagacgacccacccgtatctctgttctgctgctgtaaaaagtag

SEQ ID NO: 231147 - DNA, 1494 bp, Artificial Sequence
  Description of Artificial Sequence: Synthetic coding sequence
atggctgacccagaagtagtggtaagctcctgcagctcccatgaagaagagaacagatgcaacttcaaccagcaaacttcaccttcggaggaactgctgctggaggaccagatgaggagaaagttgaagttcttcttcatgaacccttgcgaaaagttttgggcacggggtcgaaagccatggaaactggccattcagatacttaagatcgcaatggtaacaatccagtatttgcaactctacaacgtgtcagtcgggaaccatgcctacgaaaataaaggcaccaagcagtctgcgatggctatttgccaacacttttacaaacgtggaaatatataccccggtaatgataccttcgacattgatcccgaaatcgagactgagtgtttttttgtggagcccgacgagccatttcatataggaactccggcagagaacaaattgaaccttacccttgactttcacaggctgctaacagttgaattgcagtttaaactgaaggcaatcaatttgcagactgttcgacaccaggagctgcccgactgttatgacttcacccttaccattacctttgataacaaggcacattctggacgaatcaaaattagtctggataatgacatctcaatccgggagtgtaaggactggcatgtatccgggagcatacagaagaatactcattatatgatgatttttgacgcgtttgtgattcttacttgtctggtcagcttaattttgtgtattcgatctgtgattaggggcctgcaattgcaacaggagtttgtaaacttctttctacttcactacaaaaaggaagtatccgtgagtgaccaaatggaatttgttaacggctggtacatcatgattattatctcggacattctcacaatcatcggctccattctaaagatggaaattcaagccaaatctctgacatcctacgacgtgtgttccattctgctgggaacgagtacgatgcttgtctggttaggagtcatcagatacctagggtttttcgccaaatacaatctcctaattttgacccttcaagccgcattacccaatgtgatacggttctgctgttgtgcagctatgatctacctgggctattgcttctgcggttggattgttctcggcccttaccatgataagttccgctccctcaacatggtatctgaatgcctattttctctcataaacggagatgacatgttcgccaccttcgcaaaaatgcagcagaagtcctaccttgtctggctcttctccagaatttacctatattcgtttatcagcttatttatatatatgatacttagcctgttcattgctctgatcactgacacctacgaaaccatcaaacagtatcagcaggatggattccccgagaccgagctcagaaccttcatctctgaatgtaaggacctcccgaattcaggaaagtatcggctagaagacgaccccccagttagtcttttctgctgctgtaagaagtag

SEQ ID NO: 231148 - DNA, 966 bp, Artificial Sequence
  Description of Artificial Sequence: Synthetic coding sequence
atggcggatccagaagtggtggtgtcttcgtgcagtagccacgaggaggagaatcggtgtaactttaaccagcagacaagtccaagcgaagaactgctgctggaagatcagatgcggaggaagctcaaattcttctttatgaacccttgcgagaagttctgggctcggggacgcaaaccatggaaactggccattcagatcctgaagatcgccatggtgacaatccagcttgtcctctttggcctttcaaatcagatggtcgtggcgtttaaagaagaaaatactatcgccttcaagcaccttttcctgaaaggctatatggatcgcatggacgatacctatgcggtgtacactcagagtgatgtgtacgaccagttaatcttcgcggttaatcagtatctgcagctgtacaatgttagcgtcgggaatcatgcatacgagaacaaaggcacgaagcaatctgccatggctatttgccagcatttttacaaaaggggcaatatttatcctggaaacgatacttttgacatcgatcctgaaattgagacggagtgcttcttcgtcgagcccgatgaacccttccacattggcacacctgccgaaaacaaacttaatctgactctggacttccataggctgttaaccgtcgagctccagttcaaactgaaggccatcaacttacagaccgtgcggcatcaagaactgcccgattgttacgattttactctgacgatcactttcgacaataaggctcactcaggacgtatcaagatctccttagataacgatatctctattcgagagtgcaaagactggcacgtctctggttctattcagaaaaacacacactatatgatgattttcgatgccttcgtgatccttacctgtctggtttctctgatcttatgcatcaggagtgtgattagaggcctgcagctacagcaggtgggcaatgtcgccttctag

SEQ ID NO: 231149 - DNA, 1494 bp, Artificial Sequence
  Description of Artificial Sequence: Synthetic coding sequence
atggcagatccagaagtcgtggtgtcgagttgctctagccacgaggaggagaacaggtgcaactttaaccaacaaacttccccgagcgaggagctcctactggaggaccagatgaggagaaaactgaaatttttctttatgaacccttgtgagaaattttgggcacgcggaagaaagccctggaagttggcaatccaaatccttaaaatcgccatggttaccatacagtacctccaactgtataatgttagtgtgggaaatcatgcatacgagaataaaggaacgaagcagtccgctatggccatctgccagcacttttataagcggggtaacatctacccaggaaacgatacgtttgacattgatccggagattgaaacagagtgcttttttgtcgagcctgacgagccgttccatattggcacccccgcagagaataagctcaatcttaccctggattttcatagactgctcaccgtagaactgcagtttaaactgaaggccataaatttgcaaactgtgagacaccaagagttgcctgactgttacgatttcaccctcacaatcacatttgacaataaggcccattccggtcgaataaagatcagtttggacaatgacattagtataagagagtgcaaagactggcatgtttcagggtctattcagaagaatacacactacatgatgatttttgatgcattcgttatcttaacttgtctggtctcactgattctctgcatcaggagcgtcatcagaggactgcaactccagcaggagtttgttaacttttttctcctgcactataagaaggaagtcagcgtgtctgatcagatggagttcgtgaatggatggtatatcatgattattatctccgacatcctgacgatcattggctctatcttgaagatggaaatccaagcaaaatccctcacgtcatacgacgtgtgctcgatcctgttgggaaccagcaccatgcttgtgtggctgggcgtcattagatacctcgggttctttgcaaaatacaatctgttaattctgacacttcaagccgctttgccaaatgttatccggttttgctgctgcgctgcgatgatatatctagggtattgtttctgtggctggattgtactgggcccttatcatgataagttccgctcattaaacatggtgtcagaatgcctcttttcactgatcaatggtgatgatatgttcgccacattcgcgaaaatgcagcagaaaagttatctggtgtggctgtttagccgaatttatctgtattccttcatctcgctattcatctatatgattctttccctattcatagctctgataacagacacctatgagactatcaaacaatatcagcaggatggatttcccgaaacagaactgcgcactttcatcagcgaatgcaaggatttacctaacagcggcaaataccgcttggaggacgaccctcccgtgagcttattttgctgttgtaagaagtag

SEQ ID NO: 231150 - DNA, 1662 bp, Artificial Sequence
  Description of Artificial Sequence: Synthetic coding sequence
atggccgaccctgaagtggtggttagcagctgttcatctcacgaggaggagaataggtgcaattttaaccagcaaacaagcccttccgaggagctgctattggaagaccaaatgcgacgcaaacttaaatttttcttcatgaacccatgtgaaaaattttgggcccgagggaggaaaccatggaagctggcgatccaaatcctgaaaatagccatggttacaatccagctggtcctgttcggcctttccaaccagatggtggtcgcttttaaagaggaaaacacgatcgctttcaagcacctgtttctcaaaggttatatggacaggatggatgacacctatgccgtgtacacgcagtcagatgtgtacgatcagctgatttttgctgtgaatcagtatttgcagttatacaacgtctcagttggcaatcatgcctacgaaaataaaggcacgaaacaaagcgccatggcgatatgtcaacatttttacaaaaggggtaatatctacccaggcaatgacacattcgatatcgatccagagatcgagaccgagtgtttcttcgtggagcccgacgagccctttcacatcggaacccccgcagaaaacaagctgaaccttaccctggacttccacaggcttttaacagtcgaactgcagttcaaactcaaggccattaatctccaaactgtcaggcaccaggaacttcctgattgttacgactttacactgaccatcacattcgataacaaggctcattccgggaggatcaagatcagccttgacaacgacatcagcatacgggaatgtaaagactggcacgtgtccggttctatacagaagaatacacactacatgatgattttcgatgcctttgtgatcttgacttgtctggtgagtctcattttgtgcatcaggtccgttatcaggggactgcagttgcaacaagagtttgtgaatttctttctgcttcactataaaaaggaggtatccgtgtctgatcagatggaattcgttaacggatggtatatcatgattattatcagtgatattctgacaattatcgggtccatactgaagatggaaattcaggctaagagtttgacatcctatgacgtttgctcaattttgctcgggacatccacgatgctagtttggcttggagtgatacggtacctgggcttctttgcaaaatacaacttgttgatccttaccctgcaagctgctttgcctaatgttatccggttttgttgctgtgccgcaatgatttatctgggctattgtttctgcggatggatcgtgctgggcccttaccacgacaaatttcgaagcctcaatatggtgagcgaatgtctattttcacttatcaatggcgacgatatgttcgctactttcgctaagatgcagcaaaagtcctacctggtttggctcttcagtagaatttatctttattctttcatctcattatttatctacatgatcttatccctctttattgcactgatcaccgacacctacgagaccataaaacaataccagcaggatgggttccctgaaactgagctgaggaccttcatctcagaatgcaaggatctgcccaactctggtaagtataggctcgaggacgatcctccggttagtctcttttgttgctgtaagaagtag

SEQ ID NO: 231151 - DNA, 2442 bp, Artificial Sequence
  Description of Artificial Sequence: Synthetic coding sequence
atgagtctgttgggtgatcccctccaggcactcccaccgtccgctgctcccacaggccctcttctcgcgccaccagctggagccactttgaatagattaagggagcccttgctcagacggctctcagagctcctggaccaggcaccagagggtaggggctggaggcgactggctgaactggccggttcccgcggaagactccggctgtcttgtctagacttggaacagtgctccttgaaagtcttggaaccagaaggaagccctagcctgtgtctactgaagctcatgggcgaaaaggggtgtaccgtcaccgaactgtccgattttctgcaggccatggagcatactgaggtgttacagttactgtcacctccgggtatcaaaatcactgttaacccggagtcgaaggccgtcctggcaggacaattcgtcaagttatgttgccgggcaacagggcaccctttcgtccagtaccaatggtttaagatgaataaagaaatccccaacggaaacacaagcgagctgatttttaatgcagtccacgtgaaagatgccggattttatgtgtgcagggtcaataataatttcaccttcgagttcagtcagtggagccagttggacgtttgtgatatacccgagagctttcagcgatcagttgatggggtgtcggaaagcaagctgcaaatctgtgtggagcctacaagtcagaaactgatgccagggtccactttggttctgcagtgtgttgcagtgggatcccctatcccacactaccagtggtttaaaaatgagctgcccctgacccatgagaccaaaaagctctacatggtgccctatgttgacctagagcatcagggaacttactggtgccatgtatataatgatagagatagtcaggactctaagaaagtggaaataataatcgatgaactgaacaatctggggcaccctgataacaaggaacagaccacagatcaaccacttgccaaggacaaggtggctttgttgatcggcaacatgaattaccgcgagcatcctaagcttaaggctcctcttgtggacgtatatgagctgacgaacttgctccgacagttagactttaaggtcgtgtcccttcttgacctcacagaatacgaaatgagaaatgccgtggatgaattcttattactcctggacaagggagtctacggcctcctatactatgctgggcatggttacgaaaactttggtaatagctttatggtgccagtcgacgcccctaacccctaccggtcggagaactgcctatgcgttcagaatattctgaaactgatgcaggagaaggaaaccggcctgaatgtgtttttacttgacatgtgtagaaaacgcaatgactatgacgatactattcccattcttgatgctttgaaggtcaccgcaaacattgtgttcgggtacgcgacctgtcagggcgctgaagcttttgaaattcagcactcaggactagcgaatgggatcttcatgaaatttctgaaggaccgcctgctggaggataaaaagatcaccgtgctccttgatgaggtcgcggaggatatgggaaagtgtcacctgacaaagggcaagcaggctctggaaattcgtagctccctctctgagaaacgggcacttactgacccaattcagggtactgagtactccgccgaaagtctagtcaggaatctccaatgggcgaaagcccacgaactgccagaatcgatgtgtttgaagtttgactgcggcgtgcagattcagctgggttttgccgctgaattcagcaacgtgatgataatttacactagcatcgtatataagccaccggaaataataatgtgtgacgcctacgtgacggacttcccccttgacctcgacatagatcctaaggacgctaataagggaacaccagaggagacaggctcgtacctcgtctccaaggatcttccaaagcactgcttgtacacaagattgtcttcgctgcagaagctgaaggaacatttggtattcacagtgtgtctgagttatcagtattctggacttgaggacacagtggaagataagcaggaggtgaatgtagggaagccgttaatcgctaagttagacatgcaccgcggacttggccgtaagacctgttttcagacgtgcttgatgtccaacgggccatatcaaagttctgccgctacttccggtggcgctggccattatcactcactccaagaccccttccatggcgtgtaccattctcatccgggaaatccatctaatgtgacaccagccgactcttgccattgcagtaggacacccgatgcctttatcagttcatttgcacatcacgcttcgtgccatttctctagaagcaatgtgcctgtggagacaaccgacgagattccgtttagtttctctgacaggttacgtatctctgagaagtag

SEQ ID NO: 231152 - DNA, 2475 bp, Artificial Sequence
  Description of Artificial Sequence: Synthetic coding sequence
atgtccctgttaggagaccctctgcaagcactccctccctccgccgctcctaccggaccactgctggcccctcctgccggagccaccttgaatcgattgcgcgaaccgctcctcagaaggctcagcgaactcctggaccaagcccctgaggggcgaggatggaggcgattggctgagttagccggaagtagaggaaggcttaggctgagctgcttggatctggaacaatgtagcctcaaggtcttggagccagaagggtcaccgtctctgtgtctgctgaaactaatgggggaaaagggttgtacagtgaccgaactctctgacttcctgcaggctatggagcacaccgaggtcctgcaattactctctccacccggtattaagattaccgtgaaccccgaatctaaggcagtgctagccggtcaattcgtcaagctgtgttgcagggcaaccggacacccgtttgttcagtaccaatggttcaagatgaacaaggagataccgaatggcaatacttcagagttgatcttcaacgcagtgcacgtcaaggatgcagggttctacgtgtgccgcgtgaacaacaatttcacatttgagttttcccagtggtctcaactggacgtgtgcgacattcctgaatcattccagagaagcgtggacggagtgagcgagagcaaattacagatctgtgtggagcccacatcacaaaagctaatgcctggctctactctggtgctgcagtgtgtggcagtggggtctcccattcctcactaccagtggttcaagaacgagttaccgcttacccacgagacgaagaagctctatatggtgccttatgtggaccttgagcatcaagggacatactggtgtcacgtgtataacgaccgggacagccaggacagcaaaaaggtggagataattatcggacggactgacgaggctgtcgagtgcaccgaagatgaactcaataacctgggccatcctgacaataaggaacaaactaccgaccagccactggccaaagataaggtggccttgttaatcggaaatatgaactaccgcgaacacccgaaactgaaggctccgctcgtagacgtgtacgagctcaccaatctgttgcggcagttagattttaaagtcgtctccctgctggacctcacagaatacgaaatgagaaatgccgtcgatgagttcctgctcttgctagacaaaggtgtgtatggactgctttactacgccggtcacgggtacgaaaactttgggaactccttcatggtgcccgtcgacgcccctaacccctaccgttctgagaattgtctctgcgtgcaaaatatcctgaaactcatgcaagaaaaagagacagggctgaatgtgtttttgctggacatgtgccggaagcgaaacgattatgacgacacaattccaatcttggatgccctgaaggtgactgccaacattgtgtttggttacgccacctgtcagggagctgaggcttttgagatacagcactcgggcctggctaacgggattttcatgaaatttctcaaggatcggctccttgaagacaagaagatcaccgtgttgctcgatgaggtagccgaggacatgggcaagtgccacctgaccaaaggtaagcaggcattggagatcagatctagcttgtccgaaaagcgggctctcacagatccaatccagggaaccgagtattccgcagagtcactggtgcgcaaccttcagtgggccaaagcccacgaacttcctgagtcaatgtgccttaagtttgattgtggcgttcagatacagctgggtttcgctgctgaattttcaaacgttatgatcatctatacgagtatcgtgtataaaccccctgaaatcattatgtgtgatgcctacgtgacagacttccccctggacctggatattgaccctaaggacgcaaataaggggactcccgaagagacaggatcctacctggtgtcgaaggacctgcccaaacattgtctttacacacgcctaagttccctccaaaagcttaaggagcaccttgtatttactgtgtgtttaagttaccagtacagtggcctcgaagacacagtggaagacaagcaggaggtaaacgttgggaagcccctgatagctaagcttgacatgcacagaggtctggggagaaaaacgtgttttcagacatgcctgatgtccaacggcccttatcagtcatctgccgctacttcaggaggtgccggtcactaccacagcctccaggatccctttcacggagtctaccatagccatccaggcaacccttcaaacgtgacccccgctgactcttgtcactgttctaggactcccgatgcatttattagctcgtttgctcaccatgcatcgtgccacttctcccggtctaatgtgccagtcgaaacaaccgatgagattccatttagtttctccgaccgccttaggattagcgaaaaatag

SEQ ID NO: 231153 - DNA, 441 bp, Artificial Sequence
  Description of Artificial Sequence: Synthetic coding sequence
atgacaatgcgcagtctgctgcgcaccccatttttatgcggcctgctttgggctttttgcgctcctggtgccagagcagaggagcccgctgcctcttttagtcagccgggtagcatgggattggataaaaacacggtgcatgatcaagagcatattatggaacatttggaaggcgtgattaacaagcccgaagcggagatgtcccctcaggaactgcagctgcactacttcaagatgcacgattatgacggtaacaatctcctcgatggcctggaactctccacagccataacccacgtgcacaaggaagaagggtccgaacaggctcccctgatgtccgaggatgagttgatcaacattatcgacggagtgctgcgcgatgatgacaaaaataatgacggatacatcgactacgccgagttcgccaagtcactgcaatag

SEQ ID NO: 231154 - DNA, 441 bp, Artificial Sequence
  Description of Artificial Sequence: Synthetic coding sequence
atgaccatgcgtagcctgctgcggactccctttctctgtggtctcttatgggcgttctgtgcccctggtgccagagcagaggaaccagcagcgtctttctctcagcctggtagcatgggcctggataaaaacaccgtgcacgaccaggaacacatcatggaacacctcgaaggtgttattaataagcctgaagcggagatgtcccctcaagagctccagctgcactacttcaagatgcacgattacgacggcaataaccttctagatggcctggagttgtcaacagccatcacacatgttcacaaggaggaaggctctgagcaagcccctcttatgtcagaagacgagttgatcaatatcatcgacggcgttcttcgggacgatgacaaaaataacgatggctacatcgattatgctgaattcgctaaatctctacagtag

SEQ ID NO: 231155 - DNA, 285 bp, Artificial Sequence
  Description of Artificial Sequence: Synthetic coding sequence
atggagcaccttgaaggcgtcatcaacaagcccgaggccgaaatgtcaccacaggagctgcagctccactactttaagatgcatgactacgacgggaacaatcttttggacggactagagttaagcacagccataacgcacgttcacaaagaggagggatccgagcaggctccactaatgtcagaggatgaactcattaacattatagacggtgtgctccgcgatgatgataaaaacaacgatggctacattgattatgccgaatttgctaagtcgcttcagtag

SEQ ID NO: 231156 - DNA, 441 bp, Artificial Sequence
  Description of Artificial Sequence: Synthetic coding sequence
atgactatgcgtagcctcttacgcacacctttcctttgcgggttactttgggccttctgcgctcccggagctagagccgaagagcccgctgcgagcttcagccagcctggatctatgggcctggacaaaaataccgtgcacgatcaggagcacatcatggagcacttagagggtgtgatcaacaaacccgaggccgagatgagcccccaggaactgcagttgcactattttaaaatgcatgactatgacggtaataacctgctggacggcttagaactgagcaccgctatcacccacgtacacaaggaagagggctcagagcaggctccccttatgtcagaagatgaattgataaacatcattgatggagttctgagggatgacgacaagaacaatgacggctacatagattatgcggagttcgccaagtctctgcagtag

SEQ ID NO: 231157 - DNA, 441 bp, Artificial Sequence
  Description of Artificial Sequence: Synthetic coding sequence
atgacgatgcgatcattactgagaacccctttcctgtgcggcctgctgtgggcgttctgcgccccaggcgctcgagccgaagagcccgctgccagcttctcacagccaggcagtatgggactcgataaaaacaccgtgcacgatcaggagcatatcatggagcacctcgagggcgtgattaacaagccggaggccgagatgtcacctcaggaactccagctgcattacttcaagatgcatgattacgacgggaataatctgctcgacgggttggagctgtcaaccgccatcacgcacgttcacaaagaggagggcagtgaacaggcgcctctgatgagtgaagatgaattaatcaacataatcgatggcgttttgagagatgatgacaagaataacgacgggtacatcgattatgctgagttcgcgaagtctcttcaatag

SEQ ID NO: 231158 - DNA, 285 bp, Artificial Sequence
  Description of Artificial Sequence: Synthetic coding sequence
atggagcacctggagggtgtgattaacaaacctgaggctgagatgtcaccccaagaactgcaacttcactatttcaagatgcacgactatgacggcaacaacttgctggatgggctcgagctgtcaaccgccattacccacgttcacaaagaagaagggagtgagcaggctcctctgatgtccgaagacgaactgattaacatcatcgacggggtactcagagatgacgacaaaaataacgatggctatattgactatgccgagttcgcaaagtccctgcaatag

SEQ ID NO: 231159 - DNA, 285 bp, Artificial Sequence
  Description of Artificial Sequence: Synthetic coding sequence
atggagcacttagagggagtgattaacaaacccgaggcagaaatgtcacctcaggagctccagttacattacttcaagatgcacgattatgacgggaacaatctcctggacggcctggaactgagcactgcaatcactcacgtgcataaggaggaaggctcggaacaggcaccactgatgagtgaggatgagctaatcaatatcattgacggggttctgcgagacgatgataagaataacgatggctacatcgattatgccgaattcgcaaagtcgcttcagtag

SEQ ID NO: 231160 - DNA, 441 bp, Artificial Sequence
  Description of Artificial Sequence: Synthetic coding sequence
atgacaatgcgcagcttgttgcgcaccccctttctgtgtggtctgctgtgggcattttgcgcgccaggggctcgggctgaggagcctgccgcttcattttcacagcctggttccatgggtttggacaagaacactgtccacgatcaggagcacattatggaacatttggagggcgttataaataagccagaagctgagatgagccctcaagaactccagctccactactttaagatgcacgactatgacggaaataacctgcttgacggattggagctgagcacagcgatcacacacgtgcataaagaagagggctccgagcaggcacctctgatgtctgaggatgaactgatcaacattatcgacggggttttgagggacgatgacaagaacaatgacgggtacatcgattacgccgagtttgcaaagtcactccagtag

SEQ ID NO: 231161 - DNA, 441 bp, Artificial Sequence
  Description of Artificial Sequence: Synthetic coding sequence
atgaccatgagatctctcctccgcacccctttcttatgtggactgctttgggctttctgcgcgccaggggctcgcgctgaagaaccggctgcatcttttagccagcccggaagcatggggttggacaagaataccgttcatgatcaagaacacatcatggagcacctggagggggtgatcaataagcccgaagccgagatgtcaccccaagagctacaattgcattacttcaagatgcacgattatgacggtaacaacttacttgacgggcttgaactttctactgccatcacacacgtccataaggaagaaggctctgagcaggctcccttgatgtccgaagatgagttaatcaatatcatagatggggtattgcgggatgatgataaaaacaatgacggatatattgattatgctgagttcgcgaagtccttgcagtag

SEQ ID NO: 231162 - DNA, 186 bp, Artificial Sequence
  Description of Artificial Sequence: Synthetic coding sequence
atgactatgcggtccctgctcaggacaccctttttgtgtggcctgctttgggccttttgtgctcccggagcccgagccgaagaacctgccgctagcttctctcagcccggtagcatgggactggacaaaaacaccgtgcacgaccaggaacacattatggagcacctagagggcgtgattaactag

SEQ ID NO: 231163 - DNA, 384 bp, Artificial Sequence
  Description of Artificial Sequence: Synthetic coding sequence
atgctgagcgtgtgctcatgcagaaccagctcaggaatgagatctcagtggccatccgctcggcaacgctcctcctccttgagtacgttccgtcacataatggagcacttagagggagtcattaacaagcccgaagcagagatgagccctcaggaactgcaactgcactacttcaaaatgcatgattacgatgggaataatctgctcgatggtttggagctatccaccgcaataactcacgtccataaggaggagggttccgagcaggctccccttatgtcagaggacgaactgatcaatattatcgacggcgtgctgcgggacgatgacaagaacaacgacggctacatcgactacgccgagttcgccaaatctttacagtag

SEQ ID NO: 231164 - DNA, 3423 bp, Artificial Sequence
  Description of Artificial Sequence: Synthetic coding sequence
atggtaatttctttgaactcatgcctaagttttatatgcctcctgctctgccactggattggaaccgcctcacctcttaatctggaggatcccaacgtgtgttctcactgggagagctattccgtgactgttcaggaaagttatccccaccccttcgatcagatctattatacaagctgcacggacattcttaattggttcaagtgtactcgccaccgggtgagttatcggactgcttatcgtcacggtgagaaaacaatgtatcgacggaagtcccagtgttgcccgggattctacgagtccggggaaatgtgcgttccacattgtgcagataaatgcgtccacggtcggtgtatagcacccaatacctgccagtgcgaacctgggtgggggggaaccaattgtagcagcgcctgtgacggagatcactggggcccacactgtaccagtaggtgccagtgcaagaatggcgctttgtgtaatccgatcacaggagcctgccattgcgccgctggatttagagggtggcggtgcgaggaccgctgcgagcaggggacctacggcaatgattgccaccagagatgtcaatgccagaatggcgctacctgcgatcatgttaccggcgaatgccgctgccccccagggtataccggagccttctgcgaagacctgtgtcctccgggaaagcacggtccccaatgcgaacagcgatgtccctgtcagaatggcggagtgtgccatcacgtaacaggagaatgctcttgtccatcaggatggatgggcaccgtctgtgggcagccatgccccgagggccgatttgggaagaactgctcacaggagtgtcagtgtcacaatggtggaacctgtgacgcggcaacaggccagtgccactgttctccaggctatacaggggagaggtgtcaagatgagtgcccagtaggcacatacggggtcctctgcgcagagacttgtcagtgtgtgaacggaggaaaatgctatcacgtttctggcgcatgcctgtgtgaggccggatttgcgggagagaggtgcgaggctagactctgtcctgagggcctttacggaattaagtgcgataagagatgtccgtgccacctcgaaaacacacattcctgtcatcccatgagcggcgagtgcgcatgtaaaccaggttggagtggactgtattgcaatgaaacttgcagccccggtttttacggcgaagcttgccagcaaatctgttcatgtcaaaacggcgctgattgtgactccgtgactgggaaatgtacatgtgccccagggttcaaaggtatcgattgctctaccccctgcccacttgggacctacgggataaactgctcaagtcggtgcggttgtaagaatgacgccgtttgcagccctgttgacggctcttgtacttgcaaagctggatggcatggcgtggactgctccataagatgtcccagcggtacatggggattcgggtgcaatctcacttgtcaatgcctaaatgggggagcgtgcaacaccttagacggcacatgcacgtgcgcacctggctggagaggcgagaagtgcgagctcccctgccaggacggcacctacggcctcaattgcgctgagcgttgcgattgctctcacgctgatggctgccatcccaccacaggccattgtagatgcctcccagggtggtccggtgtgcactgcgatagtgtgtgcgctgaagggagatggggacccaactgctctctcccctgctactgtaaaaatggcgcatcttgttcccccgatgatggaatctgtgagtgcgcgccaggcttccggggtacgacttgccagcgcatttgctctcctggattctacggtcaccgatgctcacaaacctgcccccaatgcgttcactcatctggcccttgccaccacataactggcctctgtgattgtctccccggattcaccggcgctctctgtaacgaggtttgcccctccggcagattcgggaagaactgcgctgggatttgtacatgtactaacaatggaacatgcaatcctattgacagaagctgtcagtgttacccgggatggattggtagtgattgctcccagccctgccctcctgctcattgggggcctaactgcattcacacatgcaattgtcataatggcgcattctgttcagcatatgacggtgagtgcaagtgtactcctggttggacaggtctctactgtactcagagatgccccctcggcttctatggcaaggattgtgccctgatctgtcagtgccagaatggtgcagactgcgatcacatctccggccagtgcacgtgccggacaggatttatggggaggcactgcgaacagaaatgtccctcagggacatacgggtatggatgtcggcagatctgcgactgcttgaacaactcgacctgcgaccacatcaccggaacttgttattgttcaccaggctggaaaggcgcaagatgcgatcaggcaggcgtgatcattgtgggcaacctaaattcgctgtcccgaaccagcacagccctccccgcagatagctaccagattggggcaatcgccggtataattatcctcgtgctggtcgtcctcttcctgttagcactgtttattatttaccgacataaacagaagggcaaagaatcctctatgcctgccgttacctatactccagctatgcgggtggtgaatgcagactataccataagcggaacgctcccccacagcaacggaggcaatgcgaattctcactattttaccaacccctcatatcatacgttgacacagtgcgctacctccccgcacgttaacaacagggatcggatgactgtaaccaagtcgaagaacaaccaactgttcgtcaatctaaaaaacgtgaatccgggtaagagagggcctgtcggtgactgcaccgggactctgcctgccgactggaagcatggcggttacttgaacgagttgggcgctttcggactagaccggagttacatggggaaaagtctgaaagacctaggaaaaaatagtgaatacaacagcagcaactgcagtttaagctctagcgagaatccatacgctacaattaaagatccgcctgtcttaatacctaaaagtagcgaatgtggatatgtcgaaatgaagtctccagcacgcagagattcgccctacgccgagataaataacagcacaagcgccaatcgtaatgtctacgaagtcgagccaacggtgagtgtggtgcagggcgtcttcagtaacaacggaaggctatcacaggacccgtacgatctgcccaagaattctcacatcccttgccactacgatcttctgcctgttagagattccagctcttcccccaagcaagaagatagcggaggctcatcgtccaattcgtcctcctcctccgaatag

SEQ ID NO: 231165 - DNA, 1704 bp, Artificial Sequence
  Description of Artificial Sequence: Synthetic coding sequence
atggtcatcagcctcaattcttgtctgtcgttcatttgcttattgctttgtcactggatcggtaccgcttctccactgaatctggaagaccctaacgtctgttcacactgggaatcatattccgttacagtgcaggagtcttacccacacccctttgatcagatctactatacaagttgcacagacatcctgaattggttcaaatgtacaaggcaccgcgtctcttatcgcaccgcataccggcacggagaaaaaacaatgtaccggaggaaatcccagtgctgtccaggcttttacgagagcggggaaatgtgtgtcccacactgtgccgacaagtgcgttcatggcagatgcatcgctcccaacacatgtcagtgtgagcctggatggggcggaacgaactgcagctccgcctgcgacggggatcattgggggccacactgcacctcgcgctgccaatgtaaaaatggtgcactctgcaacccaataacaggcgcttgccattgtgctgctgggttcagagggtggcgttgtgaggaccgatgcgagcagggaacctacggaaatgactgtcatcaacgatgtcagtgtcagaatggagccacatgcgaccacgtgacaggagagtgcaggtgtcctcccggttacactggggctttttgcgaggatctatgcccccctggaaaacacggtccgcagtgtgagcagcgttgtccatgccagaatggcggtgtctgtcatcacgtcactggcgagtgttcttgtccctccggttggatggggaccgtctgtggtcagccttgccccgaagggaggttcggtaagaactgttcgcaggagtgtcagtgccataacgggggtacctgtgacgctgctactggacaatgtcactgcagccctggctataccggtgagagatgtcaggatgaatgccctgtgggcacttacggagttctgtgcgccgaaacctgtcagtgcgtgaatggagggaagtgctatcatgtgtcgggggcttgcctgtgtgaggccggatttgcgggtgagagatgcgaagcccgtctctgcccggagggcctgtacgggatcaaatgtgataagaggtgtccatgccatctggaaaacacgcacagttgccatcctatgtccggcgagtgtgcatgcaaaccagggtggtccggactgtattgcaatgaaacttgctcacccggattctatggggaggcttgccagcagatttgcagctgtcagaacggggctgattgtgactccgtgacaggtaaatgtacgtgtgcaccgggattcaaagggatcgattgctctacaccatgtccactcggaacttatggaatcaattgttccagcaggtgcgggtgtaaaaatgatgccgtgtgctctccagtggatggctcttgtacctgcaaagccggttggcacggagttgactgctccattaggtgcccttccggaacttggggctttggctgcaatctgacgtgccagtgcctcaatggcggtgcttgcaacactctcgatggaacttgtacctgtgccccaggatggcgcggtgaaaagtgcgaactcccctgtcaagacgggacttacggtctcaactgcgccgagaggtgtgattgctcccacgccgatggatgtcatcccacaactgggcattgtagatgcctgccagggtggagtggcttgttctag

SEQ ID NO: 231166 - DNA, 3423 bp, Artificial Sequence
  Description of Artificial Sequence: Synthetic coding sequence
atggtaatttctctgaactcatgtctgagttttatttgcctcctgctgtgccactggattggcacggctagccctttgaacttggaagacccgaatgtgtgctctcactgggagtcgtactcagtaacagtacaagagagttatccgcatccttttgaccaaatttactacacctcgtgtacagatattctgaactggtttaagtgcacacggcatcgggtttcatacaggaccgcatatcggcacggcgaaaagacaatgtacaggagaaagagccaatgctgtcccggtttctatgagtccggcgagatgtgcgtgccacattgtgctgacaagtgcgtccatgggagatgcattgccccaaatacatgtcagtgtgaacctggatgggggggaactaattgtagctctgcatgcgatggggatcattggggcccacactgcacttcccggtgccagtgcaagaacggcgctctctgcaaccccattacaggtgcttgtcactgcgccgctggttttaggggctggagatgcgaggaccggtgcgaacagggaacctacggaaacgactgccatcagaggtgccagtgtcagaacggtgccacctgtgatcatgtcaccggcgaatgcagatgccctccaggctatactggggcattttgtgaggacttgtgcccaccagggaagcatgggccacagtgcgagcaaaggtgtccatgccagaatgggggagtctgtcaccacgtgacgggcgaatgctcttgtccaagcggttggatgggcacagtttgcgggcagccttgccccgaggggcgattcgggaagaattgctcgcaggagtgtcaatgtcataacggaggcacttgtgatgcagccacaggccaatgccattgttcaccgggatatactggcgaaagatgccaagacgaatgtccagttggtacctacggcgtgttgtgtgcagaaacttgtcaatgtgttaacgggggaaagtgctatcacgtctccggagcgtgtctctgtgaggcaggctttgcaggagagcggtgcgaagccaggctttgtcccgaagggctatatggcatcaaatgcgataagcggtgtccttgtcaccttgaaaatacccactcctgtcaccccatgagtggggaatgtgcctgcaagccagggtggtcaggtttatattgtaatgaaacctgctcaccaggattctatggagaggcttgtcagcagatttgctcatgccagaacggagcagattgtgattctgtaacaggcaagtgtacttgcgctccagggttcaagggaatcgattgttccaccccgtgcccactgggcacttacggaatcaactgctcatccaggtgcggctgcaagaatgatgcagtgtgctcaccagtagacgggtcttgtacctgcaaagctggatggcacggcgtggactgtagtatacgctgcccctcaggtacctggggcttcggatgtaacctgacctgtcagtgtctcaacggtggagcatgcaataccttggacggcacatgcacttgtgcccctgggtggcgcggagaaaaatgcgagctgccgtgtcaggatggcacatatgggcttaattgtgcggagagatgcgactgcagtcatgctgacggatgtcatcccaccacagggcattgtaggtgcctccctggctggtccggtgtgcactgcgacagcgtgtgtgctgaaggtcgatggggacctaactgtagcctgccgtgctattgcaaaaatggcgcttcttgtagccctgatgatggaatctgcgagtgtgctcccggttttagggggaccacatgtcagcgtatctgcagtccgggtttctatggacaccgctgtagccagacttgcccacagtgcgtacatagctcagggccatgtcatcatattaccggactgtgcgattgtcttcctggttttactggtgccctatgtaacgaggtgtgtccctctggacgcttcggaaagaattgtgccggaatctgcacatgtaccaataacggaacttgcaaccccatcgatagatcctgccaatgctaccccggttggatcggttctgactgttcccagccttgccctccagcccactggggcccaaattgtattcacacctgcaattgtcataatggtgctttctgctctgcatatgacggcgaatgtaaatgcactccgggttggacaggactgtactgcacacaacgatgtccactcggattctatggtaaagattgcgcactgatttgccagtgccagaatggcgcagactgtgatcacatcagtggccagtgcacttgcagaacaggatttatgggacgtcattgcgagcagaaatgtcctagcggaacatacgggtacgggtgtcggcagatatgcgattgcctgaacaatagtacgtgcgatcacattaccggcacatgttattgctcccctgggtggaagggcgcacgctgcgatcaggcaggcgtcatcatagttggcaatctcaattccctgagtcgcaccagcacggccttgcccgcagacagctatcagattggcgctattgcaggcatcatcatcctggtactggtagtcttgttcttgctggccctatttattatttacaggcataaacaaaagggcaaagaatcatctatgcctgccgtcacctacactccggctatgagggtcgtgaacgctgattatacaatatcgggtacccttcctcatagcaatggcggtaatgcgaattctcactacttcactaatccatcttaccacaccttgacccaatgtgccacgagtcctcacgttaataaccgcgataggatgactgttactaagagcaagaacaatcagttgttcgttaatcttaaaaatgtcaatcccggaaaaaggggcccagtgggcgattgtactgggacgctgccagcagactggaagcatggcggttaccttaacgaactgggcgcattcggactggatcggagctatatgggcaagtctctgaaagacctgggcaaaaatagcgagtataacagttctaattgcagtttatcaagctctgaaaatccatatgccacaatcaaggacccccctgttctgattcccaagtcttctgaatgtggatacgtggagatgaagagccccgctcgacgggattctccgtacgctgagattaataactccacttctgccaaccgtaacgtgtacgaagtggagccgactgtgtccgtcgtgcagggggtgttttctaacaatgggagactgtcccaggatccctatgaccttcctaagaactcccatatcccgtgccattatgacctactacccgtgcgggacagctcttcttcacctaaacaagaggattccggtggcagttctagcaactcttcaagtagcagtgaatag

SEQ ID NO: 231167 - DNA, 2910 bp, Artificial Sequence
  Description of Artificial Sequence: Synthetic coding sequence
atgcacacgccttctatcagatcgatcacccatgacgcacaaacctcttcaaccggcagttccgcccctggtaccgcactgtgcactgaagagtgtgtccacggacggtgtgttagccccgatacatgtcactgtgagccgggatggggaggcccagactgctcatccggatgtgacagcgatcactggggcccacactgcagtaacagatgtcagtgtcagaatggagcattgtgtaacccgattaccggagcgtgtgtgtgcgctgcgggattccgcggatggcgctgcgaggaactctgtgcccctggaacccacggaaagggctgccagttgccttgtcagtgccgccatggcgcaagttgtgaccctcgcgctggcgaatgtctgtgcgccccaggctataccggcgtctattgcgaagaattgtgtcctcccggtagccatggagcccactgcgagctacgctgcccttgtcagaatggaggcacctgccaccatatcactggagagtgtgcctgtccccctggatggaccggggctgtctgcgcccagccatgtccaccgggaacatttggtcagaattgttcccaggattgcccctgtcaccatggtggccagtgcgaccatgtcacaggccagtgccactgtaccgccggttacatgggcgataggtgccaggaggagtgcccatttggctccttcggctttcagtgctcccagcactgcgactgtcacaacggagggcagtgcagtccaactactggggcttgtgaatgcgaaccaggctacaaaggcccacgatgccaagagaggctgtgcccggagggtttgcacgggccagggtgcacactcccgtgtccttgcgacgctgacaatacgataagctgccaccccgttacaggggcatgtacatgtcaacccggatggagtggccaccattgtaatgagtcatgccctgttggctattatggtgatggctgtcagctgccctgtacatgccaaaacggggctgactgccattccatcacaggcggatgtacttgcgcacctgggttcatgggggaagtttgtgcagtgtcctgtgctgcaggcacttacggtccaaattgcagcagcatttgtagttgcaacaacggtggaacttgttcacccgtcgatggctcctgtacatgtaaagagggatggcaggggctggactgcacgctgccatgcccgagtgggacctgggggctcaattgcaatgaatcttgcacttgcgccaacggggctgcctgttctcccatcgacgggtcatgtagctgtacaccgggatggttgggagatacatgtgagctgccttgtccagatggcacgtttgggctgaattgctctgagcactgcgactgctcccacgctgatggctgtgaccccgtgacaggacattgttgttgcctcgccggatggacaggcatccgctgtgattccacatgtcctcctgggcgatggggccctaattgttctgtgtcttgttcatgcgagaatggtgggtcctgctctccagaagacggaagctgcgaatgtgccccaggtttccggggacccctgtgccagcgcatctgtcccccaggattctatggacatggttgtgcacaaccatgcccactctgcgtgcattcttcacggccttgtcaccatattagcggcatctgcgaatgcttgcccggtttctccggcgcactgtgtaaccaggtctgtgcaggcggttacttcggacaggattgtgcccagctgtgttcctgtgctaacaacgggacctgttcccctatcgatggctcctgccaatgcttcccaggttggatcgggaaggattgctcccaggcatgtccccctggattttggggccctgcatgctttcacgcatgcagctgtcacaatggagccagttgttctgctgaagatggagcatgccattgtacgccgggatggactggtcttttctgtacccagcggtgccccgctgccttctttggtaaagattgtggccgagtgtgtcagtgccaaaatggggcttcttgtgaccacatatctggtaagtgtacatgcagaacaggtttcacaggtcagcattgtgaacagagatgcgctcccggaaccttcggttatgggtgccagcagttatgtgaatgtatgaacaatagcacctgcgatcatgtgacagggacctgctattgtagccccggatttaaggggatacgatgcgatcaagccgctctaatgatggaggaactcaatccttataccaaaataagtccagccctcggagctgaaaggcactcagtaggtgccgttactggcatcatgctgctcctgttcctgatcgtggttctgctcgggctatttgcctggcaccggaggaggcaaaaggagaaaggtcgcgacctcgccccacgagtcagctacacacccgctatgaggatgacgtccacggactattcactatccggggcttgcggtatggatagacggcaaaatacatacatcatggacaaggggttcaaagattacatgaaagagagtgtctgcagctcctcaacttgctctctcaacagcagtgagaatccctacgctaccattaaggatcccccaatcctgacttgcaaactcccagaatcttcctacgtcgaaatgaaaagccctgtccacatgggttctccatatacagacgtccccagtctttccacatctaacaaaaatatttatgaggtagagcctaccgtttcggtggtacaggagggatgtggccacaacagctcctacatacaaaacgcatacgatctgccacgaaatagtcacattcctggacactacgatcttttgccagtgcggcagtcccctgctaatggcccttcgcaggacaagcaaagctag

SEQ ID NO: 231168 - DNA, 2628 bp, Artificial Sequence
  Description of Artificial Sequence: Synthetic coding sequence
atggtgctgagccttactgggctcattgcgttttcatttctgcaagctaccctggcattgaatcccgaggatccaaatgtctgctctcattgggaatcatatgccgtaacagttcaggagtcctacgcccaccctttcgaccagatttattatacccgatgtactgatattctcaattggttcaaatgcacacgccaccgaatttcttacaaaactgcttaccggagaggcctcaggactatgtatagacgcaggagtcagtgttgtccgggatattacgagtccggggatttttgcatccccctctgcacggaagaatgtgtccacggtagatgtgtctcccctgatacatgtcactgcgaaccgggatggggtgggcctgattgcagctcaggttgcgacagcgaccactgggggccacattgctccaacagatgccagtgtcagaacggcgcactgtgcaatcctataacaggggcttgcgtatgcgccgctggcttcagggggtggcgttgcgaagagctctgcgctccaggaacccacggaaagggttgccagcttccttgccagtgtagacatggcgctagttgtgacccacgagcgggagaatgcctctgcgcgccaggatacacaggcgtgtactgtgaggagttgtgccccccaggatctcacggagctcactgcgagctacgctgcccctgccagaatggaggcacttgtcaccatattaccggagagtgcgcgtgccccccaggctggactggagcagtatgcgcacagccttgcccaccagggactttcggtcaaaattgttctcaggattgcccatgccaccacggaggccagtgtgaccatgtaacagggcaatgccattgcaccgcagggtacatgggcgatagatgtcaggaggaatgccccttcgggtcattcggttttcagtgtagccaacattgcgactgccacaatggcggacagtgctcgcccacaactggtgcttgtgagtgcgaacctggatataagggccctcgttgccaggagcgcctgtgtccagaggggctgcatggtcccggatgtacattaccatgtccctgcgatgccgacaatactatttcttgccacccggtgacaggcgcttgcacgtgccagccaggatggagtggccatcactgcaacgagtcctgccctgtcggctattacggagatggctgtcagctcccctgcacgtgccagaatggagccgattgccacagcataacagggggttgtacatgcgccccagggttcatgggggaggtgtgtgcagttagctgtgcagcaggtacctatgggcctaactgcagttctatctgcagttgcaacaacggcggaacttgctcacccgtggatggatcctgtacttgtaaggaagggtggcagggactggattgtacactcccctgcccatccggaacatggggactaaattgcaatgaatcctgcacttgcgcaaatggcgctgcctgcagtccaatcgacggcagctgtagctgcactccaggatggcttggggatacctgtgagctgccttgtccagacggcacattcggcctgaactgctccgaacactgtgactgtagccacgcggacggatgtgatcccgtcactggccattgttgctgtctggccggatggactggaatcaggtgcgactctacttgtccgcctgggaggtggggtcccaactgtagcgtttcctgttcctgtgaaaatggcggttcctgctcccctgaggacgggtcctgcgagtgtgcccctgggttcaggggtcccctttgtcagcgcatctgtcctccaggtttttatggacatggttgcgcccagccatgtccgctttgtgtacactcttctcgcccatgtcatcacatatctggaatctgtgagtgcctccccggattcagcggggcactctgcaatcaggtctgtgccggaggatactttggtcaggactgtgcccagctgtgctcctgcgccaataacggaacctgttctccaattgatggaagctgtcaatgcttcccaggctggatcggaaaggactgctcacaagcttgccctcccggattttggggcccagcttgctttcacgcctgttcctgccacaacggtgcatcttgttccgccgaagatggagcctgtcattgcaccccaggctggaccggccttttctgcacgcagagaaagccgcacttgctcgcctcgcaaccactgcgtatcccatgctgcggactcctcgctacagtgggcatcgtacaaacttcgcgcgagggtggaatgcaggccgctcctggactggtggtgcctgattcctgtcctacccgcaccgaggagctctgtagagggtccagcaggcctgattggatccagggaatcgacaaacccaaggtccttgaaggccagggctgtaaggctgcgcagcagcactttctgggaaggacagtaggcgcatacgcctcagtgcggatggctcctgccgtcaccacctctgtggcttccgcccctgcagcccaggcttctcccggaaacaccgtgagccgggacgtgccacaggagccgttggccatgggagtttcctcttatgtgtcagcatag

SEQ ID NO: 231169 - DNA, 414 bp, Artificial Sequence
  Description of Artificial Sequence: Synthetic coding sequence
atgatggaggagctcaatccatatacgaagatctcccccgctctgggagcagagcgccattccgtcggagctgtgacaggcattatgctgctgctgttcctgatcgtggtgctgcttggtctgtttgcgtggcacagacgtcgccagaaggagaaaggcagagacctggctccgcgagtgtcctacacacctgccatgaggatgacctccaccgattattccctttccgcctccaccactccgtggtggccggttatggaacatttggccaggccattttctcaacgtcctcgaacccaattaagtaataaaagtctcgacagagataccgcagggtggacaccatacagctacgtgaatgtgttagaccagtgtcccggaggccaagttcctgctagaggcctcctgcactag

SEQ ID NO: 231170 - DNA, 2910 bp, Artificial Sequence
  Description of Artificial Sequence: Synthetic coding sequence
atgcacaccccttccattagatccatcactcatgacgcacagacatccagcaccggctccagcgccccagggacagcactttgcacggaggagtgcgtccatggcagatgcgtgtccccagatacctgtcactgcgaacccggatggggcggtccagattgctcttctggatgtgactcggaccactggggacctcattgctccaaccgatgtcaatgccagaatggagccctgtgcaatccaattactggcgcttgtgtctgtgcagccggattccgcggttggcggtgtgaagaactgtgtgccccaggcacccatggcaaaggatgtcagctgccctgccagtgcagacacggtgcatcttgcgacccacgtgctggggagtgcttatgcgctccaggatacacaggcgtgtactgcgaggagctgtgcccccctggatcccatggagcgcactgtgaactgcgttgcccctgtcagaacgggggtacctgccaccacattaccggcgagtgtgcatgcccaccaggttggaccggggctgtgtgcgctcagccttgcccccctggtacattcggccagaattgctcccaggactgtccctgtcaccatgggggacaatgtgaccatgttactggtcaatgtcattgtacagccggttatatgggcgacaggtgccaagaagagtgtcctttcggctcctttgggttccagtgctcccaacactgcgactgccataacggcggacagtgtagtccaacgacaggagcctgcgaatgtgaacccggatataaaggcccaaggtgccaggaacgcctctgcccagaaggcctccatgggcctggatgtactttgccttgtccctgcgacgccgacaatactatcagctgtcatcccgtgaccggcgcttgcacttgtcaaccaggctggtccgggcaccactgcaatgagtcgtgcccagtggggtattacggggacggatgtcagttgccctgtacctgtcagaacggagcagactgccactccataaccggcggatgcacctgtgcgcctgggttcatgggagaggtctgtgccgtgagctgcgccgctggtacgtacggccctaattgcagcagtatctgtagttgcaataacggcggtacctgcagtccggttgacggttcttgtacctgtaaggagggatggcagggattggattgtactttaccctgcccctcgggcacctggggactgaattgcaacgagagctgcacctgtgctaacggcgctgcctgctcacccatcgacggctcatgctcctgtaccccaggttggctgggggacacctgcgagctgccttgcccagacggaacatttggacttaactgttccgaacactgtgattgttctcacgcagacgggtgtgaccctgtcacaggacactgttgttgcctggccggttggactggcattagatgtgactctacttgtcctcctggtcgatgggggcctaactgcagtgtgagttgttcctgcgaaaacggcggaagctgctctccggaggacggatcgtgcgagtgtgcgccaggtttcagggggcctctgtgccaacgcatctgccctcctggcttctacgggcacggctgtgctcagccatgtcccctgtgtgtgcatagttctagaccatgccaccatatcagtggaatatgcgagtgtctacccggattttcgggagctctttgtaaccaggtttgcgccggaggatactttggccaggattgtgctcaactgtgtagctgcgcaaacaatggcacatgttcccccatagacggcagctgccagtgctttccaggatggatagggaaggactgctctcaggcttgtcctcccggattctgggggcctgcatgcttccacgcatgcagctgtcataatggggcatcttgttcggccgaggacggtgcctgccactgtacaccgggatggacaggtctgttctgtactcagagatgccccgcagctttcttcggcaaggactgtggacgtgtctgtcagtgccagaatggcgcttcttgcgatcacatttcaggcaagtgtacttgccgcacaggcttcaccggccagcattgtgaacagagatgcgcacctggaacttttggatacggttgtcaacagctttgtgagtgcatgaataattcaacttgtgaccacgtcacagggacctgttattgttccccagggttcaaagggattagatgcgaccaggctgctctgatgatggaagagctaaatccatatacgaagatcagtcccgcactgggggctgagaggcactccgttggcgcagttacagggatcatgctgctcctgttcttgatagttgtgctcctgggtctgttcgcatggcaccggagacgtcagaaggagaagggcagagacctggccccaagggtaagctacactcctgccatgagaatgactagcaccgattattccctcagtggcgcatgtgggatggacaggagacagaatacgtacattatggacaaaggattcaaggattacatgaaagagagcgtttgcagttcttcaacgtgtagtctgaactcctccgaaaacccatatgccacgattaaggacccccctattctcacctgtaagttgccagaatcgtcctatgtggaaatgaagtccccagtgcacatggggtccccgtatacggatgtgccatcattgagcacaagtaataaaaacatctatgaggtggagcctactgtgagtgtggtccaagaggggtgtggccataatagctcatacattcagaacgcctatgatcttcccagaaattctcatatacctggtcattacgacctgctccctgtgagacagagtcctgcgaatggacctagtcaggacaagcagagttag

SEQ ID NO: 231171 - DNA, 3135 bp, Artificial Sequence
  Description of Artificial Sequence: Synthetic coding sequence
atggtactaagtctcactggcctgattgccttctcttttctgcaggccactttggccctgaaccctgaggatccaaacgtttgtagccactgggagagctacgcggtcaccgtgcaagagtcctacgcacatcccttcgatcagatctactatacacgctgtaccgatatccttaactggtttaagtgcactcgccatcgcataagttataaaaccgcttatagaaggggcctcagaacaatgtacaggaggaggtctcagtgctgtcccggttattacgagagcggggacttttgcattccactgtgtaccgaggagtgcgtccacggccgttgtgtgagcccggatacgtgtcattgcgaaccaggatggggcggaccagactgctcatctggatgcgattcagaccattggggaccccactgttccaatcgatgtcagtgccagaacggggctttatgtaatcctattacgggggcatgtgtttgtgccgctggatttaggggttggcgatgcgaggaactctgcgcaccaggaacgcacgggaaaggttgccagctcccatgtcagtgtaggcatggagcttcatgtgaccctcgggctggggaatgtctctgtgcacccggatacaccggcgtttattgtgaggaactgtgcccacccggttcccacggcgctcactgtgagctgagatgtccatgccaaaatggcggtacgtgccaccatatcactggcgaatgtgcatgtcccccaggttggacgggcgctgtctgtgcacaaccctgtcctcccggaacattcggccaaaactgctctcaagactgcccgtgtcaccacggcggtcaatgtgaccacgtaactgggcagtgccactgtacagccggttacatgggcgatcgctgtcaggaagaatgcccattcggtagttttggctttcaatgctcccaacattgcgactgccataacggaggccagtgctcccctacaacaggagcttgcgagtgtgagcccggttacaaaggaccgagatgtcaggaaaggctctgtcccgagggccttcatgggcctggatgcacactaccgtgcccttgcgacgctgataataccatcagctgtcatcccgtgactggcgcttgtacttgccaacccggttggagcggccatcattgtaacgaaagctgtccggtcgggtactatggcgacggatgtcagctcccatgcacatgccagaacggagcggactgccattccatcaccggagggtgtacatgcgcccctggctttatgggcgaagtttgtgcagtaagctgcgccgctggcacctacgggccaaactgtagctctatctgctcctgcaataacggagggacgtgtagtcccgtagacggctcttgcacatgtaaagagggttggcagggtctggattgcaccctgccttgtccatctggcacttgggggctgaactgtaacgaatcttgtacatgcgccaatggggcagcttgctccccgatcgacggttcctgttcctgcacaccaggttggctcggtgacacctgtgagcttccgtgtcccgatggtacttttggcctgaactgctccgagcactgcgattgttcacacgctgacgggtgtgatccagtcactggccattgctgctgtttggctggttggacaggcataagatgcgattctacctgcccaccaggacgttggggcccaaactgttccgtgtcatgcagctgcgagaatggtggaagctgttcacctgaagatggatcttgtgagtgtgccccaggctttcgaggaccgctgtgtcagaggatctgcccgccagggttctacggccatgggtgtgcacaaccttgtcccctgtgcgttcactccagccggccttgccatcatatcagcggcatttgcgagtgcctccctggatttagtggagcactctgtaatcaggtctgcgccggaggttacttcggacaggattgtgctcaactgtgtagttgcgccaacaatggaacatgctcccctattgatggctcttgccagtgctttcccggttggattggaaaggactgcagtcaggcttgccccccaggcttctgggggcctgcatgtttccacgcttgctcatgccacaatggcgcttcatgtagcgccgaagacggcgcttgccactgcacgcctgggtggaccggacttttttgtacccaaagatgcccagcggcattctttggaaaagattgcggccgagtctgtcagtgccagaatggcgcaagctgcgaccatatttccggaaaatgtacctgtcgtacaggcttcaccggacaacattgcgaacaacggtgcgcgccaggcacattcggatacgggtgtcagcagctctgtgagtgcatgaataattcaacttgtgatcatgttaccggtacctgttattgctcgcccggtttcaagggaatccggtgtgatcaagctgcattgatgatggaggagctgaacccctacacaaagatttcaccggcactgggcgcagaacgccacagcgtgggagccgtgacgggcatcatgctcctcctctttctcatcgtggtgttactgggccttttcgcctggcacagaagaaggcagaaagagaaggggagagacctggcaccgagggttagctacactcctgcgatgcgaatgacctctactgattattccctgtccggcgcatgtgggatggatcgcagacagaacacttacattatggacaaaggattcaaggattatatgaaagaatcagtgtgtagcagctctacttgttccctcaatagttccgagaacccatatgccactattaaagatcccccaatcctcacctgcaaactccccgagagttcatatgtcgaaatgaagagccctgtgcatatgggcagcccctacactgacgtgccctctctgagcacctccaacaagaatatctatgaagtggagccgaccgtgtccgtggtgcaggaaggatgcggccataactcatcatatatacagaacgcctacgaccttcctcgcaacagtcatatccctgggcattacgatttgttgccggtgcgccagagtcccgctaacggaccctcccaggacaagcagtcttag

SEQ ID NO: 231172 - DNA, 3135 bp, Artificial Sequence
  Description of Artificial Sequence: Synthetic coding sequence
atggtgctatccctgaccggccttatcgcctttagttttttgcaggctaccttggccttgaaccctgaggaccctaatgtatgttcccattgggagtcttacgccgtgacagtccaagagtcctacgctcaccctttcgaccaaatctattacactcgctgtacagacattctaaactggtttaagtgcacacgccatcggattagttacaagaccgcctatcgtcggggattgcgaaccatgtacaggagacgctcacagtgttgtcccggatactacgaatccggagacttctgtattccgctgtgcactgaggagtgcgtccatggaagatgtgtgtctcccgatacctgccactgtgaaccgggttgggggggaccagattgttcatccgggtgcgacagtgaccactggggccctcactgcagcaatagatgtcagtgtcagaatggggcactgtgtaaccccatcacaggggcttgcgtgtgcgccgctggcttcagaggatggagatgtgaagagttgtgcgcaccagggacacacggaaagggctgccagctcccttgccaatgtcgccacggagcgtcctgcgatcctcgcgctggagaatgtttgtgtgctccaggatacacgggtgtttactgtgaggagctgtgcccccctggcagccacggagctcactgcgagctgaggtgtccctgtcaaaatgggggtacctgtcatcacatcacaggcgagtgcgcttgccccccagggtggacaggcgctgtctgtgcccagccttgtccaccgggaacattcgggcagaactgctctcaggattgcccatgtcaccatgggggacagtgcgaccatgtcacagggcagtgccactgcacagccggttatatgggcgataggtgtcaggaggaatgtccgtttgggagcttcggatttcagtgcagccagcattgcgactgtcataacggtgggcagtgcagcccaaccacaggagcctgcgagtgtgaacccggatacaaaggcccacgctgtcaggagcggttgtgcccagagggcctgcatggacccggatgtacgctgccctgcccgtgcgatgcagacaatacaattagttgccaccctgtcacaggcgcatgtacttgccagcccggatggagcggacaccactgtaatgaatcttgtcccgtgggttattacggggacggctgccagctcccatgcacttgccagaatggtgctgattgccatagcattacagggggatgtacctgcgctcccggattcatgggggaggtctgcgctgtttcatgcgctgctggtacttatgggccaaattgcagctccatctgctcttgtaataacggcggaacgtgctctcctgtcgatggctcctgtacatgcaaagaaggatggcaggggctggattgtacactgccttgtccatctgggacttggggcttgaattgtaatgaatcctgtacatgtgccaacggtgccgcatgctcccccatagatgggagttgctcctgcactcctggttggctgggggatacatgtgagttgccctgccccgatgggacatttggtttgaactgttccgagcattgtgactgctctcatgcagatggctgcgatcccgtgacgggccattgctgttgcctggcaggatggaccgggataagatgtgatagcacctgcccacccggtcgctggggacctaactgctctgtcagttgttcctgcgaaaatggcggttcttgctcccctgaagatggatcttgtgaatgtgccccaggtttccgaggcccactttgtcagcggatctgccccccaggcttttatggccacggttgtgcccagccatgtcctctgtgtgtgcacagctctcggccatgtcaccatatcagtggtatttgtgaatgtttgcctggattctctggagccttgtgtaaccaagtgtgtgctgggggttatttcggacaagactgcgcccagctgtgctcctgcgcaaacaacggtacgtgttctcctatagacggaagttgccaatgttttcctggctggatcggaaaggattgctctcaggcctgtccacccggattctgggggcctgcgtgctttcatgcctgttcctgccataatggggcttcctgtagcgctgaggacggtgcttgtcattgcacacccggttggaccggcctattttgcacacagagatgccccgcagcgttcttcggaaaggattgtggcagggtctgtcagtgtcaaaatggggctagctgcgaccacatcagcggcaaatgtacctgccgaacaggatttacgggtcagcactgcgaacagaggtgtgctccagggaccttcggctatggctgccagcagttatgtgagtgcatgaacaactctacctgtgaccacgtaaccggcacatgttactgctcacccggatttaaaggaattaggtgtgatcaggcggctctgatgatggaggagctgaatccatatacaaaaattagccctgctctcggggcagaaagacactcagttggcgctgtgacaggaataatgctgctcttgttcctgatcgtggtgctcctgggactctttgcttggcatcgcaggcggcaaaaggagaagggacgagacctcgctccacgcgtatcttacacacctgcaatgcgaatgacctccacggattactctttgtctggagcctgcgggatggatcgtcgccagaacacttatatcatggacaagggtttcaaagattatatgaaagagtccgtgtgttccagtagcacatgttccttaaactcctcggagaacccatacgcaaccatcaaggacccacctatcttaacatgtaaactccccgaaagttcatacgtcgagatgaaatcgccagtacatatgggatcaccctacacagatgtcccgtccctgagcacctcaaataagaacatatacgaggttgagccgacagtgagcgtggtacaggaggggtgcggtcataacagtagctacattcagaatgcttatgacctgcccaggaactcccacattcctggccactatgatctcttgccagtcagacagtctcctgcaaacggcccatctcaggataaacaaagctag

SEQ ID NO: 231173 - DNA, 3690 bp, Artificial Sequence
  Description of Artificial Sequence: Synthetic coding sequence
atgggggctagtagagacaggggactggcagcactgtggtgccttggactgctgggcggactagcacgcgttgccggtacacactatcgctacctctggaggggctgctacccctgtcatctgggacaggccggttaccccgttagcgctggagaccagagaccagatgtggacgaatgtcgtactcacaatggaggctgtcagcatagatgcgttaatacccccggtagttatctgtgcgagtgcaaacccggatttagattgcacacggactcaagaacttgcctggccatcaactcttgcgccctcggcaacggtggttgccagcatcattgcgtccaactgacaattactagacatcgatgccagtgtcgccctggtttccagctgcaggaggacggaagacattgcgtgagacgcagtccctgcgccaacagaaatggatcctgtatgcatcggtgccaagttgtgcggggacttgctcgatgtgagtgccacgtggggtaccaacttgcagcagatggcaaggcctgcgaggacgtggatgagtgcgccgcagggctcgcacaatgcgcacacggatgtctaaacactcaggggtcgttcaagtgcgtctgccacgccggttatgagctcggtgctgacgggaggcagtgctatcgaatcgagatggagatcgtaaatagttgtgaagccaacaatggcggttgttcgcacggatgttcgcatacgtctgctggacctctgtgcacgtgtcctcggggatacgagctggacaccgaccaacgcacatgcatagatgtggatgattgcgctgatagcccgtgctgtcaacaggtgtgcacgaacaacccaggcggatatgagtgcggctgttacgccggttacagattgagcgctgacggctgtggatgtgaagatgttgacgagtgcgcctcttcacgcggagggtgcgagcaccactgtaccaatctggctggaagttttcaatgctcatgtgaggcaggctataggcttcatgaagaccgcagaggatgttcccctttagaggagccaatggtcgacctggatggcgagttaccattcgtgaggccgttaccgcacatcgcagttctccaagatgaactgccgcaacttttccaggacgacgacgtgggagctgatgaagaggaagctgaattacgtggcgagcatactttaacagagaaattcgtgtgcctagacgattcttttggccacgattgttctctcacatgtgatgattgtcgaaatgggggaacatgtctacttggccttgatggttgtgactgtcccgaaggctggactggacttatttgtaatgagacttgcccccctgatacatttggtaaaaattgcagtttcagctgttcctgccagaatgggggaacgtgtgactccgtaacgggagcatgtaggtgccctcctggtgtgtccggaacaaattgcgaagatggatgcccaaaagggtattacggaaaacattgtaggaagaagtgcaactgcgcgaacagggggcgttgtcatagactgtacggagcctgcctttgcgatccgggtctctatgggaggttctgtcatctgacttgcccaccatgggctttcgggccaggctgtagtgaggagtgccagtgtgtccagcctcacactcagagctgtgataagagagacggcagttgttcatgtaaggcaggcttccggggagaacggtgccaggccgaatgtgaactgggctatttcggaccaggttgctggcaggcctgcacatgccccgtgggggtggcttgcgacagcgtatctggcgagtgcggcaagagatgccctgcagggtttcagggcgaagattgtggacaagagtgtcctgtgggtacattcggcgttaattgctcttcatcgtgcagctgcggcggagcaccctgccatggcgtgaccggtcagtgccgatgcccacccggacgaactggcgaagattgtgaggccgactgtcccgagggaagatggggactgggatgtcaggagatctgccccgcatgtcagcacgccgcaagatgtgatcctgaaaccggtgcttgtctatgtctgcccggattcgtgggctccagatgtcaagatgtatgtccagcaggatggtacggcccttcatgccagacccgttgttcctgcgcaaacgatggacattgtcatccagccaccggccactgcagttgtgctccagggtggacagggttttcttgccagagggcctgcgacacgggacattgggggcctgactgttcacacccttgcaactgtagcgccggtcacggaagctgcgatgccatcagcggcctgtgcctgtgtgaagcgggatacgtgggtcccaggtgtgagcagcaatgtccccaggggcacttcgggccaggatgcgaacaacggtgtcagtgtcagcatggagccgcttgtgaccacgtaagcggcgcatgcacgtgtcctgccggatggcgcggaaccttctgtgagcacgcatgccccgcaggtttcttcggccttgactgtcgctcagcatgtaactgcacggccggtgcggcttgtgatgccgtcaatggatcctgtctgtgtccagccggtcggagaggacctcgctgcgccgagaagtgcctccctagggatgtcagggctggatgcaggcattcagggggttgccttaacggcggactctgcgaccctcacacagggagatgcctgtgcccagctggttggacaggcgataaatgtcagagcccttgtctccggggttggttcggtgaggcctgcgctcagcggtgttcgtgcccgccaggcgcagcatgtcatcacgtgaccggcgcatgccgctgtcccccagggtttacaggaagcggctgcgagcaaggttgcccacctgggaggtatggccctggatgtgagcagttgtgcgggtgcctgaatggcggtagttgcgatgctgctaccggggcatgtcggtgtccaactggatttttggggaccgactgcaacctcacctgcccccaaggccgttttggtccaaattgcacacatgtttgcggttgtggacagggggcagcttgtgaccccgtgaccggaacctgtctctgcccccctggtcgggctggcgtaaggtgcgagcgcggatgcccacagaatcggtttggcgtgggctgtgagcatacatgctcctgtcggaacggcggactctgccacgcgtccaacggcagctgcagctgtggactggggtggaccggaagacattgcgaattggcatgccctcctggtagatacggcgcagcctgccatctcgagtgttcctgccacaacaacagtacctgcgagcctgctactggcacctgtcgctgcggacccggtttctatggccaggcctgcgaacatagaaggtctggggcaacatgcaacctggactgccgtaggggccagttcggcccatcctgcaccctccattgcgactgtggcggaggcgctgattgtgaccccgtgtcaggccagtgtcattgcgtggacggctacatgggcccaacctgtcgagaaggcggtccactccggctgccggaaaatccttcactggctcagggctccgccggaacacttccagcttctagtcggccaaccagtcggtcgggcggacctgctcggcattag

SEQ ID NO: 231174 - DNA, 4626 bp, Artificial Sequence
  Description of Artificial Sequence: Synthetic coding sequence
atgagctttctggaagaagctcgggctgccggacgcgctgttgtgttagctctcgtgctgttgctgctgcccgcagtgcccgtcggggcatccgtccccccacggcctttattaccactccagcccggtatgccccatgtgtgcgccgaacaggaactgactcttgttggtcgcaggcagccctgtgttcaggcactctctcatactgtgccagtttggaaggccggatgtggttggcaagcctggtgtgtcgggcatgaaagacgaaccgtgtactatatgggctaccggcaagtatacacgactgaggcaaggaccgtgctccggtgttgtcggggttggatgcagcaaccggatgaggaaggctgtctgagtgcggaatgctcagcttcattgtgtttccacggcggtaggtgtgtgccaggaagcgcacagccctgccattgcccccctgggttccaggggccacgctgccagtatgatgtagatgaatgcagaacgcataacggcggatgccaacacagatgtgtgaacaccccagggtcctatttgtgtgaatgcaagcccggttttcggctccacacagattcccgaacctgcctggccattaacagttgcgccctgggcaatggcggttgccagcatcattgcgtccagctcacaatcacccgacataggtgtcagtgtagaccaggcttccaactgcaggaggacggaagacactgcgtccgtcgcagcccttgcgcaaaccgcaatggaagctgtatgcatcgttgccaggtggtgcggggtcttgccaggtgtgaatgtcacgtaggatatcagctggcggcagacgggaaagcctgcgaagatgtcgatgagtgcgccgctggcctggcgcagtgtgctcacgggtgtctgaatacacagggcagcttcaagtgcgtgtgtcatgccggttatgagctgggagcagacggaaggcagtgttaccggatcgaaatggagattgtaaacagctgcgaggcgaacaatggtggctgctctcacggatgctcgcatacttctgctggcccactctgtacgtgcccgaggggctacgagttggataccgaccagagaacatgtattgatgtcgacgactgtgcagacagcccatgttgccagcaagtgtgtacaaataacccgggaggttatgaatgcggatgttacgctgggtaccgcctttcagccgacggctgtgggtgtgaggacgttgatgaatgtgcatccagcagagggggatgtgaacatcactgtacgaatctagccggtagtttccagtgcagttgcgaggctggatatcgtctccacgaagacaggcgtggctgctctccattagaagagcccatggtcgatctggatggggagttacccttcgtccggcctttgccacacatcgccgtactccaggacgagctgcctcagctgttccaggacgatgatgtgggagcagacgaggaagaggctgaactgcgtggggagcacaccctcacagagaagttcgtttgcttggatgactctttcggacacgattgctcactgacatgtgatgactgtagaaacggcggaacatgtctgctgggcctggacgggtgtgattgtcctgagggctggaccggcctgatttgcaacgagacatgcccccctgacacctttggcaaaaactgctctttcagttgctcttgtcagaacgggggaacctgcgattccgtgaccggtgcttgtagatgcccgccaggcgttagtggtaccaactgcgaggacgggtgccccaagggttactacggaaaacactgcaggaagaaatgcaactgcgctaatcggggacggtgtcacagattatatggtgcctgcctgtgtgacccaggcctctatgggagattctgtcatctaacatgtcctccttgggcatttggccctgggtgctctgaggagtgccaatgcgtacagccccacactcagtcttgcgataagcgcgatggctcatgctcctgtaaagctggctttcgtggtgagcgatgccaggcagagtgtgaactggggtactttgggcctggctgctggcaggcttgtacttgtcccgtaggtgtggcctgcgactcagtcagcggcgaatgcggcaaacgctgtccagccggattccagggagaggactgtggacaagagtgtccagtcggcaccttcggcgtgaactgtagctcttcttgcagctgcggaggggctccatgtcacggtgtgactggccagtgtcgctgtccgcctggccgtacaggcgaggactgtgaggcagactgtcccgaaggtaggtggggcctgggttgccaagaaatctgtcccgcatgccagcacgcagcccgatgcgatccagagactggggcttgtctgtgtcttccagggttcgtggggtctcgttgtcaggacgtctgccctgccggttggtacggaccaagctgccagactcgctgttcatgcgccaatgacggacactgccacccggctacaggacattgcagttgtgctcccggttggactggtttcagctgtcagcgggcatgtgatacaggccattgggggcctgactgtagtcacccctgcaactgttcggcagggcacgggtcatgtgatgctatttccggcctctgcctctgtgaagccggttacgtaggacccagatgcgaacagcagtgcccacaaggtcacttcggacccggatgcgagcagcggtgccagtgtcagcacggcgctgcctgtgatcacgtgtccggggcatgcacatgcccagcaggctggcgcggaaccttttgtgagcacgcctgtccagcgggtttcttcggcttagattgtcgttcggcatgcaactgtacagccggagccgcttgtgacgcagtcaacggcagctgcctttgtcccgctgggagacggggacctcggtgtgctgaaacatgcccggcacatacatatgggcacaattgctctcaagcatgcgcatgtttcaatggggcatcttgtgatccagtgcacggccagtgccactgcgcccctggatggatgggccctagttgtttgcaggcgtgtcctgcaggcctatatggggataactgccggcacagttgtttgtgccaaaatggcggtacttgcgatccggtgagtggtcactgcgcttgccccgaagggtgggccggtttggcttgtgaaaaggagtgcctacctcgtgacgtccgtgcagggtgccgccacagcggcggttgtctaaatggcggactgtgcgatcctcatactgggagatgtctgtgtcccgctggatggaccggcgataaatgtcagtctccctgtcttaggggatggtttggcgaggcctgcgcacagagatgttcatgcccacccggagcagcatgtcatcacgtgaccggagcctgtcgctgcccccctggcttcacaggctccgggtgtgagcaggcttgcccgcctggctccttcggagaggattgtgcccagatgtgtcaatgcccgggagagaacccggcttgccaccccgcaaccggcacatgctcatgtgctgctggctaccatggacctagttgtcagcagcggtgtccacccggaaggtatggccctgggtgcgagcagctatgtgggtgcctgaatggtgggtcctgcgatgccgctacaggtgcatgccgctgcccgacaggatttctgggaaccgactgcaaccttacgtgtcctcagggcaggtttggccctaactgtacgcatgtgtgcggctgtggccagggcgcagcttgcgacccagtgactgggacttgtctgtgtccccctggtagggccggtgtacgctgcgagcgcggttgcccacaaaacaggtttggcgttgggtgtgaacacacgtgcagctgtcggaatggagggctatgccatgccagtaacggcagctgttcttgcgggttaggttggaccggacgccattgtgagctggcctgccccccaggcagatacggcgcagcttgccatcttgaatgtagctgccacaataattccacatgcgagccagccacaggcacatgtcgttgcgggccaggcttttacgggcaggcctgcgaacacccctgtccgcctggcttccatggcgctggatgtcaggggctgtgttggtgccagcacggcgcaccatgtgatcccatctctggaagatgcttgtgccctgctggattccacggacatttctgcgaacgtggctgcgagccaggctctttcggtgaaggttgccatcagcgttgcgactgcgatggaggtgcaccctgcgatccagtgacaggtctatgcctttgtccaccgggtcgcagtggtgctacctgtaatttagactgtaggcgcggacagttcggaccttcctgtaccctgcattgtgactgcgggggaggagccgattgcgatcctgtgtctggacagtgtcactgcgtggacggctatatggggcctacatgtcgggaaggcggaccactccgcctacctgagaaccccagcctggcacagggctcagccggaacactgcccgcatctagtcgcccaacctctaggagcggaggacctgcccgacactag

SEQ ID NO: 231175 - DNA, 8538 bp, Artificial Sequence
  Description of Artificial Sequence: Synthetic coding sequence
atggccctgggaaaagtgctagcgatggccctcgtgttggcattagctgtgttagggagtctgtcccccggtgccagagcaggtgactgcaagggtcagaggcaggtgcttagagaggccccagggttcgtgacggacggcgctggcaactactccgtgaatggcaattgcgagtggttaatcgaggctccatccccacaacaccgcatcctgctggactttctattcctggatacggagtgcacatacgactatctcttcgtgtatgatggagattctccccgagggccacttctggcatctctttctgggagcacccgacccccacctatagaggcgtcttccggtaagatgttgctgcatctttttagtgacgccaactacaacctcttggggttcaacgctagttttagattctctttatgccccggtgggtgccagtcacacggccagtgccagccccctggagtttgcgcatgcgagcccggatggggtggcccagactgcgggctgcaagagtgcagtgcatactgcgggtcccacggcacgtgtgcctcgcctcttggcccttgtagatgcgagcctgggttcttaggtagagcgtgcgacctgcatctgtgggagaatcaaggagcgggttggtggcacaacgtctcagctcgcgacccggctttcagcgctcgaatcggtgcagctggggcattcctgtctcccccaggactccttgcagtgtttgggggacaagatctcaacaacgcattgggagaccttgtgctttataacttctccgcgaacacatgggaatcgtgggacttgagcccagcgcctgctgcaaggcactctcacgtagctgttgcttgggcgggatctcttgtcctgatgggcggagaactagccgacggctccctcaccaatgatgtttgggctttttcccccttgggccgtgggcactgggagctcctagctccacctgcaagcagcagttcaggcccacccggacttgccggacatgccgctgctctcgtggatgatgtgtggctgtatgtgagcggcggaagaacccctcatgacctgttctcctccggcctattccgttttcgcctggactcaacgtccggcggatactgggagcaagtcatccctgcaggtggcaggccgccagccgctaccggacattcaatggtttttcacgctccgtcaagagcactgctcgtccatggtgggcaccggccttcaactgccagattttctgtgcgagtgaattccaccgagctgttccatgtggatcgtcatgtctggactactcttaagggcagagatggtttgcaaggcccaagagagcgtgcgttccacacagcttctgtcctgggaaattacatggtcgtgtatggtggcaatgtgcatacccactatcaggaagagaagtgctatgaggatggcattttcttctatcacctgggttgtcaccagtgggtatcaggggcagaactcgctccccctggcacccccgaaggacgcgctgccccaccaagtggcagatacagccacgtggcagcggtactagggggaagcgtcctcttggttgctggtggatactctgggcgtccaaggggcgacctgatggcttataaagtgcctccctttgtgtttcaagcccctgctccagattatcatctggactactgcagtatgtataccgaccacagtgtgtgttccagggatccagagtgctcttggtgtcagggagcttgtcaggccgcacctcccccaggcacaccgttgggggcttgccctgctgcttcctgcctaggtctgggcagacttctaggagattgccaggcctgtctcgcattctcctctccgaccgccccacctcgtgggcctggaaccttaggctggtgcgtacacaacgaatcatgcttgcctaggccggaacaggcccgatgtcgtggggagcagatctccggaacagtcggctggtggggcccagcaccagtgtttgtaacctccttggaggcttgtgtgacccagagcttccttccagggctgcaccttcttacatttcaacagccacctaatacctctcagccagacaaggtttctatcgttcgctcaacaacgatcaccctgacccctagcgccgagacagacgtgtctttggtgtacagaggtttcatttaccctatgctcccaggaggccctggaggccctggcgcagaggatgttgctgtctggactcgggcacaacgcttgcacgtgcttgcaagaatggccagagggccagatactgagaacatggaagaagtaggacgctgggtagcccaccaggagaaagaaactcgcagattgcaacgccctgggagtgccaggctgttccccttacccggaagagatcacaagtacgcagtcgagatccaggggcagttgaatggctccgccggtcccggacatagcgagttgaccctattatgggatagaacaggagttcctgggggatcagagattagtttcttttttcttgaaccttatcgtagtagctcttgcacttcttactcctcctgcctcgggtgccttgcagaccagggatgcggctggtgtttaacctccgccacttgtcatctgaggcaaggaggcgcacactgcggtgacgacggagctggcggatcattgcttgttttggtgccaaccctttgtccactatgtgaagagcatcgcgactgccacgcctgtacacaggaccccttttgcgaatggcaccagtctacatcacgcaaaggagacgcagcttgctcaagaaggggcagggggcgtggagcacttaagagtcccgaggaatgcccccctctgtgcagccagcgattgacctgcgaggattgtctcgccaactcatcccagtgcgcatggtgtcagtccacccatacttgcttcctgtttgccgcttacctcgcccgttatccccacggtggctgccgaggatgggacgattccgtgcattccgagccgaggtgcaggagttgtgacggttttctcacctgtcatgagtgtctgcaatcccatgagtgtggctggtgcggcaatgaggataaccccactttgggaaggtgtcttcagggggacttttcaggcccactgggtggcggtaactgttcgttatgggtaggggagggactcgggctgcccgtcgccctgcccgctcgatgggcctatgccagatgtccggacgtggatgagtgcaggttgggactggccagatgtcaccccagagctacatgccttaacacgcccctgtcatatgaatgtcactgtcagagaggataccagggcgatgggatttcacactgtaataggacatgcctcgaagattgcgggcacggagtgtgtagcggaccccctgattttacttgtgtgtgtgatctgggttggacatcagatttaccccctcctacgcctgctccgggaccccctgcgcctagatgttctcgggattgcgggtgctcattccactcccattgccgcaagagaggcccaggcttttgtgatgagtgccaagactggacctggggggagcactgcgagcgctgtagacctggttcattcgggaacgccacaggttcacgcggttgtagaccgtgccaatgtaatggccacggtgaccctaggcggggacactgtgacaatctatcaggtttgtgcttctgtcaggatcatacagagggcgctcattgccagctgtgttccccaggttattatggggatcctagagccggtggctcctgtttcagagagtgtggcggtagggcactcttgaccaacgtcagctccgttgccctggggagcaggcgggtggggggtctgttgccacctggtggaggtgctgcccgagcaggccctgggttatcctactgtgtatgggtggtgtccgccactgaggaactgcagccatgtgcccctgggacattgtgccctccactaaccctgacattttcccccgactcctccactccgtgtacgcttagctatgtattggcattcgacggttttcccagatttttggacacgggggtggtccaaagcgatcgtagtctgatcgctgccttctgcggccagcgccgagatagaccactgactgtgcaagcgctgtccggcctgcttgtactgcactgggaggcaaacgggagctcctcctggggattcaatgctagcgtcgggtcagcgcgttgcgggagtgggggacccggttcttgccctgttcctcaggagtgtgtgcctcaggacggagccgcaggcgctggattgtgtcggtgcccacagggttgggctggaccccattgccgcatggccctctgcccggagaattgtaacgctcacactggcgcagggacctgtaatcagtcactgggcgtctgcatttgcgctgagggcttcggaggcccagattgcgccaccaagcttgacgggggacagctggtctgggagacactcatggactctagattgagcgccgatacagcgtccagattcctccatcgtctggggcacactatggtcgatgggccagacgcgaccctctggatgtttggtggcttggggctgccacagggactgctgggcaacctctacaggtacagcgtctctgaaagacgatggactcagatgctagctggagctgaagatggaggtccaggaccgtcaccaagaagcttccacgccgctgcctatgtgccggctggacggggagcaatgtacctgctcggcggtctgacagccggaggggtgactcgggatttttgggtattgaacctcactaccctacagtggagacaggaaaaggcacctcagacggtggagcttcccgctgtggcgggtcacacactcacagctaggagaggcctgtcacttctgctggtcggcggttattcaccggagaacggttttaatcagcagctgctggaatatcaattggccaccggtacctgggtttctggagctcagtcaggcacccctccaacaggcctttatggtcacagcgccgtgtatcatgaagctacggactcactatacgtttttgggggatttaggttccatgtcgagcttgctgcaccctctccagaactgtattcactgcattgtccagatagaacctggtcactactagctccaagccagggggcaaagcgtgaccgcatgagaaatgtgcggggatctagtcgtggtttgggacaggttccaggagaacagccaggcagctggggcttccgcgaggtgcggaagaagatggctctctgggctgcactcgccggtacaggcggattcttggaggagatctctccgcaccttaaggaacctaggcccaggctgttccatgcttcagctttgctgggcgacaccatggtcgtgctggggggaagaagtgacccggacgaattctcgtctgacgtgttgctttatcaggtgaactgtaatgcgtggctcctgcctgatctgactcgtagcgcgagcgttgggcctcccatggaagaatcagtggctcacgccgtggctgccgtgggttctcggttgtacatctcaggaggttttggcggtgtggcattgggccgactgttggcgttgacactgcctcctgacccttgtagactgctttcatctcccgaagcttgtaaccagtctggtgcatgcacttggtgccacggtgcttgcctgtccggcgaccaagctcatcggctggggtgcggcggatcaccatgctctcctatgccaagaagccctgaagaatgccggaggctgagaacgtgctcagaatgcctggcacgtcatccaagaacactacagcccggtgacggcgaagccagcacccctcggtgcaagtggtgtacaaattgccctgagggtgcatgcatcgggaggaacggaagttgtacttccgagaatgactgcaggataaaccaacgggaggttttctgggccggaaactgcagtgaagctgcatgtggggcagccgactgtgagcagtgtacgagagaaggcaagtgtatgtggaccaggcaattcaagaggacgggcgagacccggagaatcctgtctgtccagcctacctacgattggacgtgtttctctcattctctgctgaacgtgtcccctatgccggttgagagcagccccccactcccgtgtcccaccccctgccacttgctgccgaattgcacatcttgcctggattccaaaggagccgacgggggttggcaacactgtgtttggagtagctccctgcagcaatgcctcagcccttcatatctgcctctaagatgcatggcgggaggatgcggcaggttactgcgcggaccagaatcctgcagtctgggctgcgcacaggccactcaatgtgctctgtgcctgagacggcctcattgtggctggtgtgcttggggaggacaggatggcggaggcaggtgcatggaaggagggttgtctggaccccgagatgggctgacctgcggtcgccctggagccagctgggcctttctctcctgccctcccgaggatgagtgtgcaaacggccaccacgactgcaatgaaacgcagaactgccatgatcagccacatggctacgagtgctcctgtaaaaccggctacacgatggacaatatgaccggattgtgccgccctgtgtgcgctcagggctgtgtcaacgggagctgcgtcgagccagaccattgtcgatgtcactttggctttgtgggcaggaactgtagtacagaatgcagatgtaatcgccacagcgagtgtgccggagtgggcgcaagagaccactgcctgctgtgtagaaatcacactaaaggaagccactgtgagcagtgtctgccactgttcgtgggcagtgcagtgggcggaggaacctgccgtccttgtcatgcattctgccggggaaattcccacatttgtatcagtcgaaaagaattgcaaatgagcaaaggcgagcctaagaaatacagcctggacccagaggaaatcgagaactgggttacggaagggccttcggaggacgaggcagtgtgtgtgaactgtcagaacaacagctacggtgagaaatgcgaatcatgcttacaaggatattttcttttggacggtaagtgtacaaaatgccaatgtaacgggcacgcagacacatgtaacgaacaagacggaacaggctgcccatgtcaaaataacacagaaactgggacctgccagggtagctcccctagcgatagacgtgactgctacaagtaccagtgtgccaagtgcagggaaagcttccacggttcaccacttggagggcagcagtgctataggttaatttcggtagagcaagaatgttgcctggatcctacctcccaaaccaattgcttccacgagcctaaacggagggcactcggcccaggaaggacagtgctgttcggagtccaaccaaagttcaccaatgtggacatcagactgacactggatgtgacgtttggagccgtggacttatacgtgtctacctcttacgacacctttgtggtgcgcgtggcgccagacacaggcgtgcatacagtgcacattcagccgcctcctgcccctccaccccctccaccccctgcagacggtggtcccagaggggctggcgatcctgggggagctggagcctcctctggccctggcgcaccagccgagcccagggttagggaagtgtggcctagaggacttatcacttatgtgaccgtgaccgaaccgtcggcggtgcttgttgtccggggtgtgcgagatcggctggtcatcacatacccccatgagcaccacgctctaaagagctcacgattctatctgctgttgctgggggttggagacccttctggcccaggagcaaacggctctgctgatagccagggactgctgttctttagacaggaccaagcgcatatcgatctttttgtcttcttctcagtcttcttctcatgctttttcctgtttttgtccttgtgcgttctcctatggaaggctaagcaggcactggaccaacggcaggagcagcgcagacacctccaggaaatgaccaagatggctagcaggccctttgctaaggtgaccgtatgctttccacctgatccgaccgcccctgcgagtgcctggaagcccgcaggactcccacctccagcctttcggagaagcgaacctttcttggctcctttacttctgacgggagctggtggcccttggggacccatgggtggtggctgctgcccgcctgcaatccccgcaacaactgccggattacgggcaggcccaatcacccttgagccaaccgaggatggtatggccggtgtagcgacccttcttctgcagctgcccggaggtccacatgccccaaatggagcctgtttgggctcagccttagtgacactcaggcacagattacatgagtactgcggcggtggagggggagcaggaggatctggacatgggaccggcgctgggcgaaagggactgttaagccaggacaatctgacctccatgagtctgtas

SEQ ID NO: 231176 - DNA, 8336 bp, Artificial Sequence
  Description of Artificial Sequence: Synthetic coding sequence
atggcccttggcaaggtcctggctatggcactcgtcttggcgctggccgtactggggtctctgagccctggggcaagagccggagattgcaaaggccaaaggcaagtcctgagggaggcccctggcttcgtaactgatggagcaggcaactacagtgttaatggaaattgcgaatggctgatcgaggccccttccccccagcacaggattcttctagacttcctctttcttgacacagagtgcacgtatgactatctattcgtatatgatggggactcaccgcgaggccctttgctggctagcctgagtggatcaacccggccaccgccaattgaagctagctcagggaagatgctattgcacctgttttctgacgctaactataacctgctgggattcaacgcgtccttcaggttttccttgtgtccgggaggctgtcagagtcacgggcaatgtcagcccccaggcgtctgcgcatgcgaacctgggtggggcggtcctgactgcggcctccaagagtgctcagcatattgcggcagccacggcacctgcgcttcacccctgggtccatgtagatgcgagccaggctttttgggaagagcctgcgatctccacctatgggaaaatcaaggggcaggttggtggcataacgtgtccgcgagggacccagcattttcagccagaatcggagccgcaggcgcatttctttcacccccaggccttcttgccgtatttggcggacaggacttgaacaatgccctgggtgatctggtcctgtacaatttttcagctaacacttgggaatcttgggatctgtcacccgcaccggctgccaggcactcccacgtggccgtggcctgggcaggatctctggtattgatgggcggagagctggcagatggatctctgacgaatgatgtttgggcattcagcccactgggtaggggacactgggagctacttgcccctcccgcatctagctcctctggacctcctgggctcgcgggtcacgcagctgcccttgtcgacgacgtctggctctatgttagtgggggaagaacacctcatgatttatttagtagcgggttattcaggttccgacttgatagtaccagcggcggatattgggagcaagtgatcccagccggaggcaggccccctgccgcaaccggtcactccatggtatttcatgccccatctcgggctctgcttgtgcatgggggacacagaccttcgaccgcccgtttctctgtccgggtgaattcgactgaattgtttcacgtggataggcatgtgtggacaacattaaagggccgagacggcttacagggaccacgagagcgagctttccataccgcctcagtgctcgggaactatatggtcgtctatggagggaacgtccatacacattaccaggaggaaaagtgctatgaagacgggatcttcttttatcaccttgggtgtcatcagtgggtatctggagccgagcttgctccccctgggacccccgaggggagagccgctccccctagcgggaggtattcccatgtcgccgcagttttgggtggatcagtgctgcttgttgcgggtgggtatagcggaagacctcgcggagacctcatggcttataaggtgccacccttcgtgttccaggcaccagctcctgactaccatcttgactactgttcaatgtatactgatcactctgtctgctctcgagatcccgagtgtagctggtgccaaggagcttgccaggctgccccaccccctggaacccctctaggtgcatgccctgccgctagctgtttgggcctgggacgattgcttggcgactgccaggcctgtctggctttttcatcccccaccgctcccccaaggggacctggaacactgggctggtgtgtgcataacgaatcctgcctgccccgtccggagcaggccagatgccgcggagagcagatctccggaaccgtgggctggtggggccctgctcccgtttttgtaaccagcctagaagcttgcgtgactcagagtttcctgcccggtctgcaccttctaactttccagcagcctcccaacacgagccagccagacaaagaggaagtgggaaggtgggttgctcatcaggagaaggaaacacggaggttgcagcgcccaggtagcgcccgtctattccctctgcccggaagggaccataagtacgctgttgaaattcaggggcagctcaacgggagtgccggaccaggtcacagtgagctgaccttgctgtgggatcgaaccggtgttccgggaggatctgagatttccttcttcttcctagaaccttataggagcagctcttgcacatcatactcttcttgtctgggatgtctcgcagaccaggggtgtggttggtgcctcacctccgcgacatgccacttgcgccaggggggagcacactgcggtgatgatggtgcagggggaagtctcctcgtgttagtcccgacactatgccccctgtgcgaggagcaccgtgattgccacgcttgtacacaagaccccttttgcgaatggcatcaaagtacctcccgcaaaggcgacgctgcctgtagtaggcggggtcgcggacggggagctctcaagtctcctgaagagtgccctccgctgtgttctcaaagactcacctgcgaggactgtctagccaactcctcacaatgtgcttggtgccagagcacccatacctgcttcctgtttgccgcttatcttgccagatatccacacggtggttgtcgaggatgggacgactctgtgcactccgagccgaggtgcaggtcatgcgacggatttctgacttgtcacgagtgcctgcagtcacacgaatgtgggtggtgtggtaacgaggacaatccgactctcggtagatgcctacagggtgatttcagtgggcctcttggaggcggtaattgctctttatgggtcggggagggtctgggcctgccggtggcgctgcccgctcgttgggcatatgcgcgttgccctgacgtggatgagtgtagactgggattggcacggtgccacccgcgagccacctgtctcaacacaccccttagctacgagtgtcactgtcagcgtggatatcagggcgatggtatctctcattgcaataggacctgcctggaggactgtgggcacggcgtttgcagcgggccacccgacttcacttgcgtgtgtgatcttggatggacctcagacctccctcccccaactccagcacccggaccacctgctcctcgttgtagcagagattgcggctgcagcttccatagtcactgtaggaagagagggcctggcttctgcgacgagtgtcaggactggacctggggggagcactgcgagcgctgcagaccaggctctttcggtaatgctactggctctcggggatgccggccatgtcagtgcaatggccacggagatcctagacgcggacattgtgataacttgtccggactctgcttctgtcaggaccacaccgagggggctcactgccagctctgcagtccaggctattacggcgatccacgggctggaggctcttgctttagagagtgcggaggcagagcccttctgaccaacgtttcatccgtggcacttgggtcaagaagggtgggcggattacttccacctggagggggtgccgctcgcgctgggccaggtctcagctactgcgtttgggtagtctcggccaccgaagagctgcagccatgcgcccctggcacgctgtgcccaccactcacccttacattttccccagatagcagtaccccgtgtacactgtcctacgtcctcgcctttgacggattcccaagattcctggacaccggcgtggtgcaatctgaccgcagcttaatcgctgccttttgcggccagaggagagaccgccctctaacagtgcaggcccttagtggactgttggtcctccactgggaggccaatgggtcctctagctggggctttaacgcaagcgtgggaagcgcacggtgtggtagcggcggacctgggagctgccccgtgccacaagaatgcgtgcctcaggacggagccgctggggctggcctgtgccgctgtcctcaagggtgggcaggaccacactgtaggatggctctctgtcctgaaaactgtaacgcacacaccggggcaggaacctgtaaccagagcttgggcgtatgcatctgtgcagagggtttcgggggtccagattgcgcaacgaagttagacggtggccagctcgtgtgggaaacactgatggatagcagactcagcgccgacacggcttcgcggtttctgcaccgcctggggcatacaatggtggacggacctgatgctacactttggatgttcgggggactgggcttgccgcagggcctgctggggaatctgtatcgatactcagtgtcagagaggagatggacccaaatgctcgcaggagccgaggacggcggtccgggacctagcccccgatctttccatgcagccgcttatgtgccggctgggaggggagctatgtacttgttgggcggattaaccgctggcggtgtcacaagagacttctgggtgctcaatctgaccacactacagtggcggcaagagaaagcaccccagactgttgagctgcccgctgttgcaggacatactttgaccgcccgaagaggactttcgcttctacttgttggtggttattcacctgagaacggattcaatcagcagctgctcgagtaccagttagctactggcacatgggtgagtggcgctcagtcaggaactcctccaaccgggctgtacggccactccgccgtctatcacgaggctactgatagcctttatgtgttcgggggattccgctttcacgtcgaactcgctgcacccagtcccgaactgtactcccttcattgccccgaccgaacttggagtctgttggcaccgtcgcagggggctaaacgagacagaatgaggaatgtgcggggatcctccagaggcctgggccaggtaccaggggagcagcccggaagttgggggttccgggaagttaggaagaaaatggccctatgggctgcactagccggaactggcggatttttggaggagatatcgccgcatctgaaggaacctcgccctcgcctgttccatgcttctgcactattaggagacacaatggtcgttcttggaggtcgaagcgacccagacgagttctcgtctgatgtcttgctttatcaggtcaattgtaacgcttggctgttgcctgacctgaccaggagcgcatccgtcggacctcctatggaggaatccgtggcccacgccgtcgctgccgtcggcagcaggctctatatctctgggggttttggtggagtggctctcggccgtctgttggccttgacacttcccccagacccgtgccggctcctgtcttcccccgaagcttgtaaccagtctggtgcctgcacctggtgccacggagcctgccttagcggcgaccaagcacacagacttggttgcggtgggagcccatgttccccaatgcctcgctcacccgaagagtgtaggcggctaaggacctgtagtgaatgcctggcacggcaccctcgaaccctgcaacccggagacggcgaggcgtctacgccgcgatgcaagtggtgtactaactgtcccgagggagcgtgtataggcaggaacggctcttgcactagcgaaaacgactgcagaatcaatcagcgggaagtattttgggcgggtaattgcagcgaggctgcttgcggtgccgctgattgcgaacagtgtaccagagaagggaaatgtatgtggacccgtcaattcaagcgcaccggagagacgcgtaggattctaagcgtgcaacccacatatgactggacatgcttttctcattcactactcaatgtgtctcccatgcccgttgagagttccccccctctaccttgcccaaccccatgccatctgctacctaactgtacatcgtgtttggacagcaagggggctgacggcggatggcagcattgcgtgtggagctcctccctgcagcagtgtctcagtccatcttatttgcccttgcgatgtatggccggaggatgtggccgactgctgcgcggacctgagagttgctcccttggatgcgcccaggctactcagtgcgcgctgtgcttgcgtcgaccacattgcgggtggtgtgcttggggtggacaggacggtggcggtagatgcatggaggggggactctccggcccacgggatggacttacatgcgggagacccggagcgagctgggcttttctgagttgccctcctgaggacgaatgcgccaatggccaccacgattgtaatgagacgcagaattgccatgaccagccacacggatacgagtgttcttgtaaaactggctataccatggataacatgactggtttgtgcagacccgtgtgcgcccagggctgtgttaacggcagctgtgtcgagccagaccattgcagatgtcacttcggctttgtgggcaggaactgttccaccgagtgcaggtgtaatcgacacagcgagtgtgccggagttggggcaagggatcattgtctgctgtgccggaaccataccaaaggaagtcattgcgagcagtgtctccccctgtttgttggatcagccgtgggcggtggtacttgcaggccctgccacgccttctgccggggaaatagccatatctgtatcagccgaaaagaactgcagatgagtaaaggcgaacccaaaaagtacagcctcgaccctgaggaaatagagaactgggtgactgaaggaccgtctgaagatgaagcagtgtgcgtcaattgccagaacaacagttacggagagaaatgcgaatcatgcttacaaggttactttctgcttgacggaaagtgcaccaaatgtcagtgtaatggacacgctgacacgtgtaatgaacaggatggtactggttgtccctgccaaaataacacagagactggcacctgccagggctccagtccctcagacagacgcgactgttacaagtaccaatgtgcgaagtgcagagagagcttccacggctcaccactgggaggccagcagtgttaccggctgataagcgtcgagcaggaatgttgcctggaccccacaagccaaaccaactgttttcatgaacccaaacgcagggcactcggtccaggacggactgtgctgttcggtgtccaacccaaattcaccaatgtggatatcagacttaccctcgatgtgacgtttggggcagtagacctgtatgtatcgacgtcctacgacactttcgtcgtccgcgtggccccagacaccggcgttcacaccgtccacatccagccgcctccagccccacctccccctcctcccccagcagacggagggccaagaggtgctggggatccagggggtgcaggggcatcttctggcccaggggcacccgctgagcccagagtgagagaggtgtggccacggggactgatcacctatgtgacagtcacagaaccatctgccgtgttggttgtgaggggtgtccgggataggctggtcatcacctacccgcacgagcaccacgcgctcaagagttcccgattctatcttctactgctgggagtcggagaccctagtggacccggtgccaacggttccgccgactctcagggactacttttcttccgccaggatcaggctcacatcgatctctttgtcttttttagtgtgttcttttcctgcttctttctcttcctgtccttatgcgtccttctatggaaagccaagcaggccctggaccagcggcaagaacagcgaagacacctgcaggagatgaccaagatggcctcccgtccctttgccaaggtgactgtgtgttttccacccgacccaaccgcgccagcatccgcctggaagccagccggtctcccaccaccagctttccgcagatccgaaccatttctagcacccctccttttaaccggggctggcggaccgtggggccctatgggtggcggttgctgtcctcccgcaatccccgctaccactgccggactgcgggcagggcctattacattggagcccacagaggacgggatggcaggagtggccacattgctactgcagctccccggtggcccacatgcccctaatggtgcctgcctcggcagtgcgttagtcacgctccgacacaggttacacgagtactgcggcggtggcggtggggctggaggaagcggtcatgggacaggcgctggccgaaagggcttgcttagccaggacaatctgacatctatgtccctcta

SEQ ID NO: 231177 - DNA, 1320 bp, Artificial Sequence
  Description of Artificial Sequence: Synthetic coding sequence
atgagggagctgccagctggtctcctccccccaggaagggaggtgcatcagtgcgcaaaatgcagggagagtttccacggatcacccctgggcggtcagcagtgctaccgattaatatcagtcgagcaggaatgttgtctggacccaacatcgcaaaccaactgcttccatgagcccaaacgtagggccctcggccctgggaggacagtgctgttcggggtccagcccaaatttacgaatgtggatatcagactgacgctggatgtcacctttggtgctgtggacctgtacgtgtcaacctcctacgacaccttcgtggtaagagtcgcgccagataccggcgtccacacggtgcatattcaacctcctcccgctccaccacccccaccccctcctgcagacggaggcccacgcggagccggagatccagggggagctggcgctagcagcggtccgggtgctcccgctgaaccaagggtgcgcgaggtgtggcccagaggcctgatcacatatgtgaccgtcaccgagccatcggcagtcttagtggtcaggggagtacgtgaccggctcgtcattacctacccacatgaacatcacgcccttaaaagctctaggttctatctccttctcctgggcgtcggggacccctccgggccaggagccaatggcagcgctgactcccaaggattgctgttctttcgccaggaccaagcccacattgacctgttcgtgttttttagtgtattcttcagttgctttttcttgttcctgagtctgtgtgtgctcctctggaaagccaaacaggccttggaccagagacaggagcagcggagacatctgcaagagatgacgaagatggcgtctcgtccgttcgccaaggtgactgtctgctttcccccagatcctaccgccccagcatccgcctggaaacccgcaggattgccccctcccgcttttcgtcggagcgaacctttccttgcacccctgctccttacgggcgctggcggtccctgggggcctatgggcggaggctgttgtccccctgcaatccctgcaactactgcaggtctgcgagccggaccaatcacccttgagccgaccgaggacgggatggcaggtgttgcgaccctgctgctacagctgccagggggaccccatgccccaaatggggcttgccttggcagcgctctcgtgacactccggcaccgcctgcacgagtactgtggcggaggtggaggggctggaggatcagggcatggtacaggcgctggacgcaagggattgctgagtcaagataatctgacaagtatgtcgctctag

SEQ ID NO: 231178 - DNA, 1809 bp, Artificial Sequence
  Description of Artificial Sequence: Synthetic coding sequence
atgaacggtggggctgaacgcgctatgagaagtttaccttctctgggaggcctagccctactatgctgcgccgctgccgcagcagccgctgccgtggcttccgcagcaagcgctggtaacgtaacaggtggcggaggcgcagcaggacaggttgacgccagtccagggccaggactgcgcggagaaccttctcatcccttcccccgagcaacagccccaactgctcaggccccaaggactgggccacccagggccacggtgcacagacctttggccgcaacttccccagctcagtcccccgagacaactccactgtgggccaccgctggtccctcaagtacaacattccaggctcccctgggcccaagtccaaccactcccccagcagctgaaagaacctctaccactagccaggccccaacaaggccggctcccacgacgctctctacaacgaccggacccgcaccgaccactccggttgcgaccacagttccagcaccaacaacgcctcgtaccccaacccccgatcttccaagctccagcaatagcagtgtgctgccgacaccaccggctaccgaggcaccctcttcaccaccccctgagtacgtgtgcaattgcagcgtggtgggtagccttaacgtaaatcgctgcaaccagaccactggtcagtgcgaatgccgcccaggataccaggggctgcattgtgagacttgcaaagagggcttttacctcaactatacatcaggcttgtgtcagccatgtgactgtagccctcatggagccctgagtattccctgcaactcatccggaaagtgccaatgcaaggtgggcgtcatcggatccatttgcgatagatgccaggatggatattatggattttccaaaaacggctgtctgccctgccagtgcaataatcggtctgcctcatgcgatgctttgaccggtgcctgcctgaattgccaagaaaattctaaaggcaaccactgtgaggaatgtaaagaggggttttatcagagtcccgacgccactaaggaatgcctgagatgtccatgttcagccgtgacatcgacaggttcgtgctctattaagagctctgaactggagcccgagtgcgatcagtgtaaggatgggtacatcggacccaactgtaataaatgcgaaaatggctactacaattttgattccatctgtagaaagtgtcagtgccatggacacgtggacccagtgaagacaccaaaaatctgtaagcccgaatccggagaatgtataaattgcttacataacactactggattctggtgcgagaattgtcttgagggttacgttcacgacttggaagggaactgtatcaagaaagaagtcatcctgccaacacctgagggcagcaccatcttagtgagcaacgcgagtcttacaacgtccgtcccgacacctgtgatcaacagtacattcaccccaaccacactccaaaccattttcagtgtgtcaacgtctgagaattcaacatcagctctggccgacgtctcatggacacagtttaacatcatcatcttaactgttataatcatcgtggtggtcctactcatgggttttgtgggtgccgtgtatatgtacagagagtaccaaaaccggaagctgaatgctcctttttggacaattgagctcaaagaggataacatctcattcagctcatatcatgattccattccaaacgctgacgtctccgggctgctagaagacgatggtaatgaggtggctcccaatggtcaactcacactgaccactcccatccataattataaggcctag

SEQ ID NO: 231179 - DNA, 1920 bp, Artificial Sequence
  Description of Artificial Sequence: Synthetic coding sequence
atgagatcgcttccctcattgggaggtcttgcattactttgctgcgcagcggctgccgcagccgcagctgtggcctcagctgcctctgccggaaatgtgaccggcggtgggggagccgctggtcaggttgacgcaagtccaggacctggcctgcgcggagagccaagtcacccttttccgcgtgcaacagccccaaccgcccaagctccgaggaccggcccaccaagagccacagtccatcgaccactggctgccacaagtccggctcaatcccctgagaccactcccctctgggctaccgccggtcccagcagcactaccttccaggctccactgggcccttccccaacaaccccaccagctgcggaaagaacatctacaacctcgcaggcacccacacgtccggcaccaacaaccctgtctactaccacagggccagcgccaactactcccgtggcaacaaccgtccctgcacctacaactccccgaacccctactcctgatctgccatcgagttccaatagcagtgtgttaccaacacccccagcaacagaagccccttcaagtcccccacccggacaccagtggcccgtggctaaaatgccgcagaaatatctgggtaagtacgcatgcgagtctaatctgaagtcaaaatacttgcctttaacccagcctgtaatgaacctacgagtgagcgaagccgtcaagaccgagtacgtgtgcaactgcagcgtcgtcggctctctcaacgtaaaccgttgcaatcaaacaacggggcaatgtgaatgcaggccgggataccagggtctgcattgcgagacctgcaaggaagggttctatttgaactacacaagcggtctttgtcagccctgcgactgctccccacatggcgcactgtctatcccttgcaactctagcggtaaatgtcagtgcaaggttggtgttattggatccatatgtgaccgctgtcaggacggttattacggcttctctaaaaatggatgcctcccgtgtcagtgcaacaatcggtcagcgagctgcgacgcactgacaggggcatgtctgaattgccaagaaaattccaaggggaaccactgtgaggagtgtaaggaaggattctaccagtctcctgatgctacaaaagaatgcctgcggtgtccgtgttcagccgtgactagcacaggctcctgcagtataaaatccagcgaactggagcctgaatgcgatcaatgtaaggatggttacattggacccaattgcaataagtgcgaaaatgggtactataactttgactccatatgccgtaagtgccagtgccatggccacgtggatccagtaaagactcctaagatctgcaagcctgagagtggcgagtgtataaattgtctgcacaatacaactggattttggtgtgaaaactgtttggaaggttatgtgcatgatctagaaggtaattgcatcaaaaaagaggtgattctccccacaccggagggcagtacaatactcgtgagcaacgcgagtttgactacgagcgtgcctactccagtcatcaattcaacattcactcccaccacactgcagactatattctccgtgtctacatcggagaacagtactagcgcccttgccgacgtctcttggacacagttcaatattattatccttaccgtcatcatcatcgtggtggtgctcctcatggggttcgtgggggcagtctacatgtaccgggaatatcagaacaggaagttgaacgcaccgttttggactatagaattgaaagaggataacattagcttcagctcttatcacgactcgatcccgaatgccgatgtttctggtcttctggaggatgacggcaatgaggtcgcaccaaatggccaactgacactcactaccccaattcacaactacaaagcctag

SEQ ID NO: 231180 - DNA, 939 bp, Artificial Sequence
  Description of Artificial Sequence: Synthetic coding sequence
atgctgcgggcaccagggtgcctcctgagaacaagcgttgccccagctgccgcactggcagccgcactgctgtccagtctagccagatgctcccttctggagccacgcgatcctgtcgcttcttccctgagtccttattttgggacaaaaacccgatatgaagacgtgaacccggtgctgctgtcaggtcctgaggccccatggcgcgatcccgagttgctggagggcacctgcacccctgtgcagctggtcgccctgattcgacacgggacccggtatcccacggtcaagcagataaggaagctgcgtcagctccacggccttctccaggcacgtggatctagggatggcggagcaagctccacgggaagtagagacctaggagctgcgctagccgattggcctttgtggtacgctgactggatggatggccagcttgtggaaaaggggaggcaggacatgagacagctggcactccgtcttgccagcctgttcccagcactcttcagccgcgagaactatggaaggctgcgacttatcaccagtagtaaacacagatgcatggactcctcagcggcttttctgcaggggttgtggcagcattaccatcctggcttacctcctcctgacgttgcggacatggagttcgggccacccacagtcaatgataagcttatgagattcttcgatcactgcgagaagtttctcactgaagtggagaagaatgccaccgccctgtatcacgtggaggcattcaagaccggcccagaaatgcagaatatcctcaagaaggtcgctgcaaccctgcaagttcccgtgaacgacctgaatgcgggactgagccagtttttgcttcagtcttccagcagtctcgtcatgcaaaggcttttcttccactgttttctaagttgggctactagtaagactcgaaacccctag

SEQ ID NO: 231181 - DNA, 1464 bp, Artificial Sequence
  Description of Artificial Sequence: Synthetic coding sequence
atgctgcgggcacccggttgtctactcagaacgtcggtagcccctgctgccgcactcgcagccgcactcctgagctcacttgcccgatgttctttgctggaaccccgagatccagtggctagcagtttgagtccttatttcgggactaagactcgttacgaagatgtgaatccggtcctgttgtccggccctgaggccccttggcgcgaccccgaacttctggaggggacttgcactccggttcaattggttgcattgatccgtcatggcacgcggtatccaaccgtcaaacaaatccgcaagctgcggcaattgcacgggttactgcaggcccgtggctccagggacggtggggcttccagcaccggaagtagggacctaggggcagctctggcagactggcctctgtggtacgcagattggatggacggacagttagtggagaaaggtagacaggacatgcgccagctggcccttaggctggctagcctatttcctgcgctgttctcaagggaaaactatggcaggctgcgcctgatcacctcatccaagcaccgatgcatggactcaagcgcagcgttcctgcaggggctctggcaacattaccatcctgggctgccaccacccgatgtcgcagacatggaattcggaccacccacggtcaacgataaactgatgcggtttttcgatcattgtgagaagtttctgacggaggtggagaagaacgccacagccctgtaccacgtggaggccttcaagaccgggcctgaaatgcagaatattctgaagaaggtcgctgcaacattgcaagtacccgtcaatgatcttaacgctgatctgattcaagtggcattctttacctgttcgttcgatctggcgataaaaggagtcaagtctccttggtgcgacgtgttcgacatcgacgacgccaaagtattggagtatttgaacgaccttaagcagtactggaagcgaggatacggatacaccattaatagtaggtcctcctgtactctgtttcaagatattttccagcatctcgataaggctgtcgaacaaaaacagagaagccaaccaatctcatcacctgtgattctccagtttggacatgctgagacactgctgccactgctctcccttatgggctactttaaagataaggaacccctgactgcttacaactataaaaaacagatgcaccggaagtttcgtagcgggcttattgtgccctatgcatccaatttaatctttgtcttgtatcattgcgagaacgcgaagacacctaaggagcagttcagagtacaaatgctgcttaatgaaaaggtactgcctctcgcctactcccaagagaccgtgagtttttacgaggacctgaagaatcattacaaagatatcttacaaagttgccaaacctctgaggagtgcgaactcgcacgcgcaaactctacatctgatgagctgtag

SEQ ID NO: 231182 - DNA, 861 bp, Artificial Sequence
  Description of Artificial Sequence: Synthetic coding sequence
atgtgcctctttcagttgtgtggccttgtgagatacatggagtttgggcctcctacagtcaatgataaattaatgcggttttttgaccactgcgagaagtttctgacagaagttgagaaaaatgcgactgccttgtatcacgtggaagcatttaagacgggcccagagatgcagaatatactcaaaaaagtcgctgctacactgcaggtccctgtgaacgacctcaacgcagacctcattcaggtagcatttttcacctgttcctttgacctggccatcaaaggggtcaaaagcccctggtgtgatgtgttcgatatcgacgatgcgaaagttctggaatacctgaacgacctgaagcagtactggaaacgcggatacggctacaccattaattctcgatctagctgcacgctgttccaagatatctttcaacacctggacaaagccgtggagcagaaacagagaagccagcccatttcctctccagtgattctgcagttcggacatgctgaaacactgctcccactcctttcactcatgggatactttaaagacaaagaaccactgactgcatacaattataaaaagcagatgcatcgaaagttcaggtccggcctcattgtgccatatgcatccaacctgatctttgtgctgtaccactgcgagaatgccaagaccccaaaagaacagtttcgagtccagatgctcttgaatgaaaaggtcctgcctctggcctacagtcaggagactgtttcgttttacgaggatctgaagaaccattataaggatatcctgcaaagctgccagacctctgaagaatgcgaactggcaagggctaacagtacttctgatgaactgtag

SEQ ID NO: 231183 - DNA, 1041 bp, Artificial Sequence
  Description of Artificial Sequence: Synthetic coding sequence
atggatggacagctcgtcgagaaggggcgacaggatatgaggcagctggccctgcggctggcatcgctctttcccgctcttttttccagagaaaactacgggaggttgagactgatcactagcagcaaacatcgttgcatggatagcagtgcagcattccttcaggggctgtggcagcattatcaccctgggctgccccctcccgatgtcgcggatatggaattcgggcctccaacagtcaacgacaaactgatgcgatttttcgatcactgcgaaaagttcctgaccgaggtcgagaagaacgctacggccctgtatcatgttgaggcgttcaagaccggacccgagatgcagaatatactcaaaaaagtcgctgctactctacaggtccctgtcaatgacctcaatgctgatcttattcaagtcgccttctttacgtgctcattcgatctggctataaagggcgtgaagagtccgtggtgtgacgtgtttgacattgacgatgccaaagtgcttgagtacttgaacgacctgaagcagtattggaaaagggggtacggatataccattaattctcggagttcctgtacactgttccaggacattttccagcacctcgacaaggccgtggaacagaagcagaggtcacagccaatctctagcccagtaatcctacaatttggccacgctgaaacattgctgcccctcctctctctgatggggtacttcaaggacaaggaaccattgacagcttataactacaaaaaacaaatgcacaggaagttccggagtggcttgatcgtgccatacgcgtctaacctgatcttcgtgctgtaccattgtgaaaacgccaagacccccaaggaacagtttcgtgtgcaaatgctgctgaatgagaaagtgctgcccctggcatactcccaggagactgtgagcttctacgaggacctcaagaatcactataaggacatcctgcagtcctgtcagacatccgaggagtgtgaactggccagagccaatagtacttctgatgagctttag

SEQ ID NO: 231184 - DNA, 6212 bp, Artificial Sequence
  Description of Artificial Sequence: Synthetic coding sequence
atgctggaggcaattgacaagaatagagctctgcacgccgcagaaagattgcagactaagctgagagagcgcggtgacgtggcaaatgaggacaaactgagcctgttgaaaagtgtccttcaatcccccctttttagccaaattctaagtctacagacatccgtccagcaactcaaagatcaggtcaatatcgctaccagcgcaacgtccaacatcgaatacgcccatgtaccccatctgtcgccagccgtcattccaactctccagaatgaaagtttcctcctgtcccccaacaacggcaatttagaggcacttacagggccaggcatcccacatatcaacgggaaaccggcttgtgacgaatttgatcaactgataaagaatatggcgcagggcagacatgttgaagtgttcgaattgctgaaaccgccttctgggggattaggattctccgtagttggcttgagatctgagaaccgaggtgagctggggatattcgtgcaggaaattcaggaagggagcgtagcccacagagatgggaggcttaaggaaacggaccaaattctcgctatcaacggccaggccctggaccaaacaatcacacaccagcaagcaatctctattctgcagaaggccaaagacactgtgcagttggtgatagccagagggagtctcccgcagttggtctctcccatcgtaagcaggtctccatccgccgctagtaccattagcgcccacagcaaccctgtgcattggcagcatatggagacgatcgaactggtaaacgatgggtcaggcttgggcttcggtatcatcggagggaaagcaaccggggtgatcgtgaaaacaatactacccggaggggtggccgatcaacacggtcgcctctgcagcggtgaccacattctgaagatcggcgacacagacctagcaggaatgagttccgaacaggtcgcccaagtcttgagacagtgtggcaaccgcgtcaaactgatgatcgcaagaggcgcaatcgaggagaggaccgctccaacagccctcggcattaccctgtcctcttcacccaccagtacacccgagctccgtgttgacgcaagtacccaaaagggggaagagtcggaaacgtttgacgtggaactgactaagaacgtccagggactgggtattaccatcgccggttacatcggagacaaaaagctggaaccgagcggcatctttgtaaaatcaatcactaagtctagcgctgttgaacacgatgggagaattcagatcggagaccagatcatcgcagtcgatggcacgaacctccaggggtttaccaatcaacaggccgtggaggtcctccggcacaccggtcaaaccgttttgctcacactcatgaggagaggcatgaagcaggaggcagagctcatgagccgggaagacgtgacaaaggacgccgatctgtcacctgtgaatgctagcattataaaagaaaactatgaaaaagacgaagatttcctgagctcaaccaggaacactaacatactcccaactgaggaagaagggtacccactcctgagcgctgagatcgaggagatcgaggacgcccaaaagcaggaggccgcactgctgaccaaatggcaaagaatcatgggaatcaattatgagatcgtcgtcgctcatgtcagcaaattctccgagaattccggactcggcatatccttggaggccacggtgggccaccacttcattagaagtgtactccccgaaggcccagtgggccacagcgggaagctgttctctggcgacgagctcctagaagtgaacggtataactctgcttggggaaaaccaccaggatgtggtgaacatcctgaaggagctgcccatcgaggttacaatggtttgttgtcggagaacagtccccccaacaacacaaagcgagctggattcactcgacttgtgcgacatcgaactaacagaaaagccccacgtggatttaggggaatttattgggtcctccgagacagaggatcctgtgctggcaatgacagatgccggacagtctacagaggaggtgcaggctccactcgctatgtgggaagcaggtattcagcacatcgaactggagaagggatcaaagggcttgggcttcagtatactggattaccaagacccaattgatccagccagtaccgttattatcatcaggtctttggtgccaggcggtatcgccgaaaaggatggcaggctgctgcctggagaccgcctgatgtttgtcaacgatgtaaatctggagaatagcagtctggaagaggctgtggaggccttgaaaggagctcctagcggtacagtcaggatcggggttgcgaagccactgcccttatctccagaagagggttacgtctccgctaaggaagatagtttcctctaccctccacactcatgtgaagaggcaggactggccgataagcccctcttcagagccgaccttgccctcgtgggcacaaatgatgcggatctggtagatgaaagcacctttgaatctccttattcaccagagaatgatagcatctactccacccaggcaagtatcctgtcactgcatggaagctcatgtggcgatgggctcaattacggttcaagtctgccgtcctcacccccaaaggacgtgatcgaaaacagctgcgaccccgttctggacttacacatgagtctagaagaactgtacacacagaacctgctacagagacaggacgaaaatactccttccgtggacatctctatgggccctgcaagcggattcacaattaatgactacacacccgctaatgcaattgagcaacagtacgaatgtgaaaacactattgtttggaccgaatctcatttgcccagcgaggtgattagcagcgccgaactgccaagcgtgctgccagatagtgcgggaaaggggtccgagtacctcttggagcaatctagcctggcttgcaacgctgaatgcgtcatgctgcagaatgttagcaaggaatcttttgaaagaacaattaacattgcgaaggggaactcatctctagggatgacggtctcagcaaataaagatgggctggggatgattgtgcgaagtatcatccatggaggagccatctcccgtgacggcagaatcgcaattggggattgtatactgagcataaatgaggagtctactatcagtgtgacaaatgctcaggcacgggcaatgttaagacggcactcccttatcggtcctgacatcaagatcacctatgtccccgctgaacatctggaggagtttaaaatcagtcttggacagcagagtggcagggtgatggccctcgatatattttccagctacacgggcagagacattcctgaactgcccgagcgggaagaaggcgagggggaagaaagtgagctgcaaaatactgcctactcaaactggaaccaacccagacgggttgaactctggcgcgaaccctctaaatctctgggaatctccatagtaggtggtcgcggaatgggcagtcgcctcagtaatggggaagtgatgcgtggaattttcattaagcacgttctggaagactcccccgctggcaagaacggcactttgaagcccggtgaccgtattgttgaggtcgatggcatggatctgcgggatgcttctcacgagcaagccgtcgaagccataagaaaagcagggaatccagtggtgtttatggttcagtctattattaatcgtccgaggaagagtccacttccatccctccttcacaacctttaccccaagtataattttagtagtactaaccccttcgctgactctctacagatcaatgcggataaagccccatcacaaagtgagtcagagcctgagaaggctccactttgtagtgtacctccaccaccgccttcagccttcgcagaaatgggctccgaccacacccagagttccgccagcaagatatctcaagacgtggacaaagaagatgagtttggctatagctggaagaatatccgcgagaggtacgggactcttactggagagttgcacatgatcgagctggagaagggccactccgggctcggtcttagcctggcaggaaacaaggacagaagccggatgtctgtgtttatcgtggggattgaccccaacggggctgctggcaaagacggcaggctgcagattgccgatgaactgttagagatcaacgggcagatcctctatggcaggagtcatcagaacgcttcatcaatcataaaatgtgcacccagcaaagtgaagatcatttttattcgaaacaaggatgccgtgaatcaaatggcagtctgccccggtaacgcagtggagcccttgccttctaatagcgagaatttgcagaacaaggagaccgaaccaaccgtcacaacatctgatgctgcagttgacctgtctagttttaagaatgttcagcacctcgagttgcccaaggaccaggggggtcttggaatcgccatctctgaagaggataccctgagtggcgtgatcatcaagtcactcactgaacacggcgtggcagctactgatggcagactgaaagtgggggaccaaatactggcggtggacgacgagattgtggtcggctaccccatcgagaaatttatttctcttctcaaaacagcgaagatgacagtgaaactgaccattcacgccgaaaatcctgacagtcaggccgtgccttccgccgctggcgctgcctctggagaaaaaaagaattcttcccaaagcctgatggtacctcaaagtggcagtcccgaaccagaaagtatacgcaatacctctcgcagctccaccccagcaatttttgcgtcagaccccgctacatgcccaattatacctggctgcgagaccaccatcgaaattagtaaggggagaaccggcctcggcctgtccatcgttggaggctccgatactctcctcggcgcaatcattattcacgaagtgtatgaggaaggagctgcatgtaaggatgggagattatgggccggagaccaaatcctggaagtgaatggcatcgatttgaggaaggccacccatgatgaagctatcaacgttctccgccagacaccgcagcgagtcaggctgactctatacagagacgaagcaccctataaggaagaagaagtgtgtgacactcttaccattgaactccagaagaaacccggaaaaggactgggcctatctattgtcggaaagcgaaacgacactggtgtcttcgtctctgatattgtgaagggaggaatcgctgatgccgacgggagacttatgcagggcgatcagattttaatggtcaatggggaagacgtcagaaatgccactcaggaggcagtagccgcactcttgaaatgttcgctgggaacagtgactctcgaggtgggcaggatcaaggcaggaccttttcactcagaaagacggccatctcagtccagccaggtgtcagagggaagcctcagctcctttacttttcccctgtctgggtcctccacatcagagagcctggagagcagttccaaaaaaaatgccttggcgagtgaaattcagggtctccgaaccgtagagatgaaaaaggggcctaccgacagtctcggaatttcaattgcaggtggcgtgggaagtcctctgggagacgtgccaattttcatcgcaatgatgcatcccaccggcgtagcagcccagactcaaaagcttagggtgggcgatagaattgtcaccatctgcgggacctcaacagagggcatgactcacacgcaagccgtgaacctcctgaagaacgccagcggatctatcgagatgcaggtggtagccggaggggacgtaagtgttgttacagggcatcagcaggagccggcttctagtagtctaagcttcactgggttgacctcaagttcaattttccaggatgatctgggaccaccacaatgcaaaagtatcacgcttgaacgagggccagacggtctaggtttctcgatagtcggcggttatggcagcccgcacggagacttacccatttacgtcaaaactgtcttcgccaagggcgctgcatctgaagacggtcgacttaaaaggggagatcaaataattgccgtgaatggacagagcctggagggcgtcacacacgaggaggcagtcgccatcctgaaacgtacgaagggtacagttacccttatggtgctgagtta

SEQ ID NO: 231185 - DNA, 6212 bp, Artificial Sequence
  Description of Artificial Sequence: Synthetic coding sequence
atgcttgaagcaatcgataagaaccgcgctctgcatgcagcagaaagactccaaacaaagctccgggaacgaggagatgtagccaatgaagacaagctgtcgcttttgaagtcggtgctgcaatccccactcttcagtcagatcctgtcattacaaacatcagtccagcagctgaaggatcaagtaaacattgccacctccgctacaagcaatatcgagtatgcacatgtgccacatttatcccctgccgtgattcccacgctgcagaacgagtctttcttactgtctcccaataatgggaacctggaggcactcacgggcccagggatcccacatatcaatggaaagcccgcttgtgacgagtttgaccagctgataaagaatatggctcagggacgccatgtggaagtgttcgagctcctcaagcccccatccggagggcttgggttttccgtggttgggctgagaagcgagaacaggggtgagctcgggatattcgtgcaagagatccaggagggttccgtagcacaccgggacggacgactgaaggagacagatcagatcttggctatcaacggacaagcactcgaccaaacgattacacaccaacaggctatcagtattctgcagaaggcgaaagataccgtccagctggtcattgctcgcggaagtttacctcagctagtgtctcccatcgtctcgagatcaccaagtgctgcctccacaatctccgcgcatagtaaccccgtgcattggcagcacatggaaactatcgagctcgtgaatgacggatctggcctaggatttggcattatcgggggtaaggcaaccggcgtcatcgtcaaaaccattcttcccggaggcgttgccgaccagcatggacgcttatgttccggcgaccatatcctgaaaattggggacacagatctggccggaatgagcagtgagcaggttgcccaggttctccgccagtgtggcaaccgggtcaagctcatgatagccagaggagcaatcgaagagcgtacagcacccacggctctgggaatcaccctcagcagttctcctactagcacgcccgaactcagagtcgatgccagcacccagaaaggcgaagagagcgaaaccttcgatgttgagctgaccaaaaatgtccagggactgggcattacaatagctggatacataggcgacaagaagctcgaaccttctggaatcttcgtaaaatctatcactaagagcagcgctgtggaacatgacggaaggattcagatcggcgaccagatcatcgctgtcgacggcaccaatctgcagggatttacaaatcagcaagcggtcgaggtgctgcggcacactggacaaaccgtgctactaactctgatgagacgcggaatgaagcaagaagccgaattgatgagtcgcgaggatgtcaccaaagacgcggatctgagccccgtaaacgcgagtatcattaaggaaaattatgagaaagacgaagacttcctttcgtctacccggaacacaaatatcctaccaactgaggaagagggttaccctttgctgtctgccgagatcgaggaaatagaggatgctcagaaacaggaagcagctttactgacaaagtggcagcgtatcatgggaattaactacgagatcgttgtggcacacgtcagtaaatttagtgaaaatagcggcttgggcatttccttagaagctaccgtcggccatcacttcattagaagtgtgttacctgagggccctgtggggcattcaggaaaattgttctcaggggatgaactgttggaagttaatggcattactctgttgggagagaaccaccaggacgtcgtcaatatattgaaggagttaccgatcgaagtaacaatggtgtgctgccgccgtacagtccccccaacgacccagagcgagttggacagtctggacctgtgtgacatagaacttacagagaaaccgcacgtcgatcttggggaatttattggatcaagtgagactgaggatcccgtcttggctatgacggatgctgggcagagtacagaggaggtgcaggccccactggctatgtgggaagctgggatacagcatatcgaactagagaaaggttctaaaggcctcgggttcagcatcttagactatcaggaccccattgacccagcttcgaccgtgatcattatccggtctctggttcctggtggtattgcagagaaagatggacgtctattgcccggagaccgattaatgttcgtgaatgatgtgaacctagaaaattcctccctggaggaggccgtggaggcattaaagggggcaccctcgggcacagttcgcattggagtggccaagccactgccactaagccccgaggaagggtacgtaagcgcaaaggaggactcgttcctctatcctccacatagctgcgaggaggcaggtttggcagacaagcctttgttccgagctgatctcgctctggttggtaccaatgacgcggatctggtggatgagagcacctttgagtcaccctatagccccgaaaacgactcaatctattcaacacaggcctccattctctcactccacggtagctcatgtggtgatggcctcaactacgggagctcattgcccagttcccccccaaaggacgtcatcgaaaatagctgtgatccggtgctggatctccacatgtccctggaggaattatacactcagaatttgctacaaagacaggacgaaaatacccctagcgttgatattagtatgggcccagctagtggatttacgatcaatgattatacaccagctaatgcaatagagcaacagtacgaatgtgagaataccatcgtgtggaccgagtcacacctgccctcggaagtgatttccagcgctgaattgccttctgtcttgccagattcagctggaaaaggcagcgaatacctactagagcagagcagtttggcgtgtaacgctgaatgcgtgatgctgcagaatgtaagcaaggaatcctttgaaagaaccattaacatcgccaaagggaactcctctctgggtatgacggtaagtgctaacaaggatggattgggtatgatagtacgcagcattatccacggcggagctatttctcgggacgggcgaattgccatcggtgactgcatcctcagcattaacgaagagagtacaatttcggtgacgaacgcccaggcccgagccatgctgaggcgccacagcctgatcgggcctgacattaagattacatacgtgcccgctgaacacctggaggaattcaagatttctcttggccagcagagtgggagagtcatggccctcgatatatttagtagctacaccggccgtgacattcctgagctgcccgaaagagaggagggggaaggtgaggagtctgagctgcagaacacagcctattccaactggaaccaaccccgtagggtggagttgtggcgggagccctccaagagtctgggaatctctattgtgggaggcaggggcatgggaagcagactctccaatggtgaggtcatgcggggtatctttatcaaacacgtgttagaggactctccagccggaaagaacgggactctgaagccaggagatcgaatcgtggaggtagacggaatggacctgagggatgccagccacgagcaagcagtggaagctatcaggaaggccggaaacccagtcgttttcatggtccagtccatcattaacagacccagaaagagtccattgcctagcctcctccataacctttatccaaaatacaacttttccagcacaaatcctttcgccgatagtctgcaaattaatgccgacaaagctccctcacagtctgagtccgaaccagaaaaggctcccctgtgctcagtgccgccaccaccaccctctgcgttcgccgagatgggttcagaccacacacagtcctcggccagcaagatctcgcaggacgtcgataaggaggacgagtttggatattcttggaagaacatcagagaacgatacggtacactcactggagaactacacatgattgagctggagaaggggcatagcggcttgggtttgtctctggctggaaacaaggatcggtcccgcatgtcggtgttcatagttggcatcgacccaaacggggctgctgggaaggatggcagattacagattgcggatgagctgctggagatcaacgggcagatcctgtacgggaggagtcatcagaatgcaagttctattatcaaatgtgctccctcaaaagtgaagatcatcttcattcgcaataaagacgctgtaaatcagatggctgtatgtcctggtaacgctgtagagcctttgccatcaaactctgagaaccttcagaacaaggagactgagccgacagttactacatccgacgccgctgtggatctcagcagttttaagaatgtgcagcaccttgagctgcctaaagatcaaggtggccttggcattgccatttctgaggaagacaccctcagcggagttatcatcaagagccttaccgagcatggcgttgctgccacagatggccgattaaaggttggagatcaaatcctcgcagtcgatgacgagatagtggtgggttatcctattgagaaattcatcagtcttcttaaaaccgcgaaaatgaccgttaagttgacgatccacgccgaaaaccctgattctcaggccgtgccctccgctgctggggcagccagcggcgaaaaaaaaaattcctcccagagccttatggtgcctcagtcagggtctccagagccagagagcattagaaacacatcccggagcagtacgcctgcaatcttcgctagcgatccagccacatgcccaatcatacctggatgcgagaccacaattgagatttctaaagggcgtaccgggctcggcctttcgattgtagggggatcagacacactactgggggcaatcatcatccacgaagtgtatgaggagggtgctgcatgcaaggatggaagactctgggccggagaccagatcttggaagttaacgggattgatctccgcaaggcaacccacgatgaggcgatcaacgtgttaaggcaaacaccccagcgcgtacgcctcaccctatatagggacgaagccccttataaagaagaggaggtgtgtgacacactgaccatcgagttacaaaaaaaaccagggaagggcctgggacttagtattgtggggaaaaggaacgatacaggcgtgttcgttagcgatattgtgaaagggggaatcgccgatgccgacggcagactaatgcagggcgatcagatcctgatggttaacggggaagacgtgagaaatgctacgcaggaagcagtggccgctctcctcaagtgctcactggggactgttactctggaagtgggcaggatcaaagccggtcctttccattctgagcggagacctagtcagtcatctcaagtttctgaaggcagtctctcaagcttcaccttccccctttccggatccagtaccagcgagagcctggagtcatcttccaaaaaaaatgcactggcatccgagattcagggtctgcgcaccgtggaaatgaagaagggtcctaccgatagcttgggcatctccatcgccggtggagttggctcacctctcggcgatgtgcccatttttatagcgatgatgcatcctaccggagtggccgctcagacccagaagctgcgtgtgggcgaccgtattgttaccatctgcgggacgagcacggagggaatgacacacacccaggctgtgaacctgttaaagaacgctagtggatcaatcgagatgcaggtagtggcgggtggcgatgttagcgtcgtcacgggacaccagcaggaacccgcatcttcctccctgagtttcacaggactaaccagcagttcaatttttcaggatgatctcggaccgccacagtgtaaaagcattactctggagagaggcccagacggtcttggtttctccattgtggggggatatggctccccccacggggatctgccaatctacgtgaagacggtgttcgccaagggcgctgcgagcgaagacggacggctgaaacggggtgatcaaataatagccgtaaatgggcagtctcttgagggcgtaacccatgaagaggcagtcgctatattgaaacgtactaagggaactgtaaccctcatggtattgtctta

SEQ ID NO: 231186 - DNA, 6125 bp, Artificial Sequence
  Description of Artificial Sequence: Synthetic coding sequence
atgttggaagcaatcgataagaatcgggctcttcacgccgcagagaggctccagactaaactgagagaacgcggagatgttgcaaatgaagataaattatcactgctcaagtctgtcctccaatctcctctattctctcaaattctgtccttgcagacctctgtccaacaactcaaggatcaggtgaacatcgctacttccgccacaagcaacatcgagtatgcacacgtgccacatcttagtcctgctgttattccgactctccaaaatgaaagctttctgctttctcccaataatggcaacttggaagccctaaccggtccagggatcccccacatcaatggtaagcctgcttgcgacgagttcgaccagctgatcaagaacatggctcaaggaaggcacgtcgaggtctttgagcttctgaaaccaccaagtgggggtcttggcttcagcgtggtcggcctccggtccgagaacaggggagaactcggcatattcgtgcaagagattcaggaggggagcgtggcccaccgcgatgggaggcttaaggagacagaccagattctcgccattaacggccaggctctggatcagactatcactcaccagcaggcaatctctattctgcagaaggctaaggataccgtacaactggtcattgctagaggctccctgcctcagctcgtcagtccgatcgtcagtagaagtccgtctgcggcatcaacgatttctgcgcactctaaccccgttcactggcagcatatggaaacaatcgagctagtgaatgacggcagcggactgggattcgggatcattggcggtaaggccaccggcgtgattgttaaaaccatcctgcctggtggtgtcgccgaccagcacggtcgcctgtgcagcggcgatcatatccttaaaattggagacacggatctggccggaatgtccagcgagcaggtcgcccaggtgctgcgtcaatgcgggaatcgggtcaagctaatgatcgcccgtggggcaatcgaggagcggactgctccaaccgctctgggaataaccttgagtagttccccaaccagcacccctgaactgagggttgacgcctcgactcaaaagggagaggagtccgagacatttgacgtggaattgaccaagaatgtccagggactgggaatcaccattgcaggctacataggtgataagaagctggaacccagcggaatttttgtcaagtctattacaaagtcctccgctgtcgagcacgacggaaggatccaaatcggcgaccaaatcattgcagtggacggcactaaccttcagggcttcacaaatcagcaggctgtggaggtcctgcgccatactgggcagacggtcttattaaccctgatgcggagggggatgaagcaggaagcagaactcatgagtagggaggacgttactaaggacgcagacctgtcccccgtaaatgcttctattatcaaagaaaactatgagaaggatgaagattttctttcttctacaaggaacacaaatatcctgccaaccgaggaagagggttatccactgctgagcgcagaaatcgaggaaatagaggacgctcaaaagcaggaggcggctctcctgacaaagtggcagcggattatgggaattaactacgagattgtggtcgcccatgtatctaaattttcagagaactctgggttgggcatatcactcgaggccactgtggggcaccacttcattcgctccgtgttgcccgaagggccagtcggacattcaggtaaactgttttctggggacgaactcctggaagtaaatggtataactctccttggggagaaccaccaggatgtggtgaacatacttaaggaattgcccatcgaagtgaccatggtatgttgcagaaggactgtgccccctaccacacagagcgaattagacagtctcgacctttgcgatatcgaactgactgagaagcctcatgtagacctaggcgagttcattgggtcgagtgagaccgaggacccagttctggccatgactgatgcgggacagagcaccgaggaagttcaagcccctttagccatgtgggaggccggtatccagcacatagaactcgaaaaaggcagcaaaggactggggttttccatcctcgactatcaggatcctatcgaccctgccagcaccgtgatcatcatacgcagcctggtccccggtggaatcgccgaaaaagacgggcgtctgttacccggtgatagactaatgttcgtgaacgatgtgaatctggaaaactcctctctggaagaagccgtggaggccctgaaaggtgcaccctcgggcactgtccgaatcggcgtggcaaagcctcttccacttagccccgaagagggatacgtctctgccaaagaggattcttttctgtaccctccacactcgtgtgaagaggctggactcgccgataaacccttgttccgtgctgacctcgccctggttggaaccaacgacgcagatctcgtcgatgaaagtactttcgaatctccctatagcccagagaacgattccatctactctacccaggcatctatcctgagcctgcacggtagcagttgtggggacggtctcaattacggatcatccctgcccagcagccctcctaaggacgttatcgagaatagttgcgaccctgtcttggacctgcacatgagtttagaggagctctatactcagaacctgctgcaaaggcaagacgagaacaccccaagcgtcgacatttcaatgggccctgcctcaggcttcaccattaacgactataccccagccaacgctattgagcagcaatatgagtgtgaaaacaccattgtgtggactgaaagtcacctccctagcgaggtgatcagctctgctgaactcccatctgtccttccggactcagccggtaaggggtccgaatatctgttggaacaatcttctcttgcatgcaacgctgagtgcgtgatgttacagaacgtttccaaagagagtttcgagaggactattaacatagccaaagggaattccagtctggggatgacagtctccgctaacaaggacggcctcggaatgatcgttcggagtataatccatggtggagcaatctcacgggacggaaggatcgctattggcgattgtatcctgagtatcaacgaagagtcaacgatctcagttacaaatgctcaggcgagagctatgctccgccgtcacagcctgatcgggcctgacattaagattacctatgtacccgcagagcacttggaggaatttaagatatccctggggcagcagtcagggcgagttatggcactagacattttctccagctatacagggagagacattccggagctcccagagagagaggagggagagggggaggaaagcgaactacagaataccgcatattcaaattggaatcagcctcgtagggtggagctttggcgtgagccatcgaagtccctggggatctccattgtcggcggtagaggtatggggagccggctgagtaatggcgaggttatgaggggaatttttatcaaacacgtattggaagactctcccgcaggtaagaacggaactctgaagcctggggatcggatagtcgaggtggacggtatggatctccgggacgcctcgcacgagcaggccgttgaggcgatacgtaaagcgggtaaccctgtagtgttcatggtgcaaagtattataaaccggccacgaaagtcacccctcccaagcctactacacaacctgtacccaaagtacaatttttcctccactaatccttttgcagactcccttcagattaacgccgacaaggccccatcccagagtgagtcggaaccagagaaagccccattgtgctccgtaccccctccaccaccctccgctttcgcggaaatggggtccgatcatacccagtcttctgcaagcaaaatcagtcaggacgttgacaaagaggatgagtttggctactcttggaagaatatcagggaaagatacggaaccctgaccggtgaactgcacatgattgaactcgagaagggccatagcggtctcgggttaagtttagccggtaataaggaccggtcgcggatgtctgttttcatcgtgggaatcgacccaaatggcgcagcaggtaaagacggcaggctgcaaatcgccgatgagctgctggaaattaacggacagatcttatacggccgatctcatcagaacgcaagcagtatcattaaatgcgccccttcaaaagtaaagatcatttttattcgcaataaagatgccgtgaaccagatggccgtctgcccaggcaatgccgtggaacccttgccgtcaaacagcgaaaatctccagaataaagagacggagcccacagtgaccacttcagatgcggctgtagacctgtcttccttcaagaatgtccagcatctcgaattaccgaaagatcagggcggactgggtattgcgatttcagaggaggacaccttgtctggagttatcattaaaagtcttactgaacacggagtcgccgctaccgatgggagactgaaggttggggatcagatcctggccgtggatgacgagattgtcgtaggctaccccatagagaaattcataagcctcctgaaaactgcaaaaatgaccgtaaagctcacaatccatgccgaaaatcctgattcgcaggctgtgccaagtgcggctggtgcagcatccggggagaagaagaactcttcacaatccctgatggtcccacagtcgggatcccccgagcctgaaagtatacgaaacacctcgagaagttccacccctgctatctttgccagtgatcccgctacatgcccgattattcccggatgtgagaccacaatcgaaatctcgaaggggaggaccgggctggggctgtcgatagtaggaggctctgacaccttgctcggcgcaatcataattcacgaggtgtatgaggaaggtgcagcctgcaaggacggcaggctgtgggccggtgatcagattctggaagtgaatgggattgatctgcggaaggccacgcatgatgaggcaataaacgtgctgcgacagacccctcagcgggtccgcttgactctataccgagatgaggccccttacaaggaggaggaagtctgcgatacattgacaattgagttgcagaaaaaaccgggaaaaggcttgggactaagtatcgttgggaaaaggaatgatacgggggtttttgtaagtgacattgtcaaaggtgggatcgccgatgcagatggcagactcatgcagggggaccaaatcctgatggtgaacggcgaggacgtgaggaacgcaacccaagaggctgtggccgcacttttaaaggtttcagaaggatctctgtcatcgttcaccttcccactatccggatcttccacttccgagtcattggagtcaagttccaagaagaatgctctggcgagtgaaatccaggggctcagaactgttgaaatgaagaaaggaccaacagacagcctgggcatcagtatagccggaggggtggggtctccacttggggacgtacccatctttatcgccatgatgcaccctaccggggtggcggctcagacacagaaactgagagtgggtgaccgcatcgttaccatctgcggaacctccacggaaggaatgacccacacccaggctgttaacctgctcaaaaacgctagcgggtcaatcgaaatgcaagtggtggcaggtggcgacgtaagcgtggtcaccgggcaccagcaggagcccgcatcctcatcgctcagctttacaggacttacgtctagcagcatcttccaggacgatctggggcctccccagtgcaagagcatcaccctggagcgcggacctgatggcctgggattctccatcgtggggggatacggcagccctcacggggacttacctatctatgtcaaaacagtgtttgcaaaaggagcagcgtctgaggacggtcgtttgaagcggggagaccaaattattgcagtgaatgggcaatcgctggaaggcgtcacacatgaggaggcagtggcgatcttaaaacgtaccaagggtaccgtaacgctcatggtgctcagcta

SEQ ID NO: 231187 - DNA, 5852 bp, Artificial Sequence
  Description of Artificial Sequence: Synthetic coding sequence
atgctagaggcaatcgacaaaaaccgcgcactgcatgccgcagaaagactccaaaccaagctgagagaacgtggggatgtcgcaaacgaggacaagcttagcttgcttaagtcagtcctgcagtccccactgttctcacagattctgtcactccagaccagtgtgcagcagctcaaagaccaagtgaacatcgccacaagtgctacgtcaaacattgagtacgctcatgtgccacatctcagtccggcagttatccctactctgcagaatgagtcctttctgctcagccctaacaacgggaatctggaagccctgactgggccaggaattccacacatcaacggtaaaccggcttgcgatgagttcgaccagctgatcaagaacatggcacagggaagacacgtagaggtgtttgagctgttgaagcctcccagcgggggtctcgggttttccgtagtgggcttaagatccgaaaacagaggagaattaggtatattcgtccaggagatacaggaggggtctgttgcacatcgcgacggcaggctcaaggaaaccgatcagatcctagccatcaacggtcaggccctcgaccagaccatcacacaccagcaggccatctctattctacagaaagccaaggatactgtacagctggtgattgcccgagggtcgctcccccagctcgtcagtcccatagtctctagatctccaagcgccgctagcacgatcagtgcacacagtaatccggtgcattggcagcatatggaaactatcgaactcgtgaacgatggatccgggctgggatttggcataataggaggtaaggcgaccggggtaatcgtgaagacaatcctccctggcggtgtggccgatcagcacggaagactgtgttccggggaccacatcttaaaaatcggggacacagacctggccggaatgtcttccgagcaagttgctcaggtcctgcgtcaatgcggcaacagagtgaaactcatgatagcccgtggggctattgaggagagaacggcccctaccgcactcggcatcacgctttctagttcccccacatcaacgcctgaacttagagtcgacgcctcgacccagaagggggaggagagcgaaactttcgatgtggagctgaccaagaatgtgcagggcctcggcattactatcgccggatacataggggataaaaagctggaaccatccggaattttcgtgaaaagcattacgaaatcctctgcggtggagcacgacggtagaatccagattggggatcagatcattgcagtggacggcactaacttgcagggattcacaaaccagcaggcagttgaggttctacgtcataccggccagaccgttctgcttaccctgatgagacgtggcatgaagcaggaggctgagctgatgtctagggaagacgtaactaaggacgcggatcttagccctgtgaatgccagcatcattaaggagaattacgaaaaggatgaggattttctgagctctacacgcaacacgaatatcctgccaacagaagaagaaggctatccattgttatctgcggaaatcgaggagatcgaagacgcccaaaagcaggaagccgctctcttgaccaagtggcagcgcataatgggaatcaactatgagatcgtggtggctcatgttagcaagttttcagagaattctggactcgggatctctctggaagctaccgtggggcaccactttatcaggtccgtcttaccggaaggtcccgtcgggcattccggtaaactatttagtggagatgagctcctggaggtgaacggaataacattacttggcgaaaatcaccaggatgtcgtaaacatccttaaagagctccccatagaggttaccatggtctgttgcaggcggacagtcccgccaactacacagtcagaactggacagtctgggtattcagcacattgaactggaaaaaggttccaaaggcctgggcttctctatattggattaccaagaccctatcgacccagcttctacggttattattatcaggtcactggtacccggagggattgcggagaaggatggcagattgctaccaggggacaggctgatgtttgtgaatgatgtgaatttggagaattcaagcctggaggaagctgtggaagcgttaaagggggcaccgagtggaactgtccggatcggcgtcgcaaagccacttccactgtccccagaggaaggctacgttagcgctaaagaggacagttttctgtatcctcctcattcgtgcgaagaagctggcctggcagacaaacctttgttcagggctgatcttgcactggtgggtacaaatgatgccgacttagtcgatgagagcacgtttgagtctccctactccccagaaaatgactccatctatagcacccaagcttctatcctgtctcttcatggcagttcctgtggggacgggcttaactacggatcatctcttccatcctcacccccaaaagatgtgatcgagaattcctgtgatccggttttagacctgcacatgtcactggaggaattgtatacccaaaatctcctccagaggcaagacgaaaacacgccttccgtagacataagcatgggccctgccagtggatttacgatcaatgattacacccccgcaaatgctattgagcagcagtatgagtgcgaaaacactatagtgtggacggagagtcaccttcccagtgaggtgattagcagcgccgagctgccatccgttctgccagacagcgcaggtaaaggtagtgaatatctgctggagcagtcttccttggcctgcaacgctgaatgtgtgatgctgcaaaatgtcagtaaagagtcgtttgagaggacaatcaacatcgccaagggaaatagttcattaggaatgacggtgagcgctaacaaagacggcctgggcatgattgtgaggagtataattcacggcggagccatttcccgcgacggtcgtattgcgattggtgactgtatcctgtctataaatgaggaaagtaccatctctgtcacaaatgcccaggcaagagctatgctcaggaggcacagcttaatcggacctgacattaagattacatatgtacccgctgaacatttagaagaattcaaaatcagtctcggtcagcagtctggcagagtgatggccctggatatctttagtagttacaccggcagagacatccccgaattgcctgagagggaagaaggtgaaggggaagaaagtgaacttcagaatacagcctactccaattggaaccagcctcggagagtagaactgtggagagaaccttcaaaaagccttggtatcagcatcgttggcggtagggggatgggctccaggttgagcaacggtgaggtgatgcgaggaatatttattaagcacgttctcgaagatagcccagccggtaagaacggcacccttaagcctggggataggattgttgaggcgcctagccagagcgagagcgaacctgaaaaggccccactctgctcagtgcccccacccccaccctctgcatttgcggaaatgggttctgatcacacgcagagcagcgccagcaagattagtcaggatgttgacaaggaagacgagtttggctattcttggaagaatatcagagagcgttacggaacactcaccggggagttgcatatgatagaactcgagaaagggcatagcggtttgggcttatcgctcgctggcaataaagaccgatcccgtatgtctgtgtttatagttggcattgatccaaatggcgctgccggaaaagatggacgactccagatagccgacgaactgctcgaaatcaacggacaaatattgtatggccgaagtcaccagaatgctagttcaattatcaagtgcgctccaagtaaggtcaaaattatatttattaggaataaagatgccgtaaatcagatggcggtatgccctgggaacgcggtcgagccccttccatccaatagcgagaacctccagaacaaagaaacagaacctaccgtcaccacgagcgatgcagccgttgatctgagctctttcaaaaatgtacagcatctcgaactccccaaggatcaggggggactcgggattgctatctcggaggaagacaccctatcaggagttattattaaaagtcttactgaacacggggtcgcagccactgacgggaggttaaaggtgggcgaccagatcctggccgtcgacgatgagatcgtggttgggtaccctatcgaaaagttcattagcctgttgaagaccgcaaaaatgactgtcaagcttacgattcatgctgagaaccccgatagccaggcagtgccctcagctgccggtgccgcttcgggcgagaagaagaatagctcacaatccctgatggtaccgcaatctggtagtcctgaacccgagagcatccgtaatacatcgcgctcctctacccctgcgatctttgcttcagaccccgcaacatgtcccatcatccccggatgtgaaacgaccatcgagatcagcaaagggcgaacaggtctcggcttgagtattgtgggcggttccgataccctgctgggagccattatcatacacgaggtatatgaagaaggcgcagcgtgtaaagacggacgactttgggctggtgaccagattcttgaagtgaatggtatagatttaaggaaagcaacccacgacgaggccattaacgttttgagacagactccccagagagttcggttaacgctgtatcgtgatgaggcaccctataaggaagaggaagtatgcgacacccttacaatcgaattacagaagaagccaggcaaagggctaggtctcagtatagttggtaaacgtaacgatacgggggtatttgtctccgacatcgtgaagggcggtatcgctgacgccgatgggaggctgatgcaaggggaccagatcttgatggtgaacggtgaggacgtgaggaatgctactcaggaggctgttgcagctctgttgaagtgctcccttggcacagttaccctcgaggtgggccgaatcaaagcgggtcccttccatagcgaacggagaccctcacagtcctcacaggtgagcgagggcagcctgagctccttcacattccccctttctgggtccagcaccagcgagagcctcgagtcctcctcaaagaaaaatgcgctggcttccgaaatacaagggctgcgcactgtggaaatgaaaaagggaccaaccgactccttggggattagcatcgccggaggagttggttcccctctgggcgatgtgccaattttcattgcaatgatgcatcctacaggcgtggccgcacaaacacagaaattgcgagttggagatagaattgtgaccatctgcggaacctcgacagaggggatgacccatacccaagccgtgaacctgctgaagaatgcctctggcagtattgagatgcaggttgtggccggtggggacgttagcgtagttactggccaccagcaggaaccggcaagctccagcctttcctttaccggccttacaagctcttcgatttttcaggatgatcttgggcctccccagtgcaagtcaatcaccctagagcggggacctgatggtctaggattctctatagtaggaggatatggcagcccacacggcgacctgcccatctatgtcaagaccgtgttcgccaagggcgcagcatccgaagatggacgcctgaaacgcggagatcaaattatcgccgtgaacgggcagagcctggagggcgttacccacgaggaggcggtggccattctaaagcggaccaagggcactgttactctgatggtcctcagcta

SEQ ID NO: 231188 - DNA, 915 bp, Artificial Sequence
  Description of Artificial Sequence: Synthetic coding sequence
atgcaaggtgatcagatcctcatggtcaacggggaggatgttcgtaatgccacacaggaagcagtggcagctttgctaaagtgctccttgggaacggtcactctggaagtggggagaattaaggctggaccttttcatagtgagcgcaggccttctcagtcctctcaggtgtccgaagggtctctgtcctctttcacattccctctttctggcagcagcactagtgagtccctggaatcatctagcaagaagaatgccttagcatctgagatacaagggctgagaaccgttgaaatgaagaagggcccaacagatagcctgggcatctccattgcaggaggcgtgggctcccccttgggggatgtgccaatctttatcgccatgatgcaccccaccggagtcgccgcacagacacagaagctccgggtgggagatcggattgttaccatatgtgggacatccacagagggaatgactcacactcaggcagtgaatctcctgaagaacgcgtccggctcgatcgagatgcaggtcgttgcgggaggtgacgtaagcgtggtcactggacatcagcaggagcctgcctcttctagcctgtcttttaccggactgaccagctcttcaatttttcaagacgacctcggcccaccacaatgcaagtctataactctggagcgaggtcccgacggactaggcttttcaatagtgggcggttacggaagcccacatggggacctccctatttatgtaaagacagtctttgcgaagggtgcagcgtctgaagatgggcgtctcaaaaggggggatcagatcattgccgtgaatggacagagtcttgaaggcgtgacacatgaagaggcagtggctatcctgaagcgaaccaaaggcacagttactttgatggttctctcatag

SEQ ID NO: 231189 - DNA, 6125 bp, Artificial Sequence
  Description of Artificial Sequence: Synthetic coding sequence
atgcttgaggcaatagacaagaacagggccctgcatgcagccgaaagactgcaaaccaaactaagagaacggggtgatgtcgccaacgaagataagctcagcctgctcaagtcagtgctgcagtctcctcttttctcccagattctttcactccagacctccgtgcagcaactgaaagatcaggtgaacattgcaacgtcggcgacctccaatatcgagtatgcccacgtgccacacctgtctcccgctgttatcccgactctgcagaatgagagcttcctcctatctcccaacaatgggaatctcgaagccttgaccgggccagggatccctcatatcaatgggaaacccgcttgcgatgagttcgaccagctgataaagaatatggcacaggggcgtcacgtggaggtgtttgagctgctcaaaccgccttctgggggactgggattcagcgtagtgggccttcgttctgaaaaccgcggagagctggggatcttcgtgcaggagattcaggagggcagcgtcgcccaccgagacgggagattgaaggagaccgaccagatccttgccattaacggacaggcgctggaccaaaccattacacaccaacaggccatctccatcctccaaaaggctaaggacactgtgcagttagtgattgctcggggatcactacctcagttagtgtcccctatcgtgtcccgcagcccctcagcggcatctaccatatcagctcattcaaaccccgtgcactggcagcatatggagacaatcgaactggtgaacgatggaagcggtttgggctttggaattattggcggaaaggccacaggggtgatcgttaaaaccatcctgccaggtggggtggccgatcagcacggacggctgtgcagcggcgatcacatcctgaagattggcgatacagatctggcgggaatgtcttcagaacaagtagcacaggtgctcagacagtgcggcaaccgggtaaaactgatgattgccagaggcgcaattgaggagcggaccgctcccacagcactcggtatcacattgtcgtccagccctacaagtacgccagaactgagggtggacgcctctactcagaagggagaagaatcagaaacttttgacgtcgagctaaccaaaaacgtgcaagggctggggattacaatagcaggctatataggggataagaagctggaaccctccggcatcttcgttaagtcaatcactaagtcatcggccgtggagcacgatggacggattcagatcggcgaccaaatcattgccgtggacggaaccaacctacagggcttcaccaaccagcaggcagtggaggtgctccgtcacaccgggcagacagtactgttgacccttatgaggcggggaatgaagcaagaggcagaattgatgtcgcgcgaagatgtcaccaaggatgctgacctgagtcctgtcaacgcttccataataaaggaaaactatgaaaaagacgaggactttctcagctctactaggaataccaatattcttcccaccgaggaggaagggtaccccctgttatcagctgaaattgaggagattgaagatgcgcaaaagcaggaggccgctctacttaccaaatggcaaaggattatgggaatcaattacgagattgttgtggcccacgtgagcaagtttagcgagaactcaggactggggatatctctggaagctaccgttggacatcactttatccgctccgtgctgcctgaaggacccgtgggacactcaggaaaacttttcagcggcgacgagctcctcgaagtaaacgggattacactgcttggagagaatcaccaagacgtggtgaatattctaaaggaactgcccatcgaggtcactatggtgtgttgcagacgcaccgtacctccaacaacccagagcgaattagattcactggacctgtgcgacatagagctgaccgaaaaaccgcacgtcgatctcggggagtttatcgggtcttcagagactgaggacccagttcttgccatgacagacgcaggtcagtccactgaagaggtgcaggcacccctcgccatgtgggaagccggaatacagcatattgaactggaaaaaggctccaaaggtctcggcttttctattctcgattaccaagatcctatagatcccgcttccacagttatcatcattcgtagcctcgtcccaggtgggatcgccgaaaaggacggcagactgctgccaggggatcgattaatgtttgttaacgatgtgaacctggaaaatagcagtctagaggaggccgtagaagcattaaagggtgccccttctgggactgttcgcataggcgttgccaaacctctgccactgagcccagaggaggggtacgtcagtgccaaagaagattctttcctttatccgccacacagttgcgaggaagcaggattggccgataaacccctttttcgcgctgatttagccctggtcggcacgaatgacgcagacctggtcgacgaatccacattcgaatcgccttacagccctgaaaacgattctatttactccacccaagcctcaatcctctcattgcacggctcaagctgcggcgacggactcaactacgggagtagtctaccatcttcccctccgaaagatgtgatcgagaattcctgtgaccctgtgctggacctgcacatgagtcttgaggagctttatactcagaacctgctgcaaaggcaagacgaaaataccccatcggtggacatttccatgggcccagcgtcaggatttaccataaacgattatacacccgcaaacgccatcgaacagcagtacgagtgcgagaacaccattgtttggactgagtctcaccttcccagcgaggttatctcctcggccgagctgccaagtgtacttcctgactccgccggtaagggaagcgaatacctcctagagcagtcctcccttgcttgtaatgccgaatgcgtcatgctgcagaatgtgagcaaggagtcattcgagcgcacaataaacattgcaaaaggtaacagctcactagggatgactgtttctgctaacaaggacggacttggcatgattgtgcgctctattatccatggaggggctatcagtagagatggacgcatagctatcggggactgcatactgagcatcaacgaagaatctacaattagtgtgacaaacgcccaggccagagctatgctacgcagacatagcctgatcggccctgacatcaaaataacttatgtccctgcggagcacttggaggagtttaaaatcagccttgggcagcagtctggacgtgtgatggccctagacatcttcagcagttacacagggagagatatccctgagctcccggaacgggaggaaggagagggagaagagtctgaactccaaaatacggcctattccaattggaatcagccaagacgtgtagagctgtggcgggagccctccaaatctttaggaatttccatcgttggcggtcgaggaatgggctctagactctctaatggggaggtcatgcgcggaatcttcatcaaacacgtcctagaggattcacccgctgggaaaaatggaacgcttaagcccggtgacagaattgtggaggtggacggaatggatttgcgcgatgctagccatgaacaggcagttgaggctatccgaaaagcgggtaaccctgttgtattcatggtccagtctattatcaatagacccagaaaatcacccctgccatcactacttcacaatctgtacccgaaatacaacttcagttccactaaccctttcgctgactctctacaaatcaacgctgacaaggcaccttcacaaagcgagagcgaacctgagaaggcacccctctgctctgtgccgccaccacctccttccgctttcgcggagatgggctccgaccacacacagtcaagtgcttccaaaatctcccaggatgtcgacaaagaagatgagtttggttactcctggaaaaatatccgcgaacgctacgggacactgaccggagaacttcatatgatagagctagagaagggccattctgggctagggttatccctggccggtaacaaggatagatcccggatgtctgtcttcatcgtgggaatcgaccccaacggagcagcgggtaaggacggaaggcttcaaatcgccgacgagttgttggaaattaatggccaaatcctgtacggtagaagtcaccagaatgcctccagcattattaagtgcgccccatctaaggtgaagatcatttttatcagaaataaagacgcagtaaaccagatggcagtatgcccaggcaatgccgtagaaccgctcccctctaatagcgaaaatcttcagaacaaggagactgaacctacggtgactacaagcgatgccgcagtggatctcagctcttttaagaatgttcaacatctggagttgcctaaggaccagggcggattgggcatcgccatttccgaggaagatactctgtctggtgtcatcataaaaagtctaactgaacacggtgtggctgccacagatggcaggttaaaagtgggagaccaaatcttggccgtggatgacgaaatagtcgtgggctatcccatagaaaagttcatctcccttctcaaaactgctaagatgacagtgaaattgactattcatgccgaaaaccccgacagccaggcagtcccatccgcagcaggcgcagcctccggcgagaagaagaactcttcacaaagcctcatggtaccacagtctgggagccctgaaccggagagcattcgcaacacatctagatcctcgaccccagccatctttgctagcgatccagccacatgtccaatcatccccggatgcgagacaaccatcgagatctcgaaaggacgcactgggctgggtctgtctattgtcggaggttccgacactctgctcggcgctattattatacatgaagtgtacgaagaaggggcagcgtgtaaagacggtaggctctgggccggtgatcagattctggaagtcaatggcatagacctgcggaaagcaacccatgacgaggctattaacgttctgaggcagactcctcagcgcgttaggctgacactctacagagatgaggccccatacaaagaggaggaagtctgtgatacacttaccattgaattgcagaagaaacctggcaagggactggggctgtctatagtcggcaagcggaacgataccggagtattcgtgtctgatattgtcaagggcggaattgccgacgcagatgggagactgatgcagggggatcagatcctcatggtgaacggcgaggacgtacgaaacgccacacaggaggctgttgcagcactgctgaaagtgtccgagggttcgctgtctagtttcacttttcctctatctgggtcatctacatcagaatcactggaaagttcctccaaaaagaatgccctcgcttcagaaatccaaggactgcgtacagtggagatgaaaaaaggtccgacggatagtctcggcattagcatcgcaggaggtgtgggatctcctctgggcgacgtcccgatctttatcgccatgatgcacccaactggggtcgcagcgcagactcagaaactcagagtgggcgacagaattgttactatttgcgggacatctactgaaggcatgacgcacacacaagctgtcaatctgctgaaaaatgcttcaggctcgatagagatgcaggtggtcgcagggggagacgtgagcgttgtgactggccaccagcaggagcccgcttcatcgtcattgagtttcaccggactgacctctagctctatctttcaggatgaccttggcccaccccaatgcaagtctattaccctggaaagaggccctgatgggctcgggttttctattgtcggtggatacggtagtccacatggagatttgccaatttatgtgaagactgtcttcgctaagggagcagctagtgaagacggcaggctgaagaggggagatcagattatcgcagtgaatggacaaagcttggagggggtaacacacgaagaggcggtagctattcttaagaggactaagggaacggtgaccctgatggtactgagcta

SEQ ID NO: 231190 - DNA, 6113 bp, Artificial Sequence
  Description of Artificial Sequence: Synthetic coding sequence
atgctggaggcaattgataaaaatcgagcccttcatgcagccgagcggttacagacgaagctgcgagagagaggggacgtggcaaatgaagacaaactgtctctcctcaagagtgttctccagagtccactattttcacaaattttgagtttgcagaccagtgtccaacagctaaaagatcaagtgaatattgcgacatccgccactagtaatatcgaatacgcccacgttccccacctgtccccggcagttattccaactctccaaaatgagagcttcctgttgtcacctaataacggtaacctggaagccctcaccggaccaggcataccccacattaatggaaaaccagcatgcgacgagttcgatcagctgattaagaacatggcgcagggcaggcacgtcgaagttttcgaactgctgaagcccccaagtggaggcctggggttttcggttgtgggcctccgttctgagaatcgaggggagcttggaatctttgtgcaggagatccaggagggttctgtggcgcatagggacgggcgtttaaaagagaccgaccagattctagcaattaatgggcaggcactagaccagacaatcacccaccagcaggccatttctatcctgcaaaaggcaaaggatacagtgcagcttgtcatagcgagaggctcactccctcaactggtatcgcctattgtgtcacgcagcccgtctgccgcatctactatctcagctcacagcaacccagtgcactggcagcatatggagaccatagagctggttaatgatggatcaggccttgggttcggtataattggcggtaaggccactggggtcattgtcaagacaattttgccaggaggcgttgcggatcagcacggaagattatgcagcggggatcatattctgaagataggggatactgaccttgccggaatgagttctgagcaagtcgcacaagttctgaggcagtgtggcaaccgggtaaaactcatgatcgctcgcggagccatcgaggagcgcacagctcctacagcgttagggattacactgagctcctctccaacttcgaccccggagctccgggttgacgcctcaactcaaaagggcgaagaaagtgaaacattcgacgtggagcttactaaaaacgtccaagggctgggcatcactattgccggatatatcggggataagaaacttgaacctagtggtatcttcgtgaagtcgattactaaatcctccgccgttgagcatgatggaagaatccagataggcgaccagatcattgccgtggatggaaccaatctgcaggggtttaccaatcaacaggccgtggaagtgttaaggcacaccggccagacagtgctgctcactctgatgcggaggggtatgaagcaggaggccgagctgatgtccagagaggacgtgacaaaggacgcagacctgtctcccgtgaacgcttcgataattaaagaaaactatgagaaagacgaagactttctatcttccacccgaaataccaatattcttcccacggaagaggaaggctacccattgctcagcgctgagatcgaagaaattgaggacgcccagaagcaggaagcagcactgcttaccaaatggcagagaattatggggatcaattacgagattgttgtcgcccatgtctctaagttctcagagaattccggactgggtatcagcctggaggcaaccgtcggacaccacttcatccgatcagtgttacccgagggcccagtcggtcactccgggaagctgttcagcggggacgagctgctggaagtgaatggcattaccctgctcggagagaaccatcaggacgtggtaaacatcctgaaagaactgccaatcgaggttaccatggtgtgttgccgcaggaccgttcctcctacaactcagagtgagttagattctctcgacttgtgtgacattgaattgaccgagaaacctcacgtagatctgggagaatttataggtagcagcgaaacggaagatcccgtgctagccatgacagatgccggacagtcaactgaggaagtgcaagcccctctggccatgtgggaggcagggattcagcacatcgaacttgagaaaggctccaaaggactgggcttcagcatcctggattatcaggatcccatcgatccggcttccacagtaataattatcagaagtctggtgcctggtggcatagctgagaaggatgggcgtcttctcccaggcgatcgcctgatgtttgtgaacgatgttaacctggaaaacagctcgcttgaagaagcagtcgaggccttgaagggagccccatctggaactgtgcgcataggggtggccaagcctttgccgctctcccccgaggagggatatgtgtcagcaaaggaggacagctttctgtatcctcctcatagctgcgaggaagcaggcttagccgacaaacctctgttccgtgccgacctggccctggtgggaaccaatgacgcggatttggtagacgagtctacatttgagtcaccatattcacccgagaacgattccatctatagtacccaggctagcatcctgtctctgcatggaagctcctgcggggatgggctcaattacgggtccagcctcccttcttctcctccgaaagatgtaatcgaaaatagctgtgaccccgtgctggacctccacatgtcccttgaagaattgtacacccagaacctcctgcagaggcaagatgagaacaccccctccgtggacatctcaatgggcccagcttccggttttacaattaatgactacacaccggctaacgccatcgagcagcagtatgagtgcgagaatacgattgtttggacggaaagtcatctccccagtgaagtcatcagctccgcagaactgcccagtgtcttgcccgatagcgcaggaaaaggctcagagtatctgttggagcagtccagtctggcttgcaatgccgaatgtgtaatgctccagaacgtgagtaaagagtccttcgagcgtaccatcaatattgcgaaaggcaattcatctttgggaatgacagtgtctgctaacaaggacggacttggtatgatcgtacgatctataattcatgggggagctatctccagggatggtagaattgccatcggagactgcattttgagcataaatgaggagtccaccatttccgttacaaatgcccaggcacgagcaatgctgcgcagacactctttgatcggcccagacatcaagatcacatacgtgccagccgagcacttagaggagtttaagatctcgctggggcaacagtccgggagagtgatggcactggatattttcagtagctataccggccgagacatcccagagcttcccgaacgggaagagggtgagggtgaagaaagtgagctgcagaatactgcttactcaaactggaaccagccgaggcgcgtggagttatggcgtgagccatccaagtcactcggcatatcaatcgttggcggaaggggcatgggctcgcgtctttcgaatggggaggtcatgcgcggtatattcattaagcacgtcttggaggattcccccgctggcaaaaacgggacgttgaagccaggggaccggatagtggaggttgatgggatggacctgcgagacgctagtcatgagcaggccgtcgaagctatccgcaaggccggtaatccggtagtcttcatggtgcagtcaatcatcaatcgcccacgcgctccctcacagagtgagtccgagcctgagaaggcccctctttgttctgtgcctcctccaccaccttccgcttttgcggagatgggcagcgatcatactcagagttccgcaagtaaaattagccaggacgttgacaaggaggatgaattcggctatagctggaagaacatccgggagcggtacggaacactcacgggggaactgcacatgatcgagctggagaaaggccactcaggcctgggcctctccctcgccggaaacaaagaccgctctagaatgtccgttttcatcgtgggaatagatcccaacggtgccgctggcaaagacgggaggcttcaaatcgctgatgagcttctggagataaacggacagatcctgtacggcaggtcccatcagaacgcctcgagtatcatcaagtgcgcccctagcaaggtcaagatcatcttcatccggaataaggatgcggtgaatcagatggccgtgtgccccggaaacgcggtggagccccttccaagcaatagcgaaaatctccagaataaagagacagagcccaccgttacaacaagcgatgcagccgtggatttaagctcctttaaaaatgttcagcatttagagcttcccaaagaccagggaggattgggaattgctatcagtgaggaagacaccctgtctggcgtgattatcaagtcactcactgagcacggcgtggccgcaaccgacggaagactcaaggtgggggaccaaattcttgccgtggacgacgaaattgtggtcggctatcctatagagaaattcatttctctgctgaagaccgcgaaaatgacggtgaagctgacaatccatgcagagaaccccgactcgcaggctgttccctccgctgccggtgccgctagtggggagaagaagaactcttctcagtccctgatggtcccgcaaagcggcagtcctgagcccgagtctattaggaatacctctcggtctagcactcccgcaattttcgcctctgacccagctacgtgtccgattatccccggttgtgagactaccatagagatctctaaaggacgcacaggtcttggactctcaatcgtagggggttcagacaccctgctgggggctattatcatccatgaagtttacgaagagggggctgcttgcaaggacggtagactttgggcgggagatcaaatcctggaagtaaacggaatcgacctgcgcaaggccacccacgacgaggccatcaacgttcttcggcagacaccccagagagtgcgactgaccctatatcgggatgaagctccatataaagaagaagaagtgtgtgatactctgaccatagaactgcaaaaaaagccaggcaagggcttaggtctgtcaatagtggggaagcggaacgacactggggtgtttgtatcagacatcgtgaaagggggtattgcagacgcggacggacgtctcatgcagggagatcagatattgatggtgaatggtgaagacgtgagaaatgccactcaggaagccgtggccgctttgctcaaatgctctttgggcaccgtcacactggaggtaggccgaatcaaggccggacctttccattctgagagaaggccctctcagtcttcccaggtcagtgaagggtcgttatcttcctttaccttccccttgtcagggagcagtacctcggagagcctggaaagtagctccaaaaaaaatgccttggcctccgagatccaggggctgcgaacagtagaaatgaagaagggacctacggactctctgggtatctccattgcaggaggggtgggaagccctctcggcgatgttcccatcttcattgccatgatgcatcccacaggggtggcagctcagacacagaagttgcgagtaggggatagaattgtgaccatatgtgggactagtacagaaggaatgacccatacccaggccgtcaacctgcttaagaatgcaagtggttctatagaaatgcaagtggtcgccggaggcgatgtttcagtggtgacaggtcatcagcaggagcccgcttccagctctctgtcttttacgggtctgacctctagctctattttccaggatgatctaggcccaccacagtgtaagtcgatcaccttggaacggggaccagatggtttgggtttctccattgttggcggttacggaagtcctcacggcgatctccccatttatgtgaaaactgtgttcgctaagggcgctgcttccgaagatgggcgactgaagagaggcgaccaaattatcgccgtcaacgggcaatccttagagggggtgacgcacgaggaggctgtcgccatcttgaaacgcaccaaggggaccgtgactttgatggtgctctcata

SEQ ID NO: 231191 - DNA, 6026 bp, Artificial Sequence
  Description of Artificial Sequence: Synthetic coding sequence
atgctggaagctattgataaaaatcgggctctacacgccgctgaacggctccagactaagctccgggagcggggagacgtcgcgaacgaagacaagttgtcactgctcaaaagcgtcctccaaagtcctctgttctcgcaaattctttccttgcagaccagtgtgcaacagctcaaggaccaggttaacattgctacttccgccacgagcaatattgagtacgcccatgtccctcacctgagtccagcggtgattccgacgctgcagaatgaatcatttcttctgagccccaacaatggcaacctggaggccctaaccggacccggtatccctcatatcaatggaaagccggcatgtgacgagttcgaccaactgatcaagaacatggcacagggacggcacgtggaggtgttcgaattgctgaagccacctagtggagggctaggctttagtgtggtgggcctccggtccgaaaataggggagagctgggaatcttcgtacaagagatccaggaggggtctgtggcccaccgagacggtcgcttgaaggagaccgatcaaatcttagcaatcaacggacaggccctggaccagaccataactcaccaacaagctatcagtattttacagaaagccaaggacactgttcaactggtcattgcaagaggctcactcccccagttagtgagccccatcgtgtcccggagcccatctgcagccagcaccatctcagcccactccaacccagtgcattggcagcatatggaaacaattgagctggtaaatgacgggtctgggcttggtttcggcattatagggggaaaagctaccggcgtaatcgtgaagactatcctgcccggtggcgtggcggaccagcatggtaggctctgctctggcgaccacatcctgaagattggcgataccgacctcgcagggatgtcctccgaacaggtcgcacaggtgctgcggcagtgtggtaacagagttaagttgatgatcgcaagaggagctatagaagaacgcacggcgccaacggcactgggaataacactctcatccagccccacatcaacccctgagcttagggtagacgcatccacgcagaaaggagaggaaagcgaaacgtttgacgtggagctgactaaaaacgtgcagggcctggggattacaattgccggatatatcggtgataaaaagctcgaaccctctgggatcttcgtcaaatccattaccaaaagcagcgccgtggagcacgacggaaggatacagatcggcgaccagatcattgctgtagatggaaccaacttacagggctttactaatcagcaggctgtggaggtgctccgacacaccggccaaacagtgctgttaaccctcatgcgcaggggtatgaagcaggaagccgagctgatgtctcgggaggacgttacaaaggacgccgacctttcacccgtgaacgcttcaatcatcaaggaaaattatgagaaggatgaggatttcctctcttctaccaggaacaccaatattttgccaaccgaggaagaaggataccctctgctgagcgcggagatcgaagagatagaagatgcgcaaaagcaggaggctgccctcctgaccaaatggcaaagaatcatgggtatcaattacgagatcgtagtagcacatgtctccaagttcagcgaaaactctggcctgggaatctcccttgaggccacggtcgggcatcattttatccgctctgtactgcctgaaggtccagtgggacattcaggtaaactgttcagcggcgatgagctcttggaagtcaacggaattacattgctcggcgagaatcatcaggacgtcgtcaatattctaaaggaactgcctatagaggtgacaatggtgtgctgtagacgcacagtgccacctacaacgcagtctgagctggattccctggacctgtgcgacattgaacttaccgagaagccacacgtggatctcggggaattcatcggcagttccgagacggaagaccccgtgctggccatgacagacgccggacagtctacagaggaggtgcaggcaccccttgccatgtgggaggctggcattcaacacatcgaattggagaagggatcgaaggggttagggtttagtatacttgattaccaggaccctattgaccctgccagcacagtgatcatcatccggagtctggtgccaggagggatcgcagagaaagacggccgactgctccctggagatcgtctgatgttcgtaaatgacgtaaacttggaaaattcctcactcgaagaggcagtggaagccttaaagggggcaccttcaggaaccgtgagaatcggcgtcgccaagccccttccactctccccggaagaggggtacgtgtcagctaaagaggactcttttctgtacccgcctcacagttgcgaagaagctggactggctgataagccactctttagagctgatctcgctctcgtcggtacgaacgacgcggatttagttgatgagagcacgttcgagagtccatacagccctgaaaacgatagtatttacagcacccaagccagtattctgtctctgcacggctcaagttgcggggacggcctgaactatggctcctccctgccctcttcacctccaaaggatgtcatcgagaacagctgcgatcctgtacttgacctccacatgtctcttgaagagttatatacccagaatctgcttcagcgccaggacgagaacaccccgagcgtggacattagcatgggcccagcctccgggttcaccattaatgactatacacccgctaatgctatcgagcagcagtatgagtgcgaaaatacgatcgtgtggacagagtcccacttgccgtctgaggttatcagcagtgctgagctccctagtgtgctccctgactcggcaggcaagggctccgaataccttttggagcaatcaagccttgcatgcaacgccgagtgcgtcatgttgcagaacgtttccaaagaaagcttcgaaaggaccattaacatcgcgaaaggaaactcatctctggggatgacggtctctgctaataaggacgggcttgggatgattgtacgcagtatcattcacgggggagccatctcccgcgatggccgtattgctattggagactgtatactttcaatcaatgaagaaagtactatctccgtgacaaacgcccaggcccgtgctatgctcaggaggcactctctcattggccctgatatcaagatcacgtatgtccccgctgagcatcttgaggaattcaagataagcttgggccagcagtcaggcagagtgatggccctagacatttttagcagttacaccggacgggacattccagagcttccggaaagggaggagggggaaggagaagaatctgaactgcagaatactgcttactccaactggaatcagccacgtcgcgttgagctctggagagaacccagcaaatcactgggcatttctatcgtgggcggtagaggcatggggtcaagattaagcaacggcgaggtcatgagggggatctttattaagcacgtacttgaggactcccctgcagggaaaaacgggactctcaagcccggtgatcggatcgtggaagttgatgggatggacttgagagatgcaagtcacgaacaggctgtggaggccattcgaaaggctgggaatcctgtggtttttatggtccaatccataatcaacaggccaagagcaccctcccagtcagagtccgagcctgaaaaagcaccgttatgcagtgtgccaccgccacccccaagcgctttcgccgagatgggcagtgaccacactcaatcgtctgcatccaagataagccaagacgttgacaaggaagacgagttcggatatagttggaaaaacatacgcgagagatatggaacactgacaggcgagcttcacatgattgaactggagaaggggcacagcgggttaggcctcagcttagcaggcaacaaggacagatctcggatgagtgtgttcattgtgggtattgatcccaacggagcggcaggaaaagatgggaggctgcagatcgccgatgaattgctcgagatcaatggtcaaattttgtacggccgatctcaccaaaacgcctcaagtatcatcaagtgcgcaccttccaaagtcaagatcattttcattagaaataaagatgctgtgaatcagatggccgtgtgcccgggaaacgccgtagaacccctcccttccaattctgaaaacctccagaataaagaaactgagcccacagtgacaacatctgacgccgctgtggatctgagtagcttcaagaatgttcagcacctcgagttgccaaaagatcagggcggtttgggtatcgctattagtgaggaagataccctgagtggagttattataaagagtctgacagagcacggggtggctgccaccgatggaaggttgaaggtcggcgaccagatcctggccgtcgacgatgagattgtggtggggtatcccatagaaaaattcatttcgttactgaaaactgccaagatgacagtgaaactgaccattcacgccgagaaccccgacagccaagccgtaccatctgccgcaggcgctgcctctggcgaaaaaaagaatagcagccaatcactgatggtgccccagagtggaagcccagaaccggaaagcatccgaaacacttcccgcagctccactccggctatcttcgcttcagatcccgctacttgccctataattccaggatgcgaaacaaccatagagattagcaagggtcgtaccggcctcggcctgtctattgtcggtgggtctgacaccctgttgggtgcaatcattatccatgaagtctatgaggagggcgctgcctgcaaggatggtagattgtgggccggtgatcagatcctggaagttaacggtattgatctgcggaaggcaacccatgacgaagcaatcaatgtcctccggcagactcctcagagagtgaggctgacactctacagagatgaagccccatacaaggaggaagaggtgtgcgataccttaacaattgagcttcagaaaaaaccgggaaaaggcctgggattgagcatcgtgggcaagagaaatgacacaggcgtgttcgtctctgatatcgtgaaagggggaattgccgatgctgatggacgcctgatgcaaggcgatcagattcttatggtcaacggcgaggatgtgaggaatgccacacaggaggccgtggctgcgttactgaaagtatccgaggggtcgcttagcagtttcaccttcccgctatccggaagcagtaccagcgagagtctggagagtagctccaagaagaatgcattagcatccgagattcaaggactgagaacagtggagatgaaaaagggccctacagactcgttagggatctccattgctggtggcgtgggcagtcccctcggagatgtccctatttttattgccatgatgcaccctacaggagttgccgctcagactcagaaacttcgggtcggcgaccgaattgtgactatctgtggaaccagcaccgaggggatgacccacacacaagccgtgaaccttctgaagaatgctagcggcagcatcgagatgcaggttgtggccggaggagatgtgagtgtagtgacaggacaccagcaggagcccgcttcaagtagcctgtctttcacaggtctgaccagcagcagcatttttcaggatgatctgggtccgccacagtgtaagtcgattacactggaaagaggcccagatgggctcggctttagcattgtggggggatacggctccccccacggggacctaccaatttacgtcaaaaccgttttcgcaaaaggcgcagctagcgaggacgggcgtctaaaacgcggtgaccagatcattgcagtaaacggccaatctctggagggcgtaacgcatgaggaagcagtagccatcctgaagcgaaccaaagggactgtaacactgatggtcctgtcata

SEQ ID NO: 231192 - DNA, 1089 bp, Artificial Sequence
  Description of Artificial Sequence: Synthetic coding sequence
atggagacagacgcgccacagcccggactcgcatctcccgacagcccgcatgacccttgcaagatgtttatcggtgggctgtcctggcagaccacacaggagggtcttcgggagtattttgggcagtttggcgaggttaaagagtgtctggtgatgagagaccctctgacgaaacgcagtcgtgggttcggattcgtcacatttatggaccaggcgggagtggacaaggttttagcccagtcccgacatgagctcgattccaagaccatcgatcctaaggtggcgtttcctagacgggcacagcctaagatggttacccgcactaaaaaaatcttcgtgggcggtttaagtgtgaatacaaccgtggaggatgtcaaacagtatttcgagcaattcggcaaggtagacgacgcaatgcttatgtttgacaagactacgaaccggcacagggggttcggcttcgtgacattcgaatccgaggatattgtggagaaggtgtgtgagatccatttccatgagataaataataagatggtagaatgcaagaaggcacagccgaaagaagtgatgtctcctacaggcagtgccagagggagaagtagagtaatgccatacggaatggatgcattcatgctggggatcggcatgttaggctaccctgggttccaggcaaccacttacgcatcaagatcttatactggcctagctcccggatatacctaccaatttcccgaattccgcgtggagcgcacccccctcccctcagcgccagttctgccggagcttaccgctatccctctaacagcgtatggtcccatggccgcagcagccgctgccgctgccgtggtgcgcggaacgggctcacatccctggacaatggctcctccccctggaagcacaccttcacgaacaggaggcttcctggggacgacctcgccgggaccaatggcggagctctatggcgctgctaaccaggactcaggggtgagctcctacataagtgccgcttctccagcgcctagcacaggattcggacactctctcgggggacctctgattgccacagctttcaccaacggttatcactag

SEQ ID NO: 231193 - DNA, 627 bp, Artificial Sequence
  Description of Artificial Sequence: Synthetic coding sequence
atggcaacatcagcggttccctctgataaccttcccacttacaagctcgtagtggtgggcgatggcggagttggcaaaagcgcattgacaatccagtttttccagaagatatttgtacccgactacgatccaaccatcgaggattcctacctcaaacatactgaaattgacaatcagtgggccattctcgacgtgctcgatactgcaggacaggaggagttttccgctatgagggagcaatatatgcgcactggggatggcttcctcattgtgtatagcgtcaccgacaaagccagctttgaacatgtcgaccggtttcaccagctcatcctacgcgtgaaggatcgggagagttttcctatgattcttgtggccaacaaagtggacctcatgcatcttcgcaagatcacacgagagcaagggaaggagatggctactaaacacaatattccttacatcgaaacttcagctaaggaccctcctttgaatgtggacaaggctttccacgacctggttcgcgtgattcggcagcagattccagagaagtcacagaagaagaaaaaaaagaccaagtggaggggtgatagagcaactggtacacacaagctccaatgtgtgatactgtag

SEQ ID NO: 231194 - DNA, 627 bp, Artificial Sequence
  Description of Artificial Sequence: Synthetic coding sequence
atggcaacaagtgccgttcccagtgacaatctgccgacttataagcttgtggtggtgggagacgggggagtgggaaagtccgctcttactatccagttcttccagaagatatttgtgcccgactacgacccaaccatcgaggatagttacctaaagcacactgagattgataatcaatgggcgattctggatgtcctagacactgcaggacaggaagagtttagcgccatgcgtgaacagtacatgcgcaccggtgacggtttccttattgtatactccgtgactgataaggcctcgttcgagcacgttgatcgcttccatcagctgattctgagagtaaaggacagggagtctttccccatgattctagtcgcaaacaaagttgacctgatgcaccttcggaaaatcacacgggagcaagggaaagaaatggctactaagcacaatattccatacattgaaaccagcgcaaaggacccaccactcaacgtggacaaagcattccatgatctcgtaagggtgatacgtcagcagattcccgagaaatctcagaagaagaaaaaaaagaccaagtggagaggggatcgggcaacaggcacgcataaactccagtgcgtgatcctgtag

SEQ ID NO: 231195 - DNA, 399 bp, Artificial Sequence
  Description of Artificial Sequence: Synthetic coding sequence
atgagggaacagtacatgcggactggggacggtttcctgatcgtctatagcgttacagataaagccagtttcgagcacgtggatcgatttcaccagctcatactgcgggtgaaggacagggaatctttccccatgattctggttgcaaataaggtagacctcatgcaccttaggaaaatcacccgggaacaggggaaagagatggcaacaaagcacaatattccctatatcgaaacatcagctaaggaccctcctctgaacgtggacaaggcattccatgatctggttcgggttattaggcagcagataccagagaagagtcagaaaaaaaagaaaaagactaaatggcgaggagatcgagctactgggacccacaaattgcagtgcgtgatactgtag

SEQ ID NO: 231196 - DNA, 627 bp, Artificial Sequence
  Description of Artificial Sequence: Synthetic coding sequence
atggcaacatctgccgtgccctctgacaatttgcccacatacaaattagtggtcgtcggcgatggcggagtaggtaaatctgcccttactatacaattctttcaaaaaatctttgtccctgattatgacccgacaattgaggattcttaccttaaacacactgaaatagacaaccaatgggcaatccttgatgtgctcgatactgcgggtcaggaggagttttctgccatgcgagaacaatacatgcgaacaggtgatggatttctgatcgtgtattctgtcaccgacaaggcctcattcgaacacgtggaccggttccaccagctaattcttcgggtgaaagaccgagagtccttccctatgattttggtggcaaataaggtggacctgatgcacttgcgcaaaattacaagagaacagggaaaagagatggctacgaagcataatatcccatacatcgagacaagcgctaaggacccaccactgaatgtggataaggccttccatgacttggtcagagtaatccggcagcagatacccgaaaagtcacaaaaaaaaaaaaagaagaccaagtggcggggagatagggccacaggaacccataaactacagtgtgtgatcctctag

SEQ ID NO: 231197 - DNA, 72 bp, Artificial Sequence
  Description of Artificial Sequence: Synthetic coding sequence
atggccacttccgccgtgccatccgataatttgcctacatacaagttagtggtagtgggggacggaggttag

SEQ ID NO: 231198 - DNA, 2628 bp, Artificial Sequence
  Description of Artificial Sequence: Synthetic coding sequence
atgcgagaactagtcaatataccactggtgcacattttgacactggtcgccttctcagggacggaaaagctcccaaaggcacccgtaatcaccacccctctggagaccgtggacgccctggtcgaggaagtcgccactttcatgtgcgccgtcgagagctatccccagccagaaatttcttggaccagaaacaagatcctcatcaagctgttcgacacgcgatactcgattagggaaaatggccagctcttaacaattctctcggtagaggattctgacgacgggatatattgctgtaccgccaataacggggtgggtggggctgtggaaagctgtggtgctctccaggttaaaatgaaaccaaagattacccggcctccgattaacgttaagattattgagggcctgaaagccgtgcttccatgcacaacaatgggcaaccctaaacccagcgttagctggattaaaggcgacagtccattgcgcgaaaactccagaatagccgttctggaaagcggcagcctgcggattcacaatgtacagaaggaggatgctggtcagtatcggtgtgtggcaaaaaattcgctgggtacggcttacagcaaggtcgtgaaactggaggtggaggtgtttgcacgcattttgcgcgctccagagtctcataacgtaaccttcggaagcttcgtgacgctccattgcacagcaaccggtatccctgtgccaacaattacatggattgagaacggtaatgctgtgagcagcgggagtatccaggagagtgtcaaggaccgggtgattgactctagactccagttattcattacaaaacctggactctacacctgcatcgccactaataagcacggagaaaagttttctactgctaaggcagctgctaccatctcgatcgctgagatgttattcatctctagtttctcgaagcctcagaaagacaacaaaggttattgtgcacagtatcggggagaggtatgcaacgccgtcttggccaaagatgccctcgtgtttctcaataccagctatgcggacccagaggaggcccaggagctccttgtccacaccgcatggaacgagctgaaggttgtaagccctgtctgccggccagcagctgaggcgctgctatgtaatcatatttttcaggaatgctcccctggcgtggtgccaacacccatacccatctgtcgcgagtattgcctggccgtcaaagaacttttctgcgctaaggaatggctggtcatggaagaaaagacccaccggggactgtatcggtccgagatgcacctcctctcagtgcccgagtgctctaaactgcctagtatgcattgggatcccactgcttgcgcccgattaccgcatcttgattataacaaggagaatctgaagaccttccctccgatgacctcctctaagcccagcgtcgatatcccaaacctgccaagtagctcaagctcatctttcagcgtgtcaccaacttactccatgaccgtcatcattagtataatgtcatcttttgctatcttcgtcctcctcacaattactaccctatactgctgtaggcggcgaaagcagtggaaaaacaagaagcgtgaatccgctgctgtgacactgaccactcttccttcagagttactcctggaccgcctgcatcccaaccccatgtaccagaggatgccactgttactgaaccccaaacttctgtcactcgagtaccccaggaacaacatcgaatacgttagggacatcggagaaggtgcctttggacgagtgtttcaggccagagcccctggcctgctaccctacgaaccattcacgatggtcgccgtgaaaatgctgaaggaggaagcatctgctgacatgcaggctgacttccagagagaggccgcactgatggccgaatttgacaaccccaacatcgtaaaacttctcggcgtgtgtgccgtgggaaaacctatgtgtttactgtttgagtatatggcctatggtgacctcaacgagtttctgcgttctatgagcccacacactgtctgctccttgtcccactcggacctgagtatgcgggcacaggtgtcatcacccggtccccctccactttcctgcgccgagcaactgtgtatcgctcgacaggttgcggcaggtatggcctacttgtcagagcgcaagttcgtccacagggacttggccacccgtaactgtctggtgggagaaaacatggtggttaagatcgcagatttcggcctgtccagaaacatctacagcgccgactattacaaagctaacgagaatgatgccatccctatccgttggatgcctccggagagtatcttttacaaccggtataccacagaatcggatgtgtgggcatacggggtggtgctttgggaaatcttttcctacggcctgcagccttattatggcatggcccatgaggaagtcatttattacgtcagggacggcaacatacttagctgccctgagaactgtccggtcgagctttacaacctgatgagactgtgctggagtaaattgcccgctgatcggcctagcttcacaagcattcatagaatcctggaacgcatgtgtgagagggctgaggggaccgtcagcgtctag

SEQ ID NO: 231199 - DNA, 570 bp, Artificial Sequence
  Description of Artificial Sequence: Synthetic coding sequence
atggctggaaatgggcgtgaggatccccagcggacacttcagattagagatgccttcgccgtgagggcgcgaatgcagcaggcttcacagcatgcattgggaccacacggtttatgccaaaccgcaacttccagggagtccgccgctgtcactctaaccacactgccttcagagctactactagacaggctgcacccaaatcctatgtatcagcgtatgcccttgctgctcaaccccaaactcctgagcttggagtatcctcgcaataacatcgagtatgtgcgggatatcggagaaggagcttttgggagagtttttcaagcccgtgccccaggattactcccttatgagccctttactatggtcgcggtaaaaatgctgaaagaggaagcgtctgctgatatgcaggctgattttcagcgagaagcagcattgatggcggagttcgataatcccaatattgtgaagttgctgggcatgaaaattcaggtgcgcatttgcatcagtagcgagaacagagggtttccctcattctctccccttgtgagagccttctcgttctcaccctag

SEQ ID NO: 231200 - DNA, 351 bp, Artificial Sequence
  Description of Artificial Sequence: Synthetic coding sequence
atgaaacctaagatcaccagaccaccaattaatgtgaaaatcattgagggcctgaaggctgtgcttccttgcaccactatggggaatccaaaaccaagtgttagttggatcaagggagattctcctctacgcgagaatagccgtatcgcagtgctcgagtccggatccctgcggatccacaacgtgcagaaagaggatgctgggcagtacagatgcgtggctaaaaatagtttgggaaccgcctattcaaaggttgtaaaactggaagtggagggagccaagggcatccatacacagtttgtcgctagcgcactgcagctgcgctccttcctgtcgtgcccacaaatctag

SEQ ID NO: 231201 - DNA, 351 bp, Artificial Sequence
  Description of Artificial Sequence: Synthetic coding sequence
atgaagcctaagataactcgccctcccatcaatgttaagataatcgaaggcctgaaggcagtgctgccatgtaccactatgggcaatcccaagccatcagtgtcatggattaagggcgatagtcctctccgcgaaaatagtcgtatcgctgtgctcgagagcggttcactgcgaatccacaacgtacaaaaagaggatgcaggacagtatagatgcgtggcaaagaattctctggggacagcttacagcaaggttgtcaaattggaggttgagggtgctaaaggaattcatacccagttcgtggccagcgcattgcaactcagatctttcctgtcctgcccccagatatag

SEQ ID NO: 231202 - DNA, 570 bp, Artificial Sequence
  Description of Artificial Sequence: Synthetic coding sequence
atggctgggaatgggagagaggatcctcagagaacacttcaaattcgtgatgccttcgcggtcagggccaggatgcaacaggcctctcaacacgcactagggccacacggtctctgtcagactgccacctcccgcgaatcagcagctgtgaccctgacaacactcccgagcgagcttctgctcgaccgactccatcccaatcctatgtaccagcgcatgcccctgcttctcaaccccaagctattgtcacttgagtacccccgtaataatattgagtatgtgcgggacattggagaaggggctttcggacgagttttccaggcccgtgccccaggcctgctcccatacgagccgtttacaatggtggcggttaagatgttgaaggaggaggccagcgcagacatgcaggctgatttccaacgggaggccgctctgatggcggagttcgataatcctaacatagtcaagcttctgggaatgaaaattcaagtacggatctgcattagtagcgaaaaccggggatttcctagctttagccctttggttcgagccttttccttctccccttag

SEQ ID NO: 231203 - DNA, 2352 bp, Artificial Sequence
  Description of Artificial Sequence: Synthetic coding sequence
atgcgagagttagtgaacatccctctggtccatatattgactctggtggcttttagtggaaccgagaaactgcccaaggccccagtcatcaccacccctctcgagaccgtggacgctctggttgaagaggtggcaaccttcatgtgtgccgttgaatcctacccccaacccgagatctcctggaccaggaataagatcttgattaagctcttcgacaccagatattcaatccgcgaaaacggccagctgctgaccatcttatccgtggaggacagtgacgatgggatctactgttgtaccgctaacaacggagtgggcggagctgtggagtcgtgcggggctctgcaggtgaagatgaagccgaagatcacccggcctccaatcaatgtcaagatcattgaggggctgaaagcagtgcttccatgcactactatggggaaccccaagccatcggtgtcctggataaaaggcgattctcccctgcgggagaattcacgaatagccgtgcttgagagcggctcactcaggatacacaatgtgcagaaggaagatgctggacagtacaggtgcgtggccaaaaactccctcggtactgcttacagcaaggtggtgaaacttgaagttgaggaagaaagtgagcccgaacaggacactaaagtattcgctaggattctgcgagctccagagtcccacaatgtcacctttggcagtttcgttactctgcattgcacggctaccggcattcctgtccccacaattacctggatcgagaacggcaacgccgtatcctcaggtagcatacaggaaagcgtgaaggaccgggtcatagactcaagattgcaacttttcataaccaaaccaggattatacacatgcattgcaacaaataagcacggcgagaagttttctactgctaaagccgctgccaccatctcgatcgcagatttccgagagtattgccttgccgtgaaggaattgttttgcgccaaagaatggttagtgatggaggaaaagacacataggggactttaccgctcagaaatgcacctgctgtcagtcccggagtgttctaaactgccgtccatgcattgggatcccacagcctgtgcccgtctcccccacctcgcttttcctcccatgacatcatcaaagccttcggtcgatattccgaatctaccctcctcctcatcctcatcttttagcgtgtctcctacctactccatgaccgtaatcatcagcatcatgagtagtttcgctattttcgtgctgctgacaatcactaccctatattgttgcaggcggcgaaaacagtggaagaataagaagagggagtccgccgcagtgactttgactaccctaccaagtgagttgttgctcgaccggcttcatcctaatcccatgtaccagcggatgccactgttactcaatccaaaactcctgtcactggagtatcctagaaataatatagagtacgtcagagacatcggcgagggtgcctttggccgtgtgtttcaggccagggcaccagggcttctgccttacgaaccatttacgatggttgccgtcaagatgttgaaggaggaggcctccgcggatatgcaggcggactttcagcgcgaagccgcactgatggctgagtttgataatcccaatatagttaaactgctcggggtctgcgccgttgggaaaccgatgtgcctgctgtttgagtatatggcctatggagacctgaatgagtttctgcgctcaatgagcccgcatacggtgtgctctctgtcccattcagatctgtccatgcgcgcacaggtctcgtcccctggacctcctcccctgtcgtgtgcggagcaattgtgtatcgctagacaggtggccgctggcatggcttacctcagcgaacggaagttcgtgcaccgcgacctggccacacgcaactgtctggtgggcgaaaatatggttgtgaaaatcgcagacttcggactgagtcgcaatatctattcagccgactactacaaagccaacgaaaacgatgcaattcccatcaggtggatgcccccagagagcatattctacaatcgctacacaactgaatccgatgtctgggcgtacggggtcgtgctctgggagatcttctcctacggactccagccctactatgggatggcgcacgaagaagtgatttactatgtgcgagacgggaatattctctcttgtccagagaactgccctgtcgaattatacaacctcatgcggctgtgttggtcaaagttaccagccgatcgtccgagttttacttctatccaccgcattttagaaaggatgtgtgagcgagccgagggtacagtgagcgtctag

SEQ ID NO: 231204 - DNA, 2610 bp, Artificial Sequence
  Description of Artificial Sequence: Synthetic coding sequence
atgagagaactcgttaacatacctctcgtccacatcctgacgctggtggcattcagcggaaccgagaaactcccaaaagctcccgtcattacaactccactcgaaaccgtggacgcccttgtcgaggaagtggccacatttatgtgcgctgtagaatcctaccctcagcccgagatttcctggactcggaacaagatcttgattaaactgtttgacacccggtattccatccgagagaacggacagctcctgacgattcttagtgtggaggattccgacgatggcatttattgctgcaccgcgaacaacggcgtgggaggcgcagtcgaatcctgcggagccctccaagtgaagatgaaaccaaaaatcactagacccccaattaatgtaaaaatcatagagggacttaaggcagtcctcccctgcaccaccatggggaatcccaagcctagcgtcagttggattaaaggcgatagccctctcagagagaactctcgcattgccgttctggaaagcggaagcctgaggattcataatgtgcagaaggaagacgccggacaataccgctgcgtggcgaaaaattctctgggaacagcatactcaaaggtagtaaagttggaagtagaggtctttgcccgaatcctgcgcgctccagaatcacacaacgttacatttggctctttcgttaccctgcactgcaccgccaccggcatcccagtgcctacgattacatggatcgaaaatggcaacgcggtgagctcagggagcatccaggagtcggtgaaagatcgggttatcgacagccggctacagttgttcataaccaaacctggcctttacacctgtatcgcaaccaacaagcacggagaaaagttctcaaccgccaaagccgcagccactatcagcattgctgagtggagtaagccccagaaggacaataaggggtactgtgcacaatatcgcggagaggtttgcaacgccgtgcttgccaaggatgctctcgtttttctgaacacgtcctatgcagatccagaagaggcgcaggagctcttagtacacaccgcttggaacgagctaaaggttgtaagtcccgtttgtaggcccgcagctgaggccctgctctgcaatcatatcttccaggagtgctccccaggagtcgttccaactcccatcccaatatgtcgcgaatattgtcttgcagtgaaagaactgttctgtgctaaggaatggttagtcatggaggagaagactcacaggggactttatagatctgagatgcacctgctgagcgttccagagtgttccaaattgccatccatgcactgggatcccaccgcatgcgcccgattgccccacctcgactataacaaagagaacctgaagacctttccaccaatgacctcttccaagccctctgtggacatcccaaacctgccttccagcagctcatcttccttcagtgtgtccccaacttattcaatgactgtaattatctccatcatgtccagctttgccatttttgtactacttaccataactaccctgtattgctgtcgaaggcggaaacagtggaagaataagaagcgcgagagtgctgcagtgactttgactacccttccttcagagttactgctcgatcgcctgcaccctaatcccatgtatcaaaggatgcctctcctgctgaacccaaaactcctgagcctggagtatccacgaaataatattgaatacgttagggatatcggagagggggctttcggcagagtcttccaggcacgtgcccctggtctgctcccatacgagccttttacaatggtagcagttaaaatgctgaaggaggaggcctcagcagatatgcaagcagatttccagagggaagccgcactgatggcagagtttgacaatcctaatattgtgaagctgctcggtgtatgtgctgtgggcaaaccaatgtgcctgctgttcgagtatatggcatatggggatctgaatgaatttcttagatccatgagcccccatacagtctgctctttaagccactctgatctgagtatgcgggcacaggtgagttctcctggtccacctccgctgtcctgcgctgaacagctgtgcatcgcacgtcaggttgccgcagggatggcatacctttctgaaagaaaatttgtacatagggacttggctacaagaaactgcttggttggtgagaacatggtggtgaaaatcgcagacttcggattgtcaaggaacatttattcagcagattattacaaagccaacgagaacgacgccattccaattcggtggatgccgcctgaatccatcttttataacaggtacactaccgagtcagacgtgtgggcctacggcgtggtgttgtgggagatcttcagctacggattgcagccttactacggcatggcacacgaagaggtaatttattacgtgagagacggcaacattctgtcctgccccgaaaattgtcccgtggaattgtataatctgatgcgcttgtgctggtcaaagctgccagctgacaggcccagctttacctcaatacatcggatattggaacggatgtgtgagcgggctgagggcaccgtgagcgtgtag

SEQ ID NO: 231205 - DNA, 2604 bp, Artificial Sequence
  Description of Artificial Sequence: Synthetic coding sequence
atgcgcgagctagtgaatatccccctggtacacattctgacactggttgctttctccgggacagaaaagctgccgaaggctcctgtcataactacacctttagagaccgttgacgcgctcgtggaagaagtggccacatttatgtgcgctgttgaaagttatccgcagcccgaaatcagctggacccggaacaaaattctcatcaagctgtttgacacccgatactcaattcgggagaatggacaactcctgaccatcctctctgtagaggactccgatgatggtatttactgctgtactgctaacaatggggtgggcggagccgtggagagttgtggtgctttgcaggtgaaaatgaagcccaaaattactagaccgccaatcaacgtgaagatcatagagggacttaaagcggtattgccctgtacaactatgggtaatcccaaaccatcagtctcatggattaaaggagatagccccttacgagagaactccaggatcgccgtgctggagtcaggaagccttaggattcacaatgtccagaaagaggacgcaggccagtacaggtgcgtcgccaaaaacagcctgggtacagcttactccaaagtggttaagttagaagtggaggtcttcgctaggattctcagagccccagaaagccacaatgtcacctttggttccttcgtgaccctgcactgtacggccacgggaattcccgttcctaccatcacatggattgagaatggaaacgccgtgtcatccggaagtattcaggaatctgtgaaagatagggtcatcgattctcgcctacaactatttattacaaaacccggtctgtatacgtgtattgccaccaacaaacacggggagaagtttagcactgctaaggcggctgccaccatctccatagccgagatgttgtttattagctccttctcaaaacctcaaaaggacaacaaaggatactgcgcccagtatcgaggagaggtgtgtaatgcggttttggcaaaggacgcattagtgtttttgaacacttcatacgcagaccctgaagaagcccaggagctactcgttcacacagcttggaacgaactgaaggtggtatcccctgtgtgtcgtccagcagccgaagcccttctctgcaaccacatctttcaggagtgttcacccggagttgtgcccactccaatcccgatctgccgcgaatactgcttagctgtgaaagagttgttttgtgccaaggaatggctggtcatggaagaaaagactcatcgcggactctatcgctcagaaatgcatttacttagcgtgcctgaatgcagcaagctgccctccatgcattgggatcctaccgcctgcgcacgccttccgcacctcgcttttcctccaatgaccagcagtaagccatcagtggatatacctaatttgccctcctcttcctcgtcctcgttcagtgtctcgccaacgtatagcatgaccgtcattatctcgattatgtcatcgttcgccatattcgtcctgcttacgataaccactttatactgctgccgacgccgtaagcagtggaaaaataaaaagcgagagagcgctgccgttactctgaccaccctcccttcggaactgcttctcgatcgcctgcatcccaaccctatgtaccagcggatgcctctcctcctgaaccctaaactgttgtctcttgagtacccgcgtaataatattgagtatgtgagagatattggggagggcgcttttggcagagttttccaagccagggcgcctggactattaccctatgagcccttcaccatggtagctgtgaaaatgctcaaagaagaggcctcggcagatatgcaggccgactttcagcgggaagccgctttgatggccgagtttgataatcccaacattgtgaagctgctcggagtctgtgcagtgggcaagcccatgtgcctcctgttcgaatacatggcatatggagacctaaatgagttcctgcggagcatgtcaccccacaccgtgtgttccctgtcccactcggatcttagtatgcgggctcaggttagctccccgggtccgcctcccctgagctgtgctgaacagctgtgcattgccaggcaggttgccgcagggatggcatacttgagcgaacggaagtttgtacatcgggacctggccactcgcaactgcttggtcggggaaaacatggtagtgaagattgctgactttggcctgtctcgcaacatctattctgccgactattacaaggctaatgagaacgacgctattcctatcaggtggatgccacctgagagcattttctacaacaggtacactaccgagtctgatgtttgggcttatggtgtcgtgctgtgggagatcttttcctatgggcttcagccctactacgggatggctcatgaagaagttatctactatgtgcgagatggcaatatcctttcctgccctgagaactgtcctgtggagctgtataatctgatgcgcttgtgctggtctaaactgcccgctgaccgacccagctttacctccattcaccggattcttgaaagaatgtgcgagagggccgagggaacagtgtccgtatag

SEQ ID NO: 231206 - DNA, 2610 bp, Artificial Sequence
  Description of Artificial Sequence: Synthetic coding sequence
atgcgggaattggtgaacattcctctggtgcatattctgacactagtggcttttagcggtacagaaaaattacccaaggccccagtaattaccacacctttggaaaccgtggacgctctagtggaggaggttgccacctttatgtgtgcagtcgagtcctatccccagccggagatttcatggactcgcaacaagattctgatcaaactctttgacaccagatacagtattcgcgagaacggccagctgttgacaatcttgtctgtcgaagacagtgacgacggtatttattgctgtaccgcaaataatggcgtgggcggagctgtcgaatcatgcggggctcttcaggtgaaaatgaaacctaagattaccagacccccaattaatgtaaagatcatagagggcctcaaggccgtcctgccctgtactactatggggaatcccaagccaagtgtaagctggatcaaaggagacagcccactgcgtgagaacagcagaattgccgtgcttgagtcagggtctctgaggatccacaatgtgcaaaaagaagatgcaggacaatatcgatgtgtagcgaaaaacagtttgggaacagcctactctaaggtcgttaagctggaggtggaggtgtttgccaggatcctacgtgcacccgagtcccataatgtaacattcggcagctttgttacccttcattgcacagccaccggcatccctgtgccgaccattacctggatcgagaatggtaacgccgttagctctggctccattcaagaatcagtgaaggacagggtcattgattctcgcctgcagctgttcatcaccaagcccggtctgtatacctgcatagctactaacaagcatggagaaaagtttagcacagcgaaggcagctgcgaccatttcaatagccgctttcagtaaaccccagaaggataataaagggtattgcgctcagtacaggggagaggtttgtaacgcagtcctggccaaggatgctttagtattcctgaacaccagttatgctgatcctgaagaagcacaagagttgctggtgcacaccgcatggaatgagcttaaagttgtcagtcccgtgtgtagacccgctgcggaggctttgctgtgcaatcacatctttcaggaatgctctccaggggtcgtacctacgcctatccccatatgcagagagtattgtttggctgttaaagagctgttttgcgctaaggaatggttggtgatggaggaaaagactcataggggcctgtacaggagcgaaatgcacctgctgtccgtacccgagtgtagtaaacttccatctatgcactgggatccaactgcctgtgcaaggctgcctcacctcgactacaataaagagaaccttaagacatttccaccgatgaccagctccaagccctctgtggatatcccaaaccttccctcatcatcctctagctcattctcagtatctccaacatacagcatgactgttataatctcgataatgtcttctttcgcaattttcgtcctgctgaccatcaccactttgtactgctgtaggagacggaagcagtggaagaacaagaagagagaaagcgctgcagtgacactgaccaccctgccctctgagcttctcctggacaggctgcaccccaatccaatgtaccaacggatgccattgctccttaatcctaaacttttgtctctggaataccctcggaataacatcgagtacgtccgggatatcggcgagggtgccttcggcagagtcttccaggcgagagcaccagggcttctcccttatgagccatttacaatggtcgccgtcaagatgctcaaggaagaggcttctgccgatatgcaagcagatttccagagagaagcagcactcatggcagagttcgacaatcccaacatagttaagttgctgggggtgtgtgctgtggggaagcctatgtgcctcctgtttgagtacatggcctacggtgacttgaacgaattcttgcgatctatgagccctcatacggtatgctccctctctcactccgatcttagcatgcgcgctcaggtatcttcccctgggcctcctccattgtcctgtgcggagcaattatgcatcgcacgacaggtcgcggctggaatggcatatctgagtgaaagaaagttcgtgcaccgcgatcttgctactagaaattgccttgttggggagaacatggtcgtgaaaatcgccgacttcggactttctcgaaatatttatagtgccgactattacaaggctaacgaaaacgatgcgatccccatcaggtggatgcccccagagagcatcttctataatcgatacacgacagaatccgacgtctgggcatatggtgtcgtactgtgggaaatcttcagttatggtctgcaaccatactatggaatggcccatgaggaggttatctactatgtaagggatggcaatatcctgtcctgccctgaaaattgccccgttgaactgtacaatttaatgaggctgtgctggtctaagctgccagctgatcggccatccttcacatccattcaccggattttggaaagaatgtgcgaacgcgctgaaggaaccgtgtccgtctag

SEQ ID NO: 231207 - DNA, 2352 bp, Artificial Sequence
  Description of Artificial Sequence: Synthetic coding sequence
atgcgggaactggttaatatccccctggtacacatcttgacgctggtcgcgttcagcggaacagaaaaactgcccaaggcccctgtcataacaacaccgttggagactgtggatgcacttgtagaggaagttgccacctttatgtgcgctgtggagagctatccccagcccgaaatttcgtggacacggaataagatattaatcaaattgtttgacacgcggtacagtattcgggaaaatggccagctactgacgattctgagcgtcgaagattcagatgacgggatatactgctgcactgcgaataacggagtcggcggagctgtcgagtcatgtggcgcactgcaagttaagatgaaacctaagattacaagaccacctattaacgtgaagataattgaggggttgaaggccgtcctcccttgtacaacgatgggcaatcctaaacccagtgtttcgtggattaagggagactcgcccctcagagagaattccagaattgcagtcctggagagcggatccttgaggattcataacgtacaaaaggaggacgccggtcaatacagatgtgttgccaaaaatagtctgggcaccgcctacagcaaggtggtgaaactcgaggtcgaagaggagtccgaacctgagcaggatactaaggtgtttgcgcgaatcctgagagcacctgagagccacaacgtcactttcggcagttttgtaacgttacactgcaccgctacaggtattccagttcctacgattacctggatcgaaaacggaaacgccgtctcttcagggagtatccaggaaagcgttaaagatcgcgtcattgattctaggctgcagctgtttataaccaagcctgggctatatacatgcatagccactaacaagcatggggaaaaattctctactgccaaggccgctgcaacaatttcaatcgccgcttggaagaagtattgcttggccgtcaaggaactgttctgcgccaaggagtggctggttatggaagagaagacacatcggggtctctacaggagcgagatgcatcttctctctgtgcccgagtgtagcaagctaccatccatgcactgggaccccacagcttgcgctcggctgccacatctggctttcccacccatgacttcctctaaaccctcagtcgatataccaaacctcccaagctcctccagttcttccttttctgtgtcgcccacgtactcaatgaccgtgattatctccattatgagctctttcgccatctttgtcctcctaaccatcacgaccctctattgttgtcgaaggcgaaaacagtggaaaaataaaaagcgggagagtgccgcagtcacattaactaccctcccatcagagctgctgctggatagacttcaccccaatccaatgtaccagcgcatgccgctactgttgaaccccaaactcctgtctttagagtatccccgaaataacattgaatacgtccgcgacataggcgagggagctttcgggcgagtcttccaagccagagcaccgggtcttctgccttacgaacctttcactatggtggctgtaaagatgcttaaggaggaggcctccgctgacatgcaggccgatttccagagagaggccgctctgatggctgagttcgataaccccaatatcgttaaactgctgggcgtgtgtgcggtgggcaagcccatgtgcctgctctttgagtatatggcttacggtgacctcaacgagtttcttaggtctatgtcccctcacacagtgtgtagcttgagccactctgacctgtccatgcgggcacaggtgtcatcccccggaccacccccactcagctgcgcagagcagctctgtatcgctaggcaggtggctgcgggtatggcctacctgtccgagaggaagttcgtacaccgcgacctggctacacgcaactgcttagtgggagagaacatggtagtgaaaatcgctgattttggacttagcaggaacatttactcagcggattactataaggccaatgagaatgatgccatccctatcagatggatgccacccgagagcattttctataatcgctacacaacagaaagtgatgtgtgggcttatggggtggtgttatgggaaatctttagttacggactgcagccatactatggaatggctcacgaagaggtgatttattatgtccgcgatggaaacattctttcttgccccgagaattgccctgtggagctgtataatttgatgcgtctttgctggagtaaattgccagctgatcgtccatcctttacatctatacatcgaattctcgaacgcatgtgcgaaagagcagaagggacggtcagtgtgtag

SEQ ID NO: 231208 - DNA, 1167 bp, Artificial Sequence
  Description of Artificial Sequence: Synthetic coding sequence
atggccgtcagcgtgaccccgattcgcgacactaaatggttaaccctggaggtgtgccgggagtttcagcggggtacatgctcaaggccagacaccgagtgtaagttcgctcacccctccaagtcatgccaggtcgagaatgggcgagtgatagcgtgctttgattctctgaagggtcgctgtagccgagagaactgtaaatatctccacccacctccacacctgaagacacagcttgagatcaatgggaggaacaacttaatccagcaaaaaaacatggcgatgctggcacagcaaatgcaactcgctaatgctatgatgccgggtgctcctctgcagccagttcccatgttttcagtggcaccgagcttggcaaccaatgcttcagcagcagcctttaacccctatctgggtcctgtctctccttcactggtaccagctgaaatcttgccaacagcgcctatgctcgtgacaggcaacccaggcgtgcccgtaccggctgcggcagcggctgcggctcagaaactgatgcgcaccgatagactagaagtgtgtcgtgagtaccagcgagggaattgtaaccggggtgagaacgactgtcgattcgcccaccccgcagacagcaccatgatcgacacaaacgataatacagtaaccgtctgcatggattacattaagggacgctgttcccgggaaaaatgcaagtattttcacccccctgcccatttgcaggccaaaataaaagcagcccagtatcaggtgaaccaagccgctgctgcacaagcagctgctactgccgctgctatgacgcagtccgctgtgaagtctctcaagagacccttagaagccacctttgatctgggcatcccgcaggcagttctccccccattgccaaagaggcctgctctggaaaaaacaaatggagccacggctgtattcaatacggggatttttcagtaccagcaggcccttgccaatatgcagctgcagcagcataccgctttcctgccccctgtgccaatggtgcacggcgctactccagcgacagtgtccgccgcaaccaccagcgccacctctgtcccctttgctgctactgccaccgcaaatcaaatccctataatcagcgccgaacatcttacgagccacaagtacgtgacccaaatgtag

SEQ ID NO: 231209 - DNA, 909 bp, Artificial Sequence
  Description of Artificial Sequence: Synthetic coding sequence
atggccgtcagtgtcacccctatacgcgacaccaaatggctgacattagaagtgtgccgggaattccagcggggaacctgctcccgacctgataccgagtgtaagtttgcccatccttcgaaatcttgccaggtggagaatggacgcgttatagcctgcttcgacagtcttaaaggacgctgctctcgggagaactgcaaatatctccatccacccccacatctgaaaacccagctcgaaattaacggtcggaataatctgatccagcagaaaaacatggcaatgttggcccaacagatgcagctggccaatgctatgatgcccggtgcccctctccagccagtggtgtgtagggaatatcagcgtggtaattgtaatcggggagagaacgactgtaggtttgcacacccagccgactccactatgatagacactaacgacaatacagtcactgtctgcatggattatattaaagggagatgttcacgtgaaaagtgcaaatacttccatccacctgcccacctccaggccaaaattaaagccgctcagtaccaagtgaatcaggccgctgctgctcaggccgcagcaaccgcggcagccatgggcattccacaggccgtactgccgccactccccaaaaggccagccctggagaagacaaacggggcaacagccgtgttcaacaccggcatctttcagtaccagcaggcgctggcaaacatgcagttgcagcagcatacagcttttctgcccccagttcccatggtccacggggcaactccagcaaccgtgagcgccgctaccacctccgcaacctccgttcccttcgccgcaactgccaccgcaaatcagataccgatcatcagcgccgaacacctcaccagccacaaatacgtaacacagatgtag

SEQ ID NO: 231210 - DNA, 1023 bp, Artificial Sequence
  Description of Artificial Sequence: Synthetic coding sequence
atggcggtttcagttactccaatacgggataccaagtggttaacattagaagtgtgcagagagttccagagagggacctgctcgcggccagacacggagtgcaagttcgcacacccctccaagagctgtcaggtggaaaatggcagagtcatcgcctgttttgactccctgaaggggaggtgctctagagagaactgcaaatacttgcatccccctccacacctcaagacccagctcgagatcaatggaaggaacaacctgattcaacagaagaacatggctatgctcgctcagcagatgcagcttgctaatgcaatgatgccgggtgcgccactgcaacccgtgcccatgttttctgtcgctccatccctagcaacaaacgcatctgccgctgcgttcaacccctatcttgggccagtaagcccctcactggttcctgctgaaatattgccaaccgcccctatgttggtgaccggcaacccgggagtgccagtcccggcagctgctgctgccgcagcccagaagctaatgcgaaccgaccgtttagaggtatgccgcgagtatcagcgtggaaactgcaaccggggtgagaatgattgcaggttcgctcaccctgctgattctaccatgattgacactaacgacaatacagtcactgtctgcatggactacattaaggggaggtgctccagagaaaagtgtaagtattttcatccgcctgcccacctacaggcaaaaattaaggccgctcagtatcaggtgaaccaggcagccgctgcccaagccgcagccaccgctgccgcaatgttcccatggtgcactgtgctgcgccaacccctgtgccctcagcagcagcatctccctcaggtgttcccctcactccagcagccccagccaacatccccaatcctggatgcatcaaccctgcttggggcaacaagttgcccagcagctgcaggcaagatgattcccatcattagtgctgaacacttaacgtctcataaatatgtgacccagatgtag

SEQ ID NO: 231211 - DNA, 1149 bp, Artificial Sequence
  Description of Artificial Sequence: Synthetic coding sequence
atggctgtttcagtgacgcccattagagatacaaagtggctgacactcgaggtgtgcagggaatttcaaagggggacttgtagcagacctgataccgagtgcaaattcgctcatccctccaaatcttgccaagtcgaaaacggtagggtgatcgcttgcttcgactccctgaaagggaggtgctcaagagagaattgtaagtatctgcatccacctcctcacctcaagacacaactggaaatcaatggccgtaacaatctcatccagcagaaaaatatggccatgctggcacagcagatgcagctggccaacgcaatgatgcccggagcgccattgcagcccgtgcccatgttctccgtcgctccctcgctggccacaaacgcatctgcggctgcctttaacccttatttgggacccgtctccccatccctggtccccgctgagattctgccgactgcccctatgctggtaactggcaaccccggagtccccgtgcccgcagccgcagctgctgccgctcagaaactgatgaggacagacagacttgaggtttgtcgagaataccagcgtggcaattgcaatcgtggagaaaatgattgcagatttgcccacccagcagacagtactatgatcgataccaacgataatacagtgactgtgtgcatggattatatcaaaggaagatgctcccgggaaaaatgtaagtactttcatcccccagcacatctccaggccaagattaaagctgcccaatatcaggtgaaccaggcagctgctgctcaggccgcagcgacagcagccgctatgggtattccgcaagctgtcctaccccctctgcctaagaggcctgccctggaaaaaaccaatggcgcaacagcagtttttaatacagggatattccagtaccagcaagcactggctaacatgcagctacagcagcacacggccttccttcctccgggttcgattctgtgcatgactcctgctacctcagtggtacccatggttcacggggctacacccgcaacagtgagcgccgctaccaccagcgcgacttccgtgccctttgccgctacagccaccgccaatcagatcccaattatatccgctgagcacctaacgagtcataagtatgtcacccagatgtag

SEQ ID NO: 231212 - DNA, 1113 bp, Artificial Sequence
  Description of Artificial Sequence: Synthetic coding sequence
atggccgtgagcgtcactccaatcagggacactaagtggctcactctggaagtgtgcagggagtttcagaggggaacttgttcacggccagacacggaatgcaagtttgcgcaccccagtaagagctgtcaggtggagaacggccgagttatcgcatgtttcgactctctcaagggtaggtgctctcgggagaattgcaagtatcttcatccgccaccccacttaaagactcagttagaaattaacggacgtaacaatctgatccaacagaagaatatggcgatgctggcccaacagatgcagcttgcaaacgcaatgatgccaggtgcgccattacagcccgttccaatgtttagcgtcgccccaagtctagctaccaacgccagcgcagcagccttcaatccgtacttaggccctgtatctccaagtctggtgcccgcagagatcctgccaacggctcccatgttagtcaccggaaaccccggtgttcccgtacctgcagcagcagccgctgccgcacagaaactcatgagaacggatcgcctggaggtttgtagggaatatcaacggggaaattgtaacaggggagaaaatgactgtcgcttcgcccatcctgctgatagcacgatgattgacactaatgacaatacggtgacggtatgtatggactacatcaaaggtaggtgttcgcgcgagaaatgtaagtacttccatccccctgcacacttgcaggccaagatcaaagcggcacaatatcaggtcaaccaggctgcagctgctcaggccgctgccactgcagctgctatgggcatcccacaagctgtgcttcctcctttacccaaacgtccggcactggagaagacaaatggggctaccgcagtcttcaacaccgggatttttcaataccagcaagcactcgccaacatgcaattgcaacagcacacagcctttctccctcctgtgccaatggtccacggtgcaacccccgcaacggtgtctgccgctaccaccagtgccacttctgtgcccttcgcagccactgccactgcaaatcagatccccatcatctccgcagaacacctcacctcccacaagtacgtgacacagatgtag

SEQ ID NO: 231213 - DNA, 1029 bp, Artificial Sequence
  Description of Artificial Sequence: Synthetic coding sequence
atggccgtgagtgtgacacccatcagagataccaagtggcttacgttggaggtgtgtagagagttccagcgagggacatgttctcggccagatacagagtgcaaatttgcacatccatccaagagttgtcaggtcgaaaatggcagggtgatcgcctgtttcgacagcctaaaaggacgatgttcccgtgagaactgtaagtatctccaccctcctccccacctgaaaactcagctggaaatcaatgggagaaataacctaatacagcaaaagaacatggccatgctggcccagcagatgcagctcgctaacgccatgatgcctggggcaccgcttcagcccgtccctatgtttagcgttgctccctcgcttgccacaaacgcgtctgctgccgctttcaacccgtacttaggcccagtctccccttcactggttccagcagaaatcctgcctacagccccaatgctggtcaccggcaaccccggagtgccggtgccagccgctgctgctgccgcagcccagaaactcatgcgcacagacaggctggaggtttgtcgcgagtatcaacggggaaattgcaacaggggcgaaaacgattgcaggtttgcgcaccccgcagactcgaccatgatagacaccaacgacaataccgtgactgtttgcatggactacatcaagggtcgttgttcacgggagaagtgcaagtacttccaccctcctgcccacctacaggccaaaattaaggctgctcaataccaggtcaaccaggctgccgcagcacaggcggctgctaccgccgctgccatgggtatcccacaggccgttctgccgccacttcctaagagacctgccttggagaaaactaatggcgcaacggcagtgtttaacaccggtatcttccagtaccagcaggccttagccaacatgcagctgcagcagcacacagcctttctccccccaggctcaatactatgtatgactcccgcaaccagtgtggatacccacaatatctgtaggacaagcgattag

SEQ ID NO: 231214 - DNA, 1167 bp, Artificial Sequence
  Description of Artificial Sequence: Synthetic coding sequence
atggccgtcagcgtgacacctatccgcgacacgaagtggctgaccctcgaggtgtgtagggagttccagagaggaacctgttctcgacccgacacagagtgcaagttcgcccacccatcaaagtcttgccaggtggaaaatggaagggtcattgcatgcttcgactcacttaaaggtcggtgctcgcgtgaaaattgtaagtacctacacccccctccccatctgaaaacccagttggaaatcaacggaaggaataatttgattcaacagaaaaatatggccatgcttgcccaacagatgcagttggctaacgccatgatgccaggtgctcccctgcagcccgtgcccatgttttctgttgcaccatccctcgctacaaatgcctcagcggctgcattcaacccatacttgggacccgtttctccttctttggtgcccgctgaaatcctcccaacggcaccaatgctggtgacaggaaacccaggcgtacccgtacccgcagcggcagcggcagcggcacaaaaactgatgcgcacagaccgcctggaagtctgcagagaataccaaagagggaattgcaatcgcggagaaaatgactgcagatttgcacaccccgctgatagcactatgattgacaccaacgacaacacggttacagtctgcatggattacataaaaggacgctgctccagggagaagtgcaaatatttccatcctcctgcccatcttcaggctaaaataaaagctgcccagtatcaagtcaaccaggctgcggctgcccaggcggctgccacagccgctgctatgacccagtccgcagtcaagagcctgaaacgtcccttggaagccacattcgacctcgggatccctcaggcggtgcttccacctctcccgaagaggcctgccctggaaaagaccaacggcgcaacagctgtgtttaacacaggtatttttcaataccagcaggccctggccaacatgcagctgcagcagcacaccgccttcctcccacccgtcccaatggttcatggtgccaccccagccactgtgtctgccgcaaccacctcagccacatctgtgccttttgctgccacggccacggctaaccagatacccatcataagtgctgaacacttgacgtctcacaagtatgtgacgcagatgtag

SEQ ID NO: 231215 - DNA, 1023 bp, Artificial Sequence
  Description of Artificial Sequence: Synthetic coding sequence
atggctgtgtctgttaccccgattcgcgatacaaaatggcttacactcgaggtgtgccgggagtttcagagaggcacgtgctcaagaccagacaccgaatgcaagttcgcacacccatccaaatcttgccaggttgagaatggaagagtgatagcctgtttcgattccctcaagggaaggtgctcacgtgagaactgcaagtacctccacccacctccacatctgaaaactcagttagagatcaatggacgaaataatcttatccagcagaaaaatatggctatgctggcccagcagatgcaactcgctaatgcaatgatgccaggcgctccactccagcctgttccaatgttttcagtggctccatccctggccaccaatgccagtgccgcagcatttaacccttacttaggcccagtgtctccttcactggtaccggctgagatcctccccaccgctccgatgctggtcacggggaatcctggagtaccggttcctgccgcagccgctgcagccgctcagaagcttatgagaactgaccgcttggaggtctgcagggaataccagcgagggaactgtaaccgtggggagaacgattgtagattcgctcatcccgctgattcaacaatgatcgatacgaacgacaatacagtgacagtatgcatggattacattaaaggcaggtgctcacgggagaaatgtaaatattttcatcccccagcacacctgcaggctaaaattaaagctgcccagtaccaggtaaaccaggccgcagctgcccaagctgccgctacagccgctgctatgttcccctggtgcacagtactacgacagcctctgtgtccacagcaacagcacctcccgcaagtgtttcccagtttacagcagccacaacccactagccccatactcgatgccagcacacttcttggggctacttcatgccctgcagctgcgggaaagatgatccctattatcagtgctgaacatctcacttctcacaaatacgtaacgcagatgtag

SEQ ID NO: 231216 - DNA, 909 bp, Artificial Sequence
  Description of Artificial Sequence: Synthetic coding sequence
atggccgtgtccgtcacgcctatccgtgataccaaatggcttactctggaggtatgtcgagagtttcaacgcggaacctgcagtcggccagacaccgagtgtaaattcgcgcatccatcaaaatcttgtcaggtggaaaatggaagagtgattgcctgcttcgactcacttaaggggagatgtagcagagaaaattgcaaatacctgcatccgccaccacacttgaaaacgcagctggagattaatggcaggaacaatctaatccagcagaagaatatggccatgttggcccagcagatgcaactcgccaacgctatgatgcctggagcccctctccagcccgttgtttgccgggagtaccaaaggggaaattgcaacaggggggagaatgactgccggttcgcgcaccctgctgatagtacaatgattgacacaaatgacaatactgtaacggtgtgcatggattatatcaagggccgatgtagccgtgaaaagtgcaaatacttccacccaccagctcatctgcaggccaagattaaggcagctcagtaccaggtcaatcaggccgctgccgcacaggccgctgcaaccgctgctgccatggggattccacaggccgtattaccccctctccctaaaaggccagcgctcgagaaaaccaatggcgctaccgccgtttttaacaccgggatttttcagtatcagcaggctctggctaatatgcagctacagcagcacacagccttcctgccccctgtgcctatggttcatggcgcaacaccagcaactgtaagtgcagcgacgacttcagccacttccgtgccctttgccgctactgctaccgccaaccagatccccatcatttctgcggaacacctgaccagtcacaagtacgttacccaaatgtag

SEQ ID NO: 231217 - DNA, 1029 bp, Artificial Sequence
  Description of Artificial Sequence: Synthetic coding sequence
atggctgtgagcgtgacccctatccgggataccaagtggctaaccctcgaagtgtgtcgcgagttccagcgagggacatgttctcggcctgatacagagtgcaaatttgcacatccgtcaaagagttgccaggtagagaatggcagagtcatcgcgtgtttcgatagcttgaagggcaggtgcagtagagaaaactgtaagtatctgcatcccccaccacacttaaagacccagctggagattaatgggagaaataacctcatacaacagaagaatatggcaatgctggcacagcagatgcaactagccaatgcaatgatgcccggagcaccactgcaacctgtccccatgttttcggtcgcccctagtctcgccacaaacgccagcgctgccgctttcaacccgtatctggggccagtcagcccgtcacttgtaccagccgaaatcctgccaaccgcccctatgcttgtgaccggaaaccccggtgtgccggttcccgcagccgctgccgcagccgcacagaaactgatgaggaccgaccgacttgaagtttgtcgggaataccagagaggcaattgcaacagaggggaaaatgattgccgtttcgcacaccctgccgactccaccatgatcgacacaaacgataacactgtgactgtgtgtatggactatatcaaggggaggtgtagccgcgagaaatgtaagtacttccaccctcctgcgcacctccaggctaaaatcaaggcagcccagtaccaggtaaatcaggcagctgcagcacaggcagccgctacagcggctgcaatgggcatcccacaagcggtgctcccccctctcccaaagagacctgccctggaaaaaactaatggcgctaccgccgtgttcaatactgggatttttcagtaccaacaggcattggccaatatgcagctccagcagcacactgcattccttccacccggatcaatcctgtgtatgacacctgcaaccagcgtcgatacccataatatttgtaggaccagcgactag

SEQ ID NO: 231218 - DNA, 1032 bp, Artificial Sequence
  Description of Artificial Sequence: Synthetic coding sequence
atgggtaggtgttctcgggaaaattgtaaatatctgcaccctccgcctcatttaaagacacagctggaaatcaatggacggaataacctgatacaacagaagaacatggccatgctcgcccagcaaatgcagctggctaacgccatgatgcctggggctccactgcagcctgtgcctatgttctccgtggccccttccctggccactaacgccagtgccgctgcattcaacccttaccttggccctgtgtctccatccctggtgccggctgagattttgcctaccgctcctatgctggtgacagggaaccctggcgtgcctgtgccggcagcggctgccgcagccgctcagaaattgatgagaaccgatcgtctggaagtatgcagagagtaccagaggggcaattgtaatcggggtgagaacgactgtcggtttgcccacccagcggacagcacgatgatcgacactaatgacaatactgtaaccgtatgtatggactatattaaggggagatgtagtcgggagaaatgcaaatactttcatccccctgcacacttacaggctaagattaaagctgctcagtatcaagttaatcaagctgcagctgcccaggccgctgccactgcagctgcgatgactcagagcgctgtcaaatctcttaaacgtccactagaagccacgtttgaccttggcattccacaggctgtgctaccccctctgccaaaaaggcctgctttagagaaaactaacggcgctactgccgtgtttaacacaggaatttttcaataccagcaagccctcgcaaatatgcagctacaacaacacaccgcctttctgcctcctggcagcatcctgtgtatgacgcccgcaacttcggtggtgcccatggtccacggggcaacccctgcaacagtgagcgcagccacgacgtccgctacgtcagttccatttgccgctaccgcgacagctaatcaaataccaatcatttcagccgagcatctcacatctcataagtatgtgacacagatgtag

SEQ ID NO: 231219 - DNA, 945 bp, Artificial Sequence
  Description of Artificial Sequence: Synthetic coding sequence
atggctgtgagtgtcacgcctattcgagataccaaatggcttaccctggaggtgtgcagggagtttcagcggggaacatgctcgagacccgacaccgagtgcaagtttgcccatcctagtaaaagttgccaagtggaaaatggcagggtgatcgcctgtttcgactcactgaaaggcagatgctccagggaaaattgtaaatatctgcacccgccaccacaccttaagactcagctggaaattaacggcagaaacaatctgatacagcaaaagaacatggcgatgctggcacaacaaatgcaactcgccaatgctatgatgcctggtgctcctctgcagcccgtagtgtgtagagaataccagcgcggaaactgtaacaggggcgaaaatgactgccgatttgctcatcccgctgatagtactatgatagatactaatgacaacacagtgacagtttgcatggactatattaagggcagatgctcacgcgagaagtgcaagtatttccaccctccagcacatctgcaggccaagatcaaagccgctcagtaccaggtgaaccaggctgctgccgctcaggccgctgccacagccgctgccatggggattcctcaagctgtcctcccgcctctaccaaagaggccagccctagaaaaaaccaacggagccacagcagtgtttaacacagggatcttccaatatcagcaggcacttgccaacatgcagctgcagcaacataccgctttcctgcccccaggttctatactgtgtatgactcctgctacctccgtggttccaatggtgcatggtgcaacacctgctacagtgtccgccgctaccacatccgcgacatctgtgcctttcgccgctaccgccaccgctaaccagattcctattattagtgcagaacatcttacctcccacaagtatgtgacacaaatgtag

SEQ ID NO: 231220 - DNA, 1005 bp, Artificial Sequence
  Description of Artificial Sequence: Synthetic coding sequence
atgaccgccgttaatgtggccctcataagagatactaaatggctaaccctggaagtgtgtagggagtttcagcgcggaacttgctcgcgcgcagacgcagactgtaaattcgctcatccaccaagagtgtgccatgtggagaatgggcgtgtggttgcttgtttcgactcgctgaaggggcgatgcacaagggaaaattgtaagtatctgcatcctccaccacacctgaagactcaacttgagataaatggtcgcaataacctgatccagcagaagactgccgcagcaatgtttgcccaacagatgcagctcatgctccagaacgcacaaatgagctcattaggaagctttccgatgacgcccagcatccctgcaaaccctcccatggcatttaacccatacatcccgcatcccggaatgggactggtgcctgccgagctcgtaccaaacacccctgtgctcatcccagggaacccgcctttggctatgcccggagcggtgggccctaagctgatgagaagcgataagcttgaggtttgtagagagtttcaaagaggcaactgcactcgaggcgaaaatgattgtagatacgcccatccaaccgatgcgagtatgatcgaagctagtgataatactgtcacgatctgtatggattatataaagggaaggtgctcacgcgaaaagtgcaagtattttcaccccccagcccacttacaggccaggctcaaagctgcgcatcaccagatgaaccactccgccgcaagtgccatggcactcactaacctgcaacttccccagcccgcttttattcctgccggacctatcctgtgcatggctcctgcctccaatatcgtgccaatgatgcacggtgcaacacccactacagtgagcgccgctaccaccccggctaccagcgtcccgttcgctgctcccacaaccgggaatcagatacctcagctatcaatcgatgaacttaatagctccatgtttgtgtctcagatgtag

SEQ ID NO: 231221 - DNA, 777 bp, Artificial Sequence
  Description of Artificial Sequence: Synthetic coding sequence
atgtttgcccagcagatgcagctgatgctgcagaacgcccagatgtcctccttggggtcattccccatgactccatcaatccctgcgaatcctcctatggccttcaatccttatattccccatcccggtatggggctggtgccagccgaactggtccccaacacgcccgtgctcatccctggcaatcctccactcgccatgccaggtgccgtgggccctaaactgatgcggtccgataaactagaggtctgtcgtgagtttcagagaggcaactgtacacgcggagagaatgattgccgttacgctcatcccactgacgccagtatgatcgaggcaagtgacaacactgtgaccatttgcatggactacattaagggtcgatgcagcagagaaaagtgtaagtactttcacccccctgcgcacctgcaggccagacttaaggcagcacatcaccaaatgaatcacagcgctgcaagtgcaatggctcttcagcctggtaccttacaactcattcctaagcgttcagcattggagaagccaaatggcgcaacgccagtgttcaaccctactgtttttcattgtcagcaagccctgacaaatctgcaacttccccagcccgctttcattccagccggtcctatcctgtgcatggcccctgcttccaacatcgtccccatgatgcatggagcaaccccaaccacagtgtccgctgctaccacccccgctacctctgtgcccttcgctgctcccacaacagggaaccaactgaagttctag

SEQ ID NO: 231222 - DNA, 915 bp, Artificial Sequence
  Description of Artificial Sequence: Synthetic coding sequence
atggaaagggcctcaaagaacttgaagggcagatgcacccgcgagaactgcaagtacctgcatcctccccctcaccttaagacccagctagaaattaatggcagaaacaatctcattcaacagaaaacagctgccgctatgttcgctcagcaaatgcagctgatgctgcagaatgcgcagatgtcctccctgggatctttcccaatgaccccttcaatcccggctaatccaccgatggcatttaacccttatatcccacatcctggaatggggctcgtgcccgctgagctcgttccgaacacgcctgtgctgatccctggtaacccccctttggcgatgcctggcgcagtgggccctaagttgatgcgatccgacaaactcgaggtctgccgggaattccagagagggaattgcacacgcggagaaaatgattgccgatacgcacatcccacggatgctagtatgatcgaggcgtccgacaatacagtgactatctgtatggactatattaagggacggtgtagccgcgagaaatgtaaatattttcatccgcctgcgcatttgcaggcaaggctcaaggcagcccatcatcagatgaatcacagcgccgcatctgctatggcactgcagcctggcaccctgcagctcatccccaaacgttccgcacttgaaaaacccaatggcgctacgccggtctttaaccctactgtcttccactgccagcaggcccttacgaaccttcagctccctcagccagccttcatccccgctggtcccatcttgtgtatggccccagccagtaatatagtgcctatgatgcatggcgcaaccccaacaaccgtcagcgccgcaacaacaccggctacgagcgtgccctttgcagcaccaacgaccggcaaccagctaaagttctag

SEQ ID NO: 231223 - DNA, 1065 bp, Artificial Sequence
  Description of Artificial Sequence: Synthetic coding sequence
atgacagcggtgaacgtagctctgattcgagatactaaatggctgacacttgaagtttgcagagagtttcagcgaggcacatgctctcgagctgacgccgactgcaaatttgcacaccctccaagagtgtgccatgtagaaaacggcagagtggttgcctgttttgatagccttaaggggaggtgtactcgcgagaactgtaagtacctccatccacctccgcatctgaagactcagctggaaattaacggtcgaaataatctgattcagcagaaaacggctgctgcgatgttcgcacaacaaatgcagcttatgcttcagaacgcccaaatgtcgagcctcgggagtttcccaatgaccccatcaattccggctaacccacctatggctttcaatccctacataccacatcccggaatgggactcgtccctgccgaactggtccccaacacgcctgtgcttatccccggaaacccccctctggctatgcccggtgccgtgggtccaaaacttatgcgctctgacaagctggaagtgtgtcgcgaatttcagcggggaaattgtactagaggcgagaacgattgcaggtatgcccaccccacagatgcctcaatgatcgaggcttccgataacactgtcactatttgcatggactatattaagggacgctgttcaagagaaaaatgcaagtacttccatccaccagcccacttgcaggccaggcttaaggcagcacaccatcagatgaaccactctgccgcatcagctatggccctgcaaccaggcacacttcagctgattccaaaaagatcagcccttgaaaaacctaacggggcaacaccagtgttcaaccctaccgtcttccattgccagcaggcactgacgaaccttcagttgccccagccagcgttcatccctgccggaccgatcctctgtatggctcccgcttcgaatatcgtgccgatgatgcatggcgctactcccacgacagtaagcgctgctaccaccccggcaacatccgtgccttttgcggctccaactacaggtaaccagctaaaattttag

SEQ ID NO: 231224 - DNA, 1029 bp, Artificial Sequence
  Description of Artificial Sequence: Synthetic coding sequence
atgactgcagtaaatgtggctttgatccgggacacaaagtggctaaccctggaagtgtgtcgcgagttccagagaggcacctgttcgcgagcagacgcagattgtaagttcgctcacccgccacgtgtctgccatgtggaaaatggccgagtcgttgcttgtttcgattcactgaaaggccgatgtacgcgggagaactgcaaatatttacatcccccaccccacctcaagactcagctggagattaatgggaggaataatcttatccagcagaagacagcggcagcaatgtttgctcaacagatgcagttgatgctgcaaaacgcccagatgtcctccttggggtcatttccaatgacaccatccattcccgctaacccaccaatggcatttaatccgtatatccctcaccccggaatgggcttagtgcccgcagaactggtgccaaacacccccgtgttgattcccggaaatccccctcttgctatgcctggcgctgtggggcctaagctgatgaggagtgataagctcgaagtttgcagggaatttcagcggggaaattgcaccagaggtgaaaacgactgtagatacgcccatcccaccgatgccagcatgatcgaggcatctgacaataccgtgacaatctgcatggactatataaaaggaaggtgctccagagaaaagtgtaaatatttccatccacctgcccaccttcaagctaggctcaaagccgctcatcatcagatgaatcacagtgcagccagcgccatggctctgcaacccggaaccttgcaactgatcccaaagagatccgccttggaaaaacctaatggtgccacacccgtgtttaatcccaccgtcttccattgccaacaggctttgactaacctccagcttcctcagcctgcgtttattcccgctgtcccaatgatgcatggcgctacccctaccacagtcagcgcggcaacaacgcccgctacctcagtaccgtttgctgccccaaccacaggaaatcagttgaaattctag

SEQ ID NO: 231225 - DNA, 777 bp, Artificial Sequence
  Description of Artificial Sequence: Synthetic coding sequence
atgttcgcgcaacagatgcaactgatgctccagaacgcgcagatgagcagtttgggctcattccccatgacccccagtatccctgccaatccacctatggcctttaatccttacatcccgcacccaggaatgggactggtccctgcagaattggtacctaacacacctgtcctgatccccggaaatcctccactggccatgcctggtgctgtcggccctaagttgatgcgctcagacaaacttgaggtgtgtcgggaatttcaacgagggaattgtacccggggagaaaatgactgccgatatgcgcaccctacagacgcaagcatgatagaagcctccgacaataccgtgactatatgcatggactacattaaaggcagatgctcccgggaaaagtgcaagtacttccacccccctgcgcacctgcaagcccgactgaaggctgcacaccaccaaatgaatcacagtgcagcttcggcaatggctctgcaaccgggaactctccagttaattccaaaaagatcagccctggagaagcccaatggagccacccccgtgttcaaccccacggtcttccactgccaacaggcacttaccaatctccagctccctcagccagctttcattccggctgggcctatactgtgcatggccccagcttctaacattgtcccaatgatgcacggagcgacccccactaccgtgtccgccgcaacaacccctgccacttctgtgccgttcgctgccccaacaaccggtaatcagctcaaattttag

SEQ ID NO: 231226 - DNA, 672 bp, Artificial Sequence
  Description of Artificial Sequence: Synthetic coding sequence
atgttcgctcaacagatgcagctgatgctccagaacgcccagatgagttctcttggatctttcccgatgacaccttccatcccggctaacccacctatggcctttaacccttatatccctcaccccggtatgggcttagtgcctgccgagctggttccaaacactccggtgcttatccctggaaaccctccattggccatgccaggagcagtggggccaaagcttatgaggtcagacaagcttgaggtctgccgcgagttccagcgtggcaactgcacacggggagagaacgactgtcgctatgcccacccgaccgatgcatcgatgattgaggcctcagataataccgtaacaatctgtatggactacattaaaggacgctgtagcagagagaaatgtaaatacttccatccccctgcacatctgcaggcccgtctgaaagccgcacaccaccaaatgaatcatagcgctgcctctgctatggcactgcagccgggaactctgcagttgatccccaaacgttccgccttggagaagcccaatggagctaccccagttttcaacccaacagtttttcattgccagcaggcgcttaccaatctccagctccctcagcccgcttttattcctgctggcccaatcctgtgcatggcaccagcatccaatatctag

SEQ ID NO: 231227 - DNA, 729 bp, Artificial Sequence
  Description of Artificial Sequence: Synthetic coding sequence
atgttcgcacagcaaatgcaactgatgctccagaacgctcagatgtcctcacttggctcatttcctatgactcctagcataccagctaacccccctatggctttcaatccatatatcccacatcctggcatggggttggtgccggctgagctcgtcccaaatacacccgtcctgattcccggaaatcctccactggccatgcccggtgctgtgggtccaaaactgatgaggagcgacaaactcgaggtctgcagggagttccagagaggcaattgtacccgaggtgaaaacgattgccgctacgcccaccccactgacgcgtcaatgatcgaagccagcgacaatacagtaaccatctgcatggactatatcaaagggcgatgttcacgagagaagtgcaaatatttccatcctccggctcacctacaagccagactcaaggccgctcaccaccagatgaaccacagtgccgcaagtgccatggcgctacagccgggaactcttcaattaatacctaaaagatctgcacttgaaaaacctaacggcgctacgcccgtcttcaatcccaccgtgttccactgtcaacaggcactcaccaacctgcaactaccgcagccagccttcatacctgccggtcccatcctgtgcatggcccctgcctccaacatcgtcccaatgatgcacggggctacacccaccacagtcagcgctgccaccacacccgcatag

SEQ ID NO: 231228 - DNA, 453 bp, Artificial Sequence
  Description of Artificial Sequence: Synthetic coding sequence
atcaaaggacgctgcagccgcgagaaatgcaaatactttcatcctcctgcacacctgcaggccagacttaaggcggcacatcatcagatgaaccactcagccgcaagcgctatggccctgcaacctggcacactgcaactaattcccaagcggagcgccttagaaaagcctaatggagccacacctgtgtttaatccaaccgtcttccattgtcaacaggcactgacgaacttgcagctaccccaaccagcgttcattcccgcaggacccatcctgtgcatggcgcctgcctcaaatatcgttcctatgatgcatggcgctactcctacgactgtgtccgctgctaccactcctgctaccagcgtgcctttcgctgctccgaccaccggaaatcagatcccacagctgagtattgacgagctgaattcctctatgtttgtctcacagatgtag

SEQ ID NO: 231229 - DNA, 879 bp, Artificial Sequence
  Description of Artificial Sequence: Synthetic coding sequence
atggagagagcttccaagaacctcaagggaaggtgcacaagggagaattgtaagtatttgcaccctccccctcatctgaagacccagcttgaaattaacgggcgtaacaacctgattcaacaaaaaactgctgcagctatgtttgcccagcagatgcaacttatgctgcagaatgctcaaatgagctcgctggggtcatttccaatgaccccctctataccagcaaaccccccaatggcttttaacccttatattccccatccaggaatgggactcgtgccagctgaacttgtgcccaacactccagtcctgattccaggaaaccctcccctagctatgcccggagccgtgggacctaaactcatgcggtcagacaagctcgaggtttgcagggaattccagcgcggaaactgcacccggggagaaaacgattgtcgttatgctcaccctacagatgcctcaatgattgaagcctccgataacactgtgacaatctgtatggattacatcaagggaaggtgcagtcgagaaaaatgtaagtattttcacccaccagcacacctgcaggccaggcttaaagccgcacaccaccaaatgaaccattcagccgctagtgcgatggccctccaaccaggaacactccagctgatcccaaagcgcagtgcgcttgagaagcctaacggagccacgccagtatttaatcccacagtcttccactgtcagcaggccctaaccaatctgcagctgccacagccagctttcatacccgcagtgcctatgatgcatggggctacccctaccacagtttctgccgctacaacgccagccacttccgtgccattcgcggctccaacgaccggcaatcagctcaagttctag

SEQ ID NO: 231230 - DNA, 1377 bp, Artificial Sequence
  Description of Artificial Sequence: Synthetic coding sequence
atggaactggaaaagcgcgaaaagcggagcttgctgaacaaaaatctggaagaaaagctgaccgtaagtgctggaggatcagaagctaaacccctgatttttacattcgtacctacggtccgaaggcttccaacccatacacagctggccgacaccagtaaatttctcgtcaagataccggaggagtcatctgataagtctcctgagactgttaaccgcagtaagtctaatgattacctgaccttgaatgctggttctcagcaggagagagaccaggccaagctgacttgcccaagtgaggtctctggaacgattctgcaggaaagagagttcgaggccaacaagctacaaggtatgcaacagagcgatctgtttaaggccgagtacgtcctgattgtggacagcgaaggggaggacgaagctgcatcgcgaaaggtggagcagggtcccccaggaggaattggcacagctgctgtgaggccaaagtctcttgctatctcttccagtctggtaagtgacgtcgttcggcctaaaactcagggcactgacttaaagacatcctcccatcctgaaatgctgcatggaatggcccctcagcagaagcatgggcagcaatacaagactaagtcatcttacaaggcttttgctgcaatccctacaaatacgcttctgctggaacaaaaggctcttgatgagcccgctaaaaccgaatccgtatctaaggataacacgctcgagccaccggttgaactatatttccctgctcagttacgccaacagacggaggagctctgtgccaccattgacaaggtgttgcaggactctctgtcaatgcatagcagcgatagccccagcagaagtccaaaaactctgctagggagtgatactgtaaagacacctaccacgctgccgcgtgctgctggacgcgagactaagtatgctaacttgagctctccttcatccactgtctcggagtcccagctgacaaaacccggtgtgataaggcctgtgcccgtgaagagcaggatcctacttaaaaaagaagaagaggtgtatgagcctaatccattcagtaagtacctcgaagacaatagtgaccttttcagcgagcaggacgtgaccgtgccacccaagccggtgagcctccatcccctgtaccagacaaaactgtatcctcccgcaaagagcttacttcacccccagacactgtcacacgctgactgtttagcccctggacccttctcccacctctcatttagcctgtccgacgagcaagaaaacagtcacaccctactgagtcacaatgcctgtaataaactaagtcatcccatggtagcaatccccgagcatgaggcactcgacagtaaagagcagtag

SEQ ID NO: 231231 - DNA, 873 bp, Artificial Sequence
  Description of Artificial Sequence: Synthetic coding sequence
atgacctcgtgcattctaagtgggagcatccaaactacaccacaggtgtccgccggtggttccgaggctaagcccctgatcttcacttttgtcccaactgtacggaggctcccaacccacacgcaactagctgacacatctaaattcttggtgaaaataccagaagagtcaagcgataagagccctgagactgtcaaccgaagcaagtccaacgattacctcacactcaatgccggatcccagcaggagagagatcaggcgaagcttacttgtccatcggaagtaagtggcacaatcctgcaggagcgggagttcgaagccaataaattgcagggcatgcagcagtcagaccttttcaaagctgagtatgttctgattgtggattccgagggagaggacgaggccgcaagtaggaaggtggagcagggtcccccagggggaattggcactgccgcagtgcgccctaaatccctggctatcagctctagcctcgtgagcgatgtggtccgcccaaagacacaaggcaccgacctgaagacaagcagccacccagagatgctgcatggaatggccccacagcagaagcatgggcagactccaacaaccctgcctagagctgccggtcgggaaacgaaatacgcaaacctgtctagtccttcctctacagtgtctgaatcccagctgaccaagccgggagtgataagacctgtgcccgttaagagtcgaatcctcttgaaaaaagaagaggaagtttacgaacctaatccattttctaaatatttagaggataactcagacctattttctgaacaactgagtcaccccatggtggccattccagaacacgaagccctggactctaaggagcagtag

SEQ ID NO: 231232 - DNA, 705 bp, Artificial Sequence
  Description of Artificial Sequence: Synthetic coding sequence
atgtgctcctggtatctaggctttgagtgttcatctaaatccaacgattacctcacgttgaacgctggttctcagcaagaaagagaccaggccaagcttacttgccccagtgaggtctctgggaccatacttcaggagagagaattcgaagctaataaactgcaggggatgcagcagtctgatctgttcaaggcagaatatgtgctcatagttgatagtgagggcgaggacgaggccgctagcagaaaggtggagcagggcccaccgggagggatcggtacagccgctgttcggccaaagtcgcttgccattagctcctcactcgtatccgacgtcgtgaggccaaagacacagggcactgatctgaaaacttctagccacccagagatgctgcacggaatggcccctcaacagaaacatggccagacacctaccacccttccaagggccgctgggagagagacaaagtacgctaaccttagctctccctccagcaccgtctccgaatctcaactgacaaaacccggtgttatccgtcccgtccccgtgaaatcacggatactcctgaagaaagaggaagaagtgtacgagccgaacccattctccaagtatctggaagacaatagcgatctcttcagtgaacagctgtctcatcccatggtggcgatcccagaacacgaagcattagactccaaggagcagtag

SEQ ID NO: 231233 - DNA, 489 bp, Artificial Sequence
  Description of Artificial Sequence: Synthetic coding sequence
atgcagcagtctgacctttttaaggcagagtacgtgctcatcgtggatagcgaaggagaggatgaggccgcatcccggaaagtcgagcagggaccacctggcggtattggaacagctgcagtgagacctaagagccttgctatcagcagctcgttagtcagcgacgtcgtcagacccaagacacaggggaccgacctgaagactagctcccacccagagatgcttcacggaatggctcctcaacagaagcacgggcagcagtataagaccaaaagctcctacaaggcctttgccgcaataccaaccaatacactcttgttggagcagaaagctctggacgagcccgctaaaaccgaaagtgtcagcaaagacaatacactggagcccccagtcgaaacccccaccacactcccccgagctgcaggcagggagacaaagtacgcgaacctgtcgtctccgtcctctacagtttctgagtctcagttgtag

SEQ ID NO: 231234 - DNA, 2208 bp, Artificial Sequence
  Description of Artificial Sequence: Synthetic coding sequence
atggccgctgggggagccgtggctgcggcacccgaatgcagattgttaccttatgccctgcataaatggagcagcttcagctctacatatctccccgaaaacatcctggtggacaagccgaacgatcagtctagtagatggtctagcgagagcaattacccaccgcagtacctcatcttaaagctggagcgaccagcgatcgtgcaaaatatcaccttcggtaaatacgaaaaaacacacgtatgcaacctgaaaaagttcaaagtgttcggcggtatgaacgaggagaatatgactgaacttttgtcctcagggttgaaaaacgactataacaaggagaccttcaccctaaagcataaaatagatgagcagatgtttccttgtcgatttatcaagatcgtgccactcctcagttggggaccttcattcaatttctcaatctggtacgtggaactgtccggaatcgacgatccagacatcgtccagccttgcctgaactggtatagcaaataccgagaacaggaagctattaggctgtgcctgaagcacttccgccaacacaattacacagaggccttcgagtccctgcaaaagaagaccaaaattgctctggagcaccctatgttgaccgatatccacgataagttggtgctcaaaggcgattttgatgcctgtgaggagctgatcgagaaagccgtgaacgatggcctcttcaatcaatatattagtcagcaggagtataagcccagatggagtcagattatcccgaaatcaaccaagggagacggcgaagacaaccgcccaggtatgaggggagggcaccagatggtcatcgacgtccagacagagaccgtgtacttgtttggcggttgggatggaacacaggacctggctgacttctgggcatacagtgtgaaggaaaatcaatggacttgtattagtagagacacagagaaagagaatgggccatctgcacgcagttgtcataagatgtgcatcgacattcagcgcaggcagatctatacactgggaaggtacctcgattccagcgtcaggaactccaaaagtctgaaaagcgacttctacaggtatgatatagacaccaatacctggatgctccttagcgaagatacagctgctgacgggggtcccaaattggtgttcgaccaccagatgtgcatggactctgaaaagcatatgatctacacctttgggggaaggatactcacgtgcaatgggtctgtggacgactcaagagccagtgaaccacaatttagtggactgtttgccttcaactgccaatgtcagacctggaaactgctgagggaagatagctgtaacgctggtcctgaagatatccaaagcaggatcggtcactgcatgctctttcactctaaaaacagatgcctgtacgtttttggtggacaaagatcaaagacgtacctcaatgatttctttagctatgatgtggactccgaccatgtcgatataattagcgatggaacaaagaaggacagcgggatggtgcctatgacgggctttactcagagggccactatagaccctgagctgaacgaaatccacgtactctctgggctgagtaaagacaaagaaaaacgggaggagaatgtgaggaattctttctggatttacgatatcgtgaggaactcctggtcttgcgtctacaaaaatgaccaggccgctaaagacaatccaaccaaaagcttgcaggaagaagagccatgcccacgatttgctcatcagttggtgtatgacgagttacacaaagtgcactatctgttcgggggtaatcccggaaaatcctgttccccaaagatgcgacttgatgacttttggtctctgaagctatgtcgcccatccaaagactatctcttgcgacactgcaagtacctgataagaaagcatagatttgaggaaaaagcccaggtagaccctctcagtgctctgaagtatttgcagaatgacttgtacattacagtggatcatagcgatccagaggagaccaaagagtttcaactcctggcgtcagccctcttcaaatccggaagcgatttcactgccttaggtttctcagacgtggaccacacgtatgcccagagaactcagctctttgataccctggtgaatttttttccagactcaatgacacccccaaaaggcaatctggtagatctcataactctttag

SEQ ID NO: 231235 - DNA, 558 bp, Artificial Sequence
  Description of Artificial Sequence: Synthetic coding sequence
atgacaggattcacacagcgcgctactattgacccagagcttaatgaaatccacgtgctgagtggcctctctaaagataaggaaaagcgcgaggagaatgtccgcaactccttttggatctacgatatagtgcggaattcctggagctgcgtctacaaaaatgaccaagccgcaaaagataacccgactaaatcgctccaggaggaggagccatgtccccgatttgcgcaccaattggtgtacgacgagctgcacaaggtccattatctgttcggcggaaacccaggaaagagctgctctcctaaaatgaggttggatgacttttggtctctaaagctgtgccgccctagcaaagattaccttctgagacactgcaaatacttgataaggaagcaccggtttgaggagaaagcccaggtcgatccactttctgccctgaaatatctgcagaatgacctctacatcactgtcgaccactctgaccccgaagaaaccaaagaggcatttcttatgtggatcacacctatgctcaaggaactgagttccttgactccctag

SEQ ID NO: 231236 - DNA, 3060 bp, Artificial Sequence
  Description of Artificial Sequence: Synthetic coding sequence
atgatggccgctgcagctgccgcagctgctggctcttccagctcaggaggtgggggaggcggatcgggatccagctcaagctcctccgacacttcctctaccggtgaagaagagcggatgcggaggcttttccaaacctgcgatggggatggcgacggatacatatctcgaaatgatctgctaatggtgtgtagacagttgaatatggaagaatcagtcgcggaaattatgaatcaattaggggcagacgagaacgggaagatctcctttcaggattttacccgatgcaggatgcagctggttagagaaatacggaaagaagaggttgatctttctgcaaagagcgacaacagctgtactaaaaagctgcgcgaccgcatcgcatcctggccaactagttccgacaactctctgggtgctctctccgcagccagagaatcttgggagtatgatagtggggctcgagatctgcaaagccccgacgtgcagagccagagtgccctacagaaattgctggagtatgggggatcatctcttcaccagcaggctgcactgcataaactactgactcagtctccgcatatcggcaattccgtgggcggaagctatctcgagttagcaaacaccctgcactccgccgcactggctagcctgaagggtgacattgttgagttgaacaaacgactccagcagaccgaacgcgagagggacttgctggagaaaaaactagctaaagctcaatgcgagcagtctcatctgatgcgcgaacacgaagacgtgcaggagcgcaccaccctcagatacgaagagcgcatcactgaactacactccgtcattgcagagctgaacaaaaagatcgaccggctgcagggcactacaattcgagaggaagatgaatatagtgagctacgcagcgagcttagccaatctcagcacgaggttaacgaagattcacggtccatggatcaggatcaaacctccgtctccatcccagagaaccaatccaccatggtgacagccgacatggataactgtagcgaccttaattccgagctgcaacgggtgctcactgggttggagaacgtggtgtgtggcaggaaaaagtcgagctgttctctctccgtcgccgaggtcgacaagcacatcgaacagctcaccaccgccagcgaacactgcgacctcgcaattaagacagtggaggagattgagggggtgctcggcagagatttgtatccgaacctggccgaagagaggagcagatgggagaaggagcttgccggactgcgcgaggaaaacgagtctctgaccgccatgctttgctcaaaggaggaagaactgaatagaacgaaggccaccatgaatgcaatcagagaggagcgggatcgtctaagacggagagtcagggaattgcaaacaagattgcagtcagtgcaggccactggaccctcatccccaggtagactaacgtcaacaaaccggcctatcaacccttcaactggagagctgtctacgagcagcagctccaacgatatccctatcgccaaaatcgcagaaagggtgaaactcagtaagacacgttcagagtccagctcttcagataggcccgtgcttgggagcgagatcagctcgatcggagtgtcatcatccgttgcggagcacttggcccattcactgcaggactgttccaacatacaggagattttccagaccctgtactctcatggcagcgcaatttcagagagcaaaatccgggaatttgaggtggagacagagcgactgaactccagaatcgagcatttaaaatcccagaacgacctgctgacaattactctcgaagagtgtaaaagcaacgctgaacggatgtcgatgttagtgggaaaatacgagagtaatgccacagcccttcggctggctctgcagtacagtgagcaatgtattgaggcttatgagctactccttgccctcgccgagtccgaacagtcacttatactcggacaatttagagcggctggcgtgggcagctcgccaggtgatcagagtggggacgaaaacattacccagatgctgaagcgagctcacgactgtcgcaagacagccgaaaacgccgcaaaggccctgctgatgaagctggacggctcatgtggtggtgccttcgcagtcgcgggttgctcagtgcagccctgggagtcactatcttctaatagtcataccagtacaaccagctcaaccgcctcctcgtgcgacactgagttcaccaaagaagatgaacaacgcctcaaggattacatccagcagcttaaaaacgaccgggcagcagtcaagttaacaatgttagaactggagtcaatccacatcgatccgctgtcttatgacgtgaagccaaggggggattctcagcggctggacctggagaatgccgtgctcatgcaggagctaatggccatgaaggaagaaatggcagaactcaaagcacagctctacctcctagagaaagagaagaaggctcttgagctcaaactgtcaactcgagaagctcaagagcaagcctaccttgtccatattgagcaccttaagtcagaagttgaggaacagaaagagcaacgcatgcgatctctgagcagcactagctccggctccaaagacaaaccaggtaaagaatgtgccgatgcagcctcccctgcattgagtctcgccgaactgaggacaacatgcagtgagaacgagctggccgcagaatttactaatgccattagacgcgaaaaaaagttaaaggccagggtccaggagcttgtctctgcccttgagcgcttgaccaagtccagtgagatcagacatcagcaaagcgcagagtttgttaatgacctcaagagagcaaactcgaatctcgttgccgcttacgagaaggccaagaaaaagcaccagaacaaactgaaaaaactcgaatcacagatgatggcgatggtcgaacgtcatgagacgcaggtccggatgctgaaacagcgtattgccctcctcgaggaagaaaactcaaggccccatactaatgaaacctccctgtag

SEQ ID NO: 231237 - DNA, 564 bp, Artificial Sequence
  Description of Artificial Sequence: Synthetic coding sequence
atgagtgggggaggcaccgaaacacccgttggctgcgaagccgcaccgggtggtggaagtaaaaagcgggactctctcggcaccgcaggatccgcacatctgatcatcaaagaccttggcgaaattcacagcaggctcttagaccaccgtccagtcatccaaggagaaaccagatactttgtaaaggagttcgaagaaaaaaggggtttgcgagaaatgagggtcttagagaacctgaagaatatgattcatgagaccaacgagcacactctgcccaagtgtcgcgacaccatgagagactccctgtcccaggtccttcagaggctacaagccgcaaacgactccgtgtgcaggctccagcagagagagcaagagcggaagaagatccactccgaccatctggtagcttcagagaaacaacacatgctgcaatgggataatttcatgaaggagcaacccaacaaaagggccgaggtggacgaggagcatagaaaggccatggagagacttaaggagcagtatgccgaaatggaaaaggacttagcaaaattcagtacattttag

SEQ ID NO: 231238 - DNA, 372 bp, Artificial Sequence
  Description of Artificial Sequence: Synthetic coding sequence
atggaaaagaggggtctgcgggaaatgagagtgctggaaaacctaaaaaacatgatacacgagacgaacgagcacaccttacccaagtgtcgtgataccatgcgggatagcctttcccaagtgctgcagaggctgcaagctgctaacgactcggtctgtcgactgcaacaacgagaacaagaaaggaaaaagatccatagtgaccacctcgtggcttcagaaaagcaacatatgctgcagtgggataattttatgaaggaacaaccaaataagagggcggaggtggacgaagaacacaggaaggcgatggagaggttgaaggagcaatatgctgagatggaaaaagacctggccaagttctctaccttctag

SEQ ID NO: 231239 - DNA, 3987 bp, Artificial Sequence
  Description of Artificial Sequence: Synthetic coding sequence
atggagagcagagaccccgctcagcctatgagccccggtgaagcaacccagtcgggagcgaggccggctgataggtatggattacttaagcattctagagagtttctcgacttcttctgggatattgcgaagcccgaacaggagactagactggccgctacagagaagctgctggaatacttacgaggcaggcctaagggatctgagatgaaatatgcactaaagcgcctgatcacagggctgggcgtcggcagggagacagcacggccttgctattcactcgcactggcacagctgctgcagtcgtttgaggacctgcctctatgtagtatcctgcagcagattcaggagaaatatgacctgcatcaagtgaaaaaagcgatgctgagaccagcacttttcgccaacttgtttggggtgttggcactctttcaaagtggtcgcctggtcaaggaccaggaagcactgatgaagtccgtgaagctgctccaggctcttgctcagtaccaaaaccatctgcaggagcagccccgaaaggcccttgtggacatcctttcagaagtgagcaaggccaccttgcaggagatcctgccagaggttctgaaagcagacctcaacatcatcctttcttcacccgagcaactagaactcttcctgctggcacagcagaaggtgccaagcaaactgaagaaacttgtggggagcgtcaacctgttcagcgatgagaatgtcccccgtctggtgaatgtgcttaagatggcggcaagctctgttaagaaagatcggaagctgcctgccattgcactggacctgctgcgcctggcactgaaggaggacaagtttcccagattctggaaagaggttgttgaacaaggcttactcaaaatgcagttttggccagcgagctatttgtgcttccgcctattgggcgcagcactccctctcttgactaaggagcagctgcacctggtgatgcagggcgatgttattaggcactatggggagcatgtttgcaccgcaaagttgcctaagcaatttaaattcgctcctgaaatggacgactacgtgggaacctttctcgaagggtgccaagacgatcctgaaaggcaactcgctgtgctcgtggctttctctagtgtgacaaaccagggactgccggtgacgccgacattctggcgcgtggtgcggttcctatccccacccgcactgcagggatacgtggcctggctgcgcgctatgttcttacagcccgatctcgactcactcgtagacttctctacgaataaccagaagaaggctcaggatagctcacttcatatgccagaaagagccgtattccgcttacgaaagtggattattttccgacttgtgagcatagtcgacagccttcacctggaaatggaggaggctttaactgagcaggtcgccaggttttgtctcttccactcgttcttcgtgaccaagaaacctacaagccagatacctgaaaccaagcatcctttcagtttccctcttgagaatcaggcaagagaagccgtttcgagtgccttctttagcctgctacagacattaagcacacagtttaaacaggccccaggacagacccagggaggccagccttggacctatcacctggttcaattcgcggacctgctcttgaatcatagtcacaatgttactacggtgaccccgttcaccgcccaacagagacaggcctgggatcgaatgcttcaaacgctaaaagagctggaggcccattctgcggaagccagagcggcagctttccagcatttactgttgctcgtaggtattcacttgctgaagtccccagcagaaagctgcgacttgctgggggatattcagacttgcatccgtaaaagtcttggcgaaaagcctagacgaagtcgcaccaaaacaatcgatccacaggagcccccttgggtggaggttctggtcgagattctgctggccctacttgcccagccctcccacctcatgaggcaggttgcacgctcagtgtttggacatatttgtagccacctgaccccaagggccctgcaacttattttggatgtgctgaatccggagactagtgaagacgaaaacgaccgcgtagtggtgaccgacgattccgacgaaaggcgtctgaagggtgccgaggacaaaagcgaagagggagaggacaataggtcatccgaaagcgaggaagagtctgagggagaggagtcagaagaggaagaacgggacggtgacgtggatcagggtttccgagaacaactgatgaccgtattacaggccggaaaggctctgggaggggaggattcagaaaatgaggaagagctgggagatgaggcgatgatggctttagatcagtctcttgcctctctgtttgctgagcaaaagttaaggatacaggctcgccgagacgaaaagaataaactgcagaaggagaaggccctgcggcgagatttccagatcagggtccttgacttagtcgaggtcctcgtgaccaaacaaccagagaacgcacttgtgcttgagctgctggaacccctcttgagtatcatcagaaggagcctgcgatcttcctcgtccaagcaggagcaggacctgttgcacaaaactgccagaatcttcactcatcatctgtgtagggccaggcggtattgccatgacttgggcgaacgcgctggggcactccatgcacaggtcgagagactggtgcagcaagcaggtaggcagcctgactcaccaactgctctctaccacttcaatgcatctctgtacctcttgagggtgctgaaggggaatacggccgagggctgtgtgcacgaaacccaggaaaagcaaaaggctggcaccgacccctcgcatatgccaaccgggcctcaggccgcttcctgtctcgatctcaatctggtgacccgggtatacagcactgccctgagcagctttctcacaaagcgcaacagcccactcacggttccgatgtttctgtcactgttctcccgccaccctgttctctgccaaagccttctgccaattttggtccaacacataaccggcccagtgcgtcctaggcaccaagcgtgcctcttactgcagaaaacactcagcatgcgcgaggtacggtcttgtttcgaagacccagaatggaagcagttaatgggacaggtgctggctaaagtgacggagaacctcagagtcttaggggaggctcagacaaaggcgcagcaccagcaggcccttagcagtctggaactgctgaatgtcctatttcggacctgcaaacacgagaagctgacccttgacctgacggttctgttaggcgtgttgcaaggtcagcagcagagcctgcagcaaggggcacattccacggggagtagccgactccatgacctgtattggcaggccatgaaaacgcttggggtacagcgcccaaagcttgaaaagaaggatgccaaggaaattccttccgctactcaaagcccaataagcaaaaagaggaagaagaaggggtttctccccgaaaccaagaagcgtaagaaacgaaaaagcgaggacggcacccctgcggaggatggcacacccgctgcaacggggggaagtcagcccccttccatgggcaggaaaaaacgcaacaggactaaagcaaaggttccagctcaggccaacggcacccctacaacaaagagcccggctcctggcgctccaacacggagccctagcaccccggctaagtcccctaagctccagaaaaaaaatcagaagccttcacaggtgaacggtgcacctggcagtcctacagaaccggctgggcagaagcaacaccagaaagcgttgcccaaaaaaggtgtactgggcaagagtcctctctccgctttggcacggaaaaaggcaagactgtctctcgtgatcagaagtccatctctcttgcaaagtggcgctaaaaaaaaggcccaagttaggaaagccggaaaaccgtag

SEQ ID NO: 231240 - DNA, 3999 bp, Artificial Sequence
  Description of Artificial Sequence: Synthetic coding sequence
atggagtctagggaccctgcacagcccatgagccccggtgaagcgacacaaagtggcgctaggccagcagataggtatggtctgctgaaacatagcagagagttcctcgattttttctgggacatcgccaagccagagcaggagacgaggctggctgccacagagaaattactggagtacctgagaggcagacctaaaggctcagagatgaaatacgccctgaagaggctcatcactggactgggagtggggagagaaacggcccgaccatgctacagcctggctttggctcaactcttgcagtctttcgaggacttgcctctgtgctcgatcctacaacagatccaggagaagtacgacctgcaccaggtcaaaaaggccatgctgagaccagcattattcgccaatttattcggcgttctcgccctgttccagtcaggacgtttggtgaaggaccaggaggctttgatgaagtctgtaaaactactgcaggctctggcccagtatcagaaccacctccaggagcagcccagaaaggccctggtggacatcctgagcgaggtttccaaagccacccttcaggagattttaccagaagtgcttaaagctgatcttaatataattttgagttcacccgagcagctcgagctgttcctgctcgcacagcagaaggtgccctccaagctgaagaagctagttggcagcgtgaatcttttctcagacgagaacgttcctaggctcgtcaatgtgctgaagatggcagcaagctctgtaaagaaggatcggaaactcccagcaatcgccctggacctcttgaggctggcactaaaggaggacaagttcccgaggttttggaaggaggttgtggagcagggtttactgaaaatgcagttctggcccgcttcttatctgtgttttcggttgttgggtgcggcactcccattgttaaccaaggaacagctgcatctggttatgcaaggtgatgttatcagacactacggggaacacgtttgcacagccaagctgcccaagcagtttaaatttgctccagagatggacgactacgtggggacgttcctggagggctgtcaagacgaccctgagcgtcagctggccgtactagtcgcgttctcctctgtgactaaccaggggctgcccgttacaccaactttctggcgggtagtgcgctttctgtcgccaccagctctgcagggttacgtcgcctggctccgcgctatgttcctgcagcctgacctggacagcttagtggatttctccacgaacaaccagaagaaggctcaggattcctcccttcatatgccagagcgggcagtttttcggttgcgtaagtggatcatcttccgcttagtttctatcgtggactctctgcacctcgagatggaggaggccttaaccgagcaggtggcccgattttgcttgttccatagttttttcgtaaccaaaaaacctacttctcagatcccagaaacaaaacaccctttctcctttcccctcgaaaatcaagcccgagaagcagtgagcagcgcattcttctccctcttgcagactctaagtacgcagtttaaacaggcccctggccaaacgcaggggggtcagccctggacgtaccacctggtgcagtttgctgacctcctgctcaaccacagccataacgtaaccaccgtcacccccttcaccgcgcaacaacggcaggcgtgggaccgcatgctccagactttgaaggaactggaagcacactcagctgaggcccgtgcggctgcctttcagcatctgcttttactggtgggaatacacctgttaaagtcacccgcagagtcatgcgatcttcttggggacatccagacctgcattagaaaatcactcggagagaaacctcggaggtcccggaccaagactatagacccacaggaaccgccatgggtagaagtcctggttgagatcctgctggcactcttagcccaacctagtcacttgatgcgacaggtagcgagatcagtcttcggccacatctgttctcaccttacccccagggctctccagctgatcctggacgtgctcaatcctgaaacctccgaagatgagaacgatagagtcgtggtgactgacgacagcgacgaacgcagacttaaaggcgctgaagacaagtctgaagaaggcgaggataatcgctcttccgagtcagaggaagaatcggaaggcgaggagtcagaagaagaggaacgagacggtgacgtagaccaggggttcagagaacagcttatgacagtacttcaggctggcaaggccttggggggagaagacagtgagaacgaagaagagttgggcgatgaggctatgatggccctggaccagtcactcgcgagcctttttgctgagcaaaagctgcgaattcaggccaggcgggatgagaagaataaattgcaaaaggaaaaagcactgcggagggatttccagatccgtgtcctcgatctggtggaggtgttggtaacgaagcagccagaaaatgctctggttctagagcttctcgagccgctgctctcaatcatccggaggagtctgcgttctagcagctccaagcaagaacaggatctcttacacaagactgcccgaatctttacacaccacttatgccgcgcacggcgatattgtcatgacctgggtgagagagccggagcattgcacgcacaggtcgaacggttggttcagcaggcagggcgacagcccgactctcccactgctttatatcacttcaacgcctcactgtatttacttcgtgtgttaaaaggaaatactgccgagggatgcgtccacgagactcaggaaaaacagaaggcaggaacagatccaagccacatgccgaccggtccccaggccgcttcatgcctggacctgaacctcgtgacaagagtttattcaactgccctgtcatcattcctgacgaagcgcaatagtccactgaccgttccgatgtttctgagccttttcagtaggcacccagtcctatgtcagagtttactcccgattttagttcagcatattacaggtccagttcggcctagacaccaggcgtgcctgctgctccagaagactctttccatgcgcgaggtgagatcctgttttgaagacccagaatggaagcaattaatgggacaggttctcgctaaagtcaccgaaaatctcagggtgctgggcgaagcccagaccaaagcccagcatcagcaggcacttagcagtctggagctacttaatgttctgtttcgaacatgtaagcacgaaaagctaacgcttgacttgacggtgctgctgggagtgctgcaggggcagcagcagagcctgcagcagggagctcatagtacagggagcagtcgtctgcatgatctgtactggcaggccatgaaaactctgggtgtgcagagacccaagcttgagaagaaggacgcaaaggagatcccatcagctactcagagtcctatctccaaaaaacggaagaagaaggggttcctgccggaaacaaagaagcgcaaaaagaggaagagcgaggatgggactccagcagaagacggaaccccagccgcaacagggggttcacaacctccctctatggggaggaaaaaacggaaccggaccaaggcaaaagttcctgctcaggccaacggtacacctactactaagagtcctgctcctggcgcacctactcggagcccatcaaccccggctaaatcacccaagctgcaaaagaagaatcaaaaaccctcacaagtgaacggcgcacctggatcacccactgagcctgcagggcagaaacagcaccagaaagcattgccaaagaaaggtgtcctcggtaagagtccgctgagcgccttggctagaaagaaagctaggctctccttagtgatccgcagcccttcactgctgcagtctggtgccaagaagaaagcacaaaccttgagatttacaatttcttctagcaaaaagtag

SEQ ID NO: 231241 - DNA, 1812 bp, Artificial Sequence
  Description of Artificial Sequence: Synthetic coding sequence
atggaatcacgagatccggctcaacctatgtccccaggcgaagccacccagagcggggcaaggccagccgatcgctacggcctgctcaaacactccagagaatttcttgattttttctgggatatcgccaaaccagagcaggaaacaagactggccgctacagagaagttactggagtatcttcgagggagacccaaaggttccgagatgaagtacgccctgaaacgcttgatcacaggcctgggtgttggccgagagactgcacgcccatgctattcactggctctggcacaactgctgcagagcttcgaagacctgcccctgtgcagcatcttacagcaaatacaagaaaagtacgacctgcaccaggtaaagaaagccatgctccgacctgcgctctttgcgaacctattcggtgtactcgcgctcttccagagcggccgtctggtaaaagaccaagaggcactgatgaagtctgtaaagttgctgcaggcccttgcccagtatcagaatcatttgcaagaacagccacgcaaagcccttgtggatattctctcagaggtgtctaaagctacgctgcaagaaatcttgcctgaagtgctgaaggccgacttaaacatcatcctgtcttcccctgaacagttggagctcttcctgctcgcccagcagaaagttccctcgaagcttaaaaagctcgtcggttcagtcaatttgttttccgatgaaaacgtcccgagactggtgaacgtgctgaaaatggccgcaagctcagtaaagaaagaccgtaagctcccggcaatcgctctggatcttctgcgtctggcacttaaggaggacaaattcccgaggttttggaaggaggttgtagaacagggcttgttgaaaatgcaattctggccagcaagctacctatgtttcaggctgctcggagcagcactgcctctgctgacaaaagagcaactgcacctggtgatgcagggcgatgtgataaggcattatggagaacacgtgtgcacagcgaagctccccaaacagtttaaattcgcacctgaaatggatgactacgtcggtaccttcctcgagggctgtcaggatgatccagaacgccagctcgcagtgctggtggccttctcttctgtgaccaatcagggcctgccagtgaccccgacattttggcgtgtggtgaggttcctctccccccctgcactccagggctatgtggcctggctgcgggctatgttcctgcagcctgaccttgacagccttgtcgattttagcactaataatcaaaaaaaggctcaagatagcagtttgcatatgcccgaaagggctgtttttaggcttaggaagtggataatctttcgtctggtgtccatcgtggacagcctgcatttagagatggaagaagctttgacggagcaagtagcaaggttctgcctgttccatagcttttttgtcacaaagaaacctacatcgcagataccggaaactaaaccacaggagagaagcgaggggcctgcccagcctcctcatgcacccggaggcccagagaggccaaaactcgagaagaaagacgcaaaggagattccctcagccgaggatgggacacctgcagccaccggaggatctcagcccccaagcatggggcgtaagaagagaaatcgcaccaaggccaaggtgccggcacaggccaatggaacgcccaccaccaaatcgcctgcgccaggtgcccctacacggtcaccatccaccccagccaagagtccaaagctgcaaaaaaaggctcaagttcggaaagccggaaagccctag

SEQ ID NO: 231242 - DNA, 2487 bp, Artificial Sequence
  Description of Artificial Sequence: Synthetic coding sequence
atggccgcagaggaggccgacgtcgatatcgagggggatgtcgtggctgctgcgggtgctcagccaggttcaggggagaacaccgcctccgttctgcagaaagaccactacctggatagtagctggcgcaccgagaatggcttgataccatggacccttgataacacaatatcagaagagaatagagcagtcatcgagaaaatgttgctcgaggaagagtactatctgtcaaagaagtcacagccagaaaaggtgtggctggaccagaaggaagacgacaagaagtatatgaaaagcctacagaagacggccaagattatggtgcactcacccacaaaaccagctagttattcagtgaagtggactatcgaagagaaagaactttttgagcagggacttgccaaattcggacgccgttggactaagattagcaagctgataggatctcgcaccgtgttgcaagtgaaatcctatgccaggcaatattttaagaacaaggtgaaatgcggcctggacaaagaaacacctaatcagaagacgggacacaatctacaagtgaagaacgaagataaaggcactaaggcctggaccccctcctgtctgaggggcagggctgaccctaacctaaatgccgtcaaaatcgagaagctaagtgacgatgaagaagtcgatatcactgacgaagttgatgagttatcttcccagacaccgcagaagaacagttcctccgatcttcttctggattttcccaatagcaaaatgcatgagacgaatcagggcgagttcataacctcagactcacaggaagccctcttcagcaagtcctcacgcggatgcttacaaaacgaaaaacaggatgagaccctgtctagctctgagatcacactgtggaccgagaagcagtcgaatggggacaaaaagtctatagaactcaatgatcaaaagttcaacgagctgatcaagaactgcaataagcacgacgggagaggaataatagtagatgccaggcagctcccaagtcctgaaccgtgtgaaatacaaaagaatcttaacgataacgaaatgcttttccatagctgccaaatggtcgaagagtcacatgaagaagaggagttgaaaccaccagaacaggagatcgaaattgatagaaacatcatccaggaagaggaaaagcaggctatcccagagttctttgaaggacggcaagctaagactcctgaaagatatcttaagattagaaactacatccttgaccagtgggaaatatgcaaaccaaagtacctaaataagacttctgtgagacccggtctgaaaaattgcggcgatgttaactgtattggaagaatccatacttacctggaactcattggcgcaattaatttcggatgtgagcaggcagtgtacaacaggcctcagactgttgataaggtgcgcattcgggataggaaagacgcggtcgaggcgtaccagctggcacagcgcctgcagtctatgcgaacccggaggcgcagggtgcgggacccatggggaaactggtgcgacgcaaaggatctcgaagggcagacctttgaacatctcagtgccgaggaactggcgaagaggcgcgaagaagagaaggggcgacccgtaaaatctttgaaggtgccaaggcccacgaaatcatcttttgaccccttccaacttattccttgtaatttcttctccgaagaaaagcaggagcctttccaagtgaaagtggcgagcgaggcccttctgattatggatcttcatgctcacgtgagtatggctgaagtcattggcctgctcggaggaaggtactctgaggtagacaaagtggtggaggtctgtgctgcagagccatgtaatagcctgtctaccggcctgcagtgtgagatggaccctgtgtcccaaacgcaggcatccgaaaccctcgcagttagggggttttccgtcattgggtggtatcactcacaccctgctttcgaccctaatccctctctgagggacatcgatacacaggcaaaataccaaagctacttcagtcgtggcggagccaaattcattggcatgatcgtgagtccgtacaacagaaataatcctcttccatattcccagattacttgcctcgtgatctcagaggagatctcacccgatgggtcataccgactgccctacaagtttgaggtccagcaaatgttggaggaaccccaatggggactggttttcgaaaagaccaggtggatcatcgaaaagtatcgcctcagtcacagctccgtccctatggataagatcttcagaagggatagtgacctaacctgtctgcagaagctacttgagtgcatgcggaaaaccctcagtaaagtgaccaattgcttcatggccgaggagtttctgacagaaattgaaaacctgtttttatctaactataagagcaatcaggagaatggcgtgacagaagagaactgtacaaaggaactcctgatgtag

SEQ ID NO: 231243 - DNA, 843 bp, Artificial Sequence
  Description of Artificial Sequence: Synthetic coding sequence
atgccaaagaaggcaaaaccaaccggctccgggaaagaggaggggccagcaccatgtaagcaaatgaagctggaggccgctggtgggccatccgcccttaacttcgatagccccagtagtctttttgaatcactgataagcccaataaaaacagaaacattcttcaaagaattctgggagcaaaagcctctgctgatccagcgcgacgaccctgcccttgcaacttactacggcagtctgttcaagctgactgatctcaaaagcctttgcagcagaggcatgtactacggaagagatgtcaatgtgtgccggtgcgtgaatggaaaaaagaaggtgctaaacaaggatggcaaggctcattttctccaacttcgcaaggatttcgatcagaagagggctacaatccagttccatcaaccccagcggttcaaggacgagctgtggcgaatccaagagaagttggagtgctactttgggagcctcgttggcagcaacgtttatattacacctgccggaagccagggacttcctccccactacgacgatgtcgaagttttcatactccagttggagggggagaaacattggaggctgtaccatcctaccgttcccctcgcaagggagtactccgtcgaagctgaagaaagaatcggccgaccagtgcatgagttcatgctgaagcctggagatctactctacttccccaggggaacaatccaccaggccgataccccagctggattagcccacagcacccacgtgacaattagtacctatcagaacaatgacgccggagccaggatgcgtcggtgcgacctgcgcgcaatcgccccacagaaatag

SEQ ID NO: 231244 - DNA, 1398 bp, Artificial Sequence
  Description of Artificial Sequence: Synthetic coding sequence
atgccaaaaaaggccaagcccactggctcaggcaaggaagaaggaccagcaccttgtaaacagatgaagcttgaggccgcaggcggtccgtcagccctcaatttcgacagcccttcctcgcttttcgaaagcctgatttcccccattaaaacagaaactttcttcaaggagttctgggagcagaagccattactgattcagcgggatgatcctgccctagctacatattatggaagcctgttcaagttgacagacctgaaatcactttgcagccgcggtatgtattacggccgagatgtgaacgtgtgcagatgtgttaacgggaaaaagaaggtgctgaataaggatggaaaagcacattttctgcagcttaggaaggattttgaccagaagcgcgctaccattcagttccatcagcctcagcggtttaaggatgagttatggcgaattcaagaaaaattggaatgttactttggcagtcttgttggctccaatgtgtatattacccctgccggttcacagggccttccccctcactacgatgatgtggaggtgttcatactgcagttggaaggagaaaaacactggcggctgtaccaccctaccgtccccctagcccgtgagtatagcgtggaagccgaggaaagaatcggacggcctgtgcatgagttcatgctgaaaccgggtgacctgttgtactttcctcggggaacaatacaccaagcggatacacctgcgggtctagcccattctacacacgtaacaatcagtacctaccagaataattcctggggtgactttcttttggataccatctccgggctggtattcgacacggcaaaggaagatgtggaactgcgaaccggcatccccaggcagcttctactgcaggtggagtcaacaacggtcgcaacccgcagactctcgggctttctccgaacattggccgatagattggaaggcaccaaggaactgttgtccagcgacatgaagaaggactttataatgcacagactgccgccttattctgccggagacggggcagaactgtcaaccccaggagggaagctccccagactggactctgtggtgcggttgcagtttaaggaccacatcgtccttactgtccttcccgaccaggatcagtctgatgaagcccaggagaaaatggtatatatctatcactctttaaaaaactcaagggagacccacatgatgggcaacgaggaggaaacagagtttcacggcttacgtttccccctctcccacctggacgccctgaaacagatttggaattcccctgcaattagcgtgaaagatctgaaactgacgacagacgaggaaaaggagtctctggtactaagcctgtggaccgaatgcctgatccaggtggtttag

SEQ ID NO: 231245 - DNA, 1395 bp, Artificial Sequence
  Description of Artificial Sequence: Synthetic coding sequence
atgccaaagaaggccaagccaaccgggtccggcaaggaagaaggccctgccccatgtaagcaaatgaaactggaggcggcagggggtccatctgcactgaactttgatagcccctcctcactgttcgagtctctgatctcccctataaagacagaaaccttcttcaaagaattttgggagcagaaacctctgctcattcagagagatgatccagcactggctacttattacgggtctctatttaagctgactgaccttaaaagcctttgctctcgaggaatgtactatggtagagatgttaacgtgtgccggtgcgtgaacggtaaaaaaaaggtacttaacaaggatggaaaagcacacttcctgcagctgcgaaaggacttcgatcagaagagagctaccattcaatttcatcagccccaacgctttaaagacgaactgtggcgaatccaggaaaagctcgagtgttatttcggttctctggtggggagcaacgtctatatcacgcccgctggtagccagggactgccgcctcactacgacgatgtagaggtctttatcctgcagctggagggagaaaaacattggagactttaccacccaaccgtacctcttgccagggagtattccgtagaggccgaggagcgtattggtagacctgtgcatgaattcatgctcaaacctggtgatctgctgtattttccccgtgggaccattcatcaggcggatacgcccgcaggactggcgcactcaacacatgtaacaatttcgacataccagaacaactcatggggagacttcctcctcgacaccattagtgggctggtgtttgacacagctaaagaagatgtggagcttagaacaggcatccccagacagctgcttctggtggaaagtaccactgtggctacccgaaggcttagcgggtttctgcgaacactcgcagacaggttggaaggcacaaaggaactactgtctagcgatatgaagaaagattttattatgcatcgattacctccgtatagtgccggagatggggctgagctgtctacccccggaggaaaacttccaaggttagacagtgtggtacgcctacaattcaaagaccatatcgtgttgacagtactgccggatcaagaccagtcagatgaggctcaagaaaaaatggtgtacatctatcacagcctaaagaacagtcgtgaaacgcacatgatgggaaatgaagaagagacggagtttcacggcctgagattcccactgagtcatctggatgctctgaagcagatttggaattcgcctgccatttcggtcaaggatcttaagctaacaactgacgaggagaaagaaagtctggtgctgtctttatggaccgagtgcctcatacaggttgtatag

SEQ ID NO: 231246 - DNA, 1398 bp, Artificial Sequence
  Description of Artificial Sequence: Synthetic coding sequence
atgcctaaaaaagctaagccgaccggttctgggaaggaagaaggacccgctccatgcaagcagatgaagttagaggcagctggtgggccaagtgctttgaatttcgactctccctctagcttatttgagagtctgatttccccgatcaagacggagacctttttcaaggagttttgggagcagaaaccactcttaattcagcgcgatgatccagccctcgctacgtattatggctcgctgtttaaactgaccgatctgaaatcactatgttcccgaggtatgtactatggacgagacgtgaatgtgtgtcggtgcgttaacgggaagaaaaaagtgctgaacaaggacgggaaagcccattttctccagctgaggaaggattttgaccagaagagggccaccatccagtttcatcaaccccagcggttcaaggacgaactgtggaggatccaggaaaaattagaatgctactttggcagtctcgttggaagcaatgtgtatataacccctgctggtagccagggtctgccccctcattatgacgacgtggaagttttcattctgcagctggagggggaaaagcactggaggctgtaccatcctacggtgccactggccagagagtacagcgtggaagccgaagaacgcatcggcagacctgtgcatgagtttatgctcaaacctggcgacctgctctatttccccagagggaccatccaccaagctgatacccccgcaggtctggcccactctactcatgtaactatttctacctaccagaataactcctggggcgatttcttactcgatactatctctggactggttttcgacaccgccaaagaggacgtggaattgaggactgggatccccaggcagctcctattacaggtggaatctactaccgttgctactcgacgcctgagtgggtttctcaggaccctggccgaccgcttagaaggcactaaagaactgcttagtagcgatatgaagaaagattttattatgcacagacttcccccatactctgctggtgacggggcagagctgagcactcctggaggcaagctgcctcgcctggactcagtggtgcggctacagttcaaggatcacattgtcctcactgtgcttccagatcaggatcagtcagacgaagctcaggagaagatggtttacatctatcactccctgaaaaactcgcgggaaacacatatgatggggaatgaagaagagaccgaatttcacgggttaaggttccccctgtcccacctggacgcacttaaacagatctggaactcaccggcaattagcgtcaaagacttgaaacttacgacagacgaggagaaggaatccctggtgctttcattgtggacggagtgtctaattcaggtggtgtag

SEQ ID NO: 231247 - DNA, 636 bp, Artificial Sequence
  Description of Artificial Sequence: Synthetic coding sequence
atgcttctccaagtgccatgcaatagttggggggacttcctgctggacaccattagcggactggtcttcgacactgccaaggaggatgttgaacttcgcaccggaatccccaggcaactgttgctccaggtggaaagcactactgtggcaactagacgcttaagtgggttcctgcgcactctcgccgaccgtctggaaggcactaaagaacttctctcatctgatatgaaaaaggattttatcatgcataggctgccaccctactcggctggcgacggagccgagttaagcacccccggaggtaagctgccgaggctggacagcgtggttaggttacagtttaaagatcacatagtgctgaccgtgctgccggatcaggaccagtctgacgaagcacaagaaaagatggtttacatctatcatagtctgaagaattcccgggaaactcacatgatggggaatgaagaggagacagagtttcatggcctccgctttcctttgagtcacctggatgccctgaagcagatctggaacagccccgctataagtgtcaaagatttgaagctgacgacggacgaagaaaaggaatccctcgtgcttagcctttggaccgaatgtcttattcaagtggtgtag

SEQ ID NO: 231248 - DNA, 339 bp, Artificial Sequence
  Description of Artificial Sequence: Synthetic coding sequence
atgcctaaaaaggctaaacctactggaagcgggaaggaagaggggccagccccttgtaagcagatgaagctggaggcagcagggggtccatcagccctgaactttgactccccttcgtccctgttcgaatccctaatctcccccatcaagacagagactttctttaaagaattttgggagcaaaagcccctgttgattcaacgggatgaccctgccttggctacttactatggaagtctttttaaactgaccgacctgaagagcctttgcagcaggggcatgtattacggccgagatgtgaacgtttgcagatgtgtcaacggaaaaaagaaggtgtag

SEQ ID NO: 231249 - DNA, 459 bp, Artificial Sequence
  Description of Artificial Sequence: Synthetic coding sequence
atggggcctccttctctgcattcacccacgccgtcactggggcctctgggggcattagtgctgagcagccagcatactagccccgatagctgtaaatctccctggacgctgaaagccgttcgcgcagcgaggcaggccgctgacttcaccctcaaagtggaggtggagtgcagctccctccaggaggcagtccaggcggctgaggcaggggctgacttagttcttctagacaatttcaagcccgaggaacttcaccctactgcgacggtcctcaaagcacagtttcccagcgttgccgtggaagctagtggtggcattaccctggacaacctgccccaattctgcgggccacacattgacgtaatttccatgggcatgcttacacaagcagccccagctctggacttttccttgaaactgtttgccaaggaagtagcccctgttccaaagattcactag

SEQ ID NO: 231250 - DNA, 1434 bp, Artificial Sequence
  Description of Artificial Sequence: Synthetic coding sequence
atgttccctgtcttcccgtgcacactgctggccccacctttcccagtgctcggtctggacagtagaggcgttggagggttgatgaacagcttccctcccccacagggccacgctcagaatccactgcaggtgggggctgagctccagtcccggttctttgcttcccagggctgcgcgcagagcccgttccaggctgcgccagcacctccgcctacaccccaggctcccgctgccgagcctcttcaggtggacctgctccctgttctcgccgctgcacaggaaagcgctgctgccgctgctgctgcagcagccgctgcagccgcagtggcggcagcccctcctgcccctgccgcagccagcacagtcgatacagctgctctgaagcagccgcctgcccctccacctccccctcccccagtcagtgcgcctgccgctgaagccgctcctcctgcatccgccgcaacgatcgccgcagctgctgccaccgctgtggtcgcgccaaccagcaccgtcgccgttgctcctgtggcctcagcgctagagaaaaaaacaaagagtaagggcccttatatttgcgcgctgtgtgcaaaagagttcaagaatggatataacctgcggagacacgaggcaatccatactggggctaaggctggacgtgtgcctagcggagcaatgaaaatgcccacaatggtgcctctgtcgttgctgtccgtgcctcagctatcaggagccggaggagggggaggtgaggccggagctggcggaggcgctgcagcagtggccgcaggcggagtggttaccaccacagctagcggtaaaaggatccgcaagaaccacgcatgtgagatgtgtggcaaggcattccgagatgtataccacttgaaccggcacaagctctctcactccgatgagaagccataccagtgccctgtgtgccagcagcgttttaagagaaaggatagaatgagctaccacgtccggtcacatgatggagcagtccacaaaccttacaattgtagccattgtgggaaatcgttttcccgccctgaccacttgaatagccacgtccgccaggttcacagtaccgagcgcccttttaagtgtgaaaagtgtgaggccgcttttgcaaccaaggaccgccttcgggcacatacagtgagacacgaggagaaagtgccctgccatgtctgcggtaaaatgctgtctagtgcatacatctctgaccacatgaaagtccactcacaaggcccacatcacgtgtgcgaattgtgcaataagggcacaggggaggtctgcccgatggccgcagctgctgccgcagccgctgctgccgctgccgcagcagtggctgctccccctaccgctgtgggctcactgagcggtgctgagggggtcccagtgtcttcacagcctttaccaagtcaaccttggtag

SEQ ID NO: 231251 - DNA, 759 bp, Artificial Sequence
  Description of Artificial Sequence: Synthetic coding sequence
atgaagatgccgacaatggtgcccttgtccctactgtccgtcccacagttatcaggtgccggtggagggggtggggaagctggggcaggcggaggcgctgctgcggtggccgctggaggggtggttacaaccactgcatccggaaagcgaattaggaaaaaccatgcttgtgagatgtgtggaaaggcatttagagatgtgtatcatttgaaccgacataaattgtctcattccgacgagaagccctatcagtgcccggtgtgccagcagcgcttcaagagaaaagaccgaatgagctaccacgtcagatcccaccggagatgtgctaaaccatacaactgcagccattgcggaaaatcattcagccgaccagaccatctcaacagccatgtgcggcaagtgcatagcacagagcggccattcaaatgcgaaaaatgcgaagccgcttttgcgaccaaggacaggctccgcgcacacaccgtcagacacgaagagaaagtgccttgtcacgtatgtgggaaaatgcttagcagtgcatatattagcgaccatatgaaggtccactctcaggggccacatcacgtatgcgaactctgtaataagggtaccggcgaggtgtgcccaatggccgcagccgctgctgcagctgcagccgcagccgctgccgcagtggcagccccacctaccgccgtgggctcgctgtccggagccgaaggcgtcccagtttcatctcagcccttaccctcacagccatggtag

SEQ ID NO: 231252 - DNA, 1365 bp, Artificial Sequence
  Description of Artificial Sequence: Synthetic coding sequence
atggatcccagtaattggtcaagctttattttccagggtcacgctcagaacccgctccaggtaggcgcagaactgcaatcccgattcttcgcctcccagggatgcgcccagtctcctttccaagctgcaccagctcctcctcctacacctcaagccccagcagcggagccattacaggtcgacctcctccccgtcttggccgcagcccaagaaagtgctgctgcagccgcagctgccgctgccgctgctgccgctgtcgctgcggcaccacctgcacctgctgctgcttctacggtagataccgcggctctgaaacagccgccagcaccacccccaccgccaccaccagtcagcgcccctgccgctgaagccgctcctccagctagtgccgcaaccatcgcagccgctgctgcaacagccgtagtagcgccaaccagtacggtcgctgttgccccagtcgcaagcgcactggagaaaaaaaccaaatcaaaaggtccctatatttgtgccctctgcgcgaaggagttcaagaacggttataacttgagaagacacgaagccatccataccggtgcgaaggcaggcagggttccttcaggtgccatgaagatgcctacgatggtaccactttctctgctgtccgtaccccaactgtcaggggcagggggaggcggaggcgaggctggcgctgggggaggtgcagccgcagtggccgctggaggtgttgtcactacgacagcgagtggaaagaggatccgcaaaaaccatgcttgcgagatgtgtgggaaggcttttcgcgatgtttatcatttgaacaggcacaagctgagccacagcgatgagaagccttaccagtgtccagtctgtcagcagaggttcaaacggaaagatcgcatgtcctaccacgttaggagccacgatggagcggtgcacaagccatacaattgctctcactgtggaaagtcattttcacgccctgatcacctgaactctcacgtccggcaggttcactccaccgagcggccttttaagtgcgagaagtgcgaggcggcttttgccaccaaagaccgcctccgagcccatacagtacgccacgaggagaaagtgccttgtcacgtgtgcggcaaaatgctctctagcgcttatatcagtgaccacatgaaggttcatagtcagggtccacatcacgtttgcgagctgtgcaacaagggcaccggagaagtctgtcctatggctgccgcagcggctgcagccgcagctgctgccgcagcggctgtggctgctccccctactgctgtgggctcactttccggggcagagggcgtgcccgtctcctctcagcctttgccttctcagccatggtag

SEQ ID NO: 231253 - DNA, 2955 bp, Artificial Sequence
  Description of Artificial Sequence: Synthetic coding sequence
atgagagcacctgctagaggcacaggctgctgtggacgcagcgggggtagatggctagcgggagctgcccagcccaggtgtctttgggctggcggagcagggcagcgatttatggtgcctggaggcaccatgaagtccctgaaaaaagatagccgtctgcgaatcacacccacccgtttgctggaggcaagcgagaatgtcaaggagaaaaaaagggctaagggcccagagcagcctaccccaaccatccaagaggaacccgagccagtttccaatgtactccaaggcgatgacattctggctcttgctattaaaaaggaggaccttaaggaacagcatattccaagactcactgagaaagaggacaagagagtgatcactcaaaaattcatcatcaggaaactcaagcctatggatccgcgaagaaaggtgtgccatctggtggcgaggcctgctaaccctgatgaagctactaaaccactggattattccgggccaggggattcattcgatggatcagaccaaattctgcctcatcatatactgggcagcctacaggacttcaaacgcatcgcgttggcacgagggaacacacaactcgccgaacgtattcccacaagcccctgtttgatgaccctgatttcagccgagggagagagcaagcaaaaagcccctaaggaggagaagcgaccaccttgggctccccctccgcaacacaacttcttaaaaaattggcaacggaataccgcgctgcgtaaaaagcagcaagaggccttgtctgaacacttgaagaagcccgtcagtgaactgctgatgcataccggggaaacttaccggcgtatacaagaggaaagggagttgattgattgcactctcccaacgaggcgggaccgaaagagttgggaaaatagtggcttttggagcagactggagtatctgggggatgagatgacgggcctggtaatgacgaaaactaagacacagcgaggtctaatggagccgatcacacacatccgtaaaccacattcaattagagtagagacagggcttcctgcccagagagacgcctcctaccgctacacgtgggacagatcactgttcctcatctataggcgcaaagagctccagaggatcatggaggagttggattttagccagcaagacatagacggcctcgaggtcgtgggcaaaggatggccatttagcgcagtgaccgtagaggattacactgtgtttgagaggtcccaggggagcagctcagaggacacggcttacctgggcactttagcctcatcctctgacgtgagtatgcccatcctggggcctagcctactgttctgcggtaagcccgcatgctggatcagggggtcaaacccacaagataaacgccaggttggaatagctgctcacctgaccttcgaaacattagaaggagagaaaactagttcagaactgaccgttgtgaataatggcacagtggccatttggtacgactggagacgccagcatcagcccgacacttttcaggacctcaagaagaatagaatgcagagattttactttgacaatagagagggcgtcatcctgccaggagagattaagacgtttacctttttctttaaatccctcactgccggtgtgttccgggaattttgggaatttcggacgcacccaaccctactaggcggagctatccttcaagttaatctgcacgctgtgagcttgactcaagacgtgtttgaagacgaaaggaaggtgcttgagtccaaacttacagcacacgaagcggtcaccgtggtgagagaagtcctacaggagctccttatgggagtcctcactcccgaacgtaccccctctcccgtggatgcctatctgaccgaggaagacttattcagacacagaaaccctcccctgcactacgaacatcaggtggtgcagtctcttcatcagctgtggaggcagtatatgaccttgccggcaaaggctgaagaagcaagacccggagacaaagagcacgtttcacccatcgccactgagaaggcctctgtaaatgctgaactgctcccgaggtttaggtcccctatctccgagactcaggttccacgtcccgagaatgaagctctgagagagagcggatcccaaaaggccagagtgggtaccaaaagcccgcagagaaaatcaatcatggaagaaatcctggttgaggagtcacccgacgtggatagcacgaagagcccctgggagcccgacgggttgcctttattagagtggaacttatgcctggaggactttcgtaaggccgtcatggtgctgcccgacgaaaatcaccgcgaggacgccttgatgcggcttaacaaagccgctctggaactctgtcagaaacccaggcccttgcagtctaacctcctccaccaaatgtgtctccaactctggagagacgtcatcgattcactggtcgggcacagtatgtggctgaggtctgttctcggcctgcccgagaaagagacaatttatctgaacgtcccggaggagcaagatcaaaaatccccgcctattatggaagtgaaggtccctgttggcaaagccggaaaagaagagaggaaaggagccgcacaggagaagaaacagctgggcattaaggataaggaggataaaaaaggtgccaagcttttgggcaaggaggatcgtccaaactccaagaaacacaaggctaaggacgacaagaaggttattaaaagcgcctcccaggatagattctcactggaagacccgacgccagatataatactcagtagccaagaaccgatcgatcctctggttatggggaaatatacacaatctctccattcagaggtgcgcggattactcgatactctggtgaccgatcttatggtgctggcggacgagctatcacccatcaaaaatgtggaggaagcactcagactgtgccgatag

SEQ ID NO: 231254 - DNA, 2829 bp, Artificial Sequence
  Description of Artificial Sequence: Synthetic coding sequence
atggtgcctgggggtacaatgaagtcattgaagaaggattcgcgattgagaattacacccaccagattattagaagctagtgagaacgtgaaggaaaagaagcgggcaaagggtccagagcagcctacacccactatccaggaggagccagaacccgtcagtaacgtgctgcagggtgacgatatattggcattagcaatcaaaaaagaggacctcaaggagcaacacatccccagattgaccgagaaagaggataaacgggtgatcactcagaagtttatcattagaaaactgaagcctatggatccacggaggaaggtctgtcacctggtggcaagacccgcaaacccggacgaagcgacaaagcccctagattatagtggcccaggggacagctttgatggatctgatcaaatactgccacaccatatcctgggatcacttcaggactttaagaggatcgccctggccaggggaaacacgcagctcgccgagcggatccctaccagcccctgcctgatgacactcatatccgcagaaggagagtcaaagcaaaaggcacctaaggaagaaaaacgtcccccatgggcccctccgcctcagcacaacttcttgaaaaattggcagcgtaataccgccttgaggaaaaagcaacaggaggcactttccgagcacctgaaaaagccagtgtcagagctactgatgcataccggggaaacatataggcgcattcaggaggagcgtgaactaatcgattgcaccctgcccaccagacgtgatcggaaaagttgggaaaattccggtttctggagcagactcgagtatctgggagacgaaatgacaggcctcgtgatgacaaaaaccaagacacagagagggcttatggaacccattacgcatattaggaagccacattccattagggtggaaacaggtttaccagcccagcgcgacgccagttaccgatatacctgggatagatcactgtttctaatttaccgcaggaaggaactgcaacgtattatggaagagctggacttctctcagcaggatattgatggactagaagtcgtcggtaaagggtggcccttttctgctgtgactgtggaagattatacggtctttgagaggtcccaggggagctcttctgaggacactgcatacctgggcaccctggcaagctccagcgatgtgagcatgcccattcttggaccctcgttgcttttttgtggcaaacccgcatgctggatcagaggttccaaccctcaagataagagacaagtgggtatcgccgctcacctgaccttcgagaccttagagggagagaagacaagctccgagttaactgtagtgaataacggtactgttgccatttggtacgactggcggcgacaacatcagcctgatacctttcaggacctgaagaagaacagaatgcaaaggttctactttgataatagggagggcgttatattgcctggagagataaagaccttcaccttcttcttcaaatcactgaccgcgggtgtcttccgagagttttgggaatttcgtactcacccgacactcttgggcggtgcaattctgcaggttaaccttcacgcagtaagcctgactcaggatgttttcgaggatgaaaggaaggtactcgaaagtaaactgacagcccatgaggctgtcaccgtggttcgggaggttctgcaagaactcctcatgggagtcctgactcccgagcgtacccctagtcccgtggacgcttatctgaccgaggaagatctgttcaggcatcgaaatccacccttgcactatgagcaccaggtagtgcagtccctgcatcagctgtggagacagtatatgaccctccctgcaaaggccgaggaagcacggcctggagacaaagaacatgtcagtccaatcgccactgagaaggcatctgttaacgcagaattgctgcctcgctttcggtctcctatttccgaaacccaggtgccgcgacccgaaaatgaggccttgcgtgagtccggcagccagaaggccagggtggggaccaagagtccccagagaaagagcattatggaagaaatcctggtggaggaatcccctgatgtcgactctacaaaatctccttgggagccagacgggctgcctttattagagtggaacctgtgcctcgaggacttcagaaaggccgtgatggtcctccccgatgaaaatcaccgggaggatgctctgatgaggctgaacaaggcggctttagaactctgtcaaaaaccccgtcccttgcaaagcaatcttctgcaccagatgtgtttacagctgtggcgtgatgtgatcgattctctggtgggccattctatgtggttgcggtccgtgctgggtttaccagaaaaggaaactatatatctgaacgtgcccgaagagcaggatcagaagagccctcccataatggaggtaaaagtgcccgtcggaaaagcagggaaggaagagcgaaaaggagccgctcaggagaagaagcagctggggattaaagataaggaagacaagaagggggctaagcttcttggaaaggaagatagaccgaattccaagaaacacaaggctaaggatgataagaaggtcataaaatcagcatcccaggatcgattctccttggaagatccgactcctgacattatcctctcttcgcaagagccaatagaccccctggtgatgggaaagtacacgcagagtctccatagcgaggtacatcctgggagatgcgttccatgggagaataccatgcagggagcattcccatctacgactcgttgcgggggttcatgtctgtag

SEQ ID NO: 231255 - DNA, 1992 bp, Artificial Sequence
  Description of Artificial Sequence: Synthetic coding sequence
cgaagccggggagctgaagcaacagagtccaaactttcaggtggattcaggtggacccagaaaacaagtccgactcagggggatagcgctatcactcattccctctacaggatgattttcctgaccgctctgccccttttttggatcatgatatctgcttcacgagggggtcattggggcgcttggatgccctcctccatttccgcgttcgaaggcacttgcgtttcgatcccttgtcgctttgactttccagacgagctgaggcctgctgtggtacatggggtctggtactttaattctccataccctaagaactatcccccagtggtgtttaagtcaagaacgcaagttgtccacgagtcctttcaggggagatcccgcctcttgggagatctgggcctgcgaaattgcaccctgctactctcaaacgtttcccctgaactcggcggtaaatattattttcgcggtgacctaggcggatacaaccaatacacattttccgaacactccgtgttggacatagtgaatacaccaaacattgtagtgcccccagaggtggttgccggaaccgaggtcgaggtcagttgcatggtgcctgataattgcccagaactgagacccgaactgtcctggctgggccacgaagggcttggggagccagccgtgctcggtagactgcgtgaggacgaaggcacctgggtgcaggtgagcttactccatttcgtgcccacgagggaggccaatggacacaggttgggatgtcaagcttccttcccgaacaccactctccagttcgaaggttacgcctcaatggatgtcaagtatcctcccgtgatcgtcgaaatgaactcttctgtcgaggctatagaggggtctcacgtgagtttgctgtgtggcgctgacagcaatcccccaccgttactgacgtggatgcgagatggaacggtcctgcgcgaagcagtagctgagagtctcctcctcgaattggaggaggtaacacctgccgaggatggcgtttatgcttgtctggctgagaacgcatacggccaggataataggactgtgggactctcagttatgtatgcaccctggaagccaaccgtaaacggcacgatggtagccgtagaaggcgagactgtttccatcttgtgttctactcagtccaacccagatccaatcctgacaatttttaaagagaaacagatcctaagcaccgtaatatacgaatcggaactgcaactggagctccctgctgtgtccccagaggacgatggtgagtactggtgcgtggcagaaaatcagtatggccaaagagcaacagcttttaatctttcagtagagtttgcaccagtcctgcttctggaaagccattgtgcggctgcccgtgacactgtacaatgtctatgtgtggtgaagtccaatcctgagccttctgtcgcctttgagctgccatctaggaacgtgactgttaacgaaagcgaacgggagtttgtgtatagtgagcgatcaggtctcgtgctgaccagtattctcaccttgcggggacaggcgcaggctccacctagagtcatatgtacggccagaaatctttacggggcaaagagcttggagcttcccttccagggcgcacacagacttatgtgggccaagataggcccagtgggagctgtcgtggccttcgcaatccttatcgccatcgtttgttatatcacacagacccggagaaaaaagaacgtgacggagagccctagcttttctgccggtgataacccccctgtgctcttctcaagcgatttccgcattagcggagctccagagaaatatgagtcggaacgaaggttaggcagtgaacggagacttcttggactccgaggagaaccaccagagctggacctcagttactcccatagcgatctgggaaagcgaccaacgaaagattcgtacactcttaccgaggaattggcggagtacgcagagattcgggtcaagtag

SEQ ID NO: 231256 - DNA, 1749 bp, Artificial Sequence
  Description of Artificial Sequence: Synthetic coding sequence
atgatttttcttacagccttgcctctattctggatcatgatctctgccagtcggggtggacattggggggcttggatgccatcttctatcagtgcttttgaagggacatgcgttagcattccatgcagattcgattttcctgatgaacttagacctgccgttgtgcacggggtgtggtattttaacagtccatatccaaagaattatccgcctgtagtctttaaatcaagaacacaggtggttcacgagagctttcagggaagatcccgcctgctgggagacttagggctccggaactgtacccttctactgagcaacgtttcccctgagcttggcggtaaatactacttccgaggagatctgggtggatacaaccagtatacattttcagaacactccgtgcttgatattgtgaatacaccaaatattgttgtgcctcccgaggtggtggcgggaactgaggtggaagtgtcttgcatggtgcctgacaattgccctgaattaaggccagaattaagttggcttgggcacgagggtctcggggagcccgctgtactcggacggcttcgagaagacgagggaacctgggtgcaggtgagcctgctccactttgtgccgacgagagaagcaaatggccatcggttaggatgtcaggcaagcttccccaataccacactgcagttcgagggctatgcgagcatggacgttaagtacccgcctgtgatagtcgagatgaacagttccgtcgaagcaattgaaggctcccatgtctcactgctgtgcggtgccgatagcaatccccctcccctgttgacttggatgcgagatggaacagtcctacgtgaggcagtggccgagtcactcctgctagaactcgaggaagtgaccccagccgaggacggcgtgtacgcctgcttggctgagaatgcttatggtcaggataaccgtaccgtgggcctgagtgtaatgtacgccccttggaagccaactgtcaacggcaccatggtggccgtagaaggagaaacagtgtccattctatgttctacccaatctaatccggaccccattttgaccattttcaaagaaaaacagatactgtctaccgtgatttatgagagtgaactccaactggagctgcccgcagtcagcccagaggacgacggagagtattggtgtgtcgctgagaaccaatacgggcagcgggctacagccttcaacctgagtgttgaatttgccccagtgctcctattggagagtcattgtgcggcagcaagggacaccgtgcagtgcctctgtgtagtgaaaagtaaccctgaacccagtgttgcatttgaactccccagccgcaacgttactgtcaatgagtctgaacgtgagtttgtatatagtgagcgcagcgggctggtcctgactagcatcctgacactgcgcggacaggcccaggccccacccagagttatttgcaccgcccgaaacctgtacggagctaaaagccttgagttgccctttcagggggcacatcgtcttatgtgggcaaagatcggccctgtcggtgccgtggttgccttcgccatattaatagctattgtgtgctatattacacagacacgccgaaaaaagaatgtgactgaaagtcctagtttttctgccggtgacaacccaccggtgctcttcagttccgacttcagaatctcaggagcgccagagaagtatgagtcgaaggaggtgtcaacactcgagagtcactag

SEQ ID NO: 231257 - DNA, 1881 bp, Artificial Sequence
  Description of Artificial Sequence: Synthetic coding sequence
atgatattcctcacagcactgccattgttctggatcatgattagcgcttcacgcggtgggcactggggtgcctggatgccttctagcatttccgccttcgagggtacatgcgtgtcaatcccatgccgttttgactttcctgacgaactgcgcccagcggttgtgcacggagtctggtatttcaatagtccctatccaaaaaactatcctcccgtggttttcaaatcccggacacaggtagtccacgagtccttccaaggccgaagcagactcctgggcgacctcggtctgaggaactgtactctccttctcagcaacgtatcacctgaactcggcggtaaatattacttccgtggggatctcggtggctataatcagtacacgttctcagagcacagtgtcctggatatcgtgaatacaccgaatatcgtggtgccccctgaagtcgtggctggcacggaggtggaggtatcttgtatggtccctgacaattgcccagaactacgccctgaacttagttggctgggacacgaaggcctcggtgaaccagcggtgctcggcaggctgagggaagacgaaggaacctgggtacaagtctcactgctccatttcgtgcccactagggaggctaacgggcatcgtctggggtgccaggcgtcctttcccaatactacgcttcaatttgaagggtatgcttccatggatgttaaatacccccctgtgattgtggaaatgaacagtagcgtggaagccatcgagggtagtcacgtctcgttgctctgtggtgcagatagcaacccacctccactgctgacatggatgagagacgggaccgtattacgggaggctgtggctgagtctctgctcctggaactggaagaagtcacccccgctgaagacggggtctatgcctgcctagccgaaaacgcgtacggccaagacaaccgaacagtaggcctgtctgtcatgtacgctccgtggaaaccaacagtgaatggcactatggtggccgtggagggcgagactgtctctatcctctgcagtactcagagcaatccggaccctatattaaccatattcaaggaaaaacaaatcctgagcacagtgatttacgagtctgagctacagctcgagctgcctgcagtctcaccagaagatgatggtgaatactggtgcgtggccgaaaatcagtacggccagcgtgccactgcctttaacctgtcggtggagttcgctcccgtgctgctcctggaaagccactgtgcggctgccagggacacggtgcagtgtctgtgcgtggtgaagtctaatcccgagccctcagtggcattcgagctgcctagcagaaacgtgactgtgaacgagagcgaacgcgagttcgtgtattccgagaggtccggcctggtactcacatccattctcacattgcgaggtcaagcccaggcaccaccaagggtgatctgcaccgcaaggaacctgtacggcgctaagtcactcgagctcccattccagggcgcacatcggcttatgtgggcaaaaatcggtccagtgggcgctgtggtcgctttcgctattctgatcgcaatcgtgtgttatatcactcagaccagacgtaagaaaaatgttaccgaatcaccctctttttccgccggtgataacccccctgtcctgttttcaagcgatttccggatcagcggtgccccagaaaagtacgagagtgagaggcggctcggctctgaaaggaggctgctgggattaagaggtgaaccccctgaactggatctgtcctatagccactcagacctgggcaagagaccaacaaaggattcatacactctgactgaggagctcgcagagtacgcagagatacgggttaaatag

SEQ ID NO: 231258 - DNA, 1806 bp, Artificial Sequence
  Description of Artificial Sequence: Synthetic coding sequence
atgcccagctcgatttctgcctttgagggcacctgcgttagtatcccctgtagattcgatttcccagacgaactgagaccggctgtggtgcacggagtctggtactttaattcgccatacccaaagaactaccccccagtcgtgttcaaatcacgcacacaggtggtccatgagtcctttcagggaaggagtagactgcttggcgatcttggtcttaggaattgcacactcctgctgtcaaacgtttcaccagaactgggcggtaaatactacttcaggggtgatctgggtggatacaatcagtacacttttagcgaacacagcgtactggatatcgtgaatactcctaatatcgtggttccccctgaggtagtggcagggactgaggtggaggtctcctgtatggtgccagacaattgtccggagctgcgccctgaattgtcttggctaggacatgagggtctgggcgagccggctgtactcgggagacttcgggaggatgagggcacatgggtgcaggtgagcctcctgcacttcgttccgaccagagaagctaatggccatcgactcggctgccaggccagctttcctaatactacactgcagttcgaagggtatgccagcatggatgtaaagtatcctcccgtgatcgtcgaaatgaattctagtgtcgaggccatagagggatcccatgtttcccttctgtgcggagctgactctaaccctcccccattgctcacctggatgagagacgggacggtgctacgcgaggctgtggcagagagtctgctgctcgagctagaagaagttacgccagctgaggacggcgtctacgcttgtctggccgagaacgcttatggccaggacaacagaaccgtgggcctcagtgtcatgtacgcaccttggaagcctactgttaacggcaccatggtcgctgtggaaggcgagactgtgagtatcctgtgctcaacacagagcaatccagaccccatccttacaatttttaaggagaagcagatcttatccaccgttatatacgagagtgagctccaactggagctgccagccgtctctcctgaggatgatggagaatattggtgcgttgccgaaaatcagtacggccagagagccaccgcatttaatctgagtgttgaattcgcaccggttttgttactggaatcgcattgcgccgcagctcgtgacactgtccagtgcctctgcgtggtgaaatccaacccagaacctagcgtcgccttcgaacttccttccaggaacgttaccgttaacgagtccgagcgggagtttgtctattccgaacgcagtggactggtactcacatcaattttgacgctacggggtcaagcccaggcaccacctagagttatttgcactgcgaggaacctatacggagccaaatccctggagctgcctttccaaggtgcccacagattaatgtgggcaaaaattggccctgttggggcagtggtggccttcgctatccttattgccattgtgtgttatatcacacagacgagaaggaagaagaacgttacggagagtccaagtttttctgcaggtgacaacccaccagtactgttctcctctgatttccgtatttccggcgcacccgagaagtatgagtcagaaagaagactgggtagcgagcggagacttttgggactgaggggcgaaccccctgagctggacctgagctactcgcatagcgacctcggaaagcggccaactaaggattcgtataccttgactgaagagctggcagagtatgccgaaattagagtgaagtag

SEQ ID NO: 231259 - DNA, 915 bp, Artificial Sequence
  Description of Artificial Sequence: Synthetic coding sequence
atgggaaatcatgcaggaaagagagagctcaacgctgagaaagcttccactaactctgagactaatcgcggagaatctgagaagaagagaaacctcggagaactcagcagaaccaccagtgaggataacgaagtgtttggtgaagcagatgccaaccaaaacaacggaactagttctcaagacacagcagtgacagattctaagcgcactgccgatccgaagaatgcttggcaagatgcgcacccagctgacccaggctcccggcctcacctgatcaggctgtttagtagagacgccccaggacgggaggacaataccttcaaagacagaccatcggagagcgatgaactccaaactattcaggaagatagtgcagcaacctctgaatccctggatgtgatggccagccagaagaggcctagccagaggcacgggagcaagtacctggccacagccagcactatggaccacgcccgacacggatttctgccaaggcatcgcgacacaggcatcctggactccataggcaggtttttcggcggagaccgtggtgcgccaaaaagaggttcaggaaaagactcccatcatccagctaggaccgcccattatggatcactgcctcagaagagtcacggacggacgcaggacgaaaatccggtcgttcacttctttaaaaatatcgtgacccccaggacacccccaccatctcagggtaaagggcgtggccttagtttatcccggttctcatggggggctgaaggacagaggcctgggttcggttacggaggacgggcaagcgactacaagtccgctcacaaaggattcaaaggcgtggacgcccaaggaaccctatctaagatcttcaaactgggcggacgcgatagccggtctggctcgccaatggcccgacggtag

SEQ ID NO: 231260 - DNA, 561 bp, Artificial Sequence
  Description of Artificial Sequence: Synthetic coding sequence
atggcatcacaaaaacgtccctcacagagacacggatctaaatacttggctacagcttctactatggaccatgccaggcacgggtttctgcctagacatcgagacaccggcattttagacagtatcggacggtttttcggcggagataggggggcacccaaaaggggtagtggtaaagtgccctggttaaaacccggaagatcccctttgcctagtcacgctcggtcccagccgggtctgtgtaacatgtataaggattctcatcaccctgcgaggacagcccactacgggtcactgcctcagaagtctcatggcagaactcaggatgagaaccctgtggttcacttttttaagaatatcgtgactcccagaacaccacctccatctcagggtaagggcgcagaggggcagcgaccgggatttgggtacggcggaagagcttctgactacaaatctgctcacaagggctttaaaggcgtggatgcccaggggacactgtccaagatcttcaagctcgggggaagggatagtcgtagtgggagccccatggctagacggtag

SEQ ID NO: 231261 - DNA, 594 bp, Artificial Sequence
  Description of Artificial Sequence: Synthetic coding sequence
atggcctcacaaaagcgcccatctcagagacacggctctaagtacctcgcaaccgcaagtaccatggatcacgcccgacatggcttcctgcctcggcaccgggatactgggatactggactctatcgggaggttctttgggggtgacaggggtgcgccaaaacgaggatccgggaaagtaccctggcttaaacctgggaggtcccctcttccttcccatgcccgaagtcaaccgggtctttgcaacatgtacaaagactcccaccacccagctaggacggctcattacggctcccttccacagaagtcacacggtaggacccaggatgaaaatcccgtggtacatttcttcaaaaacatcgttacccctaggaccccccctccctcccagggtaaggggcgaggtctgagcctgagccgattttcttggggggctgagggtcaacgaccgggatttggctatggtggcagagcctctgattacaaaagcgcacacaagggatttaagggagtggacgcccagggcaccctcagcaagatctttaagttgggcggtagagacagtcgcagcggtagtcccatggcgaggcgctag

SEQ ID NO: 231262 - DNA, 594 bp, Artificial Sequence
  Description of Artificial Sequence: Synthetic coding sequence
atggggaatcatgctggcaagcgtgaacttaatgcggaaaaggcctctacaaactccgaaaccaatagaggtgaaagcgagaagaaacggaacctaggcgaattgtcccgcacaactagcgaggacaatgaagtgttcggcgaggccgatgccaatcagaataacgggactagctcccaggacaccgctgtgacagactctaagcgaacagcggaccccaaaaacgcgtggcaggatgcccaccccgcagaccccggtagccgaccccaccttatccgtctttttagccgagacgcacctggtcgggaggataacacctttaaggacagaccatctgaaagtgatgagctgcaaaccattcaggaggatagtgctgcgacttctgagtcgctagatgttatggctagtcaaaaacgcccttctcaacggcacggatccaaatacctggccaccgcatccaccatggatcacgctagacatgggttcctgccaagacatagggatacggggatactcgattcaattgggcgatttttcgggggagatcgcggagccccaaagcgtgggagtgggaaggttagctcagaagaatag

SEQ ID NO: 231263 - DNA, 594 bp, Artificial Sequence
  Description of Artificial Sequence: Synthetic coding sequence
atgggcaaccacgccggtaaaagagaactcaatgctgaaaaagcgagtaccaactctgaaaccaacaggggggagtccgagaagaaacgcaacttgggcgagctgagtaggaccactagtgaggacaatgaagtctttggggaagctgatgctaaccagaacaacggcaccagttctcaggacacagccgtcacagacagcaagcgtacggccgaccccaagaacgcctggcaggatgcacatccagcggatccaggctcacgccctcacctgatcagacttttttctcgggacgcccctgggagggaggacaacaccttcaaagacagaccttccgagagcgatgaactccagacaatccaggaagattccgcagcaaccagcgagtcgctcgatgtcatggcatctcagaaaaggccgagtcaaagacatggatcaaaatacttggccacagcctctactatggatcacgcaagacacgggttcctgccccgtcaccgagataccggtatattggacagtattggaaggttcttcgggggagatagaggagcccctaaaaggggttcaggtaaggtgtcgtcagaagagtag

SEQ ID NO: 231264 - DNA, 483 bp, Artificial Sequence
  Description of Artificial Sequence: Synthetic coding sequence
atggcctcgcagaagcggccttctcagcgacatggctcgaaatacctggctactgcttcaacaatggatcatgcacgtcacgggtttcttcctcggcaccgcgatactggaattctcgattcaattggaagattcttcggaggggaccggggagccccaaaaagaggatctggaaaagatagtcaccatccagccaggacagcccactacggctctctcccccagaaatcgcacggacgcacccaggacgaaaaccctgtagttcacttctttaaaaacatcgttacccctaggactcctcccccttcccaaggaaaaggcgcagagggacagcggccaggctttggctacgggggacgagcttcggactacaagagcgcccataagggttttaaaggtgtagacgcgcaagggactctgtctaagatattcaagctgggcggaagagattctagaagcggatctcccatggcaaggcgttag

SEQ ID NO: 231265 - DNA, 516 bp, Artificial Sequence
  Description of Artificial Sequence: Synthetic coding sequence
atggcctcacagaaaaggcctagtcagcgtcatggatctaagtacctggccactgcctccaccatggaccacgctcgtcacggctttctgccgcgtcaccgcgacaccggcatactggactccataggcagatttttcggtggggacaggggggcaccaaagcgcggttctgggaaagactcccatcatccagccaggaccgctcactatggctcactccctcagaagtcccacggtaggactcaagacgagaacccggtggtgcatttcttcaagaacatcgtcacacccaggacaccacctcctagccagggaaagggtcggggtctttcactttctcggttttcctggggcgctgagggccagaggccgggattcggatatgggggaagggcatctgattataagtctgcacataaaggattcaagggagtggatgcccaggggaccttaagcaagatatttaaactgggcggaagagattctcgctccggatctcctatggcacgccgatag

SEQ ID NO: 231266 - DNA, 261 bp, Artificial Sequence
  Description of Artificial Sequence: Synthetic coding sequence
atggccagccagaaaagaccttcacagcgacacggatcgaaatatctggctaccgccagcacaatggatcacgcaaggcatgggtttctgcctcgtcacagagatactggcatcctagattccatcggcaggttttttggcggtgatcggggtgccccaaaacgcggttccggaaaagattcccatcatcccgcaaggactgcacattacggcagcctgccgcagaaatcccacggaagaacacaggacgagaatccgtag

SEQ ID NO: 231267 - DNA, 888 bp, Artificial Sequence
  Description of Artificial Sequence: Synthetic coding sequence
atggcaagtctgtcgagaccctccctgccttcatgtctgtgctcatttttgctcctgcttctactgcaagtcagctcatcgtacgcaggacagttccgagtaatcggccctagacatccaattcgtgcactcgtcggcgacgaagtagagctgccctgccgcatttcacctgggaagaatgctactggtatggaggtgggctggtaccgcccacccttcagccgtgtggttcatttatacaggaacgggaaggatcaagacggagaccaggctcccgaatatagggggaggacggagttgttaaaagatgccatcggagaaggaaaggttacattgcggataaggaatgtcaggttcagcgacgaggggggttttacctgcttcttcagagatcattcataccaagaagaagccgctatggagttgaaggtggaagatccgttttactgggtgtcccccggagtgctggtgctccttgccgtcctacctgtgctgctgcttcaaattaccgtgggcttagtttttctgtgccttcagtacaggctgcgcggaaagttacgggctgagatcgagaatctgcaccgtacctttgacccccactttctgagggtgccctgctggaagataaccctgttcgttatcgtgcccgtcttggggccactcgtggcgttgataatctgttataattggctgcatcgacgactggcaggtcagttcttagaggagctccggaaatttagctcgttgtgctacaagcagaggataaagtctcaagaaagagagacagaggcaacacgaggcagagggggactgctccgtgaccatatccctagaggaaaggaggaactggagtcccttgggggtgggaaaaccccccctggcagatag

SEQ ID NO: 231268 - DNA, 642 bp, Artificial Sequence
  Description of Artificial Sequence: Synthetic coding sequence
atggcctccttatcaaggcctagcctgccatcatgcctgtgctccttcctgctgctcctgctcctgcaagtctcgtcatcttatgcagggcaatttagagttataggccctcgccatccaatccgagcactggtgggagacgaagtcgaactgccttgtcggatctcgcccggtaagaatgcgactggaatggaggtgggatggtatcgacctccttttagtcgcgtggttcacctgtataggaacgggaaggatcaagacggcgatcaggccccagagtatcggggacgcacagaattattaaaagatgctattggtgaagggaaggtgacccttcgaattagaaatgtgcggttttctgacgagggaggattcacctgcttttttcgtgaccactcgtaccaagaggaggccgctatggaacttaaggtggaagaccctttttactgggtgtctcctggcgtgctcgtgctgctcgctgtcctccccgtgctgcttctccaaattacagtcgggctggtgtttctttgtctgcagtataggctgagggggaaactgcgcgctgagattgaaaatttacatagaacttttgggcagttcctggaagaattgctgtttcatctcgaagccctgtccggctag

SEQ ID NO: 231269 - DNA, 396 bp, Artificial Sequence
  Description of Artificial Sequence: Synthetic coding sequence
atggccagtttgagccgacctagcctgccgtcctgcctatgctcgttcctacttttgctcctcctgcaggtgtcctcatcgtatgcggaccccttctattgggtatcaccaggagttctggtgctccttgccgtcttgcccgtcctcttactgcaaataaccgtagggttaatcttcctttgcctccaataccgtctcaggggtaagctgagggccgagatagaaaatctgcacagaaccttcgatcctcactttctaagggtaccctgctggaagatcacactcttcgtcatcgtgcccgtgctgggccctctcgttgccctgataatttgctataactggctgcatcgcagactggccggacagttcctggaagaattgcgcaacccgttctag

SEQ ID NO: 231270 - DNA, 621 bp, Artificial Sequence
  Description of Artificial Sequence: Synthetic coding sequence
atggctagtctctccaggccaagcttaccgtcctgtctttgctccttcctgctcttgctgctacttcaagttagctcatcatatgcgggtcaatttagggtaattgggcctaggcatcctatacgagccttagtgggagatgaagtagaactgccatgccgcatctcgccgggaaagaacgccaccggtatggaggtggggtggtaccggcctccgttttctagggtcgtgcatctctaccgtaacggaaaggaccaggatggggatcaggcccctgaataccgtggcagaacagagcttctcaaagatgctatcggcgagggcaaggtgacattaagaatacgaaatgtgagatttagcgacgagggcggatttacctgcttctttcgcgatcattcctatcaggaggaagccgctatggagttgaaggtggaggaccctttctattgggtgtcccctggggtgttagtgttactggcggttctgccagttcttctgctccagatcacagtgggtcttatctttctctgcctacaatataggttaagaggtaaactacgggctgagatcgagaacctgcatcgcacctttgtgttccatctggaggcgctgtccggctag

SEQ ID NO: 231271 - DNA, 759 bp, Artificial Sequence
  Description of Artificial Sequence: Synthetic coding sequence
atggcttcgttgtccagaccttccctgccctcctgtctttgttcgtttctgctactgttgcttctccaggtgtcaagtagctatgcaggccagttccgagtaattggcccacgacatcctatacgtgctcttgtcggggacgaggttgagttgccttgccgcatttccccgggaaaaaacgccacgggtatggaggtcggatggtatcgaccacctttcagtcgagtggtgcatctctaccgtaacggtaaagatcaggacggggaccaggctcctgagtatcgcggacggaccgaactgctgaaggatgccatcggggaggggaaagtgactctgcgaatccgcaacgtgaggttctcagacgagggtggcttcacatgctttttcagggatcatagctatcaggaggaggccgcaatggaactcaaggttgaggaccctttttattgggttagccccggagttctggtactgctagcagtattgcctgtgctgttactgcagataacagtaggactgatatttctttgccttcagtaccggctgcggggaaaattgcgagccgagattgagaacctgcaccggaccttcgacccacattttctcagggtgccctgctggaaaataacactctttgtgattgttcctgtccttggtccattggtagcactgattatatgttacaactggctgcaccggagactcgcgggacagtttctcgaggagctactgttccatctggaggccctgagcgggtag

SEQ ID NO: 231272 - DNA, 516 bp, Artificial Sequence
  Description of Artificial Sequence: Synthetic coding sequence
atggcatctttgagcagacccagtctgcctagctgtctgtgtagctttctgctgctgttgcttctacaggtgtcctcttcttatgcgggacagttcagagtgataggacccaggcaccccataagggcgctggtgggcgatgaagtagagctgccctgcaggatctcccccggaaagaatgctaccgggatggaagtaggctggtatcgccctcccttctccagagtggtccacctgtaccggaacggcaaggatcaggacggtgatcaagcgcctgagtaccgcggtaggacggaattgttgaaggacgctattggcgaggggaaagtgaccctgcggattcggaatgttagattctcagatgaaggcggattcacatgttttttcagagatcactcttaccaagaagaggcggctatggaactaaaagtggaggtcagccacagcgtgacccaggattggctgcagtggcacgatcacggtagcctgcaaccaccccctccacgcctcaagtag

SEQ ID NO: 231273 - DNA, 744 bp, Artificial Sequence
  Description of Artificial Sequence: Synthetic coding sequence
atggctagcctgagccggccttccttgccgagttgtttgtgctcatttctcctgctgctgctcctccaggtctcgagctcttacgcgggacagtttcgggtgataggtccccgacacccaattcgcgcactggtcggggacgaagtggaactgccatgccgcatttcacccggaaagaatgcgaccggcatggaggttggatggtatcgcccacctttctctagggttgtgcatctttacagaaacgggaaggaccaggatggcgaccaggccccagaatacagaggccgtacagaactgttaaaagacgctatcggcgaaggtaaagtgactctgcgcatccggaacgtcagatttagcgacgaaggcggatttacgtgctttttcagagatcacagctaccaagaggaagcagccatggaacttaaagtggaagatcccttttattgggttagcccgggagtgctggtgcttttggcagtgctacccgtgctgctccttcaaattactgtagggttgatattcctgtgcctccagtaccgcttaaggggcaagctccgggctgaaattgaaaacctgcatcgaaccttcgaccctcactttctgagagttccttgctggaaaattacccttttcgtcattgtgcccgtcctcggcccactggtggctttgattatctgctacaattggctgcacagaagactggcgggtcagtttctcgaggaactacgcaatcctttttag

SEQ ID NO: 231274 - DNA, 396 bp, Artificial Sequence
  Description of Artificial Sequence: Synthetic coding sequence
atggctagtctcagccgtccctctttgccatcatgtctttgctccttcctgctgcttttgctacttcaggtgagttcaagctacgcagatcctttctactgggttagccctggagtcctggttctcctggccgtccttcccgtgctgcttttacagattactgttggactggtctttctatgcctacaataccgcctccgaggcaaactgcgggctgagatagagaatttgcatcgtacctttgatccgcatttcctcagagtcccctgttggaagattacactctttgtgattgtgcccgtcctcgggcctcttgtcgccctcattatctgctataattggttgcacagaaggctcgcaggacagttcctggaggagcttcggaatcccttttag

SEQ ID NO: 231275 - DNA, 744 bp, Artificial Sequence
  Description of Artificial Sequence: Synthetic coding sequence
atggccagtctgagccgccctagtctcccgtcgtgcctgtgctcattcctcctgttgctcctgctgcaagtctcaagttcatacgccggtcagtttcgagtgattgggccacggcaccccatcagggctttagtcggagacgaggtcgagctcccctgtaggatctctcctggcaagaacgcaaccggcatggaagtgggatggtatagacctcccttcagccgtgttgtccatttgtacagaaacggcaaggaccaggatggggaccaggctcctgaataccggggaaggacagagctcttgaaggacgcgatcggagagggtaaagtgactctgaggatccggaacgttagatttagcgatgaagggggtttcacttgcttctttcgcgatcactcctaccaggaggaagccgctatggagttaaaggtcgaggatcccttctactgggtctctcctggcgtgctcgtactgctggcggtgcttccagtgctgctcctacagatcacagtggggctcgtgttcctttgtctgcagtataggcttaggggaaaactccgcgctgaaattgaaaatttacatcgaaccttcgacccccattttctgagggtgccctgctggaagatcaccctatttgtcatcgtgccagtcttaggccctttggtggctttgatcatctgctacaattggctccataggcgcctagcaggacaatttttggaggagctgcgcaacccattctag

SEQ ID NO: 231276 - DNA, 744 bp, Artificial Sequence
  Description of Artificial Sequence: Synthetic coding sequence
atggcttcattgtctcgccctagcctccccagctgtctatgctctttcctgctgttgctgctcctgcaggtctcaagctcctacgccggacagttcagggtcatcggtcccaggcatcccatcagagcgctcgtgggggacgaggtggagctcccctgtaggatcagtccgggtaaaaatgccacagggatggaggtaggatggtataggccacctttcagtagagtcgtgcacctgtatcgaaatggcaaggatcaggatggtgaccaagcccctgagtatagagggagaacagagctcctgaaagacgccataggtgaaggcaaagtgacacttagaatccggaatgtaagattctccgatgagggcggttttacctgcttctttagagaccactcctatcaggaggaggcagccatggaactgaaggtcgaggaccctttctactgggtatctccaggggttttagtgctgctggctgtcttaccagtcttgcttttgcagatcacagtgggcctggtgttcttgtgcctgcagtacagactgcgaggaaagctgcgtgccgagatcgaaaatcttcaccggactttcgacccccatttcctgcgcgtgccctgctggaaaatcactctgtttgtaattgtccccgtattgggccctctggtggccctgatcatatgttataattggctgcatcggaggttagctggccagttccttgaggaactaagaaatccattttag

SEQ ID NO: 231277 - DNA, 690 bp, Artificial Sequence
  Description of Artificial Sequence: Synthetic coding sequence
atggctagtctgagcaggccttcgctacctagctgcctgtgctcttttttgctgttgctcttgctccaggtctcctccagctacgctggccagttcagggtgatcgggcctcgtcacccaatccgagccctggtaggcgacgaggtggagctcccctgccgaatttctcctggcaagaatgctaccggaatggaggttgggtggtatcggccaccctttagtcgggtagtgcacctgtatagaaacggaaaagaccaggacggcgatcaggccccagaatatcgcggaagaacagagctattgaaggacgcaatcggtgagggaaaagttacactgcgcattaggaacgtgcgatttagcgacgaggggggtttcacatgcttctttcgcgaccattcctaccaggaggaagccgcaatggagctgaaggtggaggacccattctattgggtgagcccgggagtgcttgttttgcttgcggtcctgcccgtcctgctgcttcaaatcaccgttgggctggtctttctctgcctgcaatataggcttagggggaagctccgcgcagaaatagaaaatttgcatcgcaccttcgagtcgttcggcgtactgggaccacaggtgaaagaaccaaagaagactggacagttcctggaagaacttttattccacctggaagcgctatctgggtag

SEQ ID NO: 231278 - DNA, 642 bp, Artificial Sequence
  Description of Artificial Sequence: Synthetic coding sequence
atggcgagtctcagtcgccctagtctaccaagttgcttgtgctctttcctgctgctactcctcctccaggtatcttcatcatacgccggtcagtttagggtcattgggccaagacaccccattcgggctctggtgggcgatgaggtggagctaccctgccgaatatcccctggcaaaaacgcaactggaatggaagtggggtggtaccgtccacctttctcacgcgtggtccacctgtaccggaacggcaaagaccaagatggtgatcaggccccagagtatcgcggaagaactgaactcctgaaagacgcaattggggagggaaaggtgaccctgagaatacgtaacgttcgcttttctgatgagggcggtttcacgtgtttctttagagaccacagttatcaggaggaagccgctatggagctcaaagtcgaggatcccttctactgggtctctcccggagtcctggtcctgctggcggtcctgccagtgttgcttctgcagataactgttgggctcatctttctctgtctgcagtatcgcctgagagggaaattgcgggctgagatagaaaacctgcaccggaccttcgggcagttcctcgaagaactgctgtttcacctggaggccctgagcggctag

SEQ ID NO: 231279 - DNA, 675 bp, Artificial Sequence
  Description of Artificial Sequence: Synthetic coding sequence
atggcctcactgtcacgtcccagcctaccttcttgcctttgttcatttctactgcttctgctcctgcaggtctcttcctcctacgccggtcagttcagggtgattggacctcggcacccaattcgcgcattagttggggacgaagttgagctgccttgcagaatctcccccggaaaaaacgcaactgggatggaggtgggttggtacagaccccctttctcacgagtggttcatctgtaccgaaatggcaaggaccaggacggagaccaagcccctgagtacagagggagaactgagctcttgaaggatgcaatcggagagggaaaagtcacgcttcgtatccggaacgttcgcttctcggacgaaggcggattcacctgctttttccgcgaccactcgtaccaggaggaggccgcaatggaactaaaagtggaagacccattctattgggtgtcacccggagtgctcgtcctcctagctgtgctcccagtcttattgctgcagatcaccgtcgggctaatcttcctttgtttgcagtatcgactgcgtggcaaactccgcgcagaaatagaaaacctgcatagaacattcgagagttttggagtgctggggccacaggtcaaggaacccaagaagaccggacagttcctcgaagagttgcgcaatcctttttag

SEQ ID NO: 231280 - DNA, 675 bp, Artificial Sequence
  Description of Artificial Sequence: Synthetic coding sequence
atggcgtctttgagtcgcccttcgcttccttcttgtctctgtagcttcctcttgcttctcctgctgcaagtgtcaagctcatacgctggccagttccgggtaattggcccacggcacccaattagggcacttgtgggcgatgaagtggaactgccatgcaggatctcaccgggaaagaatgctacaggcatggaggtgggctggtatagacccccttttagcagagtggtgcatttatacaggaatgggaaggatcaggatggggatcaggcaccagagtataggggcaggaccgaattgttaaaagatgcgattggcgagggaaaggtcaccctgcgcatccggaacgtgcggttcagcgacgagggaggtttcacttgttttttccgggaccactcttatcaggaggaggccgctatggaacttaaggtggaagatccattttactgggtgtctcctggcgtgctggtactgctagccgttctacctgtcctgttgctgcaaataaccctaggcttggtctttctctgcctccagtacaggctgcggggtaagctgagagccgagatcgagaaccttcaccgcaccttcgagtcatttggggtcttaggccctcaggttaaagagcctaaaaaaacaggtcaattcctggaggaacttagaaaccccttctag

SEQ ID NO: 231281 - DNA, 690 bp, Artificial Sequence
  Description of Artificial Sequence: Synthetic coding sequence
atggccagcctgagccgcccaagcctccccagttgtctgtgctcatttctcctcctactgctgctgcaggtctctagctcatatgccggacaatttcgggtgattggtcctcggcatcctattagggccctggtaggagacgaagtcgagttgccatgtcgcatcagtcccggaaagaatgcaacaggaatggaggtcggctggtataggcctcccttctcaagagtcgtgcacctctatagaaacggtaaggaccaggacggcgaccaggcccctgaatacagaggcaggacggaactcctgaaggatgcaattggcgaggggaaggtaacgctgaggattcgcaacgttcggttctctgacgagggaggttttacctgtttctttcgggaccactcttatcaggaggaggctgcgatggaactgaaagtggaggatcctttttactgggtaagtccaggggtgctagtgctcctcgccgtcctgcccgttctcctcctgcagattactgtgggtttagtttttctgtgtctccaataccgtctgcggggaaaactgcgcgctgagatagagaatcttcatcggaccttcgaatcatttggtgtgcttggtcctcaggtcaaagagcctaagaagacaggccagttcttggaggagttgctctttcatctggaggccttaagtggctag

SEQ ID NO: 231282 - DNA, 642 bp, Artificial Sequence
  Description of Artificial Sequence: Synthetic coding sequence
atggcgtctttgtcgcggcctagccttccctcatgcttatgcagttttctgctgctgctcttgctccaagtatccagtagttacgctggccagtttcgggtgatcggtcccaggcatcccattagggcattggtgggcgatgaggtcgaacttccatgccggataagtcccggaaaaaacgccactggaatggaggtcggctggtacagaccacccttttcacgggtcgtgcacctgtataggaatggaaaggatcaggacggcgaccaggcaccggagtatagaggcaggaccgaattattaaaggatgccataggagagggcaaagtgacgcttcgaatacggaacgtgagattcagcgatgaggggggattcacatgcttctttcgcgatcactcctaccaggaagaagcggctatggaactcaaggtggaggatccattttactgggtgtctccaggcgtgctggtgctacttgccgttttaccagttcttcttctgcaaattaccgtgggcctcgtctttctgtgtctgcagtacaggttgcgcggaaaactcagagctgagatcgaaaatttgcacaggacatttgggcagttcctcgaggagctgctgttccacttagaggcactgtccgggtag

SEQ ID NO: 231283 - DNA, 540 bp, Artificial Sequence
  Description of Artificial Sequence: Synthetic coding sequence
tgacagtttcgagtgatcggccctcgtcatccaatccgcgctctcgtgggggacgaagtggaactaccttgccgcataagcccagggaaaaacgcgactggcatggaggtgggctggtaccgaccacctttctctcgcgtagtccacctgtatagaaacgggaaggatcaggatggagatcaagcccctgagtaccgaggcagaaccgaactgctgaaggatgccatcggagaaggaaaagtcacgctgcgaatccgtaacgtgaggtttagcgatgaaggcggttttacctgttttttcagagaccattcatatcaagaagaggccgctatggaactaaaagtagaagaccccttctactgggttagccccggagtgttggtcttgctggctgtgctacccgtcctgctgctccagattaccgtcgggctggtcttcctatgtctacagtacagactcaggggcaagcttagagctgaaatcgagaatctccacaggaccttcggccagttcctggaggagctgcgaaaccccttttag

SEQ ID NO: 231284 - DNA, 396 bp, Artificial Sequence
  Description of Artificial Sequence: Synthetic coding sequence
atggcctccctttctcggccatccctccccagctgcctctgtagcttcctgctcctcctgttgctgcaggtgagtagcagttacgctgatccattttattgggttagtccaggcgtgctagtccttctggccgtgctgcccgtcctcctgctccagattaccgtgggcctcgttttcctgtgcttgcagtacaggctccggggaaagttgagggcagaaatcgaaaacctgcatcgcacttttgacccccactttctgcgggtcccctgttggaagatcaccctgttcgtgatcgtgccggtactgggaccattggtggctttaataatatgctataactggctccaccggagattagccggtcagtttttggaggagctgagaaacccattttag

SEQ ID NO: 231285 - DNA, 615 bp, Artificial Sequence
  Description of Artificial Sequence: Synthetic coding sequence
tctctaagccgacctagtctgccctcatgtctgtgttcatttcttctgttactgctactgcaggtgtcttcatcctatgcaggccagttcagagttattggccctaggcacccaatccgagccttggtgggcgacgaagttgagttaccatgccgcatttcaccaggtaaaaatgctaccggtatggaggttggttggtacaggcctcccttctctcgggtggtccatctttatcggaacgggaaggaccaggacggtgatcaggctccggagtacaggggacggacagagctactcaaggatgcaataggtgagggtaaggtaacattaagaattcggaatgtgaggtttagcgacgaggggggatttacctgcttctttagagatcacagctaccaggaggaagccgcaatggaacttaaggttgaggatcccttctattgggtaagccctggcgtactggtgcttctggccgttctcccggtcctgctgctgcagataaccgtaggtctcgtattcctgtgcttacagtaccgcttacggggaaaactgcgggctgagatcgagaacctccaccggactttcgtcttccatctcgaggccctttcaggatag

SEQ ID NO: 231286 - DNA, 396 bp, Artificial Sequence
  Description of Artificial Sequence: Synthetic coding sequence
atggcctccctgagtcgcccttctctaccatcttgcctttgttctttcctgcttttactcctcttacaggtttcttcaagctatgctgatcctttctactgggtgtctcctggcgttctggtgttattagccgtcctcccagtcctgctcctccaaatcacgctcggcctggtcttcctctgcctgcagtataggctgagaggtaaattgcgcgcagagatcgaaaatctccaccggacatttgatccccacttcctgagagtgccctgctggaagattactttgttcgtcatagtacctgtcctgggaccactggtggcactgattatctgttacaactggttgcaccggcgactagctggccaattcctggaggagctgcggaatccgttttag

SEQ ID NO: 231287 - DNA, 675 bp, Artificial Sequence
  Description of Artificial Sequence: Synthetic coding sequence
atggcgtccctctctcgcccatcactcccgagctgtctatgttctttcctgttgctgttattgctccaagtgtccagctcttacgcaggacagttccgagtcataggacccaggcaccctattcgcgcattggtaggagacgaagtggagctcccatgccgtatctccccaggaaagaacgccaccgggatggaggtaggctggtatcggccaccattctcaagagtggtccacttataccgcaatggcaaagaccaggatggcgaccaggcgcctgaatatcgaggtagaaccgaactgttgaaggatgcaattggtgaaggtaaagtgactcttcgcatccgaaacgtcagattttctgacgaaggtgggtttacctgtttcttccgtgaccactcttaccaagaggaagccgctatggaattaaaagtggaagacccattctactgggtttcccccggagtcctcgtactgctggcagtgctgcccgtcttgctcctgcagattacagtgggtctggtgtttctttgccttcaatacagactgagaggcaagcttagagccgaaatagagaacctccatagaacttttgagtccttcggcgttctgggcccacaggttaaggaaccaaaaaaaaccggtcaatttttagaagagctccggaaccctttttag

SEQ ID NO: 231288 - DNA, 675 bp, Artificial Sequence
  Description of Artificial Sequence: Synthetic coding sequence
atggcctccctgtcgaggccaagtctccctagctgcctatgcagttttttgttgttgctgctgttacaagtttcttcttcttatgctggccagttcagagttattggccctcggcatcctattagagccttagtgggagacgaggtagagctcccgtgtcggattagtcccggaaaaaacgcaaccggcatggaagtcgggtggtacagacctcccttcagtagagtcgttcacctctaccggaatggtaaggaccaggacggggatcaggcacccgaatatcgaggacgtactgagctcctgaaggacgcgatcggcgaaggcaaggttaccctccgcattcgaaatgtcagattcagcgatgaaggtggctttacatgcttctttagggaccattcctatcaagaggaggcggctatggaactcaaggttgaggaccctttctactgggttagcccaggggtcctggtgctgctggcagttcttcccgtgctacttctccagataaccgttggcctggtgttcctgtgcctgcagtatagactcagaggcaagctccgggcagaaatagaaaatctgcatcggaccttcgagtctttcggagtacttggtccacaggtgaaggagcccaagaaaaccggtcaattccttgaggagctcaggaacccattttag

SEQ ID NO: 231289 - DNA, 675 bp, Artificial Sequence
  Description of Artificial Sequence: Synthetic coding sequence
atggcgtcactttccagaccttccctcccctcctgcctgtgctcttttctcctccttttactgctgcaagtgtccagctcctacgccggacaatttcgggtgattggacccagacatccaatccgcgctctggtaggagacgaagttgagctgccttgccggatttccccaggaaagaatgctacaggcatggaagtcggttggtaccgaccacccttctctcgcgtggtgcacctgtaccgcaacggtaaagatcaggacggtgaccaggcccctgaatacaggggtagaacagagcttctgaaggacgcaatcggagaaggcaaggttaccctgcgcatcaggaatgtccgattcagtgacgaggggggattcacctgcttcttccgcgatcacagttaccaggaagaggctgccatggagctgaaggtcgaagacccattctactgggtttctcctggggtactggtcctgctggcagtgctgcccgttctccttctacagattacagttgggctggtgtttctgtgcttgcagtatcgtctccggggaaagctgcgcgctgagattgagaacctgcacagaacctttgagagttttggagtcctaggccctcaggtgaaagaaccaaagaagactggccagtttttggaggagctgagaaaccctttttag

SEQ ID NO: 231290 - DNA, 759 bp, Artificial Sequence
  Description of Artificial Sequence: Synthetic coding sequence
atggccagcctttctcgacctagtttgcctagttgcctctgcagtttcctgctcttactcctgttgcaagtgtccagttcttatgccggtcagttccgcgtgattggacccagacatccgataagggccttggtgggggacgaggtggagctcccctgtaggatctctccaggcaagaacgccaccggaatggaggtgggatggtaccggccaccattttcccgcgttgtacacctctatcggaacggaaaggatcaggatggagatcaggccccagaataccgtggacggaccgaattgctgaaagacgctatcggcgaaggcaaggtcacattaagaatacgcaacgtgagattctcagacgaagggggttttacttgcttctttagggatcacagctaccaggaggaggcagcaatggagctaaaagtggaagaccccttctattgggtgtccccgggtgttcttgtgctgttggccgttttgcctgtcttgctgttacagatcacagttggcttagtgtttttatgcctgcagtatcgactgcggggaaaacttagagcggaaatagagaatctgcacagaacattcgatcctcacttcttgcgtgttccctgctggaaaattaccttgtttgtcattgtccccgtccttggacctctggttgcgctcattatctgctataactggctgcacaggcggttggcaggacagttcctcgaggagcttctgtttcatctagaagccctgagcggatag

SEQ ID NO: 231291 - DNA, 744 bp, Artificial Sequence
  Description of Artificial Sequence: Synthetic coding sequence
atggcatccttgtcccggcctagtctgccctcttgtctatgcagcttcctacttctgctccttctgcaggtttcctcttcatatgccggacagtttagggtgataggtccaaggcatcccattagagctctggtcggcgatgaagtcgagcttccttgccgcatctcgcctggaaagaacgccacggggatggaggtggggtggtacagacccccattttctcgggtggtacacctgtaccgtaacggaaaagatcaggatggcgatcaagcacctgaataccgaggcaggacagaactcctgaaggacgccattggagaaggcaaggtcacactgcgcatcaggaacgtgaggttcagtgatgaggggggatttacttgtttcttccgggaccatagctatcaggaggaagctgccatggagctaaaagtagaggatcctttctattgggttagcccaggcgtgttggtgttgctcgcggttcttcccgtactgctgctacagatcacagtcggactggtgttcctttgtctccagtatcgcctacggggaaagctgagagccgagatcgagaacctccacagaacattcgatcctcattttctgagagtgccatgctggaagatcactttgttcgtaattgtgcccgtcttgggccctctagttgccctcatcatatgctataattggctccacagaagactggctggacagttcttggaggaattgagaaaccccttctag

SEQ ID NO: 231292 - DNA, 540 bp, Artificial Sequence
  Description of Artificial Sequence: Synthetic coding sequence
tgacaatttagagtaattgggccacgacaccccattcgcgcactggtgggagacgaggtggaactcccctgccgtatttcaccaggaaagaacgcaaccggtatggaagttggctggtatcgcccacccttctctcgtgtagtgcatctgtataggaacgggaaagatcaagacggcgaccaggcccctgaatataggggacggactgaactcctgaaggatgccatcggcgaaggtaaagtcaccctccggattcggaatgtacgatttagtgacgaaggcggatttacatgttttttcagagatcactcctatcaagaggaagctgccatggagttaaaagtggaggatccgttctactgggtttctcccggtgtgctggtactgttggctgtacttccagtcctgctcttacagatcaccgtgggcctggtgttcttgtgcctgcaatatcgtcttcggggaaagctgcgtgccgaaatcgaaaatctccaccgcactttcggacagttcttggaggagctcagaaatcccttctag

SEQ ID NO: 231293 - DNA, 540 bp, Artificial Sequence
  Description of Artificial Sequence: Synthetic coding sequence
taacagttcagagtgattggacccaggcacccaatccgcgctctcgtgggggatgaagtggagttgccatgccgcattagccccggaaagaacgctactggcatggaagttggttggtataggcctccttttagccgcgtggtgcacctgtatcgaaacgggaaggaccaagacggagaccaggctcccgaataccgcggaaggactgagcttctgaaagatgccatcggagaagggaaggtaacccttcgcattcggaacgtgcggttctccgacgaagggggttttacatgcttttttagggatcacagttatcaggaggaagccgctatggagttgaaagtggaagacccgttttactgggtctccccaggggttttagtgttgctggcagtcttgcccgtgctcctgctgcagattacagtgggcctggtttttctatgtcttcaatataggttgcggggtaagctgcgcgcagagattgaaaaccttcacaggacttttggccaattccttgaggagctacgaaatcccttctag

SEQ ID NO: 231294 - DNA, 759 bp, Artificial Sequence
  Description of Artificial Sequence: Synthetic coding sequence
atggcttctctgtccagacctagtctgccttcatgtctgtgctcattccttctgttactcctactccaggtctcctcttcatatgccggacagttccgagtcatcgggcctagacatccaatccgagcactggtaggtgacgaagtggagctcccttgccgaataagtccagggaaaaacgccaccggaatggaggtgggctggtaccgcccacctttctcacgagttgttcatctgtataggaatgggaaagatcaggacggagatcaggctcctgaataccggggacggacagagcttctcaaagacgctatcggggagggtaaggttactctgcggatacggaacgttcgtttttctgatgaaggcggattcacctgtttctttcgcgatcacagctatcaggaagaagccgctatggaactaaaagtcgaagatccgttttattgggtcagccccggtgtcctggtcctcctggctgtgctgcccgttctgctgctacagatcacagttggactggtattcctgtgtctacagtacaggttacggggaaagcttagagctgagattgaaaacctgcacaggacattcgacccgcactttttaagagtaccctgctggaagatcaccctgtttgtgatcgtccccgtgctcggtcctttggttgctctcattatctgctataactggctgcatcgcaggttggctggtcaattcttggaggagctgctgtttcacttagaagctctctctggctag

SEQ ID NO: 231295 - DNA, 690 bp, Artificial Sequence
  Description of Artificial Sequence: Synthetic coding sequence
atggcttccctcagtagaccttccttaccatcatgtttatgcagtttcctcttgctgctcttgctgcaagtttcgtcctcctatgcaggccaatttcgcgtaattggtcctcggcatccaataagagcactggtgggcgacgaagtagagttgccctgtagaatttcgcctggtaagaacgccacggggatggaagtcggatggtaccgcccaccattctctcgagtggtgcatctctacagaaatggcaaagaccaagacggcgatcaggcacctgagtaccgtggtagaacagaactgctaaaagatgcaattggagaggggaaggtcaccctgagaattcggaacgttcgcttttccgacgaagggggttttacttgcttctttcgtgatcactcctaccaggaagaagctgctatggagctaaaggtggaagatccgttttactgggtcagtcctggggtactcgtgctgctggccgtcctaccagtcctcctactccagattactgtggggctggtgtttctgtgcttgcagtaccgcctgcggggtaagttgcgtgcagagatcgaaaatctccatcgaacgttcgagagctttggcgtcctgggaccgcaggtaaaggagcccaagaagacaggacagtttctcgaagaactcttgtttcacctggaggcgctatcaggctag

SEQ ID NO: 231296 - DNA, 888 bp, Artificial Sequence
  Description of Artificial Sequence: Synthetic coding sequence
atggctagtttgtctcgcccaagcctacctagctgtttatgctcgtttctgctgctgcttctgctacaggtctcgagttcttatgctgggcagttccgggtgatcggacccagacacccgatacgtgccctagtgggcgatgaggtagagttgccctgtcggatctccccaggaaagaacgccacgggtatggaggttggatggtaccggcctccctttagcagggtggtccacctgtacaggaatggtaaggaccaggacggtgatcaggccccagaatacagggggcgaactgagcttcttaaagacgcaataggcgaaggcaaggtgacactccgtatccgcaatgtcaggttcagcgacgagggcggatttacctgcttcttcagggatcacagttaccaggaggaagctgccatggaactgaaagtggaggatcccttctactgggtctctcctggggtactcgtgctgcttgctgtcttgcccgttctcctcctccaaatcacagttggccttgtattcctatgcctccaatatcgccttagggggaaacttagagcggagatcgagaatcttcaccgtaccttcgaccctcattttttaagagtgccatgttggaaaatcacactctttgtcattgtccccgtcctagggccacttgtggcactgattatttgctataattggctgcatcgcagactggctggccaatttttggaagaacttcgcaaattctcatctctgtgttataagcaaagaattaaaagtcaggagcgagagactgaggccacccgcggtaggggcggactgctaagagatcacattccacggggtaaggaagagctcgagtcattgggagggggtaaaaccccacccggaaggtag

SEQ ID NO: 231297 - DNA, 642 bp, Artificial Sequence
  Description of Artificial Sequence: Synthetic coding sequence
atggcatcactgtctcggccatctttgccgtcttgcctttgtagtttcctgttactgttactcttgcaggtcagttcttcctacgccggtcagttcagagtcataggtcccaggcaccctatcagggccttagtgggggacgaggtggagctgccttgtagaataagcccaggcaagaacgctactggtatggaggtcgggtggtacaggcccccttttagccgagtggtgcatctttatcgcaatggaaaggaccaagatggagaccaggctcccgagtaccggggtagaactgaactactcaaggatgctatcggagagggtaaggtgaccttgcgcattaggaatgttcggttcagcgacgaggggggttttacctgttttttcagggaccatagttaccaagaagaggcggctatggaactgaaagtcgaagacccattttactgggtgagcccaggtgtgctcgtgctgctcgccgttctccccgtcctgttactccagataactgtcggcctggtattcttatgcctccagtataggctgaggggaaagctcagagccgagattgaaaacttacaccggacctttggccagtttcttgaggagctcctgtttcacttggaggctttatctgggtag

SEQ ID NO: 231298 - DNA, 759 bp, Artificial Sequence
  Description of Artificial Sequence: Synthetic coding sequence
atggcaagcctgagtcggccttctctgccatcatgtttgtgttcttttctactgctccttctcttacaggtgtcaagcagctacgcaggccagttccgcgtaatcggtccacggcaccctatccgggcactggtgggggacgaagtggagctgccttgtagaattagtccaggaaaaaatgccacagggatggaggtcgggtggtataggcctccattttcgagggtggtgcatctgtataggaacgggaaagatcaggatggcgaccaggcccctgagtacaggggcaggactgaactgctgaaggatgctattggcgagggcaaggttactcttagaatccggaatgtccgcttttctgatgaaggcggatttacttgcttttttagagatcattcataccaagaggaagcagccatggagctaaaggtggaggaccctttctattgggtgagtccaggcgtgctagtgctactagccgtcctgcctgtccttttgctgcaaattaccgttggcttggtctttctttgtctacagtaccggttacgcggtaaactgagggcagagattgaaaaccttcacagaacatttgacccgcatttcctgcgggtgccttgctggaaaatcaccttgttcgtgatagtcccagtcctcggccctctggtcgctctaatcatatgttacaattggctacataggaggctggctgggcaattcctggaggaactgttgtttcacctcgaggcattgagcggctag

SEQ ID NO: 231299 - DNA, 540 bp, Artificial Sequence
  Description of Artificial Sequence: Synthetic coding sequence
tgacagttccgcgttatcggcccacgccaccctatacgggctcttgtgggtgacgaggttgaactcccttgccgaattagcccgggaaagaatgctacaggtatggaagtgggctggtatcgaccaccattctccagagtggttcacctgtatagaaacggcaaagaccaagacggcgatcaagcacctgaatacagaggaagaaccgagttgctaaaggacgcaataggtgaggggaaagtgactcttcgcatccgcaacgtgcgttttagcgacgaagggggatttacgtgcttcttcagggatcactcatatcaagaggaggcagccatggaactgaaggtggaggaccccttctactgggtgtctcctggggtgctcgtacttctggccgttctgcccgtccttttactgcaaatcacagtcgggctggtcttcctttgtctgcagtaccggctcagaggcaagctgcgtgcagagattgagaacctccaccgcacatttggccagttcctggaagaactcaggaatcccttttag

SEQ ID NO: 231300 - DNA, 888 bp, Artificial Sequence
  Description of Artificial Sequence: Synthetic coding sequence
atggcaagcctttctcgccctagtctgccttcttgcctgtgctcgtttctcctgctgctcctgctgcaggtgtctagctcctacgcaggccagtttcgggtgattggacccaggcatcctattagagcattggtgggagacgaagtggagctgccttgtagaatctcccctggtaaaaacgcaaccggaatggaggtcggctggtatcggccacctttttcccgtgttgtgcatttgtatcgcaacggcaaggaccaggatggggatcaggccccagagtatcgcggacggaccgagctcttaaaggacgccatcggagaagggaaagttacactccgtataaggaacgtgcggtttagtgacgaaggcggtttcacttgcttctttagggaccacagctatcaagaggaagctgccatggagctgaaagtggaggaccccttctactgggtgtcacccggtgttctggttctgcttgctgttctcccggtactcctgcttcagatcaccgttgggctggtctttctttgcctacagtaccgcctccgtggcaaactacgcgctgagattgaaaatctgcaccggaccttcgacccccactttctgcgtgtgccgtgctggaagatcacactgtttgtgatagttccggtgcttgggcctttagtggcactaattatttgctacaattggcttcaccgacgcctcgcgggacaatttctggaagagctacgcaagtttagtagcctgtgctacaaacagcggatcaagagccaggaaagggagactgaagccacgcgaggccgaggcggattactgagagaccacattcccaggggtaaggaggagctcgaatcactcggagggggaaagacacctccgggaagatag

SEQ ID NO: 231301 - DNA, 888 bp, Artificial Sequence
  Description of Artificial Sequence: Synthetic coding sequence
atggcctctctgtcgcgcccttcattaccctcctgcttgtgttcatttttgctcctactgctgctgcaggtgagctcttcgtacgccggacagttcagagtaatcggacccagacaccctatccgtgccttggtcggtgatgaggtggagctgccctgccgtatttcccctgggaagaacgccaccgggatggaggttggctggtacagacctccttttagcagggtggtgcatctgtatcgcaacggaaaggatcaagatggcgatcaggcacccgagtaccgtggcagaacagagctattgaaagatgctatcggcgaaggcaaggttaccctcagaatccgcaatgtccggttctcagacgaaggtggtttcacttgttttttcagggatcacagctatcaagaggaggcagcaatggagttaaaagtggaagatccgttctattgggtgtcgcctggagtcctggtgttgctggcagtgctgccagtgctgctgctccagatcaccgtggggctcgtcttcttatgcttgcagtatcgactgagaggaaagttgagagccgagatagagaacttgcacagaactttcgatcctcatttcctccgggtgccttgctggaagataacactgttcgttatcgtgccagtgctgggtcccctggtcgctctcattatttgctacaactggctgcaccggcgattagccggtcagtttctggaggaattacggaagttctcatcactatgctataaacaacggatcaagagtcaagagagagaaaccgaggccacccgcggacgtgggggattgctgcgcgatcatataccacgagggaaagaagaattagaatcactgggaggcggaaagacaccccctgggaggtag

SEQ ID NO: 231302 - DNA, 396 bp, Artificial Sequence
  Description of Artificial Sequence: Synthetic coding sequence
atggccagcctctcacggccatccctcccttcctgcctgtgttcttttctgttacttctgctgctgcaggtcagcagctcctacgctgacccattttattgggttagtcccggtgtgctcgtgttgcttgccgtactgccagttctgctccttcaaatcacggtcgggctggttttcttatgtctgcagtacagattgaggggtaagctccgcgcagagattgagaatctgcaccggacttttgacccccactttctacgggtgccttgttggaaaataactttatttgtgatcgtgccagtgctgggacccttagtggcactgataatatgctacaactggttgcatagaaggctggccggtcagttcctggaagaactaaggaaccccttctag

SEQ ID NO: 231303 - DNA, 759 bp, Artificial Sequence
  Description of Artificial Sequence: Synthetic coding sequence
atggccagcttgtctagaccatctttacctagttgcctgtgcagtttcctcttgctgctcttattgcaggtgagcagcagctacgctggacagtttcgagtaattggcccacgccatcccatcagggctttggtgggcgatgaggtagagctgccctgccggatctctccaggcaaaaacgccacaggaatggaggttggctggtatagacctcccttttcacgggtcgtgcacctgtaccggaatggaaaggatcaagatggtgatcaggcacccgagtaccgcggaagaaccgagttactcaaggacgcaattggggaaggtaaagtgacactcaggatccgaaatgtgcggttttccgacgagggtgggttcacctgcttcttccgtgaccacagctaccaagaggaagcggcaatggagctaaaggtcgaggacccattttattgggtgtctccaggcgttctcgtgctgctggcagtcttacccgtgctgctgctccagattaccgttggtctggtgttcctgtgcctccagtatagattgcgcggaaagcttcgggcagaaattgaaaatctgcacagaacatttgaccctcatttcctccgagtcccttgttggaagatcaccctgttcgtgattgtaccagtgctgggacctctcgttgctctcatcatatgttataactggcttcatagacgcctggcaggtcaattcctggaggagctgttgtttcacttagaggctcttagcggctag

SEQ ID NO: 231304 - DNA, 744 bp, Artificial Sequence
  Description of Artificial Sequence: Synthetic coding sequence
atggccagcctgtcccgaccatccctgcccagctgtctgtgttctttcctgttgcttctcctcttacaggtctcatcatcctacgcaggtcagtttcgagtgatcggcccacgccatcccattcgcgctttggttggcgacgaggtcgaattgccttgcaggatttccccaggaaagaatgccacaggaatggaagtgggctggtaccgaccccctttctcccgtgtggtgcatctgtataggaacggcaaggaccaggatggggatcaggcaccagagtacagaggcaggacggagctgcttaaggacgccataggggaaggcaaggtcaccctcaggatcaggaatgtgcggtttagtgacgaaggtgggtttacctgctttttcagggaccactcatatcaagaggaggctgcaatggaactgaaggtcgaggatccattttattgggtttcccctggagtgttggtactcttggccgtattgcccgtactcctgctgcagattacggtcggactggtctttctctgtctgcagtacagactccggggtaagctgagggccgaaattgaaaatctgcaccggacctttgacccccacttcctgagagtgccctgttggaagattactttgttcgttattgtgcccgtccttggacctttagtggcccttatcatctgctacaattggctgcatagaagacttgccggacagttcctggaggagctgcgtaaccctttttag

SEQ ID NO: 231305 - DNA, 615 bp, Artificial Sequence
  Description of Artificial Sequence: Synthetic coding sequence
tccttatcaaggcctagtctgcccagttgtctgtgcagcttcctactacttttgctcctgcaagtctcttcttcttacgctggacaatttagggtcattggtccccgacatcctatccgggcactggttggagacgaagtggagctcccatgccgaatctctcctggcaaaaacgccacgggcatggaggtcggctggtacagacctcccttctcgcgcgttgtgcacctgtatcggaatggtaaagatcaggacggcgatcaggctccagagtaccggggtagaacagagctcctgaaggatgccataggagagggaaaggtgacgctacgtatccggaatgtgagattcagcgacgaggggggatttacatgcttcttccgggaccactcctaccaagaagaagccgctatggagctgaaagtggaggatcccttttattgggtctcacccggtgtgctagtgctgctggcggttctccctgtgcttctcttacaaatcactgtagggctcgtcttcctatgtttgcagtacagattgagaggtaagctccgggcagaaattgaaaatcttcacaggacctttgttttccatcttgaagcgttgtccggctag

SEQ ID NO: 231306 - DNA, 888 bp, Artificial Sequence
  Description of Artificial Sequence: Synthetic coding sequence
atggcttcacttagtaggccaagtctgcccagctgcctgtgctcatttttgctgttactgctcctgcaggtttcaagtagttacgccggtcagtttcgggtgatcggaccgaggcaccctattcgtgctcttgtcggagacgaggtggagctcccgtgcagaatctctccaggaaagaatgcaacaggcatggaggtggggtggtacaggccaccctttagccgtgttgtccatctgtacagaaacggcaaggaccaggacggtgaccaggccccagagtacagaggacgtacagaattgttaaaggacgccataggcgaggggaaagtgactctgcgtataagaaacgtgcgattttctgacgaaggcggttttacttgctttttccgcgaccatagctaccaggaggaggctgctatggagctgaaagtggaggacccattctactgggtgtcaccaggcgtgctcgtgctcctggccgtgctcccagttctgctgctccagatcaccctgggcctggtcttcctttgtctgcagtaccggctacgaggcaaactgagagctgaaatagagaacctgcaccgcaccttcgacccccacttcctgagagtcccttgttggaagataacgctctttgtgatagttccagtgctcggtccgctagttgccctgattatctgctacaattggctgcacagaagacttgccggtcaattcctagaagagttgaggaaattttcaagcctctgctacaagcaacgcattaagagccaggagcgagagactgaggctacccggggaaggggaggcttgcttagagatcacattccacgtggcaaggaggagcttgagtccctgggaggcggaaaaacacccccaggacggtag

SEQ ID NO: 231307 - DNA, 690 bp, Artificial Sequence
  Description of Artificial Sequence: Synthetic coding sequence
atggcaagtctcagccggccttccctgccgtcatgcctgtgttccttcttgctcctgcttttactccaagtctcttcatcttacgctggacagtttagggttattggacccagacacccaatacgagctctcgtaggagacgaggtcgagttaccctgtcggatctctcccggaaaaaatgcaaccgggatggaggtcggttggtatcggcctcctttcagccgagtagtgcacctatacagaaacggcaaggatcaggacggggatcaggctcccgagtaccggggacgcaccgagctgctcaaagatgccattggggaagggaaggtcacgctccgaatccggaacgtgcgtttctccgacgaaggagggttcacatgtttttttagagatcatagctaccaagaggaagcggcaatggagctaaaggtagaggatccgttctactgggtgagcccgggagtgctcgtgctactcgcggtcctccctgtccttctccttcagatcacagttggtttggtgttcctatgtctacagtatagattgaggggcaaactgcgcgctgagatcgaaaaccttcatcggaccttcgagtcttttggtgtgctgggtccacaagtgaaagaacccaaaaaaactggccagttccttgaggagttgctgttccatcttgaggcactgagcggatag

SEQ ID NO: 231308 - DNA, 396 bp, Artificial Sequence
  Description of Artificial Sequence: Synthetic coding sequence
atggcatcacttagcaggccgtccctgccttcttgtctctgtagtttcttattactgttgctactgcaagtttcctcaagttatgccgatcccttttactgggtttcgcccggagtgctggtgttgctcgccgtactgccggtgctgctacttcagattacagtaggccttgtattcttgtgcctccagtaccggctgcgcggaaagctcagggctgaaatcgaaaacctacatagaaccttcgacccacattttctaagggttccatgctggaaaatcactcttttcgtcatcgtgcccgtactgggtccactagtcgccctcattatctgttataattggctccaccgcaggttagcaggccagtttctggaagaattacggaatcctttttag

SEQ ID NO: 231309 - DNA, 540 bp, Artificial Sequence
  Description of Artificial Sequence: Synthetic coding sequence
tagcagtttcgagtgatcggccctcggcatcctatccgggctctggtgggagacgaggtcgagctgccttgtagaatctctcccggaaagaacgccaccggcatggaggtgggctggtaccgacccccatttagtcgggttgtgcatctatatagaaacggaaaggaccaggacggagaccaggcacccgaatataggggcagaacggagcttctgaaagacgccatcggggaagggaaggtcaccctgcgcattcgtaatgtgagattttcagatgagggaggctttacttgtttcttccgggaccatagctaccaagaggaagcagctatggaacttaaagttgaggaccccttttattgggtatctccgggagttctcgtgcttcttgccgtcctcccagtcttattgttgcagatcacattgggtttggtttttttatgtttgcaataccgcttacgcggaaagctgagagccgaaatcgaaaacctgcatagaaccttcggtcagtttctggaagagctgagaaatcccttctag

SEQ ID NO: 231310 - DNA, 627 bp, Artificial Sequence
  Description of Artificial Sequence: Synthetic coding sequence
atggcatccctctctaggccctctttgccctcctgcctatgctcctttcttttacttttgcttcttcaggtgtcttcgtcatatgctggccaatttcgtgtgatcggtcctcgccatcccattagagctttagtaggggacgaagtcgagcttccttgccggatctcaccaggcaagaacgctactggcatggaggtgggctggtatcgcccaccatttagcagagtcgttcatttatatcgcaatggaaaggaccaggacggcgaccaagccccagaataccgcggtagaaccgaattactgaaggacgctattggagagggtaaagtcaccctgcggataaggaatgtgcggttctctgatgaagggggattcacatgtttcttccgcgaccatagttaccaggaggaggccgctatggagcttaaagtggaagaccctttctattgggtgtcccctggcgttctggtcctgctggctgtgctgcccgttttgctcctacagataaccgttggcctaatcttcctttgtctccagtacagactgcgtgggaaactgcgggctgaaatagagaatctgcatagaacatttggtcagtttcttgaggagctgcggaaccccttctag

SEQ ID NO: 231311 - DNA, 744 bp, Artificial Sequence
  Description of Artificial Sequence: Synthetic coding sequence
atggcatccctgtcgcgaccctctctgccctcctgcctgtgttcctttctcctcttactgcttcttcaagtatcttcaagctacgctgggcagtttagggtaattgggccaaggcaccccatccgggcactcgtgggagacgaagtcgaactaccgtgtaggatcagtccaggcaagaacgccaccgggatggaggtggggtggtaccgaccccctttttcacgggttgttcacttatatagaaatggaaaagaccaagacggcgaccaggcaccagaatataggggcagaacagagctgctgaaggacgcaataggggaggggaaagtaactctgaggatccgaaacgtccggttttctgacgagggcggattcacttgctttttccgggaccattcatatcaggaagaggccgctatggagctgaaagtggaagatccgttctattgggtaagccccggagtgcttgtgctgttggctgtgctgccagttctgctccttcagattactgtgggcttggtattcctgtgcttacagtaccgcctgcgaggaaagcttcgggcagaaatcgagaatttacaccgcaccttcgaccctcacttcctcagagtgccttgctggaagattaccctcttcgttatcgttccagttttagggcctctggtggctttaattatatgctacaattggcttcatagaagactggcaggccagtttcttgaggagttaaggaaccctttctag

SEQ ID NO: 231312 - DNA, 396 bp, Artificial Sequence
  Description of Artificial Sequence: Synthetic coding sequence
atggcaagcttatcacggccaagtctcccatcctgtttgtgttcctttctccttcttctcctgctgcaggtgtcaagtagttacgctgacccattctactgggtgagtcccggtgtgttggtcctgctggcagtcctcccggtgctcttgctgcaaatcacagttggcctggtgtttctgtgcctacagtataggttgcgtgggaaactgcgagcggagatagagaatttgcaccgcactttcgaccctcactttctgcgtgttccatgttggaaaatcacactgttcgtaattgtgcctgtgctgggccctctagtcgcgctgatcatatgctataattggttacataggaggctggcgggacagttccttgaagagttaaggaacccattttag

SEQ ID NO: 231313 - DNA, 642 bp, Artificial Sequence
  Description of Artificial Sequence: Synthetic coding sequence
atggcctctttatctagaccctctctgccctcttgcctgtgttcttttctcctcctgctcctgctgcaggtgtcctcgagttacgccggtcaattcagagtcatcggccctcggcacccgatacgcgctttagtcggcgacgaggtggagctgccctgcagaatctcccctggcaaaaacgccacgggcatggaagtcggctggtaccgccctcccttctccagggtagtccatctgtacagaaatggaaaagaccaagacggtgaccaggctccggagtacaggggaaggacagagcttcttaaggacgccatcggcgagggcaaggtgactctgcgcatccgaaacgtccgattttcagatgagggtggattcacctgcttcttccgtgaccactcttaccaggaagaagccgcaatggaactgaaggtggaagaccccttctattgggtaagccctggtgtgcttgtgctgctggcggttctcccagtgctgcttttacagattactgtgggcctggttttcctgtgcctgcagtaccgcctgcgcggaaaacttcgcgcagagattgagaacctccaccgtacgtttggtcagtttcttgaagagctgctgtttcatctcgaagcgctgagcggctag

SEQ ID NO: 231314 - DNA, 615 bp, Artificial Sequence
  Description of Artificial Sequence: Synthetic coding sequence
tccctgagtcgaccatctctccccagctgcctttgcagtttcttgctgctgctgctgctgcaggtctcctccagttatgctgggcagtttagggtgatagggcctaggcatccaatccgggctctggtaggggatgaggttgaactgccttgccgcatctcgcctggtaaaaatgccaccgggatggaggttggctggtaccgcccaccttttagccgggtggtgcacttgtataggaacggtaaagaccaggatggggatcaggctcctgaatacagagggaggacggagctcctaaaagatgccataggcgaggggaaagttacccttcggatacgaaacgttaggttttcagatgaaggcggttttacctgcttctttagagatcattcttatcaggaagaggctgccatggagctaaaagtcgaagatcctttctactgggtgagccccggagtgctagttctcctggccgtgctgcccgtgttactgctgcagataaccctcgggttggtgttcctgtgcttgcaataccgcctgagagggaagctgagagcggaaattgaaaatctgcataggacctttgtttttcacctcgaggctctgtcggggtag

SEQ ID NO: 231315 - DNA, 675 bp, Artificial Sequence
  Description of Artificial Sequence: Synthetic coding sequence
atggctagcctaagcaggcccagtctgcctagttgcttatgctcatttcttcttttactgttgctccaggtgtcgagctcctatgctggacagttcagggtcatcgggcctaggcacccaattagggccctggttggcgacgaagtggaactaccctgccggattagtccgggaaagaacgctactggcatggaggttggatggtaccgaccgccattctcaagagtcgtacacctgtaccgcaatggaaaagaccaagacggtgatcaggcccctgagtacagaggcagaacagagctgttgaaggacgcgatcggagaaggtaaggtcacactcaggataagaaatgtccgcttcagtgacgagggcggattcacatgcttcttccgggaccactcatatcaagaagaggccgcaatggaactgaaggtggaagatccattttactgggtaagccccggagtcctcgtgctgttggccgtactgcccgtgctgctgctgcaaatcacagtgggcctcgtatttctatgcctccaatacagattgcggggaaagctcagagcagagatagagaacctccaccggacgttcgaaagcttcggagtccttggaccacaggtgaaggaacccaagaaaactggccagtttcttgaagaactgcgcaatccattctag

SEQ ID NO: 231316 - DNA, 690 bp, Artificial Sequence
  Description of Artificial Sequence: Synthetic coding sequence
atggcgtccctctcccggccttcccttccaagttgtctctgtagcttcctgctgctgctgctgctgcaggtaagcagcagttacgctgggcagttcagggtaatcgggccaaggcatccaatccgagctcttgtgggagatgaagtggaactaccatgtcgtattagtccgggaaaaaatgctacagggatggaagtggggtggtataggccccctttttcacgagtcgttcacctgtataggaacgggaaagatcaggatggagaccaggctcccgagtacagaggcaggacggaactgctaaaggatgccatcggagaaggaaaagtcaccctacgcatccgcaatgtgcggtttagtgatgaagggggtttcacttgcttcttccgtgatcatagttaccaggaggaagctgctatggaattgaaagttgaggaccccttctactgggtgagccccggagtgctggtccttctggccgtactccccgtgctgcttctgcagataactgtcgggttagtgtttctgtgtcttcagtacaggcttcgcggaaaacttagagccgagatcgagaacctgcaccgcactttcgagagtttcggcgtcctgggtccacaagtgaaggagccaaagaaaactgggcaatttttggaggagctcctctttcacctggaggccttaagcgggtag

SEQ ID NO: 231317 - DNA, 888 bp, Artificial Sequence
  Description of Artificial Sequence: Synthetic coding sequence
atggccagtctcagtagaccctcgttaccatcatgtttatgtagtttcctcctcctcctgctgcttcaggtgagctcttcttatgccggtcagtttagagtaatcggccctaggcatccaatacgggctttggtcggagacgaggtggagctgccatgtcggatctcccccggtaaaaatgcaacaggtatggaagtggggtggtaccggcctcccttttcgagggtggtgcacctgtaccggaacggaaaagaccaggatggcgatcaagcccctgaatatcggggaaggaccgaactgctgaaagatgctattggggagggcaaagtgaccttgaggatcaggaatgtgaggttctccgacgaaggaggattcacctgtttctttcgcgaccattcatatcaggaggaggcagcaatggaactgaaggtggaagatcctttctattgggttagtcccggagtgctggtgcttctcgcagttctgcctgtgttactcctgcaaattaccgtgggcttggtgtttctctgcctgcaatataggctccgtggcaaactgcgggcagaaatcgagaacctgcatcggaccttcgaccctcacttcctcagagtgccttgttggaagattaccctattcgtgatcgtgccggtattaggcccactcgttgctcttataatctgttataattggttgcacaggagacttgccggtcagtttctcgaggagctgaggaagttttcctccctctgttacaaacagaggataaagtcacaagagcgtgagaccgaggccactcgaggcaggggtggcttactccgcgaccacatccccaggggcaaagaggagctggagagcctgggcggaggcaagactccccctggccgttag

SEQ ID NO: 231318 - DNA, 540 bp, Artificial Sequence
  Description of Artificial Sequence: Synthetic coding sequence
tgacagttcagggtgataggtcctaggcatcctatcagggccttagtaggagatgaggtggagttaccctgtagaatttcccccggaaagaacgccaccggtatggaagtgggatggtatagaccccctttctctcgagttgtgcatttgtaccgtaatggtaaagaccaggatggcgaccaagctcctgaataccgagggaggaccgagcttctgaaagatgccatcggagagggcaaggtcactctacgcatcagaaatgtccgctttagcgacgaaggcggattcacatgcttttttcgagatcacagctaccaggaggaggctgccatggaattaaaagtggaggaccctttttactgggtgtcaccgggtgtgcttgttttgctcgccgtgttacccgttctgctcctgcagatcactgtgggcctcgtatttttgtgcctccagtaccggctcagggggaagcttagagccgagatcgaaaatctgcataggacctttggacagttcctggaggagctgagaaaccctttctag

SEQ ID NO: 231319 - DNA, 642 bp, Artificial Sequence
  Description of Artificial Sequence: Synthetic coding sequence
atggctagcctcagccggcctagcctcccctcttgtctctgcagctttttgctgctgttactgctgcaggtcagctctagctacgcaggccagtttcgggttattggcccacgacaccccattagagccctcgtcggcgatgaggtggagctgccctgtagaattagtccaggaaagaatgccactgggatggaggtgggatggtacagaccccctttttccagagtagtccacctatataggaatggaaaggaccaggacggagaccaggccccagagtaccggggacggacagaactactgaaggacgcaatcggagagggaaaggtcacactccggatccgtaatgtccgcttctcggacgaaggtggattcacatgcttcttccgagaccattcttaccaggaagaggccgcaatggaactaaaagttgaggatccgttttactgggtgagtcccggtgtcctggtgttacttgccgtgctgcccgtgttactgctgcagattacagtcgggctggtgtttctgtgtctgcagtaccgactgcggggaaaactcagggccgagattgagaatcttcatagaacatttggccagttcctcgaggaacttctgttccaccttgaggctttgtccggctag

SEQ ID NO: 231320 - DNA, 759 bp, Artificial Sequence
  Description of Artificial Sequence: Synthetic coding sequence
atggcaagcctctcccggccttcattgccgtcttgtttgtgcagtttcctgctcctactgttgcttcaggtatcatcaagctatgcaggacagttccgcgtcatcgggcctaggcatccaatcagagctctggtcggggatgaggtcgaattaccatgtaggatcagccctggtaaaaacgccactggcatggaagtaggctggtaccgccctccgttcagcagggtggtgcatctataccgcaacggaaaagaccaggatggggatcaggctcctgaatatcggggtcggaccgagctgttgaaggacgccattggagaggggaaggtcaccctgaggattcgcaatgtacgtttctctgacgagggcggattcacctgcttctttagggatcattcatatcaggaggaggccgcaatggagctcaaagtggaggaccctttttattgggtctcacccggtgtactggtacttttggccgttttgccagtgctgcttctgcagatcaccgtcggcctggttttcctttgtctgcaataccgtctgcgtggcaagctccgggcagaaatcgagaacctccataggacattcgacccccacttcctcagagtgccgtgctggaaaatcaccctgtttgttattgttcccgtcttgggtcccctcgtggccttgattatttgctataactggctccaccgcaggctagccggacagttcctggaggagcttctgtttcacttagaggccttgtccgggtag

SEQ ID NO: 231321 - DNA, 642 bp, Artificial Sequence
  Description of Artificial Sequence: Synthetic coding sequence
atggcgtctctgtctaggccgtcccttccaagttgtctttgtagcttcctgcttttgctgctactgcaggtctcctcctcttacgccggacagttccgagttattgggcctcgccaccctattcgggcattggttggtgacgaggttgaactgccctgtcggatatccccaggaaaaaatgctacaggaatggaggtgggctggtatcgccctccgttttctcgtgtggtgcacctttatagaaacggtaaggaccaggacggggatcaggcacctgagtaccgcggaaggactgaactgctgaaagacgcgattggcgagggaaaagtgactctacgtattcgaaatgtcaggttttccgatgaggggggattcacatgcttttttagagaccatagctaccaggaggaagcggctatggaactgaaagtggaagatcctttttattgggtgagcccgggagttctcgtattgcttgcggtccttcctgttctgttgctgcagatcactgtaggattggtgtttctgtgcttacagtacaggctgcgcggaaagctgagggccgaaatcgagaatttacacaggacatttggtcagtttctggaggaactcttgtttcacctggaagccctgtccggttag

SEQ ID NO: 231322 - DNA, 675 bp, Artificial Sequence
  Description of Artificial Sequence: Synthetic coding sequence
atggctagcttatccaggccttctttgccatcttgcctttgttctttcctccttctgctccttctgcaagtgtcatcgagttatgctggacaattccgtgtgataggaccacgccaccccattcgcgcacttgtgggggacgaagttgagctgccctgcagaatatcaccgggaaagaacgccacagggatggaagtaggatggtatagacccccttttagcagagtcgtacatctctaccgtaatggcaaagatcaggatggtgaccaggctcccgagtaccgcggacgcaccgaactgctgaaagatgccattggagaaggcaaggttaccctgaggatccgtaatgttcgattctccgacgagggtgggttcacttgttttttcagagatcatagctatcaggaggaagcagccatggagttgaaggtggaggacccgttctactgggtgtcccctggggttctggtcctactggcagtcttgcccgtgctactgctgcagatcactgtcgggctggtctttctctgtctgcagtacaggttgcgaggaaagctgcgggcagagatcgaaaaccttcacaggacgttcgaatcttttggagtactaggaccgcaggtcaaggaacctaaaaagactggacaattcttagaggagctgagaaatccgttttag

SEQ ID NO: 231323 - DNA, 615 bp, Artificial Sequence
  Description of Artificial Sequence: Synthetic coding sequence
agccttagccggcctagcttaccttcctgtctatgctcctttctcctgcttctcctgctgcaggtctcatcatcatacgccggacaattcagagtgatcggtccccgacatccgatcagagccttggtgggtgacgaggttgagttgccttgcagaatttctccaggcaagaatgctacgggcatggaagtcggatggtaccgccctcctttttcacgagtggtccacttgtatagaaatgggaaagaccaggacggcgaccaagcgccagagtataggggacgcactgagttactgaaggatgccatcggagagggaaaagtcactctgagaattaggaatgtgaggttcagcgacgagggcggtttcacgtgtttttttagagatcacagttatcaagaagaagccgcaatggagctcaaagtggaagatccattctactgggtttcgccaggggtgcttgttcttttagccgtgcttcccgtgctgctgctacagatcacggtgggactggtgtttctgtgtttacagtatagattgcggggaaagctgagagcagaaattgagaacttgcatcgcacctttgtcttccaccttgaagcactgtcagggtag

SEQ ID NO: 231324 - DNA, 675 bp, Artificial Sequence
  Description of Artificial Sequence: Synthetic coding sequence
atggcgagcctatctagaccttcattaccctcgtgtctctgtagcttcctgctccttctgttgttgcaagtaagcagttcctatgccggtcagttcagggtgatcgggcctcgtcaccccataagagcacttgtgggagatgaagtggaactgccatgccgcatcagccctggaaaaaatgcaaccggtatggaagtcgggtggtatcgccctccgttctcccgagtggtccatctgtacagaaatggcaaagatcaggacggcgaccaggcccctgagtatcgcggacgaaccgagcttctgaaagacgctattggcgaggggaaggtgactctgaggatcagaaatgtgcgctttagtgatgagggcggatttacatgctttttccgtgaccattcctatcaagaggaagccgctatggagctaaaagttgaagacccattctactgggtttccccgggagtccttgtccttctcgcagtgttacctgtgctactgcttcagatcacggtcggcctggtgttcctctgcctgcagtaccgcttgcggggtaaactgcgcgctgaaatcgaaaacctgcaccgcacctttgagtcctttggggttctcggaccgcaggttaaagagcctaaaaaaactgggcagttccttgaagagctgcgcaatccgttttag

SEQ ID NO: 231325 - DNA, 759 bp, Artificial Sequence
  Description of Artificial Sequence: Synthetic coding sequence
atggcatccctgagccgccctagcctgccaagttgcctgtgctcattcctcctcctgttactactgcaggtttctagcagttacgctggccagttccgagttataggtcccagacacccaatccgagcactggtgggcgatgaagtagaacttccatgtcggatctcgccgggaaagaacgctactggtatggaggtcggctggtatcgccctcccttttcccgcgtcgtgcacctttatagaaacgggaaggaccaggatggcgatcaagcaccggaataccgagggcgaacagaactgctgaaagacgctatcggggagggcaaagttacgttgaggatccggaacgtgcgcttttcagacgagggcggattcacatgttttttcagggaccattcatatcaggaggaggccgcaatggagctcaaagtggaagatccgttttattgggtgtctccgggtgtcctggtactcttggcagtgctcccagttctcctgctgcagattacggttgggctggtatttctctgcctgcagtacagactgcggggtaaattgcgtgccgaaatcgaaaacctgcaccggactttcgacccacacttcctccgcgttccctgctggaagataactctgtttgttatcgtgcccgttttgggacctctggttgcactgatcatatgttataactggctgcatagacgcttagctggccagttcctagaggagctactgttccaccttgaggctctgtccggctag

SEQ ID NO: 231326 - DNA, 744 bp, Artificial Sequence
  Description of Artificial Sequence: Synthetic coding sequence
atggcgagcctctcccgtccaagtctgccttcctgtctttgtagctttctccttttgttgctgctacaagtttcatcctcctatgccggtcagttcagagtcatcggcccaaggcaccctatcagggcacttgtgggcgatgaagtggaactcccatgcaggattagccccggtaagaatgccaccggcatggaggtgggttggtatagaccccctttttctcgcgtggtgcatttgtataggaatggcaaggatcaggacggcgaccaggctcccgagtatcgcggtagaacagagttactcaaggacgccatcggtgaaggtaaggtgacgctccgtattcgcaatgtccgctttagcgatgagggaggttttacttgcttcttccgtgatcattcttaccaggaagaggcagctatggagttgaaagtcgaagatcccttctactgggtgtcacccggtgtgttagtgttactcgccgtattaccggtcctcctgctccagatcactgtgggcctggtttttttgtgtttgcaatataggctgaggggtaaactgagagcagagatcgaaaacctgcaccgcaccttcgacccccactttctgcgggtcccttgctggaagataactttatttgtgatcgtgcctgttttgggcccactggtcgccttaattatttgttacaattggctgcatcgtcggctggcagggcagtttcttgaggaactgcggaatccgttctag

SEQ ID NO: 231327 - DNA, 615 bp, Artificial Sequence
  Description of Artificial Sequence: Synthetic coding sequence
tcgctgtcacgacccagcctcccctcctgcctgtgcagctttctccttctgctgctgttgcaggtgagcagttcctatgccggacagtttcgagtgatcggtcccaggcatcccattcgcgctctggtcggggatgaagttgagctgccctgtcgaatttcccccggtaaaaacgcaactggcatggaagtaggatggtatcgcccacccttcagtcgcgtcgttcacctgtatagaaacggtaaagatcaggacggcgatcaagcccctgagtacagagggagaaccgagctgcttaaagatgcaatcggtgagggcaaggtgacactacgcattcgcaacgtgcgcttttccgatgaagggggtttcacctgtttcttccgcgaccattcttaccaagaggaggctgcaatggaattaaaggtggaagatcccttttattgggtatctcccggagttctcgtgctgttagccgttctacctgtcctgttgcttcagatcacggtaggcctggttttcttatgtttacagtaccgcctccgaggtaaactcagggccgagatagagaacctgcaccgcacatttgtgttccacctcgaagcactgtcaggctag

SEQ ID NO: 231328 - DNA, 888 bp, Artificial Sequence
  Description of Artificial Sequence: Synthetic coding sequence
atggcaagcctgagtaggcctagtctcccgagttgcctgtgcagctttctcttgctcttgctgctgcaggtatcctcaagctacgctggccagttccgagttattggccctcgtcacccaattcgcgctctggtaggcgatgaagtggaactgccatgtaggatttcacctggcaagaatgctaccggcatggaggtgggctggtacaggcccccttttagtcgcgtggtgcatctgtacagaaatgggaaggaccaagacggcgatcaggctccggagtacaggggcaggactgaactgttgaaggacgcaattggggaggggaaagtcacgctgagaattcgtaatgtccgattttctgacgaaggcggattcacctgcttcttcagggatcactcctaccaggaggaggccgctatggaattgaaggttgaggatcctttttattgggtatcaccaggtgttctagtgctcctggcggtactgcccgtgcttctgctgcaaataaccgttggcctcgtctttctctgcctgcaatacagactccgcggaaaactgcgggcagagatcgaaaacttgcaccgtacttttgatccccacttcctcagagtgccctgttggaagattaccttgttcgtgatcgtcccggtgcttggaccactggtagccttaatcatctgctataactggctgcaccgtcgcctcgccggacaattcctcgaggagctgcgcaaattctcatctctctgctacaaacagaggatcaaatcgcaagaacgggaaacagaagccactcgaggcagaggtggactgcttcgggaccacattcccagaggaaaagaggagcttgagtctctgggaggaggcaaaacgcccccaggccgatag

SEQ ID NO: 231329 - DNA, 759 bp, Artificial Sequence
  Description of Artificial Sequence: Synthetic coding sequence
atggccagcctctcccggcctagcttaccatcatgcctgtgctcattccttctacttctcctgcttcaagtctcatcttcatatgccggacagttccgtgtcattggcccaaggcatccgataagggcactcgtgggagacgaagtggaactgccatgtcgcatatcgccaggcaaaaacgctacgggcatggaagtgggctggtacagaccacccttctctcgcgttgtgcacttgtacagaaatggtaaggaccaggatggggaccaggcaccagagtaccgcggacgtacagagctacttaaggacgctatcggcgaagggaaggtaacactcaggatcaggaacgtacgattttccgatgaagggggattcacatgtttttttagggatcactcctaccaggaagaggccgcaatggagctgaaagtcgaggaccccttctattgggtgagcccaggagtcctcgtgttattggctgtgctcccggtgctgctgctgcagattaccctgggactcgtctttctctgcttacagtatcggctacggggtaagctgcgcgctgaaattgagaatctccatcgcacctttgatccccacttcttacgggtcccctgctggaaaatcacattgtttgtgatcgtgcccgtgctggggccacttgttgcgctgattatctgttacaactggctgcataggcggctggccggacagtttttggaggaacttttgttccacctggaggcactgtctggttag

SEQ ID NO: 231330 - DNA, 540 bp, Artificial Sequence
  Description of Artificial Sequence: Synthetic coding sequence
taacaatttagggtgatcgggcctaggcatcccatccgcgcactggtcggagacgaagtcgaacttccgtgtcggatatcaccaggcaaaaacgcaaccggaatggaggtgggttggtatcggcctcctttctcccgcgtggtccacctgtaccgcaatgggaaggaccaggatggcgatcaggcgccagaataccgaggaaggaccgagctcctgaaagatgcgattggggaaggaaaggtcaccctcaggatccgtaacgtcaggtttagcgacgaaggaggctttacctgcttttttcgggaccatagttatcaagaggaggctgccatggaactgaaagttgaagaccctttttactgggtttcgcccggtgttttggttctactagctgtgcttcctgtgttgctgttgcagattacggttggtctggtcttcttgtgcctgcaatatcggttaagaggaaagctgcgggcagagatcgaaaatctgcaccggacattcggccagttcctggaggaactccggaatcctttttag

SEQ ID NO: 231331 - DNA, 396 bp, Artificial Sequence
  Description of Artificial Sequence: Synthetic coding sequence
atggcttctcttagtcgccctagcttgccaagctgtctctgttcttttctgctccttctgttactccaagtgtcgtcatcctatgccgatcccttctactgggtaagcccaggagtactagtgctcttggccgttctgccagttctactgctccagatcactgtgggattggtctttttgtgccttcagtataggctaagggggaagctgcgcgctgaaatcgagaaccttcacagaacatttgacccccatttcctgcgcgtaccttgttggaaaatcaccctgtttgttatcgtgcctgtgctagggcctctggtcgccctgattatatgctacaactggcttcatcgtcggctggctggacagttcctcgaagaactaagaaaccccttttag

SEQ ID NO: 231332 - DNA, 744 bp, Artificial Sequence
  Description of Artificial Sequence: Synthetic coding sequence
atggcctcactctcacgaccgagcttgcctagctgcttgtgctccttcctcctcctccttttgttgcaagtgtcttcttcttacgctggacagtttagagtcatcggtcccagacaccccatacgggctctcgtgggggatgaggtcgagctcccctgtcgtataagcccaggaaagaacgctacgggcatggaggtcggctggtatcggccacccttctctagagtggtgcacttatacagaaacgggaaggaccaggatggggaccaagcgccagagtaccggggtcgcaccgagttgcttaaagacgccatcggtgaagggaaggtgactcttcggatacgcaatgtgcgattctcggatgagggagggttcacttgctttttcagggatcatagctatcaggaggaggcggctatggagttgaaagtcgaggatcccttttactgggtgtctcccggagttttggtcctgcttgccgtcctgccagtgctgttgttgcagataacccttggcctcgtgtttctttgcctccagtacagacttcggggtaaactgagagccgagatagaaaatctgcatcgcacattcgacccacattttctgcgcgtgccttgttggaagattacactgttcgtgatagtccctgttctgggcccacttgtggcactgataatctgttacaattggctgcatcggagactggcaggccagttcctcgaagaactacggaatcccttttag

SEQ ID NO: 231333 - DNA, 642 bp, Artificial Sequence
  Description of Artificial Sequence: Synthetic coding sequence
atggcctccttgagcagaccttccctgcccagctgcctgtgcagcttcctcctcttgttactactgcaagtttcatcctcttatgccggtcaatttagagtcatcggcccacggcatcctatccgggctttggtcggcgatgaagtggagctcccctgccgcatctcccctggaaaaaacgcaactggcatggaggtgggatggtaccgacctcctttcagtagggtggtgcacttgtaccgtaatggtaaagaccaggacggggatcaggcccctgagtatcgcggacggacagagctgctgaaagacgccattggagagggtaaggtgaccttgaggatccgaaacgttaggttctccgatgaggggggttttacttgcttcttcagggatcatagttaccaagaagaagcggctatggaactgaaggttgaggacccattctattgggtctctcctggcgtgttggtcctgctggcggttcttcctgtgctcctcttgcaaatcactctggggctcgtcttcctctgcctgcaatatagactccggggaaagctgcgggctgagattgagaacctccaccggaccttcggccagtttctggaagagctgctctttcaccttgaggccttgtccggctag

SEQ ID NO: 231334 - DNA, 615 bp, Artificial Sequence
  Description of Artificial Sequence: Synthetic coding sequence
agtctttccaggccctctcttccgagctgtctctgcagcttcttgttactgttgttactccaagtgtccagttcgtacgctgggcagtttcgggtgattgggccacgccatcctattcgagctcttgtcggggacgaagtggaattgccttgcagaattagccccggtaagaacgcaactggcatggaagtgggctggtaccggcctcctttcagccgagttgtccatttgtaccgtaacggaaaggaccaggacggggaccaggctcctgagtaccgaggccgtacagagctgctgaaagacgccatcggcgaggggaaagtcaccctccggattcgcaacgtgcgctttagcgacgagggcggtttcacctgttttttccgggaccactcctaccaagaggaggcagcaatggagctaaaggtggaggatccattttactgggtttcgccaggtgtgcttgtcttactcgcggttctccctgtgctgctgctccagattaccgtgggcctggtgtttctctgccttcagtatcggctgagaggcaagctgcgcgcagagatcgaaaacttgcatcgcacatttgttttccatctggaagccttaagcggctag

SEQ ID NO: 231335 - DNA, 690 bp, Artificial Sequence
  Description of Artificial Sequence: Synthetic coding sequence
atggcctccctgagtagacccagcctcccatcttgtctgtgcagctttctgctgctgctcctcctgcaggtgtcctcctcttacgctggccaatttcgggttatcggcccaagacaccctatcagagctctggtgggagacgaggttgaactgccgtgtaggatctcacccggaaaaaacgctacagggatggaggtgggatggtacagacctccttttagtcgtgtggtccacctctacaggaatgggaaagaccaggacggagaccaggcccctgagtacagagggcgtaccgagttgctgaaggatgccatcggggaaggtaaggtgaccttacggatacggaatgtcaggttttcagatgaagggggtttcacctgcttcttcagggaccatagttaccaagaggaggctgcaatggagctgaaggttgaggatcctttttattgggtgtccccaggtgtattggtgctgctcgccgttctgcccgtgctcttgctgcagatcacggtcggtctcgtctttctgtgccttcagtacaggctgagagggaagctgcgcgcagaaatcgaaaacctccatagaaccttcgaatccttcggtgtgctaggccctcaggtcaaggaaccgaaaaagactggacagttcttggaggagctcctgttccacctagaggccctgtctgggtag

SEQ ID NO: 231336 - DNA, 615 bp, Artificial Sequence
  Description of Artificial Sequence: Synthetic coding sequence
tccctatctaggccctccttgccctcatgtctttgttcctttctattgttactcctcttacaggtgtcctcttcctacgccggtcagtttcgcgttattggacccagacacccaattagagcgcttgtgggtgacgaagtcgagctgccctgtagaatctctcccggtaagaacgcaacgggaatggaggtcggttggtacagaccacccttcagtagggtggtgcatctttacaggaatggcaaggatcaggatggcgatcaggcacccgagtataggggccgtactgagctgttgaaggatgccattggggaggggaaggttactctgcgcatccggaacgttagattttcagacgaaggcggatttacttgcttctttcgggaccactcttaccaggaggaggccgctatggagctgaaagtggaagaccctttctactgggtatcgcctggcgttctcgtgctgctggcagttctgcctgtgctgctgcttcagatcaccgttgggttagtgtttctttgccttcagtaccgtcttagaggcaagcttcgcgcagagatagaaaacctgcacagaacatttgttttccacctggaggctttgtctgggtag

SEQ ID NO: 231337 - DNA, 690 bp, Artificial Sequence
  Description of Artificial Sequence: Synthetic coding sequence
atggcatcactgtctaggccttcgcttccttcttgtctctgtagttttttgcttcttttgctgttgcaggtgtccagcagctatgccggtcagttcagagtgataggtcctagacaccccatcagagccctggtgggagacgaggtggagctcccatgccggatttcccctgggaagaatgccaccggtatggaggtgggctggtacagaccccctttttcaagagttgtgcacctttaccggaatggaaaggatcaggatggtgaccaggctcccgaatataggggaaggacggagttactgaaggatgctattggggaggggaaggtaactttacgcattcggaacgtgagattcagcgatgaagggggattcacgtgcttcttcagagaccattcatatcaagaggaggctgctatggagctgaaggtcgaggatccgttctattgggtctcaccaggagtcttagtcctcctggcagtgctgccagtcctcctgctgcaaataacgctcgggctggtctttctttgtctccagtaccggttgcgtggaaaactgagagcggagatcgagaacctacacagaacctttgagagctttggagtcctgggccctcaagtgaaagaacccaaaaagactgggcagttccttgaggagctactgtttcacctggaggccctgtctggatag

SEQ ID NO: 231338 - DNA, 690 bp, Artificial Sequence
  Description of Artificial Sequence: Synthetic coding sequence
atggcaagtttatcaaggccctccctgccttcctgcctgtgttcctttctccttttgctgctgctacaggtaagctcgtcgtacgccggtcagtttagagtcatcgggccacggcatccaatcagggcattggttggcgacgaggtggagctgccctgtcggatttcaccaggcaaaaacgccaccggcatggaagtcggatggtaccggcctcctttttctagggtggtccatctctatagaaatggcaaggaccaggatggcgatcaggccccagagtatagggggcgtacagaactgctgaaggatgccatcggagagggtaaagtgacactgcggattcggaatgttaggttttccgacgaagggggattcacttgcttctttcgggaccatagctatcaggaagaagctgcaatggagttgaaggtagaggaccctttttattgggttagccccggagtactcgtcctcttggccgttctgccagtccttttgctccagattactgttggcctgatattcttatgtctccaatacagattaagaggtaaactaagggccgaaattgaaaacctgcacagaacgtttgagtcattcggtgtgctcggtccccaggtaaaggaaccaaaaaaaacggggcaattcttggaagagctgctgtttcatctggaagcattgtccggttag

SEQ ID NO: 231339 - DNA, 516 bp, Artificial Sequence
  Description of Artificial Sequence: Synthetic coding sequence
atggcctctctttcccgcccttcattaccatcctgcctgtgcagctttctgctgcttttgctcctgcaggttagtagtagctatgccggacagtttagagtcatcggaccacgccaccctatacgagccctggtgggcgatgaagttgaacttccttgtcgcatcagcccaggcaaaaacgccacggggatggaggttggctggtaccgccctccctttagtagggtggtgcatctgtatagaaatggcaaggaccaagacggagaccaagcgcctgaatatagaggacgcaccgaactcctgaaagatgccattggggaggggaaagtgactctgaggattaggaacgtccgtttctctgatgaggggggatttacctgtttttttagagaccactcttaccaggaggaggccgctatggagttgaaggtagaggtgagccattccgtcactcaagattggcttcagtggcacgatcatggctccctacagccacccccacccagactgaaatag

SEQ ID NO: 231340 - DNA, 534 bp, Artificial Sequence
  Description of Artificial Sequence: Synthetic coding sequence
atgtcacacatcagttgggaggaacgttaccggaacggcaaggatcaggatggcgaccaggcaccagagtataggggacgtaccgagctgctcaaggatgccattggtgagggtaaagtcacgcttcgtattaggaatgtaaggttctcagatgaggggggatttacttgcttttttagagaccactcctaccaggaggaagccgcaatggagcttaaagtggaggatccattttactgggttagtcccggtgtgctagtgttgcttgccgttttgccagtgctgcttctgcaaataactgttggtctggtcttcctttgcttgcagtataggcttcggggaaagctccgagcagaaatcgaaaatctgcacagaacttttgaccctcattttctcagagtgccctgctggaagattacactatttgttattgtgccggttctaggccctttagtggcgttgatcatttgttataactggttacacaggcggctggcaggtcaattcctggaagagttgcgaaatccattttag

SEQ ID NO: 231341 - DNA, 174 bp, Artificial Sequence
  Description of Artificial Sequence: Synthetic coding sequence
atggcttctttgagcagaccgtctctgccctcctgtttatgttcctttctactgctgctgctgttgcaggtctccagctcttacgccggtctggtggctgtggctcgctcttggctgatagccgcatctacctctcaggcacaagttatcctgttgacccaaccactagaatag

SEQ ID NO: 231342 - DNA, 627 bp, Artificial Sequence
  Description of Artificial Sequence: Synthetic coding sequence
atggcctcgctctcccggccatccctccctagctgtctgtgcagcttcctgctgttgctcttgctccaggtatcttcttcttatgccggacagttcagggtgatcggaccaaggcaccctatccgggctctggtgggtgatgaagtggaattgccttgtcgcatatcacccggaaaaaatgcaaccggtatggaagtcggatggtaccggccaccgttctcccgcgtggtgcacctgtacaggaacggcaaggatcaggatggtgaccaggcccctgaatacagaggccgtacagaactgctgaaggatgccatcggagaagggaaggtcacactgcggatacgcaatgtgcggttctctgacgagggcggtttcacttgctttttcagagaccacagttaccaagaggaggcggcaatggaactcaaagtggaggatcccttttattgggtatctcccggagtgctcgtactgctagcggtactgcctgtccttctcctccagatcaccgtcggactggtgttcctgtgccttcagtataggttacgaggtaaactgagggccgagatcgaaaacctgcaccggacctttggccagttcctagaagagttacgcaatcccttctag

SEQ ID NO: 231343 - DNA, 516 bp, Artificial Sequence
  Description of Artificial Sequence: Synthetic coding sequence
atggccagcctcagccggcctagcctgccctcttgcctgtgctcttttctgttgttgctactgctccaagtttcttctagttatgccggacagttccgcgtcataggccctcggcatccaatccgggcactggtgggggatgaagtcgagctgccctgcagaataagccccggtaaaaacgcaactgggatggaggtcggctggtaccgccctcccttcagtcgcgtcgtacacttgtacaggaacggtaaggaccaggatggcgatcaggccccagagtataggggcaggaccgagctcctcaaagatgctatcggcgaaggcaaggtgacgcttaggatccggaacgttcgattctccgacgaaggtggctttacatgctttttccgggaccactcatatcaggaagaagcggctatggaactgaaagtggaagtctctcatagtgtgacccaagactggcttcaatggcatgatcatggcagcctccagcctcccccaccaaggttgaagtag

SEQ ID NO: 231344 - DNA, 516 bp, Artificial Sequence
  Description of Artificial Sequence: Synthetic coding sequence
atggctagtttatcaagaccttctctgccttcttgcttatgtagcttccttctcctgcttttactacaagtttcaagttcctacgctggtcagttccgtgtgataggccctaggcaccctatccgggcactagtcggcgacgaggtcgagttgccttgtcggatttcccctgggaagaatgctactgggatggaagtgggctggtatcgcccacctttttctcgcgtggtgcacctctaccgcaatggcaaggatcaggatggtgatcaggcgccagaatatcggggacgaacggagctgctcaaggacgctataggcgagggcaaggttacactgagaattcgtaatgtccggttctctgacgaagggggattcacctgcttttttagagaccactcttaccaagaagaggccgctatggaattgaaggtggaagtatcccactctgtgacacaagactggcttcagtggcatgatcatggctctctgcagccgcctccacccagactgaagtag

SEQ ID NO: 231345 - DNA, 621 bp, Artificial Sequence
  Description of Artificial Sequence: Synthetic coding sequence
atggcgtccttgagccggccttctctgccctcttgtctgtgctcttttctgctacttctgctgctacaagtgtcctcctcatatgcaggtcagttcagagtgataggtccaagacatcctattagagcccttgtgggtgatgaggtggagctcccttgcaggatatctccgggaaagaacgctacggggatggaagtgggctggtacagaccccctttcagccgcgtggtccacttgtatcgtaacgggaaggatcaggacggagatcaggcccctgagtataggggacgaaccgaactcttgaaggacgcgattggggagggaaaggtgactttgcgaataaggaatgtgaggttttctgacgaggggggattcacatgttttttccgtgaccattcatatcaggaagaagcagctatggaactaaaagtcgaagatcctttttattgggttagccccggagtcctagtcctattagccgtgctgcccgttttgctcctccaaattaccgttggattggtctttctttgtcttcagtacagactccgcggaaagctgagagctgaaattgagaacctgcaccggacctttgttttccacttggaggcactatcgggttag

SEQ ID NO: 231346 - DNA, 627 bp, Artificial Sequence
  Description of Artificial Sequence: Synthetic coding sequence
atggcctctctgagccgcccttctttgccgagttgtttgtgctcattcctgctgctccttctcctgcaggtttcatcctcatacgctggccaattcagagtcattggccctcgacatcccatccgggcactcgtcggcgatgaagtggaactgccctgtcggatctcaccaggcaagaatgctaccggcatggaggtcggctggtaccgaccacccttttcccgcgttgtacacctgtacagaaatggtaaagaccaggacggtgatcaagcccctgaatacagaggaagaacggagctcctgaaggatgccattggagagggtaaggtgactctccggatccggaatgttcgcttctccgacgaaggtggcttcacttgcttcttccgggaccacagctaccaggaagaggcagctatggagctgaaggtggaagatcccttttattgggtgagccctggggtgttagttttgctcgccgtgttgcctgtcctgcttctgcagattacagtcggcctggtgtttctgtgcttacagtaccggctccgcggtaagcttcgcgctgagattgaaaatcttcacagaacattcggacagtttcttgaggagctgcggaatcctttttag

SEQ ID NO: 231347 - DNA, 621 bp, Artificial Sequence
  Description of Artificial Sequence: Synthetic coding sequence
atggccagtctgtccaggccctctttaccatcttgcctgtgtagcttcctgttgcttctgttgcttcaagtgtcatcctcttacgctgggcaatttcgcgtgattgggcctcgccaccctatccgggcacttgttggagacgaagttgaactgccatgtcggataagcccaggcaaaaacgctacgggcatggaggttggctggtacagacctcctttctctcgagttgtccacctctatcggaatggcaaggaccaggatggagatcaggcccctgaatataggggccgaactgagctgttgaaggacgcgattggggagggaaaggtgaccctgaggatccgcaatgtgcgcttcagcgacgaggggggattcacctgtttcttcagggaccactcctatcaggaagaagccgcaatggagcttaaggtggaggatcctttctactgggtatcccctggcgtgctcgtgctgctcgccgttttacctgtccttctgctgcagattacagttggtctggttttcctatgtctacagtaccgactccgaggcaagctgcgcgctgaaattgaaaatcttcacagaacgtttgtgtttcaccttgaagccctgagcggctag

SEQ ID NO: 231348 - DNA, 534 bp, Artificial Sequence
  Description of Artificial Sequence: Synthetic coding sequence
atgtcacacatttcctgggaggaacggtaccggaacggcaaagaccaggacggggatcaggctcctgagtatagaggaagaacagaattgttgaaggacgcaattggggaaggcaaagtgacactgcggatcagaaacgtgagattctcagatgaaggcggattcacatgcttttttcgagatcattcataccaggaggaggccgctatggaattaaaggtggaagatcccttctattgggtgtcacctggggtgcttgtcctgttggccgtgctgccagtcctgctgctgcagataacggtgggtctggtgttcctgtgtctccagtacaggctgcgcggaaaactacgagccgagattgagaatttgcatagaaccttcgacccgcacttcctgcgggtgccttgctggaaaataactctgttcgtcatcgtgcctgtgttgggaccccttgtggcgcttatcatctgctacaattggctgcatagacgcctggccggacagttcctggaggagctgcggaatcccttctag

SEQ ID NO: 231349 - DNA, 621 bp, Artificial Sequence
  Description of Artificial Sequence: Synthetic coding sequence
atggcctcacttagcaggcctagcctcccttcctgcctgtgctcctttctgcttctgcttctcttacaggtgagctccagctatgccggtcagttccgagtgattggccctagacaccccatacgggcactggtcggcgatgaggttgagttgccgtgtaggattagtcctggaaagaacgcaactgggatggaggtgggctggtataggcccccattcagtcgagtggtgcacctgtatcgaaacggcaaggatcaggatggggaccaggcaccagagtaccggggaaggaccgaactgctgaaggacgccataggagaggggaaagtgaccctgcgaattcggaatgttcgcttcagtgatgaaggtggtttcacctgcttcttccgagaccattcttaccaggaggaggcagccatggagctcaaagtcgaggacccattttattgggtgtctccgggagtgctcgtgctcctggccgtgctgcctgtgctgctgctccagataactgttggcctggtgtttctgtgcctgcagtatcgcctgagggggaagctcagagccgagatagaaaatctgcaccggacctttgtgtttcacctagaagccctaagtgggtag

SEQ ID NO: 231350 - DNA, 621 bp, Artificial Sequence
  Description of Artificial Sequence: Synthetic coding sequence
atggcaagcctgagccgccctagtctcccatcatgtctatgcagcttcctcctcttgctgctgcttcaagtgtcgagttcatacgccggacagttcagggtaattggcccacgccaccccattagggctctcgtgggcgacgaggtggagttaccttgccgcatctctccgggtaagaacgccactggcatggaggtgggttggtaccgtcccccattctctcgtgtggtgcacctgtatagaaatggcaaggaccaggatggcgaccaggcccctgaatataggggacggaccgagcttttaaaggacgccataggcgaaggcaaagtaacactgcgaatccgcaatgttcgattctccgatgagggcggattcacatgcttctttagggaccactcgtatcaggaggaggccgcaatggaactcaaagtggaggatcctttctattgggtctctccgggtgtactggtgctcctggctgtgctgcctgtcctcctgctgcagattacagtgggactcgtgttcttatgtctccagtataggctgagggggaaacttcgagcagagatcgagaacctgcaccgtaccttcgtgttccacttggaggccctgtccggctag

SEQ ID NO: 231351 - DNA, 534 bp, Artificial Sequence
  Description of Artificial Sequence: Synthetic coding sequence
atgtctcatatcagttgggaggagaggtatcgcaacggtaaagatcaggacggtgatcaggcccctgaataccgcggaaggaccgagctcctgaaggacgccattggagaggggaaggtcacattgcgaatccgaaatgtgcgcttcagtgacgaggggggatttacttgcttttttcgtgaccactcataccaggaggaggccgcaatggagttgaaagtcgaggatccgttttactgggttagccctggcgtgttagtcctgcttgccgtgcttccggtgctcttgctacagattaccgttgggctggtctttttgtgcctgcagtacaggttgcggggaaagttaagagctgagatagaaaatctgcatcggacttttgatcctcacttcttgcgggtgccttgctggaaaattaccctgttcgtgattgtccccgtgctcggcccactggtcgctctaatcatatgctacaattggttgcacaggcgcctcgccggacaatttctggaggagcttagaaatccattctag

SEQ ID NO: 231352 - DNA, 621 bp, Artificial Sequence
  Description of Artificial Sequence: Synthetic coding sequence
atggcaagtcttagtaggcccagtctgccctcttgcctgtgtagcttcctgctgctgctgctgctgcaggtgagcagttcttatgctggacagttcagagtgataggcccacgacaccctatacgcgcactcgtgggagacgaggtggaattaccttgtagaatctcacccggtaaaaatgcaactgggatggaggtcggatggtataggcccccattttcacgggtggtacatttgtaccggaacggcaaggatcaggacggggatcaagcaccagaataccggggacggaccgagctgctgaaagatgcaatcggggaaggcaaggtgaccctgcgcatcaggaacgtgcggttcagtgacgagggaggtttcacctgtttctttagagaccatagttatcaggaggaggctgcaatggagctgaaggtagaggatcccttctattgggtgtccccaggagtactggtactgctagccgtcctcccggtattgctgcttcaaattaccgtcggtctggtctttctgtgcctgcagtatagactgagagggaaactgcgcgcagagatagagaatctacataggaccttcgttttccaccttgaggctctatcagggtag

SEQ ID NO: 231353 - DNA, 174 bp, Artificial Sequence
  Description of Artificial Sequence: Synthetic coding sequence
atggcctccctatctcgcccatctttaccatcctgcctgtgctccttcctgctactgctgttattgcaggtatcaagctcatatgccggactggtggccgtcgccagaagctggttaattgctgcgtcgactagccaggcacaggttattctgctgacacagccactggaatag

SEQ ID NO: 231354 - DNA, 621 bp, Artificial Sequence
  Description of Artificial Sequence: Synthetic coding sequence
atggcctccctgagtaggccaagtttgccatcctgcctctgctctttcctgctgctgttactgctgcaggtcagtagttcctacgctggtcagtttcgggtgattggtccacgacatccaatcagggcccttgtgggcgatgaagtggaactgccctgcaggatcagtccaggaaagaacgccaccggaatggaggtcggctggtaccggccaccattctcacgggtggttcatctgtaccgaaatggcaaagaccaggatggagaccaggccccagaatacagaggacgtaccgagctcctgaaagatgccatcggcgaaggtaaagtcacacttcgaattcgcaatgtgcggtttagtgatgaggggggttttacctgcttcttccgcgaccactcttatcaggaagaggcggcaatggagctgaaggtggaggacccattttactgggtgagcccaggggtgctggtgctgctggccgttctcccagtgctgctgctgcagataacagtcgggctagtatttttatgcctgcagtaccgcctgcggggaaagctgcgcgctgaaatagagaacctgcaccgcaccttcgtatttcacctggaagcattgtcagggtag

SEQ ID NO: 231355 - DNA, 516 bp, Artificial Sequence
  Description of Artificial Sequence: Synthetic coding sequence
atggcgtccctgtcccggcctagcttgccaagttgtctttgcagttttcttttattgttactcttacaggtttccagcagttatgccggacagtttcgcgtgattggacccagacacccgatacgggctttagtcggagatgaagtggagctgccttgtagaatttcccctggcaagaatgccaccgggatggaggtgggctggtacagaccaccctttagtagggttgtgcatctgtaccgaaatgggaaggaccaagatggcgatcaggcacccgaatacagagggaggacagagcttttgaaagatgccatcggtgaaggtaaggtgaccctccgcatccgcaatgtcaggttcagtgacgagggagggtttacttgcttcttccgcgatcacagctaccaggaggaagcagccatggagctcaaggtggaggtatctcatagcgtcacccaggactggttgcagtggcacgaccatggatctctgcagcctcctcctcccagactgaaatag

SEQ ID NO: 231356 - DNA, 621 bp, Artificial Sequence
  Description of Artificial Sequence: Synthetic coding sequence
atggcttcacttagccggccttctctccccagctgcctgtgcagctttctcctgctcctgctcctacaggtgtcaagcagctacgcaggccaattcagagtaattggtcccagacatcctatcagggcattggttggggacgaagtggagctaccatgtcggatctcacctggcaaaaacgccacaggcatggaagtgggatggtacagacctccttttagtcgtgtagtgcacctttatagaaacggaaaggatcaggatggggaccaagcaccagagtacagaggacgcactgagctgctcaaagacgcaattggcgaggggaaagtgaccctgcgtatccggaatgtcaggttttctgatgaaggtggctttacgtgcttcttccgcgatcatagttaccaagaggaagccgctatggagctgaaagtggaggatcccttttactgggtgtcccccggagtcctcgttttgctggccgttctgcctgtcttactcttgcagattactttgggcttggtttttctctgcctccagtatcgattgcgcggaaagctcagggccgaaatagagaatctgcatcgaacattcgtttttcacctggaagccctgagtggatag

SEQ ID NO: 231357 - DNA, 516 bp, Artificial Sequence
  Description of Artificial Sequence: Synthetic coding sequence
atggcatcactgtcgcggccttctctgcccagctgcctctgctctttcttgctactgttgttactccaggtgtcctcctcttacgcgggacagtttagagttattgggcctcggcacccaattagagcgctggtgggcgacgaggtcgagttgccctgtcgcatctccccgggtaagaatgcgacaggcatggaagtcgggtggtacaggcccccatttagtcgggttgtgcatctttacagaaacggcaaggaccaggatggggatcaggcgcctgaataccggggacggactgaactgttaaaggatgccattggtgagggcaaagtgactctgcgtattaggaacgtgcgcttttcagacgagggcggatttacatgcttttttcgcgatcactcctaccaggaagaggccgctatggaattaaaggtcgaggtgagccattcggtgacacaggactggcttcagtggcatgaccacggttcacttcaaccccctccacccaggctgaagtag

SEQ ID NO: 231358 - DNA, 516 bp, Artificial Sequence
  Description of Artificial Sequence: Synthetic coding sequence
atggcctcgctgagccggccatcattgccctcttgcctttgctcttttcttctccttcttcttctgcaggtgagcagttcatacgccggtcagttccgcgtgataggccctcgccacccaatacgtgccctggtgggagacgaggttgaactgccatgtaggatctctccgggaaaaaacgccacgggcatggaagttgggtggtaccgccctcccttttctagagttgttcacttgtaccggaatggcaaagatcaggatggtgaccaagcccctgagtacaggggacggaccgagctgctcaaagatgctattggggaggggaaagttactttgcgaattcgcaacgtgcgcttcagcgatgagggtggatttacgtgtttctttcgagatcactcctatcaggaggaggcagccatggagctcaaggtcgaagtgtcccactctgtgacccaggattggctgcagtggcatgaccacggcagcctgcaaccaccaccacctcggctgaagtag

SEQ ID NO: 231359 - DNA, 627 bp, Artificial Sequence
  Description of Artificial Sequence: Synthetic coding sequence
atggccagcctgagccgcccttccctcccgtcctgcctttgttcctttctattgctccttttactccaagtgtctagctcgtatgccggtcaatttcgtgtgatcggcccacggcaccccattcgggctctggtgggcgatgaggtggagttaccttgtagaatctcaccgggtaagaatgctactggtatggaggtcgggtggtaccggccaccgttctctagagtcgtgcatttgtatcggaatgggaaagaccaggacggcgatcaggctccggagtatcgtggccgaacagaactgctgaaggacgctattggagaaggtaaagtcacgcttcgtatcagaaacgttcgcttttctgacgaaggaggattcacctgcttctttagagatcactcctaccaggaagaagccgcaatggagctaaaagttgaagaccccttctactgggtgtcccccggagtgctggtcctgttagctgtgttgccagtgttgctcttacagatcacggtgggactggtttttctctgtcttcagtatcgtctaagaggaaagctgcgcgctgagatcgaaaacctgcaccgtacctttgggcagttcttggaagagctgcgaaacccattctag

SEQ ID NO: 231360 - DNA, 174 bp, Artificial Sequence
  Description of Artificial Sequence: Synthetic coding sequence
atggcttcgttgtctcggccaagtctcccatcttgtctctgttcattcctcctcctgctcctcctccaggtgtcttccagctacgccggactcgtggctgtagcaaggagctggctgatcgctgcatcaacaagtcaggctcaggtgatcctcctaacacagcccctggagtag

SEQ ID NO: 231361 - DNA, 627 bp, Artificial Sequence
  Description of Artificial Sequence: Synthetic coding sequence
atggcatccttgtctagaccatcactaccttcttgtttgtgcagtttcttgctcctcttactgttgcaagtgtcctcaagctatgcaggccagtttcgtgtcatcggcccacgccaccccattcgcgctctggtgggtgacgaagttgagttgccttgtcgaatctcacctgggaagaatgccactggaatggaggtgggttggtatcgacccccattttcaagggtggtgcacttatatcgaaacggcaaagaccaggatggagaccaagctccggaatatcggggtagaacagagctgctaaaggacgccataggtgaaggcaaggttacgctcaggattaggaatgtcaggtttagcgatgaggggggatttacatgcttctttcgcgaccactcataccaggaagaggctgccatggagctgaaagttgaagatcctttctactgggtctcgccaggcgtattagtcctgttggccgtattgccagtgctgctgctccagatcaccgtgggactggtgttcctgtgtctgcagtaccgacttcgagggaagctgcgggcagagattgagaaccttcacagaacatttgggcagttcctcgaagagctcagaaaccctttctag

SEQ ID NO: 231362 - DNA, 174 bp, Artificial Sequence
  Description of Artificial Sequence: Synthetic coding sequence
atggctagtctttcgcggccatccctgccatcatgcctctgtagttttctgctactgcttcttcttcaggtgtcctcctcttacgctggtctggtggccgtggctcggtcatggctcattgctgcatccacaagtcaggctcaggtcatcttattgacgcagcctttggagtag

SEQ ID NO: 231363 - DNA, 534 bp, Artificial Sequence
  Description of Artificial Sequence: Synthetic coding sequence
atgtctcatatctcttgggaagaacgctacaggaacggcaaggaccaggacggagaccaggcacctgaatatcggggacgaactgagctgctcaaggacgctattggcgaaggtaaagtcaccctgcgtattcgcaatgtcaggttctccgacgagggaggttttacctgcttcttccgagatcatagctaccaggaggaagctgctatggagctcaaggtggaagacccattctattgggtgtcacctggcgtcctcgttttgctggctgtgctgcctgtccttcttctgcaaattacagttggtctcgttttcctttgcctgcagtaccgcctccgcggaaagttgcgcgctgagatcgagaaccttcaccgtaccttcgatcctcacttcctaagggtgccttgttggaagatcacactgtttgtgattgttcctgtgctaggacccttggtagcgttgattatttgctacaattggctgcatcgcaggctcgccggtcagtttctggaggagctacgtaatcccttttag

SEQ ID NO: 231364 - DNA, 516 bp, Artificial Sequence
  Description of Artificial Sequence: Synthetic coding sequence
atggctagtctcagtagaccaagcctgccatcttgcctgtgcagcttccttctcctccttctgttacaagtgtcgtcgtcgtatgccggacagttccgtgtcatcggacctcgccaccccattagggctcttgtaggagacgaagtcgagctcccttgtcggatttcccctggcaaaaatgctacaggtatggaagtgggctggtacaggcctccgttttctagagtcgtgcatctgtacagaaatggcaaggatcaggacggggatcaggccccagagtatagaggacgcactgaactcttgaaggatgccatcggtgaaggcaaggtcactttgcggatccggaacgtccgcttcagcgatgaaggcggttttacctgctttttcagggaccactcttatcaagaggaagcagccatggaactcaaggtagaggtgtcacactccgtgactcaggactggctacagtggcatgaccatggcagccttcagccccctccccctcgcctgaaatag

SEQ ID NO: 231365 - DNA, 534 bp, Artificial Sequence
  Description of Artificial Sequence: Synthetic coding sequence
atgtctcatatttcatgggaggagagatatcggaacgggaaagaccaggacggtgaccaagcacccgaatacagaggcagaactgagttactgaaggacgccataggggaaggtaaggtgaccttgcggatccggaacgttaggttttccgatgaggggggtttcacctgcttcttccgggatcactcctaccaggaggaggccgctatggagctgaaagtggaagacccgttctattgggtatccccgggagttctagtgttactggctgttcttccagtactcttgctacagattaccctgggactcgtgtttttgtgtctgcagtatcgcctacgcggaaaactccgagccgagatagagaacctccatcgcacatttgatcctcactttttacgtgtgccttgttggaaaatcacgctcttcgtgatcgtgccagtgctcggaccactcgtggcccttataatctgctataattggttgcataggcgcctggccggtcagttcctggaagagttgaggaacccattttag

SEQ ID NO: 231366 - DNA, 627 bp, Artificial Sequence
  Description of Artificial Sequence: Synthetic coding sequence
atggcatcactcagccgtccatccttaccctcatgcttgtgtagtttcttactcctactgttgctgcaggtatcatcctcatatgcgggtcaattccgggtgattggcccacgccatccaattagggctcttgtcggcgacgaggtggagctgccatgtaggatatctccaggcaagaacgccaccggcatggaggttggatggtatagacccccattcagccgggtcgtgcacctgtatcgaaacgggaaggatcaagacggggatcaggcccctgagtatcgagggagaaccgagctgcttaaagatgcaatcggtgaaggaaaagtcacacttaggatccgcaatgtgcggttctccgacgaaggtggttttacttgtttcttccgcgaccactcctaccaagaggaggccgctatggaactgaaggtggaagacccgttttattgggtctcacctggagtcctagtgcttctggcagtcctgcccgtgcttctgctgcaaattaccgtaggtctagtcttcttgtgtttgcagtatagacttcggggaaagctgagagctgagattgagaaccttcacaggacgtttggacaatttctcgaagagctgcggaatccattttag

SEQ ID NO: 231367 - DNA, 174 bp, Artificial Sequence
  Description of Artificial Sequence: Synthetic coding sequence
atggcgtctctgagccggccttccttgcccagctgcctctgcagcttcctgctgctgttgctgctgcaggtgagcagtagttatgccggattagtcgccgtagcacggagttggttaattgccgctagcacttctcaggctcaggtgattttgctcacacagcccctggagtag

SEQ ID NO: 231368 - DNA, 174 bp, Artificial Sequence
  Description of Artificial Sequence: Synthetic coding sequence
atggcttcactgagcagaccatccctcccctcttgcctctgttccttcctgcttctacttctgttgcaggtttcgtcatcttacgccggtctcgtggcggttgccagaagctggctgattgccgcttccacaagtcaggcacaggtgatcctgctcacgcagccgcttgagtag

SEQ ID NO: 231369 - DNA, 534 bp, Artificial Sequence
  Description of Artificial Sequence: Synthetic coding sequence
atgtcacatataagctgggaggagagatatagaaacggcaaagatcaagatggtgaccaggcccctgaatacaggggaaggacagaactgctcaaggatgccattggggagggaaaagtgactctacggattcggaatgtgcgcttcagcgatgagggcggatttacttgcttttttcgtgaccattcctaccaagaagaggctgctatggagcttaaggtcgaggaccctttttattgggtgagccctggcgtgctggtacttctggctgtgctgcccgtactcctacttcagatcacagtcgggctggtgtttttatgcctgcagtaccgcttgcggggtaaactgcgtgccgaaattgaaaacttgcatcggaccttcgaccctcacttcctgagggtgccttgctggaaaattactctttttgtgatcgtgcccgttttggggccactggtggcactgattatatgctataactggctccataggagattggcgggacagttccttgaggagctgaggaatccgttctag

SEQ ID NO: 231370 - DNA, 516 bp, Artificial Sequence
  Description of Artificial Sequence: Synthetic coding sequence
atggccagtctgtctcggccttccctaccttcttgcttgtgctctttcttgcttctgcttcttttacaagtgtcttcttcttacgccggacagttcagagtcattgggcctcgccatcccatcagggcacttgttggagatgaagtggagcttccctgtcgaatttcccccggaaagaatgcaaccgggatggaggtcggttggtaccgtcctcctttttctcgcgtagtgcacctataccgcaacggtaaggaccaggacggagaccaggccccagagtaccgcggacggaccgaattgctgaaagacgctatcggcgaaggcaaggtcaccttaagaatcaggaacgtgagattcagcgatgagggcggatttacgtgtttcttccgcgatcactcttatcaggaagaagctgccatggagctcaaagtagaggtgagccattccgtcactcaagattggttgcagtggcacgatcatggcagcctacagccccctccgcctcggctcaaatag

SEQ ID NO: 231371 - DNA, 534 bp, Artificial Sequence
  Description of Artificial Sequence: Synthetic coding sequence
atgagccacattagttgggaggaacgctacaggaacggcaaagatcaggatggagatcaggccccagagtacagaggtagaactgaactgctaaaagacgcaatcggagagggaaaggtgacacttcggatcaggaacgtgcgattttccgacgagggcggttttacatgcttttttcgggatcattcttaccaggaagaggcagccatggagctcaaggtcgaggacccattctactgggtctctcctggcgttttggtgctgctggccgtcctacccgtcttgctgcttcagattaccgtgggcctggtctttctgtgcctccaataccggctacgtggcaagctgcgtgcagagattgagaacctgcataggacctttgacccccactttctcagggtgccttgttggaagataaccctttttgttattgtgccggtgttggggcctctcgtggctctgatcatctgctacaactggcttcacaggcgactggccggtcagttccttgaagagctaagaaaccctttttag

SEQ ID NO: 231372 - DNA, 174 bp, Artificial Sequence
  Description of Artificial Sequence: Synthetic coding sequence
atggcctctctctctaggcctagcctgccctcttgcctgtgtagctttctgctgctgctgctgctgcaggtcagcagcagttatgctggcctcgttgccgtcgctcggtcgtggctcattgccgcatctaccagtcaagcccaagtgatactcttaacccagcctctagagtag

SEQ ID NO: 231373 - DNA, 627 bp, Artificial Sequence
  Description of Artificial Sequence: Synthetic coding sequence
atggcatctctgagtcgcccttcgttgccatcatgtttatgctcctttctactgcttctgctgcttcaggtcagctcaagttacgctggacagttccgtgtcataggcccaagacaccctatcagggcattggtgggcgacgaagtggagcttccgtgccggatctcaccaggcaagaatgcaacaggcatggaggtggggtggtaccgaccccctttttccagagtggtgcatctgtatcgcaatggaaaagaccaggacggggatcaggccccagagtataggggacgcaccgagcttctgaaggacgcaattggcgaggggaaggttactctgaggatacggaatgtgaggttctcagacgagggtggttttacatgcttctttcgcgatcacagttatcaagaagaggccgcaatggagttaaaagtggaggatcctttttattgggtctctcctggggtcctggtcctcctggccgttctaccagtgcttctgttacagattacggtcggactggtcttcctctgtctgcagtaccggctccgaggcaagctcagagctgaaatagaaaatctgcatcgaactttcggtcagttcctggaggaattacggaacccgttctag

SEQ ID NO: 231374 - DNA, 327 bp, Artificial Sequence
  Description of Artificial Sequence: Synthetic coding sequence
atggccagcctaagtagaccttccttgccgagttgtctgtgctcgtttctgttattactgctgctccaggtgtcctccagctacgctgatcctttttactgggtctcaccaggcgtgcttgtgctcctggccgtgctgcccgtcttgctgttacagattaccgtgggactgattttcctgtgcttgcagtaccgacttcgtgggaagcttagggcggaaatcgagaaccttcatcgaacctttgaatcttttggagtactggggccacaggtgaaagaacctaaaaaaaccggccaattcctggaagagctaagaaatcctttttag

SEQ ID NO: 231375 - DNA, 753 bp, Artificial Sequence
  Description of Artificial Sequence: Synthetic coding sequence
atggcgccaggtgctccaagcagctcacccagcccgatcctcgcagtgctgctgttttcttcactggtgttgagccctgctcaggctatcgtcgtctatacagatcgagaagtgcatggcgctgttggatcaagggtaacactccactgcagtttctggtcttcagagtgggtgagtgacgacatttcttttacttggcgttaccagcctgaagggggtcgggacgcaatctccatctttcattatgcaaaggggcagccctacatagacgaggtgggcacgtttaaggagcgaatccagtgggtgggagatcccagatggaaggatggcagcattgtgattcacaatctggattattcagacaacggcacttttacatgcgacgtgaaaaacccacctgacattgtgggcaaaacgagtcaggttacactgtatgtgtttgaaaaggttcccacgaggtatggggtcgtgctgggagcagtgataggcggagtactgggagtcgtacttctattactgttactcttctacgtggtgagatactgctggctgaggagacaagcggctctccagagacgcctgtcagccatggagaaggggaagctgcataaacccggtaaggacgcgagcaagcgcggaagacagacacccgttctgtatcagtgctggaccaccgcagaggcaccaaaactctctgtgaggcgtaggccaagaggatggggctcgctggcccgtatccggaacagcggatag

SEQ ID NO: 231376 - DNA, 777 bp, Artificial Sequence
  Description of Artificial Sequence: Synthetic coding sequence
atgttacgcgcacccgcaccggctcccgctatggccccaggagccccttcttctagtcccagccccatcctggcagtcctactgttcagctctctggtgctgtctcccgctcaagcgatcgtggtttatacggatagagaggtgcacggggctgtcgggtctagggtaactcttcactgctctttttggagtagcgagtgggtatctgatgacatttcttttacatggcggtatcaacccgagggaggacgcgatgctatttctatttttcactatgccaaggggcagccttatatcgacgaggtcggcactttcaaggaacggattcagtgggtgggagatcctagatggaaggacggatctattgtgatacacaacctcgattactcggataatggcacatttacctgcgatgttaaaaatccaccagacatagtaggaaaaacttcccaggtcacactttatgtgtttgagaaggtgccaacacggtacggagttgtgctcggtgccgtaatcgggggagtattgggtgtggtgctactgttgctattactgttctacgtcgttcgctactgctggctgcgtagacaggccgctctacaaaggcgattgtctgccatggagaaggggaaattacataagccaggtaaagatgcctctaagagaggcagacagacacccgtactgtatgcgatgcttgatcattctcgatcaacaaaagcagtcagcgagaagaaggccaagggactcggcgagtcgcggaaagataaaaagtag

SEQ ID NO: 231377 - DNA, 747 bp, Artificial Sequence
  Description of Artificial Sequence: Synthetic coding sequence
atggcccctggcgctccctctagcagtcccagtccgatcctggccgttttactattttcatctctggtgctttcacccgcacaggcaattgtggtctatacagatcgcgaggttcacggagccgtcggaagtcgggtcacgctgcattgttccttctggtctagcgagtgggtgtcagacgacatcagcttcacttggaggtatcagcccgaaggcggtcgggacgcaatctcaatatttcactatgccaagggacagccttatatcgacgaggtcggaacatttaaagaaagaatccagtgggtgggcgatccccgttggaaggatggctctatagtgattcacaacctcgactactccgataacgggacttttacctgtgatgtgaaaaatcctcctgacatcgtggggaaaacttcccaggtaactctctatgtattcgaaaaggttcccacccgatacggtgtggttctgggtgccgttatcggcggagtgctcggtgtggtgctactacttctcctgctgttctacgtcgtaagatattgctggctgcggaggcaggctgccctgcagagaaggttgtcagcaatggaaaaggggaaactacacaagccaggaaaggacgcgagcaagagaggtcgccagacccctgtactgtatgccatgctcgaccactctcgatcaaccaaggcagtgagtgaaaagaaggctaagggactaggggagtctcggaaggacaaaaaatag

SEQ ID NO: 231378 - DNA, 747 bp, Artificial Sequence
  Description of Artificial Sequence: Synthetic coding sequence
atggccccaggtgctcccagttctagtccatctcccatactggccgtgttgctcttctcatcactggtgctgtctcctgcccaagccatcgtggtgtacactgaccgggaagtgcatggggcagttggcagccgcgttactctccactgttccttctggagttcggaatgggtgtcggatgatattagttttacatggaggtatcagcccgaagggggaagggacgcgatctcaatattccattatgccaaaggacagccatacatagatgaggtgggcacattcaaagagcgtattcagtgggtcggcgacccacggtggaaagacggcagcattgtgattcacaacctggactactccgacaatggcacgtttacatgtgacgtgaaaaatccacccgacattgtcggaaaaacatcacaggtgactctgtatgtgtttgaaaaagtcccaactagatatggggtggtcctgggagcagtcatcgggggagtgctgggtgtggtgctcctgctcttattattgttttacgtggttaggtattgttggttacggaggcaggctgcactgcagcgccgtctgtccgctatggagaaaggtaaacttcacaagccaggcaaagacgcctctaaaagaggaaggcagactcccgtgctgtacgcgatgcttgaccactcccgcagtacaaaggctgtcagcgaaaagaaggcaaagggcctgggtgagtctagaaaagacaagaagtag

SEQ ID NO: 231379 - DNA, 648 bp, Artificial Sequence
  Description of Artificial Sequence: Synthetic coding sequence
atgtacggcaaaagcagcacgcgcgctgtgctattgctgttgggaatacaactgaccgccctgtggccgattgcagctgtggagatctacacctccagggtgctggaggcagtgaacggaactgatgcccgtcttaaatgcacctttagcagcttcgctcctgtgggcgacgctctgaccgttacatggaacttcaggccactggatggcggaccagagcagtttgtgttctactaccacattgaccctttccagcctatgtccggcagatttaaggatcgggtgagttgggacgggaaccctgagaggtacgatgcctccatcctgctatggaagctccagtttgatgacaacggaacctacacctgtcaggttaagaatcctccagatgttgacggagtcattggtgagatacgcctgtctgttgtccacaccgttcgtttcagtgaaatccactttcttgcattggcaattggaagtgcttgtgccctcatgattataatcgtaatagtggtggttctcttccagcactaccggaagaaaaggtgggcagagagggcccacaaggtagtggagatcaaaagcaaagaagaagagagacttaaccaggaaaaaaaggtgagtgtgtacctcgaagacactgattag

SEQ ID NO: 231380 - DNA, 648 bp, Artificial Sequence
  Description of Artificial Sequence: Synthetic coding sequence
atgtacggaaagtcctcaacgcgggctgttctgctcctgctgggtatacagctgacagccctatggcctatcgctgcggtggagatttataccagtcgagtgttggaggctgtcaacggcacggatgccagacttaaatgtaccttcagctccttcgctcccgtgggagatgcactcactgtgacatggaatttccgcccactggatggcggtccagagcagttcgtgttttactaccacattgatccgtttcagccaatgagcggaaggttcaaggaccgggtctcatgggatggcaatcctgagagatatgatgcttctatcctgctgtggaaattgcaatttgacgataatgggacctacacctgtcaggtgaagaacccacccgacgtggatggcgtaatcggtgagattcggctctcggtggtgcatacggtcaggtttagcgaaatccactttctggctttagccatcggctcagcttgtgccctaatgattatcattgtcattgtggtcgtgctgttccagcactatcggaaaaagaggtgggctgaacgcgctcacaaggtcgtggagatcaagagtaaggaggaagagaggcttaaccaggagaagaaagttagtgtgtatcttgaagacaccgattag

SEQ ID NO: 231381 - DNA, 708 bp, Artificial Sequence
  Description of Artificial Sequence: Synthetic coding sequence
atgcagcagaggggtgcagcaggttcgagaggatgcgctctcttccccttactcggggttctcttcttccagggggtctacatagttttctcactggagatcagagctgacgcgcatgtaagggggtatgtcggggaaaaaatcaaacttaagtgtaccttcaagagcacctctgacgttacagacaagttgactattgactggacatacagacctcccagttccagccacacggtgagcatatttcattatcagtcctttcagtatccaacaactgccggtaccttccgcgatcggattagttgggtcggcaatgtctataagggggacgcatctatatcaataagtaaccctacaatcaaggacaatggaacctttagctgcgccgttaagaacccccctgacgtccaccacaatatccccatgacagaactgacagtgactgaacggggttttggcacaatgctcagctctgtcgcgttactgtctatccttgtgtttgtaccctctgccgtggtggtggccctgctgctggttcggatgggaagaaaggcggcagggctaaagaaacgatcacgaagcggctacaagaaaagttccatcgaggtcagcgacgataccgaccaagaggaggaggaagcatgtatggctaggctttgtgtgagatgcgcagagtgtctggacagcgattatgaggagacttactag

SEQ ID NO: 231382 - DNA, 672 bp, Artificial Sequence
  Description of Artificial Sequence: Synthetic coding sequence
atgcagcaaaggggcgcagctggctcaagaggatgcgccctcttccctctgctcggggttctgttcttccaggatgcgcacgtgagaggctatgtcggggaaaagatcaagctgaaatgtaccttcaaaagtacgagcgatgttaccgacaaactgacaatcgattggacctaccggccaccttcttcctcgcataccgtctcaatctttcactaccaaagtttccaataccccacgacggcaggaacctttcgtgatcgcatatcatgggtcgggaacgtatacaagggagacgcatctatctcgatctcaaatcccaccataaaggataatggcaccttctcttgcgcggtgaagaacccccctgacgtccaccataacatccctatgactgaacttaccgtaaccgagagaggtttcggaaccatgctgagtagtgtggccctgctgagcatcttggtgttcgtgccaagcgcagtggtggtggcactccttctcgtgaggatgggtcgaaaggccgcaggcctcaagaagcggtctcgaagcggctacaaaaagtcctccattgaggtgtccgacgacacagaccaagaggaagaagaggcatgcatggccaggctgtgcgtgcgctgtgctgagtgcctggatagcgattacgaagaaacctattag

SEQ ID NO: 231383 - DNA, 3366 bp, Artificial Sequence
  Description of Artificial Sequence: Synthetic coding sequence
atgtctctggagaacgaggacaaaagggccagaaccaggtcgaaggccctgcgcggtcctcctgagactaccgcggctgacctgtcgtgccctaccccagggtgcactgggtcaggccacgtccggggaaaatactcgaggcatcgtagccttcagtcttgcccactcgcaaagaaaaggaaactggaaggcgctgaggccgagcacctagtctcgaagcgcaagtcccacccactaaaactggccttggatgagggctacggggtggactcagatggaagcgaagacacagaagtcaaggacgcctcggtctcagatgagagcgaaggcacattggagggcgctgaggctgagacttctggacaggatgagattcataggcccgagacagcagaaggtcggtctcctgtgaaaagccattttggtagcaatcctattggctctgccacagcttcctcaaaaggctcctatagctcataccagggtataatcgccacaagcctgttgaatctgggccagattgccgaggaaacattagtggaggaggatctgggccaagctgcgaaacctggccctgggatcgtgcacctgttgcaggaagccgcagaaggagctgctagcgaagaaggagagaaggggcttttcatacagccggaggacgctgaagaagtcgttgaggtgacgacagaacgatctcaggatttgtgcccccagagtttggaagatgccgcttctgaagaatcttccaagcagaaaggtattctgtctcatgaagaggaagatgaagaggaagaagaggaggaagaagaggaggaagaagacgaagaggaggaagaggaagaggaggaggaggaggaagaagaggaggaggaagaggaagaagaagaagaagaagaggaagaagaggaagaggaggaagcggcacctgacgtgatttttcaggaagacacttcacatacctccgcccagaaagccccagagctacgcggacctgaatctccctcccctaagcccgaatatagcgtaatcgtagaggtgcgttcagacgatgacaaagacgaggatacccacagtagaaagagcaccgtgaccgatgaaagtgagatgcaggacatgatgacccgaggcaaccttggattactggaacaggctattgccctcaaggctgaacaggtcaggacagtctgcgagcctggctgcccccctgctgaacagtcccagttaggcctgggggagccaggtaaggcagctaagcccctggacaccgtcaggaagagctattactcgaaggatccatcacgggcagaaaagagagagattaaatgcccaacccctggttgtgacggtacggggcatgtcacaggtctctacccccaccataggtctctcagcggctgccctcacaaggaccgcatccctccggaaatcttagccatgcacgagaacgtgttgaagtgtcctactcctggatgtacgggacaaggacacgtcaactctaacagaaatactcaccgtagtctgagtgggtgccccattgccgctgctgagaagctggcaaaatcacacgaaaagcaacagcctcaaactggagacccctccaaaagcagttccaatagcgatagaatcttgaggcccatgtgcttcgtgaagcagctcgaagtgcccccatacgggagctaccgccctaacgtagctcccgcaaccccccgagcgaatcttgcaaaagaacttgaaaaattttctaaggtgacattcgactacgcttccttcgacgctcaggtgttcggcaagcgcatgttagccccaaagatccagaccagcgagacgtctccgaaggctttccagtgctttgactattctcaggacgctgaggcggctcatatggctgctacagcgatattaaaccttagtacacgctgttgggagatgccggagaacctgtccactaaaccccaggacctgcctagcaagtccgtggacatcgaggtggacgagaacggcaccttagatctgtcgatgcacaagcacaggaagagggagaatgcctttccctcttcaagcagctgttcatctagccccggtgtcaagtctccagatgcctctcagagacactcctctacatctgctcccagctcaagcatgacgagcccgcagtcctctcaggctagcagacaggacgaatgggatcggcctctggactacacgaagccttctagactccgcgaggaggagcccgaggaaagcgaacccgcagctcactcatttgccagctctgaggccgacgaccaggaagtctccgaggaaaacttcgaggaacggaagtatccaggtgaagtgacattaaccaattttaaacttaagtttctgtctaaagatatcaagaaagaattgctcacatgccctacccctgggtgcgacggatcaggacatatcacagggaactacgcctcccacagatccctctctggttgccccctcgctgataagtcattacgcaatcttatggcggcacattccgccgatttaaagtgtcccaccccaggctgtgacgggagcggacacatcacaggaaactacgcgagtcatcggtccctgtccggttgcccccgtgccaagaaaagcggagtgaaggtggcgccaaccaaagacgacaaggaggacccagaactaatgaagtgccccgttccagggtgcgtgggcctgggccatatttcgggaaaatatgcaagtcatcgctccgcgagcggttgccctttagccgctcgccgacagaaggagggttcacttaatggatcttccttctcctggaagtctctgaagaatgagggtcctacttgccctaccccaggatgcgacgggtccggacacgctaacggttcttttcttacccatagaagtctcagcggatgccctcgagcgacctttgccggtaaaaaggggaagttaagcggggatgaggtgctttcgcccaaatttaaaacaagtgacgtactcgagaatgatgaggagattaagcaattgaaccaggaaatcagggacctgaacgaatctaatagtgagatggaagccgctatggtgcaattgcagagccagatcagctcaatggagaaaaacctaaaaaatatagaggaggaaaataagctcattgaagagcagaacgaggctctgttcctcgagctctcaggcctttcacaggctctaattcagtccctggccaatattcgcctcccccacatggaaccaatttgtgaacagaacttcgatgcttacgtgtctactctcacagacatgtatagcaaccaggatccggagaacaaagacttattggagagtattaagcaggcagtgaggggaatccaggtctag

SEQ ID NO: 231384 - DNA, 1776 bp, Artificial Sequence
  Description of Artificial Sequence: Synthetic coding sequence
atgagtttggaaaatgaagacaagcgggctcggactaggtctaaggccctgcgaggcccacccgagaccacagcggcagatctcagctgtcccaccccgggatgtacgggcagcggtcacgtgcgtggtaagtactcgcgccaccgcagcctacagagctgtcccctggcaaagaagcgtaaattagagggcgcagaagccgaacatctcgtgtccaagagaaaatcacacccactaaagttagctcttgatgaaggttacggagttgactcagatggcagcgaggatacagaggtgaaagacgcatccgtcagcgatgagagtgagggcaccctcgaaggggctgaagccgagacatcagggcaagacgaaattcacagaccggaaacagccgaagacccaagcagagccgagaaaagagaaataaaatgtccaacacctgggtgcgacggcaccggccatgttaccggcctctatccacatcatcgaagtctgagtggctgccctcataaggaccgcatccctccagaaattctggcgatgcatgagaatgtgctgaagtgtcccacccccggttgtactggccaggggcacgtcaactcaaacaggaacacccatcggagtcttagcggatgccccatcgccgcagccgaaaagctcgcgaagtctcacgagaagcagcaacctcagactggggaccctagcaaatcctcttcaaactctgaccgcatattacgaccaatgtgttttgtgaagcaactggaggtacctccctacgggtcctacaggcctaatgtggcacccgcaacaccccgtgccaatctggctaaagagctggagaaatttagcaaggtgacctttgattacgcatccttcgatgctcaggtgttcgggaaacggatgctggcaccgaagattcaaacatctgagacctcacccaaagccttccagtgttttgattacagccaggacgccgaggccgctcacatggcagcgaccgcaattctgaacctttccacccgatgttgggaaatgcccgagaatctgtctacgaagccccaggacctgccttcgaagtccgtcgacattgaggtcgacgaaaatggcactctcgatttaagcatgcacaagcaccgaaagagggaaaacgctttcccctccagttcttcctgctcctctagcccaggagtgaagtctccggatgcttcccagagacacagctccacgtctgctccgtcttctagcatgacttcaccacagtcttcgcaggcatcccgccaggatgagtgggacagacctctcgactataccaaaccgtcacgtctccgcgaggaagagcccgaagagtccgagcccgcagcccactctttcgccagctctgaggctgatgatcaggaagtttccgaggaaaatttcgaagagcggaagtaccctggcgaggtcactttaaccaacttcaagctgaaatttctctccaaggatatcaagaaggaactgctgacgtgcccaacgcccggttgtgatggatcagggcatatcaccggaaactacgcctctcataggagatgtcctaccccaggctgtgacggtagcgggcatataactggaaattacgcctctcatagatctctgtccggatgtccccgagccaaaaaatcgggtgtaaaggtggcaccaacaaaggacgacaaggaagatcctgagttgatgaagtacgtgggtccttgctggctatttcattgcatagcggaattacggttcagctgcgtgctgtag

SEQ ID NO: 231385 - DNA, 3447 bp, Artificial Sequence
  Description of Artificial Sequence: Synthetic coding sequence
atgagcctcgaaaatgaggataaaagagctcggacgagaagcaaagccctgcggggaccaccagaaacaaccgctgctgacctatcttgcccaacacccggttgcactggaagcgggcacgtgcgaggtaaatatagccgacataggagcctgcagtcatgtccgctggctaaaaagagaaagctggagggtgccgaggccgaacatctggtgtcgaaacggaagagccacccactcaaactcgccttggatgagggatatggcgtggatagcgatggctcggaagacaccgaggtgaaagacgcctccgtgagcgacgaatctgagggcactctagaaggtgccgaggccgaaactagcggccaggacgagattcatcggcctgagacggcagaggggagatccccagtcaagtcccattttgggtctaatcccattgggtcagctacagcaagcagtaagggctcctacagctcttatcagggtattattgccactagtctgctcaatctcgggcagattgcggaggaaacacttgtcgaagaggacttagggcaggcagctaaacctgggccagggattgtccatctgttgcaggaggccgctgaaggtgcggcatccgaagaaggggagaagggcctgttcatccagcccgaagacgcggaagaggtggtcgaagtgacgactgaaagatcacaggatctatgcccccagtctttggaagacgccgcatcggaggaaagtagtaagcagaaggggatcctgagtcacgaggaggaagacgaagaggaggaagaggaggaggaggaagaagaagaagatgaggaagaagaagaggaggaagaggaagaggaagaggaagaggaagaagaggaagaggaagaggaggaggaagaagaggaggaagaggaagaagaggctgccccagatgtcatattccaggaagatacaagtcacacttccgcccaaaaagcccctgaactgcggggtccagaaagtccaagccccaagcctgaatattccgtcatcgtcgaggttcggtccgacgatgacaaagatgaagacacccacagccgtaagtcaacagtgaccgacgagtccgaaatgcaggatatgatgacccgcggaaacctcgggctcctcgaacaggctatcgccctgaaagccgagcaggtgcgaaccgtatgcgagcccggatgcccccctgccgagcagtcccagctgggactgggagaaccaggaaaggccgcaaaaccacttgacactgtgcggaaatcctattacagcaaggatccttcccgagcagagaaacgcgagatcaagtgtcccaccccgggttgcgacggcaccggccatgtaaccggactgtatccccatcaccgcagtctgtccggatgtccccataaagacaggattccccctgagatcctggccatgcatgagaacgtgctcaagtgtccaaccccgggatgtacaggacagggacacgtaaactcgaaccggaacacacataggtctctatccgggtgccccatagcagctgcggagaaactggccaagtcccatgaaaaacagcagccccagacaggcgacccatcaaaatcttccagtaactcagacagaattctgaggccaatgtgcttcgtgaagcagttggaggtgccgccatatggctcataccggccaaatgtcgcgcctgctacccctcgagccaatctagccaaggagcttgagaagttctctaaggttaccttcgattacgcgagtttcgacgcacaagttttcggaaaacgcatgttggcccctaagatccagacatcagaaacctctcccaaagcctttcagtctaagcctttccctaaggcctcttcaccacgccactccccttccagctcatacgtgcgatctaccagctccagctctgccggatttgattatagccaggatgccgaagccgcacatatggctgcgactgcgatcttgaacttgtccaccagatgctgggaaatgcccgaaaacctgagcactaaaccgcaagacctgccctccaaaagtgtcgatatcgaagtcgatgaaaatggtactctggacctgtctatgcataagcacaggaaaagggaaaatgccttccctagcagttctagctgtagctcatccccaggcgtcaagtctcccgatgcatctcaacggcattcttctacctctgccccttccagctcaatgactagcccacagtcctcgcaagcatcaagacaggacgagtgggatagaccactggactatacaaagccctctagactacgtgaggaggagcctgaggaaagcgagcccgcagcccactcatttgccagctcggaagcagacgatcaggaagtgtccgaggagaacttcgaggagcgaaaataccctggagaagtgaccctgacaaacttcaagctgaagttcctgtcgaaggacatcaaaaaggagcttcttacatgcccgaccccgggttgcgatggatcgggccatattactggaaattacgcatcgcaccgcagcttatcaggttgccctctcgccgacaaatctcttcggaatctcatggccgctcacagtgccgacctgaaatgcccgacaccagggtgcgatgggtcagggcatatcaccgggaactacgcttcccacagaagtttgagcggatgtcccagagcaaagaaaagtggagtgaaggtcgcgccaaccaaggacgataaggaggatcccgagctgatgaaatgtccagtgcccggatgtgtaggtttagggcacatcagcgggaagtatgcgagtcataggagcgcctctgggtgccctctggcagccagaagacagaaggagggttctctcaatggatcatcctttagctggaagagtctcaaaaatgagggccctacttgccctactcccggatgcgacgggtccggtcacgcaaatggatcctttttgacccatcggagtctgtcaggatgtcctcgagctacattcgctggaaagaaaggaaagttgtctggcgacgaagtcctgagccctaaattcaaaacttctgatgtcctagagaacgatgaggaaatcaagcagttaaaccaggaaatacgtgacctgaacgaatccaactcagagatggaggctgccatggtgcaacttcagagccaaatctcatctatggagaaaaacctgaaaaatattgaagaggagaacaagctgattgaggaacaaaacgaggctctgtttctggaactcagtgggctgtcccaggcactcattcagtcccttgccaacatcaggctccctcatatggaacctatctgcgaacagaattttgacgcgtatgtctcaactctgactgacatgtactcaaatcaggatccggagaataaagatcttctagagtctattaagcaggctgtcaggggcattcaagtctag

SEQ ID NO: 231386 - DNA, 3399 bp, Artificial Sequence
  Description of Artificial Sequence: Synthetic coding sequence
atggaagtcgataccgaggaaaagcggcatcggacgcggagcaaaggggttagagtgccggtcgagcctgcgatccaagaacttttttcttgtcctacccccggatgcgatggatccggccatgtcagcggaaaatatgcccgacacaggagtgtgtatgggtgtcctcttgccaagaaacgcaagacgcaggataagcagccccaggagcctgccccaaagaggaaacctttcgccgtgaaagctgattcctcgtccgtggatgaatgtgacgactccgatggcacagaagatatggatgagaaggaggaagatgaggaagaggaagaagaggaagaagaagaaaatgaagaccaccaaatgaattgtcataacactcggatcatgcaggacacagagaaagacgacaacaataatgatgaatatgataattacgatgagctggtcgctaaaagcctgttgaacctggggaagattgcagaggatgctgcataccgggcacgaacggaatccgagatgaattctaacacatctaactcactggaggatgacagtgataagaacgagaatctcgggagaaaatccgagctgagtctggatcttgattcagacgttgtaagagagactgtcgactctttgaaactgctggctcaaggacacggcgtagttctgagcgagaacatgaacgaccggaactacgccgactctatgtctcagcaagattcacgcaacatgaactatgtcatgctcggaaagcctatgaacaacgggttgatggagaagatggttgaggaatctgatgaggaagtctgtttatcatctctagagtgcctcagaaatcaatgcttcgacctcgctcgcaaactgagtgaaactaacccccaggaacgcaatccacagcagaacatgaacatcagacagcatgttcgacctgaggaggactttccgggacgaacgcctgatcggaattatagtgatatgctgaatctcatgcggttggaagagcagctctctcctcggagtagggtctttgcgagctgtgccaaggaggatggttgtcatgagagagatgacgacaccacttctgttaatagcgaccgctcagaggaagtgttcgatatgactaagggtaacctcacactcttagagaaggccatcgcactagaaaccgagcgggcaaaagccatgagggagaagatggctatggaggcgggtaggcgagacaacatgcggtcttacgaggaccagtcccctcggcagttgccgggtgaagaccgcaaacccaaatcatccgattcccacgtgaagaagccctattacgacccatcacgcaccgagaaaaaggagagtaagtgtccgacacccggttgcgatggcactggacacgttacaggcctgtacccacatcaccggtcactgagcggttgtccacacaaggacagagtcccgcctgaaatcctggccatgcacgaaagtgtgcttaaatgccccactcccggatgcactggacgcggacacgtgaacagtaacaggaactcgcaccggagcctgtctggatgccccatcgccgctgctgaaaagttagctaaagcccaggagaaacaccagagctgtgacgtgagcaagagcagccaggcgtcagatcgggttctccgcccaatgtgttttgtgaagcagttagaaatcccacagtacggctacaggaacaacgtgcctacaacaactccacgatccaacctggcgaaagagctcgagaagtactcgaaaacgtcctttgaatataacagctacgacaaccatacttatggcaagagggctatagctcctaaggtgcagacgagagacattagccctaagggttatgatgacgcgaagcgctactgcaaagacccttctccaagcagcagctccacaagctcttacgccccatcatcttccagcaacctgagttgtggcggaggcagttcggcttctagtacttgttcaaagtcgagcttcgattatacccatgacatggaagcagctcatatggccgcaacagccatattaaatctcagcactcggtgccgcgagatgcctcagaacctgtcaaccaagccacaggacctgtgtgctacacgcaatcctgacatggaagtggatgaaaacggcacacttgatttgagcatgaacaagcagcggcctcgcgactcgtgctgtcctatcctgaccccccttgagccgatgtccccccagcagcaggctgtgatgaataatagatgttttcaactgggtgagggtgattgctgggacctgccagtcgactacacgaagatgaaaccgaggcgtatcgatgaagacgagtcaaaggacattactcccgaggacctagaccccttccaggaggccctggaggagcgcagatacccaggggaggtgaccattcccagtcccaaaccgaagtacccacagtgtaaggagagtaagaaggatcttattaccttgtccgggtgcccacttgcagataagtctatacggtcaatgctggctaccagcagccaggagcttaagtgtcccacacccggttgcgatggctccggacatatcactggtaattacgcctctcaccgatcgcttagcggttgcccaagagctaagaaaagcggaatcaggatcgcgcagagcaaggaagataaggaggaccaagagccaattcggtgcccagtgcccggatgtgatggccagggccacatcacaggtaagtatgcctcccataggtccgcctcaggttgcccgctcgcagccaaaaggcagaaagatgggtacctaaacgggtcgcaattttcatggaaatccgtgaagacagaggggatgtcatgtccgacccctggctgtgacgggagcggccatgtgagcggaagctttttgactcacagatccctctccggatgtccgagggctacctccgccatgaaaaaagccaaattgagcggggaacaaatgctaaccatcaagcaacgcgcttctaacggcattgaaaatgatgaagaaatcaagcagttggatgaggaaataaaagagttgaacgaaagtaactcccaaatggaggccgatatgatcaagctccgcacacagattacaactatggagtctaacttgaagactattgaggaagagaataaggtcatcgaacagcagaacgagtcattgcttcacgagctcgccaacctttcccagtccttgatccacagtctcgcgaacatccagcttcctcacatggacccaatcaacgagcagaatttcgacgcgtacgttactaccctcactgaaatgtatactaaccaggatcgataccagagtccagagaataaagccctactcgagaatattaagcaggcggtaaggggcatacaggtatag

SEQ ID NO: 231387 - DNA, 3561 bp, Artificial Sequence
  Description of Artificial Sequence: Synthetic coding sequence
atggaagttgacactgaagagaagagacataggacacggtctaaaggggtacgagtgcccgtcgagcccgcaatccaggagctcttctcctgcccgacgcctggctgtgacggatccggtcacgtttctggaaagtacgctagacatagatcagtctacggttgtcccctcgccaagaagagaaaaacccaggataagcaacctcaggaaccggctcccaaacgcaagccgttcgcagttaaggccgattcctctagcgtggacgagtgcgacgattccgacggcaccgaggatatggacgagaaggaagaggatgagggggaagaatatagtgaggataacgacgaaccaggggatgaggacgaagaggatgaagagggtgaccgcgaagaggaagaggaaattgaagaggaggatgaggacgacgacgaggatggagaggacgtcgaagacgaggaggaagaggaggaggaagaggaagaagaggaggaggaagaagagaacgaggatcatcagatgaattgccataacactcggataatgcaggacacagaaaaggatgacaacaacaacgacgaatatgacaattatgacgaactcgttgcaaaatccttgttgaatttaggtaaaatcgccgaagatgctgcctaccgcgcaagaaccgaatctgagatgaatagcaacaccagtaatagcctggaggatgattccgataagaatgaaaatctgggaaggaaatctgagttatcgctggacttagatagcgacgtggtgagagaaaccgttgattccttgaagttattagcccaggggcacggagtggtgctcagcgagaacatgaatgataggaattacgctgacagcatgtcacagcaggattcaaggaacatgaactacgtgatgcttggtaagcctatgaacaatggacttatggaaaagatggttgaggagtcagatgaagaggtctgcttatcctcactcgagtgcctgcggaaccagtgttttgatctggctaggaagctgtctgagacaaaccctcaggaaaggaacccgcagcagaacatgaacatccgacagcatgtccggccagaagaagacttcccagggagaacccctgatcgcaattattcggacatgctcaacttgatgcgactcgaggagcaattatcacctcgcagtagggtgtttgcatcttgcgcaaaggaggacggttgccacgaaagggatgatgatactaccagtgtcaactccgaccgatcagaagaggtgttcgacatgacaaagggaaacttgaccctgcttgaaaaggctattgccctggagaccgagcgggctaaggccatgcgcgagaaaatggctatggaggctggcaggagggacaatatgaggagctacgaggatcaatcaccccgtcagctgccaggcgaagatcgcaagccaaagtccagcgactcacacgtgaaaaaaccatattacggcaaagatccgagccgtaccgagaagaaggagtccaagtgccctacgcctggttgtgacggcaccggccacgttaccggcctgtatccacatcacagatccctctccgggtgccctcacaaagatagagtgccccctgagatcctggctatgcacgaaagtgtcctaaaatgtccgacacctggatgtacggggagaggtcacgtgaactcaaacaggaattctcataggtcgttgagcggatgccctatcgcagccgcagagaaacttgcgaaagcccaggaaaaacatcagagctgcgacgtgtctaaatctagccaagcgtcagatagggtcttaagaccaatgtgcttcgtgaaacaactggagattccacaatatgggtaccgcaacaatgtcccgacaacaaccccaaggagcaatctggcaaaagagctcgagaaatatagtaagacctcgttcgagtataactcttacgacaatcacacttatgggaaacgagctattgcgccaaaggtgcaaacccgggatatatctcctaaaggatacgatgatgcgaaaagatactgcaaggatccttctccctcctcttcatcgacctctagctacgcaccatcatccagctctaacctgagttgtgggggtggctcctccgcatccagcacctgctcgaaaagcagctttgactacacccacgatatggaagccgctcatatggcagccacggccatcctgaacctgtctaccagatgtcgcgagatgccccagaacttgagcacaaagcctcaggacctgtgtgctaccaggaatcccgatatggaagtggacgaaaacggaacacttgacctttctatgaataagcagaggccgagggattcttgttgtcccattctgaccccactagaacctatgtctcctcagcaacaggccgtgatgaataataggtgctttcagctgggagagggggactgctgggacttaccggtcgactacacaaagatgaaaccccgaagaatcgacgaggatgaaagcaaagacatcacacccgaagatctggacccgtttcaagaggcccttgaggagcgccgataccccggagaggtgaccatcccttctccgaaacccaagtaccctcagtgtaaagagagcaagaaggatctcatcacactgagtgggtgcccgctcgccgataaatctatcagatccatgctcgctactagctctcaggagctcaagtgtccaacccccggttgcgatggatccggacatatcaccggcaactatgcaagtcacaggagcttgtcaggttgcccccgagcgaaaaaatccggaatccgtatagcacagtccaaggaggacaaggaagaccaagagcctataaggtgtccagtcccaggatgtgacgggcagggccatatcaccgggaagtacgcgtctcaccggagcgcatctggctgccccctggcagccaaacgacagaaagacggctatctgaatgggtctcagttctcatggaagtccgtgaaaactgagggtatgtcttgccctacacctggatgcgatggttcaggtcatgtgtccgggagcttcctgactcatcgaagcctgagcggctgtcctagagctacctctgccatgaaaaaagccaaacttagcggcgaacagatgcttaccattaaacagcgcgcttctaacgggattgagaacgatgaagaaatcaagcagctggatgaggagattaaagagctcaatgagtccaactctcaaatggaagccgatatgatcaaactacgcacccaaatcaccactatggagtcaaacttgaagactattgaagaggaaaataaggtgatcgaacaacagaatgagtccctgctgcacgaactggcgaatctgtctcagtctctgatccacagcctagccaacatacaactgccacatatggatccgatcaacgagcaaaactttgatgcatacgtaaccacccttacagagatgtacacaaaccaagatagataccagagtcctgagaataaagcactcctggagaacatcaagcaagccgtgcggggtatccaggtgtag

SEQ ID NO: 231388 - DNA, 555 bp, Artificial Sequence
  Description of Artificial Sequence: Synthetic coding sequence
atgtcatgccctactcctgggtgtgacggctcaggccatgtttctggctcatttttgacccataggtcactctcaggatgccctagggctactagtgctatgaagaaggccaagctgagtggagagcaaatgctgaccattaagcagcgggcaagcaacggaattgaaaacgacgaagaaataaagcagttagacgaagaaataaaggagcttaatgagtctaacagtcagatggaagcagacatgatcaaactgcgaacacaggtcactatcactaccatggagagtaacctcaaaacgatagaggaagaaaataaagtcatcgaacagcagaatgagagtttactccatgagctcgccaatctgtcgcagtcactgatccactctttggctaacatccagctaccccatatggaccctattaatgaacaaaattttgatgcctatgtcactacacttacggagatgtacacaaaccaggataggtaccaatcccccgagaacaaagctttacttgagaacatcaagcaagccgttcgcggtatccaggtgtag

SEQ ID NO: 231389 - DNA, 3555 bp, Artificial Sequence
  Description of Artificial Sequence: Synthetic coding sequence
atggaggtcgacacagaagagaaacgacaccgcactaggagtaagggagtcagggtccctgttgaaccagctattcaggagcttttctcctgtccaacacctggctgcgatggctcgggccacgttagcggcaagtacgcgcgacataggagcgtgtatggatgtccccttgccaaaaagagaaagactcaggacaaacaaccacaggagccagcccctaagaggaagccctttgccgtcaaggccgacagctccagcgtggacgagtgtgacgacagcgacggaactgaggatatggatgagaaagaggaagacgagggcgaggagtactccgaagataacgacgaaccaggggatgaggatgaggaagacgaggagggggaccgcgaggaagaggaggagattgaggaagaggatgaggatgatgacgaggacggggaggatgtggaagacgaggaagaggaagaggaggaggaggaggaggaagaggaggaagaggagaatgaggaccaccagatgaattgccacaacacccggattatgcaggacactgaaaaggacgataataacaacgacgagtacgacaactatgatgagctggttgccaagagcctgctgaatctggggaagatcgcagaggacgccgcttatagagccaggaccgagtctgaaatgaacagtaacactagcaatagtctggaagacgactcagacaaaaacgaaaatctgggtaggaaaagcgaactgtctcttgaccttgattcggacgtggtccgcgagaccgtggactcattaaaactactggctcagggacatggcgtggtgctgtccgagaatatgaacgaccgaaattacgccgactctatgtctcaacaggattcccgcaatatgaactatgtgatgcttgggaaacccatgaacaatggactcatggagaagatggtcgaggaatcagacgaggaagtttgtctgtcctctctcgagtgcttgcgcaaccagtgttttgaccttgcacgcaaactcagtgagaccaatcctcaggagcgtaacccccagcagaacatgaatattcgccagcatgtacgaccagaagaggactttcccggtcggacccccgaccggaactattccgatatgcttaacctcatgcggctggaggagcagttgtcacctcggtcccgggtctttgccagttgcgcaaaggaagacggatgccacgagcgagatgatgacaccacatctgtgaacagcgatagatcagaggaagttttcgatatgaccaagggcaacctaactctgctagagaaagctattgcattagaaacagagcgtgctaaagctatgcgggagaagatggcaatggaggcagggcgtcgggacaatatgaggagttacgaggatcagtccccccgtcagttaccaggtgaagaccgaaagccaaagtcttcagacagtcacgtcaagaaaccatattacgacccgagtcggaccgaaaagaaagagagcaaatgccctacgcctggctgtgacggtactgggcacgtgacaggtctttacccccaccatcgaagcctttcgggctgccctcataaagaccgggtgcctcccgagatcctggcgatgcacgagtccgttctgaagtgcccaacacccggatgcaccggccgtggtcacgtgaattccaataggaattcacacaggtcattaagcgggtgtccgattgcagccgcagagaaactggccaaggctcaggagaaacaccagtcttgtgatgtctccaagtcatcacaggcttctgaccgtgttcttcgtcctatgtgtttcgtgaaacagctggagattccacagtacggttatagaaacaacgttccaactacaacacctaggagcaatctggccaaagagctagagaaatactccaaaacctcttttgagtataacagttacgacaaccatacctacggcaaacgagccatcgcccctaaagtgcagacaagagacatctcccccaaagggtatgatgatgcaaagagatactgtaaagacccctctccatcctcttcttctacgtcttcatatgctcctagctcctcttctaaccttagttgcggagggggtagttcagcatcgagcacctgttctaagtcatccttcgattacactcatgatatggaggctgcccacatggcagccaccgccattcttaatctgagtactaggtgtcgagaaatgcctcaaaatctctcgacaaagccacaggatttatgtgccaccaggaacccggatatggaggtcgacgaaaatggtacactggatttgtcaatgaacaagcagcggccacgggacagttgctgccctattctgacgcctcttgagcctatgtccccacagcagcaggcagtgatgaacaacagatgcttccagctcggcgagggcgactgctgggaccttcccgtcgactataccaaaatgaaaccaagacgaattgacgaggacgagagcaaagatattaccccagaagatttagatccctttcaggaagcactggaagagcggagataccccggtgaagtgacaataccatcccctaagccaaaatatccccaatgcaaagagagcaagaaggatctgattacactttcgggctgtcctttggctgacaagagtatcagaagcatgctggccacctccagtcaggagctgaagtgtccaacgccagggtgcgatgggagcggtcatattacgggtaattatgcctctcaccgtagtttgagcgggtgtcctcgggcaaagaagtcggggattcggattgctcagagcaaagaggataaggaagatcaggaacctatacgttgtccagttcccggttgcgacggccaggggcacatcacaggaaagtatgctagtcatcgcagtgcctcgggctgcccgctggccgcaaagcgacaaaaagatgggtacctcaatggctcccagttctcttggaagagcgtcaaaaccgaaggtatgtcttgtcccactccaggatgcgacggctccgggcatgtctctggaagctttctgacacaccggagcttatcaggctgtccacgggctacctccgcgatgaagaaagcaaaactaagtggagagcaaatgcttaccattaagcagcgagccagcaacggcatagagaatgacgaagaaatcaaacagctcgacgaagaaatcaaagaactgaacgaaagcaatagccagatggaggctgatatgatcaagttaagaacccagattacaaccatggagtccaatctgaaaacaatcgaagaggagaataaagtcatcgagcagcagaatgagagtctcctgcacgagctggcaaatcttagtcagagcctcatccacagtctggccaatatccagctccctcacatggatcccataaatgaacagaacttcgatgcgtacgtgaccacgctaacagagatgtatacgaatcaagacaggtaccaaagcccggagaataaagccctgctcgagaatatcaagcaggccgtgagagggatccaagtctag

SEQ ID NO: 231390 - DNA, 552 bp, Artificial Sequence
  Description of Artificial Sequence: Synthetic coding sequence
atgagccagaaacctgctaaagagggcccacggctttcaaaaaaccagaagtactccgaacacttttcaatccactgttgtcctccctttacatttctcaattctaagaaagagatagtagacagaaaatactccatatgcaagtctgggtgtttctaccaaaagaaggaggaggactggatttgctgcgcctgccaaaagaccaggacctcccgcagggctaagagtccccaacgtcccaagcagcagcccgctgccccacccgcagtagtgcgggcaccggctaagcctcggtcccctcctcgaagcgaacggcagccacgctctccccctagatccgagagacagcctagatcgcctcctcgatctgaaagacagcctcggagtccaccaaggtccgaaaggcaacctcgcccaagacccgaggtcagaccacctcctgctaagcagcggccacctcagaagtcaaagcagcaaccacggagtagtccactgagaggccctggggcttcacgaggtggctcccctgttaaagcatccaggttttggtag

SEQ ID NO: 231391 - DNA, 246 bp, Artificial Sequence
  Description of Artificial Sequence: Synthetic coding sequence
atgagccaaaaacccgctaaggaaggcccacggctgtcgaagaaccagaaatattccgaacacttttctattcattgctgcccccctttcaccttcttaaactcgaagaaggaaatcgtagaccgcaaatactcgatctgtaaatcggggtgcttttaccagaaaaaggaggaggactggatatgttgtgcatgccagaagacgcgcctgaagaggaagattcggcctacaccgaaaaaaaagtag

SEQ ID NO: 231392 - DNA, 246 bp, Artificial Sequence
  Description of Artificial Sequence: Synthetic coding sequence
atgagtcaaaagccggctaaggaaggtccacgcttgtctaagaaccagaaatatagtgaacactttagcattcactgctgtccaccgtttacctttcttaattctaagaaagaaatagtagatcgtaaatattcgatatgcaaatcagggtgtttttaccagaaaaaggaagaggactggatctgttgtgcttgccagaagacgcgcctcaaaagaaaaataaggcccacgcctaaaaaaaagtag

SEQ ID NO: 231393 - DNA, 246 bp, Artificial Sequence
  Description of Artificial Sequence: Synthetic coding sequence
atgtcacaaaagcccgcaaaggaaggccctagacttagtaagaatcagaaatactcggagcacttcagcatccactgttgccctccattcacctttttgaattccaagaaagagattgttgatagaaaatacagtatctgcaaaagcggctgcttctaccagaagaaggaggaagactggatttgctgtgcctgccaaaagacacgtttaaaacgaaagattcgacctacccctaagaagaagtag

SEQ ID NO: 231394 - DNA, 552 bp, Artificial Sequence
  Description of Artificial Sequence: Synthetic coding sequence
atgtctcaaaaaccagccaaggaggggccaagattgagtaaaaaccagaaatactctgaacactttagcatccattgttgcccaccattcaccttcctaaactccaaaaaagagatcgttgatcggaagtattccatctgtaagtcaggctgtttttatcaaaaaaaggaagaggactggatctgctgcgcttgtcagaaaaccaggacgtctagacgcgctaaatccccgcagcgtcccaaacagcagcctgccgcaccaccagctgtggtccgcgctccagccaagccccgttctcctccccgttcagaacgccaacccaggtctccccctcgaagcgaaaggcaaccacggagcccaccccgttctgaaaggcagccacgttccccaccccgaagcgaaagacagcccaggccccgtcctgaggtgcgtcctcctcccgcaaaacagcgtccccctcaaaaatctaaacagcagcctcgttcctcaccgctccgcggtcccggtgcttcaaggggagggagtcccgttaaagcctctcgattttggtag

SEQ ID NO: 231395 - DNA, 552 bp, Artificial Sequence
  Description of Artificial Sequence: Synthetic coding sequence
atgtcacagaaaccggctaaggagggaccacgcctgtctaaaaaccaaaaatactccgagcacttctccattcactgctgccccccatttaccttccttaacagtaagaaagaaattgtagatcggaaatacagcatctgcaagtctggctgtttttatcagaaaaaagaggaggattggatttgttgtgcctgccagaagacaaggactagccgcagagccaaatcccctcagagacccaaacagcagccagccgctcccccagccgtggtgagggcccctgcaaagcctaggagcccccctcgtagcgagcgacaaccgcgaagccctccaaggtccgagcggcagccacggtcaccaccgcgatccgagcggcagcctcgttctccacctcggtctgagcgccagccaaggcctaggcctgaggtacgcccacctccagcgaagcagcgccctcctcaaaagagcaaacagcaacctcgttcatcccccctcagaggcccaggagcgagccgcggaggaagccccgtcaaagctagccggttctggtag

SEQ ID NO: 231396 - DNA, 246 bp, Artificial Sequence
  Description of Artificial Sequence: Synthetic coding sequence
atgtcccaaaagcctgcgaaagagggccctcgcctgtctaagaaccagaagtactcagaacacttttccattcattgctgtcctcctttcacctttttgaatagcaaaaaggagatagtggacagaaagtattctatctgcaaaagcggctgcttctaccaaaagaaggaagaagactggatctgctgtgcttgccagaaaacccgtcttaaaaggaagatacgtccgacacctaaaaagaagtag
